United States Patent 9,254,311 (MODIFIED POLYNUCLEOTIDES FOR THE PRODUCTION OF PROTEINS) - sequence listing, part 18

SEQ ID NO: 36991 - DNA, 423 bp, Artificial Sequence
  Description of Artificial Sequence: Synthetic coding sequence
atgctgagcaacctgcacgagctgctgcccaaccacctgatggagaccctgtacagcaggaagtctgaggaggacaagaagaagtgtgagaaccctgagctgagcggcctggagcgcatcctggcccggcaccagctgcccaaggagatcaacctgacccccaagcccaacaggatgccaccctggaagaggaagatcatcaacaacgtgacagatggctggaagaagtgccacctgctgaagaggaacaccaaggagccccccatgagcaccatcgtggtgaggaagctgatccagaagaatgtgccccggcggcacagcctgaggaacaccagcaggaagctgaggaacctgcccaccacagccaagggcacccagacaggcaagagccagtgcctgctgggcatcagcgagcccacctag

SEQ ID NO: 36992 - DNA, 1326 bp, Artificial Sequence
  Description of Artificial Sequence: Synthetic coding sequence
atggctgtggtgcctgccagcctgagcggccaggatgtgggcagctttgcctacctgaccatcaaggaccgcatcccccagatcctgaccaaggtgattgacaccctgcaccgccacaagtctgagttctttgagaagcatggagaggagggcgtggaggccgagaagaaggccatcagcctgctgagcaagctgagaaatgagctgcagacagacaagcccttcatccccctggtggagaagtttgtggacacagacatctggaaccagtacctggagtaccagcagagcctgctgaatgaaagtgatggcaagagccgctggttctacagcccctggctgctggtggagtgctacatgtaccgccgcatccacgaggccatcatccagagcccccccatcgactactttgatgtgttcaaggagagcaaggagcagaacttctacggcagccaggagagcatcatcgccctgtgcacccacctgcagcagctgatccgcaccatcgaggacctggatgagaaccagctgaaggatgagttcttcaagctgctgcagatcagcctgtggggcaacaagtgtgacctgagcctgtctggaggagagagcagcagccagaacaccaacgtgctgaacagcctggaggacctgaagcccttcatcctgctgaatgacatggagcacctgtggagcctgctgagcaactgcaagaagacccgggagaaggccagcgccaccagggtgtacatcgtgctggacaacagcggctttgagctggtgacagacctgatcctggccgacttcctgctgagcagcgagctggccacagaggtgcacttctacggcaagaccatcccctggtttgtgtctgacaccaccatccatgacttcaactggctgattgagcaggtgaagcacagcaaccacaagtggatgagcaaatgtggggctgactgggaggagtacatcaagatgggcaagtgggtgtaccacaaccacatcttctggaccctgccccatgagtactgtgccatgccccaggtggccccagacctgtatgcagagctgcagaaggcccacctgatcctcttcaagggggacctgaactacaggaagctgaccggggacaggaagtgggagttctctgtgcccttccaccaggccctgaatggcttccacccagcccccctgtgcaccatccgcaccctgaaggccgagatccaggtgggcctgcagcccggccagggcgagcagctgctggccagcgagcccagctggtggaccaccgggaagtatggcatcttccagtatgatggccccctgtag

SEQ ID NO: 36993 - DNA, 969 bp, Artificial Sequence
  Description of Artificial Sequence: Synthetic coding sequence
atgtaccgccgcatccacgaggccatcatccagagcccccccatcgactactttgatgtgttcaaggagagcaaggagcagaacttctacggcagccaggagagcatcatcgccctgtgcacccacctgcagcagctgatccgcaccatcgaggacctggatgagaaccagctgaaggatgagttcttcaagctgctgcagatcagcctgtggggcaacaagtgtgacctgagcctgagcggcggggagagcagcagccagaacaccaacgtgctgaacagcctggaggacctgaagcccttcatcctgctgaatgacatggagcacctgtggagcctgctgagcaactgcaagaagacccgggagaaggccagcgccaccagggtgtacatcgtgctggacaacagcggctttgagctggtgacagacctgatcctggccgacttcctgctgagcagcgagctggccacagaggtgcacttctacggcaagaccatcccctggtttgtgtctgacaccaccatccatgacttcaactggctgattgagcaggtgaagcacagcaaccacaagtggatgagcaaatgtggggctgactgggaggagtacatcaagatgggcaagtgggtgtaccacaaccacatcttctggaccctgccccatgagtactgtgccatgccccaggtggccccagacctgtatgcagagctgcagaaggcccacctgatcctcttcaagggggacctgaactacaggaagctgactggagacaggaagtgggagttctctgtgcccttccaccaggccctgaatggcttccacccagcccccctgtgcaccatccgcaccctgaaggccgagatccaggtgggcctgcagcccggccagggcgagcagctgctggccagcgagcccagctggtggaccaccgggaagtatggcatcttccagtatgatggccccctgtag

SEQ ID NO: 36994 - DNA, 1959 bp, Artificial Sequence
  Description of Artificial Sequence: Synthetic coding sequence
atggagaacccccgctgcccccggcggcccctggccgagaagaaggcccggagcctggaccggccccaggcccctggaaaaggaagtgagagctgggactgccactggctgagcctgcccacagcccccagcaggaaggccctgcactggaccaccagtgactgggcccggcacagcgacagccctgcccccagcgctgaggcccactgcaccacagctgctgcccccaccccagaggagactggagacttcctgcccagcgagcagaggcccagccaggacaccaagaagggctggctgaagaccatgctgaacttctttgtgaggacaggccctgaggagccccgggagaaggccagcagaagaccccggggcaaggagggcatcagccagcaccctgagcccctggaggccgccggggagcccgccctgaggaagaaggcccaccacgacaagaagcccagcaggaagaagcagggccacaagaagcatgctgctgaggtgaccaaggccgcccaggaccaggaggcccggggccgggaggagggcctgagcaaggctgctgctgccctgcggtctggagaggccgacctgggccctgcccggcggggcggggaggacagcgaccaccagagcttcctgatcaaggtggatggcaccggggccctggatgtgagcccccacgccaccggccaccagcaggaggaggagctgaagaagccagaccaggatgccatcatccagatgattgtggagctgctgaagagggtgggggaccagtgggaggaggagcagagcctggccagccagctgggcgtggccctgcccaacccagccccagctgtgaggaagaagagccaggagaagaagaccagcctgaagaggaccagcaagaccaaccccaagaagcacggcagcgaggaggccaagagaggagctgctgatgtgagcagccctgaggcctggccacccaagaagagcagcttcctgcccctgtgtgtgtctggccaccggcccagcatcagcagcagctatggcctggaggagcccaaggtgcaggaggcccccagcacagaggccggggcccctggccccagcgtgctgcccacccccagcgagagccaggagcctggagaggagctgcccctggaccgggccagcgagtacaaggagttcatccagaagatcatctccatgctgcaggatgctgaggagcagcagggcgaggagcagccccaggtgcagcaggaggaggtgggcgtggagaacccagccccccactgcaggaggaagagccaggagaagaggagcagcttccggcgggccttctaccacaagaagcacaccagcaaggagccccggcgggccggggctgctggagctgccagccctgaggcccggcggcccaagaggcccagcttcctgcccctgtgtgtgggcggccaccggcccagcaccagcagcagcctggaccctgaggacctggagtgccgggagcccctgcctgctgagggggagcctgtggtgatcagcgaggcccccagccaggcccggggccacaccccagagggcgccccccagctgagcggggcctgtgagagcaaggagatcatcatccagaagctggtggccctgctgcaggaggtggatggccagctgggccagcagatccgccgccaccccagcttcaagcgcttcttctatgagttcagtgacagcagcctgagcaagctggtggccaccctgcggagccaggtggcccacagcagcaagctggacaggaacagagcccggcggctgtaccagtttgatgtgtccctggccaacaagtttgctggcagcaacagccacgccatgtgcatcctgatgggcctgcgggaccactacaactgcacccagttcccctaccgggaggaccagcccaacatcaccagccccaaggtggagagcccagactag

SEQ ID NO: 36995 - DNA, 729 bp, Artificial Sequence
  Description of Artificial Sequence: Synthetic coding sequence
atgatgcccctggccgaggccggggccctggcccagggcggcggccccagcgccacagagtgggcctgcatcctgcggaggaagacccccaggcacaagcagcccaccctgctgatggtgcgggccagccgccgcagcggcaagaccagcgctgtgctgaaggccggccggcagagcgtgtctggcaggaagaacagcaccagcaaggacctggtgaccctgggcgccagcagcctgcgggaggagcggggccaccccctgcaccccaggcacaggaaggctgtgcacctgcggacccggggccgcacccggggctgggtgcagaccctggccaggatgagcaggaggacccggggccctgtggagagagctgctgctgctgctgctgctgctgctggaggagatgctggccacgcccccttccccccacctcctgctgctgatggagcccgggcccccaggagccctggccaggtgaccccccggggcctgcggctgcggctgccccggcgggagagcctgctgcggggcctgtgccggcccctgcggcccctgctgggcttccgggagagtgacagcgccaagccagccagcctgcggctgctgcagcacaccccatctgcccggaggaactacagaattgctggggcccggctgatgaggagcaactaccccccacccctgagcagcgctgccctgcggggggccggccccaccaggagaaattag

SEQ ID NO: 36996 - DNA, 318 bp, Artificial Sequence
  Description of Artificial Sequence: Synthetic coding sequence
atgatgcccctggccgaggccggggccctggcccagggcggcggccccagcgccacagagtgggcctgcatcctgcggcggctgctgaggaaggagggcgtggatggcggcctcttcagccctgaggacccccaggcccaggccgcccacctgacagatggccagagcatccagaagaagtggcaggacttcagctgcccccagagcaggaagacagagtgcttctggcagaaggagcagcacaagcagaggagcggcaacccccgctgcctgcagtttgaaggaggagagaggaccccacctccaccccagacctag

SEQ ID NO: 36997 - DNA, 243 bp, Artificial Sequence
  Description of Artificial Sequence: Synthetic coding sequence
atgcccttccagtttggcacccagccccggcgcttccctgtggagggcggggacagcagcattgagctggagcccggcctgagcagcagcgctgcctgcaatggcaaggagatgagccccacccggcagctgcggcgctgccccggcagccactgcctgaccatcacagatgtgcctgtgacagtgtatgccaccaccaggaagcccccagcccagagcagcaaggagatgcaccccaagtag

SEQ ID NO: 36998 - DNA, 306 bp, Artificial Sequence
  Description of Artificial Sequence: Synthetic coding sequence
atggagcggcccaggagcccccagtgcagcgccccagccagcgccagcgcctctgtgaccctggcccagctgctgcagctggtgcagcagggccaggagctgcccggcctggagaagaggcacatcgccgccatccacggggagcccacagccagccggctgccccggcggcccaagccctgggaggccgccgccctggccgagagcctgcccccacccaccctgagaattggaacagccccagctgagcccggcctggtggaggccgccacagcccccagctcctggcacacagtgggcccctag

SEQ ID NO: 36999 - DNA, 276 bp, Artificial Sequence
  Description of Artificial Sequence: Synthetic coding sequence
atgtggcacagcgtgggcctgaccctgctggtgtttgtggccaccctgctgattgtgctgctgctgatggtgtgtggctggtactttgtgtggcacctgttcctgagcaagttcaagttcctgcgggagctggtgggggacaccggcagccaggagggggaccacgagcccagcggcagcgagacagaggaggacaccagcagcagcccccaccgcatccgcagcgcccggcagaggcgggccccagcagatgagggccaccggcccctgacctag

SEQ ID NO: 37000 - DNA, 582 bp, Artificial Sequence
  Description of Artificial Sequence: Synthetic coding sequence
atggctgtgttcctgcagctgctgcccctgctgctgagccgggcccagggcaaccctggggccagcctggatggccggcctggggacagagtgaacctgagctgtggcggcgtgagccaccccatccgctgggtgtgggcccccagcttccctgcctgcaagggcctgagcaagggccggcggcccatcctgtgggccagcagcagcggcacccccaccgtgccccccctgcagccctttgtgggccgcctgcggagcctggacagcggcatccggcggctggagctgctgctgtctgctggggacagcggcaccttcttctgcaagggcagacatgaagatgagagcaggacagtgctgcacgtgctgggggacaggacctactgcaaggcccctggccccacccacgccctgagccccccccacagcagcacctgtgaaaatagagcccctgaggccagcaaaggaggccgggcccaggacagccggggccctggccctggaacagagcccgccctgtgtggcagcggccccagcagcccccagcaggcccctcctgctgtgcacagcggcccctgctag

SEQ ID NO: 37001 - DNA, 594 bp, Artificial Sequence
  Description of Artificial Sequence: Synthetic coding sequence
atggctgtgttcctgcagctgctgcccctgctgctgagccgggcccagggcaaccctggggccagcctggatggccggcctggggacagagtgaacctgagctgtggcggcgtgagccaccccatccgctgggtgtgggcccccagcttccctgcctgcaagggcctgagcaagggccggcggcccatcctgtgggccagcagcagcggcacccccaccgtgccccccctgcagccctttgtgggccgcctgcggagcctggacagcggcatccggcggctggagctgctgctgtctgctggggacagcggcaccttcttctgcaagggcagacatgaagatgagagcaggacagtgctgcacgtgctgggggacaggacctactgcaaggcccctggccccacccacgcccccctggtgaagacagagccccagaggcctgtgaaggaggaggagcccaagatccctggggacctggaccaggagcccagcctgctgtatgctgacctggaccacctggccctgagccggccccggcggctgagcacagctgaccctgcagatgccagcaccatctatgctgtggtggtgtag

SEQ ID NO: 37002 - DNA, 714 bp, Artificial Sequence
  Description of Artificial Sequence: Synthetic coding sequence
atggctgtgttcctgcagctgctgcccctgctgctgagccgggcccagggcaaccctggggccagcctggatggccggcctggggacagagtgaacctgagctgtggcggcgtgagccaccccatccgctgggtgtgggcccccagcttccctgcctgcaagggcctgagcaagggccggcggcccatcctgtgggccagcagcagcggcacccccaccgtgccccccctgcagccctttgtgggccgcctgcggagcctggacagcggcatccggcggctggagctgctgctgtctgctggggacagcggcaccttcttctgcaagggcagacatgaagatgagagcaggacagtgctgcacgtgctgggggacaggacctactgcaaggcccctggccccacccacggctctgtgtacccccagctgctgatccccctgctgggcgccggcctggtgctgggcctgggcgccctgggcctggtgtggtggctgcaccggcggctgcccccccagcccatcggccccctgcccaggtttgccctgagccccccccacagcagcacctgtgaaaatagagcccctgaggccagcaaaggaggccgggcccaggacagccggggccctggccctggaacagagcccgccctgtgtggcagcggccccagcagcccccagcaggcccctcctgctgtgcacagcggcccctgctag

SEQ ID NO: 37003 - DNA, 726 bp, Artificial Sequence
  Description of Artificial Sequence: Synthetic coding sequence
atggctgtgttcctgcagctgctgcccctgctgctgagccgggcccagggcaaccctggggccagcctggatggccggcctggggacagagtgaacctgagctgtggcggcgtgagccaccccatccgctgggtgtgggcccccagcttccctgcctgcaagggcctgagcaagggccggcggcccatcctgtgggccagcagcagcggcacccccaccgtgccccccctgcagccctttgtgggccgcctgcggagcctggacagcggcatccggcggctggagctgctgctgtctgctggggacagcggcaccttcttctgcaagggcagacatgaagatgagagcaggacagtgctgcacgtgctgggggacaggacctactgcaaggcccctggccccacccacggctctgtgtacccccagctgctgatccccctgctgggcgccggcctggtgctgggcctgggcgccctgggcctggtgtggtggctgcaccggcggctgcccccccagcccatcggccccctgcccaggtttgcccccctggtgaagacagagccccagaggcctgtgaaggaggaggagcccaagatccctggggacctggaccaggagcccagcctgctgtatgctgacctggaccacctggccctgagccggccccggcggctgagcacagctgaccctgcagatgccagcaccatctatgctgtggtggtgtag

SEQ ID NO: 37004 - DNA, 654 bp, Artificial Sequence
  Description of Artificial Sequence: Synthetic coding sequence
atggctgtgttcctgcagctgctgcccctgctgctgagccgggcccagggcaaccctggggccagcctggatggccggcctggggacagagtgaacctgagctgtggcggcgtgagccaccccatccgctgggtgtgggcccccagcttccctgcctgcaagggcctgagcaagggccggcggcccatcctgtgggccagcagcagcggcacccccaccgtgccccccctgcagccctttgtgggccgcctgcggagcctggacagcggcatccggcggctggagctgctgctgtctgctggggacagcggcaccttcttctgcaagggcagacatgaagatgagagcaggacagtgctgcacgtgctgggggacaggacctactgcaaggcccctggccccacccacggggcctgccccaggaaccggctggaccacagcctggacctgctgtgccccccccacatcgcccccctggtgaagacagagccccagaggcctgtgaaggaggaggagcccaagatccctggggacctggaccaggagcccagcctgctgtatgctgacctggaccacctggccctgagccggccccggcggctgagcacagctgaccctgcagatgccagcaccatctatgctgtggtggtgtag

SEQ ID NO: 37005 - DNA, 885 bp, Artificial Sequence
  Description of Artificial Sequence: Synthetic coding sequence
atgttcctgcggcggctgggcggctggctgccccggccctggggccgcaggaagcccatgaggccagaccccccctacccagagccccggcgggtggacagcagcagtgaaaattctggcagtgactgggacagcgcccctgagaccatggaggatgtgggccaccccaagaccaaggacagcggggccctgcgggtgtccagagctgccagcgagcccagcaaggaggagccccaggtggagcagctgggcagcaagaggatggacagcctgaagtgggaccagcccatcagcagcacccaggagagcggccgcctggaggccggcggggccagccccaagctgcgctgggaccacgtggacagcggcggcacccggcggcctggggtgtccccagagggcggcctgtctgtgcccggccctggggcccccctggagaagccaggccggcgggagaagctgctgggctggctgcggggggagcccggggcccccagccgctacctgggcggccctgaggagtgcctgcagatcagcaccaacctgaccctgcacctgctggagctgctggccagcgccctgctggccctgtgcagccggcccctgcgggccgccctggacaccctgggcctgcggggccccctgggcctgtggctgcacggcctgctgtccttcctggccgccctgcacggcctgcatgctgtgctgagcctgctgacagcccaccccctgcactttgcctgcctgtttggcctgctgcaggccctggtgctggccgtgtccctgcgggagcccaatggagatgaggccgccacagactgggagagcgagggcctggagcgggagggggaggagcagagaggagaccccgggaagggcctgtag

SEQ ID NO: 37006 - DNA, 885 bp, Artificial Sequence; identical to SEQ ID NO: 37005
  Description of Artificial Sequence: Synthetic coding sequence

SEQ ID NO: 37007 - DNA, 885 bp, Artificial Sequence
  Description of Artificial Sequence: Synthetic coding sequence
atgttcctgcggcggctgggcggctggctgccccggccctggggccgcaggaagcccatgaggccagaccccccctacccagagccccggcgggtggacagcagcagtgaaaattctggcagtgactgggacagcgcccctgagaccatggaggatgtgggccaccccaagaccaaggacagcggggccctgcgggtgtctggagctgccagcgagcccagcaaggaggagccccaggtggagcagctgggcagcaagaggatggacagcctgaagtgggaccagcccatcagcagcacccaggagagcggccgcctggaggccggcggggccagccccaagctgcgctgggaccacgtggacagcggcggcacccggcggcctggggtgtccccagagggcggcctgtctgtgcccggccctggggcccccctggagaagccaggccggcgggagaagctgctgggctggctgcggggggagcccggggcccccagccgctacctgggcggccctgaggagtgcctgcagatcagcaccaacctgaccctgcacctgctggagctgctggccagcgccctgctggccctgtgcagccggcccctgcgggccgccctggacaccctgggcctgcggggccccctgggcctgtggctgcacggcctgctgtccttcctggccgccctgcacggcctgcatgctgtgctgagcctgctgacagcccaccccctgcactttgcctgcctgtttggcctgctgcaggccctggtgctggccgtgtccctgcgggagcccaatggagatgaggccgccacagactgggagagcgagggcctggagcgggagggggaggagcagagaggagaccccgggaagggcctgtag

SEQ ID NO: 37008 - DNA, 885 bp, Artificial Sequence; identical to SEQ ID NO: 37005
  Description of Artificial Sequence: Synthetic coding sequence

SEQ ID NO: 37009 - DNA, 885 bp, Artificial Sequence; identical to SEQ ID NO: 37005
  Description of Artificial Sequence: Synthetic coding sequence

SEQ ID NO: 37010 - DNA, 885 bp, Artificial Sequence; identical to SEQ ID NO: 37005
  Description of Artificial Sequence: Synthetic coding sequence

SEQ ID NO: 37011 - DNA, 885 bp, Artificial Sequence; identical to SEQ ID NO: 37007
  Description of Artificial Sequence: Synthetic coding sequence

SEQ ID NO: 37012 - DNA, 936 bp, Artificial Sequence
  Description of Artificial Sequence: Synthetic coding sequence
atgttcctgcggcggctgggcggctggctgccccggccctggggccgcaggaagcccatgaggccagaccccccctacccagagccccggcgggtggacagcagcagtgaaaattctggcagtgactgggacagcgcccctgagaccatggaggatgtgggccaccccaagaccaaggacagcggggccctgcgggtgtctggagctgccagcgagcccagcaaggaggagccccaggtggagcagctgggcagcaagaggatggacagcctgaagtgggaccagcccatcagcagcacccaggagagcggccgcctggaggccggcggggccagccccaagctgcgctgggaccacgtggacagcggcggcacccggcggcctggggtgtccccagagggcggcctgtctgtgcccggccctggggcccccctggagaagccaggccggcgggagaagctgctgggctggctgcggggggagcccggggcccccagccgctacctgggcggccctgaggagtgcctgcagatcagcaccaacctgaccctgcacctgctggagctgctggccagcgccctgctggccctgtgcagccggcccctgcgggccgccctggacaccctgggcctgcggggccccctgggcctgtggctgcacggcctgctgtccttcctggccgccctgcacggcctgcatgctgtgctgagcctgctgacagcccaccccctgcactttgcctgcctgtttggcctgctgcaggccctggtgctggccgtgtctggcagccccatgggcatgaggcggcccctgaccggccgggtgcggggctggaggggcaaggtgcgcagcagaggagagacccgggagcggggctgtgaccggggcgtgggcgccaagggggaggagagcgtgggcttccggaggaaggtgtag

SEQ ID NO: 37013 - DNA, 228 bp, Artificial Sequence
  Description of Artificial Sequence: Synthetic coding sequence
atggagaggagctttgtgtggctgagctgcctggacagcgacagctgcaacctgaccttccggctgggggaggtggagagccacgcctgcagccccagcctgctgtggaacctgctgacccagtacctgcccccaggagctggccacatcctgcggacctacaacttccctgtgctgagctgtgtgagcagctgccacctgattggaggcaagatgcctgagaactag

SEQ ID NO: 37014 - DNA, 228 bp, Artificial Sequence; identical to SEQ ID NO: 37013
  Description of Artificial Sequence: Synthetic coding sequence

SEQ ID NO: 37015 - DNA, 378 bp, Artificial Sequence
  Description of Artificial Sequence: Synthetic coding sequence
atgagggtggtgatggcccggctgctgtctgagggggagcagggcatccccacagcctgtgccgcctttgcccagcagcctgctggcccccggcggggcctggccggcgtgggggagggcggcccccagtgctcctgggtgaactaccgctgcaccctggagttcctggtgtccctgctgggcacagacctggcccggggccggggcaacagcgccagcggccccacagccccagctgacagcaagcagctgatgaacagcggcagccctgcccgggacaatgcccccagccagcgcttctgcaccaacctgtctgagggcctgcgcttcggcatcagccccagctggagggaggccctgtatggctgccacgcctag

SEQ ID NO: 37016 - DNA, 228 bp, Artificial Sequence; identical to SEQ ID NO: 37013
  Description of Artificial Sequence: Synthetic coding sequence

SEQ ID NO: 37017 - DNA, 228 bp, Artificial Sequence; identical to SEQ ID NO: 37013
  Description of Artificial Sequence: Synthetic coding sequence

SEQ ID NO: 37018 - DNA, 228 bp, Artificial Sequence; identical to SEQ ID NO: 37013
  Description of Artificial Sequence: Synthetic coding sequence

SEQ ID NO: 37019 - DNA, 228 bp, Artificial Sequence; identical to SEQ ID NO: 37013
  Description of Artificial Sequence: Synthetic coding sequence

SEQ ID NO: 37020 - DNA, 228 bp, Artificial Sequence; identical to SEQ ID NO: 37013
  Description of Artificial Sequence: Synthetic coding sequence

SEQ ID NO: 37021 - DNA, 228 bp, Artificial Sequence; identical to SEQ ID NO: 37013
  Description of Artificial Sequence: Synthetic coding sequence

SEQ ID NO: 37022 - DNA, 228 bp, Artificial Sequence; identical to SEQ ID NO: 37013
  Description of Artificial Sequence: Synthetic coding sequence

SEQ ID NO: 37023 - DNA, 228 bp, Artificial Sequence; identical to SEQ ID NO: 37013
  Description of Artificial Sequence: Synthetic coding sequence

SEQ ID NO: 37024 - DNA, 228 bp, Artificial Sequence; identical to SEQ ID NO: 37013
  Description of Artificial Sequence: Synthetic coding sequence

SEQ ID NO: 37025 - DNA, 228 bp, Artificial Sequence; identical to SEQ ID NO: 37013
  Description of Artificial Sequence: Synthetic coding sequence

SEQ ID NO: 37026 - DNA, 228 bp, Artificial Sequence; identical to SEQ ID NO: 37013
  Description of Artificial Sequence: Synthetic coding sequence

SEQ ID NO: 37027 - DNA, 228 bp, Artificial Sequence; identical to SEQ ID NO: 37013
  Description of Artificial Sequence: Synthetic coding sequence

SEQ ID NO: 37028 - DNA, 228 bp, Artificial Sequence; identical to SEQ ID NO: 37013
  Description of Artificial Sequence: Synthetic coding sequence

SEQ ID NO: 37029 - DNA, 228 bp, Artificial Sequence; identical to SEQ ID NO: 37013
  Description of Artificial Sequence: Synthetic coding sequence

SEQ ID NO: 37030 - DNA, 228 bp, Artificial Sequence; identical to SEQ ID NO: 37013
  Description of Artificial Sequence: Synthetic coding sequence

SEQ ID NO: 37031 - DNA, 228 bp, Artificial Sequence; identical to SEQ ID NO: 37013
  Description of Artificial Sequence: Synthetic coding sequence

SEQ ID NO: 37032 - DNA, 228 bp, Artificial Sequence; identical to SEQ ID NO: 37013
  Description of Artificial Sequence: Synthetic coding sequence

SEQ ID NO: 37033 - DNA, 228 bp, Artificial Sequence; identical to SEQ ID NO: 37013
  Description of Artificial Sequence: Synthetic coding sequence

SEQ ID NO: 37034 - DNA, 228 bp, Artificial Sequence; identical to SEQ ID NO: 37013
  Description of Artificial Sequence: Synthetic coding sequence

SEQ ID NO: 37035 - DNA, 228 bp, Artificial Sequence; identical to SEQ ID NO: 37013
  Description of Artificial Sequence: Synthetic coding sequence

SEQ ID NO: 37036 - DNA, 228 bp, Artificial Sequence; identical to SEQ ID NO: 37013
  Description of Artificial Sequence: Synthetic coding sequence

SEQ ID NO: 37037 - DNA, 228 bp, Artificial Sequence; identical to SEQ ID NO: 37013
  Description of Artificial Sequence: Synthetic coding sequence

SEQ ID NO: 37038 - DNA, 228 bp, Artificial Sequence; identical to SEQ ID NO: 37013
  Description of Artificial Sequence: Synthetic coding sequence

SEQ ID NO: 37039 - DNA, 228 bp, Artificial Sequence; identical to SEQ ID NO: 37013
  Description of Artificial Sequence: Synthetic coding sequence

SEQ ID NO: 37040 - DNA, 228 bp, Artificial Sequence; identical to SEQ ID NO: 37013
  Description of Artificial Sequence: Synthetic coding sequence

SEQ ID NO: 37041 - DNA, 228 bp, Artificial Sequence; identical to SEQ ID NO: 37013
  Description of Artificial Sequence: Synthetic coding sequence

SEQ ID NO: 37042 - DNA, 228 bp, Artificial Sequence; identical to SEQ ID NO: 37013
  Description of Artificial Sequence: Synthetic coding sequence

SEQ ID NO: 37043 - DNA, 228 bp, Artificial Sequence; identical to SEQ ID NO: 37013
  Description of Artificial Sequence: Synthetic coding sequence

SEQ ID NO: 37044 - DNA, 228 bp, Artificial Sequence; identical to SEQ ID NO: 37013
  Description of Artificial Sequence: Synthetic coding sequence

SEQ ID NO: 37045 - DNA, 228 bp, Artificial Sequence; identical to SEQ ID NO: 37013
  Description of Artificial Sequence: Synthetic coding sequence

SEQ ID NO: 37046 - DNA, 228 bp, Artificial Sequence; identical to SEQ ID NO: 37013
  Description of Artificial Sequence: Synthetic coding sequence

SEQ ID NO: 37047 - DNA, 228 bp, Artificial Sequence; identical to SEQ ID NO: 37013
  Description of Artificial Sequence: Synthetic coding sequence

SEQ ID NO: 37048 - DNA, 228 bp, Artificial Sequence; identical to SEQ ID NO: 37013
  Description of Artificial Sequence: Synthetic coding sequence

SEQ ID NO: 37049 - DNA, 228 bp, Artificial Sequence; identical to SEQ ID NO: 37013
  Description of Artificial Sequence: Synthetic coding sequence

SEQ ID NO: 37050 - DNA, 228 bp, Artificial Sequence; identical to SEQ ID NO: 37013
  Description of Artificial Sequence: Synthetic coding sequence

SEQ ID NO: 37051 - DNA, 228 bp, Artificial Sequence; identical to SEQ ID NO: 37013
  Description of Artificial Sequence: Synthetic coding sequence

SEQ ID NO: 37052 - DNA, 228 bp, Artificial Sequence; identical to SEQ ID NO: 37013
  Description of Artificial Sequence: Synthetic coding sequence

SEQ ID NO: 37053 - DNA, 228 bp, Artificial Sequence; identical to SEQ ID NO: 37013
  Description of Artificial Sequence: Synthetic coding sequence

SEQ ID NO: 37054 - DNA, 228 bp, Artificial Sequence; identical to SEQ ID NO: 37013
  Description of Artificial Sequence: Synthetic coding sequence

SEQ ID NO: 37055 - DNA, 228 bp, Artificial Sequence; identical to SEQ ID NO: 37013
  Description of Artificial Sequence: Synthetic coding sequence

SEQ ID NO: 37056 - DNA, 228 bp, Artificial Sequence; identical to SEQ ID NO: 37013
  Description of Artificial Sequence: Synthetic coding sequence

SEQ ID NO: 37057 - DNA, 228 bp, Artificial Sequence; identical to SEQ ID NO: 37013
  Description of Artificial Sequence: Synthetic coding sequence

SEQ ID NO: 37058 - DNA, 228 bp, Artificial Sequence; identical to SEQ ID NO: 37013
  Description of Artificial Sequence: Synthetic coding sequence

SEQ ID NO: 37059 - DNA, 297 bp, Artificial Sequence
  Description of Artificial Sequence: Synthetic coding sequence
atgagggtggtgatggcccggctgctgtctgagggggagcagggcatccccacagcctgtgccgcctttgcccagcagcctgctggcccccggcggggcctggccggcgtgggggagggcggcccccagtgctcctgggtgaactaccgctgcaccctggagttcctggtgtccctgctgggcacagacctggcccggggccggggcaacagcgccagcggccccacagccccagctgacagcaagcagctgagctgcaagaccttcatcgctgtgctgagcctgagcaaggagtag

SEQ ID NO: 37060 - DNA, 378 bp, Artificial Sequence; identical to SEQ ID NO: 37015
  Description of Artificial Sequence: Synthetic coding sequence

SEQ ID NO: 37061 - DNA, 297 bp, Artificial Sequence; identical to SEQ ID NO: 37059
  Description of Artificial Sequence: Synthetic coding sequence

SEQ ID NO: 37062 - DNA, 378 bp, Artificial Sequence; identical to SEQ ID NO: 37015
  Description of Artificial Sequence: Synthetic coding sequence

SEQ ID NO: 37063 - DNA, 297 bp, Artificial Sequence; identical to SEQ ID NO: 37059
  Description of Artificial Sequence: Synthetic coding sequence

SEQ ID NO: 37064 - DNA, 297 bp, Artificial Sequence; identical to SEQ ID NO: 37059
  Description of Artificial Sequence: Synthetic coding sequence

SEQ ID NO: 37065 - DNA, 378 bp, Artificial Sequence; identical to SEQ ID NO: 37015
  Description of Artificial Sequence: Synthetic coding sequence

SEQ ID NO: 37066 - DNA, 378 bp, Artificial Sequence; identical to SEQ ID NO: 37015
  Description of Artificial Sequence: Synthetic coding sequence

SEQ ID NO: 37067 - DNA, 297 bp, Artificial Sequence; identical to SEQ ID NO: 37059
  Description of Artificial Sequence: Synthetic coding sequence

SEQ ID NO: 37068 - DNA, 459 bp, Artificial Sequence
  Description of Artificial Sequence: Synthetic coding sequence
atggcccagcctgagagcagcgctgactttggcatcgcccagcagaacaactactactgctactggcagagcctgcccagcgccatccgggtgaagcaggagttccagcccagccagagctaccgctatggcaactggtacgcccggcagcacggcagctacctgctgagcggctacagctatggctgtgctgtggatggaaatggcaaggactgcttcagcgcccacgagaccccagagcacacagctggcaccctggtgatgcccaaggagaccacccccctggccgagaaccaggatgaggaccccctggaggacccccacctgcacctgaacatcgaggagagcaaccaggagttcatggtgaagtctgaggagctgtatgacagcctgatgaactgccactggcagcccctggacacagtgcacagcgagatcccagatgagacccccaagtag

SEQ ID NO: 37069 - DNA, 198 bp, Artificial Sequence
  Description of Artificial Sequence: Synthetic coding sequence
atgcccaaggagaccacccccctggccgagaaccaggatgaggaccccctggaggacccccacctgcacctgaacatcgaggagagcaaccaggagttcatggtgaagtctgaggagctgtatgacagcctgatgaactgccactggcagcccctggacacagtgcacagcgagatcccagatgagacccccaagtag

SEQ ID NO: 37070 - DNA, 603 bp, Artificial Sequence
  Description of Artificial Sequence: Synthetic coding sequence
atgtctgagaacctgagtgaccctgtgtcccctgtggtgaggaagaagaagagcgccctgtttgaggtgtctgaggtgattcctgtgatgaccaacaactatgaggagaacatcctgaagggcgtgcgggacagcagctacagcctggagagcagcctggagctgctgcagaaggatgtggtgcagctgcacgccccccgctaccagagcatgagaagagatgtgattggctgcacccaggagatggacttcatcctgtggcccagaaatgacatcgagaagatcgtgtgcctgctcttcagccgctggaaggagagtgatgagcccttccggcctgtgcaggccaagtttgagttccaccacggggactatgagaagcagttcctgcacgtgctgagcaggaaggacaagacaggcatcgtggtgaacaaccccaaccagagcgtcttcctgttcatcgaccggcagcacctgcagacccccaagaacaaggccaccatcttcaagctgtgcagcatctgcctgtacctgccccaggagcagctgacccactgggccgtgggcaccatcgaggaccacctgcggccctacatgcctgagtag

SEQ ID NO: 37071 - DNA, 690 bp, Artificial Sequence
  Description of Artificial Sequence: Synthetic coding sequence
atgggagaccccaacagcaggaagaagcaggccctgaaccggctgcgggcccagctgaggaagaagaaggagagcctggccgaccagtttgacttcaagatgtacatcgcctttgtgttcaaggagaagaagaagaagagcgccctgtttgaggtgtctgaggtgattcctgtgatgaccaacaactatgaggagaacatcctgaagggcgtgcgggacagcagctacagcctggagagcagcctggagctgctgcagaaggatgtggtgcagctgcacgccccccgctaccagagcatgagaagagatgtgattggctgcacccaggagatggacttcatcctgtggcccagaaatgacatcgagaagatcgtgtgcctgctcttcagccgctggaaggagagtgatgagcccttccggcctgtgcaggccaagtttgagttccaccacggggactatgagaagcagttcctgcacgtgctgagcaggaaggacaagacaggaattgtggtgaacaaccccaaccagagcgtcttcctgttcatcgaccggcagcacctgcagacccccaagaacaaggccaccatcttcaagctgtgcagcatctgcctgtacctgccccaggagcagctgacccactgggccgtgggcaccatcgaggaccacctgcggccctacatgcctgagtag

SEQ ID NO: 37072 - DNA, 516 bp, Artificial Sequence
  Description of Artificial Sequence: Synthetic coding sequence
atgaccaacaactatgaggagaacatcctgaagggcgtgcgggacagcagctacagcctggagagcagcctggagctgctgcagaaggatgtggtgcagctgcacgccccccgctaccagagcatgagaagagatgtgattggctgcacccaggagatggacttcatcctgtggcccagaaatgacatcgagaagatcgtgtgcctgctcttcagccgctggaaggagagtgatgagcccttccggcctgtgcaggccaagtttgagttccaccacggggactatgagaagcagttcctgcacgtgctgagcaggaaggacaagacaggaattgtggtgaacaaccccaaccagagcgtcttcctgttcatcgaccggcagcacctgcagacccccaagaacaaggccaccatcttcaagctgtgcagcatctgcctgtacctgccccaggagcagctgacccactgggccgtgggcaccatcgaggaccacctgcggccctacatgcctgagtag

SEQ ID NO: 37073 - DNA, 669 bp, Artificial Sequence
  Description of Artificial Sequence: Synthetic coding sequence
atggccggggctgagcccttcctggctgatggcaaccaggagctgttcccctgtgaggtgtgtggcagaagatttgctgctgatgtgctggagagacatggccccatctgcaagaagctgttcaacaggaagaggaagcccttcagcagcctgaagcagaggctgcagggcacagacatccccaccgtgaagaagaccccccagagcaagagcccccctgtgaggaagagcaactggaggcagcagcacgaggacttcatcaatgccatccgcagcgccaagcagtgcatgctggccatcaaggagggccggcccctgcccccacctcctccacccagcctgaacccagactacatccagaggccctactgcatgaggcgcttcaatgaatctgctgctgagcggcacaccaacttctgcaaggaccagagcagccggcgggtcttcaacccagcccagacagctgccaagctggccagccgggcccagggccgggcccagatgggccccaagaaggagcccaccgtgaccagcgctgtgggcgccctgctgcagaacagagtgctggtggccaccaatgaggtgcccaccaagagcggcctggccatggaccctgccagcggggccaagctgcggcagggcttcagcaagagcagcaagaaggactag

SEQ ID NO: 37074 - DNA, 465 bp, Artificial Sequence
  Description of Artificial Sequence: Synthetic coding sequence
tgaggaaaccaggagctgttcccctgtgaggtgtgtggccgccgctttgctgctgatgtgctggagcggcacggccccatctgcaagaagctgttcaacaggaagaggaagcccttcagcagcctgaagcagaggctgcagggcacagacatccccaccgtgaagaagaccccccagagcaagagcccccctgtgaggaagagcaactggaggcagcagcacgaggacttcatcaatgccatccgcagcgccaagcagtgcatgctggccatcaaggagggccggcccctgcccccacctcctccacccagcctgaacccagactacatccagaggccctactgcatgaggcgcttcaatgaatctgctgctgagcggcacaccaacttctgcaaggaccagagcagcagaagagtcttcaacccagcccagacagctgccaagctggccagccgggcccagtag

SEQ ID NO: 37075 - DNA, 348 bp, Artificial Sequence
  Description of Artificial Sequence: Synthetic coding sequence
cctcctcctccacccagcctgaacccagactacatccagaggccctactgcatgaggcgcttcaatgaatctgctgctgagcggcacaccaacttctgcaaggaccagagcagcagaagagtcttcaacccagcccagacagctgccaagctggccagccgggcccagggccgggcccagatgggccccaagaaggagcccaccgtgaccagcgctgtgggcgccctgctgcagaacagagtgctggtggccaccaatgaggtgcccaccaagagcggcctggccatggaccctgccagcggggccaagctgcggcagggcttcagcaagagcagcaagaaggactag

SEQ ID NO: 37076 - DNA, 381 bp, Artificial Sequence
  Description of Artificial Sequence: Synthetic coding sequence
atgctggccatcaaggagggccggcccctgcccccacctcctccacccagcctgaacccagactacatccagaggccctactgcatgaggcgcttcaatgaatctgctgctgagcggcacaccaacttctgcaaggaccagagcagccggcgggtcttcaacccagcccagacagctgccaagctggccagccgggcccagggccgggcccagatgggccccaagaaggagcccaccgtgaccagcgctgtgggcgccctgctgcagaacagagtgctggtggccaccaatgaggtgcccaccaagagcggcctggccatggaccctgccagcggggccaagctgcggcagggcttcagcaagagcagcaagaaggactag

SEQ ID NO: 37077 - DNA, 2148 bp, Artificial Sequence
  Description of Artificial Sequence: Synthetic coding sequence
atgagcctggactgcaccagccacatcgccctgggcgccgccagccctgcccctgaggagacctatgaccacctgtctgaggtgcctgtgacccgggagcagctgaaccactacagaaatgtggcccagaatgcccggtctgagctggccgccaccctggtgaagtttgaatgtgcccagagcgagctgcaggacctgcggagcaagatgctgagcaaggaggtgtcctgccaggagctgaaggccgagatggagagctacaaggaaaataatgccaggaagagcagcctgctgaccagcctgcgggacagagtgcaggagctggaggaggagagcgctgccctgagcaccagcaagatcagaacagagatcacagcccacgccgccatcaaggagaaccaggagctgaagaagaaggtggtggagctgaatgagaagctgcagaagtgcagcaaagaaaatgaggagaacaagaagcaggtgtccaagaactgcaggaagcatgaggagttcctgacccagctgcgggactgcctggaccctgatgaaagaaatgacaaggccagtgatgaagatctcatcctgaagctgcgggacctgaggaaagaaaatgaatttgtgaagggccagatcgtcatcctggaggagaccatcaacgtgcatgagatggaggccaaggccagccgggagaccatcatgaggctggccagcgaggtgaaccgggagcagaagaaggccgccagctgcacagaggagaaggagaagctgaaccaggacctgctgtctgctgtggaggccaaggaggccctggagcgggaggtgaagatcttccaggagcggctgctggccggccagcaggtgtgggatgccagcaagcaggaggtgtccctgctgaagaagagcagcagcgagctggagaagagcctgaaggccagccaggatgctgtgaccaccagccagagccagtacttctccttccgggagaagattgctgccctgctgcggggccgcctgtccatgacaggcagcacagaggacaccatcctggagaagatccgggagatggacagccgggaggagagccgggacaggatggtgtcccagctggaggcccagatcagcgagctggtggagcagctgggcaaggagagcggcttccaccagaaggccctgcagagggcccagaaggccgagaacatgctggagaccctgcagggccagctgacccacctggaggccgagctggtgtctggaggagtgctgcgggacaacctgaactttgagaagcagaagtacctgaagttcctggaccagctgagccagaagatgaagctggaccagatggctgctgagctgggctttgacatgaggctggatgtggtgctggccaggacagagcagctggtgcggctggagagcaatgctgtgattgagaacaagaccatcgcccacaacctgcagaggaagctgaagacccagaaggagcggctggagagcaaggagctgcacatgagcctgctgcggcagaagatcgcccagctggaggaggagaagcaggccaggacagccctggtggtggagcgggacaatgcccacctgaccatccggaacctgcagaagaaggtggagcggctgcagaaggagctgaacacctgccgggacctgcacacagagctgaaggccaagctggccgacaccaatgagctgaagatcaagaccctggagcagaccaaggccatcgaggacctgaacaagagccgggaccagctggagaagatgaaggagaaggccgagaagaagctgatgtctgtgaagtctgagctggacaccacagaacatgaggccaaggagaacaaggagcgggccaggaacatgattgaggtggtgaccagcgagatgaagaccctgaagaagagcctggaggaggccgagaagcgggagaagcagctggccgacttccgggaggtggtgtcccagatgctgggcctgaatgtgaccagcctggccctgcctgactatgagatcatcaagtgcctggagcggctggtgcacagccaccagcaccactttgtgacctgtgcctgcctgaaggatgtgaccaccggccaggagcggcacccccagggccacctgcagctgctgcactag

SEQ ID NO: 37078 - DNA, 2169 bp, Artificial Sequence
  Description of Artificial Sequence: Synthetic coding sequence
atgagcctggactgcaccagccacatcgccctgggcgccgccagccctgcccctgaggagacctatgaccacctgtctgaggtgcctgtgacccgggagcagctgaaccactacagaaatgtggcccagaatgcccggtctgagctggccgccaccctggtgaagtttgaatgtgcccagagcgagctgcaggacctgcggagcaagatgctgagcaaggaggtgtcctgccaggagctgaaggccgagatggagagctacaaggaaaataatgccaggaagagcagcctgctgaccagcctgcgggacagagtgcaggagctggaggaggagagcgctgccctgagcaccagcaagatcagaacagagatcacagcccacgccgccatcaaggagaaccaggagctgaagaagaaggtggtggagctgaatgagaagctgcagaagtgcagcaaagaaaatgaggagaacaagaagcaggtgtccaagaactgcaggaagcatgaggagttcctgacccagctgcgggactgcctggaccctgatgaaagaaatgacaaggccagtgatgaagatctcatcctgaagctgcgggacctgaggaaagaaaatgaatttgtgaagggccagatcgtcatcctggaggagaccatcaacgtgcatgagatggaggccaaggccagccgggagaccatcatgaggctggccagcgaggtgaaccgggagcagaagaaggccgccagctgcacagaggagaaggagaagctgaaccaggacctgctgtctgctgtggaggccaaggaggccctggagcgggaggtgaagatcttccaggagcggctgctggccggccagcaggtgtgggatgccagcaagcaggaggtgtccctgctgaagaagagcagcagcgagctggagaagagcctgaaggccagccaggatgctgtgaccaccagccagagccagtacttctccttccgggagaagattgctgccctgctgcggggccgcctgtccatgacaggcagcacagaggacaccatcctggagaagatccgggagatggacagccgggaggagagccgggacaggatggtgtcccagctggaggcccagatcagcgagctggtggagcagctgggcaaggagagcggcttccaccagaaggccctgcagagggcccagaaggccgagaacatgctggagaccctgcagggccagctgacccacctggaggccgagctggtgtctggaggagtgctgcgggacaacctgaactttgagaagcagaagtacctgaagttcctggaccagctgagccagaagatgaagctggaccagatggctgctgagctgggctttgacatgaggctggatgtggtgctggccaggacagagcagctggtgcggctggagagcaatgctgtgattgagaacaagaccatcgcccacaacctgcagaggaagctgaagacccagaaggagcggctggagagcaaggagctgcacatgagcctgctgcggcagaagatcgcccagctggaggaggagaagcaggccaggacagccctggtggtggagcgggacaatgcccacctgaccatccggaacctgcagaagaaggtggagcggctgcagaaggagctgaacacctgccgggacctgcacacagagctgaaggccaagctggccgacaccaatgagctgaaggccagcgcctggctgcacttcatcaagaccctggagcagaccaaggccatcgaggacctgaacaagagccgggaccagctggagaagatgaaggagaaggccgagaagaagctgatgtctgtgaagtctgagctggacaccacagagcacgaggccaaggagaacaaggagcgggccaggaacatgattgaggtggtgaccagcgagatgaagaccctgaagaagagcctggaggaggccgagaagcgggagaagcagctggccgacttccgggaggtggtgtcccagatgctgggcctgaatgtgaccagcctggccctgcctgactatgagatcatcaagtgcctggagcggctggtgcacagccaccagcaccactttgtgacctgtgcctgcctgaaggatgtgaccaccggccaggagcggcacccccagggccacctgcagctgctgcactag

SEQ ID NO: 37079 - DNA, 378 bp, Artificial Sequence
  Description of Artificial Sequence: Synthetic coding sequence
atgaagaatgaggagcactgccccggcagcttcttcctgtgcaagatccgggagtgtgtgctgaactaccgcttccagctgcagcaccctggcttccagcactacctgcagagcagtggaagaagagaccggggccgctctgaggacaagaagcccctggaggccggcgtgtggtgctgggacagaggaggctgggatggcagcagcagagctgtgcacctgctcttccggggcgtggcccaccccagcctgtacctgttcccccgggaggaccccccccggctgctcttcccccggctgagcctgctggtgtgtgagcagttctggtgctacagcgccaccctgctgctggcccccctgcctgccagcacctgctag

SEQ ID NO: 37080 - DNA, 609 bp, Artificial Sequence
  Description of Artificial Sequence: Synthetic coding sequence
atgaatgctgctgtgcccccagagcaggcccacagctgtggctggggcacagagggctgcccctgcctgcggagcacagccatccggcagaccttcttccctggaggagaccagttccagagagatggcggcctggccatgctgcccatcctggtgtccaagttcctggccagcagtgacccccctgtgtctgtgcctgagatgctgggcctgcagaaccgctggaggggcatgaagaatgaggagcactgccccggcagcttcttcctgtgcaagatcagagaatgtgtgctgaactaccgcttccagctgcagcaccctggcttccagcactacctgcagagcagcggccggcgggaccggggccgctctgaggacaagaagcccctggaggccggcgtgtggtgctgggaccggggcggctgggatggcagcagcagagctgtgcacctgctcttccggggcgtggcccaccccagcctgtacctgttccccagagaagatcctccccggctgctcttcccccggctgagcctgctggtgtgtgagcagttctggtgctacagcgccaccctgctgctggcccccctgcctgccagcacctgctag

SEQ ID NO: 37081 - DNA, 1266 bp, Artificial Sequence
  Description of Artificial Sequence: Synthetic coding sequence
atgtctgcccacagcatgctgtgtgaaagaattgccatcgccaaggagctgatcaagagagctgagagcctgagccgcagcaggaaaggaggcatcgagggcggggccaagctgtgcagcaagctgaaggccgagctgaagttcctgcagaaggtggaggccggcaaggtggccatcaaggagagccacctgcagagcaccaacctgacccacctgcgggccatcgtggagagcgctgagaacctggaggaggtggtgtctgtgctgcacgtgtttggctacacagacaccctgggggagaagcagaccctggtggtggatgtggtggccaatggaggccacacctgggtgaaggccatcggcaggaaggccgaggccctgcacaacatctggctgggccggggccagtatggagacaagagcatcatcgagcaggccgaggacttcctgcaggccagccaccagcagcctgtgcagtacagcaacccccacatcatctttgccttctacaacagcgtgagcagccccatggccgagaagctgaaggagatgggcatctctgtgcggggggacatcgtggccgtgaatgccctgctggaccaccctgaggagctgcagcccagcgagagcgagagtgatgatgagggccctgagctgctgcaggtgaccagggtggaccgggagaacatcctggcctctgtggccttccccacagagatcaaggtggatgtgtgcaagagggtgaacctggacatcaccaccctcatcacctacgtgtctgccctgtcctatggaggctgccacttcatcttcaaggagaaggtgctgacagagcaggccgagcaggagaggaaggagcaggtgctgccccagctggaggccttcatgaaggacaaggagctgtttgcctgtgagagcgctgtgaaggacttccagagcatcctggacaccctgggcggccctggagagcgggagcgggccaccgtgctgatcaagaggatcaacgtggtgcctgaccagcccagcgagcgggccctgcggctggtggccagcagcaagatcaacagccgcagcctgaccatcttcggcaccggggacaccctgaaggccatcaccatgacagccaacagcggctttgtgcgggccgccaacaaccagggcgtgaagttctctgtgttcatccaccagccccgggccctgacagagagcaaggaggccctggccacccccctgcccaaggactacaccacagattctgagcactag

SEQ ID NO: 37082 - DNA, 537 bp, Artificial Sequence
  Description of Artificial Sequence: Synthetic coding sequence
atgtctgcccacagcatgctgtgtgaaagaattgccatcgccaaggagctgatcaagagagctgagagcctgagccgcagcaggaaaggaggcatcgagggcggggccaagctgtgcagcaagctgaaggccgagctgaagttcctgcagaaggtggaggccggcaaggtggccatcaaggagagccacctgcagagcaccaacctgacccacctgcgggccatcgtggagagcgctgagaacctggaggaggtggtgtctgtgctgcacgtgtttggctacacagacaccctgggggagaagcagaccctggtggtggatgtggtggccaatggaggccacacctgggtgaaggccatcggcaggaaggccgaggccctgcacaacatctggctgggccggggccagtatggagacaagagcatcatcgagcaggccgaggacttcctgcaggccagccaccagcagcctgtgcagtacagcaacccccacatcatctttgccttctacaacagcgtgagcagccccatggcctag

SEQ ID NO: 37083 - DNA, 1440 bp, Artificial Sequence
  Description of Artificial Sequence: Synthetic coding sequence
atgcaggaggtgcctgaggccgccggcctggcccgggtggagcccccaagaagaagcagcggcgtgggcgccgcccggctgcgcttccctgggggcagccggcccctgcgggcccgggcctgtgtgctggccctggccgtgctggccctgcctgagagaaataatgctgacagcatgtctgcccacagcatgctgtgtgaaagaattgccatcgccaaggagctgatcaagagagctgagagcctgagccgcagcaggaaaggaggcatcgagggcggggccaagctgtgcagcaagctgaaggccgagctgaagttcctgcagaaggtggaggccggcaaggtggccatcaaggagagccacctgcagagcaccaacctgacccacctgcgggccatcgtggagagcgctgagaacctggaggaggtggtgtctgtgctgcacgtgtttggctacacagacaccctgggggagaagcagaccctggtggtggatgtggtggccaatggaggccacacctgggtgaaggccatcggcaggaaggccgaggccctgcacaacatctggctgggccggggccagtatggagacaagagcatcatcgagcaggccgaggacttcctgcaggccagccaccagcagcctgtgcagtacagcaacccccacatcatctttgccttctacaacagcgtgagcagccccatggccgagaagctgaaggagatgggcatctctgtgcggggggacatcgtggccgtgaatgccctgctggaccaccctgaggagctgcagcccagcgagagcgagagtgatgatgagggccctgagctgctgcaggtgaccagggtggaccgggagaacatcctggcctctgtggccttccccacagagatcaaggtggatgtgtgcaagagggtgaacctggacatcaccaccctcatcacctacgtgtctgccctgtcctatggaggctgccacttcatcttcaaggagaaggtgctgacagagcaggccgagcaggagaggaaggagcaggtgctgccccagctggaggccttcatgaaggacaaggagctgtttgcctgtgagagcgctgtgaaggacttccagagcatcctggacaccctgggcggccctggagagcgggagcgggccaccgtgctgatcaagaggatcaacgtggtgcctgaccagcccagcgagcgggccctgcggctggtggccagcagcaagatcaacagccgcagcctgaccatcttcggcaccggggacaccctgaaggccatcaccatgacagccaacagcggctttgtgcgggccgccaacaaccagggcgtgaagttctctgtgttcatccaccagccccgggccctgacagagagcaaggaggccctggccacccccctgcccaaggactacaccacagattctgagcactag

SEQ ID NO: 37084 - DNA, 258 bp, Artificial Sequence
  Description of Artificial Sequence: Synthetic coding sequence
atgtctgcccacagcatgctgtgtgaaagaattgccatcgccaaggagctgatcaagagagctgagagcctgagccgcagcaggaaaggaggcatcgagggcggggccaagctgtgcagcaagctgaaggccgagctgaagttcctgcagaaggtggaggccggcaaggtggccatcaaggagagccacctgcagagcaccaacctgacccacctgcgggccatcgtggagagcgctgagaacctggaggaggtgtag

SEQ ID NO: 37085 - DNA, 1266 bp, Artificial Sequence; identical to SEQ ID NO: 37081
  Description of Artificial Sequence: Synthetic coding sequence

SEQ ID NO: 37086 - DNA, 1266 bp, Artificial Sequence; identical to SEQ ID NO: 37081
  Description of Artificial Sequence: Synthetic coding sequence

SEQ ID NO: 37087 - DNA, 1350 bp, Artificial Sequence
  Description of Artificial Sequence: Synthetic coding sequence
atgtctgacatccgccacagcctgctgcggagagatgccctgtctgctgccaaggaggtgctgtaccacctggacatctacttcagcagccagctgcagagcgcccccctgcccatcgtggacaagggccctgtggagctgctggaggagtttgtgttccaggtgcccaaggagaggtctgcccagcccaagaggctgaacagcctgcaggagctgcagctgctggagatcatgtgcaactacttccaggagcagaccaaggacagcgtgcggcagatcatcttcagcagcctcttcagcccccagggcaacaaggcagatgacagcaggatgagcctgctgggcaagctggtgtccatggctgtggccgtgtgccgcatccctgtgctggagtgtgccgcctcctggctgcagaggacccctgtggtgtactgtgtgcggctggccaaggccctggtggatgactactgctgcctggtgcccggcagcatccagaccctgaagcagatcttcagcgccagcccccgcttctgctgccagttcatcacctctgtgacagccctgtatgacctgagcagtgatgacctgatcccccccatggacctgctggagatgattgtgacctggatctttgaggaccccaggctcatcctgatcaccttcctgaacacccccatcgccgccaacctgcccatcggcttcctggagctgacccccctggtgggcctcatccgctggtgtgtgaaggcccccctggcctacaagaggaagaagaagccacccctgagcaatggccacgtgagcaacaaggtgaccaaggaccccggggtgggcatggaccgggacagccacctgctgtacagcaagctgcacctgtctgtgctgcaggtgctgatgaccctgcagctgcacctgacagagaagaacctgtatggccgcctgggcctcatcctgtttgaccacatggtgcccctggtggaggagatcaaccggctggctgatgagctgaaccccctgaatgccagccaggagattgagctgagcctggaccggctggcccaggccctgcaggtggccatggccagcggggccctgctgtgcaccagagatgacctgcggaccctgtgcagccggctgccccacaacaacctgctgcagctggtgatcagcggccctgtgcagcagagcccccatgctgccctgcccccaggcttctacccccacatccacaccccacccctgggctacggggctgtgcctgcccaccctgctgcccacccagccctgcccacccaccctggccacaccttcatctctggagtgaccttccccttccggcccatcagatag

SEQ ID NO: 37088 - DNA, 1059 bp, Artificial Sequence
  Description of Artificial Sequence: Synthetic coding sequence
atgtctgacatccgccacagcctgctgcggagagatgccctgtctgctgccaaggaggtgctgtaccacctggacatctacttcagcagccagctgcagagcgcccccctgcccatcgtggacaagggccctgtggagctgctggaggagtttgtgttccaggtgcccaaggagaggtctgcccagcccaaggagcagaccaaggacagcgtgcggcagatcatcttcagcagcctcttcagcccccagggcaacaaggcagatgacagcaggatgagcctgctgggcaagctggtgtccatggctgtggccgtgtgccgcatccctgtgctggagtgtgccgcctcctggctgcagaggacccctgtggtgtactgtgtgcggctggccaaggccctggtggatgactactgctgcctggtgcccggcagcatccagaccctgaagcagatcttcagcgccagcccccgcttctgctgccagttcatcacctctgtgacagccctgtatgacctgagcagtgatgacctgatcccccccatggacctgctggagatgattgtgacctggatctttgaggaccccagcgtgctgcaggtgctgatgaccctgcagctgcacctgacagagaagaacctgtatggccgcctgggcctcatcctgtttgaccacatggtgcccctggtggaggagatcaaccggctggctgatgagctgaaccccctgaatgccagccaggagattgagctgagcctggaccggctggcccaggccctgcaggtggccatggccagcggggccctgctgtgcaccagagatgacctgcggaccctgtgcagccggctgccccacaacaacctgctgcagctggtgatcagcggccctgtgcagcagagcccccacgccgccctgcccccaggcttctacccccacatccacaccccacccctgggctatggagctgtgcctgcccaccctgctgcccacccagccctgcccacccaccctggccacaccttcatcagcggcgtgaccttccccttccggcccatcagatag

SEQ ID NO: 37089 - DNA, 711 bp, Artificial Sequence
  Description of Artificial Sequence: Synthetic coding sequence
atggtggtgcgggaggccagcgctgcccaggccagcctgagccaggtgctgccccagctgcgctacctgcacatcttcctggagcaggtgcacacccacttccaggagcagagcgtgggggagcggggggccgccatccagctggccgagggcctggcccggcagctgtgcacagactgccagctgaacaagctgttctaccgggaggagtttgtgctggccaccctgctggacccctgcttcaagggcaagattgaggccatcctgccctggggccccacagacatcgaccactggaagcaggtgctggtgtacaaggtgaaggagatccgggtgtctgagtacagcctgaacagccccagccccctgcagagcccccggggcctgtgtgtggaccccaccagggtggccaagagcagcggcgtggagggccgcagccagggcgagcccctgcagagcagcagccacagcggggccttcctgctggcccagcgggagaagggcctgctggagagcatgggcctgctggccagcgagaggtctgggggcagcctgagcaccaagagccactgggccagcatcatcgtgaagaagtacctgtgggagaatgaaacagtgggcgcccaggatgaccccctggcctactgggagaagaagcgggaggcctggccacccagcatctgcctgaccccccacaggagcctgctgtag

SEQ ID NO: 37090 - DNA, 1773 bp, Artificial Sequence
  Description of Artificial Sequence: Synthetic coding sequence
atggaggtgattcatggccggccctactgctgccgggagctggagggcgctgacatcctgagcaacaccttctacagcaatgagctgcacaaccccctgcagacagtgacccggcccacagcctctgaagatcgctaccaggagctgcgggagagcctgcagcagtgccgcctgccctggggcgctgagcgggagtatggaggcatcatccccatcagcctgcctgaggaccaccggcccaagtatgagcccccccgggtgatgggcaagggccaccagcactacggctttggaggagagacctggcccaggaagctgcctgtggagcagttctactacctgacccagaacaagaagagtgatgtgtatggaaatgacagcctcatccccaagccacccaacagcacagtgggggagatctgcctgccctaccccatcgagcacccctaccacacccacatctgccgcggggccatgttccccaccttcaccagcccagaagatctctacacaggcatcaaggcccggacccagcagcccttcccccccaccgtgcccaccaaggcctatgacagcacagtgctgaagacccggggcaacccctaccgctatgagctgattgacatccccatggacagcaagaagaaggccctgacctggccaggccagggcgtgtactatgacttcccccggggcgtggagaagaacaagcctgtgttctaccccaagccacccaagacctttgcccccaacaccagcctgaacagctgggaccccatctgcagcgccaaggaggccaacatccagaggaacctggagaggagccactggctgaccagctacacccatgacttcaccggcctgggccccatggaccccctggagctggatgactaccacgagaagatggtggccgagctgaccaggaagattggatttgatcctgagccccaggagaagttccaccctgtgttcaagccaccccggcccctggagggcagaattgcccggctcatccagaacagaagaagcctggaggccatcgtgcagcagaggcccaggagctgcccagactgcaccccccgggtgctgtgcaacttccacacctttgtgcccagcagcaaggagatggtggccctgagtgacaacatcccagctggggtgacccacaagaaccaggacatcgaggagaagatcatcgaggagcagagcctgctgagcacctatgagctgcccagctgctaccccaccaaggacctgaccagcatctatgacatcaagcccttccccaagatcacagacaccaagaagacagaagatctctactggaggcagcagagcctgaagacccagcccaccccctactgcaagccagaccactggatccactatgagaacctgaagagccccctgcgggaccagtacaacatgtgcccagaccctgtgtccctgagcaagcccagcgtgctgcagaacaagcaggacacagaggccttcaccctggagcacttcctgagcaagccagaggaggagctgttcctgaacatggagaacaatgaggagaccaggcctgtgctgggctggatcccccgggccggcgtgaccaagccccagaccaacctgctggagctgaagaacagcttcagcaagacaggagcccagaagcgcttccacaagagcatcctggaggaccacaaggacctgcgggacaatgagcacagcggcatgaagcaccagttctacggccacaacagctactacttctacaactag

SEQ ID NO: 37091 - DNA, 1773 bp, Artificial Sequence; identical to SEQ ID NO: 37090
  Description of Artificial Sequence: Synthetic coding sequence

SEQ ID NO: 37092 - DNA, 348 bp, Artificial Sequence
  Description of Artificial Sequence: Synthetic coding sequence
atggaggtgattcatggccggccctactgctgccgggagctggagggcgctgacatcctgagcaacaccttctacagcaatgagctgcacaaccccctgcagacagtgacccggcccacagcctctgaagatcgctaccaggagctgcgggagagcctgcagcagtgccgcctgccctggggcgctgagcgggagtatggaggcatcatccccatcagcctgcctgaggaccaccggcccaagtatgagcccccccgggtgatgggcaagggccaccagcactacggctttggaggagagacctggcccaggaagctgcctgtggagcagttctactacctgacctag

SEQ ID NO: 37093 - DNA, 462 bp, Artificial Sequence
  Description of Artificial Sequence: Synthetic coding sequence
atggaggtgattcatggccggccctactgctgccgggagctggagggcgctgacatcctgagcaacaccttctacagcaatgagctgcacaaccccctgcagacagtgacccggcccacagcctctgaagatcgctaccaggagctgcgggagagcctgcagcagtgccgcctgccctggggcgctgagcgggagtatggaggcatcatccccatcagcctgcctgaggaccaccggcccaagtatgagcccccccgggtgatgggcaagggccaccagcactacggctttggaggagagacctggcccaggaagctgcctgtggagcagttctactacctgacccagaacaagaagagtgatgtgtatggaaatgacagcctcatccccaagccacccaacagcacagtgggggagatctgcctgccctaccccatcgagcacccctaccacacccactag

SEQ ID NO: 37094 - DNA, 279 bp, Artificial Sequence
  Description of Artificial Sequence: Synthetic coding sequence
atggaggtgattcatggccggccctactgctgccgggagctggagggcgctgacatcctgagcaacaccttctacagcaatgagctgcacaaccccctgcagacagtgacccggcccacagcctctgaagatcgctaccaggagctgcgggagagcctgcagcagtgccgcctgccctggggcgctgagcgggagtatggaggcatcatccccatcagcctgcctgaggaccaccggcccaagtatgagcccccccgggtgatgggcaagggccactag

SEQ ID NO: 37095 - DNA, 534 bp, Artificial Sequence
  Description of Artificial Sequence: Synthetic coding sequence
atgcaggtggaggtgcagagcctgagcctggaggagtgcccctggaggctgcccggcccccagtgtgaatgtgaggccctgctgcccagcggggcccggaggagaattgacctgcggctgagcggccgggctgtggccgtgtgggtgcacgtgcggggcggccctggccagttcaacctgtcctatgccaccggccgccacaagaagcccaacccccaccagaacatgaacagaggcatggagttcatcgcccctgtgtctgcccccaccaagagcggggccccctggcacttcctgagccagggccccacagatgcccagagagctgtgcgcatccggcccggcaccaggatgggcctgagcagtgaccctgtggtgggcaccctgagcagcagctacctggacctgctgaccctgagctacaagccaggccgcacagtgaccagcagctacctgaatgtgcggggccacgaggtgaggaagctgcagaacagcgtggaggccacccgcatcagcaggacagacagcagctag

SEQ ID NO: 37096 - DNA, 396 bp, Artificial Sequence
  Description of Artificial Sequence: Synthetic coding sequence
atggacttccagcagctggctgatgtggccgagaagtggtgcagcaacaccccatttgagctgattgccacagaggagacagaaagaaggatggacttctatgctgaccccggggtgtccttctacgtgctgtgcccagacaatggctgtggggacaacttccacgtgtggagcgagagcgaggactgcctgcccttcctgcagctggcccaggactacatcagcagctgtgggaagaagaccctgcacgaggtgctggagaaggtgttcaagagcttccggcccctgctgggcctgcctgatgctgatgatgatgcctttgaggagtacagcgcagatgtggaggaggaggagcctgaggccgaccacccccagatgggcgtgtcccagcagtag

SEQ ID NO: 37097 - DNA, 297 bp, Artificial Sequence
  Description of Artificial Sequence: Synthetic coding sequence
atggccacccactgccccctgtactgtgtgggcgctgacctgatgatgaacagagctggggagcacgtgtggagcgagagcgaggactgcctgcccttcctgcagctggcccaggactacatcagcagctgtgggaagaagaccctgcacgaggtgctggagaaggtgttcaagagcttccggcccctgctgggcctgcctgatgctgatgatgatgcctttgaggagtacagcgcagatgtggaggaggaggagcctgaggccgaccacccccagatgggcgtgtcccagcagtag

SEQ ID NO: 37098 - DNA, 396 bp, Artificial Sequence; identical to SEQ ID NO: 37096
  Description of Artificial Sequence: Synthetic coding sequence

SEQ ID NO: 37099 - DNA, 297 bp, Artificial Sequence; identical to SEQ ID NO: 37097
  Description of Artificial Sequence: Synthetic coding sequence

SEQ ID NO: 37100 - DNA, 600 bp, Artificial Sequence
  Description of Artificial Sequence: Synthetic coding sequence
atgcacaagaagagcggctttgagaaccagatgaggctgtgctggaggcggccctgtggaaatgaggagcgctgcagcgtgtgctggagcctcttcctgcccccaggcaagcagctgtgtgaggaggagcggcgggccatgcaggccgccctggacagcgtggtgtgccacacccccctgaacaacctgggcttcagcaggaagggcagcgccctgaccttctctgtggccttccaggccctgaggacaggcctgtttgagcacatgaagctgaagctgcagttcaccgcctctgtgagccaccccccacctgaggcccggcccctgagcaggaagagcagccccagcagccctgctgtgcgggacctggtggagcggcaccaggccagcctgggccgcagccagagcttcagccaccagcagcccagccgcagccacctgatgaggagcggctctgtgatggagcggcgggccatcaccccacctgtggccagccctgtgggccggcccctgtacctgcccccagacaaggctgtgctgagcctggacaagatcgccaagcgggagtgcaaggtgctggtggtggagcctgtgaagtag

SEQ ID NO: 37101 - DNA, 1743 bp, Artificial Sequence
  Description of Artificial Sequence: Synthetic coding sequence
atggagagccagtgtgactacagcatgtacttccctgctgtgcccctgccccccagggctgagctggccggggaccccggccgctaccgggccctgcccaggaggaaccacctgtacctgggggagaccgtgcgcttcctgctggtgctgcgctgccggggcggggccggcagcggcaccggcggcggccctggcctgggcagcagaggagcctgggccgagctggccacagccctggccgccctggcctctgtgtctgctgggggcggcatgcctgggggcggcggggccggggaccaggacagcgagcccccaggcggcggggaccccggcggcggcggcctcttccggggctgcagccccctgctgacccacggccctggccctgccaccagcggcggggccaccaccctgcctgtggaggagcccatcgtgtccacagatgaggtgatcttccccctgactgtgtccctggaccggctgcccccaggcacccccaaggccaagatcgtggtgacagtgtggaagcgggagattgaggcccctgaggtgcgggaccagggctacctgcggctgctgcagaccaggagccctggagagaccttccggggggagcagagcgccttcaaggcccaggtgtccaccctgctgaccctgctgcccccacctgtgctgcgctgccggcagttcaccgtggccggcaagcacctgactgtgctgaaggtgctgaacagcagcagccaggaggagatcagcatctgggacatccgcatcctgcccaacttcaatgccagctacctgcctgtgatgccagatggctctgtgctgctggtggacaacgtgtgccaccagagcggggaggtgtccatgggcagcttctgccgcctgcccggcaccagcggctgcttcccctgccccctgaatgccctggaggagcacaacttcctgttccagctgcggggcggggagcagcccccacctggggccaaggagggcctggaggtgcccctgattgctgtggtgcagtggagcacccccaagctgcccttcacccagagcatctacacccactaccgcctgcccagcgtgcggctggaccggccctgctttgtgatgacagccagctgcaagagccctgtgaggacctatgagcgcttcaccgtgacctacaccctgctgaacaacctgcaggacttcctggccgtgcggctggtgtggaccccagagcacgcccaggccggcaagcagctgtgtgaggaggagcggcgggccatgcaggccgccctggacagcgtggtgtgccacacccccctgaacaacctgggcttcagcaggaagggcagcgccctgaccttctctgtggccttccaggccctgaggacaggcctgtttgagctgagccagcacatgaagctgaagctgcagttcaccgcctctgtgagccaccccccacctgaggcccggcccctgagcaggaagagcagccccagcagccctgctgtgcgggacctggtggagcggcaccaggccagcctgggccgcagccagagcttcagccaccagcagcccagccgcagccacctgatgaggagcggctctgtgatggagcggcgggccatcaccccacctgtggccagccctgtgggccggcccctgtacctgcccccagacaaggctgtgctgagcctggacaagatcgccaagcgggagtgcaaggtgctggtggtggagcctgtgaagtag

SEQ ID NO: 37102 - DNA, 897 bp, Artificial Sequence
  Description of Artificial Sequence: Synthetic coding sequence
atggagcggctgaccctgcccctgggcggcgctgctgctgtggatgagtacctggagtacagaagaattgtgggggaggatgatggcggcaagctgttcaccccagaggagtatgaggagtacaagaggaaggtgctgcccctgcggctgcagaaccggctgtttgtgtcctggaggagccccaccggcatggactgcaagctggtgggccctgagaccctgtgcttctgcacccaccgctacaagcagcacaagacagacctggaggccatcccccagcagtgccccatcgacctgccctgccaggtgacaggctgccagtgccgggcctacctgtatgtgcccctgaatggcagccagcccatccgctgccgctgcaagcactttgctgaccagcacagcgctgcccctggcttcacctgcaacacctgcagcaagtgcagcggcttccacagctgcttcacctgtgcctgtggccagcctgcctatgcccatgacacagtggtggagaccaagcaggagcggctggcccaggagaagcctgtgggccaggacatcccctatgctgccatgggcggcctgaccggcttcagcagcctggccgagggctacatgaggctggatgacagcggcatcggcgtgcccagcgtggagttcctggagagccccatcacagctgtggacagccccttcctgaaggccttccaggccagcagcagcagcagccctgagaccctgacagatgtgggcaccagcagccaggtgagcagcctgcggcggccagaagaagatgacatggccttctttgaaagacgctaccaggagaggatgaagatggagaaggccgccaagtggaagggcaaggcccccctgcccagcgccaccaagcccagctag

SEQ ID NO: 37103 - DNA, 789 bp, Artificial Sequence
  Description of Artificial Sequence: Synthetic coding sequence
atggagcggctgaccctgcccctgggcggcgctgctgctgtggatgagtacctggagtacagaagaattgtgggggaggatgatggcggcaagctgttcaccccagaggagtatgaggagtacaagaggaaggtgctgcccctgcggctgcagaaccggctgtttgtgtcctggaggagccccaccggcatggactgcaagctggtgggccctgagaccctgtgcttctgcacccaccgctacaagcagcacaagacagacctggaggccatcccccagcagtgccccatcgacctgccctgccaggtgacaggctgccagtgccgggcctacctgtatgtgcccctgaatggcagccagcccatccgctgccgctgcaagcactttgctgaccagcacagcgctgcccctggcttcacctgcaacacctgcagcaagtgcagcggcttccacagctgcttcacctgtgcctgtggccagcctgcctatgcccatgacacagtggtggagaccaagcaggagcggctggcccaggagaagcctgtgggccaggacatcccctatgctgccatgggcggcctgaccggcttcagcagcctggccgagggctacatgaggctggatgacagcggcatcgtgggcaccagcagccaggtgagcagcctgcggcggccagaagaagatgacatggccttctttgaaagacgctaccaggagaggatgaagatggagaaggccgccaagtggaagggcaaggcccccctgcccagcgccaccaagcccagctag

SEQ ID NO: 37104 - DNA, 615 bp, Artificial Sequence
  Description of Artificial Sequence: Synthetic coding sequence
atggagcggctgaccctgcccctgggcggcgctgctgctgtggatgagtacctggagtaccgccgctacaagcagcacaagacagacctggaggccatcccccagcagtgccccatcgacctgccctgccaggtgacaggctgccagtgccgggcctacctgtatgtgcccctgaatggcagccagcccatccgctgccgctgcaagcactttgctgaccagcacagcgctgcccctggcttcacctgcaacacctgcagcaagtgcagcggcttccacagctgcttcacctgtgcctgtggccagcctgcctatgcccatgacacagtggtggagaccaagcaggagcggctggcccaggagaagcctgtgggccaggacatcccctatgctgccatgggcggcctgaccggcttcagcagcctggccgagggctacatgaggctggatgacagcggcatcgtgggcaccagcagccaggtgagcagcctgcggcggccagaagaagatgacatggccttctttgaaagacgctaccaggagaggatgaagatggagaaggccgccaagtggaagggcaaggcccccctgcccagcgccaccaagcccagctag

SEQ ID NO: 37105 - DNA, 585 bp, Artificial Sequence
  Description of Artificial Sequence: Synthetic coding sequence
atggccaagcagaagaggaaggtgcctgaggtgacagagaagaagaacaagaagctgaagaaggccagcgctgagggccccctgctgggccctgaggccgcccccagcggggagggcgccggcagcaaaggagaggccgtgctgcggcccggcctggatgctgagcctgagctgagccctgaggagcagagggtgctggagaggaagctgaagaaggagaggaagaaggaggagcggcagaggctgcgggaggccggcctggtggcccagcaccccccagccaggagaagtggagctgagctggccctggactacctgtgccgctgggcccagaagcacaagaactggaggttccagaagacccggcagacctggctgctgctgcacatgtatgacagcgacaaggtgcctgatgagcacttcagcaccctgctggcctacctggagggcctgcagggccgggcccgggagctgactgtgcagaaggccgaggccctgatgagggagctggatgaggagggcagtgacccccccctgcccggccgggcccagaggatccggcaggtgctgcagctgctgtcctag

SEQ ID NO: 37106 - DNA, 585 bp, Artificial Sequence; identical to SEQ ID NO: 37105
  Description of Artificial Sequence: Synthetic coding sequence

SEQ ID NO: 37107 - DNA, 585 bp, Artificial Sequence; identical to SEQ ID NO: 37105
  Description of Artificial Sequence: Synthetic coding sequence

SEQ ID NO: 37108 - DNA, 579 bp, Artificial Sequence
  Description of Artificial Sequence: Synthetic coding sequence
atggccaagcagaagaggaaggtgcctgaggtgacagagaagaagaacaagaagctgaagaaggccagcgctgagggccccctgctgggccctgaggccgcccccagcggggagggcgccggcagcaaaggagaggccgtgctgcggcccggcctggatgctgagcctgagctgagccctgaggagcagagggtgctggagaggaagctgaagaaggagaggaagaaggaggagcggcagaggctgcgggaggccggcctggtggcccagcaccccccagccaggagaagtggagctgagctggccctggactacctgtgccgctgggcccagaagcacaagaactggaggttccagaagacccggcagacctggctgctgctgcacatgtatgacagcgacaaggtgcctgatgagcacttcagcaccctgctggcctacctggagggcctgcagggccgggcccgggagctgactgtgcagaaggccgaggccctgatgagggagctggatgaggagggcagtgacccccccctgcccggccgggcccagaggatccggcaggtgctgcagctgtag

SEQ ID NO: 37109 - DNA, 888 bp, Artificial Sequence
  Description of Artificial Sequence: Synthetic coding sequence
atgaggaacaccagcaaggagctgcagggcgccacccacagatatgccccctgtgactggtactaccacgtgcctgtgaagaggtctgagaaggctgtggatgcccccccagccagccagatccctggcctgagcaacctgggggacagccacagcgagaacctgcccggcacccggcgctactggatcaaggagacagacagtgaatatgtgaagctggccaagcagggcggccgcccagacctgctgaagcactttgcccctggcaccaggaagggcagccctgtggcctacagcctgcctgactggtacatccaccacagcaagccacccacagccagccagcaggaggtgcgggctgtgtccatgccagactacatggtgcatgaggagttcaacccagaccaggccaacggcagctatgccagccggcggggcccctttgattttgacatgaagacagtgtggcagcgggaggccgaggagctggagaaggagaagaagaagctgcggctgcctgccatcgacagcaagtacctgagcaaggccggcacccccctgggccccaagaacccagctggcagccggctgtccttcccccctgtgcccggccagaagaacagcagccccaccaacttcagcaagctgatcagcaatggctacaaggatgagtggctgcagcagcagcagagagctgacagcgacaagaggacccccaagaccagccgggcctctgtgctgagccagagcccccgggacctggagggcccccaggatgctgcccggctgcaggatgctgaggccagcgagggccctgaggacaccccagagagcagccagagccctgaggagagcgtgtctgccagcaccccagctgagctgaagtag

SEQ ID NO: 37110 - DNA, 888 bp, Artificial Sequence
  Description of Artificial Sequence: Synthetic coding sequence
atgaggaacaccagcaaggagctgcagggcgccacccacagatatgccccctgtgactggtactaccacgtgcctgtgaagaggtctgagaaggctgtggatgcccccccagccagccagatccctggcctgagcaacctgggggacagccacagcgagaacctgcccggcacccggcgctactggatcaaggagacagacagtgaatatgtgaagctggccaagcagggcggccgcccagacctgctgaagcactttgcccctggcaccaggaagggcagccctgtggcctacagcctgcctgactggtacatccaccacagcaagccacccacagccagccagcaggaggtgcgggctgtgtccatgccagactacatggtgcatgaggagttcaacccagaccaggccaacggcagctatgccagccggcggggcccctttgattttgacatgaagacagtgtggcagcgggaggccgaggagctggagaaggagaagaagaagctgcggctgcctgccatcgacagcaagtacctgagcaaggccggcacccccctgggccccaagaacccagctggcagccggctgtccttcccccctgtgcccggccagaagaacagcagccccaccaacttcagcaagctgatcagcaatggctacaaggatgagtggctgcagcagcagcagagagctgacagcgacaagaggacccccaagaccagccgggcctctgtgctgagccagagcccccgggacctggagggcccccaggatgctgcccggctgcaggatgctgaggccagcgagggccctgaggacaccccagagagcaacacctgcccagaggagagcgtgtctgccagcaccccagctgagctgaagtag

SEQ ID NO: 37111 - DNA, 462 bp, Artificial Sequence
  Description of Artificial Sequence: Synthetic coding sequence
atgccagactacatggtgcatgaggagttcaacccagaccaggccaacggcagctatgccagccggcggggcccctttgattttgacatgaagacagtgtggcagcgggaggccgaggagctggagaaggagaagaagaagctgcggctgcctgccatcgacagcaagtacctgagcaaggccggcacccccctgggccccaagaacccagctggcagccggctgtccttcccccctgtgaatggctacaaggatgagtggctgcagcagcagcagagagctgacagcgacaagaggacccccaagaccagccgggcctctgtgctgagccagagcccccgggacctggagggcccccaggatgctgcccggctgcaggatgctgaggccagcgagggccctgaggacaccccaggccctgaggagagcgtgtctgccagcaccccagctgagctgaagtag

SEQ ID NO: 37112 - DNA, 300 bp, Artificial Sequence
  Description of Artificial Sequence: Synthetic coding sequence
atgaccagcgccctgacccagggcctggagcgcatcccagaccagctgggctacctggtgctgtctgagggcgctgtgctggccagcagcggggacctggagaatgatgagcaggccgccagcgccatcagcgagctggtgtccacagcctgtggcttccggctgcaccggggcatgaatgtgcccttcaagaggctgtctgtggtgtttggagagcacaccctgctggtgacagtgtctggccagagggtgtttgtggtgaagaggcagaacagaggccgggagcccattgatgtgtag

SEQ ID NO: 37113 - DNA, 1218 bp, Artificial Sequence
  Description of Artificial Sequence: Synthetic coding sequence
atggagcctggagctgggggcaggaacacagcccgggcccagagagctggcagccccaacaccccaccaccccgggagcaggagaggaagctggagcaggagaagctgtctggagtggtgaagtctgtgcaccggcggctgaggaagaagtaccgggaggtgggggactttgacaagatctggagggagcactgtgaagatgaggagaccctgtgtgaatatgctgtggccatgaagaacctggccgacaaccactgggccaagacctgtgagggggagggccgcatcgagtggtgctgcagcgtgtgccgggagtacttccagaatggaggcaagaggaaggccctggagaaggatgagaagagagctgtgctggccaccaagaccaccccagccctgaacatgcatgagagcagccagctggagggccacctgaccaacctgtccttcaccaaccctgagttcatcacagagctgctgcaggccagcggcaagatccggctgctggatgtgggcagctgcttcaaccccttcctgaagtttgaggagttcctgactgtgggcattgatattgtgcctgctgtggagagcgtgtacaagtgtgacttcctgaacctgcagctgcagcagcccctgcagctggcccaggatgccattgatgccttcctgaagcagctgaagaaccccatcgacagcctgcccggggagctgttccacgtggtggtgttcagcctgctgctgagctacttccccagcccctaccagcgctggatctgctgcaagaaggcccacgagctgctggtgctgaatggcctgctgctgatcatcaccccagacagcagccaccagaacagacatgccatgatgatgaagtcctggaagatcgccatcgagagcctgggcttcaagcgcttcaagtacagcaagttcagccacatgcacctgatggccttcaggaagatcagcctgaagaccaccagtgacctggtgtccaggaactacccaggcatgctgtacatcccccaggacttcaacagcattgaagatgaggagtacagcaaccccagctgctacgtgcggagtgacattgaagatgagcagctggcctacggcttcacagagctgcctgatgccccctatgacagcgacagcggggagagccaggccagcagcatccccttctatgagctggaggaccccatcctgctgctgtcctag

SEQ ID NO: 37114 - DNA, 1059 bp, Artificial Sequence
  Description of Artificial Sequence: Synthetic coding sequence
atgggagactttgacaagatctggagggagcactgtgaagatgaggagaccctgtgtgaatatgctgtggccatgaagaacctggccgacaaccactgggccaagacctgtgagggggagggcagaattgagtggtgctgcagcgtgtgccgggagtacttccagaatggaggcaagaggaaggccctggagaaggatgagaagagagctgtgctggccaccaagaccaccccagccctgaacatgcatgagagcagccagctggagggccacctgaccaacctgtccttcaccaaccctgagttcatcacagagctgctgcaggccagcggcaagatccggctgctggatgtgggcagctgcttcaaccccttcctgaagtttgaggagttcctgactgtgggcatcgacatcgtgcctgctgtggagagcgtgtacaagtgtgacttcctgaacctgcagctgcagcagcccctgcagctggcccaggatgccattgatgccttcctgaagcagctgaagaaccccatcgacagcctgcctggagagctgttccacgtggtggtgttcagcctgctgctgagctacttccccagcccctaccagcgctggatctgctgcaagaaggcccacgagctgctggtgctgaatggcctgctgctgatcatcaccccagacagcagccaccagaacagacatgccatgatgatgaagtcctggaagatcgccatcgagagcctgggcttcaagcgcttcaagtacagcaagttcagccacatgcacctgatggccttcaggaagatcagcctgaagaccaccagtgacctggtgtccaggaactacccaggcatgctgtacatcccccaggacttcaacagcattgaagatgaggagtacagcaaccccagctgctacgtgcggagtgacattgaagatgagcagctggcctacggcttcacagagctgcctgatgccccctatgacagcgacagcggggagagccaggccagcagcatccccttctatgagctggaggaccccatcctgctgctgtcctag

SEQ ID NO: 37115 - DNA, 621 bp, Artificial Sequence
  Description of Artificial Sequence: Synthetic coding sequence
atggtggtggtgatgaagttcttccgctgggtgcggcgggcctggcagaggatcatctcctgggtgttcttctggaggcagaagatcaagcccaccatcagcggccacccagacagcaagaagcacagcctgaagaagatggagaagaccctgcaggtggtggagaccctgcggctggtggagctgcccaaggaggccaagcccaagctgggggagagccctgagctggccgacccctgtgtgctggccaagaccacagaggagacagaggtggagctgggccagcagggccagagcctgctgcagctgcccaggacagctgtgaagtctgtgtccaccctgatggtgtctgccctgcagagcggctggcagatgtgctcctggaagagctctgtgagcagcgcctctgtgagcagccaggtgaggacccagagccccctgaagaccccagaggccgagctgctgtgggaggtgtacctggtgctgtgggccgtgaggaagcacctgcggcggctgtaccgccggcaggagcggcaccggcggcaccacgtgcgctgccacgccgccccccggcccaacccagcccagagcctgaagctggatgcccagagccccctgtag

SEQ ID NO: 37116 - DNA, 762 bp, Artificial Sequence
  Description of Artificial Sequence: Synthetic coding sequence
atgtccttctctgtgcacaaccagaagggcagcaagaggcccctgcccctggagcccctgctcttcctgcaggtgcccaggagcaactacctgcacttccaggaggagaagcagaggctgcacctgaagaagttcctgctggacaggatgttcctggtggccaagatccaggccaacgtggagaggaaggatgtggccgactactatgagcagatgttccagagcgtgctgaagcaccacctgggggaggccgtgacaggcctgctgctgatctaccccaccagcatcctgcacatcctggagagcagcagtgacaccctgtacaaggtgctgctggactacatcggccacgtgaaggatgagaccgtcttcttcatccagcagatgaagatcatcgtcatcagccacaacatccccatgaggctcttcatgcagtggcacgtgtctgtcatcaaggtgcctgtgatgtacctggatgatgtgacccagagccagagcctgaaggaggtgatcacagacttcctgacccagacccacaagctgagcctgtacctgtgccagaccatgaaggtgggcaccaagggccctggggacaacctgcaccaggtggccccagacctgctgctgcctgagcagatcatcaagtacctgtgcaagtctgaggagttcatggaccctgccaccttcatcaacatgtacaaccggcccatccacatcaccctggacagcgaggtggtgtggccagcccccagccgcttctag

SEQ ID NO: 37117 - DNA, 2688 bp, Artificial Sequence
  Description of Artificial Sequence: Synthetic coding sequence
atgtggacagaggaggccggggccacagctgaggcccaggagagcggcatccggaacaagagcagcagcagcagccagatccctgtggtgggcgtggtgacagaagatgatgaggcccaggatgtgttcaagcccatggacctgaacagagtcatcaagctgctggaggagacagacaaggatggcctggaggagaagcagctgaagtttgtgaagaagctggtgcagtgctaccagaatggcctgcccctgcgggacctggcccagatcttcaagatcctgaacctgtgcagcggcaagatcaagaaccagccccgcttcatcgagagcgcctatgacatcatcaagctgtgtggcctgcccttcctgaagaagaaggtgtctgatgagatcacctatgcagaggacacagccaacagcatcgccctgctgggggacctgatgaagatccccagcagcgagctgcgcatccagatctgcaagtgcatcgtggacttctaccacgccgagccccccaagaagcacatccctggctaccagcaggccagcagcagctacaagatccagatggccgaggtgggcggcctggccaagaccatggtgcagagcatgaccctgctggagaaccagctggtggagaagctgtgggtgctgaaggtgctgcagcacctgagcaccagcgaggtgaactgcaccatcatgatgaaggcccaggccgccagcggcatctgcacccacctgaatgaccctgaccccagcggccagctgctcttccgcagcagcgagatcctgtggaacctgctggagaagagcagcaaggaggaggtgatccagcagctgagcaacctggagtgcctgctggccctgaaggaggtgttcaagaacctcttcatgaggggcttcagccactatgaccggcagctgagaaatgacatcctggtgatcaccaccatcatcgcccagaaccctgaggcccccatgattgaatgtggcttcaccaaggacctgatcctgtttgccaccttcaatgaggtgaagagccagaacctgctggtgaagggcctgaagctgagcaacagctatgaggactttgagctgaagaagctgctcttcaacgtcatcgtcatcctgtgcaaggacctgcccaccgtgcagctgctgattgatggcaaggtgatcctggccctcttcacctacgtgaagaagccagagaagcagaagatcatcgactggagcgctgcccagcacgaggagctgcagctgcacgccatcgccaccctgagctctgtggcccccctgctgattgaggagtacatgagctgccagggcaatgcccgggtgctggccttcctggagtggtgtgagagcgaggaccccttcttcagccacggcaacagcttccacggcaccggcggccggggcaacaagtttgcccagatgagatacagcctgcggctgctgcgggctgtggtgtacctggaggatgaaacagtgaacaaggacctgtgtgagaagggcaccatccagcagatgattggcatcttcaagaacatcatcagcaagcccaatgagaaggaggaggccatcgtgctggagatccagagcgacatcctgctgatcctgagcggcctgtgtgagaaccacatccagaggaaggagatctttggaacagaaggagtggacatcgtgctgcacgtgatgaagacagaccccaggaagctgcagagcggcctgggctacaacgtgctgctcttcagcaccctggacagcatctggtgctgcatcctgggctgctaccccagcgaggactacttcctggagaaggagggcatcttcctgctgctggacctgctggccctgaaccagaagaagttctgcaacctgatcctgggcatcatggtggagttctgtgacaaccccaagacagctgcccacgtgaatgcctggcagggcaagaaggaccagacagctgccagcctgctgatcaagctgtggaggaaggaggagaaggagctgggcgtgaagagggacaagaatggcaagatcatcgactttgagaacctgcccggcctgtctgctgaggactttgtgaccctgtgcatcatccaccgctacctggacttcaagatcggggagatctggaatgagatctatgaggagatcaagctggagaagctgcggcctgtgaccacagacaagaaggccctggaggccatcaccacagccagcgagaacatcggcaagatggtggccagcctgcagagcgacatcatcgagagccaggcctgccaggacatgcagaatgagcagaaggtgtatgccaagatccaggccacccacaagcagcgggagctggccaacaagtcctgggaggacttcctggcccggaccagcaatgccaagaccctgaagaaggccaagagcctgcaggagaaggccatcgaggccagccgctaccacaagaggccccagaatgccatcttccaccagacccacatcaagggcctgaacaccaccgtgcccagcggcggcgtggtgacagtggagagcaccccagcccggctggtgggcggccccctggtggacacagacatcgccctgaagaagctgcccatccggggcggggccctgcagagggtgaaggctgtgaagatcgtggatgcccccaagaagagcatccccacctag

SEQ ID NO: 37118 - DNA, 2826 bp, Artificial Sequence
  Description of Artificial Sequence: Synthetic coding sequence
atgtggacagaggaggccggggccacagctgaggcccaggagagcggcatccggaacaagagcagcagcagcagccagatccctgtggtgggcgtggtgacagaagatgatgaggcccaggatgtgttcaagcccatggacctgaacagagtcatcaagctgctggaggagacagacaaggatggcctggaggagaagcagctgaagtttgtgaagaagctggtgcagtgctaccagaatggcctgcccctgcgggacctggcccagatcttcaagatcctgaacctgtgcagcggcaagatcaagaaccagccccgcttcatcgagagcgcctatgacatcatcaagctgtgtggcctgcccttcctgaagaagaaggtgtctgatgagatcacctatgcagaggacacagccaacagcatcgccctgctgggggacctgatgaagatccccagcagcgagctgcgcatccagatctgcaagtgcatcgtggacttctaccacgccgagccccccaagaagcacatccctggctaccagcaggccagcagcagctacaagatccagatggccgaggtgggcggcctggccaagaccatggtgcagagcatgaccctgctggagaaccagctggtggagaagctgtgggtgctgaaggtgctgcagcacctgagcaccagcgaggtgaactgcaccatcatgatgaaggcccaggccgccagcggcatctgcacccacctgaatgaccctgaccccagcggccagctgctcttccgcagcagcgagatcctgtggaacctgctggagaagagcagcaaggaggaggtgatccagcagctgagcaacctggagtgcctgctggccctgaaggaggtgttcaagaacctcttcatgaggggcttcagccactatgaccggcagctgagaaatgacatcctggtgatcaccaccatcatcgcccagaaccctgaggcccccatgattgaatgtggcttcaccaaggacctgatcctgtttgccaccttcaatgaggtgaagagccagaacctgctggtgaagggcctgaagctgagcaacagctatgaggactttgagctgaagaagctgctcttcaacgtcatcgtcatcctgtgcaaggacctgcccaccgtgcagctgctgattgatggcaaggtgatcctggccctcttcacctacgtgaagaagccagagaagcagaagatcatcgactggagcgctgcccagcacgaggagctgcagctgcacgccatcgccaccctgagctctgtggcccccctgctgattgaggagtacatgagctgccagggcaatgcccgggtgctggccttcctggagtggtgtgagagcgaggaccccttcttcagccacggcaacagcttccacggcaccggcggccggggcaacaagtttgcccagatgagatacagcctgcggctgctgcgggctgtggtgtacctggaggatgaaacagtgaacaaggacctgtgtgagaagggcaccatccagcagatgattggcatcttcaagaacatcatcagcaagcccaatgagaaggaggaggccatcgtgctggagatccagagcgacatcctgctgatcctgagcggcctgtgtgagaaccacatccagaggaaggagatctttggaacagaaggagtggacatcgtgctgcacgtgatgaagacagaccccaggaagctgcagagcggcctgggctacaacgtgctgctcttcagcaccctggacagcatctggtgctgcatcctgggctgctaccccagcgaggactacttcctggagaaggagggcatcttcctgctgctggacctgctggccctgaaccagaagaagttctgcaacctgatcctgggcatcatggtggagttctgtgacaaccccaagacagctgcccacgtgaatgcctggcagggcaagaaggaccagacagctgccagcctgctgatcaagctgtggaggaaggaggagaaggagctgggcgtgaagagggacaagaatggcaagatcatcgacaccaagaagcccctcttcaccagcttccaggaggagcagaagatcatccccctgcctgccaactgccccagcattgctgtgatggatgtgtctgagaacatccgggccaagatctatgccatcctgggcaagctggactttgagaacctgcccggcctgtctgctgaggactttgtgaccctgtgcatcatccaccgctacctggacttcaagatcggggagatctggaatgagatctatgaggagatcaagctggagaagctgcggcctgtgaccacagacaagaaggccctggaggccatcaccacagccagcgagaacatcggcaagatggtggccagcctgcagagcgacatcatcgagagccaggcctgccaggacatgcagaatgagcagaaggtgtatgccaagatccaggccacccacaagcagcgggagctggccaacaagtcctgggaggacttcctggcccggaccagcaatgccaagaccctgaagaaggccaagagcctgcaggagaaggccatcgaggccagccgctaccacaagaggccccagaatgccatcttccaccagacccacatcaagggcctgaacaccaccgtgcccagcggcggcgtggtgacagtggagagcaccccagcccggctggtgggcggccccctggtggacacagacatcgccctgaagaagctgcccatccggggcggggccctgcagagggtgaaggctgtgaagatcgtggatgcccccaagaagagcatccccacctag

SEQ ID NO: 37119 - DNA, 1437 bp, Artificial Sequence
  Description of Artificial Sequence: Synthetic coding sequence
gagctgcagctgcacgccatcgccaccctgagctctgtggcccccctgctgattgaggagtacatgagctgccagggcaatgcccgggtgctggccttcctggagtggtgtgagagcgaggaccccttcttcagccacggcaacagcttccatggaactggaggccggggcaacaagtttgcccagatgagatacagcctgcggctgctgcgggctgtggtgtacctggaggatgagaccgtgaacaaggacctgtgtgagaagggcaccatccagcagatgattggcatcttcaagaacatcatcagcaagcccaatgagaaggaggaggccatcgtgctggagatccagagcgacatcctgctgatcctgagcggcctgtgtgagaaccacatccagaggaaggagatcttcggcacagagggcgtggacatcgtgctgcacgtgatgaagacagaccccaggaagctgcagagcggcctgggctacaacgtgctgctcttcagcaccctggacagcatctggtgctgcatcctgggctgctaccccagcgaggactacttcctggagaaggagggcatcttcctgctgctggacctgctggccctgaaccagaagaagttctgcaacctgatcctgggcatcatggtggagttctgtgacaaccccaagacagctgcccacgtgaatgcctggcagggcaagaaggaccagacagctgccagcctgctgatcaagctgtggaggaaggaggagaaggagctgggcgtgaagagggacaagaatggcaagatcatcgactttgagaacctgcccggcctgtctgcagaagattttgtgaccctgtgcatcatccaccgctacctggacttcaagattggagagatctggaatgagatctatgaggagatcaagctggagaagctgcggcctgtgaccacagacaagaaggccctggaggccatcaccacagcctctgaaaatattggcaagatggtggccagcctgcagagcgacatcatcgagagccaggcctgccaggacatgcagaatgagcagaaggtgtatgccaagatccaggccacccacaagcagcgggagctggccaacaagtcctgggaggacttcctggcccggaccagcaatgccaagaccctgaagaaggccaagagcctgcaggagaaggccatcgaggccagccgctaccacaagaggccccagaatgccatcttccaccagacccacatcaagggcctgaacaccaccgtgcccagcggaggagtggtgacagtggagagcaccccagcccggctggtgggcggccccctggtggacacagacatcgccctgaagaagctgcccatccggggcggggccctgcagagggtgaaggctgtgaagatcgtggatgcccccaagaagagcatccccacctag

SEQ ID NO: 37120 - DNA, 2772 bp, Artificial Sequence
  Description of Artificial Sequence: Synthetic coding sequence
atgtggacagaggaggccggggccacagctgaggcccaggagagcggcatccggaacaagagcagcagcagcagccagatccctgtggtgggcgtggtgacagaagatgatgaggcccaggatgtgttcaagcccatggacctgaacagagtcatcaagctgctggaggagacagacaaggatggcctggaggagaagcagctgaagtttgtgaagaagctggtgcagtgctaccagaatggcctgcccctgcgggacctggcccagatcttcaagatcctgaacctgtgcagcggcaagatcaagaaccagccccgcttcatcgagagcgcctatgacatcatcaagctgtgtggcctgcccttcctgaagaagaaggtgtctgatgagatcacctatgcagaggacacagccaacagcatcgccctgctgggggacctgatgaagatccccagcagcgagctgcgcatccagatctgctaccagcaggccagcagcagctacaagatccagatggccgaggtgggcggcctggccaagaccatggtgcagagcatgaccctgctggagaaccagctggtggagaagctgtgggtgctgaaggtgctgcagcacctgagcaccagcgaggtgaactgcaccatcatgatgaaggcccaggccgccagcggcatctgcacccacctgaatgaccctgaccccagcggccagctgctcttccgcagcagcgagatcctgtggaacctgctggagaagagcagcaaggaggaggtgatccagcagctgagcaacctggagtgcctgctggccctgaaggaggtgttcaagaacctcttcatgaggggcttcagccactatgaccggcagctgagaaatgacatcctggtgatcaccaccatcatcgcccagaaccctgaggcccccatgattgaatgtggcttcaccaaggacctgatcctgtttgccaccttcaatgaggtgaagagccagaacctgctggtgaagggcctgaagctgagcaacagctatgaggactttgagctgaagaagctgctcttcaacgtcatcgtcatcctgtgcaaggacctgcccaccgtgcagctgctgattgatggcaaggtgatcctggccctcttcacctacgtgaagaagccagagaagcagaagatcatcgactggagcgctgcccagcacgaggagctgcagctgcacgccatcgccaccctgagctctgtggcccccctgctgattgaggagtacatgagctgccagggcaatgcccgggtgctggccttcctggagtggtgtgagagcgaggaccccttcttcagccacggcaacagcttccacggcaccggcggccggggcaacaagtttgcccagatgagatacagcctgcggctgctgcgggctgtggtgtacctggaggatgaaacagtgaacaaggacctgtgtgagaagggcaccatccagcagatgattggcatcttcaagaacatcatcagcaagcccaatgagaaggaggaggccatcgtgctggagatccagagcgacatcctgctgatcctgagcggcctgtgtgagaaccacatccagaggaaggagatctttggaacagaaggagtggacatcgtgctgcacgtgatgaagacagaccccaggaagctgcagagcggcctgggctacaacgtgctgctcttcagcaccctggacagcatctggtgctgcatcctgggctgctaccccagcgaggactacttcctggagaaggagggcatcttcctgctgctggacctgctggccctgaaccagaagaagttctgcaacctgatcctgggcatcatggtggagttctgtgacaaccccaagacagctgcccacgtgaatgcctggcagggcaagaaggaccagacagctgccagcctgctgatcaagctgtggaggaaggaggagaaggagctgggcgtgaagagggacaagaatggcaagatcatcgacaccaagaagcccctcttcaccagcttccaggaggagcagaagatcatccccctgcctgccaactgccccagcattgctgtgatggatgtgtctgagaacatccgggccaagatctatgccatcctgggcaagctggactttgagaacctgcccggcctgtctgctgaggactttgtgaccctgtgcatcatccaccgctacctggacttcaagatcggggagatctggaatgagatctatgaggagatcaagctggagaagctgcggcctgtgaccacagacaagaaggccctggaggccatcaccacagccagcgagaacatcggcaagatggtggccagcctgcagagcgacatcatcgagagccaggcctgccaggacatgcagaatgagcagaaggtgtatgccaagatccaggccacccacaagcagcgggagctggccaacaagtcctgggaggacttcctggcccggaccagcaatgccaagaccctgaagaaggccaagagcctgcaggagaaggccatcgaggccagccgctaccacaagaggccccagaatgccatcttccaccagacccacatcaagggcctgaacaccaccgtgcccagcggcggcgtggtgacagtggagagcaccccagcccggctggtgggcggccccctggtggacacagacatcgccctgaagaagctgcccatccggggcggggccctgcagagggtgaaggctgtgaagatcgtggatgcccccaagaagagcatccccacctag

SEQ ID NO: 37121 - DNA, 456 bp, Artificial Sequence
  Description of Artificial Sequence: Synthetic coding sequence
atgaggatggcccccacagagagcacagagggccggcggctgtggccaggcccccgggagggcggcagcggcaaggagaccaccagcgagaagctgagcaacctgccccggccccacagctacagccccaagagagcagatgctgagagcttccggggcgtgcctgctgccttcaagaagtgccgggaggtgttccgggcctgctggggcagccgggagctgctcttcctgttcaaggccatcagcgaggccggccctgcccagaacagctgtggcatcaccctggagaaggccggcggcctggaggacaccggcagccactggctgtcctgggcccgctgcaaggtgctgtacatcaatggcttcacagacccctggaaggatgcccaggcctggatcctgattgtgtcctgcaagaagggcaagggcaccccagagcgggagggcaggaactag

SEQ ID NO: 37122 - DNA, 510 bp, Artificial Sequence
  Description of Artificial Sequence: Synthetic coding sequence
atgggcagctgtggctgggccctgacccagagcgactggtgccccttcaagaagaggaagaggcaccagagatgtgcccacagcgagaccaggcacatgaggacccagaggcagggcggctacctgcaggcccgggagcggggcctgggggaggccaacccagcctatgccctgatcctggacttccagcccccagagctgcagaacctgtctgagatgggcatcaaccacgagctgggctacagcagcatcatccccatgatgaagagggccttcagcgcctgtggcaccctgggcctcatcatgagcggcatctttgacaaccctggccccatcaagaacaccctgaagaaggccttcaccatgctgtggagcttcaccgtgtacacccggctggagagcctgcgggtggccctgagcaatgaggagatggtgcccttcatcttccacctgaagacccagacagccaacatgctgagcggccccatcagcacccccatgctgctgtag

SEQ ID NO: 37123 - DNA, 1317 bp, Artificial Sequence
  Description of Artificial Sequence: Synthetic coding sequence
atggatgtggagatccaggacaccccaggcaagatcagcatcagcaagaggagcatcctgtctggaacagtggagaacatcgactacccccactactgtgacctgctgaggaagatgaacatgccctttgtgaagggcctggagaacagacacaactacggccgctttgagaagaagtgcaacccagccttcctgaagttccacccctacccaccttctgtgctgcctgactaccacctgcatgacccctaccccccaccctacggcccccactaccccctcttccccctgagagatgatgtgaccctgggggacagctgcagcggcttcatgagccctggaggagatgctgacctgaaccctggcattggaagaaccatccccaccctggtggacttcagtgatgtgaagccccagcaccgggtgcccaggccagacaccggcttccagaccaccatcaagaggcagaagatcctgtctgaggagctgcagcagaacagacgctggaacagccgggaggtgcctgacatcagcatccgggcccggctgggcggctggaccagccccctgaaggtgacccccctgcagccccaccacgagggccgcagcctgagccacatcttcacctttgatgaggaggccacctgcacagatgaaggagagcccctggtgcagaccaacaagaagtgcaatgccaaggacagcttctacaagagcagcacccagaaggcctatgaagatgtgccctgggacaagatgctgccccccaagctggtgcctgaggagaccaccctggagaagacagctgaccccatcagccagtgcttcaccctgaagcgctacaagggcgtgcctgccatcacccagatggtgggggagctgtgggaccgcttccagaccaggagcttcctggcccctgtgaagcccatcaactttgtgagcagcagcagccgcagcaagtacatccccctgtacacaggccacgtgcagagcaccaatgctgatgatgtggacaaccccctgggggacatcgccagcctggccaagcagcgctacagcaagcccctgtacaccaacaccagcagagctgccaacatccctggctacaccgggaaggtgcacttcaccgccacccacccagccaacagcaacatccccagcaccacccccagcccagacagcgagctgcacagggtcttccagaaggagatggctgtggacctcttccgccaccaggcccccctgagccggctggtgaccaccgtgcggccctacaaccccttcaacaagaaggacaaggagaccatcgactactag

SEQ ID NO: 37124 - DNA, 144 bp, Artificial Sequence
  Description of Artificial Sequence: Synthetic coding sequence
atgctgcagttcctgctgggcttcaccctgggcaatgtggtgggcatgtacctggcccagaactatgacatccccaacctggccaagaagctggaggagatcaagaaggacctggatgccaagaagaagccacccagcgcctag

SEQ ID NO: 37125 - DNA, 315 bp, Artificial Sequence
  Description of Artificial Sequence: Synthetic coding sequence
atgggccgcagcccctgcttcttcaagagcttcaagggcaagctgcacaaggacaggagcccagaccccagcaccctggccagcccccaccccagcacagaggcccggcggcctgtggaggccggcagcgctgagtggacctggggctggatgaagaggctgcccccagccagcctgagccctggcatcgccatgagctgctacagcggggacagcatgctgcagaagtacaaggtgaagaatgcctaccgcctgcactggcagggccgggaggagcccggggccagcacctttgccagcctggtgttccagtag

SEQ ID NO: 37126 - DNA, 315 bp, Artificial Sequence; identical to SEQ ID NO: 37125
  Description of Artificial Sequence: Synthetic coding sequence

SEQ ID NO: 37127 - DNA, 255 bp, Artificial Sequence
  Description of Artificial Sequence: Synthetic coding sequence
atggcctctgtgcccagcatcggctgcctgctggccaggaaccagtactacaggaagagctctgtgtcctctgtgagcagcctgaccagcagtgacagcgtgaacttcattgatgatgacaagccccagcagggcctgcctgaggtggccgagagcacctggtggttcaagagcttcttccacagcgagcctgtgctgagcaatgtgcgcatcaaggacctgagcgccaccggcagcctgagcggccgctcctag

SEQ ID NO: 37128 - DNA, 246 bp, Artificial Sequence
  Description of Artificial Sequence: Synthetic coding sequence
atggcctctgtgcccagcatcggctgcctgctggccaggaaccagtactacaggaagagctctgtgtcctctgtgagcagcctgaccagcagtgacagcgtgaacttcattgatgatgacaagccccagcagggcctgcctgaggtggccgagagcacctggtggttcaagagcttcttccacagcgagcctgtgctgagcaatgtgcgcatcaaggacctgagcgccaccggcatgaacagctag

SEQ ID NO: 37129 - DNA, 399 bp, Artificial Sequence
  Description of Artificial Sequence: Synthetic coding sequence
atggccgagaagccccaccagaacagctgcaacagcgtgcggcagctgttcaagaccaagcagctggtgacccaccgggaccggggcagctgcacccaccgggcccagggcctgctggccgcccggaccacagccctgcagaggagccccctgcagcaggagatctgggagagcaccacagccctgaacctgcccagcgccctggccccccagggcctgacagccaaggatgcccacttcctgggggacacagaccccatccaggagggcgcccgggaccatgctgctgggggccccttccaggaccggcaggcctctgtggccgcccagaccctgtcctgggagcggggccagggcttcagccgccaccacggcaaccacctgctgtacagccactag

SEQ ID NO: 37130 - DNA, 690 bp, Artificial Sequence
  Description of Artificial Sequence: Synthetic coding sequence
atggccgccctgggccacctggccggggaggccgctgctgcccctggccctggcaccccctgtgccagcagaggagcccggctgcccggccctgtgagcagcgccaggaaccccagcacagtgtgcctgtgcccagagcagcccacctgcagcaatgctgacagccgggcccaccccctgggagatgagggcggcacagccagcaagaagcagaagaacaagaagaagaccaggaacagagcctctgtggccaatggaggagagaaggccagcgagaagctggcccctgaggaggtgcccctgtctgctgaggcccaggcccagcagctggcccaggagctggcctggtgtgtggagcagctggagctgggcctgaagaggcagaagcccacccccaagcagaaggagcaggccatcggggccatccgcaccctgcggagcaagaggacccccctgcccaggaagaggcagctgatgcacagcctgtttggagactaccgggcccagatggaggccgagtggagggaggccctgcgggccctgcgggccgccgcctacagcgcccaggtgcagcctgtggatggagccaccaggaagaagagccagagggtgtgccggcccaggagcatctggagggccaaggccaccctggacatgccagatgaggagttccgcttcaacttcttctag

SEQ ID NO: 37131 - DNA, 606 bp, Artificial Sequence
  Description of Artificial Sequence: Synthetic coding sequence
atggagaatggcttcaccatgtgccagacaggccggcagcaccctgtggcctgtggcctgcacctgagcggcggcaaggaggacctgaatgacctgaggatggagggcgtgaccaccctggtgcccagcggcagcaagttcaaccagggccggcccacctacccagctgagccccaggccaaggtgaccctgaacatctgcagccgctgtgcccggctgcagggcgacaacctggaggagaggacagaggagagcctgcccatcctgcacagcccagatgagaagatcccagacagctttgacagcctgcccggcacagaggaggccctgatggaggagggagatgaatttgagaaggccagcaagctgaccggccctggagaggccagcagtggagtgggccacagcctgaagaactacatggaggaggatgagagcctgaagcagctgcaggtggtgcaccagccctggatcctgcccagcgacacagaaagtgaaggagtggaggccgagcaggagaagcacctgctgaaccagaacctgtgtggctgggacagcgagttctgcatcttccacaccctggccagcttcctgatctacaagtag

SEQ ID NO: 37132 - DNA, 1284 bp, Artificial Sequence
  Description of Artificial Sequence: Synthetic coding sequence
atgaccaagctgatcacagagaccccagaccagcccatccccttcctgattgaccacctgcagagcaagcagggcaacagaggccagctgcagaggaccctgagcggcagcgctgccctgtgggccgagagcgagaagtctgagagcaagggcacccggcgggacttccgctcctatgacaagccctggcagctgaatgccaagaagcccaagaagagcaagagtgacctggccgtgagcaacatcagcccccccagcccagacagcaagagcctgcccaggtctgtggagcaccccaagtggaactggaggaccaagccccagagccgggactttgatgagctgaaccacatcctgcaggagagcaagaagctgggcaaggccctggagaacctgagccgcagcatcgccatcagtgatgagctggacaaggagaccgtgaccttcaacagcagcctgctgcggccccgggtgattggagagtggattggccgggaggagaatgatgctgaccccctggccgctgagatgctgcagccccccatccccaggagcaagaatgaccagtgggagagtgaagattctggcagcagccctgctggcagcctgaagatggagcccaagaacaagggcctgaagcagcagcagcagcagcacaagaagctgctggccgccatgctgagccaggacagctttgagagcatccacagccccaccccatctgtgacagaagaagatattgacaatgaagatgatgccatggagctgctggaggacctgaatgacctgaggatggagggcgtgaccaccctggtgcccagcggcagcaagttcaaccagggccggcccacctacccagctgagccccaggccaaggtgaccctgaacatctgcagccgctgtgcccggctgcagggcgacaacctggaggagaggacagaggagagcctgcccatcctgcacagcccagatgagaagatcccagacagctttgacagcctgcctggaacagaggaggccctgatggaggagggagatgaatttgagaaggccagcaagctgactggacctggagaggccagcagcggcgtgggccacagcctgaagaactacatggaggaggatgagagcctgaagcagctgcaggtggtgcaccagccctggatcctgcccagcgacacagagagcgagggcgtggaggccgagcaggagaagaggtctgctgacctgctgctgtgtgtgccctgcagcagctgccccaccctggtgtacagcggcctgtag

SEQ ID NO: 37133 - DNA, 864 bp, Artificial Sequence
  Description of Artificial Sequence: Synthetic coding sequence
atggccagccacccccagacccgcatccaggcctacctggagaagaacaagattggccccctgtttgaggagctgatgaccaagctgatcacagagaccccagaccagcccatccccttcctgattgaccacctgcagagcaagcagggcaacagaggccagctgcagaggaccctgagcggcagcgctgccctgtgggccgagagcgagaagtctgagagcaagggcacccggcgggacttccgctcctatgacaagccctggcagctgaatgccaagaagcccaagaagagcaagagtgacctggccgtgagcaacatcagcccccccagcccagacagcaagagcctgcccaggtctgtggagcaccccaagtggaactggaggaccaagccccagagccgggactttgatgagctgaaccacatcctgcaggagagcaagaagctgggcaaggccctggagaacctgagccgcagcatcgccatcagtgatgagctggacaaggagaccgtgaccttcaacagcagcctgctgcggcccagggtcatcggggagtggattggccgggaggagaatgatgctgaccccctggccgctgagatgctgcagccccccatccccaggagcaagaatgaccagtgggagagcgaggacagcggcagcagccctgctggcagcctgaagatggagcccaagaacaagggcctgaagcagcagcagcagcagcacaagaagctgctggccgccatgctgagccaggacagctttgagagcatccacagccccacccccagcgtgacagaggaggacatcgacaatgaagatgatgccatggagctgctgggcaacttcaagaactag

SEQ ID NO: 37134 - DNA, 1617 bp, Artificial Sequence
  Description of Artificial Sequence: Synthetic coding sequence
atgagcagccccctggccagcgagctgtctgagctggccgccctgcggcccggcttccggctgagcgcccctcatgcccgggtggccccccgggccgccacccacgcccggggccggggccgggccagccatgctggccagccccggctgcggagcagctgccccggccccagccctgggaagagaagagtggtgcccagcggcggggcccagccccgggtgctgcctgccctgagcagccgcagccacctgttccccatggccagccacccccagacccgcatccaggcctacctggagaagaacaagattggccccctgtttgaggagctgatgaccaagctgatcacagagaccccagaccagcccatccccttcctgattgaccacctgcagagcaagcagggcaacagaggccagctgcagaggaccctgagcggcagcgctgccctgtgggccgagagcgagaagtctgagagcaagggcacccggcgggacttccgctcctatgacaagccctggcagctgaatgccaagaagcccaagaagagcaagagtgacctggccgtgagcaacatcagcccccccagcccagacagcaagagcctgcccaggtctgtggagcaccccaagtggaactggaggaccaagccccagagccgggactttgatgagctgaaccacatcctgcaggagagcaagaagctgggcaaggccctggagaacctgagccgcagcatcgccatcagtgatgagctggacaaggagaccgtgaccttcaacagcagcctgctgcggcccagggtcatcggggagtggattggccgggaggagaatgatgctgaccccctggccgctgagatgctgcagccccccatccccaggagcaagaatgaccagtgggagagcgaggacagcggcagcagccctgctggcagcctgaagatggagcccaagaacaagggcctgaagcagcagcagcagcagcacaagaagctgctggccgccatgctgagccaggacagctttgagagcatccacagccccacccccagcgtgacagaggaggacatcgacaatgaagatgatgccatggagctgctggaggacctgaatgacctgaggatggagggcgtgaccaccctggtgcccagcggcagcaagttcaaccagggccggcccacctacccagctgagccccaggccaaggtgaccctgaacatctgcagccgctgtgcccggctgcagggcgacaacctggaggagaggacagaggagagcctgcccatcctgcacagcccagatgagaagatcccagacagctttgacagcctgcccggcacagaggaggccctgatggaggagggagatgaatttgagaaggccagcaagctgaccggccctggagaggccagcagtggagtgggccacagcctgaagaactacatggaggaggatgagagcctgaagcagctgcaggtggtgcaccagccctggatcctgcccagcgacacagaaagtgaaggagtggaggccgagcaggagaagaggtctgctgacctgctgctgtgtgtgccctgcagcagctgccccaccctggtgtacagcggcctgtag

SEQ ID NO: 37135 - DNA, 390 bp, Artificial Sequence
  Description of Artificial Sequence: Synthetic coding sequence
atggccagccacccccagacccgcatccaggcctacctggagaagaacaagattggccccctgtttgaggagctgatgaccaagctgatcacagagaccccagaccagcccatccccttcctgattgaccacctgcagagcaagcagggcaacagaggccagctgcagaggaccctgagcggcagcgctgccctgtgggccgagagcgagaagtctgagagcaagggcacccggcgggacttccgctcctatgacaagccctggcagctgaatgccaagaagcccaagaagagcaagagtgacctggccgtgagcaacatcagcccccccagcccagacagcaagagctgcaaggaggtgtcctacagcaatgccatccagagcatgtag

SEQ ID NO: 37136 - DNA, 1359 bp, Artificial Sequence
  Description of Artificial Sequence: Synthetic coding sequence
atggccagccacccccagacccgcatccaggcctacctggagaagaacaagattggccccctgtttgaggagctgatgaccaagctgatcacagagaccccagaccagcccatccccttcctgattgaccacctgcagagcaagcagggcaacagaggccagctgcagaggaccctgagcggcagcgctgccctgtgggccgagagcgagaagtctgagagcaagggcacccggcgggacttccgctcctatgacaagccctggcagctgaatgccaagaagcccaagaagagcaagagtgacctggccgtgagcaacatcagcccccccagcccagacagcaagagcctgcccaggtctgtggagcaccccaagtggaactggaggaccaagccccagagccgggactttgatgagctgaaccacatcctgcaggagagcaagaagctgggcaaggccctggagaacctgagccgcagcatcgccatcagtgatgagctggacaaggagaccgtgaccttcaacagcagcctgctgcggcccagggtcatcggggagtggattggccgggaggagaatgatgctgaccccctggccgctgagatgctgcagccccccatccccaggagcaagaatgaccagtgggagagcgaggacagcggcagcagccctgctggcagcctgaagatggagcccaagaacaagggcctgaagcagcagcagcagcagcacaagaagctgctggccgccatgctgagccaggacagctttgagagcatccacagccccacccccagcgtgacagaggaggacatcgacaatgaagatgatgccatggagctgctggaggacctgaatgacctgaggatggagggcgtgaccaccctggtgcccagcggcagcaagttcaaccagggccggcccacctacccagctgagccccaggccaaggtgaccctgaacatctgcagccgctgtgcccggctgcagggcgacaacctggaggagaggacagaggagagcctgcccatcctgcacagcccagatgagaagatcccagacagctttgacagcctgcccggcacagaggaggccctgatggaggagggagatgaatttgagaaggccagcaagctgaccggccctggagaggccagcagtggagtgggccacagcctgaagaactacatggaggaggatgagagcctgaagcagctgcaggtggtgcaccagccctggatcctgcccagcgacacagaaagtgaaggagtggaggccgagcaggagaagaggtctgctgacctgctgctgtgtgtgccctgcagcagctgccccaccctggtgtacagcggcctgtag

SEQ ID NO: 37137 - DNA, 624 bp, Artificial Sequence
  Description of Artificial Sequence: Synthetic coding sequence
atggccgaggacctggatgagctgctggatgaggtggagagcaagttctgcaccccagacctgctgcggcggggcatggtggagcagcccaagggctgcggcggcggcacccacagcagtgacaggaaccaggccaaggccaaggagaccctgcggagcacagagaccttcaagaaggaggatgacctggacagcctcatcaatgagatcctggaggagcccaacctggacaagaagcccagcaagctgaagagcaagagcagcggcaacacctctgtgcgggccagcattgagggcctgggcaagagctgcagccctgtgtacctgggcggcagcagcatcccctgtggcatcggcaccaacatctcctggagggcctgtgaccacctgcgctgcatcgcctgtgacttcctggtggtgtcctatgatgactacatgtgggacaagagctgtgactacctgttcttcaggaacaacatgcctgagttccacaagctgaaggccaagctgatcaagaagaagggcacccgggcctatgcctgccagtgctcctggaggaccatcgaggaggtgacagacctgcagacagaccaccagctgcgctgggtgtgtgggaagcactag

SEQ ID NO: 37138 - DNA, 309 bp, Artificial Sequence
  Description of Artificial Sequence: Synthetic coding sequence
atggcccaggacttcagccagcacccccagacaggcatcatcagaagacaccgcttctacagccccaagcccctgagcaccaccccccggggccagagcttcctgctgagccggcaggccaaggtggccacctgggaccccatgctgagcccagacttccagcccaagagcgccttcaagctgacctggacagcccagcccccctgcctgtctgtgacccccagccagggccagaccttccaccccaacagccctgagggggagctgcccccagacctgacagagaacacctgccccagccaggcctag

SEQ ID NO: 37139 - DNA, 558 bp, Artificial Sequence
  Description of Artificial Sequence: Synthetic coding sequence
atgtggaagctgggccggggccgggtgctgctggatgagcccccagaggaggaggatggcctgcggggcggccccccacctgctgctgctgctgctgcccaggcccaggtgcagggcgccagcttccggggctggaaggaggtgaccagcctcttcaacaaggatgatgagcagcacctgctggagcgctgcaagagccccaagagcaagggcaccaacctgcggctgaaggaggagctgaaggccgagaagaagagcggcttctgggacaacctggtgctgaagcagaacatccagagcaagaagccagatgaaattgagggctgggagccccccaagctggccctggaggacatctctgctgaccctgaggacacagtgggcggccaccccagctggagcggctgggaggatgatgccaagggcagcaccaagtacaccagcctggccagcagcgccaacagcagccgctggagcctgcgggctgctggccgcctggtgtccatccggcggcagagcaagggccacctgacagacagccctgaggaggccgagtag

SEQ ID NO: 37140 - DNA, 597 bp, Artificial Sequence
  Description of Artificial Sequence: Synthetic coding sequence
atgtggaagctgggccggggccgggtgctgctggatgagcccccagaggaggaggatggcctgcggggcggccccccacctgctgctgctgctgctgcccaggcccaggtgcagggcgccagcttccggggctggaaggaggtgaccagcctcttcaacaaggatgatgagcagcacctgctggagcgctgcaagagccccaagagcaagggcaccaacctgcggctgaaggaggagctgaaggccgagaagaagagcggcttctgggacaacctggtgctgaagcagaacatccagagcaagaagccagatgaaattgagggctgggagccccccaagctggccctggaggacatctctgctgaccctgaggacacagtgggcggccaccccagctggagcggctgggaggatgatgccaagggcagcaccaagtacaccagcctggccagcagcgccaacagcagccgctggagcctgcgggctgctggccgcctcatcaaggaggtgtggatcaacttcagccagctgatcatctccttcaggaagcactgcctggcccactaccgggagctgcggctgtgcatcaagtactag

SEQ ID NO: 37141 - DNA, 597 bp, Artificial Sequence; identical to SEQ ID NO: 37140
  Description of Artificial Sequence: Synthetic coding sequence

SEQ ID NO: 37142 - DNA, 480 bp, Artificial Sequence
  Description of Artificial Sequence: Synthetic coding sequence
atgaggaagaatgaaagctacctgaaccagcctgccccacccatccccatccccaccctgagcctgatgggcggctgccgggagcactttgagaaccactggaagggccgggcccgctggctgatgcctgtgatcccagccctgtgggaggccaaggccggccgcagccctgaggtgcgcagcagcaagccagcctggcccacctggaggaaccccatcttcaccaagaacaccaagatcagccaggtgctggagctgttcctgaactaccagagcctcatctgtgccctggagaagcagaagaggcagaagggcagcctggccatcttctgctggagcttccagggcggctgtgtgtccaagaggccagatgtgcccagcctgaagagccagaagcccaagaggaagaggatcactggaaggaagaggctgagcaagggcttctggagcctgctcttcagcaacctgggccgcttctag

SEQ ID NO: 37143 - DNA, 480 bp, Artificial Sequence; identical to SEQ ID NO: 37142
  Description of Artificial Sequence: Synthetic coding sequence

SEQ ID NO: 37144 - DNA, 1899 bp, Artificial Sequence
  Description of Artificial Sequence: Synthetic coding sequence
atgagcaacctgaagatgaaggaggccgccctgatctacctggacagaagtggcggcctgcagaagttcattgatgactgcaagtactacaatgacagcaagcagagctatgctgtgtaccgcttcaagatcctgatcaaccccagtgatgtggtggagctggatgctgagctgggcaaccacatcctgcaccagcccctgaaggctgctgaggtgttccagagcgtgtgcttcatcgctgtgaagaccctgagcctgattggccagctgcagacagagacccagatcaacatcgtgctgaagctgacccacctgccccccctgcccagctatggcctggacctgtgtgagttccccctggactacaccagccagcgcttctacatgatgcagggcatcgtgattgccatgaccaccatcaccaagtacacccagggcgcccgcttcctgtgcagtgatgaggcctgccccctgagcaagggcttccagtacatccgggtgcacgtgcctggggccacagaaagtgccaccatcagaaatgacttcctgtgcaacctgtgtgccagcagcctgcaggaggacaggaagttccgggtgctgggggacaagcagatcgtggagatcatcgccaccaaggccctgcgggccttccagggctacagcaacaaccagcccttccgcttccagagcctgaccatcttcctgagagatgaatctgtgaacaagatgaacattggaaatgagtacaagatcatcggcatccccacctgtgtgaagaccagccagacagctgtgtgcatcgaggccaacagcatcaccttctgcaacagcaaggtgcccagcggcatcagtgacaacttccgctgcctgctgagcctgaccagcagcagctgctggaagttcaccgccatcctggccaacatctttgccagccagatcaccccacctggcacctacaacctgctgaagctgtgcctgctgatgagcctggtgcagaccacagacaggaacaaggagctggaggactgcctggacatcctgatcatcaccagtgacaccctgctgattgaccggctgctgaacttcagcatcaacctggtgccccggggcatccgccacctggtgtccacagagatcttccccaccctgagcaggaacaagtatggcaccggggctgtgtccatccaggccggcagcgccctgctggccaagggcggcatctgcttcatcggggacctggccagccacaagaaggacaagctggagcagctgcagacagtgctggagagccgcagcatcaccgtgtacatccctgggaagaagtttggagaggacatcgaccagcagatgaccttccctgtgcagtgcagcttctggagctttgtggatgtggacagcagcagcagaagaaatgcccagaagatcaacaccctgattggccagatggactgcagcctcatcccagccaacctggtggaggccttcggcctgctgatcaactgcaatgaaagcagcccctgccaccccttcctgcccaccgtgcagcacaccctgaacaaggccatcaaccctgagggcctcttctacgccgccagccggcagttcaccacagaggactttgagaagctgctggcctttgccaagaacctgaatgtggagttcagcctggaggccgagaggatgacccacggctactacctggccagccgccgcatcagaacaggctctgtgtgtggcagcaagctgagcgccagcgccctgaagtacctggtgttcctgtctgaggcccacgcccggctgaacctgaggaacaaggtgctgaaggaggatgtgctgattgctgccctgctgtttgagaccagcctgaccctgaagtatggaaatgagctgaactactag

SEQ ID NO: 37145 - DNA, 1002 bp, Artificial Sequence
  Description of Artificial Sequence: Synthetic coding sequence
atgatgcagggcatcgtgattgccatgaccaccatcaccaagtacacccagggcgcccgcttcctgtgcagtgatgaggcctgccccctgagcaagggcttccagtacatccgggtgcacgtgcctggggccacagaaagtgccaccatcagaaatgacttcctgtgcaacctgtgtgccagcagcctgcaggaggacaggaagttccgggtgctgggggacaagcagatcgtggagatcatcgccaccaaggccctgcgggccttccagggctacagcaacaaccagcccttccgcttccagagcctgaccatcttcctgagagatgaatctgtgaacaagatgaacattggaaatgagtacaagatcatcggcatccccacctgtgtgaagaccagccagacagctgtgtgcatcgaggccaacagcatcaccttctgcaacagcaaggtgcccagcggcatcagtgacaacttccgctgcctgctgagcctgaccagcagcagctgctggaagttcaccgccatcctggccaacatctttgccagccagatcaccccacctggcacctacaacctgctgaagctgtgcctgctgatgagcctggtgcagaccacagacaggaacaaggagctggaggactgcctggacatcctgatcatcaccagtgacaccctgctgattgaccggctgctgaacttcagcatcaacctggtgccccggggcatccgccacctggtgtccacagagatcttccccaccctgagcaggaacaagtatggcaccggggctgtgtccatccaggccggcagcgccctgctggccaagggcggcatctgcttcatcggggacctggccagccacaagaaggacaagctggagcagctgcagacagtgctggagagccgcagcatcaccgtgtacatccctgggaagaagtttggagaggacatcgaccagcagatgaccttccccagcgtgcagttcctggtgttctgctag

SEQ ID NO: 37146 - DNA, 1773 bp, Artificial Sequence
  Description of Artificial Sequence: Synthetic coding sequence
atgagcaacctgaagatgaaggaggccgccctgatctacctggacagaagtggcggcctgcagaagttcattgatgactgcaagtactacaatgacagcaagcagagctatgctgtgtaccgcttcaagatcctgatcaaccccagtgatgtggtggagctggatgctgagctgggcaaccacatcctgcaccagcccctgaaggctgctgaggtgttccagagcgtgtgcttcatcgctgtgaagaccctgagcctgattggccagctgcagacagagacccagatcaacatcgtgctgaagctgacccacctgccccccctgcccagctatggcctggacctgtgtgagttccccctggactacaccagccagcgcttctacatgatgcagggcatcgtgattgccatgaccaccatcaccaagtacacccagggcgcccgcttcctgtgcagtgatgaggcctgccccctgagcaagggcttccagtacatccgggtgcacgtgcctggggccacagaaagtgccaccatcagaaatgacttcctgtgcaacctgtgtgccagcagcctgcaggaggacaggaagttccgggtgctgggggacaagcagatcgtggagatcatcgccaccaaggccctgcgggccttccagggctacagcaacaaccagcccttccgcttccagagcctgaccatcttcctgagagatgaatctgtgaacaagatgaacattggaaatgagtacaagatcatcggcatccccacctgtgtgaagaccagccagacagctgtgtgcatcgaggccaacagcatcaccttctgcaacagcaaggtgcccagcggcatcagtgacaacttccgctgcctgctgagcctgaccagcagcagctgctggaagttcaccgccatcctggccaacatctttgccagccagatcaccccacctggcacctacaacctgctgaagctgtgcctgctgatgagcctggtgcagaccacagacaggaacaaggagctggaggactgcctggacatcctgatcatcaccagtgacaccctgctgattgaccggctgctgaacttcagcatcaacctggtgccccggggcatccgccacctggtgtccacagagatcttccccaccctgagcaggaacaagtatggcaccggggctgtgtccatccaggccggcagcgccctgctggccaagggcggcatctgcttcatcggggacctggccagccacaagaaggacaagctggagcagctgcagacagtgctggagagccgcagcatcaccgtgtacatccctgggaagaagtttggagaggacatcgaccagcagatgaccttccctgtgcagtgcagcttctggagctttgtggatgtggacagcagcagcagaagaaatgcccagaagatcaacaccctgattggccagatggactgcagcctcatcccagccaacctggtggaggccttcggcctgctgatcaactgcaatgaaagcagcccctgccaccccttcctgcccaccgtgcagcacaccctgaacaaggccatcaaccctgagggcctcttctacgccgccagccggcagttcaccacagaggactttgagaagctgctggcctttgccaagaacctgaatgtggagttcagcctggaggccgagaggatgacccacggctactacctggccagccgccgcatcagaacaggctctgtgtgtggcagcaagctgagcgccagcgccctgaagtacctgtag

SEQ ID NO: 37147 - DNA, 2046 bp, Artificial Sequence
  Description of Artificial Sequence: Synthetic coding sequence
atgagcaacctgaagatgaaggaggccgccctgatctacctggacagaagtggcggcctgcagaagttcattgatgactgcaagtactacaatgacagcaagcagagctatgctgtgtaccgcttcaagatcctgatcaaccccagtgatgtggtggagctggatgctgagctgggcaaccacatcctgcaccagcccctgaaggctgctgaggtgttccagagcgtgtgcttcatcgctgtgaagaccctgagcctgattggccagctgcagacagagacccagatcaacatcgtgctgaagctgacccacctgccccccctgcccagctatggcctggacctgtgtgagttccccctggactacaccagccagcgcttctacatgatgcagggcatcgtgattgccatgaccaccatcaccaagtacacccagggcgcccgcttcctgtgcagtgatgaggcctgccccctgagcaagggcttccagtacatccgggtgcacgtgcctggggccacagaaagtgccaccatcagaaatgacttcctgtgcaacctgtgtgccagcagcctgcaggaggacaggaagttccgggtgctgggggacaagcagatcgtggagatcatcgccaccaaggccctgcgggccttccagggctacagcaacaaccagcccttccgcttccagagcctgaccatcttcctgagagatgaatctgtgaacaagatgaacattggaaatgagtacaagatcatcggcatccccacctgtgtgaagaccagccagacagctgtgtgcatcgaggccaacagcatcaccttctgcaacagcaaggtgcccagcggcatcagtgacaacttccgctgcctgctgagcctgaccagcagcagctgctggaagttcaccgccatcctggccaacatctttgccagccagatcaccccacctggcacctacaacctgctgaagctgtgcctgctgatgagcctggtgcagaccacagacaggaacaaggagctggaggactgcctggacatcctgatcatcaccagtgacaccctgctgattgaccggctgctgaacttcagcatcaacctggtgccccggggcatccgccacctggtgtccacagagatcttccccaccctgagcaggaacaagtatggcaccggggctgtgtccatccaggccggcagcgccctgctggccaagggcggcatctgcttcatcggggacctggccagccacaagaaggacaagctggagcagctgcagacagtgctggagagccgcagcatcaccgtgtacatccctgggaagaagtttggagaggacatcgaccagcagatgaccttccctgtgcagtgcagcttctggagctttgtggatgtggacagcagcagcagaagaaatgcccagaagatcaacaccctgattggccagatggactgcagcctcatcccagccaacctggtggaggccttcggcctgctgatcaactgcaatgaaagcagcccctgccaccccttcctgcccaccgtgcagcacaccctgaacaaggccatcaaccctgagggcctcttctacgccgccagccggcagttcaccacagaggactttgagaagctgctggcctttgccaagaacctgaatgtggagttcagcctggaggccgagaggatgacccacggctactacctggccagccgccgcatcagaacaggctctgtgtgtggcagcaagctgagcgccagcgccctgaagtacctggtgttcctgtctgaggcccacgcccggctgaacctgaggaacaaggtgctgaaggaggatgtgctgattgctgccctgctgtttgagaccagcctgaccctgaagtacggggccaccgtcttctgtgtggccccaaatgctgtgttcccctttgagctgtacaatgaggagtacctggagcagagggacctgtacctgacccagtgccagcagcagctggagcagttcatcgccacctacggccctggcaccaccatcttcagcagtgatgaatag

SEQ ID NO: 37148 - DNA, 1857 bp, Artificial Sequence
  Description of Artificial Sequence: Synthetic coding sequence
atgattgccagcaccaccatggtgcgcagcgccaaggtgtgcttcatcgctgtgaagaccctgagcctcatcggccagctgcagacagagacccagatcaacatcgtgctgaagctgacccacctgccccccctgcccagctatggcctggacctgtgtgagttccccctggactacaccagccagcgcttctacatgatgcagggcatcgtcatcgccatgaccaccatcaccaagtacacccagggcgcccgcttcctgtgcagtgatgaggcctgccccctgagcaagggcttccagtacatccgggtgcacgtgcctggggccacagagagcgccaccatcagaaatgacttcctgtgcaacctgtgtgccagcagcctgcaggaggacaggaagttccgggtgctgggggacaagcagatcgtggagatcatcgccaccaaggccctgcgggccttccagggctacagcaacaaccagcccttccgcttccagagcctgaccatcttcctgagagatgagagcgtgaacaagatgaacattggaaatgagtacaagatcatcggcatccccacctgtgtgaagaccagccagacagctgtgtgcatcgaggccaacagcatcaccttctgcaacagcaaggtgcccagcggcatcagtgacaacttccgctgcctgctgagcctgaccagcagcagctgctggaagttcaccgccatcctggccaacatctttgccagccagatcaccccacctggcacctacaacctgctgaagctgtgcctgctgatgagcctggtgcagaccacagacaggaacaaggagctggaggactgcctggacatcctgatcatcaccagtgacaccctgctgattgaccggctgctgaacttcagcatcaacctggtgccccggggcatccgccacctggtgtccacagagatcttccccaccctgagcaggaacaagtatggaactggagctgtgtccatccaggccggcagcgccctgctggccaagggcggcatctgcttcatcggggacctggccagccacaagaaggacaagctggagcagctgcagacagtgctggagagccgcagcatcaccgtgtacatccctgggaagaagtttggagaagatattgaccagcagatgaccttccctgtgcagtgcagcttctggagctttgtggatgtggacagcagcagcagaagaaatgcccagaagatcaacaccctcatcggccagatggactgcagcctcatcccagccaacctggtggaggccttcggcctgctgatcaactgcaatgaaagcagcccctgccaccccttcctgcccaccgtgcagcacaccctgaacaaggccatcaaccctgagggcctcttctatgctgccagccggcagttcaccacagaagattttgagaagctgctggcctttgccaagaacctgaatgtggagttcagcctggaggccgagaggatgacccacggctactacctggccagccgccgcatcagaactggatctgtgtgtggcagcaagctgagcgccagcgccctgaagtacctggtgttcctgtctgaggcccacgcccggctgaacctgaggaacaaggtgctgaaggaggatgtgctgattgctgccctgctgtttgagaccagcctgaccctgaagtatggagccaccgtcttctgtgtggccccaaatgctgtgttcccctttgagctgtacaatgaggagtacctggagcagagggacctgtacctgacccagtgccagcagcagctggagcagttcatcgccacctacggccctggcaccaccatcttcagcagtgatgaatag

SEQ ID NO: 37149 - DNA, 624 bp, Artificial Sequence
  Description of Artificial Sequence: Synthetic coding sequence
atgatgcaccagatctacagctgcagtgatgaaaatattgaggtgttcaccaccgtcatccccagcaaggtgagcagccctgcccggcggcgggccaagagcagccagcacctgctgaccaagaatgtggtgattgaaagtgacctgtacacccaccagcccctggagctgctgccccacagaggagaccggcgggaccccggggacagaagaagatttggccgcctgcagacagcccggcccccaacagcccacccagccaaggccagcgcccggcctgtgggcatcagcgagcccaagaccagcaacctgtgtggcaacagagcctacggcaagagcctcatcccccctgtgccccgcatctctgtgaagaccagcgccagcgccagcctggaggccacagccatgggcacagagaagggagctgtgctgatgaggggcagccgccacctgaagaagatgacagaggagtacccagccctgccccagggcgctgaggccagcctgcccctgaccggcagcgccagctgtggggtgcccggcatcctgaggaagatgtggaccaggcacaagaagaagtcagaatatgtgggcgccaccaacagcgcctttgaggccgactag

SEQ ID NO: 37150 - DNA, 1125 bp, Artificial Sequence
  Description of Artificial Sequence: Synthetic coding sequence
atgggctgcagcagcagcgccctgaacaaggccggggacagcagccgcttccccagcgtgaccagcaatgagcacttcagcacagctgaggagagcgagagctgctttgcccagcccaagccccacgccctgggccgggagagcacagtggatggaaatgtgcagcgggagagccggccccccctgcagaagctgaaggtgtctgctgagcccacagccaacggggtgaagcccctgcaggagcagcccctggccaaggatgtggcccctggaagagatgccacagaccagagcggcagcacagagaagacccagcccggggagggcctggaggagagcggccccccccagcccggcggcaaggaggatgccccagctgctgagggcaagaagaaggatgctggggccggcacagaggccgagagcctgaagggaaatgctgaggcccagcccctgggccctgaggccaagggccagcccctgcaggccgctgtggagaaggacagcctgcgggctgtggaggtgacagagaacccccagacagctgctgagatgaagcccctgggcaccacagaaaatgtgctgaccctgcagattgctggggagctgcagccccagggcaccgtgggcaaggatgagcaggcccccctgctggagaccatcagcaaagaaaatgaaagccctgagatcctggagggcagccagtttgtggagacagctgaggagcagcagctgcaggccaccctgggcaaggaggagcagccccagctgctggagcgcatccccaaggaaaatgtgaccccagaggtgctggacaggagccagctggtggagaagcctgtgatgaatgaccccttccacaagaccccagagggccctggcaacatggagcagatccagcctgagggcatcgtgggctccatggagcacccagccagaaatgtggaggccggggcctacgtggagatgatccggaacatccacaccaatgaggaggaccagagaattgaaggagagaccggggagaaggtggagacagacatggagaatgagaaggtgtctgagggcgctgagaccaaggaggaggagaccggggaggtggtggacctgtctgctgccacctag

SEQ ID NO: 37151 - DNA, 171 bp, Artificial Sequence
  Description of Artificial Sequence: Synthetic coding sequence
atgggctgcagcagcagcgccctgaacaaggccggggacagcagccgcttccccagcggggagaccggggagaaggtggagacagacatggagaatgagaaggtgtctgagggcgctgagaccaaggaggaggagaccggggaggtggtggacctgtctgctgccacctag

SEQ ID NO: 37152 - DNA, 960 bp, Artificial Sequence
  Description of Artificial Sequence: Synthetic coding sequence
atggccatctgcccagagctggcccagacagacaagagcgccctggccaacctgagtgatgaaacagagaccctgaagaacagcacagatgaggtgcagaccagcagcagcttcagcagcagcggcggccggcagagcagccccctgaccagcggcagcaagctggagcgggagaagcagacccccagcctggagcagggcgacacccagagcgagctgctggactacaagaactatgagaagaagctgagcaagaagtggatcaactacctgaagctgaaggacagcaactttgagcggcaccagcctgacaccaagctgcccacagagatcaccagggtgtctgatgaggagctgaatgccctgcagagctactgcaccatgaagatcaacctgatccacagaagaggagacagcaagaagaagaccagcagccgccacaagaagctgcacctgggcctggatgtggaggccagcgagagagatgccttcagctgcaccgtgcctgatgagctgctgaaccgcatctacttcaagaacatgaggaccacccccaagcaggaggccgccgccaagcagcacatctcctaccagtgcccctactgcaacaggaagagagctgagctggccctgagcgccttcctgaagcagaagaagaccctgctggagagcttcctgctgcaggagagaattgatgagcacctgcacaccaaggacttcctgacccgcatcggggaggcccaccaggacttcccccggctgagtgatgacccccgcatcatctggaagaggctgacagagaagagccacatccgctacagcggctttgagaggagtgaaacagagcagaagctgcagagagatggcaacagcgcctgccacctgcccttcagcctgcccttcctgaagaggctgaccctcatcaagccagagctggtgattgtgaatgacaacgtgtag

SEQ ID NO: 37153 - DNA, 693 bp, Artificial Sequence
  Description of Artificial Sequence: Synthetic coding sequence
atggagaagccccggctgtaccagaagtacaagatcagccgggtgtggtggaggctgcccgtcatcccagccactggagaggccgaggacaaccggctgaaccctgagggccggggctgtggggagcccaggagccgccactgcaccccagcctggaccaccacagccaagctgcacctgaagaccatcatcagcctgcagcccctgaacatgtaccagatggagcccggggtgggcagcatccgcaccagccctgccctgcagagccccccagccctgacccggggccccagcgcctgggacacagccatcaggaaggccctgagctttggagtgggcctgggcgtgctggtgctggtgtgcctcttctaccactttgtgaccctggcccccatcctgcagtttgccagcctgccctgcctgctggaggccggggcccagatgagccgccaccctgtgaccacccaggtgtgtgtgatgcctgcccggctgagcctgggcagcggcatcagcaggaacctgctgcggctgtctgtgtgccacttcaccctgctgctgcccttccgcagcctgcggccctgccccctgagcagccgggacatggtgctgtcctatgagctgtggctgctgtgtgacttctacatcgcccccccagacagcagcggcagcggcatctgcaagaaggccatctag

SEQ ID NO: 37154 - DNA, 318 bp, Artificial Sequence
  Description of Artificial Sequence: Synthetic coding sequence
atgagcctgaagtcctggcacccccagagcaagaccaagagggtgggcgccagcgagggcaacccccagtggggcagcggctccatggaggcccccctgctgagcagcttcctgccccccctggccagcgaggccgagctgaccggcaacacctggttcctgcaccgctgcagctgcatcctgaacctggaggagagcatggacagcgactggggcgcctggtggggcgtgtccctgccccggcgggcccccttcctgatctacggcagtgatggcccctggtgcacccaggccggcttccctggctggggccactag

SEQ ID NO: 37155 - DNA, 318 bp, Artificial Sequence; identical to SEQ ID NO: 37154
  Description of Artificial Sequence: Synthetic coding sequence

SEQ ID NO: 37156 - DNA, 1098 bp, Artificial Sequence
  Description of Artificial Sequence: Synthetic coding sequence
atgatgggcagaagaagagcctttgctgtggatggaagagatggagctggggagggcctggcccggggctgcatcgtgcctggggtgaccagcacctaccgccgcatcccagatgctgcccacggctgcagctcctgggagcggggggacaagttccggggcgtgggccgggaggccctcttcctgaagctggccagccgggacagcggcgtggagatggctgtgggggacagccccctggccgccctgcccggcctgagccaggacagcctggactttgagagcagcggcagcagcgagcccccagcccaggtgggccgcctgctggccagccagaagctgggggaggtgctggagaggagccggcggctgcccacagcccccaccagcctgagcggccagcacaggagcctgcggctggccagcaagccagagcgggaggtgcccctgggcgccggccagcaggagagcatggaggccgacacagacctggaggccggcctggaggaggaggccgtgggcggcctgggccctggggcctgggcctgcctgcccggccagggcctgcgctacctggagcacctgtgcctggtgctggagcagatggcccggctgcagcagctgtacctgcagctgcgcatccagaggcctcctggggaccctggagaggaggagagcacccgggcccccctgcccagccccctgcacaccccaggcaacagaggccagggcccctgggagctgctgagccagacagagcacactggagccaaggccgccagcccccccaaggtggaggtgcccagcgccaaccccccccggctgcctgagacccctgtggagcccacctaccacctgcccagcagccagggccacaagagggacatcagccactgggacaaggtgaaggtgctgctgaaccgcatctgcagaagaagccaccaccaccctgagcccccagcccccccagatggcagtgacccccgcatcgagagccgggacctgcctgagcggccccagtgccggccccacaggaagaccttcatgcccagcctggtggtgaagaagcagagggccaagaacctgtctgtgggctag

SEQ ID NO: 37157 - DNA, 987 bp, Artificial Sequence
  Description of Artificial Sequence: Synthetic coding sequence
atggctgtgggggacagccccctggccgccctgcccggcctgagccaggacagcctggactttgagagcagcggcagcagcgagcccccagcccaggtgggccgcctgctggccagccagaagctgggggaggtgctggagaggagccggcggctgcccacagcccccaccagcctgagcggccagcacaggagcctgcggctggccagcaagccagagcgggaggtgcccctgggcgccggccagcaggagagcatggaggccgacacagacctggaggccggcctggaggaggaggccgtgggcggcctgggccctggggcctgggcctgcctgcccggccagggcctgcgctacctggagcacctgtgcctggtgctggagcagatggcccggctgcagcagctgtacctgcagctgcgcatccagaggcctcctggggaccctggagaggaggagagcacccgggcccccctgcccagccccctgcacaccccaggcaacagaggccagggcccctgggagctgctgagccagacagagcacactggagccaaggccgccagcccccccaaggtggaggtgcccagcgccaaccccccccggctgcctgagacccctgtggagcccacctaccacctgcccagcagccagggccacaagagggacatcagccactgggacaaggtgaaggtgctgctgaaccgcatctgcagaagaagccaccaccaccctgagcccccagcccccccagatggcagtgacccccgcatcgagagccgggacctgcctgagcggccccagtgccggccccacaggaagaccttcatgcccagcctggtggtgaagaagcagaggaagaagcccttctgccgcctgcggcccctgggcgcccctggggaccccggctggaggggcctggccgtgaagagcagcagccccagcgccctgctgctgctgctgcacatcgccaggaagagctgctag

SEQ ID NO: 37158 - DNA, 1074 bp, Artificial Sequence
  Description of Artificial Sequence: Synthetic coding sequence
atgatgggcagaagaagagcctttgctgtggatggaagagatggagctggggagggcctggcccggggctgcatcgtgcctggggtgaccagcacctaccgccgcatcccagatgctgcccacggctgcagctcctgggagcggggggacaagttccggggcgtgggccgggaggccctcttcctgaagctggccagccgggacagcggcgtggagatggctgtgggggacagccccctggccgccctgcccggcctgagccaggacagcctggactttgagagcagcggcagcagcgagcccccagcccaggtgggccgcctgctggccagccagaagctgggggaggtgctggagaggagccggcggctgcccacagcccccaccagcctgagcggccagcacaggagcctgcggctggccagcaagccagagcgggaggtgcccctgggcgccggccagcaggagagcatggaggccgacacagacctggaggccggcctggaggaggaggccgtgggcggcctgggccctggggcctgggcctgcctgcccggccagggcctgcgctacctggagcacctgtgcctggtgctggagcagatggcccggctgcagcagctgtacctgcagctgcgcatccagaggcctcctggggaccctggagaggaggagagcacccgggcccccctgcccagccccctgcacaccccaggcaacagaggccagggcccctgggagctgctgagccagacagagcacactggagccaaggccgccagcccccccaaggtggaggtgcccagcgccaaccccccccggctgcctgagacccctgtggagcccacctaccacctgcccagcagccagggccacaaggtgaaggtgctgctgaaccgcatctgcagaagaagccaccaccaccctgagcccccagcccccccagatggcagtgacccccgcatcgagagccgggacctgcctgagcggccccagtgccggccccacaggaagaccttcatgcccagcctggtggtgaagaagcagagggccaagaacctgtctgtgggctag

SEQ ID NO: 37159 - DNA, 132 bp, Artificial Sequence
  Description of Artificial Sequence: Synthetic coding sequence
atggccaagaacaagctgcggggccccaagagcagaaatgtgttccacatcgccagccagaagaacttcaaggccaagaacaaggccaagcctgtgaccaccaacctgaagaaggtgctgcacttctcctag

SEQ ID NO: 37160 - DNA, 297 bp, Artificial Sequence
  Description of Artificial Sequence: Synthetic coding sequence
atggccaagaacaagctgcggggccccaagagcagaaatgtgttccacatcgccagccagaagaacttcaaggccaagaacaaggccaagcctgtgaccaccaacctgaagaagatcaacatcatgaatgaggagaaggtgaacagagtgaacaaggcctttgtgaatgtgcagaaggagctggcccactttgccaagagcatcagcctggagcccctgcagaaggagctgatcccccagcagagacatgagagcaagcctgtggatgaggccacccggctgatggccctgctgtag

SEQ ID NO: 37161 - DNA, 297 bp, Artificial Sequence; identical to SEQ ID NO: 37160
  Description of Artificial Sequence: Synthetic coding sequence

SEQ ID NO: 37162 - DNA, 297 bp, Artificial Sequence; identical to SEQ ID NO: 37160
  Description of Artificial Sequence: Synthetic coding sequence

SEQ ID NO: 37163 - DNA, 297 bp, Artificial Sequence; identical to SEQ ID NO: 37160
  Description of Artificial Sequence: Synthetic coding sequence

SEQ ID NO: 37164 - DNA, 138 bp, Artificial Sequence
  Description of Artificial Sequence: Synthetic coding sequence
atggccaagaacaagctgcggggccccaagagcagaaatgtgttccacatcgccagccagaagaacttcaaggccaagaacaaggccaagcctgtgaccaccaacctgaagaagatcaacatcatgaatgaggagtag

SEQ ID NO: 37165 - DNA, 297 bp, Artificial Sequence; identical to SEQ ID NO: 37160
  Description of Artificial Sequence: Synthetic coding sequence

SEQ ID NO: 37166 - DNA, 132 bp, Artificial Sequence; identical to SEQ ID NO: 37159
  Description of Artificial Sequence: Synthetic coding sequence

SEQ ID NO: 37167 - DNA, 2160 bp, Artificial Sequence
  Description of Artificial Sequence: Synthetic coding sequence
atggccggcggcgtgtggggccgcagccgggcccgggaggcccctgtgggcgccctgaccctgacagccctgacagagggcatccgggcccggcagggccagccccagggcccccccagcgctggcccccagcccaagtcctgggaggtgaagccagaggccgagccccagacccaggccctgacagcccccagcgaggccgagcccggccgcggggccaccgtgcctgaggccggcagcgagccctgcagcctgaacagcgccctggagcccgcccctgagggcccccaccaggtgccccagagctcctgggaggagggcgtgctggccgacctggccctgtacacagctgcctgcctggaggaggccggctttgctggcacccaggccaccgtgctgaccctgagcagcgccctggaggcccggggggagcggctggaggaccaggtgcacgccctggtgcggggcctgctggcccaggtgcccagcctggccgagggccggccctggagggctgccctgcgggtgctgagcgccctggccctggagcacgccagagatgtggtgtgtgccctgctgcccaggagcctgcctgctgacagagtggccgctgagctgtggaggagcctgagcaggaaccagagggtgaatggccaggtgctggtgcagctgctgtgggccctgaagggggccagcggccctgagccccaggccctggccgccacccgggccctgggggagatgctggccgtgtctggctgtgtgggcgccacccggggcttctacccccacctgctgctggccctggtgacccagctgcacaagctggcccggagcccctgcagcccagacatgcccaagatctgggtgctgagccaccggggccccccccacagccacgccagctgtgctgtggaggccctgaaggccctgctgactggagatggcggccgcatggtggtgacctgcatggagcaggccggcggctggaggcggctggtgggcgcccacacccacctggagggcgtgctgctgctggccagcgccatggtggcccacgccgaccaccacctgcggggcctgtttgctgacctgctgccccggctgcggtctgcagatgacccccagaggctgacagccatggccttcttcaccggcctgctgcagagccggcccacagcccggctgctgcgggaggaggtgatcctggagcggctgctgacctggcagggcgaccctgagcccaccgtgcgctggctgggcctgctgggcctgggccacctggccctgaacagaaggaaggtgagacatgtgtccaccctgctgcctgccctgctgggcgccctgggggagggagatgcccggctggtgggcgccgccctgggcgccctgcggcggctgctgctgcggccccgggcccctgtgcggctgctgtctgctgagctgggcccccggctgccccccctgctggatgacacccgggacagcatccgggccagcgctgtgggcctgctgggcaccctggtgcggcggggccggggcggcctgcggctgggcctgcggggccccctgaggaagctggtgctgcagagcctggtgcccctgctgctgcggctgcatgaccccagcagagatgctgctgagagcagcgagtggaccctggcccgctgtgaccacgccttctgctggggcctgctggaggagctggtgacagtggcccactatgacagccctgaggccctgagccacctgtgctgccgcctggtgcagcgctacccaggccacgtgcccaacttcctgagccagacccagggctacctgcggagcccccaggaccccctgcggcgggctgctgctgtgctgattggcttcctggtgcaccacgccagccctggctgtgtgaaccaggacctgctggacagcctcttccaggacctgggccgcctgcagagcgaccccaagccagctgtggccgccgccgcccacgtgtctgcccagcaggtggccatgctggcccgggcccggggctgcccccggggcccccggctgctgcgcatcgcccccaggcctgcccggcccccacctgtgtttgctgacagccccttccagaggagatctgtggccggccgctggggctgcagcggcccccggcgggcctag

SEQ ID NO: 37168 - DNA, 885 bp, Artificial Sequence
  Description of Artificial Sequence: Synthetic coding sequence
atggccctgctgaccccccagggcgtgaaggaggtgttccagctgcagaggccccagggccgggagcggctgcggcggctgctgaactgggaggagtttgatgagcagagggacagccgccgcagcatcctgctggacaccctgtatgagagcatcatctttgctgtgggcaagggcttcccctgggtggaggtggcccaggtggtgaagttcacagaggagctgctgcgggagaccaagggctgcagcatcacagaagctgtgaccatcctgggcaacaagctgcgggactaccggggccacttcaacaccacccacctgctggccctgtgtgactacttccaccacaccttcatccgccactacaagctgtaccagtatgtgctgggccaggaccagcaggtggacctgactgtggcccacctggaggtgtgcatgccaccccaccccctgcccctggccgagggcatggaccgggacctgtggatccacgagcagcaggtggccaccctgacagaggccgaggcccagaagagagcagatgtgctgctgctgaaggaggccctgcggctggagcgggagaacagcctgcagaaggcctttgctgctgctgccccagcccagcccggccaggtgctggagcggcaggagctggagagcctcatctgccaggccgtgcacacccagatggagctgctgcaggagctgctgcagaggcagatccagaacacctttgccatcctggacctgaagctgcagaagaagaccctgaacctgaatgcccccacccccatccccccacccatcaccagccatgctggccaggaggaggccctgaagccccagagggccagcaagggcaagaaggccaaggccaggaagtag

SEQ ID NO: 37169 - DNA, 1143 bp, Artificial Sequence
  Description of Artificial Sequence: Synthetic coding sequence
atggattctggctgctggctgtttggaggagaatttgaagattctgtgtttgaggagaggcctgagaggagaagtggccccccagccagctactgtgccaagctgtgtgagccccagtggttctatgaggagacagagagcagtgatgatgtggaggtgctgaccctgaagaagttcaagggggacctggcctaccgccggcaggagtaccagaaggccctgcaggagtacagcagcatcagcgagaagctgagcagcaccaactttgccatgaagagagatgtgcaggagggccaggcccgctgcctggcccacctgggccgccacatggaggccctggagattgctgccaacctggagaacaaggccaccaacacagaccacctgaccaccgtgctgtacctgcagctggccatctgcagcagcctgcagaacctggagaagaccatcttctgcctgcagaagctgatcagcctgcaccccttcaacccctggaactggggcaagctggccgaggcctacctgaacctgggccctgccctgtctgctgccctggccagcagccagaagcagcacagcttcaccagcagtgacaagaccatcaagagcttcttcccccacagcggcaaggactgcctgctgtgcttccctgagaccctgcctgagagcagcctcttctctgtggaggccaacagcagcaacagccagaagaatgagaaggccctgaccaacatccagaactgcatggccgagaagcgggagaccgtgctgattgagacccagctgaaggcctgtgccagcttcatccgcacccggctgctgctgcagttcacccagccccagcagaccagctttgccctggagaggaacctgcggacccagcaggagattgaggacaagatgaagggcttctccttcaaggaggacaccctgctgctgattgctgaggtgatgggagaggacatccctgagaagatcaaggatgaggtgcaccctgaggtgaagtgtgtgggctctgtggccctgacagccctggtgacagtgagcagcgaggagtttgaggacaagtggttcaggaagatcaaggaccacttctgcccctttgagaaccagttccacacagagatccagatcctggcctag

SEQ ID NO: 37170 - DNA, 636 bp, Artificial Sequence
  Description of Artificial Sequence: Synthetic coding sequence
atgctgcggcagagctgcagcttccctgtgaccagcctgcctgccctgggcggcgtgtgtggccgggagggcgctggagctgaggtgcccccagctgcctgtggctgtgagggccgggaccctgacacagagaggagctgtggccgcagcagcactggaggctgcagcccctgcagcggccctggccccagcagccccaggaccagcagaggagccctgagccccagcctgggccgcctcttcccccacctgcaggtggtgatcaagctgcgcatccagctggccccagctgtgcacctggccctgcccacctgcagcctgctgaccagcagcccccccctggagggctgctgccaccggctgaatgaggaggccgaggtgcagaggggcttccggcccatcgctgtggagctggagtttgagaaccagcccctgggcgctgagacccggctgagaaatggaagaagagctggggtgaagaggtctgagggccggggccaggtgcggcccggccaggtgcgcagcacaggccctgagggcggcctgaccaggatggagaggaaggccgcccggctgcagtgggacagcggcagcatcaagatgtctgaaaatgagcagctgtgggaggagccctag

SEQ ID NO: 37171 - DNA, 261 bp, Artificial Sequence
  Description of Artificial Sequence: Synthetic coding sequence
atgtggccaccctgtggcaccctgcggaccctggccctggcccggagcagaggagcccgggcctgcagcggagatggaggagtgtcctacacccagggccagagccctgagcccaggacccgggagtacttctactacgtggaccaccagggccagctgttcctggatgacagcaagatgaagaacttcatcacctgcttcaagggaaatgctgtgccccccagccctgcccccagcttcagcctgcccggcagcccctag

SEQ ID NO: 37172 - DNA, 468 bp, Artificial Sequence
  Description of Artificial Sequence: Synthetic coding sequence
atgggccctggggacttccgccgctgccgggagcgcatcagccagggcctgcagggcctgcccggccgggcagagctgtggttcccccccaggcctgcctgtgacttctttggagatggccgcagcacagacatccaggaggaggccctggccgccagccccctgctggaggacctgcggcggcggctgacccgggccttccagtgggccgtgcagagggccatcagcagaagagtgcaggaggccgctgctgctgctgctgcccgggaggagcagagctggacaggagtggaggccaccctggcccggctgcgggcagagctggtggagatgcacttccagaaccaccagctggcccggaccctgctggacctgaacatgaaggtgcagcagctgaagaaggagtatgagctggagatcaccagtgacagccagagccccaaggatgatgctgccaaccctgagtag

SEQ ID NO: 37173 - DNA, 672 bp, Artificial Sequence
  Description of Artificial Sequence: Synthetic coding sequence
atgaggcccctgggcaagggcctgctgcctgctgaggagctgatccgcagcaacctgggcgtgggccgcagcctgcgggactgcctgagccagagcggcaagctggccgaggagctgggcagcaagaggctgaagccagccaagtttggaacagagggcaaggagcgggtggagcagaggacagagcggcagaggacaggcagcagcaaggagcccaggatgcagatcatctgcagaagacgctggagggagcccccaccccggctgctgtggggctgcctgatgccccgggcccagcccctgctgcacgtgacagcctatgagaacacaggccactgggagcggctggcctctgtggtgagcagcaagacccagcagcccaccgtcatcagccacagcagcatcagcatcaccttcagccactaccccccagccaccctggacagcttcctggtgctggagcccatcaagctgtttcctgtgagcagcctgcggagccccctgtgcctgaactgtggcagctgccgggagagcatccgcatcagcggggagctgattggaaatgcccacagccctgccccacccaggaccccagagctggagaccctgggctgggacaagcaggccgtgctgagcggggcccaggtgatcctggtgtgtgccgaggtgtag

SEQ ID NO: 37174 - DNA, 306 bp, Artificial Sequence
  Description of Artificial Sequence: Synthetic coding sequence
atgaggacccccaagaggaccaggagccccaagaccaaggtgtccctgcggggggagaccctgaccctgcagctgaccaccgtgtccctggacaccaggcacatggtgaagagatgtgatgaaagacatggccggcccctgccccacagccaggagagccagcacggcagcgccaccagcaagaaggctgtgcggggcacagctgacacagcccccctggagcgcatctctgctgcccggggctgggccctgcccatggaggccaccgtgtctgtgttccgggcccaccagtggcagtggaactag

SEQ ID NO: 37175 - DNA, 561 bp, Artificial Sequence
  Description of Artificial Sequence: Synthetic coding sequence
atggagctgagctgccccggcagccgctgccctgtgcaggagcagagggcccgctgggagaggaagagggcctgcacagcccgggagctgctggagacagaaagacgctaccaggagcagctgggcctggtggccacctacttcctgggcatcctgaaggccaagggcaccctgcggcccccagagcggcaggccctgtttggctcctgggagctgatctacggggccagccaggagctgctgccctacctggagggcggctgctggggccagggcctggagggcttctgccgccacctggagctgtacaaccagtttgctgccaacagcgagaggagccagaccaccctgcaggagcagctgaagaagaacaagggcttccgccgctttgtgcggctgcaggagggccggcctgagtttggaggcctgcagctgcaggacctgctgcccctgcccctgcagaggctgcagcagtatgagaacctggtggtggccctggccgagaacacaggccccaacagcccagaccaccagcagctgacccctgtgctgcccagctag

SEQ ID NO: 37176 - DNA, 1008 bp, Artificial Sequence
  Description of Artificial Sequence: Synthetic coding sequence
atggagctgagctgccccggcagccgctgccctgtgcaggagcagagggcccgctgggagaggaagagggcctgcacagcccgggagctgctggagacagaaagacgctaccaggagcagctgggcctggtggccacctacttcctgggcatcctgaaggccaagggcaccctgcggcccccagagcggcaggccctgtttggctcctgggagctgatctacggggccagccaggagctgctgccctacctggagggcggctgctggggccagggcctggagggcttctgccgccacctggagctgtacaaccagtttgctgccaacagcgagaggagccagaccaccctgcaggagcagctgaagaagaacaagggcttccgccgctttgtgcggctgcaggagggccggcctgagtttggaggcctgcagctgcaggacctgctgcccctgcccctgcagaggctgcagcagtatgagaacctggtggtggccctggccgagaacacaggccccaacagcccagaccaccagcagctgaccagggctgcccggctcatcagcgagacagcccagagggtgcacaccatcggccagaagcagaagaatgaccagcacctgcggcgggtgcaggccctgctgagcggccggcaggccaagggcctgaccagcggccgctggttcctgcggcagggctggctgctggtggtgcccccccacggggagccccggcccaggatgttcttcctgttcacagatgtgctgctgatggccaagccccggccccccctgcacctgctgcggagcggcacctttgcctgcaaggccctgtaccccatggcccagtgccacctgagccgggtgtttggccacagcggcggcccctgtggcggcctgctgagcctgtccttcccccatgagaagctgctgctgatgagcacagaccaggaggagctgagccgctggtaccacagcctgacctgggccatcagcagccagaagaactag

SEQ ID NO: 37177 - DNA, 900 bp, Artificial Sequence
  Description of Artificial Sequence: Synthetic coding sequence
atgctgggcgtgtgccagaccctgaagcagtacttcctgggcatcctgaaggccaagggcaccctgcggcccccagagcggcaggccctgtttggctcctgggagctgatctacggggccagccaggagctgctgccctacctggagggcggctgctggggccagggcctggagggcttctgccgccacctggagctgtacaaccagtttgctgccaacagcgagaggagccagaccaccctgcaggagcagctgaagaagaacaagggcttccgccgctttgtgcggctgcaggagggccggcctgagtttggaggcctgcagctgcaggacctgctgcccctgcccctgcagaggctgcagcagtatgagaacctggtggtggccctggccgagaacacaggccccaacagcccagaccaccagcagctgaccagggctgcccggctcatcagcgagacagcccagagggtgcacaccatcggccagaagcagaagaatgaccagcacctgcggcgggtgcaggccctgctgagcggccggcaggccaagggcctgaccagcggccgctggttcctgcggcagggctggctgctggtggtgcccccccacggggagccccggcccaggatgttcttcctgttcacagatgtgctgctgatggccaagccccggccccccctgcacctgctgcggagcggcacctttgcctgcaaggccctgtaccccatggcccagtgccacctgagccgggtgtttggccacagcggcggcccctgtggcggcctgctgagcctgtccttcccccatgagaagctgctgctgatgagcacagaccaggaggagctgagccgctggtaccacagcctgacctgggccatcagcagccagaagaactag

SEQ ID NO: 37178 - DNA, 171 bp, Artificial Sequence
  Description of Artificial Sequence: Synthetic coding sequence
atgaggcggccctgggagaagaaggaggccaccaggaaccccatcgccgaggtgctggccaggaagaagaggacagaggagctgatcagcctgcaggagcacggcagcaggaagcagaagatcaaggaggccagcatctcctgggccgagaccagccggcagattggatag

SEQ ID NO: 37179 - DNA, 222 bp, Artificial Sequence
  Description of Artificial Sequence: Synthetic coding sequence
atgcagtttgctgactggctgcaccccagcggctggaccatcgagatcctgaatgcctacggcatgggagacaggaagaggaccaacagcatgagcaaggaggccttcaccccagagcagctgcacctggagaaggagctgggggagatgaggctgcggcccaccgtgctgcacagccagacagaccaccagggcttccggcccatccccatgatgcagtag

SEQ ID NO: 37180 - DNA, 1131 bp, Artificial Sequence
  Description of Artificial Sequence: Synthetic coding sequence
atggccgagcggggcaggaagaggccctgtggccctggagaacatggccagagaattgagtggaggaagtggaagcagcagaagaaggaggagaagaagaagtggaaggacctgaagctgatgaagaagctggagcggcagagggcccaggaggagcaggccaagaggctggaggaggaggaggccgctgctgagaaggaggaccggggccggccctacaccctgtctgtggccctgcccggcagcatcctggacaatgcccagagccctgagctgcggacctacctggccggccagatcgcccgggcctgtgccatcttctgtgtggatgagatcgtggtgtttgatgaggagggccaggatgccaagacagtggagggggagttcaccggggtgggcaagaagggccaggcctgtgtgcagctggcccgcatcctgcagtacctggagtgcccccagtacctgaggaaggccttcttccccaagcaccaggacctgcagtttgctggcctgctgaaccccctggacagcccccaccacatgaggcaggatgaggagagcgagttccgggagggcatcgtggtggaccggcccaccaggcctggccacggcagctttgtgaactgtggcatgaagaaggaggtgaagattgacaagaacctggagcccggcctgcgggtgacagtgcggctgaaccagcagcagcacccagactgcaagacctaccacggcaaggtggtgagcagccaggaccccaggaccaaggccggcctgtactggggctacacagtgcggctggccagctgcctgtctgctgtgtttgctgaggcccccttccaggacggctatgacctgaccatcggcaccagcgagcggggcagtgatgtggccagcgcccagctgcccaacttcagacatgccctggtggtgtttggaggcctgcagggcctggaggccggggctgatgctgaccccaacctggaggtggccgagcccagcgtgctgtttgacctgtatgtgaacacctgccccggccagggcagcaggaccatcagaacagaggaggccatcctgatcagcctggccgccctgcagcccggcctcatccaggccggggcccggcacacctag

SEQ ID NO: 37181 - DNA, 1167 bp, Artificial Sequence
  Description of Artificial Sequence: Synthetic coding sequence
atggccgagcggggcaggaagaggccctgtggccctggagaacatggccagagaattgagtggaggaagtggaagcagcagaagaaggaggagaagaagaagtggaaggacctgaagctgatgaagaagctggagcggcagagggcccaggaggagcaggccaagaggctggaggaggaggaggccgctgctgagaaggaggaccggggccggccctacaccctgtctgtggccctgcccggcagcatcctgaccatgctgagcagaagaagctttgcccccacctggcctgtgcggctgcctgagcctgtgcccagctctgtgtggatgaggtcctggtgcctgatgagaagagccaggatgccccggctgtggaggggcaacagccaggagctggaggagggcgctggggtgaggacagctggccctgaccctgctgtgcctgaatgtccccagtacctgaggaaggccttcttccccaagcaccaggacctgcagtttgctggcctgctgaaccccctggacagcccccaccacatgaggcaggatgaggagagcgagttccgggagggcatcgtggtggaccggcccacccggcccggccacggcagctttgtgaactgtggcatgaagaaggaggtgaagattgacaagaacctggagcccggcctgcgggtgacagtgcggctgaaccagcagcagcacccagactgcaagacctaccacggcaaggtggtgagcagccaggaccccaggaccaaggccggcctgtactggggctacacagtgcggctggccagctgcctgtctgctgtgtttgctgaggcccccttccaggacggctatgacctgaccatcggcaccagcgagcggggcagtgatgtggccagcgccagcttccccaccagcggcatgctgctgtggtgcagcggggccagccgggtgtggaagctggagaggatgctgacccccacctggcgctggctgaaccctgtgagcagcctgacctgcaccagcatccctgtgctggcccgggtggccgtgcccagcgcccggaggaagcccagcagcagcccctggccaccctgcagcctggccagcagcagaagagtgcccggcaccccagagagcagcaagggccccaggacctctgtgaagcagcagtag

SEQ ID NO: 37182 - DNA, 279 bp, Artificial Sequence
  Description of Artificial Sequence: Synthetic coding sequence
atggccgaggagtgcccccgggcctgtgccgagcctgtggcccccaaggccacagcccctcctgagaggaccagtgactactacagagtgtctgctgacctgcccggccgcttcaacaaccctggctggttccggggctaccgcacccagaaggctgtgtctgtgtaccgcaccagcaaccaggcctacggcagccgggcccccaccgtgcatgagatgccccgggtggagtgcagcggcaccatcctgtccatgttcacctggaggaaggccagctag

SEQ ID NO: 37183 - DNA, 279 bp, Artificial Sequence; identical to SEQ ID NO: 37182
  Description of Artificial Sequence: Synthetic coding sequence

SEQ ID NO: 37184 - DNA, 411 bp, Artificial Sequence
  Description of Artificial Sequence: Synthetic coding sequence
atggccgaggagtgcccccgggcctgtgccgagcctgtggcccccaaggccacagcccctcctgagaggaccagtgactactacagagtgtctgctgacctgcccggccgcttcaacaaccctggctggttccggggctaccgcacccagaaggctgtgtctgtgtaccgcaccagcaaccaggcctacggcagccgggcccccaccgtgcatgagatgcccaaggtgttctaccccaacagcaacaagttcagccagcagctggccgccggcggcatgttcaggaacaacaccctgaatgtgtacctggagaagagcatcgtgactggaccagacaactgcatcaccagctgtgaccggctgaacttccaccccagctacaacatcaaccggcccagcatctgtgactag

SEQ ID NO: 37185 - DNA, 381 bp, Artificial Sequence
  Description of Artificial Sequence: Synthetic coding sequence
atgggcacagaggtgggcatctcctggaccagggtgggcaccggggccaccgtgggcctgctgcccccccacccccaccagcagatgcacagagatgaggaggacagtgatgtggatgtgaccttccagccctggcacaaggagatgctgcagcagctgctggtgatgctgagcagcacagtggccacccggccccagaaggccgcctgcccccaccaggagagccagagccacggcccccccaaggagagcgtgccctgggcccccacccagaggtctggaaatgctgagcagcgctgcagcggggagggcgccaggagaagaggccctgagacccggcccctgcggaccccagagggctgggccggccgggccccctag

SEQ ID NO: 37186 - DNA, 1563 bp, Artificial Sequence
  Description of Artificial Sequence: Synthetic coding sequence
atggcccccaagaagtctgtgtccaaggccggcaaggagctggaggtgaagaagaagggcggcaagaaggagcctgtggtggccgtggagccccccctggccaaggagatgaaggagttctaccacatccagatccgggacctggaggaccggctggcccgctaccagaggaagtgggatgagctggccgtgcaggagaagatgttccggcaggagtttgagcagctggccaacaacaagaaggagatcgtggccttcctgaagaggaccctgaaccagcaggtggatgagatcacagacctgaatgagcagctgcagaacctgcagctggccaaggagatggagaaggatgcctttgaggcccagctggcccaggtgagacatgagttccaggagaccaaggaccagctgaccacagagaacatcatcctgggcggcaagctggccgccctggaggagttccggctgcagaaggaggaggtgacagacaagttcaccctgctggaggagcaggtgaggaagcaggagaatgagttccgggactatgcctacaacctggagaagaagtctgtgctggacaaggaccggctgaggaaggagatcatccagagggtgaacctggtggccaatgagttccacaaggtgaccaccaacaggatgtgggagaccaccaagagggccatcaaggagaacaacggcatcaccctgcagatggcccgggtgtcccagcagggcatgaagctgctgcaggagaatgagcagctgaagggccggcagaacaacctgtgcaagcagctggagctgctggagaacacccagaaggtgatggcccggcacaagaggggccaccagaagatcatcctgatgctgaccaagaagtgccaggagcagcagcaggacaccaaggaggccgaggagctgcggctgctgctgagccagctggagcagaggagcctgcagctgcaggtggacaaccaggccctgaagagccagagggaccagctgagcctgcagctggagcagcagcaggtggacctgcagaggctgcagcaggagctggccaatgagcagaaggtgcgggccagcctggaggccgccctggtgcaggccaccagcttcctgcagaacatcctgcagatgcacagagatgaagaagattctgatgtggatgtgaccttccagccctggcacaaggagatgctgcagcagctgctggtgatgctgagcagcacagtggccacccggccccagaaggccgcctgcccccaccaggagagccagagccacggcccccccaaggagagccggcccagcatccagctgcccaggacaggcagcctgctgccccagctgagtgacatcaccccctaccagcccggggacctgggcctggtgccccggcaggtgcacatcccccccaacccccaggacctgcggctgctgagctacatcaccagggtgggcaccttccgggcccacagcagccctgagatgagggcccctggcagcctgaagaggctggagaagttcagcctgcctgaggtgcccctgcggcccaagtag

SEQ ID NO: 37187 - DNA, 210 bp, Artificial Sequence
  Description of Artificial Sequence: Synthetic coding sequence
atgtgctacgtggtgcccggctgcttcatctacatctgtggctgcacccgcatcaagagcacccacttcaacgggaagagccagatggtggacctgaagagccagagctgggacctggagcggctggagaacaagcccccacctgctgtgtatgacctggccgccaccaccagccagctgggggagtgggccaagagccgcatctggtag

SEQ ID NO: 37188 - DNA, 906 bp, Artificial Sequence
  Description of Artificial Sequence: Synthetic coding sequence
atggaggcccacgagatcatcgaggagccccacatcaccatggatgctgagaagcacccccccagcaaggaccccagcgctgaggacctgcaggagaaccacatcagcgagagcttcctgaagcccagcaccagcgagacccccctggagccccacaccagcgagagccccctggtgcccagccccagccagatccccctggaggcccacagccctgagacccaccaggagcccagcatcagcgagaccccatctgagacccccacctatgaggccagcctggacagccccatctctgtggtgcctgagaagcacctgaccctgcccccccagagccgggactatgtgtgcctgagcagcagtgacaccctgaaggaggacctgagcagcgagagcagcagcaatgaggtgccctggaccaggaggagcacccacctgtctgagagcgagagcctgcctgagcactgcctgagcggccccagcagccaggtgcaggtggacaccacagagaagcaggaggaggaggccggggaggtggagaagggcgtggatgccagtgacagcacagcccacacagcccagcccggccaccagctgggcaacacagcccggcctgtgtttcctgcccggcagacagagctggtggaggtggccaaggccatgcaccgggaggagtttggagcccaggtgaacaacctcttccagtgggagaaggatgctgccctgaatgccatccagacaggcctgtacatcggctggcgctgcccccactacctgtgggactgcttcagaattggagatgagagccgctgcttctgtggccacctgctgcgggagcaccgcatcatcagtgacatctctgtgccctgcaaggtgtcccagtgccgctgcttcatgttctgctag

SEQ ID NO: 37189 - DNA, 1209 bp, Artificial Sequence
  Description of Artificial Sequence: Synthetic coding sequence
atggaggcccacgagatcatcgaggagccccacatcaccatggatgctgagaagcacccccccagcaaggaccccagcgctgaggacctgcaggagaaccacatcagcgagagcttcctgaagcccagcaccagcgagacccccctggagccccacaccagcgagagccccctggtgcccagccccagccagatccccctggaggcccacagccctgagacccaccaggagcccagcatcagcgagaccccatctgagacccccacctatgaggccagcctggacagccccatctctgtggtgcctgagaagcacctgaccctgcccccccagagccgggactatgtgtgcctgagcagcagtgacaccctgaaggaggacctgagcagcgagagcagcagcaatgaggtgccctggaccaggaggagcacccacctgtctgagagcgagagcctgcctgagcactgcctgagcggccccagcagccaggtgcaggtggacaccacagagaagcaggaggaggaggccggggaggtggagaagggcgtggatgccagtgacagcacagcccacacagcccagcccggccaccagctgggcaacacagcccggcctgtgtttcctgcccggcagacagagctggtggaggtggccaaggccatgcaccgggaggagtttggagcccaggtgaacaacctcttccagtgggagaaggatgctgccctgaatgccatccagacaggcctgtacatcggctggcgctgcccccactacctgtgggactgcttcagaattggagatgagagccgctgcttctgtggccacctgctgcgggagcaccgcatcatcagtgacatctctgtgccctgcaaggtgtcccagtgccgctgcttcatgttctgcttcatccccagcaggcctgaggaggtgggggagttctggctgaagagaagagccacctttgaccccaaggcctggagggcccagtgccgctgcaagcacagccatgaggagcacgccgccaccggcccccacccctgccgccaccacggctgctgctgcggctgctttgagagcaacttcctgtgtgccgcctgtgaccggcgctgggaggagcacgagaccttctttgacacccagaagacccggcagaggggcggccggccccggggcacagacacagtgagcaactggcaccggcccctgtag

SEQ ID NO: 37190 - DNA, 273 bp, Artificial Sequence
  Description of Artificial Sequence: Synthetic coding sequence
atggaggcccacgagatcatcgaggagccccacatcaccatggatgctgagaagcacccccccagcaaggaccccagcgctgaggacctgcaggagaaccacatcagcgagagcttcctgaagcccagcaccagcgagacccccctggagccccacaccagcgagagccccctggtgcccagccccagccagatccccctggaggcccacagccctgagacccaccaggagcccagcatcagcgagaccccatctgagacccccacctactag

SEQ ID NO: 37191 - DNA, 591 bp, Artificial Sequence
  Description of Artificial Sequence: Synthetic coding sequence
atgcctggcatggtgcccccccacgtgcccccccagatgctgaacatcccccagaccagcctgcaggccaagcctgtggccccccaggtgcccagccctggaggagcccctggccagggcccctacccctacagcctgtctgagcccgcccccctgaccctggacaccagcggcaagaacctgacagagcagaacagctacagcaacatcccccatgagggcaagcacacccccctgtatgaaagaagcctgcccatcaacccagcccagagcggcagccccaaccacgtggacagcgcctacttccctggcagcagcaccagcagcagcagtgacaatgatgagggcagcggcggggccaccaagtacaccatctactggggcttccgggccacagaccaccacgtgcagggccgggacagccaggcccggggcacagctgcccactggcatggaggccacgtgtgcagccccaacgtgttctggaggatcagccacggccctgcccagcagctgaccttccccacagagcaggccgcccctcctgtgtgcccagccccagccagccggcggctgagcgcccctggatag

SEQ ID NO: 37192 - DNA, 3240 bp, Artificial Sequence
  Description of Artificial Sequence: Synthetic coding sequence
atggagtggctgctggaggacctgctgggcgccaagggggacatgggcctgctgtggggccagctgacccacgccctggcctgccgccactgcggcagcagctgcttccagagccctggcaacctggtgaccctcttcctgtttgtggtgtggcagatccagcgctggtggcagctgggccgcctgcggcagctgcacccctggtgcagcggcaacatggtgcagggcaaggagctgcccctgctgcaccgggtggccttcctggaccacctgtgcaagcagaagtctgaggtggaggaggagggggaggaggaggaggagggagaagatgaggccagcctggaccccctgaagccctgcagccccaccaaggaggcccccaccggggagcaggccaccccagccccaccccagcccagctgtggcagcgagggcctgctgaaggccatcggcatccctgagcagacagtgatgcagcctgtgagccccagccgctccttccccatcttccagatcctgaccagcttccctgtgcgccacaagatcgccagcggcaaccggcagcagcagaggaagagccagctgttctggggcctgcccagcctgcacagcgagagcctggaggccatcttcctgagcagcggcggccccagccccctgaagtggagcgtgtgcagctctgtgttcttcaacaagctggccttcctgcccaggagcaacctgctgctgccccagtaccacagcagcgcccagttcagcacccatggagcccacaccatggaggacctggagggcatggccccagacccccagctgctgcccccacccagcagccccagcgtgagcagcctgctgctgcacctgcggcccttccctgtggaccacaagggcgtgctgagcggggctgaggcccccacccagagccctggcaccagccccctggaggtgctgcccggctatgagacccacctggagaccaccggccacaagaagatgccccaggcctttgagccccccatgcccccaccctgccagagccctgccagcctgtctgagcccaggaaggtgtccccagagggcggcctggccatcagcaaggacttctggggcaccgtgggctaccgggagaagccccaggccagcgagagctccatgcctgtgccctgcccccccctggacagcctgcctgagctgcagcgggagagcagcctggaggaccccagccgctacaagccccagtgggagtgccgggagaacagcggcaacctgtgggcctttgagagccctgtgctggacctgaaccctgagctgagcggcaccagcccagaatgtgtgcccccagccagcgagaccccctggaagggcatgcagagccgggagaacatctgggtgcctgctgaccctgtgtccccacccagcctgcccagcgtgcccctgctggagagcctggtgatgggcccccagggcgtgctgtctgagagcaaggccctgtgggagaccatgggccagaaggagaacctgtgggccagtgacagcccagaccctgtgcacagcaccccacccaccaccctgatggagccccaccgcatcaaccctggagagtgcctggccaccagcgaggccacctggaaggacacagagcacagcaggaacagcagcgccagccgcagccccagcctggccctgagccccccaccagccctggcccctgagctgctgcgggtgcgctccatgggcgtgctgagtgacagcgaggcccgctgtggggacatccagaagaccaagaacagctgggccagcaagcacccagcctgcaacctgccccaggacctgcacggggccagccccctgggcgtgctgagtgacagccagagcatcgtgggggagatggagcagaaggagaactgtgtgcctgtgtttcctggccggggcagcagccccagcagcaacagcgtgtccaagagccacgtgtctgagcccatcgctgaccagagcaactacaagccagatggagaggccgtggagcagaggaagaaccactgggccacagagctgcctgcccccagcagcctgagcacccccctgcctgagccccacatcgacctggagctggtgtggagaaatgtgcagcagcgggaggtgccccagggccccagccccctggccgtggaccccctgcaccctgtgccccagccccccaccctggccgaggccgtgaagattgaaagaacccaccctggcctgcccaagggcgtgacctgccctggggtgaaggccgaggcccccctgagccagcgctggacagtgcctgagctgctgacccaccctggcatccacgcctggcagtggagccgggagctgaagctgcggctgaagaagctgcggcagagccctgccagccgggcccctggccccagccagagcttctgcagcagccccatcctgagcagcaccatcccagacttctggggcctgcccagctgccccccccagcagatctacccacccaacccctgcccccacagcagcagctgccacccccaggaggtgcagaggacagtgccccagcctgtgcagagcagccactgccaccacttccagagcagcagccagctgcagccccaggagagcggccgggcagagcagggcagccagagaggagagaagatgaagggcaagatggtgtcccaggtgcccagccagggcccctgtgtgcacatggaggccggcgtggactacctgagccctggccctggagagcccagcaacagcaaggtgctggtgtctgggaagaggaaggacaaggccagcgccagcagcagcgccaagaagcgggagcaccccaggaagcccaaggccggggaccacagaagaggaacagcccggctgggcctgagcacagtgacaggcaagaaccacccagcccaggcccggagcctggtggaggcccctgtgtccaccttcccccagaggagccagcaccggggccagagcagccagcacacagccctgccccagctgctgctgcccaaggccagcggcccccaggaccagcctgaggccggcagaagagccagtgacatcctgacccccaggcactgcaagcactgcccctgggcccacatggagaagtacctgtccttccccaccctgaaggccagcctgacccggggcctgcagaaggtgctggccaagtgcctggacaaccaccggcccctgcccaccaagagcagccagtag

SEQ ID NO: 37193 - DNA, 3021 bp, Artificial Sequence
  Description of Artificial Sequence: Synthetic coding sequence
atgctgaggaaggagctgcccctgctgcaccgggtggccttcctggaccacctgtgcaagcagaagtctgaggtggaggaggagggggaggaggaggaggagggggaggatgaggccagcctggaccccctgaagccctgcagccccaccaaggaggcccccactggagagcaggccaccccagccccaccccagcccagctgtggcagcgagggcctgctgaaggccatcggcatccctgagcagacagtgatgcagcctgtgagccccagccgctccttccccatcttccagatcctgaccagcttccctgtgcgccacaagatcgccagcggcaaccggcagcagcagaggaagagccagctgttctggggcctgcccagcctgcacagcgagagcctggaggccatcttcctgagcagcggcggccccagccccctgaagtggagcgtgtgcagcagcgtcttcttcaacaagctggccttcctgcccaggagcaacctgctgctgccccagtaccacagcagcgcccagttcagcacccacggggcccacaccatggaggacctggagggcatggccccagacccccagctgctgcccccacccagcagccccagcgtgagcagcctgctgctgcacctgcggcccttccctgtggaccacaagggcgtgctgtctggagctgaggcccccacccagagccctggcaccagccccctggaggtgctgcccggctatgagacccacctggagaccaccggccacaagaagatgccccaggcctttgagccccccatgcccccaccctgccagagccctgccagcctgtctgagcccaggaaggtgtccccagagggcggcctggccatcagcaaggacttctggggcaccgtgggctaccgggagaagccccaggccagcgagagctccatgcctgtgccctgcccccccctggacagcctgcctgagctgcagcgggagagcagcctggaggaccccagccgctacaagccccagtgggagtgcagagaaaattctggcaacctgtgggcctttgagagccctgtgctggacctgaaccctgagctgagcggcaccagcccagaatgtgtgcccccagccagcgagaccccctggaagggcatgcagagccgggagaacatctgggtgcctgctgaccctgtgagcccccccagcctgcccagcgtgcccctgctggagagcctggtgatgggcccccagggcgtgctgtctgagagcaaggccctgtgggagaccatgggccagaaggagaacctgtgggccagtgacagcccagaccctgtgcacagcaccccacccaccaccctgatggagccccaccgcatcaaccctggagaatgtctggccaccagcgaggccacctggaaggacacagagcacagcaggaacagcagcgccagccgcagccccagcctggccctgagccccccaccagccctggcccctgagctgctgcgggtgcgctccatgggcgtgctgagtgacagcgaggcccgctgtggggacatccagaagaccaagaacagctgggccagcaagcacccagcctgcaacctgccccaggacctgcatggagccagccccctgggcgtgctgagtgacagccagagcatcgtgggggagatggagcagaaggagaactgtgtgcctgtgtttcctggccggggcagcagccccagcagcaacagcgtgtccaagagccacgtgtctgagcccatcgctgaccagagcaactacaagccagatggagaggccgtggagcagaggaagaaccactgggccacagagctgcctgcccccagcagcctgagcacccccctgcctgagccccacatcgacctggagctggtgtggagaaatgtgcagcagcgggaggtgccccagggccccagccccctggccgtggaccccctgcaccctgtgccccagccccccaccctggccgaggccgtgaagattgaaagaacccaccctggcctgcccaagggcgtgacctgccctggggtgaaggccgaggcccccctgagccagcgctggacagtgcctgagctgctgacccaccctggcatccacgcctggcagtggagccgggagctgaagctgcggctgaagaagctgcggcagagccctgccagccgggcccctggccccagccagagcttctgcagcagccccatcctgagcagcaccatcccagacttctggggcctgcccagctgccccccccagcagatctacccacccaacccctgcccccacagcagcagctgccacccccaggaggtgcagaggacagtgccccagcctgtgcagagcagccactgccaccacttccagagcagcagccagctgcagccccaggagagcggccgggcagagcagggcagccagagaggagagaagatgaagggcaagatggtgtcccaggtgcccagccagggcccctgtgtgcacatggaggccggcgtggactacctgagccctggccctggagagcccagcaacagcaaggtgctggtgtctgggaagaggaaggacaaggccagcgccagcagcagcgccaagaagcgggagcaccccaggaagcccaaggccggggaccaccggcggggcacagcccggctgggcctgagcacagtgacaggcaagaaccacccagcccaggcccggagcctggtggaggcccctgtgtccaccttcccccagaggagccagcaccggggccagagcagccagcacacagccctgccccagctgctgctgcccaaggccagcggcccccaggaccagcctgaggccggccggcgggccagtgacatcctgacccccaggcactgcaagcactgcccctgggcccacatggagaagtacctgtccttccccaccctgaaggccagcctgacccggggcctgcagaaggtgctggccaagtgcctggacaaccaccggcccctgcccaccaagagcagccagtag

SEQ ID NO: 37194 - DNA, 3096 bp, Artificial Sequence
  Description of Artificial Sequence: Synthetic coding sequence
atgctgaggaagatccagcgctggtggcagctgggccgcctgcggcagctgcacccctggtgcagcggcaacatggtgcagggcaaggagctgcccctgctgcaccgggtggccttcctggaccacctgtgcaagcagaagtctgaggtggaggaggagggggaggaggaggaggagggagaagatgaggccagcctggaccccctgaagccctgcagccccaccaaggaggcccccaccggggagcaggccaccccagccccaccccagcccagctgtggcagcgagggcctgctgaaggccatcggcatccctgagcagacagtgatgcagcctgtgagccccagccgctccttccccatcttccagatcctgaccagcttccctgtgcgccacaagatcgccagcggcaaccggcagcagcagaggaagagccagctgttctggggcctgcccagcctgcacagcgagagcctggaggccatcttcctgagcagcggcggccccagccccctgaagtggagcgtgtgcagctctgtgttcttcaacaagctggccttcctgcccaggagcaacctgctgctgccccagtaccacagcagcgcccagttcagcacccatggagcccacaccatggaggacctggagggcatggccccagacccccagctgctgcccccacccagcagccccagcgtgagcagcctgctgctgcacctgcggcccttccctgtggaccacaagggcgtgctgagcggggctgaggcccccacccagagccctggcaccagccccctggaggtgctgcccggctatgagacccacctggagaccaccggccacaagaagatgccccaggcctttgagccccccatgcccccaccctgccagagccctgccagcctgtctgagcccaggaaggtgtccccagagggcggcctggccatcagcaaggacttctggggcaccgtgggctaccgggagaagccccaggccagcgagagctccatgcctgtgccctgcccccccctggacagcctgcctgagctgcagcgggagagcagcctggaggaccccagccgctacaagccccagtgggagtgccgggagaacagcggcaacctgtgggcctttgagagccctgtgctggacctgaaccctgagctgagcggcaccagcccagaatgtgtgcccccagccagcgagaccccctggaagggcatgcagagccgggagaacatctgggtgcctgctgaccctgtgtccccacccagcctgcccagcgtgcccctgctggagagcctggtgatgggcccccagggcgtgctgtctgagagcaaggccctgtgggagaccatgggccagaaggagaacctgtgggccagtgacagcccagaccctgtgcacagcaccccacccaccaccctgatggagccccaccgcatcaaccctggagagtgcctggccaccagcgaggccacctggaaggacacagagcacagcaggaacagcagcgccagccgcagccccagcctggccctgagccccccaccagccctggcccctgagctgctgcgggtgcgctccatgggcgtgctgagtgacagcgaggcccgctgtggggacatccagaagaccaagaacagctgggccagcaagcacccagcctgcaacctgccccaggacctgcacggggccagccccctgggcgtgctgagtgacagccagagcatcgtgggggagatggagcagaaggagaactgtgtgcctgtgtttcctggccggggcagcagccccagcagcaacagcgtgtccaagagccacgtgtctgagcccatcgctgaccagagcaactacaagccagatggagaggccgtggagcagaggaagaaccactgggccacagagctgcctgcccccagcagcctgagcacccccctgcctgagccccacatcgacctggagctggtgtggagaaatgtgcagcagcgggaggtgccccagggccccagccccctggccgtggaccccctgcaccctgtgccccagccccccaccctggccgaggccgtgaagattgaaagaacccaccctggcctgcccaagggcgtgacctgccctggggtgaaggccgaggcccccctgagccagcgctggacagtgcctgagctgctgacccaccctggcatccacgcctggcagtggagccgggagctgaagctgcggctgaagaagctgcggcagagccctgccagccgggcccctggccccagccagagcttctgcagcagccccatcctgagcagcaccatcccagacttctggggcctgcccagctgccccccccagcagatctacccacccaacccctgcccccacagcagcagctgccacccccaggaggtgcagaggacagtgccccagcctgtgcagagcagccactgccaccacttccagagcagcagccagctgcagccccaggagagcggccgggcagagcagggcagccagagaggagagaagatgaagggcaagatggtgtcccaggtgcccagccagggcccctgtgtgcacatggaggccggcgtggactacctgagccctggccctggagagcccagcaacagcaaggtgctggtgtctgggaagaggaaggacaaggccagcgccagcagcagcgccaagaagcgggagcaccccaggaagcccaaggccggggaccacagaagaggaacagcccggctgggcctgagcacagtgacaggcaagaaccacccagcccaggcccggagcctggtggaggcccctgtgtccaccttcccccagaggagccagcaccggggccagagcagccagcacacagccctgccccagctgctgctgcccaaggccagcggcccccaggaccagcctgaggccggcagaagagccagtgacatcctgacccccaggcactgcaagcactgcccctgggcccacatggagaagtacctgtccttccccaccctgaaggccagcctgacccggggcctgcagaaggtgctggccaagtgcctggacaaccaccggcccctgcccaccaagagcagccagtag

SEQ ID NO: 37195 - DNA, 1665 bp, Artificial Sequence
  Description of Artificial Sequence: Synthetic coding sequence
atggtgcagggcaaggagctgcccctgctgcaccgggtggccttcctggaccacctgtgcaagcagaagtctgaggtggaggaggagggggaggaggaggaggagggagaagatgaggccagcctggaccccccagagctgctgcgggtgcgctccatgggcgtgctgagtgacagcgaggcccgctgtggggacatccagaagaccaagaacagctgggccagcaagcacccagcctgcaacctgccccaggacctgcatggagccagccccctgggcgtgctgagtgacagccagagcatcgtgggggagatggagcagaaggagaactgtgtgcctgtgtttcctggccggggcagcagccccagcagcaacagcgtgtccaagagccacgtgtctgagcccatcgctgaccagagcaactacaagccagatggagaggccgtggagcagaggaagaaccactgggccacagagctgcctgcccccagcagcctgagcacccccctgcctgagccccacatcgacctggagctggtgtggagaaatgtgcagcagcgggaggtgccccagggccccagccccctggccgtggaccccctgcaccctgtgccccagccccccaccctggccgaggccgtgaagattgaaagaacccaccctggcctgcccaagggcgtgacctgccctggggtgaaggccgaggcccccctgagccagcgctggacagtgcctgagctgctgacccaccctggcatccacgcctggcagtggagccgggagctgaagctgcggctgaagaagctgcggcagagccctgccagccgggcccctggccccagccagagcttctgcagcagccccatcctgagcagcaccatcccagacttctggggcctgcccagctgccccccccagcagatctacccacccaacccctgcccccacagcagcagctgccacccccaggaggtgcagaggacagtgccccagcctgtgcagagcagccactgccaccacttccagagcagcagccagctgcagccccaggagagcggccgggcagagcagggcagccagagaggagagaagatgaagggcaagatggtgtcccaggtgcccagccagggcccctgtgtgcacatggaggccggcgtggactacctgagccctggccctggagagcccagcaacagcaaggtgctggtgtctgggaagaggaaggacaaggccagcgccagcagcagcgccaagaagcgggagcaccccaggaagcccaaggccggggaccaccggcggggcacagcccggctgggcctgagcacagtgacaggcaagaaccacccagcccaggcccggagcctggtggaggcccctgtgtccaccttcccccagaggagccagcaccggggccagagcagccagcacacagccctgccccagctgctgctgcccaaggccagcggcccccaggaccagcctgaggccggccggcgggccagtgacatcctgacccccaggcactgcaagcactgcccctgggcccacatggagaagtacctgtccttccccaccctgaaggccagcctgacccggggcctgcagaaggtgctggccaagtgcctggacaaccaccggcccctgcccaccaagagcagccagtag

SEQ ID NO: 37196 - DNA, 573 bp, Artificial Sequence
  Description of Artificial Sequence: Synthetic coding sequence
atggccctgcggggccaccctgagccccagcccaccaacacccccctgagcgccaccgtgggcggccccatcagcctcttcacccagccccgctgccacagcgctgcccgggacctggtgtggagccaggcctggccagaccctgatgtgctggagatctccatgcagacccctgggggcagcagctgcaggaaggaggccgtgctgccccggctgcgggtgacccggcccctggtgcctgagcccgccatcctgcctgtgtgtgccgcccggctggccggcagcctggccacagacctgagccgcagccacagcctgctgcccccctgggtggacctgaaggagcccccaccacccagcgcccccagcctgctgctggaggaccccggccagggcggctgccacggggcccagagctgtgtgggcacctgtgagctggccaacggggcccggggcttctgcccagagatgggccagaatgaaagcctgtctgaggagaggaagggccacgagagcaagaggaagagcggcggccggggcagccccagcagccaccccacccaggccagctag

SEQ ID NO: 37197 - DNA, 693 bp, Artificial Sequence
  Description of Artificial Sequence: Synthetic coding sequence
atgctgggcacccagtggaccctggcccgctgcctgctgcccagccacccagaccccggcctggccggcagcctgcggggggacagcagtgaagatggccggcggggccagctgctgccccagagccctgccccctgcagccctgtgtggagccctggcacccctgtgggcggcccccaccctgctggagatggccctgccacagcccctggccccccagagggccctgagctggccttcccccaggacctgagccctgcctggccccagaagggagctggcacccacccagccaatgccggccctggccccctgagcagaagaagcagccagctgcggacccccctggaggccggcaggaagtggggctggaagatgacccgctggaggctgcggcgggaccaggcccctggagagggcacccaggccaagctgctgggggaggccctgagcacagctggccggggccacgccggccccccagagggctgggccggggagggcggcgtgtccccaggcctgacccccctgctgggcaccggccagggcaaggagctggacctggacctgcgggagaagttcatccgctttgaccagatcctgggcatcagcctggaccacatccccttcctgccccagacaggccctggccggccctggggctgcggcgtgggcaagcagaggccccactag

SEQ ID NO: 37198 - DNA, 615 bp, Artificial Sequence
  Description of Artificial Sequence: Synthetic coding sequence
atggaccccctgagcccccccctgtgcaccctgcccccaggccctgagcccccaagatttgtgtgctactgtgagggggaggagagcggggagggggacagaggaggcttcaacctgtatgtgacagatgctgctgagctgtggagcacctgcttcaccccagacagcctggccgccctgaaggcccgcttcggcctgtctgctgctgaggacatcaccccccgcttccgggccgcctgtgagcagcaggccgtggccctgaccctgcaggaggaccgggccagcctgaccctgagcggcggccccagcgccctggcctttgacctgagcaaggtgcccggccctgaggccgccccccggctgcgggccctgaccctgggcctggccaagagggtgtggagcctggagcggcggctggccgctgctgaggagacagctgtgagccccaggaagagccccaggcctgctggcccccagctgttcctgcctgaccctgacccccagaggggcggccctggccctggggtgagaagacgctgccctggagagagcctcatcaaccctggcttcaagagcaagaagccagctgggggcgtggactttgatgagacctag

SEQ ID NO: 37199 - DNA, 177 bp, Artificial Sequence
  Description of Artificial Sequence: Synthetic coding sequence
atgcccaacagacacaagaccaaggaccagaccctgctgcctgcccagcagtacatctggctgctgaacagccacacccagatgacagcccctgtgccccagttcaagctgtctgaaacagccagcctgctgtgcaagaggaagatcagcacagccatgagcagcacctgcctgtag

SEQ ID NO: 37200 - DNA, 459 bp, Artificial Sequence
  Description of Artificial Sequence: Synthetic coding sequence
tgaggacggcccccccacaagggggccccccggctgggccggggcgtgggcgccctggtgcctgcccccagggctggcagccaccccccagctggggtgtgtgcctctgtgcacagaaatgctgtgggcgctgggggccctgcccgggccggccagcccggcctggatggcaccggccggcggggggcccgggccggcggggagaggcctgagggccgggcccccaaggtgtggaacccccccagccccctgtggagcgaggaggtgtacagcacagccccctactacacctcctgggcccggggcccccgctgccccccagagctgtgtgccccacccctgaagaggaaggagcagacagagcccaccccatctgtgcgccaccccaccatgatgagatacctggtggagcagaccaacagcgccacagaaaatgatgagagctgcctgaagaagtag

SEQ ID NO: 37201 - DNA, 687 bp, Artificial Sequence
  Description of Artificial Sequence: Synthetic coding sequence
atggaggacagccccctgcctgacctgcgggacatcgagctgaagctgggcaggaaggtgcctgagagcctggtgcgcagcctgcggggggaggagcctgtgccccgggagcgggaccgggacccctgtggcggcagcggcggcggcggcggcggcggcggcggctgcagcagcagcagcagctactgcagcttcccccccagcctgagcagcagcagcagcagcagccccaccagcggcagcccccggggcagccacagcagcgccctggagcggctggagaccaagctgcacctgctgcggcaggagatggtgaacctgcgggccacagatgtgcggctgatgaggcagctgctggtgatcaatgaaagcattgagagcatcaagtggatgattgaggagaaggccaccatcaccagccggggcagcagcctgagcggcagcctgtgcagcctgctggagagccagagcaccagcctgcggggcagctacaacagcctgcatgatggcagtgatggcctggatggcatctctgtgggcagctacctggacaccctggctgatgatgtgcccggccaccagacccccagcgacctggaccagttcagtgacagcagcctgattgaggacagccaggccctgcacaagaggcccaagctggacagcgagtactactgctttggatag

SEQ ID NO: 37202 - DNA, 720 bp, Artificial Sequence
  Description of Artificial Sequence: Synthetic coding sequence
atggagggcctgccctgcccctgcccagccctgccccacttctggcagctgcggagccacctgatggccgagggcagcaggacccaggcccctggaaaaggaccacccctgagcatccagttcctgcgggcccagtatgagggcctgaagaggcagcagaggacccaggcccacctgctggtgctgcccaagggcggcaacaccccagccccagctgagagcatggtgaatgctgtgtggatcaacaaggagaggaggagcagcctgagcctggaggaggccgacagcgaggtggagggccgcctggaggaggccgcccagggctgcctgcaggcccccaagagcccctggcacacccacctggagatgcactgcctggtgcagaccagcccccaggacaccagccaccaggtgcaccaccggggcaagctggtgggcagtgaccagaggctgcccccagagggggacacccacctgtttgagaccaaccagatgacccagcagggcaccggcatccctgaggccgcccagctgccctgccaggtgggcaacacccagaccaaggctgtggagagcggcctgaagttcagcacccagtgccccctgagcatcaagaacccccacaggtctgggaagccagcctactaccccttcccccagaggaagaccccccgcatcagccaggccgccaggaacctgggcctgtatggcagcgcctag

SEQ ID NO: 37203 - DNA, 288 bp, Artificial Sequence
  Description of Artificial Sequence: Synthetic coding sequence
atgttcctgaccggggacaccagccctgctgaggacaaccgggaggccaccctgccccagtgcagcctgcctgagctgtatgcctgcatcgagaacttcaacaaggagagcaagaagagcaacctgctgaagatgcacggcatcagcctgaatgaggcccaggaggtgctggccaggaacctgaatgtgatgtccttcaccagaggagcagatgtgcggggggacctgcagcccgtcatcaggaagaccatccacgagagcaagggcagcggcatggagatcttctag

SEQ ID NO: 37204 - DNA, 306 bp, Artificial Sequence
  Description of Artificial Sequence: Synthetic coding sequence
atgttcctgaccggggacaccagccctgctgaggacaaccgggaggccaccctgccccagtgcagcctgcctgagctgtatgcctgcatcgagaacttcaacaaggagagcaagaagagcaacctgctgaagatgcacggcatcagcctgaatgaggcccaggaggtgctggccaggaacctgaatgtgatgtccttcaccagaggagcagatgtgcggggggacctgcagcccgtcatctctgtgaacaagatgaacaagccaggcaagcacaggaagacccccagccccaagatcaacaagtag

SEQ ID NO: 37205 - DNA, 558 bp, Artificial Sequence
  Description of Artificial Sequence: Synthetic coding sequence
atgtcctggagccagcctgtgctgcggggcctgcctgccagcagagatgaggacagcaagcaggtgaccaccctgccctggggcaagaggagcagccggggcggggccatctacctgagcggcatcgacatgatccacggcacccctgtgctggacatcaagccctacatcgccgagtatgacagcccccagaatgtgatggagcccctggccgacttcaacctgcagaacaaccagcacacccccaacacagtgtcccagagcgacagcaagacagacagctgtgaccagaggcagctgagcggctgtgatgagccccagccccaccacagcaccaagaggaagcccaagtgcccagaggacaggaccagcgaggagaactacctgacccacagcgacacagcccgcatccagcaggccttccccatgcaccgggagattgctgtggactttggcctggagagccggcgggaccagagcagctctgtggccgaggagcagatcggcccctactgcccagagaagagcttcagcgagaagggcacagacaggagctag

SEQ ID NO: 37206 - DNA, 480 bp, Artificial Sequence
  Description of Artificial Sequence: Synthetic coding sequence
cggggcctggaggagagcggcccccggcccacagccaccccctgtggctgtgtgaagccagccctggagaccggcaacctgctgacagagcctgtgggctacctggagagctgcttcagcgccaagaatggcaccccccggcagcccagcatctgcagctacagccgggcctgcctgcgcatcaggaagaggatcttcaacaaccctgagcacagcctgatgggcctggagcagttcagccacgtgtggatcctgtttgtgttccacaagaatggccacctgagctgcaaggccaaggtgcagcccccccggctgaatggagccaagacaggagtcttcagcaccaggagcccccaccggcccaatgccatcggcctgaccctggccaagctggagaaggtggaggccctgggcaagtggacagacatcatggctgctgtgctgatgagcacagtgctgtgtggccgcagcctgggctag

SEQ ID NO: 37207 - DNA, 888 bp, Artificial Sequence
  Description of Artificial Sequence: Synthetic coding sequence
atgattcatggcacccctgtgctggacatcaagccctacatcgccgagtatgacagcccccagaatgtgatggagcccctggccgacttcaacctgcagaacaaccagcacacccccaacacagtgtcccagagcgacagcaagacagacagctgtgaccagaggcagctgagcggctgtgatgagccccagccccaccacagcaccaagaggaagcccaagtgcccagaggacaggaccagcgaggagaactacctgacccacagcgacacagcccgcatccagcaggccttccccatgcaccgggagattgctgtggactttggcctggagagcagaagagaccagagcagctctgtggccgaggagcagatcggcccctactgcccagagaagagcttcagcgagaagggcacagacaagaagctggagcgggtggagggcgctgctgtgctgcagggcagcagagctgagacccagcccatggccccccactgcccagctggccgggcagatggagcccccaggtctgtggtgcctgcctgggtgacagaggcccctgtggccaccctggaggtgcgcttcacccctcatgctgagatggacctgggccagctgagcagccaggatgtgggccaggccagcttcaagtacttccagagcgctgaggaggccaagagggccattgaagctgtgctgtctgctgaccccaggtctgtgtacagaaggaagctgtgccaggacaggctcttctacttcaccgtggacatcgcccacgtgacctgctggtttggagatggctttgctgaggtgctgcgcatcaagccagccagcgagcctgtgcacatgacaggccctgtgggcagcctggtgtccctgggcagctag

SEQ ID NO: 37208 - DNA, 1326 bp, Artificial Sequence
  Description of Artificial Sequence: Synthetic coding sequence
atgaggggcctggaggagagcggcccccggcccacagccaccccctgtggctgtgtgaagccagccctggagactggaaacctgctgacagagcctgtgggctacctggagagctgcttcagcgccaagaatggcaccccccggcagcccagcatctgcagctacagccgggcctgcctgcgcatcaggaagaggatcttcaacaaccctgagcacagcctgatgggcctggagcagttcagccacgtgtggatcctgtttgtgttccacaagaatggccacctgagctgcaaggccaaggtgcagcccccccggctgaatggagccaagacaggagtcttcagcaccaggagcccccaccggcccaatgccatcggcctgaccctggccaagctggagaaggtggagggcggggccatctacctgtctggaattgacatgattcatggcacccctgtgctggacatcaagccctacatcgccgagtatgacagcccccagaatgtgatggagcccctggccgacttcaacctgcagaacaaccagcacacccccaacacagtgtcccagagcgacagcaagacagacagctgtgaccagaggcagctgagcggctgtgatgagccccagccccaccacagcaccaagaggaagcccaagtgcccagaggacaggaccagcgaggagaactacctgacccacagcgacacagcccgcatccagcaggccttccccatgcaccgggagattgctgtggactttggcctggagagcagaagagaccagagcagctctgtggccgaggagcagatcggcccctactgcccagagaagagcttcagcgagaagggcacagacaagaagctggagcgggtggagggcgctgctgtgctgcagggcagcagagctgagacccagcccatggccccccactgcccagctggccgggcagatggagcccccaggtctgtggtgcctgcctgggtgacagaggcccctgtggccaccctggaggtgcgcttcacccctcatgctgagatggacctgggccagctgagcagccaggatgtgggccaggccagcttcaagtacttccagagcgctgaggaggccaagagggccattgaagctgtgctgtctgctgaccccaggtctgtgtacagaaggaagctgtgccaggacaggctcttctacttcaccgtggacatcgcccacgtgacctgctggtttggagatggctttgctgaggtgctgcgcatcaagccagccagcgagcctgtgcacatgacaggccctgtgggcagcctggtgtccctgggcagctag

SEQ ID NO: 37209 - DNA, 519 bp, Artificial Sequence
  Description of Artificial Sequence: Synthetic coding sequence
ggcctggaggagagcggcccccggcccacagccaccccctgtggctgtgtgaagccagccctggagactggaaacctgctgacagagcctgtgggctacctggagagctgcttcagcgccaagaatggcaccccccggcagcccagcatctgcagctacagccgggcctgcctgcgcatcaggaagaggatcttcaacaaccctgagcacagcctgatgggcctggagcagttcagccacgtgtggatcctgtttgtgttccacaagaatggccacctgagctgcaaggccaaggtgcagcccccccggctgaatggagccaagacaggagtcttcagcaccaggagcccccaccggcccaatgccatcggcctgaccctggccaagctggagaaggtggagggcaaccccttccacttctacttctacctgttcccccaccccaagaagccctacaagatcaacagcatccaccactggctgttcatccagaccagcaccaatgatgtgaacagctag

SEQ ID NO: 37210 - DNA, 252 bp, Artificial Sequence
  Description of Artificial Sequence: Synthetic coding sequence
atgagcggccccaatggagacctgggcatgcctgtggaggccggggctgagggggaggaggatggctttggagaggccgagtatgctgccatcaacagcatgctggaccagatcaacagctgcctggaccacctggaggagaagaatgaccacctgcacgcccggctgcaggagctgctggagagcaaccggcagacccggctggagttccagcagcagctgggggaggcccccagtgatgccagcccctag

SEQ ID NO: 37211 - DNA, 612 bp, Artificial Sequence
  Description of Artificial Sequence: Synthetic coding sequence
atgcctggccccctgacctgcaccccagcctggcagggccagggccgggccgccgccttcctgtgctgcagcttccagagagctggagctgtggtgggcgtgcctgcccgctggcaccggggccgcctgagcagccagcagaggctgcggagcagcctgggcggcagccacccctgcccccagctgggccggcggctggtgcgggagggcgtcatctctgtgccccggcagcagggcagaagacgctgccgggagagcttctccccagcagatgtggcccctggccccatctgcagcgccaacatctgcctgtctggagtgcgcttcctgacctgcctgaacagagtgcgggagcacgtggtgggccccagccccagccctgctgcccccatctgcttcttccctgtggtggaggccctgtgcaccctgcggggccgccgctgccactgcctgcccttccccaagaggggcatgcagcgctggatgctgcccctgcggcggggggcccggctgctgcccctggccagcagcaagaacccccgggcccggagccctggcctggaccccctgggcagcagcgagaccctgtggagccacagaggaggccactag

SEQ ID NO: 37212 - DNA, 435 bp, Artificial Sequence
  Description of Artificial Sequence: Synthetic coding sequence
atggacccccaggagatggtggtgaagaacccctatgcccacatcagcatcccccgggcccacctgcggccagacctgggccagcagctggaggtggccagcacctgcagcagcagcagcgagatgcagcccctgcctgtgggcccctgtgcccctgagcccacccacctgctgcagcccacagaggtgcccggccccaagggggccaagggcaaccagggcgccgcccccatccagaaccagcaggcctggcagcagcccggcaacccctacagcagcagccagaggcaggccggcctgacctacgccggccccccacctgctggaagaggagatgacatcgcccaccactgctgctgctgcccctgctgccactgctgccactgcccccccttctgccgctgccacagctgctgctgctgcgtcatctcctag

SEQ ID NO: 37213 - DNA, 366 bp, Artificial Sequence
  Description of Artificial Sequence: Synthetic coding sequence
atgtggagccggcggggcctgggcgtgtcccgggcccccctgcacctgctgctgggcgtgtggggccccagcggccgcactggaggccagaggaagggggccagcctggcccggcccggccggggcggcctggccagctgcagcgtgggcgccaacgggaagagagatgtgctcttcctgaggaagaccctgaccaacacagtggaggacatccagattgacaacttccggaggaagagtgacctgggcgtgggcagcccagactggaagaacctgctgattgatgtgaccagagaagatcatgagaacagccagaacaacagcaagaggcgctgcaaggtgaactgtgaaacagaccagaggtag

SEQ ID NO: 37214 - DNA, 963 bp, Artificial Sequence
  Description of Artificial Sequence: Synthetic coding sequence
atgcctgaggcccggagcagcggccctgacctgacccgctggaggaagcagcagcagcctgtgcggaggacagtgtcccaggtgtgccccccaccaagaagacccctgactgtggccgacatccgcagcggcatggagaatgaaaggctgggcgtggtgcgggacagcatgttccagaaccccctgattgtgaaggctgctggccctgcctctgtgggcaccagctacagcgtgtatgacagcagcgctgtgcagaaggtgatccccagcctggccggccaccacatcaagggcggcccccaggccgagctgggcaagccccgggagaggagctacagcctgcccggcatcaacttcaactacggcctgtacatccggggcctggatggaggagtgcctgaggccatcggccgctggaatgtgttcaagcagcagcccacctgcccccatgagctgaccaggaactacatcgccatgaacagaggagctgtgaaggccggcctggtgacagcccgggagaacctgctgtaccggcagctgaatgacatccgcatcagtgaccaggatgacaggaggatgaagaaggagcccccacccctgccccccaacatgaccttcggcatccgggcccggcccagcacccccttctttgacctgctgcagcaccgctacctgcagctgtgggtgcaggagcagaaggccacccagaaggccatcaagctggagaagaagcagaaggtggtgctgggcaagctgtatgagaccaggagcagccagctgaggaagtacaagccccctgtgaagctggacaccctgtggcacatgccccacttccagaaggtgggccgccacctggacaccttccccacagaggccgaccggcagagggccctgaaggcccaccgggaggagtgtgctgtgcggcagggcaccctgaggatgggcaactacacccacccctag

SEQ ID NO: 37215 - DNA, 855 bp, Artificial Sequence
  Description of Artificial Sequence: Synthetic coding sequence
atgcctgaggcccggagcagcggccctgacctgacccgctggaggaagcagcagcagcctgtgcggaggacagtgtcccaggtgtgccccccaccaagaagacccctgactgtggccgacatccgcagcggcatggagaatgaaaggctgggcgtggtgcgggacagcatgttccagaaccccctgattgtgaaggccgagctgggcaagccccgggagaggagctacagcctgcccggcatcaacttcaactacggcctgtacatccggggcctggatggaggagtgcctgaggccatcggccgctggaatgtgttcaagcagcagcccacctgcccccatgagctgaccaggaactacatcgccatgaacagaggagctgtgaaggccggcctggtgacagcccgggagaacctgctgtaccggcagctgaatgacatccgcatcagtgaccaggatgacaggaggatgaagaaggagcccccacccctgccccccaacatgaccttcggcatccgggcccggcccagcacccccttctttgacctgctgcagcaccgctacctgcagctgtgggtgcaggagcagaaggccacccagaaggccatcaagctggagaagaagcagaaggtggtgctgggcaagctgtatgagaccaggagcagccagctgaggaagtacaagccccctgtgaagctggacaccctgtggcacatgccccacttccagaaggtgggccgccacctggacaccttccccacagaggccgaccggcagagggccctgaaggcccaccgggaggagtgtgctgtgcggcagggcaccctgaggatgggcaactacacccacccctag

SEQ ID NO: 37216 - DNA, 2931 bp, Artificial Sequence
  Description of Artificial Sequence: Synthetic coding sequence
atgaccaggacagaccccccagacctgctggtgtccacagtgtaccaggacatcaaggtggccaccccaggccctgccagcaagtgcagcccctgtgagaggtctgtggcccggcctgctgagcccgcccccttcaacaagaggcactgccgcagctttgacttcctggaggccctggatggccctgccatggagaccctgcctgagcccccacctcctgagagcgctgtgccccgggcccggacccgggaggccgagcccaggagaagagcccggagcaagagcgccccccgggcccctcctggcctgaccccagccccagccagcccccctgtgctgccccggcggggccgggaggcccagagagctgcccgggcagaggccagcccccggcgggagcccgcctacccagccctgcgggccctggccaatgagctgcaccccatcaagctgcagccccagaggggcggccctggccgggtggcccccctgtgtgccgccgccggccgctgtgcccctcctgagcccccagctggccctgcccctcatgtgcgctgccgcctggacatcaagccagatgatgctgtgctgcagcacgccacccggggcagccgcagctgtggccccacagaggccgcccactgggcccggcctgccccccagttccacggcctgactgtgcccggccccaggcacatggccctgagcaggacccccacccccagcgacagctactgtgccgacccccgggccttctactgtgatggccccctgcccggcccccgggactatgcagagaggaggagcctgcccttcaccaccccacctggccccacccagttcttctacacagaggagccccagggcttccggggcagctttgctgccagccctggccccacctttgatgcctactacccccggccctaccccagcgaggagctgagcggccccagccccaggaggatgggcggctactatgctggggaggtgaggaccttccccatccaggagccccccagccgcagctactatggagaggccccccgggcctacggcctgccctacggcccccgctacgtgcctgaggagccccgggcccacagcacagcccggcccttctacacagaagattttggccgctaccgggagagagatgtgctggcccggacctacccccaccccaggagcagccctgcctgggccgactggggcccccggccctaccgcaccctgcaggtggtgccccccagcgaccctgaccccctgctggcctcctggcacggcggcaccggcaccagccccccccggctggccacagacagccgccactacagccgctcctgggacaacatcctggcccctggcccccggcgggaggaccccctgggccggggccgctcctatgagaacctgctgggccgggaggtgcgggagccccggggcgtgtccccagagggccggcggccccctgtggtggtgaacctgagcaccagccccaggagatatgctgccctgagcctgtctgagaccagcctgacagagaagggccgggccggggagggcctgggcaggaactggtacgtgaccccagagatcaccatcacagacaatgacctgcgggccacagagcggcccagcgcccgggcctgggagctgcccggcggccgcacccggcccccacctcatgctgccccagatggccccaccagcggccggcagaggagcctggagcagctggatgagctgatcacagacctggtgattgacagccggcccacagctggccaggccagcgagcctgctgctgactgcctgggcccccagctgcggcggctgctggacagcaggcctgctggcagcggggccccagccctggccccacccaggagccccccagccagcgctggcagcgctgaggagcctgctgcccctggagaggccgcagatgccagccctgagcccagcgcagatgaagatgacctgatgacctgcagcaatgcccgctgcagaagaacagagaccatgtttaatgcctgcctgtacttcaagagctgccacagctgctacacctactactgcagccggctgtgcagaagagaggactgggatgcccacaaggcccgctgtgtgtatggccgggtgggctctgtgtgcagacatgtgctgcagttctgccgggacagcggccctgtgcaccgggccttcagcagaattgcccgggtgggcttcctgagccggggccggggcgtgctcttcctgggcttccccagccctggcagcgctgacaacttcctgcgcttcggcctggagggcctgctgctgagccccacctacctgagcctgcgggagctggccacccatgctgcccccctgggcagctatgcccgggagctggccgccgccggccgcctgtatgagcctgctgagtgcttcctgctgtctgtgtctgtggccgtgggccctggaacagcccctcctggcaccccagccctgcctgccccagcccccaggagccacggccccaccgtgaggaagtttgccaaggtggccctggccgccggcagccctgcccggcccccaccagcccggagccgggagccagacatggagaccctcatcctgaccccacctcctggaacagctggcctggaccaggatggagaggccggccggcgggcccgggaggtggccttcatccacatccagcgggagctgcggctgcggggcgtcttcctgcggcatgagttcccccgggtgtatgagcagctgtgtgaatttgtggaggccaacagacgcttcacccccaccaccatctaccccacagacagaagaacaggccggcccttcatgtgcatgatcatggccgccagcgagccccgggccctggactgggtggccagcgccaacctgctggatgacatcatgtag

SEQ ID NO: 37217 - DNA, 1161 bp, Artificial Sequence
  Description of Artificial Sequence: Synthetic coding sequence
atgatgaacagcgaccagaaggctgtgaagttcctggccaacttctacatcaatggaggcaagcactggacccacggccacctgcggcagacccagcctgagcccacccagcccaaggcctctgtgctgctgctgggccctgagcccggcatggcctgggatgagacccagccccccaagatgaaggagatccctgtgggcctgcggctgcagacaggcaccccccaggagagcctgcccacctacacccagaccctgcgggagctgctgctggagcagaggcccctcatcacagctgacctggaggtgcccagccccacccgctaccaggtgcccagccccagcgtgcgggagagcagcccccacccccactacagcatcggctgcaagcaccagggccgggagggcggcggcagaagagcctggcagaccctgtggttccagagcgagagccccttcacccagaaggctgactttgaccaggagcagaagtggcccagccctgcccactaccagctgctgagcaggcctgccttccctgccttctccttccggggctgccacagcgccagcaagaccccagagggccacacccacctgggcctgcccggggcccggggcctgggcctgcgggtgcagccccagagcctgctgcaggccagcctgcaggcccctgggaagcgctgccccggccccaacacctacaacatcctgcccggcagccggctgcagagccccaggagccctgccttctccatgagccgcagccctgccttcacctcctggctgagcaccagcttctcctttggcagccccaacccctggcccagccggctgccccggggcggcctgcagctgaccctgccctttggagcctggaggggccaccctggctgcacccagacccaggcccccaggcaccggcccctgctgcacgccctggagcctgctggccacaacctgctgggccctgccacagagtggaaccacggcctgccccggggcttccccaggcctcccctgggcctgggcgccccagcctggcccagcgaccccctgggcacccccatgcaccccagcggctggcccaccctgctgtgggccgtggacaaggccggccctgcctggatcccccacctgcccatcagccccctgcactag

SEQ ID NO: 37218 - DNA, 927 bp, Artificial Sequence
  Description of Artificial Sequence: Synthetic coding sequence
atgatgaacagcgaccagaaggctgtgaagttcctggccaacttctacatcaatggaggcaagcactggacccacggccacctgcggcagacccagcctgagcccacccagcccaaggcctctgtgctgctgctgggccctgagcccggcatggcctgggatgagacccagccccccaagatgaaggagatccctgtgggcctgcggctgcagacaggcaccccccaggagagcctgcccacctacacccagaccctgcgggagctgctgctggagcagaggcccctcatcacagctgacctggaggtgcccagccccacccgctaccaggtgcccagccccagcgtgcgggagagcagcccccacccccactacagcatcggctgcaagcaccagggccgggagggcggcggcagaagagcctggcagaccctgtggttccagagcgagagccccttcacccagaaggctgactttgaccaggagcagaagtggcccagccctgcccactaccagctgctgagcaggcctgccttccctgccttctccttccggggctgccacagcgccagcaagaccccagagggccacacccacctgggcctgcccggggcccggggcctgggcctgcgggtgcagccccagagcctgctgcaggccagcctgcaggcccctgggaagcgctgccccggccccaacacctacaacatcctgcccggcagccggctgcagagccccaggagccctgccttctccatgagccgcagccctgccttcacctcctggctgagcaccagcaggaccccaggccctgctgcctaccacgtggaggactgcaacagccgcttccccagcgcccctggggtggtgatccagggcgtgagaagacccaagagacatgacaccggccccttctgcaccctgtag

SEQ ID NO: 37219 - DNA, 549 bp, Artificial Sequence
  Description of Artificial Sequence: Synthetic coding sequence
atggccgccccagcccctgtgacccggcaggtgtctggagctgctgccctggtgcctgcccccagcggccctgacagcggccagcccctggccgctgctgtggccgagctgcctgtgctggatgcccggggccagagggtgccctttggagccctcttccgggagcggcgggctgtggtggtgtttgtgcgccacttcctgtgctacatctgcaaggagtatgtggaggacctggccaagatccccaggagcttcctgcaggaggccaacgtgaccctcatcgtcatcggccagagcagctaccaccacatcgagcccttctgcaagctgaccggctacagccatgagatctacgtggaccctgagcgggagatctacaagaggctgggcatgaagagaggagaggagatcgccagcagcggcaacaacatccacttcatccaccgggacaggaaccggctggaccacaagcccatcaacagcgtgctgcagctggtgggcgtgcagcacgtgaacttcaccaaccggcccagcgtcatccacgtgtag

SEQ ID NO: 37220 - DNA, 681 bp, Artificial Sequence
  Description of Artificial Sequence: Synthetic coding sequence
atggccgccccagcccctgtgacccggcaggtgtctggagctgctgccctggtgcctgcccccagcggccctgacagcggccagcccctggccgctgctgtggccgagctgcctgtgctggatgcccggggccagagggtgccctttggagccctcttccgggagcggcgggctgtggtggtgtttgtgcgccacttcctgtgctacatctgcaaggagtatgtggaggacctggccaagatccccaggagcttcctgcaggaggccaacgtgaccctcatcgtcatcggccagagcagctaccaccacatcgagcccttctgcaagctgaccggctacagccatgagatctacgtggaccctgagcgggagatctacaagaggctgggcatgaagagaggagaggagatcgccagcagcggccagagcccccacatcaagagcaacctgctgagcggcagcctgcagagcctgtggagggctgtgacaggccccctgtttgacttccagggcgaccctgcccagcagggcggcaccctcatcctgggccctggcaacaacatccacttcatccaccgggacaggaaccggctggaccacaagcccatcaacagcgtgctgcagctggtgggcgtgcagcacgtgaacttcaccaaccggcccagcgtcatccacgtgtag

SEQ ID NO: 37221 - DNA, 333 bp, Artificial Sequence
  Description of Artificial Sequence: Synthetic coding sequence
tgatatgtggaggacctggccaagatccccaggagcttcctgcaggaggccaacgtgaccctcatcgtcatcggccagagcagctaccaccacatcgagcccttctgcaagctgaccggctacagccatgagatctacgtggaccctgagcgggagatctacaagaggctgggcatgaagagaggagaggagatcgccagcagcggcaacaacatccacttcatccaccgggacaggaaccggctggaccacaagcccatcaacagcgtgctgcagctggtgggcgtgcagcacgtgaacttcaccaaccggcccagcgtcatccacgtgtag

SEQ ID NO: 37222 - DNA, 543 bp, Artificial Sequence
  Description of Artificial Sequence: Synthetic coding sequence
tgaggacccaggcctccccgggtgatggccgccccagcccctgtgacccggcagcacttcctgtgctacatctgcaaggagtatgtggaggacctggccaagatccccaggagcttcctgcaggaggccaacgtgaccctcatcgtcatcggccagagcagctaccaccacatcgagcccttctgcaagctgaccggctacagccatgagatctacgtggaccctgagcgggagatctacaagaggctgggcatgaagagaggagaggagatcgccagcagcggccagagcccccacatcaagagcaacctgctgagcggcagcctgcagagcctgtggagggctgtgacaggccccctgtttgacttccagggcgaccctgcccagcagggcggcaccctcatcctgggccctggcaacaacatccacttcatccaccgggacaggaaccggctggaccacaagcccatcaacagcgtgctgcagctggtgggcgtgcagcacgtgaacttcaccaaccggcccagcgtcatccacgtgtag

SEQ ID NO: 37223 - DNA, 492 bp, Artificial Sequence
  Description of Artificial Sequence: Synthetic coding sequence
atggagcactacaggaaggccggctctgtggagctgcctgcccccagccccatgccccagctgcccccagacaccctggagatgagggtgagagatggcagcaagatccggaacctgctgggcctggccctgggccgcctggagggcggcagcgcccggcacgtggtgttcagcggcagcggccgggccgccggcaaggctgtgtcctgtgccgagatcgtgaagagaagagtgcccggcctgcaccagctgaccaagctgcgcttcctgcagacagaagattcctgggtgcctgccagcccagacaccggcctggaccccctgactgtgagaagacatgtgcctgctgtgtgggtgctgctgagccgggaccccctggaccccaatgaatgtggctaccagcccccaggggcccctcctggcctgggctccatgcccagcagcagctgtggccccaggagcagaagaagagcccgggacaccaggagctag

SEQ ID NO: 37224 - DNA, 492 bp, Artificial Sequence; identical to SEQ ID NO: 37223
  Description of Artificial Sequence: Synthetic coding sequence

SEQ ID NO: 37225 - DNA, 495 bp, Artificial Sequence
  Description of Artificial Sequence: Synthetic coding sequence
atggagacagctgtgcggggcatgcccctggagtgcccccccaggcctgagcggctgaatgcctatgaaagagaggtgatggtgaacatgctgaacagcctgagcaggaaccagcagctgccccgcatcaccccccgctgtggctgtgtggaccccctgcccggccgcctgcccttccacggctatgagagcgcctgcagcggccgccactactgcctgcggggcatggactactatgccagcggggccccctgcacagaccggcggctgcggccctggtgccgggagcagcccaccgtgcgctgtgtgcccccctatgagcaccggcccggcatgcagtgtgctgtgaccaccccaccacccagctactacccctaccccaacctgcgctgggacaccagccacttcaagaagagcggcggcccccagaggaacaactacgtgatccaccctgagtttgtgtctgagacctacccagactaccgctgctggtag

SEQ ID NO: 37226 - DNA, 336 bp, Artificial Sequence
  Description of Artificial Sequence: Synthetic coding sequence
atggagacagctgtgcggggcatgcccctggagtgcccccccaggcctgagcggctgaatgcctatgaaagagaggtgatggtgaacatgctgaacagcctgagcaggaaccagcagctgccccgcatcaccccccgctgtggctgtgtgcccccctatgagcacaggcctggcatgcagtgtgctgtgaccaccccacctccttcctactacccctaccccaacctgcgctgggacaccagccacttcaagaagagcggcggcccccagaggaacaactacgtgatccaccctgagtttgtgtctgagacctacccagactaccgctgctggtag

SEQ ID NO: 37227 - DNA, 495 bp, Artificial Sequence; identical to SEQ ID NO: 37225
  Description of Artificial Sequence: Synthetic coding sequence

SEQ ID NO: 37228 - DNA, 384 bp, Artificial Sequence
  Description of Artificial Sequence: Synthetic coding sequence
atggagacagctgtgcggggcatgcccctggagtgcccccccaggcctgagcggctgaatgcctatgaaagagaggtgatggtgaacatgctgaacagcctgagcaggaaccagcagctgccccgcatcaccccccgctgtggctgtgtggaccccctgcccggccgcctgcccttccacggctatgagagcgcctgcagcggccgccactactgcctgcggggcatggactactatgccagcggggccccctgcacagaccggcggctgcggccctggtgccgggagcagcccaccatgtgcaccagcctgcgggccccagccagaaatgctgtgtgctgctacaacagccctgctgtgatcctgcccatcagcgagccctag

SEQ ID NO: 37229 - DNA, 381 bp, Artificial Sequence
  Description of Artificial Sequence: Synthetic coding sequence
tgagcctgggaggccaacaagttcctgaccccaggcctgacccacaccatggagcggcacgtggaccctgaggccctgcagaagatggccaagtgtgctgtgcaggactacacctaccggggcagcatcagcggccacccctacctgcctgagaagtactggctgagccaggaggaggccgacaagtgcagccccaactacctgggcagtgactggtacaacacctggaggatggagccctacaacagcagctgctgcaacaagtacaccacctacctgccccggctgcccaaggtgtctgtggcccccagcacagatgtgtggggcctgggccacgcctaccccaccaccagccagaccaccgtgacagacatctcctag

SEQ ID NO: 37230 - DNA, 507 bp, Artificial Sequence
  Description of Artificial Sequence: Synthetic coding sequence
atgatggaggagattgaccgcttccaggtgcccacagcccacagcgagatgcagcccctggaccctgctgctgccagcatcagtgatggagactgtgatgcccgggaggagaagcagcgggagctggccaggaagggcagcctgaagaatggctccatgggcagccctgtgaaccagcagcccaagaagaacaacgtgatggcccggacccggctggtggtgcccaacaagggctacagcagcctggaccagagcccagatgagaagcccctggtggccctggacacagacagtgatgatgactttgacatgagccgctacagcagcagcggctacagcagcgctgagcagatcaaccaggacctgaacatccagctgctgaaggatggctaccgcctggatgagatcccagatgatgaggacctggacctgatcccccccaagtctgtgaaccccacctgcatgtgctgccaggccaccagcagcacagcctgccacatccagtag

SEQ ID NO: 37231 - DNA, 471 bp, Artificial Sequence
  Description of Artificial Sequence: Synthetic coding sequence
atggaggagattgaccgcttccaggtgcccacagcccacagcgagatgcagcccctggaccctgctgctgccagcatcagtgatggagactgtgatgcccgggagggggagagcgtggccatgaactacaagcccagccccctgcaggtgaagctggagaagcagcgggagctggccaggaagggcagcctgaagaatggctccatgggcagccctgtgaaccagcagcccaagaagaacaacgtgatggcccggacccggctggtggtgcccaacaagggctacagcagcctggaccagagcccagatgagaagcccctggtggccctggacacagacagatgtgtgtggggcctgggcggctcctgggccgcccagaggaacctgtacagcaccagcggcctgtaccggccccacctgctgtactgccagaactgggacatcctgcagcctgagagcctgcagggctag

SEQ ID NO: 37232 - DNA, 519 bp, Artificial Sequence
  Description of Artificial Sequence: Synthetic coding sequence
atggaggagattgaccgcttccaggaccctgctgctgccagcatcagtgatggagactgtgatgcccgggagggggagagcgtggccatgaactacaagcccagccccctgcaggtgaagctggagaagcagcgggagctggccaggaagggcagcctgaagaatggctccatgggcagccctgtgaaccagcagcccaagaagaacaacgtgatggcccggacccggctggtggtgcccaacaagggctacagcagcctggaccagagcccagatgagaagcccctggtggccctggacacagacagtgatgatgactttgacatgagccgctacagcagcagcggctacagcagcgctgagatcaaccaggacctgaacatccagctgctgaaggatggctaccgcctggatgagatcccagatgatgaggacctggacctgatcccccccaagtctgtgaaccccacctgcatgtgctgccaggccaccagcagcacagcctgccacatccagtag

SEQ ID NO: 37233 - DNA, 471 bp, Artificial Sequence
  Description of Artificial Sequence: Synthetic coding sequence
atggaggagattgaccgcttccaggaccctgctgctgccagcatcagtgatggagactgtgatgcccgggaggagaagcagcgggagctggccaggaagggcagcctgaagaatggctccatgggcagccctgtgaaccagcagcccaagaagaacaacgtgatggcccggacccggctggtggtgcccaacaagggctacagcagcctggaccagagcccagatgagaagcccctggtggccctggacacagacagtgatgatgactttgacatgagccgctacagcagcagcggctacagcagcgctgagcagatcaaccaggacctgaacatccagctgctgaaggatggctaccgcctggatgagatcccagatgatgaggacctggacctgatcccccccaagtctgtgaaccccacctgcatgtgctgccaggccaccagcagcacagcctgccacatccagtag

SEQ ID NO: 37234 - DNA, 495 bp, Artificial Sequence
  Description of Artificial Sequence: Synthetic coding sequence
atggaggagattgaccgcttccaggtgcccacagcccacagcgagatgcagcccctggaccctgctgctgccagcatcagtgatggagactgtgatgcccgggaggagaagcagcgggagctggccaggaagggcagcctgaagaatggctccatgggcagccctgtgaaccagcagcccaagaagaacaacgtgatggcccggacccggctggtggtgcccaacaagggctacagcagcctggaccagagcccagatgagaagcccctggtggccctggacacagacagtgatgatgactttgacatgagccgctacagcagcagcggctacagcagcgctgagcagatcaaccaggacctgaacatccagctgctgaaggatggctaccgcctggatgagatcccagatgatgaggacctggacctgatcccccccaaccaggtgagcccctgcagcctcatctacttccaggagggcgtgtggaagacctag

SEQ ID NO: 37235 - DNA, 501 bp, Artificial Sequence
  Description of Artificial Sequence: Synthetic coding sequence
atggaggagattgaccgcttccaggtgcccacagcccacagcgagatgcagcccctggaccctgctgctgccagcatcagtgatggagactgtgatgcccgggaggagaagcagcgggagctggccaggaagggcagcctgaagaatggctccatgggcagccctgtgaaccagcagcccaagaagaacaacgtgatggcccggacccggctggtggtgcccaacaagggctacagcagcctggaccagagcccagatgagaagcccctggtggccctggacacagacagtgatgatgactttgacatgagccgctacagcagcagcggctacagcagcgctgagatcaaccaggacctgaacatccagctgctgaaggatggctaccgcctggatgagatcccagatgatgaggacctggacctgatcccccccaagtctgtgaaccccacctgcatgtgctgccaggccaccagcagcacagcctgccacatccagtag

SEQ ID NO: 37236 - DNA, 552 bp, Artificial Sequence
  Description of Artificial Sequence: Synthetic coding sequence
atggaggagattgaccgcttccaggtgcccacagcccacagcgagatgcagcccctggaccctgctgctgccagcatcagtgatggagactgtgatgcccgggagggggagagcgtggccatgaactacaagcccagccccctgcaggtgaagctggagaagcagcgggagctggccaggaagggcagcctgaagaatggctccatgggcagccctgtgaaccagcagcccaagaagaacaacgtgatggcccggacccggctggtggtgcccaacaagggctacagcagcctggaccagagcccagatgagaagcccctggtggccctggacacagacagtgatgatgactttgacatgagccgctacagcagcagcggctacagcagcgctgagatcaaccaggacctgaacatccagctgctgaaggatggctaccgcctggatgagatcccagatgatgaggacctggacctgatcccccccaagtctgtgaaccccacctgcatgtgctgccaggccaccagcagcacagcctgccacatccagtag

SEQ ID NO: 37237 - DNA, 510 bp, Artificial Sequence
  Description of Artificial Sequence: Synthetic coding sequence
atggaggagattgaccgcttccaggtgcccacagcccacagcgagatgcagcccctggaccctgctgctgccagcatcagtgatggagactgtgatgcccgggagggggagagcgtggccatgaactacaagcccagccccctgcaggtgaagctggagaagcagcgggagctggccaggaagggcagcctgaagaatggctccatgggcagccctgtgaaccagcagcccaagaagaacaacgtgatggcccggacccggctggtggtgcccaacaagggctacagcagcctggaccagagcccagatgagaagcccctggtggccctggacacagacagtgatgatgactttgacatgagccgctacagcagcagcggctacagcagcgctgagcagatcaaccaggacctgaacatccagctgctgaaggatggctaccgcctggatgagatcccagatgatgaggacctggacctgatcccccccaagtctgtgaaccccacctag

SEQ ID NO: 37238 - DNA, 558 bp, Artificial Sequence
  Description of Artificial Sequence: Synthetic coding sequence
atgatggaggagattgaccgcttccaggtgcccacagcccacagcgagatgcagcccctggaccctgctgctgccagcatcagtgatggagactgtgatgcccgggagggggagagcgtggccatgaactacaagcccagccccctgcaggtgaagctggagaagcagcgggagctggccaggaagggcagcctgaagaatggctccatgggcagccctgtgaaccagcagcccaagaagaacaacgtgatggcccggacccggctggtggtgcccaacaagggctacagcagcctggaccagagcccagatgagaagcccctggtggccctggacacagacagtgatgatgactttgacatgagccgctacagcagcagcggctacagcagcgctgagcagatcaaccaggacctgaacatccagctgctgaaggatggctaccgcctggatgagatcccagatgatgaggacctggacctgatcccccccaagtctgtgaaccccacctgcatgtgctgccaggccaccagcagcacagcctgccacatccagtag

SEQ ID NO: 37239 - DNA, 153 bp, Artificial Sequence
  Description of Artificial Sequence: Synthetic coding sequence
atgaagctgctgtctgagcagcaggagctgaggacagtgtccatgacagcctggaagcccaggatgaacaggaagagccgcagcaggatgagccccatcgaccccaggcacagcggcacccccaacagcaaccgcatcggcctgagcacctag

SEQ ID NO: 37240 - DNA, 153 bp, Artificial Sequence; identical to SEQ ID NO: 37239
  Description of Artificial Sequence: Synthetic coding sequence

SEQ ID NO: 37241 - DNA, 360 bp, Artificial Sequence
  Description of Artificial Sequence: Synthetic coding sequence
atgaacagaaacatcctggaggagatgctgcagtacctgctgattgactggatcgtgggggaccagtttgagatccagctgaaccagcagctgtggagcctcatccccaacaatgatgtgcggcggctggtgagccacgtgatccgcaccctgaagacagactgcacagagacccacctgcagctggcctgtgccaagctgatcagcaggacaggcctgctgatgaagctgctgtctgagcagcaggagctgaggacagtgtccatgacagcctggaagcccaggatgaacaggaagagccgcagcaggatgagcatccccagcggccctgacatggaggagaccacagatgtgtcctag

SEQ ID NO: 37242 - DNA, 297 bp, Artificial Sequence
  Description of Artificial Sequence: Synthetic coding sequence
atgctgcagtacctgctgattgactggatcgtgggggaccagtttgagatccagctgaaccagcagctgtggagcctcatccccaacaatgatgtgcggcggctggtgagccacgtgatccgcaccctgaagacagactgcacagagacccacctgcagctggcctgtgccaagctgatcagcaggacaggcctgctgatgaagctgctgtctgagcagcaggagctgaggacagtgtccatgacagcctggaagcccaggatgaacaggaagagccgcagcaggatgaggagctag

SEQ ID NO: 37243 - DNA, 2163 bp, Artificial Sequence
  Description of Artificial Sequence: Synthetic coding sequence
atggacatccagctggaccctgccagagatgacctgcccctgatggccaacaccagccacatcctggtgaagcactacgtgctggacctggatgtggactttgagagccaggtgattgagggcaccatcgtgctcttcctggaggatggcaaccgcttcaagaagcagaacagcagcattgaggaggcctgccagagcgagagcaacaaggcctgcaagtttggcatgcctgagccctgccacatccctgtgaccaatgcccggaccttcagcagcgagatggagtacaatgactttgccatctgcagcaagggggagaaggacaccagtgacaaggatggcaaccacgacaaccaggagcacgccagcggcatcagcagcagcaagtactgctgtgacaccggcaaccacggcagcgaggacttcctgctggtgctggactgctgtgacctgtctgtgctgaaggtggaggaggtggatgtggccgctgtgcccggcctggagaagttcaccaggagccctgagctgactgtggtgtctgaggagttcaggaaccagatcgtgcgggagctggtgaccctgcctgccaaccgctggagggagcagctggactactatgcccgctgcagccaggcccctggctgtggggagctgctgtttgacacagacacctggagcctgcagatcaggaagacaggagcccagacagccacagacttcccccacgccatccgcatctggtacaagaccaagccagagggccgctctgtgacctggaccagtgaccagagcggccggccctgtgtgtacacagtgggcagccccatcaacaacagagccctcttcccctgccaggagccccctgtggccatgagcacctggcaggccaccgtgcgggctgctgccagctttgtggtgctgatgtctggagaaaattctgccaagcccacccagctgtgggaggagtgcagctcctggtactactacgtgaccatgcccatgcctgccagcaccttcaccatcgctgtgggctgctggacagagatgaagatggagacctggagcagcaatgacctggccacagagcggcccttcagccccagcgaggccaacttccgccacgtgggcgtgtgcagccacatggagtacccctgccgcttccagaatgccagcgccaccacccaggagatcatcccccaccgggtgtttgcccctgtgtgcctgactggagcctgccaggagaccctgctgcggctcatccccccctgcctgtctgctgcccacagcgtgctgggcgcccaccccttcagccggctggatgtgctgattgtgcctgccaacttccccagcctgggcatggcccggcccagcaaggacaagacaggccacaccagtgacagcggggccagcgtcatcaagcacggcctgaaccctgagaagatcttcatgcaggtgcactacctgaagggctacttcctgctgcgcttcctggccaagaggctgggagatgagacctacttctccttcctgaggaagtttgtgcacaccttccacggccagctgatcctgagccaggacttcctgcagatgctgctggagaacatccctgaggagaagaggctggagctgtctgtggagaacatctaccaggactggctggagagcagcggcatccccaagcccctgcagcgggagcggcgggccggggctgaatgtggcctggcccggcaggtgcgggcagaggtgaccaagtggattggagtgaacagaagacccaggaagaggaagagaagagagaaggaggaggtgtttgagaagctgctgcctgaccagctggtgctgctgctggagcacctgctggagcagaagaccctgagccccaggaccctgcagagcctgcagaggacctaccacctgcaggaccaggatgctgaggtgcgccaccgctggtgtgagctgattgtgaagcacaagttcaccaaggcctacaagtctgtggagcgcttcctgcaggaggaccaggccatgggcgtgtacctgtatggagagctgatggtgtctgaagatgcccggcagcagcagctggcccggcgctgctttgagaggaccaaggagcagatggacaggagcagcgcccaggtggtggccgagatgctgttctag

SEQ ID NO: 37244 - DNA, 552 bp, Artificial Sequence
  Description of Artificial Sequence: Synthetic coding sequence
gctgaccccggccgggcccagggcgccggcagcggggctgctgctgccagcagccctgctgctggggagcccctgcagcgggagaggagagctggagcagaatgtggcctggcccggcaggtgcgggcagaggtgaccaagtggattggagtgaacagaagacccaggaagaggaagaggcgggagaaggaggaggtgtttgagaagctgctgcctgaccagctggtgctgctgctggagcacctgctggagcagaagaccctgagccccaggaccctgcagagcctgcagaggacctaccacctgcaggaccaggatgctgaggtgcgccaccgctggtgtgagctgattgtgaagcacaagttcaccaaggcctacaagtctgtggagcgcttcctgcaggaggaccaggccatgggcgtgtacctgtatggagagctgatggtgtctgaagatgcccggcagcagcagctggcccggcgctgctttgagaggaccaaggagcagatggacaggagcagcgcccaggtggtggccgagatgctgttctag

SEQ ID NO: 37245 - DNA, 2460 bp, Artificial Sequence
  Description of Artificial Sequence: Synthetic coding sequence
atggacatccagctggaccctgccagagatgacctgcccctgatggccaacaccagccacatcctggtgaagcactacgtgctggacctggatgtggactttgagagccaggtgattgagggcaccatcgtgctcttcctggaggatggcaaccgcttcaagaagcagaacagcagcattgaggaggcctgccagagcgagagcaacaaggcctgcaagtttggcatgcctgagccctgccacatccctgtgaccaatgcccggaccttcagcagcgagatggagtacaatgactttgccatctgcagcaagggggagaaggacaccagtgacaaggatggcaaccacgacaaccaggagcacgccagcggcatcagcagcagcaagtactgctgtgacaccggcaaccacggcagcgaggacttcctgctggtgctggactgctgtgacctgtctgtgctgaaggtggaggaggtggatgtggccgctgtgcccggcctggagaagttcaccaggagccctgagctgactgtggtgtctgaggagttcaggaaccagatcgtgcgggagctggtgaccctgcctgccaaccgctggagggagcagctggactactatgcccgctgcagccaggcccctggctgtggggagctgctgtttgacacagacacctggagcctgcagatcaggaagacaggagcccagacagccacagacttcccccacgccatccgcatctggtacaagaccaagccagagggccgctctgtgacctggaccagtgaccagagcggccggccctgtgtgtacacagtgggcagccccatcaacaacagagccctcttcccctgccaggagccccctgtggccatgagcacctggcaggccaccgtgcgggctgctgccagctttgtggtgctgatgtctggagaaaattctgccaagcccacccagctgtgggaggagtgcagctcctggtactactacgtgaccatgcccatgcctgccagcaccttcaccatcgctgtgggctgctggacagagatgaagatggagacctggagcagcaatgacctggccacagagcggcccttcagccccagcgaggccaacttccgccacgtgggcgtgtgcagccacatggagtacccctgccgcttccagaatgccagcgccaccacccaggagatcatcccccaccgggtgtttgcccctgtgtgcctgactggagcctgccaggagaccctgctgcggctcatccccccctgcctgtctgctgcccacagcgtgctgggcgcccaccccttcagccggctggatgtgctgattgtgcctgccaacttccccagcctgggcatggccagcccccacatcatgttcctgagccagagcatcctgactggaggcaaccacctgtgtggcacccggctgtgccatgaaattgcccacgcctggtttggcctggccatcggggcccgggactggacagaggagtggctgtctgagggctttgccacccacctggaggatgtgttctgggccacagcccagcagctggccccctatgaggcccgggagcagcaggagctgcgggcctgcctgcgctggaggcggctgcaggatgagatgcagtgcagccctgaggagatgcaggtgctgcggcccagcaaggacaagacaggccacaccagtgacagcggggccagcgtcatcaagcacggcctgaaccctgagaagatcttcatgcaggtgcactacctgaagggctacttcctgctgcgcttcctggccaagaggctgggagatgagacctacttctccttcctgaggaagtttgtgcacaccttccacggccagctgatcctgagccaggacttcctgcagatgctgctggagaacatccctgaggagaagaggctggagctgtctgtggagaacatctaccaggactggctggagagcagcggcatccccaagcccctgcagcgggagaggagagctggagcagaatgtggcctggcccggcaggtgcgggcagaggtgaccaagtggattggagtgaacagaagacccaggaagaggaagaggcgggagaaggaggaggtgtttgagaagctgctgcctgaccagctggtgctgctgctggagcacctgctggagcagaagaccctgagccccaggaccctgcagagcctgcagaggacctaccacctgcaggaccaggatgctgaggtgcgccaccgctggtgtgagctgattgtgaagcacaagttcaccaaggcctacaagtctgtggagcgcttcctgcaggaggaccaggccatgggcgtgtacctgtatggagagctgatggtgtctgaagatgcccggcagcagcagctggcccggcgctgctttgagaggaccaaggagcagatggacaggagcagcgcccaggtggtggccgagatgctgttctag

SEQ ID NO: 37246 - DNA, 495 bp, Artificial Sequence
  Description of Artificial Sequence: Synthetic coding sequence
atgcaggtgcactacctgaagggctacttcctgctgcgcttcctggccaagaggctgggagatgagacctacttctccttcctgaggaagtttgtgcacaccttccacggccagctgatcctgagccaggacttcctgcagatgctgctggagaacatccctgaggagaagaggctggagctgtctgtggagaacatctaccaggactggctggagagcagcggcatccccaagcccctgcagcgggagcggcgggccggggctgaatgtggcctggcccggcaggtgcgggcagaggtgaccaagtggattggagtgaacagaagacccaggaagaggaagagaagagagaaggaggaggtgtttgagaagaccctgaactggagccacctgaggaaccgggagaggaggaggaagaagtggatcaccttcaagaccctgggcggcatcctcttcaccgtgaagcagatgaggaacctgtttgcccaggtgtag

SEQ ID NO: 37247 - DNA, 561 bp, Artificial Sequence
  Description of Artificial Sequence: Synthetic coding sequence
atggagtacccctgccgcttccagaatgccagcgccaccacccaggagatcatcccccaccgggtgtttgcccctgtgtgcctgactggagcctgccaggagaccctgctgcggctcatccccccctgcctgtctgctgcccacagcgtgctgggcgcccaccccttcagccggctggatgtgctgattgtgcctgccaacttccccagcctgggcatggccagcccccacatcatgttcctgagccagagcatcctgactggaggcaaccacctgtgtggcacccggctgtgccatgaaattgcccacgcctggtttggcctggccatcggggcccgggactggacagaggagtggctgtctgagggctttgccacccacctggaggatgtgttctgggccacagcccagcagctggccccctatgaggcccgggagcagcaggagctgcgggcctgcctgcgctggaggcggctgcaggatgagatgcagtgcagccctgaggagatgcaggtgctgcgcttcccccacgtgggcggctgcagcggcagcttctcctag

SEQ ID NO: 37248 - DNA, 1527 bp, Artificial Sequence
  Description of Artificial Sequence: Synthetic coding sequence
gtggtgtctgaggagttcaggaaccagatcgtgcgggagctggtgaccctgcctgccaaccgctggagggagcagctggactactatgcccgctgcagccaggcccctggctgtggggagctgctgtttgacacagacacctggagcctgcagatcaggaagacaggagcccagacagccacagacttcccccacgccatccgcatctggtacaagaccaagccagagggccgctctgtgacctggaccagtgaccagagcggccggccctgtgtgtacacagtgggcagccccatcaacaacagagccctcttcccctgccaggagccccctgtggccatgagcacctggcaggccaccgtgcgggccgccgccagctttgtggtgctgatgtctggagagaacagcgccaagcccacccagctgtgggaggagtgcagctcctggtactactacgtgaccatgcccatgcctgccagcaccttcaccatcgctgtgggctgctggacagagatgaagatggagacctggagcagcaatgacctggccacagagcggcccttcagccccagcgaggccaacttcagacatgtgggcgtgtgcagccacatggagtacccctgccgcttccagaatgccagcgccaccacccaggagatcatcccccaccgggtgtttgcccctgtgtgcctgaccggggcctgccaggagaccctgctgcggctcatccccccctgcctgtctgctgcccacagcgtgctgggcgcccaccccttcagccggctggatgtgctgattgtgcctgccaacttccccagcctgggcatggcccggcccagcaaggacaagacaggccacaccagtgacagcggggccagcgtcatcaagcacggcctgaaccctgagaagatcttcatgcaggtgcactacctgaagggctacttcctgctgcgcttcctggccaagaggctgggagatgagacctacttctccttcctgaggaagtttgtgcacaccttccacggccagctgatcctgagccaggacttcctgcagatgctgctggagaacatccctgaggagaagaggctggagctgtctgtggagaacatctaccaggactggctggagagcagcggcatccccaagcccctgcagcgggagaggagagctggagcagaatgtggcctggcccggcaggtgcgggcagaggtgaccaagtggattggagtgaacagaagacccaggaagaggaagaggcgggagaaggaggaggtgtttgagaagctgctgcctgaccagctggtgctgctgctggagcacctgctggagcagaagaccctgagccccaggaccctgcagagcctgcagaggacctaccacctgcaggaccaggatgctgaggtgcgccaccgctggtgtgagctgattgtgaagcacaagttcaccaaggcctacaagtctgtggagcgcttcctgcaggaggaccaggtgggcgtcatcttccagcagatgggcatcctgtag

SEQ ID NO: 37249 - DNA, 546 bp, Artificial Sequence
  Description of Artificial Sequence: Synthetic coding sequence
atgaggatgaggcggcccctggccggcggcggcaagtcctggggcatcgcccacttctacaagcccctgcagcgggagaggagagctggagcagaatgtggcctggcccggcaggtgcgggcagaggtgaccaagtggattggagtgaacagaagacccaggaagaggaagaggcgggagaaggaggaggtgtttgagaagctgctgcctgaccagctggtgctgctgctggagcacctgctggagcagaagaccctgagccccaggaccctgcagagcctgcagaggacctaccacctgcaggaccaggatgctgaggtgcgccaccgctggtgtgagctgattgtgaagcacaagttcaccaaggcctacaagtctgtggagcgcttcctgcaggaggaccaggccatgggcgtgtacctgtatggagagctgatggtgtctgaagatgcccggcagcagcagctggcccggcgctgctttgagaggaccaaggagcagatggacaggagcagcgcccaggtggtggccgagatgctgttctag

SEQ ID NO: 37250 - DNA, 423 bp, Artificial Sequence
  Description of Artificial Sequence: Synthetic coding sequence
agcagcaagtactgctgtgacaccggcaaccacggcagcgaggacttcctgctggtgctggactgctgtgacctgtctgtgctgaaggtggaggaggtggatgtggccgctgtgcccggcctggagaagttcaccaggagccctgagctgactgtggtgtctgaggagttcaggaaccagatcgtgcgggagctggtgaccctgcctgccaaccgctggagggagcagctggactactatgcccgctgcagccaggcccctggctgtggggagctgctgtttgacacagacacctggagcctgcagatcaggaagacaggagcccagacagccacagacttcccccacgccatccgcatctggtacaagaccaagccagagggccgctctgtgacctggaccagtgaccagagcggccgctag

SEQ ID NO: 37251 - DNA, 1806 bp, Artificial Sequence
  Description of Artificial Sequence: Synthetic coding sequence
ctctttgacacagacacctggagcctgcagatcaggaagacaggagcccagacagccacagacttcccccacgccatccgcatctggtacaagaccaagccagagggccgctctgtgacctggaccagtgaccagagcggccggccctgtgtgtacacagtgggcagccccatcaacaacagagccctcttcccctgccaggagccccctgtggccatgagcacctggcaggccaccgtgcgggctgctgccagctttgtggtgctgatgtctggagaaaattctgccaagcccacccagctgtgggaggagtgcagctcctggtactactacgtgaccatgcccatgcctgccagcaccttcaccatcgctgtgggctgctggacagagatgaagatggagacctggagcagcaatgacctggccacagagcggcccttcagccccagcgaggccaacttccgccacgtgggcgtgtgcagccacatggagtacccctgccgcttccagaatgccagcgccaccacccaggagatcatcccccaccgggtgtttgcccctgtgtgcctgactggagcctgccaggagaccctgctgcggctcatccccccctgcctgtctgctgcccacagcgtgctgggcgcccaccccttcagccggctggatgtgctgattgtgcctgccaacttccccagcctgggcatggccagcccccacatcatgttcctgagccagagcatcctgactggaggcaaccacctgtgtggcacccggctgtgccatgaaattgcccacgcctggtttggcctggccatcggggcccgggactggacagaggagtggctgtctgagggctttgccacccacctggaggatgtgttctgggccacagcccagcagctggccccctatgaggcccgggagcagcaggagctgcgggcctgcctgcgctggaggcggctgcaggatgagatgcagtgcagccctgaggagatgcaggtgctgcggcccagcaaggacaagacaggccacaccagtgacagcggggccagcgtcatcaagcacggcctgaaccctgagaagatcttcatgcaggtgcactacctgaagggctacttcctgctgcgcttcctggccaagaggctgggagatgagacctacttctccttcctgaggaagtttgtgcacaccttccacggccagctgatcctgagccaggacttcctgcagatgctgctggagaacatccctgaggagaagaggctggagctgtctgtggagaacatctaccaggactggctggagagcagcggcatccccaagcccctgcagcgggagaggagagctggagcagaatgtggcctggcccggcaggtgcgggcagaggtgaccaagtggattggagtgaacagaagacccaggaagaggaagaggcgggagaaggaggaggtgtttgagaagctgctgcctgaccagctggtgctgctgctggagcacctgctggagcagaagaccctgagccccaggaccctgcagagcctgcagaggacctaccacctgcaggaccaggatgctgaggtgcgccaccgctggtgtgagctgattgtgaagcacaagttcaccaaggcctacaagtctgtggagcgcttcctgcaggaggaccaggccatgggcgtgtacctgtatggagagctgatggtgtctgaagatgcccggcagcagcagctggcccggcgctgctttgagaggaccaaggagcagatggacaggagcagcgcccaggtggtggccgagatgctgttctag

SEQ ID NO: 37252 - DNA, 483 bp, Artificial Sequence
  Description of Artificial Sequence: Synthetic coding sequence
atgaggatgaggcggcccctggccggcggcggcaagtcctggggcatcgcccacttctacaaggtgaccaagtggattggagtgaacagaagacccaggaagaggaagagaagagagaaggaggaggtgtttgagaagctgctgcctgaccagctggtgctgctgctggagcacctgctggagcagaagaccctgagccccaggaccctgcagagcctgcagaggacctaccacctgcaggaccaggatgctgaggtgcgccaccgctggtgtgagctgattgtgaagcacaagttcaccaaggcctacaagtctgtggagcgcttcctgcaggaggaccaggccatgggcgtgtacctgtatggagagctgatggtgtctgaagatgcccggcagcagcagctggcccggcgctgctttgagaggaccaaggagcagatggacaggagcagcgcccaggtggtggccgagatgctgttctag

SEQ ID NO: 37253 - DNA, 555 bp, Artificial Sequence
  Description of Artificial Sequence: Synthetic coding sequence
tgagctgaccccggccgggcccagggcgccggcagcggggctgctgctgccagcagccctgctgctggggagcccctgcagcgggagcggcgggccggggctgaatgtggcctggcccggcaggtgcgggcagaggtgaccaagtggattggagtgaacagaagacccaggaagaggaagagaagagagaaggaggaggtgtttgagaagctgctgcctgaccagctggtgctgctgctggagcacctgctggagcagaagaccctgagccccaggaccctgcagagcctgcagaggacctaccacctgcaggaccaggatgctgaggtgcgccaccgctggtgtgagctgattgtgaagcacaagttcaccaaggcctacaagtctgtggagcgcttcctgcaggaggaccaggccatgggcgtgtacctgtatggagagctgatggtgtctgaagatgcccggcagcagcagctggcccggcgctgctttgagaggaccaaggagcagatggacaggagcagcgcccaggtggtggccgagatgctgttctag

SEQ ID NO: 37254 - DNA, 438 bp, Artificial Sequence
  Description of Artificial Sequence: Synthetic coding sequence
tgagatgagacctacttctccttcctgaggaagtttgtgcacaccttccacggccagctgatcctgagccaggacttcctgcagatgctgctggagaacatccctgaggagaagaggctggagctgtctgtggagaacatctaccaggactggctggagagcagcggcatccccaagcccctgcagcgggagaggagagctggagcagaatgtggcctggcccggcaggtgcgggcagaggtgaccaagtggattggagtgaacagaagacccaggaagaggaagaggcgggagaaggaggaggtgtttgagaagaccctgaactggagccacctgaggaaccgggagaggaggaggaagaagtggatcaccttcaagaccctgggcggcatcctcttcaccgtgaagcagatgaggaacctgtttgcccaggtgtag

SEQ ID NO: 37255 - DNA, 546 bp, Artificial Sequence
  Description of Artificial Sequence: Synthetic coding sequence
atgcagaacaatgagatcatcaagccagccaagtacttcagcgagctggagaagagcatcctgctggccctggtggagaagtacaagtatgtgctggagtgcaagaagagtgatgcccggaccatcgccctgaagcagaggacctggcaggccctggcccacgagtacaacagccagcccagcgtgtccctgcgggacttcaagcagctgaagaagtgctgggagaacatcaaggcccggaccaagaagatcatggcccatgaaagaagagagaaggtgaagaggtctgtgagccccctgctgagcacccacgtgctgggcaaggagaagatcgcctccatgctgcctgagcagctgtacttcctgcagagccccccagaggaggagcctgagtaccacccagatgccagcgcccaggagagctttgctgtgagcaaccgggagctgtgtgatgatgagaaggagttcatccacttccctgtgtgtgagggcaccagccagcctgagcccagctgcagcgctgtgcgcatcacagccaacaagtag

SEQ ID NO: 37256 - DNA, 828 bp, Artificial Sequence
  Description of Artificial Sequence: Synthetic coding sequence
atgcagaacaatgagatcatcaagccagccaagtacttcagcgagctggagaagagcatcctgctggccctggtggagaagtacaagtatgtgctggagtgcaagaagagtgatgcccggaccatcgccctgaagcagaggacctggcaggccctggcccacgagtacaacagccagcccagcgtgtccctgcgggacttcaagcagctgaagaagtgctgggagaacatcaaggcccggaccaagaagatcatggcccatgaaagaagagagaaggtgaagaggtctgtgagccccctgctgagcacccacgtgctgggcaaggagaagatcgcctccatgctgcctgagcagctgtacttcctgcagagccccccagaggaggagcctgagtaccacccagatgccagcgcccaggagagctttgctgtgagcaaccgggagctgtgtgatgatgagaaggagttcatccacttccctgtgtgtgagggcaccagccagcctgagcccagctgcagcgctgtgcgcatcacagccaacaagaactaccgcagcaagaccagccaggagggcgccctgaagaagatgcatgaggaggagcaccaccagcagatgagcatcctgcagctgcagctgatccagatgaatgaggtgcacgtggccaagatccagcagatcgagagagaatgtgagatggccgaggaggagcaccgcatcaagatggaggtgctgaacaagaagaagatgtactgggagaggaagctgcagaccttcaccaaggagtggcctgtgagcagcttcaaccggcccttccccaacagcccctag

SEQ ID NO: 37257 - DNA, 405 bp, Artificial Sequence
  Description of Artificial Sequence: Synthetic coding sequence
atgcagaacaatgagatcatcaagccagccaagtacttcagcgagctggagaagagcatcctgctggccctggtggagaagtacaagtatgtgctggagtgcaagaagagtgatgcccggaccatcgccctgaagcagaggacctggcaggccctggcccacgagtacaacagccagcccagcgtgtccctgcgggacttcaagcagctgaagaagtgctgggagaacatcaaggcccggaccaagaagatcatggcccatgaaagaagagagaaggtgaagaggtctgtgagccccctgctgagcacccacgtgctgggcaaggagaagatcgcctccatgctgcctgagcagctgtacttcctgcagagccccccagaggaggagcctgagtaccacccctag

SEQ ID NO: 37258 - DNA, 492 bp, Artificial Sequence
  Description of Artificial Sequence: Synthetic coding sequence
atgacccaccccctgccccatgacagccacaccagcggggccccacccctggtgaacaagagccgggacctggccaacggcccccccttcttcagccccctgcagagcctgtgggaggagttcctgcacctgctcttcatgggcaccctgctcttctacagaattgccaccaaggccctgcggggcaaggccaccctgctgaagagccacagcaagcagcctgcccagcccggctgggagcccggcatccgggcccccagccctgtgcctgccagcagcctgcaggaccacagccggctgaccagcctgagcaggacaggcaaggagcagaggaggaccctgagcctcatcaggaagaccagcggcacccccacagagagcacagtggccacagctgctgccagcaccacagaggtgcccagccggctgccctgggccgcccgggccggcttcaagaggaccactggagtgtgcatcgccctgcccacctag

SEQ ID NO: 37259 - DNA, 435 bp, Artificial Sequence
  Description of Artificial Sequence: Synthetic coding sequence
atgcccagcagcgcccacgcccacgccatcctgaaggatgcccaggacagccctggggtggtgctgggccagggcgtcatccgggccggcaagggctgggagaatggacctgagagccaccgggtgcgctaccggggcaagaagaacacagactggcacaccaggagccctgccctgaccttcaccgtgctgtggcccagctgccccctggtgcccatcgtgctgggcctgaaccctggcttctgcccctgtgcccggagcagcggggagtgcaaccacagcggccacatcatcgagggcacccgctgggaccagggccagctgtgcctgctcttcaccctgagcagagctgacatccgggcctgctggagggtgggggagcagcagtatgtgtccctcttcacccacgtgcagatgcagcaccccagcctgtag

SEQ ID NO: 37260 - DNA, 531 bp, Artificial Sequence
  Description of Artificial Sequence: Synthetic coding sequence
atggagttccactacgtggcccaggccgacctggagctgctgaccagcagcaaccccccagccagcgccagccagagcacaggcatcaccggcggcagccaccgggcccggcccggccctgtgcacttcatcgacaaggtgacagacaagcccagccacagccacccctttgccctgaaggagaactggaacctgaaccctgagcccagcagcccccccagccccctcttcctggaggcccccagccggcaggccagccagcaccacggggccagccctggagctggcaccagcgctggctgcccctttgagaagtgctgcagcacagagccctgcctgagcggcctgggagatgtgggccgcggggaggccgccagcctgcgggcccggcccggcagcggggccagccggggccagggccctggcagccgggtgtcctgccggcgggacctgggcaagcccctgcacgccccagctggcttctctgctggggaggtgcacaccacccccctgggcaacctgggcgcctag

SEQ ID NO: 37261 - DNA, 357 bp, Artificial Sequence
  Description of Artificial Sequence: Synthetic coding sequence
atgcccagcaagacagcagaaaatgccaccttctactacatcagcagcctgctgagcagccgcagccctgtgttcaaccagagccccaaggtgaaggccggccacatgctggaggccagccagatcagcgccaagaacagcgctgacttcttccaccccacccccagctgcagcgagctggacttcaccctgcaccctgagctggccgacagcctgggcgccaagcacaactacaaggccacctgcctgatgaggttcctgcccctgcagaggcacaccaggtcctggttcagcctcatcctgtggtgcatccagagagatgactacctgattggcctcttcagctgcttctcctag

SEQ ID NO: 37262 - DNA, 462 bp, Artificial Sequence
  Description of Artificial Sequence: Synthetic coding sequence
atgcagaggagaagaagacctcctccacccaccagccggctgcctgagggctgcggcggcggcggcggcggcagcgaggaggtggaggtgcagttctctgctggccgctggggcagcgctgctgctgtgtctgctgctgctgctgctgccaccaggagcacagaggaggaggaggagcggctggagcgggagcacttctggaagatcatcaatgccttccgctactacggcacctccatgcatgagcgggtgaacagaacagagcggcagttccgcagcctgcctgccaaccagcagaagctgctgccccagttcctgctgcacctggacaagatcaggaagtgcatcgaccacaaccaggagatcctgctgaccatcgtgaatgactgcatccacatgtttgagaacaaggagtatggagaagatgtgtgtgagagcctcttctacttctgcctcttctag

SEQ ID NO: 37263 - DNA, 1230 bp, Artificial Sequence
  Description of Artificial Sequence: Synthetic coding sequence
atgcagaggagaagaagacctcctccacccaccagccggctgcctgagggctgcggcggcggcggcggcggcagcgaggaggtggaggtgcagttctctgctggccgctggggcagcgctgctgctgtgtctgctgctgctgctgctgccaccaggagcacagaggaggaggaggagcggctggagcgggagcacttctggaagatcatcaatgccttccgctactacggcacctccatgcatgagcgggtgaacagaacagagcggcagttccgcagcctgcctgccaaccagcagaagctgctgccccagttcctgctgcacctggacaagatcaggaagtgcatcgaccacaaccaggagatcctgctgaccatcgtgaatgactgcatccacatgtttgagaacaaggagtatggagaagatggaaatggcaagatcatgcctgccagcacctttgacatggacaagctgaagagcaccctgaagcagtttgtgcgggactggagcgagaccgggaaggccgagagagatgcctgctaccagcccatcatcaaggagatcctgaagaacttccccaaggagcgctgggaccccagcaaggtgaacatcctggtgcctggagctggcctgggccgcctggcctgggagatcgccatgctgggctacgcctgccagggcaatgagtggagcttcttcatgctgttcagcagcaactttgtgctgaaccgctgcagcgagatcaacaagtacaagctgtacccctggatccaccagttcagcaacaacagaagatctgctgaccagatccggcccatcttcttcccagatgtggacccccacagcctgcccccaggcagcaacttctccatgacagctggggacttccaggagatctacagcgagtgcaacacctgggactgcatcgccacctgcttcttcatcgacacagcccacaacgtcatcgactacatcgacaccatctggaagatcctgaagccaggcggcatctggatcaacctgggccccctgctgtaccactttgagaacctggccaatgagctgagcattgagctgtcctatgaggacatcaagaatgtggtgctgcagtatggcttcaaggtggaggtggagaaggagagcgtgctgagcacctacacagtgaatgacctgtccatgatgaagtactactatgaatgtgtgctgtttgtggtgaggaagccccagtag

SEQ ID NO: 37264 - DNA, 591 bp, Artificial Sequence
  Description of Artificial Sequence: Synthetic coding sequence
atgcagaggagaagaagacctcctccacccaccagccggctgcctgagggctgcggcggcggcggcggcggcagcgaggaggtggaggtgcagttctctgctggccgctggggcagcgctgctgctgtgtctgctgctgctgctgctgccaccaggagcacagaggaggaggaggagcggctggagcgggagcacttctggaagatcatcaatgccttccgctactacggcacctccatgcatgagcgggtgaacagaacagagcggcagttccgcagcctgcctgccaaccagcagaagctgctgccccagttcctgctgcacctggacaagatcaggaagtgcatcgaccacaaccaggagatcctgctgaccatcgtgaatgactgcatccacatgtttgagaacaaggagtatggagaagatggaaatggcaagatcatgcctgccagcacctttgacatggacaagctgaagagcaccctgaagcagtttgtgcgggactggagcgagaccgggaaggccgagagagatgcctgctaccagcccatcatcaaggagatcctgaagaacttccccaaggagaggtag

SEQ ID NO: 37265 - DNA, 717 bp, Artificial Sequence
  Description of Artificial Sequence: Synthetic coding sequence
gtgctgcggctgcagctggagagtgacagacatgacctgctgcggagcacctccatgcatgagcgggtgaacagaacagagcggcagttccgcagcctgcctgccaaccagcagaagctgctgccccagttcctgctgcacctggacaagatcagaaaatgtattgaccacaaccaggagatcctgctgaccatcgtgaatgactgcatccacatgtttgagaacaaggagtatggagaagatggaaatggcaagatcatgcctgccagcacctttgacatggacaagctgaagagcaccctgaagcagtttgtgcgggactggagcgagaccgggaaggccgagagagatgcctgctaccagcccatcatcaaggagatcctgaagaacttccccaaggagcgctgggaccccagcaaggtgaacatcctggtgcctggggccggcctgggccgcctggcctgggagatcgccatgctgggctacgcctgccagggcaatgagtggagcttcttcatgctgttcagcagcaactttgtgctgaaccgctgcagcgagatcaacaagtacaagctgtacccctggatccaccagttcagcaacaacagaagatctgctgaccagatccggcccatcttcttcccagatgtggacccccacagcctgcccccaggcagcaacttctccatgacagctggggacttccaggagatctag

SEQ ID NO: 37266 - DNA, 1386 bp, Artificial Sequence
  Description of Artificial Sequence: Synthetic coding sequence
atggacctgcctgatgagagccagtgggatgagaccacctgtggcctggccgtgtgccagcacccccagtgctgggccaccatcagaagaattgagcggggccacccccgcatcctgggcagcagctgcaagacccccctggatgctgaggacaagctgcctgtgctgactgtggtggacatcctggacagcggctttgctgcccaccacctgcctgaatgtaccttcaccaaggcccacagcctgctgagccagagcagcaagttctacagcaagttccacggccggccccccaagggcctgcctgacaagagcctcatcaactgcaccaaccggctgcccaagtttcctgtgctgaacctgaatgagacccagctgccctgcccagaagatgtgaggaacatggtggtgctgtggatccctgaggagacagagatccacgtgtcccagcacggcaagaagaagaggaagaacagcgctgtgaagagcaagagcttcctgggcctgagcggcaaccagagcgctggcaccagggtgggcaccccaggcatgattgtgcccccacccacccctgtgcagctgtctgagcagttcagcagtgacttcctgcccctgtgggcccagagcgaggccctgccccaggacctgctgaaggagctgctgcccggcggcaagcagaccatgctgtgcccagagatgaagatcaagctggccatgatgaagaagaacctgcccctggagaagaacagaccagattctgtcatcagcagcaagatgttcctgagcatccaccggctgaccctggagaggcctgccctgcgctacccagagcggctgaagaagctgcacaacctgaagacagagggctacaggaagcagcagcagaggcagcagcagcagcagcagcagcagaagaaggtgaagacccccatcaagaagcaggaggccaagaagaaggccaagagtgaccccggcatccagagcaccagccacaagcaccctgtgaccaccgtgcatgaccggctgtatggctaccgcaccctgcccggccagaacagcgacatgaagcagcagcagcagatggagaagggcaccaccagcaagcaggacagcacagagcggcccaagatgaactactatgaccatgctgacttccaccacagcgtgaagagccctgagctgtatgaaacagagcccaccaacaaggacatcagcgcccctgtggatgctgtgcctgaggcccaggccgcccggcagaagaagatctccttcaacttcagcgagatcatggccagcacaggctggaacagcgagctgaagctgctgcgcatcctgcaggacacagatgatgaagatgaggaggaccagagcagcggggctgagtag

SEQ ID NO: 37267 - DNA, 1386 bp, Artificial Sequence; identical to SEQ ID NO: 37266
  Description of Artificial Sequence: Synthetic coding sequence

SEQ ID NO: 37268 - DNA, 1386 bp, Artificial Sequence
  Description of Artificial Sequence: Synthetic coding sequence
atgagccgcatcaacaagaatgtggtgctggccctgctgaccctgaccagcagcgccttcctgctcttccagctgtactactacaagcactacctgagcaccaagaatggagctggcctgagcaagagcaagggcagccgcatcggctttgacagcacccagtggagggctgtgaagaagttcatcatgctgaccagcaaccagaatgtgcctgtgttcctgattgaccccctcatcctggagctgatcaacaagaactttgagcaggtgaagaacaccagccacggcagcaccagccagtgcaagttcttctgtgtgccccgggacttcaccgcctttgccctgcagtaccacctgtggaagaatgaggagggctggttcagaattgctgagaacatgggcttccagtgcctgaagattgagagcaaggacccccggctggatggcatcgacagcctgagcggcacagagatccccctgcactacatctgcaagctggccacccacgccatccacctggtggtgttccacgagaggagcggcaactacctgtggcacggccacctgcggctgaaggagcacatcgacaggaagtttgtgcccttcaggaagctgcagtttggccgctacccaggggcctttgacaggcctgagctgcagcaggtgacagtggatggcctggaggtgctgatccccaaggaccccatgcactttgtggaggaggtgccccacagccgcttcattgaatgtcgctacaaggaggcccgggccttcttccagcagtacctggatgacaacacagtggaggccgtggccttcaggaagagcgccaaggagctgctgcagctggccgccaagaccctgaacaagctgggcgtgcccttctggctgagcagcggcacctgcctgggctggtaccggcagtgcaacatcatcccctacagcaaggatgtggacctgggcatcttcatccaggactacaagagtgacatcatcctggccttccaggatgctggcctgcccctgaagcacaagtttgggaaggtggaggacagcctggagctgtccttccagggcaaggatgatgtgaagctggatgtgttcttcttctatgaggagacagaccacatgtggaatggaggcacccaggccaagacaggcaagaagttcaagtacctgttccccaagttcaccctgtgctggacagaatttgtggacatgaaggtgcacgtgccctgtgagaccctggagtacatcgaggccaactacggcaagacctggaagatccctgtgaagacctgggactggaagaggagcccccccaacgtgcagcccaacggcatctggcccatcagcgagtgggatgaagtcatccagctgtactag

SEQ ID NO: 37269 - DNA, 2640 bp, Artificial Sequence
  Description of Artificial Sequence: Synthetic coding sequence
atggctgatggcggcggccccaaggatgcccccagcctgcggagcagccctggccctgccccccgggtgcccagggctgtgggccccagcggcggcggcggggagacccccaggacagctgccctggccctgcgctttgacaagcccatcaagcaggccttctacaacacaggagctgtgctgtttgtgtgcctgtgctgcggggctgctgtgctggtgtacttcatcctggaggccttcctgcggcccctgctgtgggccgtgctgtgtggcaccttcctgcaccccttcaagagcagcctgacccggctgggccgccactggctgcagaggctgcaccgggcccacacccccatcgtgctggccgccctgctgctgcccctgtgctttgtggactatggagtggaggccctgggggagcaggccctgcggcggcggcggctgctgctgctgctgggcgctgggggccccctgctgtatggcctgtactgcctgggcagctacctgggcgtgcaggtgctgctggtgcacgccgccaccctcatctgccggggcctggactacttcagcagcctgtggatctggaccctggtggtgggctacgtgctgactgtgtccttcaagtggaatgccagcacagagcgctacctgcgggctgtgtccatccctgtgtggatcatcctgctcttccacctggccagcctggccggctcctggagaattcctgtgttcctggtgattgtgttcctgatgtctgtgggcaccctgtatgagaagcagaatggcaaggagagcagcggggctgagctgcccggccaggtgatctccatggccgccagcaccctggccaacctggccatcagcatcaccggctatgagagcagcagcgaggaccagcccagcacccagcctgctgaggccgtggacagaggagagagcgcccccaccctgagcaccagccccagccccagcagccccagccccaccagccccagccccaccctgggcagaagaagacctgagatcggcaccttcctgaggaagaagaagaccagtgacatctactttgtgtccctggtgtgggccatcgtggtgatgcagatctggctgaacctgtggatcgtgcagctgctgcctgtgcccatcgctgtgtggatcctgaagaagctggtgatccactttggagtggtggacttcctggagaagcgctaccacgtgtggtggggcatcatcgagagcttcctgaaggagcggcagggcgccctggccccctggcccatcgtgggcctgggcaagttcctgctgaaggtggacagcaagctgtggcactggctgaacaagaagatgatcatctggctggagaagatgctggacaagatcatcagcatcttcatcatcttcctgctggtgattggcaccctgctgctggccctgctgctgacagccaaggtgcaccaggagagcgtgcacatgattgaggtgaccagcaacctgatcaatgagaccctggccaaccaccctgagtgggccaactggctgcctgaggcccaggtggtgcagagggccctgaacagcgctgccaacaacgtgtaccagtatggccgggagtggatcacccacaagctgcacaagatcctgggggacaaggtgaacaacacagctgtgattgagaagcaggtgctggagctgtgggaccggctgtaccacagctggtttgtgaagaatgtgacccacagcggccgccacaagggccagaagctgcacgtgtcccggcagaacagctggctgggggacatcctggactggcaggacatcgtgtcctttgtgcatgaaaatattgagaccttcctgagcatcctggagagcctgtggatcgtgatgagcagaaatgtgtccctgctcttcaccaccgtgaccaccctgctgaccatcctcttctacagcggcacagccctgctgaactttgtgctgagcctcatcatcttcctgaccaccctcttctacctgctgagcagcagtgatgagtactacaagcctgtgaagtgggtgatcagcctgacccccctgagccagcccggccccagcagcaacatcatcggccagagcgtggaggaggccatccggggcgtgtttgatgccagcctgaagatggccggcttctacggcctgtacacctggctgacccacaccatgtttggcatcaacatcgtgttcatccccagcgccctggccgccatcctgggcgctgtgcccttcctgggcacctactgggccgctgtgcctgctgtgctggacctgtggctgacccagggcctgggctgcaaggccatcctgctgctgatcttccacctgctgcccacctactttgtggacacagccatctacagcgacatcagcggcggcggccacccctacctgaccggcctggccgtggccggcggggcctactacctgggcctggagggcgccatcatcggccccatcctgctgtgcatcctggtggtggccagcaacatctacagcgccatgctggtgagccccaccaacagcgtgcccacccccaaccagaccccctggccagcccagccccagaggaccttccgggacatcagcgaggacctgaagagctctgtgggctag

SEQ ID NO: 37270 - DNA, 1509 bp, Artificial Sequence
  Description of Artificial Sequence: Synthetic coding sequence
atggctgatggcggcggccccaaggatgcccccagcctgcggagcagccctggccctgccccccgggtgcccagggctgtgggccccagcggcggcggcggggagacccccaggacagctgccctggccctgcgctttgacaagcccatcaagcaggccttctacaacacaggagctgtgctgtttgtgtgcctgtgctgcggggctgctgtgctggtgtacttcatcctggaggccttcctgcggcccctgctgtgggccgtgctgtgtggcaccttcctgcaccccttcaagagcagcctgacccggctgggccgccactggctgcagaggctgcaccgggcccacacccccatcgtgctggccgccctgctgctgcccctgtgctttgtggactatggagtggaggccctgggggagcaggccctgcggcggcggcggctgctgctgctgctgggcgctgggggccccctgctgtatggcctgtactgcctgggcagctacctgggcgtgcaggtgctgctggtgcacgccgccaccctcatctgccggggcctggactacttcagcagcctgtggatctggaccctggtggtgggctacgtgctgactgtgtccttcaagtggaatgccagcacagagcgctacctgcgggctgtgtccatccctgtgtggatcatcctgctcttccacctggccagcctggccggctcctggagaattcctgtgttcctggtgattgtgttcctgatgtctgtgggcaccctgtatgagaagcagaatggcaaggagagcagcggggctgagctgcccggccaggtgatctccatggccgccagcaccctggccaacctggccatcagcatcaccggctatgagagcagcagcgaggaccagcccagcacccagcctgctgaggccgtggacagaggagagagcgcccccaccctgagcaccagccccagccccagcagccccagccccaccagccccagccccaccctgggcagaagaagacctgagatcggcaccttcctgaggaagaagaagaccagtgacatctactttgtgtccctggtgtgggccatcgtggtgatgcagatctggctgaacctgtggatcgtgcagctgctgcctgtgcccatcgctgtgtggatcctgaagaagctggtgatccactttggagtggtggacttcctggagaagcgctaccacgtgtggtggggcatcatcgagagcttcctgaaggagcggcagggcgccctggccccctggcccatcgtgggcctgggcaagttcctgctgaaggtggacagcaagatgatcatctggctggagaagatgctggacaagatcatcagcatcttcatcatcttcctgctggtgattggcaccctgctgctggccctgctgctgacagccaaggtgcaccaggagagcgtgcacatgattgaggtgaccagcaacctgatcaatgagaccctggccaaccaccctgagtgggcctag

SEQ ID NO: 37271 - DNA, 1296 bp, Artificial Sequence
  Description of Artificial Sequence: Synthetic coding sequence
atgttctggaggcggctgcggcctggggcccaggacctggcccccaagggcctgcctggagatggagacttcagaagaagcagtgacccccggctgcccaagctgaccccaccagccctgcgggccgccctgggcgcccggggcagcggggactggagaattcctgggggcggggccgcctggtggccagaaggagatgccaagccaggagtgggcgtgggccgcctgcccccccggctgcctgccctgctgacagccacccggcgggctgtgaggaagaggggcctgctgcggagcctgctgcccccacccctgctgtctgctggggccagccgggagagcgccccccggcagcccggccctggagagcgggagcggcccaggagaagagtggcccgggaggaccctgacttcctgggcgccttcctgggggagctgctgcccagccgcttccgggagttcctgcaccagctgcaggagaagtgtgccgaggagcctgagcccctgaccagccctgccccccagcaccagaggggcgtgctggagcactgccccggcagcccccgctgccccaactgcagcttcctgcctgacctgtggggccagagcagccacctgcaggacagcctgaccaagatcagcctgcagcagacccccatcctgggccccctgaagggggaccacagccagttcaccaccgtgaggaaggccaaccaccggccccacggggcccaggtgccccggctgaaggccgccctgacccacaaccccagcggggagggcagccggccctgccggcagcgctgccccttccgggtgcgctttgctgatgagaccctgcaggacaccaccctgcgctactgggagaggagaagatctgtgcagcagagcgtgattgtgaaccagaaggccgccctgcctgtggccagcgagcgggtgtttggatctgtgggcaagaggctggagagcctgcccaaggccctgtacccaggggccaaggaggagaccctggccagcagcagctgctgggactgtgccggcctgagcacccagaagacccagggctacctgtctgaggacacctccatgaacagcagcctgcccttctgctcctggaagaaggccgccgcccagaggcccaggagcagcctgcgggccttcctggacccccacaggaacctggagcaggagagcctgctgcccaacagagtgctgcagagcgtgctgaagcagggctgccccaagggctaccacctgctgctggccagcgccaccctgcagcctgacaagaggtag

SEQ ID NO: 37272 - DNA, 816 bp, Artificial Sequence
  Description of Artificial Sequence: Synthetic coding sequence
atgagggaccggcggggccccctgggcacctgcctggcccaggtgcagtgggccggcggcggggacagcgacaagctgagctacagcctgaagaagaggatgcccacagagggcccctggccagcagatgcccccagctggatgaacaagccagctgtggatggcaacagccagagcgaggccctgagcctggagatggccggcctgagcctgcccagcggcggccctgtgctgccctacgtgaaggagagcgccaggagaaatcctgccagcgctgccacccccagcgctgctgtgggcctcttccctgcccccacagagtactttgcccgggtgtcctgcagcggcgtggaggccctgggccgggactggctgggcggcggcccccgggccacccacggccaccggggccagtgccccaagggggagccccgggtgtcccggctgaccaggcaccagaagctgcctgagatgggcagcttctgggatgatcctccttctgccttccccagcggcctgggcagcgagctggagcccagctgcctgcacagcatcctgagcgccaccctgcacgcctgcccagaggtgctgctgaaggatgagaccaagaggatcttcctggacctgctgaaccccatgttcagcaagcagaccatcgagttcaagaagatgttcaagagcaccagtgatggcctgcagatcaccctgggcctgctggccctgcagcactttgagctggccaacagcctgtgccacagcctgaagtacaagcagaacaatgccagccgcctcatcctgcgggtggtgctggagtag

SEQ ID NO: 37273 - DNA, 240 bp, Artificial Sequence
  Description of Artificial Sequence: Synthetic coding sequence
atgaggcagaggggccaggagcacctgcccacctctgtgaagtctgagccccgggcctgcaacaaccccaccgtggctgaaaatagaagagtgcccagcggcctggccgctgtgatccggaacctgacagccctgtggaaccccagcctgggcgtgtctgaaagaagaggaggagactgggagcccagccgcatcccccggctgtgggcccgggtgggctggatccagctgcccggctag

SEQ ID NO: 37274 - DNA, 459 bp, Artificial Sequence
  Description of Artificial Sequence: Synthetic coding sequence
atgggcctgagccctggccagacctctgtgtccttcctgtggcccctgctggaggtgcgggaccacaacacaggccggggcctggtgcctgccaccgtgctgaccccaggcagccctgagaccctgctggagctgcggcaggccttcctgggcagccggcaggcccggcacggccatgatgctgcccccagcagcggccagcagggctgcagcgtggacagaacagctggccggcctgtgctgggctggaggctgaggaacagcctgaccggccaggagggccggcagcacctgcacctgagcggcatccgcaccagcaggaaggccaaggagtacaagcctgtgttctttggagccacagagatctctgtgctgatggctgtggccgagagcctgcgggagcccccaccaccccagtggggctggttcctgagcagcctcttcctgaagatcttctag

SEQ ID NO: 37275 - DNA, 603 bp, Artificial Sequence
  Description of Artificial Sequence: Synthetic coding sequence
atgcccctggtggaggagcggcaccgcatcctgaatgagaccgggaagatcctgctggagaagtttggaggcagcttcctgaactgtgtgcgggagagcgagaacagcgcccagaagctgatgcacctggtggtggagagcttccccagctacagagatgtgaccctgtttgagggcaagagggtgtccttctacaagagggcccagatcctggtggccgacacctggagcgtgctggagggcaaaggagatggctgcttcaaggacatcagcagcatcaccatgtttgctgactaccgcctgccccaggtgctggcccacctgggcgccctgaagtacagtgatgacctgctgaagaagctgctgaagggggagatgctgtcctatggagaccggcaggaggtggagatccggggctgcagcctgtggtgtgtggagctgatccgggactgcctgctggagctgattgagcagaagggggagaagcccaacggggagatcaacagcatcctgctggactactacctgtgggactatgcccatgaccaccgggaggacatgaagggcatccccttccaccgcatccgctgcatctactactag

SEQ ID NO: 37276 - DNA, 183 bp, Artificial Sequence
  Description of Artificial Sequence: Synthetic coding sequence
atgcccctggtggaggagcggcaccgcatcctgaatgagaccgggaagatcctgctggagaagtttggaggcagcttcctgaactgtgtgcgggagagcgagaacagcgcccagaagctgatgcacctggtggtggagagcttccccagctacagagatgtgaccctgtttgagtgcacctag

SEQ ID NO: 37277 - DNA, 1026 bp, Artificial Sequence
  Description of Artificial Sequence: Synthetic coding sequence
atggatggcctgctgaacccccgggagagcagcaagttcatcgccgagaacagcagagatgtgttcattgattctggaggagtgagaagagtggccgagctgctgctggccaaggccgccggccctgagctgcgggtggagggctggaaggccctgcacgagctgaaccccagggctgctgatgaagctgctgtgaactgggtgtttgtgacagacaccctgaacttctccttctggagcgagcaggatgagcacaagtgtgtggtgcgctaccggggcaagacctacagcggctactggagcctgtgtgccgctgtgaacagagccctggatgagggcatccccatcaccagcgccagctactatgccaccgtgaccctggaccaggtgaggaacatcctgcggagtgacacagatgtgtccatgcccctggtggaggagcggcaccgcatcctgaatgaaacaggcaagatcctgctggagaagtttggaggcagcttcctgaactgtgtgcgggagagtgaaaattctgcccagaagctgatgcacctggtggtggagagcttccccagctacagagatgtgaccctgtttgagggcaagagggtgtccttctacaagagggcccagatcctggtggccgacacctggagcgtgctggagggcaaaggagatggctgcttcaaggacatcagcagcatcaccatgtttgctgactaccgcctgccccaggtgctggcccacctgggcgccctgaagtacagtgatgacctgctgaagaagctgctgaagggggagatgctgtcctatggagaccggcaggaggtggagatccggggctgcagcctgtggtgtgtggagctgatccgggactgcctgctggagctgattgagcagaagggggagaagcccaatggagagatcaacagcatcctgctggactactacctgtgggactatgcccatgaccaccgggaggacatgaagggcatccccttccaccgcatccgctgcatctactactag

SEQ ID NO: 37278 - DNA, 888 bp, Artificial Sequence
  Description of Artificial Sequence: Synthetic coding sequence
atgaggcacagcgtggcccggcccacccggctgccccggcggctgagccccttctgggaccctgccacctgcaagaacctggagggcggggccggggaggtggtgcggggccgggacccccggcggctgcggaccagccgcagcacagagatcctgggggaggacctggccggccccagcgctggagctgctgcccggcctgctgcccccccaccccagccccgggagcccggggcccctggcctgcggcgggccccacccaggaccaggatggacagcagcggcctgggcccctgcagcgaggcccccctgcacaccagcgctggcctgtctggaagaaacctgcgggccgccggcggcgtgctgcctgtggacctggagcgggagagagctgccctgtgtgcccggcagagcggccacggccccccagctgtgcgctggctgctgggcagcagaggagctgagagcggcggcctggcccggcggcgggtggccgctgagcacgcccagcccagcgccaacctggtgtgccgcagcgccctggagaccagcgccttcccccccagcaagcccaagagcccccggggccgggtgcgggcccggagcagtgatggccgcctgcggcacccagcctggagggctggcagcggcggccggggcggccggggccccagcgctgagctggccagccgctactggggcagaagaagagccctgcccggggctgctgacctgcggcccaagggggcccgggcagatgacagaagacccctgcgggccggcaggaagctgcacctgcctgaggccgcccggctgcctggaaatgtgggcaagtctggagagccccacaaggccggggaggtgggcaaccacccccgggacagctag

SEQ ID NO: 37279 - DNA, 810 bp, Artificial Sequence
  Description of Artificial Sequence: Synthetic coding sequence
atgggcccccggcccctggagaagggctgcttccctggctgcttcttcaggaacagcaaggaggagagacatgagagcagaagacccctgagcaccagccatgagcccatcttccccctgaacaccatcaagatgaagctgaaggagaacaacctgaaccggctgcccaagggcatgcaggcccgggcccccagccagtacagcaccaggcacttcttccaggaccagcctgcccagctgaacctgggcaacaacttcaagatcagcggcggcagcaagcccccatttgtggtgcgccacgtggacagcgccaagccctttggagagaacatcagcgagcaccacctgcggcgcagcaggaggaagagcaagttcagtgacttccccttccccacccggcgggccagcagcctggacagcctggccgccaacgtgaaggtgatcaaggagccagatgaaagaattgtgctgcggagtgacagcagcagctgcctggacagcagccagtttgggaagagcagcagcagcaagcagggagatgctgacttccacggcaaggccagctttgccacctaccagcacagcaccagccctggccccctggaccagcccctgctgcgggagcgcttccaccctggcagccagagcacctggaagaacatccacgagcgggtgtgcagcctgctgaccagccaccgggcccagctgcaccagaacaaggaggacagcaccagcgaggtgaactacatcatcgagcggcccagctaccccctgaagaagtacagcctgcacgagcagcgctacttctag

SEQ ID NO: 37280 - DNA, 1179 bp, Artificial Sequence
  Description of Artificial Sequence: Synthetic coding sequence
atgcccctggaggtggtggtggagctgcagatccgggccatcagctgccctggggtcttcctgcccgggaagcaggatgtgtacctgggcgtgtacctgatgaaccagtacctggagaccaacagcttccccagcgccttccccatcatgatccaggagagcatgagatttgagaaggtgtttgaatctgctgtggaccctggagctgtggtggacctgctggagatgtgggatgagctggcctactatgaggagaacacccgggacttcctgtttcctgagcccaagctgacccccagccacccccggcgctgccgggaggtgctgatgaagacagccctgggcttccctggcatcgcccccaagattgagttcagcaccaggacagccatcagagaatgtgtgttcctgcacaggaaccgcttcctggaggagagacatgagagccggcggcccctgagcaccagccatgagcccatcttccccctgaacaccatcaagatgaagctgaaggagaacaacctgaaccggctgcccaagggcatgcaggcccgggcccccagccagtacagcaccaggcacttcttccaggaccagcctgcccagctgaacctgggcaacaacttcaagatcagcggcggcagcaagcccccatttgtggtgagacatgtggacagcgccaagccctttggagagaacatcagcgagcaccacctgcggcgcagcaggaggaagagcaagttcagtgacttccccttccccacccggcgggccagcagcctggacagcctggccgccaacgtgaaggtgatcaaggagccagatgagcgcatcgtgctgcggagtgacagcagcagctgcctggacagcagccagtttgggaagagcagcagcagcaagcagggagatgctgacttccacggcaaggccagctttgccacctaccagcacagcaccagccctggccccctggaccagcccctgctgcgggagcgcttccaccctggcagccagagcacctggaagaacatccacgagcgggtgtgcagcctgctgaccagccaccgggcccagctgcaccagaacaaggaggacagcaccagcgaggtgaactacatcatcgagcggcccagctaccccctgaagaagtacagcctgcacgagcagcgctacttctag

SEQ ID NO: 37281 - DNA, 408 bp, Artificial Sequence
  Description of Artificial Sequence: Synthetic coding sequence
atgacccccacccccacagctgcctggaccccacctccacccctgcggcccagcgctgctgctgctggggcccagtgccgcagctgccccttccggggcggctgtgcccccagcacagcccggaccccaccagcctgcatgaggcctgctggcccctgtgccccacccacctggccagcccccagcaccaccaccagcacctgcaccagcagaagagctggctgcacagccagcagcgccagctacagcaccctggccgccgcctgcagcctgcggcgcagcggcgtgcgctggccacccagcagcgcctacagcacctgggcctttgccagctgctgtgccagcagcgccagctgccgctgctgctgctgctgctgggccgccggggcctggaccagcgcctggtag

SEQ ID NO: 37282 - DNA, 870 bp, Artificial Sequence
  Description of Artificial Sequence: Synthetic coding sequence
atgcctgtggtgaggaagatcttcagaagaagaagaggagacagcgagagtgaagaagatgagcaggacagcgaggaggtgcggctgaagctggaggagacccgggaggtgcagaacctgaggaagaggcccaatggagtgtctgctgtggccctgctggtgggggagaaggtgcaggaggagaccaccctggtggatgaccccttccagatgaagacaggaggcatggtggacatgaagaagctgaaggagcggggcaaggacaagatcagcgaggaggaggacctgcacctgggcaccagcttctctgctgagaccaacagaagagatgaagatgctgacatgatgaagtacattgaaacagagctgaagaagaggaaaggaattgtggagcacgaggagcagaaggtgaagcccaagaatgctgaggactgcctgtatgagctgcctgagaacatccgggtgtcctctgccaagaagacagaggagatgctgagcaaccagatgctgagcggcatccctgaggtggacctgggcattgatgccaagatcaagaacatcatcagcacagaagatgccaaggcccggctgctggccgagcagcagaacaagaagaaggacagcgagaccagctttgtgcccaccaacatggctgtgaactacgtgcagcacaaccgcttctaccacgaggagctgaatgcccccatcagaagaaacaaggaggagcccaaggcccggcccctgcgggtgggggacacagagaagccagagcctgagaggagcccccccaacaggaagaggcctgccaatgagaaggccacagatgactaccactatgagaagttcaagaagatgaacagacgctactag

SEQ ID NO: 37283 - DNA, 528 bp, Artificial Sequence
  Description of Artificial Sequence: Synthetic coding sequence
atggtggacatgaagaagctgaaggagcggggcaaggacaagatcagcgaggaggaggacctgcacctgggcaccagcttctctgctgagaccaacagaagagatgaagatgctgacatgatgaagtacatcgagacagagctgaagaagaggaagggcatcgtggagcacgaggagcagaaggtgaagcccaagaatgctgaggactgcctgtatgagctgcctgagaacatccgggtgagcagcgccaagaagacagaggagatgctgagcaaccagatgctgagcggcatccctgaggtggacctgggcattgatgccaagatcaagaacatcatcagcacagaagatgccaaggcccggctgctggccgagcagcagaacaagaagaaggacagcgagaccagctttgtgcccaccaacatggctgtgaactacgtgcagcacaaccgcttctaccacgaggagctgaatgcccacacagagaagcagaggcgggcccagggccctgccctggagagcaggtag

SEQ ID NO: 37284 - DNA, 1086 bp, Artificial Sequence
  Description of Artificial Sequence: Synthetic coding sequence
atgaccgggaagaagagcagccgggagaagaggaggaagaggagcagccaggaggccgctgctgccctggccgccccagacatcgtgcctgccctggccagcggcagcagcggcagcaccagcggctgcggcagcgctgggggctgcggctctgtgtcctgctgcggaaatgccaacttcagcggctctgtgactggaggcggcagcggcggcagctgctggggcggcagctctgtggagaggtctgagaggaggaagagaagaagcacagacagcagctctgtgtctggcagcctgcagcaggagaccaagtacatcctgcccaccctggagaaggagctgttcctggccgagcacagcgacctggaggagggcggcctggacctgactgtgtccctgaagcctgtgtccttctacatcagtgacaagaaggagatgctgcagcagtgcttctgcatcatcggggagaagaagctgcagaagatgctgcctgatgtgctgaagaactgcagcattgaggagatcaagaagctgtgccaggagcagctggagctgctgtctgagaagaagatcctgaagatcctggagggggacaatggcatggacagcgacatggaggaggaggctgatgatggcagcaagatgggcagtgacctggtgtcccagcaggacatctgcattgattctgccagctctgtgcgggagaacaagcagcctgagggcctggagctgaagcagggcaagggggaggacagtgatgtgctgagcatcaatgctgatgcctatgacagcgacatcgagggcccctgcaatgaggaggccgccgcccctgaggccccagaaaatacagtgcagagcgaggccggccagattgatgacctggagaaggacatcgagaagtctgtgaatgagatcctgggcctggccgagagcagccccaatgagcccaaggccgccaccctggccgtgcccccaccagaagatgtgcagcccagcgcccagcagctggagctgctggagctggagatgagggcccgggccatcaaggccctgatgaaggccggggacatcaagaagccagcctag

SEQ ID NO: 37285 - DNA, 651 bp, Artificial Sequence
  Description of Artificial Sequence: Synthetic coding sequence
atgctgcagcagtgcttctgcatcattggagagaagaagctgcagaagatgctgcctgatgtgctgaagaactgcagcattgaggagatcaagaagctgtgccaggagcagctggagctgctgtctgagaagaagatcctgaagatcctggagggggacaatggcatggacagcgacatggaggaggaggctgatgatggcagcaagatgggcagtgacctggtgtcccagcaggacatctgcatcgacagcgccagctctgtgcgggagaacaagcagcctgagggcctggagctgaagcagggcaaaggagaagattctgatgtgctgagcatcaatgctgatgcctatgacagcgacatcgagggcccctgcaatgaggaggccgccgcccctgaggcccctgagaacacagtgcagagcgaggccggccagattgatgacctggagaaggacatcgagaagtctgtgaatgagatcctgggcctggccgagagcagccccaatgagcccaaggccgccaccctggccgtgcccccaccagaagatgtgcagcccagcgcccagcagctggagctgctggagctggagatgagggcccgggccatcaaggccctgatgaaggccggggacatcaagaagccagcctag

SEQ ID NO: 37286 - DNA, 4335 bp, Artificial Sequence
  Description of Artificial Sequence: Synthetic coding sequence
atgacagacacctctgtgctggaccagtggaaggccagcttctttgtggaggacttcctggagaagaagaccatcaccaggatggtgacccagatcaactgtgaatttgaggaggtggtgcccagcagcaacccagacagccagatcgaggtggaggaggtgtccctgtacacccacatggactacaatgaggtgttcacccctgtgtcctgcctggagaagtgcagcgccctgcagaaccagaaccaggacctcttcattgatgacaagggcatcctgtttgtgagcagcaggaagcacctgcccaccctgcccaccctgctgagccggctgaagctgttcctggtgaaggaccccctgctggacttcaagggccagatcttcacagaggccaacttcagccgggagtgcttcagcctgcaggagaccctggaggcctttgtgaaggaggacttctgcatggacaaggtgaacttctgccaggagaagctggaggacaccatctgcctgaatgagcccagcagcttcctgattgaatatgagttcctgatcccccccagcctgaagccagaaattgacatccccagcctgtctgagctgaaggagctgctgaaccctgtgcctgagatcatcaactacgtggatgagaaggagaagctgtttgagcgggacctgaccaacaagcatggaattgaggacatcggggacatcaagttcagcagcacagagatcctgaccatccagagccagagcgagccagaagaatgttccaagccaggagagctggagatgcccctgacccccctcttcctgacctgccagcacagctctgtgaacagcctgaggacagagctgcagaccttccccctgagccctgtgtgcaagatcaacctgctgacagctgaggagagcgccaatgagtactacatgatgtggcagctggagcgctgccgcagccccctgaaccccttcctgctgactgtgccccgcatccaggagccccacagccagtacagcgtgacagacctgaagaagatcttctctgtgaaggaggagagcctggtgatcaacctggagaaggccgagtggtggaagcaggccggcctgaacctgaagatgatggagaccctggagcacctgaacacctacctgtgccacgacaacctgagcagcaatgacaccaagattgagatcttcctgcccaccaaggtgctgcagctggagagctgcctggagcacaagagccacagcagccccatcgccctgattgatgagaagagcaccaatgcccacctgagcctgccccagaagagccccagcctggccaaggaggtgcctgacctgtgcttcagtgatgactacttcagtgacaagggggccgccaaggaggagaagcccaagaatgaccaggagcctgtgaaccgcatcatccagaagaaggaaaataatgaccactttgagctggactgcaccggccccagcatcaagagccccagcagcagcatcatcaagaaggccagctttgagcacggcaagaagcaggagaatgacctggacctgctgagtgacttcatcatgctgaggaacaagtacaagacctgcaccagcaagacagaggtgaccaacagtgatgagaagcatgacaaggaggcctgcagcctgaccctgcaggaggagagccccatcgtgcacatcaacaagaccctggaggagatcaaccaggagcggggcacagacagcgtcatcgagatccaggccagtgacagccagtgccaggccttctgcctgctggaggccgccgccagccccatcctgaagaacctggtgtccctgtgcaccctgcccacagccaactggaagtttgccaccgtcatctttgaccagacccgcttcctgctgaaggagcaggagaaggtggtgtctgatgctgtgcggcagggcaccattgatgagcgggagatgaccttcaagcatgctgccctgctgcacctgctggtgaccatcagagatgtgctgctgacctgcagcctggacacagccctgggctacctgagcaaggccaaggacatctacaacagcatcctgggcccctacctgggggacatctggaggcagctggagatcgtgcagttcatccggggcaagaagccagagaccaactacaagatccaggagctgcagtgccagatcctgtcctggatgcagagccagcagcagatcaaggtgctgatcatcatccgcatggacagtgatggagagaagcacttcctgatcaagatcctgaacaagattgagggcctgaccctgactgtgctgcacagcaatgaaaggaaggacttcctggagagcgagggcgtgctgcggggcaccagcagctgtgtggtggtgcacaaccagtacatcggggctgacttcccctggagcaacttctcctttgtggtggagtacaactacgtggaggacagctgctggaccaagcactgcaaggagctgaacatcccctacatggccttcaaggtgatcctgcctgacacagtgctggagaggagcaccctgctggacagatttggaggcttcctgctggagatccagatcccctacgtgttctttgccagcgagggcctgctgaacaccccagacatcctgcagctgctggagagcaactacaacatcagcctggtggagcggggctgcagcgagagcctgaagctgtttggcagcagtgaatgttatgtggtggtgaccattgatgagcacacagccatcatcctgcaggacctggaggagctgaactatgagaaggccagtgacaacatcatcatgaggctgatggccctgagcctgcagtaccgctactgctggatcatcctgtacaccaaggagaccctgaacagcgagtacctgctgacagagaagaccctgcaccacctggccctgatctatgctgccctggtgtcctttggcctgaacagcgaggagctggatgtgaagctgatcatcgcccctggggtggaggccacagccctgatcatccggcagattgctgaccacagcctgatgaccagcaagagggacccccatgagtggctggacaagtcctggctgaaggtgagccccagcgaggaggagatgtacctgctggacttcccctgcatcaaccccctggtggcccagctgatgctgaacaagggccccagcctgcactggatcctgctggccaccctgtgccagctgcaggagctgctgcctgaggtgcctgagaaggtgctgaagcacttctgcagcatcaccagcctcttcaagattggcagcagcagcatcaccaagagcccccagatcagcagcccccaggagaacagaaaccagatcagcaccctgagcagccagagcagcgccagtgacctggacagcgtcatccaggagcacaatgagtactaccagtacctgggcctgggggagaccgtgcaggaggacaagaccaccatcctgaatgacaacagcagcatcatggagctgaaggagatcagcagcttcctgccccctgtgaccagctacaaccagaccagctactggaaggacagcagctgcaagagcaacatcggccagaacacccccttcctgatcaacatcgagagcagaagacctgcctacaacagcttcctgaaccacagcgacagcgagagtgatgtgttcagcctgggcctgacccagatgaactgtgagaccatcaagagccccacagacacccagaagagggtgtctgtggtgccccgcttcatcaacagccagaagaggaggacccatgaggccaagggcttcatcaacaaggatgtgtctgaccccatcttcagcctggagggcacccagagccccctgcactggaacttcaagaagaacatctgggagcaggagaaccaccccttcaacctgcagtacggggcccagcagacagcctgcaacaagctgtacagccagaagggcaacctcttcacagaccagcagaagtgcctgagtgatgaaagtgagggcctgacctgtgagagcagcaaggatgagaccttctggagggagctgcccagcgtgcccagcctggacctcttccgggccagtgacagcaatgccaaccagaaggagttcaacagcctgtacttctaccagagagctgggaagagcctgggccagaagaggcaccacgagagcagcttcaacagcggggacaaggagagcctgaccggcttcatgtgcagccagctgccccagttcaagaagaggcggctggcctatgagaaggtgcccggccgggtggatggccagacccggctgcgcttcttctag

SEQ ID NO: 37287 - DNA, 1467 bp, Artificial Sequence
  Description of Artificial Sequence: Synthetic coding sequence
atgttttctgccctgaagtaccacgccatcgactacctgtatgaaaatgtggtgaggaagaagttctacagagatgccctgctgctgcgcatccccagctgcctgtaccaggatgagagctaccacgtggccgtgacagacaacaagttcagaagaccctggaccagggtgtctgctgtgtctgtgcccggcatgacagacacctctgtgctggaccagtggaaggccagcttctttgtggaggacttcctggagaagaagaccatcaccaggatggtgacccagatcaactgtgaatttgaggaggtggtgcccagcagcaacccagacagccagatcgaggtggaggaggtgtccctgtacacccacatggactacaatgaggtgttcacccctgtgtcctgcctggagaagtgcagcgccctgcagaaccagaaccaggacctcttcattgatgacaagggcatcctgtttgtgagcagcaggaagcacctgcccaccctgcccaccctgctgagccggctgaagctgttcctggtgaaggaccccctgctggacttcaagggccagatcttcacagaggccaacttcagccgggagtgcttcagcctgcaggagaccctggaggcctttgtgaaggaggacttctgcatggacaaggtgaacttctgccaggagaagctggaggacaccatctgcctgaatgagcccagcagcttcctgattgaatatgagttcctgatcccccccagcctgaagccagaaattgacatccccagcctgtctgagctgaaggagctgctgaaccctgtgcctgagatcatcaactacgtggatgagaaggagaagctgtttgagcgggacctgaccaacaagcatggaattgaggacatcggggacatcaagttcagcagcacagagatcctgaccatccagagccagagcgagccagaagaatgttccaagccaggagagctggagatgcccctgacccccctcttcctgacctgccagcacagctctgtgaacagcctgaggacagagctgcagaccttccccctgagccctgtgtgcaagatcaacctgctgacagctgaggagagcgccaatgagtactacatgatgtggcagctggagcgctgccgcagccccctgaaccccttcctgctgactgtgccccgcatccaggagccccacagccagtacagcgtgacagacctgaagaagatcttctctgtgaaggaggagagcctggtgatcaacctggagaaggccgagtggtggaagcaggccggcctgaacctgaagatgatggagaccctggagcacctgaacacctacctgtgccacgacaacctgagcagcaatgacaccaagattgagatcttcctgcccaccaaggtgctgcagctggagtgcaagtacatcaccgtgaacatctcctatgtgaacatcttcaggatgtag

SEQ ID NO: 37288 - DNA, 4335 bp, Artificial Sequence; identical to SEQ ID NO: 37286
  Description of Artificial Sequence: Synthetic coding sequence

SEQ ID NO: 37289 - DNA, 3177 bp, Artificial Sequence
  Description of Artificial Sequence: Synthetic coding sequence
atgatcatctgcctgctgatgaccctgaagctgcgctacctgcccaccaaggtgctgcagctggagagctgcctggagcacaagagccacagcagccccatcgccctgattgatgagaagagcaccaatgcccacctgagcctgccccagaagagccccagcctggccaaggaggtgcctgacctgtgcttcagtgatgactacttcagtgacaagggggccgccaaggaggagaagcccaagaatgaccaggagcctgtgaaccgcatcatccagaagaaggaaaataatgaccactttgagctggactgcaccggccccagcatcaagagccccagcagcagcatcatcaagaaggccagctttgagcacggcaagaagcaggagaatgacctggacctgctgagtgacttcatcatgctgaggaacaagtacaagacctgcaccagcaagacagaggtgaccaacagtgatgagaagcatgacaaggaggcctgcagcctgaccctgcaggaggagagccccatcgtgcacatcaacaagaccctggaggagatcaaccaggagcggggcacagacagcgtcatcgagatccaggccagtgacagccagtgccaggccttctgcctgctggaggccgccgccagccccatcctgaagaacctggtgtccctgtgcaccctgcccacagccaactggaagtttgccaccgtcatctttgaccagacccgcttcctgctgaaggagcaggagaaggtggtgtctgatgctgtgcggcagggcaccattgatgagcgggagatgaccttcaagcatgctgccctgctgcacctgctggtgaccatcagagatgtgctgctgacctgcagcctggacacagccctgggctacctgagcaaggccaaggacatctacaacagcatcctgggcccctacctgggggacatctggaggcagctggagatcgtgcagttcatccggggcaagaagccagagaccaactacaagatccaggagctgcagtgccagatcctgtcctggatgcagagccagcagcagatcaaggtgctgatcatcatccgcatggacagtgatggagagaagcacttcctgatcaagatcctgaacaagattgagggcctgaccctgactgtgctgcacagcaatgaaaggaaggacttcctggagagcgagggcgtgctgcggggcaccagcagctgtgtggtggtgcacaaccagtacatcggggctgacttcccctggagcaacttctcctttgtggtggagtacaactacgtggaggacagctgctggaccaagcactgcaaggagctgaacatcccctacatggccttcaaggtgatcctgcctgacacagtgctggagaggagcaccctgctggacagatttggaggcttcctgctggagatccagatcccctacgtgttctttgccagcgagggcctgctgaacaccccagacatcctgcagctgctggagagcaactacaacatcagcctggtggagcggggctgcagcgagagcctgaagctgtttggcagcagtgaatgttatgtggtggtgaccattgatgagcacacagccatcatcctgcaggacctggaggagctgaactatgagaaggccagtgacaacatcatcatgaggctgatggccctgagcctgcagtaccgctactgctggatcatcctgtacaccaaggagaccctgaacagcgagtacctgctgacagagaagaccctgcaccacctggccctgatctatgctgccctggtgtcctttggcctgaacagcgaggagctggatgtgaagctgatcatcgcccctggggtggaggccacagccctgatcatccggcagattgctgaccacagcctgatgaccagcaagagggacccccatgagtggctggacaagtcctggctgaaggtgagccccagcgaggaggagatgtacctgctggacttcccctgcatcaaccccctggtggcccagctgatgctgaacaagggccccagcctgcactggatcctgctggccaccctgtgccagctgcaggagctgctgcctgaggtgcctgagaaggtgctgaagcacttctgcagcatcaccagcctcttcaagattggcagcagcagcatcaccaagagcccccagatcagcagcccccaggagaacagaaaccagatcagcaccctgagcagccagagcagcgccagtgacctggacagcgtcatccaggagcacaatgagtactaccagtacctgggcctgggggagaccgtgcaggaggacaagaccaccatcctgaatgacaacagcagcatcatggagctgaaggagatcagcagcttcctgccccctgtgaccagctacaaccagaccagctactggaaggacagcagctgcaagagcaacatcggccagaacacccccttcctgatcaacatcgagagcagaagacctgcctacaacagcttcctgaaccacagcgacagcgagagtgatgtgttcagcctgggcctgacccagatgaactgtgagaccatcaagagccccacagacacccagaagagggtgtctgtggtgccccgcttcatcaacagccagaagaggaggacccatgaggccaagggcttcatcaacaaggatgtgtctgaccccatcttcagcctggagggcacccagagccccctgcactggaacttcaagaagaacatctgggagcaggagaaccaccccttcaacctgcagtacggggcccagcagacagcctgcaacaagctgtacagccagaagggcaacctcttcacagaccagcagaagtgcctgagtgatgaaagtgagggcctgacctgtgagagcagcaaggatgagaccttctggagggagctgcccagcgtgcccagcctggacctcttccgggccagtgacagcaatgccaaccagaaggagttcaacagcctgtacttctaccagagagctgggaagagcctgggccagaagaggcaccacgagagcagcttcaacagcggggacaaggagagcctgaccggcttcatgtgcagccagctgccccagttcaagaagaggcggctggcctatgagaaggtgcccggccgggtggatggccagacccggctgcgcttcttctag

SEQ ID NO: 37290 - DNA, 4218 bp, Artificial Sequence
  Description of Artificial Sequence: Synthetic coding sequence
atgtctgagaccctgggagatgagctggagatcctgcggggcaagatgatgcagaggcggcccaggtctgctgaggtgaagtacttctacttcttcaagatcctgctgcggctgcggctggccatcctgaagtacctgttcattgatgacaagggcatcctgtttgtgagcagcaggaagcacctgcccaccctgcccaccctgctgagccggctgaagctgttcctggtgaaggaccccctgctggacttcaagggccagatcttcacagaggccaacttcagccgggagtgcttcagcctgcaggagaccctggaggcctttgtgaaggaggacttctgcatggacaaggtgaacttctgccaggagaagctggaggacaccatctgcctgaatgagcccagcagcttcctgattgaatatgagttcctgatcccccccagcctgaagccagaaattgacatccccagcctgtctgagctgaaggagctgctgaaccctgtgcctgagatcatcaactacgtggatgagaaggagaagctgtttgagcgggacctgaccaacaagcacggcattgaagatattggagacatcaagttcagcagcacagagatcctgaccatccagagccagagcgagcctgaggagtgcagcaagccaggagagctggagatgcccctgacccccctcttcctgacctgccagcacagctctgtgaacagcctgaggacagagctgcagaccttccccctgagccctgtgtgcaagatcaacctgctgacagctgaggagagcgccaatgagtactacatgatgtggcagctggagcgctgccgcagccccctgaaccccttcctgctgactgtgccccgcatccaggagccccacagccagtacagcgtgacagacctgaagaagatcttctctgtgaaggaggagagcctggtgatcaacctggagaaggccgagtggtggaagcaggccggcctgaacctgaagatgatggagaccctggagcacctgaacacctacctgtgccacgacaacctgagcagcaatgacaccaagattgagatcttcctgcccaccaaggtgctgcagctggagagctgcctggagcacaagagccacagcagccccatcgccctgattgatgagaagagcaccaatgcccacctgagcctgccccagaagagccccagcctggccaaggaggtgcctgacctgtgcttcagtgatgactacttcagtgacaagggagctgccaaggaggagaagcccaagaatgaccaggagcctgtgaaccgcatcatccagaagaaggagaacaatgaccactttgagctggactgcaccggccccagcatcaagagccccagcagcagcatcatcaagaaggccagctttgaacatggcaagaagcaggagaatgacctggacctgctgagtgacttcatcatgctgaggaacaagtacaagacctgcaccagcaagacagaggtgaccaacagtgatgagaagcatgacaaggaggcctgcagcctgaccctgcaggaggagagccccatcgtgcacatcaacaagaccctggaggagatcaaccaggagcggggcacagattctgtgattgagatccaggccagtgacagccagtgccaggccttctgcctgctggaggccgccgccagccccatcctgaagaacctggtgtccctgtgcaccctgcccacagccaactggaagtttgccaccgtcatctttgaccagacccgcttcctgctgaaggagcaggagaaggtggtgtctgatgctgtgcggcagggcaccattgatgagcgggagatgaccttcaagcacgccgccctgctgcacctgctggtgaccatcagagatgtgctgctgacctgcagcctggacacagccctgggctacctgagcaaggccaaggacatctacaacagcatcctgggcccctacctgggggacatctggaggcagctggagatcgtgcagttcatccggggcaagaagccagagaccaactacaagatccaggagctgcagtgccagatcctgtcctggatgcagagccagcagcagatcaaggtgctgatcatcatccgcatggacagtgatggagagaagcacttcctgatcaagatcctgaacaagattgagggcctgaccctgactgtgctgcacagcaatgaaaggaaggacttcctggagagcgagggcgtgctgcggggcaccagcagctgtgtggtggtgcacaaccagtacatcggggctgacttcccctggagcaacttctcctttgtggtggagtacaactacgtggaggacagctgctggaccaagcactgcaaggagctgaacatcccctacatggccttcaaggtgatcctgcctgacacagtgctggagaggagcaccctgctggacagatttggaggcttcctgctggagatccagatcccctacgtgttctttgccagcgagggcctgctgaacaccccagacatcctgcagctgctggagagcaactacaacatcagcctggtggagcggggctgcagcgagagcctgaagctgtttggcagcagcgagtgctacgtggtggtgaccattgatgagcacacagccatcatcctgcaggacctggaggagctgaactatgagaaggccagtgacaacatcatcatgaggctgatggccctgagcctgcagtaccgctactgctggatcatcctgtacaccaaggagaccctgaacagcgagtacctgctgacagagaagaccctgcaccacctggccctgatctatgctgccctggtgtcctttggcctgaacagcgaggagctggatgtgaagctgatcatcgcccctggggtggaggccacagccctgatcatccggcagattgctgaccacagcctgatgaccagcaagagggacccccatgagtggctggacaagtcctggctgaaggtgagccccagcgaggaggagatgtacctgctggacttcccctgcatcaaccccctggtggcccagctgatgctgaacaagggccccagcctgcactggatcctgctggccaccctgtgccagctgcaggagctgctgcctgaggtgcctgagaaggtgctgaagcacttctgcagcatcaccagcctcttcaagattggcagcagcagcatcaccaagagcccccagatcagcagcccccaggagaacagaaaccagatcagcaccctgagcagccagagcagcgccagtgacctggacagcgtcatccaggagcacaatgagtactaccagtacctgggcctgggggagaccgtgcaggaggacaagaccaccatcctgaatgacaacagcagcatcatggagctgaaggagatcagcagcttcctgccccctgtgaccagctacaaccagaccagctactggaaggacagcagctgcaagagcaacatcggccagaacacccccttcctgatcaacatcgagagccggcggcctgcctacaacagcttcctgaaccacagcgacagcgagagtgatgtgttcagcctgggcctgacccagatgaactgtgagaccatcaagagccccacagacacccagaagagggtgtctgtggtgccccgcttcatcaacagccagaagaggaggacccatgaggccaagggcttcatcaacaaggatgtgtctgaccccatcttcagcctggagggcacccagagccccctgcactggaacttcaagaagaacatctgggagcaggagaaccaccccttcaacctgcagtatggagcccagcagacagcctgcaacaagctgtacagccagaagggcaacctcttcacagaccagcagaagtgcctgagtgatgagagcgagggcctgacctgtgagagcagcaaggatgagaccttctggagggagctgcccagcgtgcccagcctggacctcttccgggccagtgacagcaatgccaaccagaaggagttcaacagcctgtacttctaccagagagctgggaagagcctgggccagaagaggcaccacgagagcagcttcaacagcggggacaaggagagcctgaccggcttcatgtgcagccagctgccccagttcaagaagaggcggctggcctatgagaaggtgcccggccgggtggatggccagacccggctgcgcttcttctag

SEQ ID NO: 37291 - DNA, 474 bp, Artificial Sequence
  Description of Artificial Sequence: Synthetic coding sequence
atgagcagccagaagggaaatgtggcccggagccggccccagaagcaccagaacaccttctccttcaagaatgacaagtttgacaagtctgtgcagaccaagaagatcaatgccaagctgcatgatggagtgtgccagcgctgcaaggaggtgctggagtggagggtgaagtacagcaagtacaagcccctgagcaagcccaagaagtgtgtgaagtgcctgcagaagacagtgaaggacagctaccacatcatgtgccggccctgtgcctgtgagctggaggtgtgtgccaagtgtgggaagaaggaggacatcgtcatccccctgaacaaggagacagagaagattgagcacacagagaacaacctgagcagcaaccaccggcgcagctgcagaagaaatgaggagagtgatgatgacctggactttgatattgacctggaggacaccggcggggaccaccagatgaactag

SEQ ID NO: 37292 - DNA, 108 bp, Artificial Sequence
  Description of Artificial Sequence: Synthetic coding sequence
atgagcagccagaagggaaatgtggcccggagccggccccagaagcaccagaacaccttctccttcaagaatgacaagtttgacaagtctgtgcagaccaagtgctag

SEQ ID NO: 37293 - DNA, 540 bp, Artificial Sequence
  Description of Artificial Sequence: Synthetic coding sequence
atgagcagccagaagggaaatgtggcccggagccggccccagaagcaccagaacaccttctccttcaagaatgacaagtttgacaagtctgtgcagaccaagaagatcaatgccaagctgcatgatggagtgtgccagcgctgcaaggaggtgctggagtggagggtgaagtacagcaagtacaagcccctgagcaagcccaagaagtgtgtgaagtgcctgcagaagacagtgaaggacagctaccacatcatgtgccggccctgtgcctgtgagctggaggtgtgtgccaagtgtgggaagaaggaggacatcgtcatcccctggagcctgcccctgctgccccggctggagtgcagcggccgcatcctggcccaccacaacctgcggctgccctgcagcagtgacagccctgccagcgccagccgggtggccggcaccaccggggcccaccaccacgcccagctgatctttgtgttcctggtggagatgggcttccactacgtgggccaggccggcctggagctgctgaccagctag

SEQ ID NO: 37294 - DNA, 507 bp, Artificial Sequence
  Description of Artificial Sequence: Synthetic coding sequence
atgaatgaggtgaaggagagcctgcggagcattgagcagaagtacaagctgttccagcagcagcagctgaccttcaccgctgccctggagcactgccgggagaatgcccatgacaagatccggcccatcagcagcatcggccaggtgcagagctacatggagcactactgcaacagcagcacagacagaagagtgctgctgatgttcctggacatctgcagcgagctgaacaagctgtgccagcactttgaagctgtgcacagcggcacccctgtgaccaacaacctgctggagaagtgcaagaccctggtgtcccagagcaatgacctgagcagcctgcgggccaagtacccccatgatgtggtgaaccacctgagctgtgatgaggccaggaaccactacggcggcgtggtgtccctcatccccctcatcctggacctgatgaaggagtggatcgcccacagcgagaagctgcccaggaaggtgctgcagcacggcaccacctag

SEQ ID NO: 37295 - DNA, 669 bp, Artificial Sequence
  Description of Artificial Sequence: Synthetic coding sequence
atgaatgaggtgaaggagagcctgcggagcattgagcagaagtacaagctgttccagcagcagcagctgaccttcaccgctgccctggagcactgccgggagaatgcccatgacaagatccggcccatcagcagcatcggccaggtgcagagctacatggagcactactgcaacagcagcacagacagaagagtgctgctgatgttcctggacatctgcagcgagctgaacaagctgtgccagcactttgaagctgtgcacagcggcacccctgtgaccaacaacctgctggagaagtgcaagaccctggtgtcccagagcaatgacctgagcagcctgcgggccaagtacccccatgatgtggtgaaccacctgagctgtgatgaggccaggaaccactacggcggcgtggtgtccctcatccccctcatcctggacctgatgaaggagtggatcgcccacagcgagaagctgcccaggaaggtgctgcagcacgtgtctgagccccaggcccaccaggagagcaccagaggagctgcccggcctgcccaggccatcggcacccagccccgggccaccaagcacaagtgccggcagctgaccaaggccagcctgaagccccggggctgcagcaagccaccctggaggcctcctgggggcaagctgtag

SEQ ID NO: 37296 - DNA, 669 bp, Artificial Sequence; identical to SEQ ID NO: 37295
  Description of Artificial Sequence: Synthetic coding sequence

SEQ ID NO: 37297 - DNA, 234 bp, Artificial Sequence
  Description of Artificial Sequence: Synthetic coding sequence
atggcccgcttccagaggaccaaggagcgggaggaggaccgctgcagcctgaacatctactacgtgaggaacaccacccagggcacagccccagcctgtgtgggcaagaggatgcagcccagccccactggaaaaggaggcaagtgctgcaccgtgcacggcctgaccaggaagatccacaacgtgcagcccaacctgcagagccccatcctgtctgctgcctgtgtggactag

SEQ ID NO: 37298 - DNA, 327 bp, Artificial Sequence
  Description of Artificial Sequence: Synthetic coding sequence
atggagctgaacaccaacatcaagagcaagaagggcctgggcagaagaaacctgaagcccatgaatggagcctggcccccagcccggcgggagatggcccgcttccagaggaccaaggagcgggaggaggaccgctgcagcctgaacatctactacgtgaggaacaccacccagggcacagccccagcctgtgtgggcaagaggatgcagcccagccccaccgggaagggcggcaagtgctgcaccgtgcacggcctgaccaggaagatccacaacgtgcagcccaacctgcagagccccatcctgtctgctgcctgtgtggactag

SEQ ID NO: 37299 - DNA, 234 bp, Artificial Sequence; identical to SEQ ID NO: 37297
  Description of Artificial Sequence: Synthetic coding sequence

SEQ ID NO: 37300 - DNA, 225 bp, Artificial Sequence
  Description of Artificial Sequence: Synthetic coding sequence
tgaaatggagcctggcccccagcccggcgggagatggcccgcttccagaggaccaaggagcgggaggaggaccgctgcagcctgaacatctactacgtgaggaacaccacccagggcacagccccagcctgcagccagggccgctacatcatgtacagccgcatctacagcctgctcttctgccagctgctggtgctgatcaagaccagcatcaagatcctgtag

SEQ ID NO: 37301 - DNA, 3690 bp, Artificial Sequence
  Description of Artificial Sequence: Synthetic coding sequence
atgaacctgaacaccagcagcaacacaggagacacccagaggctgaagatcgccagcctggatgtgaagcagatcctgaagaatgaaacagagctggacatcacagacaacctgaggaagaagctgcactgggccaagaaggagaagctggagatcaccaccaagcacaatgctgagctggccagctatgagagccagatcgccaagctgcggtctgaggtggagaagggggaggccctgcggcagagcctggagtatgacctggccgtggccaggaaggaggccggcctgggcagaagagctgctgaggagcggctggccgaggcccaccgcatccaggagaagctgtgtgcccagaacagcgagctgcaggccaagaccaatgaaacagagaaggccttccagaccagccagcagaagtggaaggaggagtgccgccgctttgaacatgacctggaggagcgggacaacatgatccagaactgcaaccgggagtatgacctgctgatgaaggagaagagccggctggagaagaccctgcaggaggccctggagaagcaccagcgggagaagaatgagatggagagccacatccgggagacagccctggaggagttccggctgcaggaggagcagtgggaggccgagcggcgggagctgcagttcatcgtgcaggagcaggacacagctgtgcagaacatgcacaagaaggtggagaagctggagacagagcacatggactgcagcgacctgctgcggcggcagaccagcgagctggagttcagcacccagcgggaggagcggctgaggaaggagtttgaggccaccaccctgcgggtgaggaagctggaggagaacattgaagctgagcgggccgcccacctggagagcaagttcaacagcgagatcatccagctgcgcatccgggacctggagggcgccctgcaggtggagaaggccagccaggccgaggccgtggccgacctggagatcatcaagaatgagttcaaggaggtggagagcgcctatgagcgggagaagcacaatgcccaggagagctttgccaagctgaacctgctggagaaggagtacttcagcaagaacaagaagctgaatgaagatattgaggagcagaagaaggtgatcatcgacctgagcaagaggctgcagtacaatgagaagagctgcagcgagctgcaggaggagctggtgatggccaagaagcaccaggccttcctggtggagacctgtgagaacaacgtgaaggagctggagagcatcctggacagcttcaccgtgtctggccagtggaccagcggcatccacaaggacaaggacaagccacccagcttctctgtggtgctggagcggctgcggaggaccctgacagactaccagaacaagctggaggatgccagcaatgaggagaaggcctgcaatgagctggacagcaccaagcagaagattgacagccacaccaagaacatcaaggagctgcaggacaagctggctgatgtgaacaaggagctgagccacctgcacaccaagtgtgccgaccgggaggccctgatcagcaccctgaaggtggagctgcagaatgtgctgcactgctgggagaaggagaaggcccaggccgcccagagcgagagcgagctgcagaagctgagccaggccttccacaaggatgctgaggagaagctgaccttcctgcacaccctgtaccagcacctggtggccggctgtgtgctgatcaagcagcctgagggcatgctggacaagttctcctggagcgagctgtgtgctgtgctgcaggagaatgtggatgccctgattgctgacctgaacagagccaatgagaagatccgccacctggagtacatctgcaagaacaagagtgacaccatgagggagctgcagcagacccaggaggacaccttcaccaaggtggccgagcagatcaaggcccaggagagctgctggcaccggcagaagaaggagctggagctgcagtacagcgagctgttcctggaggtgcagaagagggcccagaagttccaggagattgctgagaagaacatggagaagctgaaccacatcgagaagagccatgagcagctggtgctggagaacagccacttcaagaagctgctgagccagacccagcgggagcagatgagcctgctggccgcctgtgccctgatggccggggccctgtaccccctgtacagccgcagctgtgccctgagcacccagagggacttcctgcaggagcaggtgaacacctttgagctgttcaagctggagatccgcaccctggcccaggccctgagcacagtggaggagaagaagcaggaggaggccaagatgaagaagaagaccttcaagggcctcatccgcatcttcagaaaaggagtgattgctgtgctggccgccaaccggctgaagatcctgggccagagctgtgccagcctcttcacctggatggagagcttcaaggagggcatcggcatgctggtgtgcacaggagagccccaggacaagcacaagttccccaagcaccagaaggagcagctgcgctgcctgcaggccctgtcctggctgaccagcagtgacctgctggccgccatcatcagctccatggccgagctgcaggatgtgattggcaaggctgaccccaacagccgcatctgtggccacctgctgattggagctgccaagaacagctttgccaagctgatggacaagatcagcctggtgatggagtgcatccccctgcacagcagccgcagcatcacctacgtggagaaggacagcctggtgcagaggctggcccacggcctgcacaaggtgaacaccctggccctgaagtatggcctgcggggccacgtgcccatcaccaagagcacagccagcctgcagaagcagatcctgggcttcacccagaggctgcatgctgctgaggtggagcggcgcagcctgcggctggaggtgacagagttcaagaggtctgtgaatgagatgaagaaggagctggacaaggcccagggcctgcagatgcagctgaatgagttcaagcagagcaagctgatcacccatgagaagtttgaaagtgcctgtgaggagctgaacaatgccctgctgcgggaggagcaggcccagatgctgctgaatgagcaggcccagcagctgcaggagctgaactacaagctggagctgcacagcagcgaggaggccgacaagaaccagaccctgggggaggccgtgaagagcctgtctgaggccaagatggagctgcggaggaaggaccagagcctgcggcagctgaacagacacctgacccagctggagcaggacaagaggcggctggaggagaacatccatgatgctgagagcgccctgaggatggccgccaaggacaaggaatgtgtggccaaccacatgagagctgtggagaacaccctgcacaaggtgcgggaccagatcagcctgtcctggagcgctgccagcagaaatgacttcaccctgcagctgcccaagctgcacctggagacctttgccatggagggcctgaagggcggccctgaggtggtggcctgccaggtgcgggtgcagtggtgtgaccacagcagcctgcagagccagatgcctggcctgaagcagagcagctgcctgagcctgctgagcacctag

SEQ ID NO: 37302 - DNA, 411 bp, Artificial Sequence
  Description of Artificial Sequence: Synthetic coding sequence
atgagagctgtggagaacaccctgcacaaggtgcgggaccagatcagcctgtcctggagcgctgccagcagaaatgacttcaccctgcagctgcccaagctgcacctggagacctttgccatggagggcctgaagggcggccctgaggtggtggcctgccaggccatgatcaagagcttcatggatgtgtaccagctggccagcacccgcatcatgaccctggagaaggagatgaccagccacaggagccacatcgccgccctgaagtctgagctgcacacagcctgcctgagagaaaatgccagcctgcagagcgacaccttcatcatctccttcagaagagatggcagcccctgcagcgacagcagcagcattgaatgtgagaccttcccccaggtgatcctgatgtag

SEQ ID NO: 37303 - DNA, 1497 bp, Artificial Sequence
  Description of Artificial Sequence: Synthetic coding sequence
atggccggggccctgtaccccctgtacagccgcagctgtgccctgagcacccagagggacttcctgcaggagcaggtgaacacctttgagctgttcaagctggagatccgcaccctggcccaggccctgagcacagtggaggagaagaagcaggaggaggccaagatgaagaagaagaccttcaagggcctcatccgcatcttcaggaagggcgtgattgctgtgctggccgccaaccggctgaagatcctgggccagagctgtgccagcctcttcacctggatggagagcttcaaggagggcatcggcatgctggtgtgcaccggggagccccaggacaagcacaagttccccaagcaccagaaggagcagctgcgctgcctgcaggccctgtcctggctgaccagcagtgacctgctggccgccatcatcagctccatggccgagctgcaggacgtcatcggcaaggctgaccccaacagccgcatctgtggccacctgctgattggagctgccaagaacagctttgccaagctgatggacaagatcagcctggtgatggagtgcatccccctgcacagcagccgcagcatcacctacgtggagaaggacagcctggtgcagaggctggcccacggcctgcacaaggtgaacaccctggccctgaagtatggcctgcggggccacgtgcccatcaccaagagcacagccagcctgcagaagcagatcctgggcttcacccagaggctgcacgccgctgaggtggagaggaggagcctgcggctggaggtgacagagttcaagaggtctgtgaatgagatgaagaaggagctggacaaggcccagggcctgcagatgcagctgaatgagttcaagcagagcaagctgatcacccatgagaagtttgagagcgcctgtgaggagctgaacaatgccctgctgcgggaggagcaggcccagatgctgctgaatgagcaggcccagcagctgcaggagctgaactacaagctggagctgcacagcagcgaggaggccgacaagaaccagaccctgggggaggccgtgaagagcctgtctgaggccaagatggagctgcggaggaaggaccagagcctgcggcagctgaacagacacctgacccagctggagcaggacaagaggcggctggaggagaacatccatgatgctgagagcgccctgaggatggccgccaaggacaaggaatgtgtggccaaccacatgagagctgtggagaacaccctgcacaaggtgcgggaccagatcagcctgtcctggagcgctgccagcagaaatgacttcaccctgcagctgcccaagctgcacctggagacctttgccatggagggcctgaagggcggccctgaggtggtggcctgccaggtgcgggtgcgggtgcagtggtgtgaccacagcagcctgcagagccagatgcctggcctgaagcagagcagctgcctgagcctgctgagcacctag

SEQ ID NO: 37304 - DNA, 3981 bp, Artificial Sequence
  Description of Artificial Sequence: Synthetic coding sequence
atgaacctgaacaccagcagcaacacaggagacacccagaggctgaagatcgccagcctggatgtgaagcagatcctgaagaatgaaacagagctggacatcacagacaacctgaggaagaagctgcactgggccaagaaggagaagctggagatcaccaccaagcacaatgctgagctggccagctatgagagccagatcgccaagctgcggtctgaggtggagaagggggaggccctgcggcagagcctggagtatgacctggccgtggccaggaaggaggccggcctgggcagaagagctgctgaggagcggctggccgaggcccaccgcatccaggagaagctgtgtgcccagaacagcgagctgcaggccaagaccaatgaaacagagaaggccttccagaccagccagcagaagtggaaggaggagtgccgccgctttgaacatgacctggaggagcgggacaacatgatccagaactgcaaccgggagtatgacctgctgatgaaggagaagagccggctggagaagaccctgcaggaggccctggagaagcaccagcgggagaagaatgagatggagagccacatccgggagacagccctggaggagttccggctgcaggaggagcagtgggaggccgagcggcgggagctgcagttcatcgtgcaggagcaggacacagctgtgcagaacatgcacaagaaggtggagaagctggagacagagcacatggactgcagcgacctgctgcggcggcagaccagcgagctggagttcagcacccagcgggaggagcggctgaggaaggagtttgaggccaccaccctgcgggtgaggaagctggaggagaacattgaagctgagcgggccgcccacctggagagcaagttcaacagcgagatcatccagctgcgcatccgggacctggagggcgccctgcaggtggagaaggccagccaggccgaggccgtggccgacctggagatcatcaagaatgagttcaaggaggtggagagcgcctatgagcgggagaagcacaatgcccaggagagctttgccaagctgaacctgctggagaaggagtacttcagcaagaacaagaagctgaatgaagatattgaggagcagaagaaggtgatcatcgacctgagcaagaggctgcagtacaatgagaagagctgcagcgagctgcaggaggagctggtgatggccaagaagcaccaggccttcctggtggagacctgtgagaacaacgtgaaggagctggagagcatcctggacagcttcaccgtgtctggccagtggaccagcggcatccacaaggacaaggacaagccacccagcttctctgtggtgctggagcggctgcggaggaccctgacagactaccagaacaagctggaggatgccagcaatgaggagaaggcctgcaatgagctggacagcaccaagcagaagattgacagccacaccaagaacatcaaggagctgcaggacaagctggctgatgtgaacaaggagctgagccacctgcacaccaagtgtgccgaccgggaggccctgatcagcaccctgaaggtggagctgcagaatgtgctgcactgctgggagaaggagaaggcccaggccgcccagagcgagagcgagctgcagaagctgagccaggccttccacaaggatgctgaggagaagctgaccttcctgcacaccctgtaccagcacctggtggccggctgtgtgctgatcaagcagcctgagggcatgctggacaagttctcctggagcgagctgtgtgctgtgctgcaggagaatgtggatgccctgattgctgacctgaacagagccaatgagaagatccgccacctggagtacatctgcaagaacaagagtgacaccatgagggagctgcagcagacccaggaggacaccttcaccaaggtggccgagcagatcaaggcccaggagagctgctggcaccggcagaagaaggagctggagctgcagtacagcgagctgttcctggaggtgcagaagagggcccagaagttccaggagattgctgagaagaacatggagaagctgaaccacatcgagaagagccatgagcagctggtgctggagaacagccacttcaagaagctgctgagccagacccagcgggagcagatgagcctgctggccgcctgtgccctgatggccggggccctgtaccccctgtacagccgcagctgtgccctgagcacccagagggacttcctgcaggagcaggtgaacacctttgagctgttcaagctggagatccgcaccctggcccaggccctgagcacagtggaggagaagaagcaggaggaggccaagatgaagaagaagaccttcaagggcctcatccgcatcttcagaaaaggagtgattgctgtgctggccgccaaccggctgaagatcctgggccagagctgtgccagcctcttcacctggatggagagcttcaaggagggcatcggcatgctggtgtgcacaggagagccccaggacaagcacaagttccccaagcaccagaaggagcagctgcgctgcctgcaggccctgtcctggctgaccagcagtgacctgctggccgccatcatcagctccatggccgagctgcaggatgtgattggcaaggctgaccccaacagccgcatctgtggccacctgctgattggagctgccaagaacagctttgccaagctgatggacaagatcagcctggtgatggagtgcatccccctgcacagcagccgcagcatcacctacgtggagaaggacagcctggtgcagaggctggcccacggcctgcacaaggtgaacaccctggccctgaagtatggcctgcggggccacgtgcccatcaccaagagcacagccagcctgcagaagcagatcctgggcttcacccagaggctgcatgctgctgaggtggagcggcgcagcctgcggctggaggtgacagagttcaagaggtctgtgaatgagatgaagaaggagctggacaaggcccagggcctgcagatgcagctgaatgagttcaagcagagcaagctgatcacccatgagaagtttgaaagtgcctgtgaggagctgaacaatgccctgctgcgggaggagcaggcccagatgctgctgaatgagcaggcccagcagctgcaggagctgaactacaagctggagctgcacagcagcgaggaggccgacaagaaccagaccctgggggaggccgtgaagagcctgtctgaggccaagatggagctgcggaggaaggaccagagcctgcggcagctgaacagacacctgacccagctggagcaggacaagaggcggctggaggagaacatccatgatgctgagagcgccctgaggatggccgccaaggacaaggaatgtgtggccaaccacatgagagctgtggagaacaccctgcacaaggtgcgggaccagatcagcctgtcctggagcgctgccagcagaaatgacttcaccctgcagctgcccaagctgcacctggagacctttgccatggagggcctgaagggcggccctgaggtggtggcctgccaggccatgatcaagagcttcatggatgtgtaccagctggccagcacccgcatcatgaccctggagaaggagatgaccagccacaggagccacatcgccgccctgaagtctgagctgcacacagcctgcctgagagaaaatgccagcctgcagagcatcggcagccgggaccacagcaacctgagcatccccagccgggcccccctgcctgctgacaccactggaattggagacttcctgcccctgaaggccgagctggacaccacctacaccttcctgaaggagaccttcatcaacacagtgccccacgccctgaccagcagccacagcagccctgtgaccatgtctgccaatgccaaccggcccacccagatcggcctgtag

SEQ ID NO: 37305 - DNA, 774 bp, Artificial Sequence
  Description of Artificial Sequence: Synthetic coding sequence
tgacacaaggtgaacaccctggccctgaagtatggcctgcggggccacgtgcccatcaccaagagcacagccagcctgcagaagcagatcctgggcttcacccagaggctgcatgctgctgaggtggagcggcgcagcctgcggctggaggtgacagagttcaagaggtctgtgaatgagatgaagaaggagctggacaaggcccagggcctgcagatgcagctgaatgagttcaagcagagcaagctgatcacccatgagaagtttgaaagtgcctgtgaggagctgaacaatgccctgctgcgggaggagcaggcccagatgctgctgaatgagcaggcccagcagctgcaggagctgaactacaagctggagctgcacagcagcgaggaggccgacaagaaccagaccctgggggaggccgtgaagagcctgtctgaggccaagatggagctgcggaggaaggaccagagcctgcggcagctgaacagacacctgacccagctggagcaggacaagaggcggctggaggagaacatccatgatgctgagagcgccctgaggatggccgccaaggacaaggaatgtgtggccaaccacatgagagctgtggagaacaccctgcacaaggtgcgggaccagatcagcctgtcctggagcgctgccagcagaaatgacttcaccctgcagctgcccaagctgcacctggagacctttgccatggagggcctgaagggcggccctgaggtggtggcctgccaggtgcgggtgtag

SEQ ID NO: 37306 - DNA, 1416 bp, Artificial Sequence
  Description of Artificial Sequence: Synthetic coding sequence
tgatttgagctgttcaagctggagatccgcaccctggcccaggccctgagcacagtggaggagaagaagcaggaggaggccaagatgaagaagaagaccttcaagggcctcatccgcatcttcagaaaaggagtgattgctgtgctggccgccaaccggctgaagatcctgggccagagctgtgccagcctcttcacctggatggagagcttcaaggagggcatcggcatgctggtgtgcacaggagagccccaggacaagcacaagttccccaagcaccagaaggagcagctgcgctgcctgcaggccctgtcctggctgaccagcagtgacctgctggccgccatcatcagctccatggccgagctgcaggatgtgattggcaaggctgaccccaacagccgcatctgtggccacctgctgattggagctgccaagaacagctttgccaagctgatggacaagatcagcctggtgatggagtgcatccccctgcacagcagccgcagcatcacctacgtggagaaggacagcctggtgcagaggctggcccacggcctgcacaaggtgaacaccctggccctgaagtatggcctgcggggccacgtgcccatcaccaagagcacagccagcctgcagaagcagatcctgggcttcacccagaggctgcatgctgctgaggtggagcggcgcagcctgcggctggaggtgacagagttcaagaggtctgtgaatgagatgaagaaggagctggacaaggcccagggcctgcagatgcagctgaatgagttcaagcagagcaagctgatcacccatgagaagtttgaaagtgcctgtgaggagctgaacaatgccctgctgcgggaggagcaggcccagatgctgctgaatgagcaggcccagcagctgcaggagctgaactacaagctggagctgcacagcagcgaggaggccgacaagaaccagaccctgggggaggccgtgaagagcctgtctgaggccaagatggagctgcggaggaaggaccagagcctgcggcagctgaacagacacctgacccagctggagcaggacaagaggcggctggaggagaacatccatgatgctgagagcgccctgaggatggccgccaaggacaaggaatgtgtggccaaccacatgagagctgtggagaacaccctgcacaaggtgcgggaccagatcagcctgtcctggagcgctgccagcagaaatgacttcaccctgcagctgcccaagctgcacctggagacctttgccatggagggcctgaagggcggccctgaggtggtggcctgccaggtgcgggtgcgggtgcagtggtgtgaccacagcagcctgcagagccagatgcctggcctgaagcagagcagctgcctgagcctgctgagcacctag

SEQ ID NO: 37307 - DNA, 954 bp, Artificial Sequence
  Description of Artificial Sequence: Synthetic coding sequence
atgaacctgaacaccagcagcaacacaggagacacccagaggctgaagatcgccagcctggatgtgaagcagatcctgaagaatgaaacagagctggacatcacagacaacctgaggaagaagctgcactgggccaagaaggagaagctggagatcaccaccaagcacaatgctgagctggccagctatgagagccagatcgccaagctgcggtctgaggtggagaagggggaggccctgcggcagagcctggagtatgacctggccgtggccaggaaggaggccggcctgggcagaagagctgctgaggagcggctggccgaggcccaccgcatccaggagaagctgtgtgcccagaacagcgagctgcaggccaagaccaatgaaacagagaaggccttccagaccagccagcagaagtggaaggaggagtgccgccgctttgaacatgacctggaggagcgggacaacatgatccagaactgcaaccgggagtatgacctgctgatgaaggagaagagccggctggagaagaccctgcaggaggccctggagaagcaccagcgggagaagaatgagatggagagccacatccgggagacagccctggaggagttccggctgcaggaggagcagtgggaggccgagcggcgggagctgcagttcatcgtgcaggagcaggacacagctgtgcagaacatgcacaagaaggtggagaagctggagacagagcacatggactgcagcgacctgctgcggcggcagaccagcgagctggagttcagcacccagcgggaggagcggctgaggaaggagtttgaggccaccaccctgcgggtgaggaagctggaggagaacattgaagctgagcgggccgcccacctggagagcaagttcaacagcgagatcatccaggtgaagtgcaagcagatcttctggccagccttctcctag

SEQ ID NO: 37308 - DNA, 600 bp, Artificial Sequence
  Description of Artificial Sequence: Synthetic coding sequence
atgaagaccttcatcatcggcatctctggagtgaccaacagcggcaagaccaccctggccaagaacctgcagaagcacctgcccaactgcagcgtcatcagccaggatgacttcttcaagccagagagcgagattgaaacagacaagaatggcttcctgcagtatgatgtgctggaggccctgaacatggagaagatgatgtctgccatcagctgctggatggagagcgcccggcacagcgtggtgtccacagaccaggagagcgctgaggagatccccatcctgatcatcgagggcttcctgctcttcaactacaagcccctggacaccatctggaacagaagctacttcctgaccatcccctatgaggagtgcaagagaagaagaagcaccagggtgtaccagcccccagacagccctggctactttgatggccacgtgtggcccatgtacctgaagtaccggcaggagatgcaggacatcacctgggaggtggtgtacctggatggcaccaagtcagaagaagatctcttcctgcaggtgtatgaagatctcatccaggagctggccaagcagaagtgcctgcaggtgacagcctag

SEQ ID NO: 37309 - DNA, 558 bp, Artificial Sequence
  Description of Artificial Sequence: Synthetic coding sequence
atgggcaagaggaggcacagaagaggaaatgtcatcagctgtgtgaccaacagcggcaagaccaccctggccaagaacctgcagaagcacctgcccaactgcagcgtcatcagccaggatgacttcttcaagccagagagcgagattgaaacagacaagaatggcttcctgcagtatgatgtgctggaggccctgaacatggagaagatgatgtctgccatcagctgctggatggagagcgcccggcacagcgtggtgtccacagaccaggagagcgctgaggagatccccatcctgatcatcgagggcttcctgctcttcaactacaagcccctggacaccatctggaacagaagctacttcctgaccatcccctatgaggagtgcaagagaagaagaagcaccagggtgtaccagcccccagacagccctggctactttgatggccacgtgtggcccatgtacctgaagtaccggcaggagatgcaggacatcacctgggaggtggtgtacctggatggcaccaagtcagaagaagatctcttcctgcaggtgtag

SEQ ID NO: 37310 - DNA, 528 bp, Artificial Sequence
  Description of Artificial Sequence: Synthetic coding sequence
atgaagaccttcatcatcggcatctctggagtgaccaacagcggcaagaccaccctggccaagaacctgcagaagcacctgcccaactgcagcgtcatcagccaggatgacttcttcaagccagagagcgagattgaaacagacaagaatggcttcctgcagtatgatgtgctggaggccctgaacatggagaagatgatgtctgccatcagctgctggatggagagcgcccggcacagcgtggtgtccacagaccaggagagcgctgaggagatccccatcctgatcatcgagggcttcctgctcttcaactacaacaccagggtgtaccagcccccagacagccctggctactttgatggccacgtgtggcccatgtacctgaagtaccggcaggagatgcaggacatcacctgggaggtggtgtacctggatggcaccaagtcagaagaagatctcttcctgcaggtgtatgaagatctcatccaggagctggccaagcagaagtgcctgcaggtgacagcctag

SEQ ID NO: 37311 - DNA, 612 bp, Artificial Sequence
  Description of Artificial Sequence: Synthetic coding sequence
atgggcaagaggaggcacagaagaggaaatgtcatcagctgtgtgaccaacagcggcaagaccaccctggccaagaacctgcagaagcacctgcccaactgcagcgtcatcagccaggatgacttcttcaagccagagagcgagattgaaacagacaagaatggcttcctgcagtatgatgtgctggaggccctgaacatggagaagatgatgtctgccatcagctgctggatggagagcgcccggcacagcgtggtgtccacagaccaggagagcgctgaggagatccccatcctgatcatcgagggcttcctgctcttcaactacaagcccctggacaccatctggaacagaagctacttcctgaccatcccctatgaggagtgcaagagaagaagaagcaccagggtgtaccagcccccagacagccctggctactttgatggccacgtgtggcccatgtacctgaagtaccggcaggagatgcaggacatcacctgggaggtggtgtacctggatggcaccaagtcagaagaagatctcttcctgcaggtgtatgaagatctcatccaggagctggccaagcagaagtgcctgcaggtgacagcctag

SEQ ID NO: 37312 - DNA, 642 bp, Artificial Sequence
  Description of Artificial Sequence: Synthetic coding sequence
atggagctgcatgacagagtgctggatgtgcagctgtgtgcctgcagcctgctgctgcacctgctgggccagggcatcatcgtgaacaaggcccccctggagaaggtgcctgacctgatcagccaggtgctggccacctacccagcagatggagagatggccgaggccagctgtggggtcttctggctgctgagcctgctgggctgcatcaaggagcagcagtttgagcaggtggtggccctgctgctgcagagcatccggctgtgccaggaccgggccctgctggtgaacaatgcctaccggggcctggccagcctggtgaaggtgtctgagctggccgccttcaaggtggtggtgcaggaggagggcggcagcggcctgagcctcatcaaggagacctaccagctgcacagagatgatcctgaggtggtggagaatgtgggcatgctgctggtgcacctggccagctatgaggagatcctgcctgagctggtgagcagctccatgaaggccctgctgcaggagatcaaggagcgcttcaccagcagcctggtgtctgacagcagcgccttcagcaagccaggcctgcccccaggcggcagcccccagctgggctgcaccaccagcggcggcctggagtag

SEQ ID NO: 37313 - DNA, 2043 bp, Artificial Sequence
  Description of Artificial Sequence: Synthetic coding sequence
atgctgggccctggcagcaacagaagaagacccacccagggcgagcggggccctggcagccctggagagcccatggagaagtaccaggtgctgtaccagctgaaccctggggccctgggcgtgaacctggtggtggaggagatggagaccaaggtgaagcacgtgatcaagcaggtggagtgcatggatgaccactacgccagccaggccctggaggagctgatgcccctgctgaagctgcggcatgcccacatctctgtgtaccaggagctgttcatcacctggaatggagagatcagcagcctgtacctgtgcctggtgatggagttcaatgagctgtccttccaggaggtgattgaggacaagaggaaggccaagaagatcattgattctgagtggatgcagaatgtgctgggccaggtgctggatgccctggagtacctgcaccacctggacatcatccacaggaacctgaagcccagcaacatcatcctgatcagcagtgaccactgcaagctgcaggacctgagcagcaatgtgctgatgacagacaaggccaagtggaacatccgggcagaggaggaccccttcaggaagtcctggatggcccctgaggccctgaacttctccttcagccagaagagtgacatctggagcctgggctgcatcatcctggacatgaccagctgcagcttcatggatggaacagaggccatgcacctgaggaagagcctgcggcagagccctggcagcctgaaggctgtgctgaagaccatggaggagaagcagatcccagatgtggagaccttcaggaacctgctgcccctgatgctgcagattgaccccagcgaccgcatcaccatcaaggatgtggtgcacatcaccttcctgcggggcagcttcaagagcagctgtgtgtccctgaccctgcaccggcagatggtgcctgccagcatcacagacatgctgctggagggcaatgtggccagcatcctggaggtgatgcagaagttcagcggctggccagaggtgcagctgcgggccatgaagaggctgctgaagatgcctgctgaccagctgggcctgccctggcccccagagctggtggaggtggtggtgaccaccatggagctgcatgacagagtgctggatgtgcagctgtgtgcctgcagcctgctgctgcacctgctgggccaggccctggtgcaccaccctgaggccaaggccccctgcaaccaggccatcaccagcaccctgctgagcgccctgcagagccaccctgaggaggagcccctgctggtgatggtgtacagcctgctggccatcaccaccacccaggagagcgagagcctgtctgaggagctgcagaatgccggcctgctggagcacatcctggagcacctgaacagcagcctgaagagcagagatgtgtgtgccagcggcctgggcctgctgtgggccctgctgctggatggcatcatcgtgaacaaggcccccctggagaaggtgcctgacctgatcagccaggtgctggccacctacccagcagatggagagatggccgaggccagctgtggggtcttctggctgctgagcctgctgggctgcatcaaggagcagcagtttgagcaggtggtggccctgctgctgcagagcatccggctgtgccaggaccgggccctgctggtgaacaatgcctaccggggcctggccagcctggtgaaggtgtctgagctggccgccttcaaggtggtggtgcaggaggagggcggcagcggcctgagcctcatcaaggagacctaccagctgcacagagatgatcctgaggtggtggagaatgtgggcatgctgctggtgcacctggccagctatgaggagatcctgcctgagctggtgagcagctccatgaaggccctgctgcaggagatcaaggagcgcttcaccagcagcctggtgtctgacagcagcgccttcagcaagccaggcctgcccccaggcggcagcccccagctgggctgcaccaccagcggcggcctggagtag

SEQ ID NO: 37314 - DNA, 486 bp, Artificial Sequence
  Description of Artificial Sequence: Synthetic coding sequence
atgctgggccctggcagcaacagaagaagacccacccagggcgagcggggccctggcagccctggagagcccatggagaagtaccaggtgctgtaccagctgaaccctggggccctgggcgtgaacctggtggtggaggagatggagaccaaggtgaagcacgtgatcaagcaggtggagtgcatggatgaccactacgccagccaggccctggaggagctgatgcccctgctgaagctgcggcatgcccacatctctgtgtaccaggagctgttcatcacctggaatggagagatcagcagcctgtacctgtgcctggtgatggagttcaatgagctgtccttccaggaggtgattgaggacaagaggaaggccaagaagatcattgattctgagatcaagacagaaggagtgcccaacacccggcgcttccctgtgggggaccatgacagccgcctcttctgccgcagcctgaagttcctgtag

SEQ ID NO: 37315 - DNA, 906 bp, Artificial Sequence
  Description of Artificial Sequence: Synthetic coding sequence
atgctgtctgagggctacctgagcggcctggagtactggaatgacatccactggagctgtgccagctacaatgagcaggtggccggggagaaggaggaggagaccaacagcgtggccaccctgagctacagctctgtggatgagacccaggtgcgcagcctgtatgtgtcctgcaagagcagcggcaagttcatcagctctgtgcacagccgggagagccagcacagccgcagccagagggtgacagtgctgcagaccaaccccaaccctgtgtttgagagccccaacctggccgctgtggagatctgcagagatgccagccgggagacctacctggtgcccagcagctgcaagagcatctgcaagaactacaatgacctgcagattgctgggggccaggtgatggccatcaacagcgtgaccacagacttccccagcgagagcagctttgaatatggccccctgctgaagagcagcgagatccccctgcccatggaggacagcatcagcacccagcccagcgacttcccccagaagcccatccagcgctacagcagctactggaggatcaccagcatcaaggagaagagcagcctgcagatgcagaaccccatcagcaatgctgtgctgaatgagtacctggagcagaaggtggtggagctgtacaagcagtacatcatggacacagtgttccatgacagcagccccacccagatcctggccagcgagctgatcatgacctctgtggaccagatcagcctgcaggtgtcccgggagaagaacctggagaccagcaaggcccgggacatcgtgttcagccggctgctgcagctgatgagcacagagatcacagagatcagcacccccagcctgcacatcagccagtacagcaatgtgaacccctag

SEQ ID NO: 37316 - DNA, 2931 bp, Artificial Sequence
  Description of Artificial Sequence: Synthetic coding sequence
atgaacacccagaagggcagcctgaccatcaacgtgcaccggggcagcctggccatgagcatccagaggggcagcctggtgccccgggacatggacagcagcggccgggacatgcagctgcgggtcatcccagctgaggtgaagttcctggacaccatggccggccgggtgtaccgcctgcccatcaccgtgcacaacatctgccgctggaaccagaagatccgcttcaaggagcctgtgaagccccagttcaagctgatgctgaccagcctggacaaggagctggccagcggcctgcagatgacagccatggtggagtaccacccagacaaggatgaggacacctttgaccggctgctgatcagcattgagaacaagaccacagagatccccctgattggcctcatccccagctgccagctggagattgaatctgtggtgaactttggcaccctggtggccaacagcaaggtgtacagcaaggagatcaccatcaccaaccacggcaaggcccctggcatcttcaaggccgagtaccacggccagctgcccatcctgatcttccccaccagcggcatcgtggatgccaagagctccatggtgatcaaggtggacttctgtgccgaccagcccagaattgtggatgaggaggccatcgtcatcctgcagggccagcctgagatgctgctgagcatcaaggcccacgtggtggagcagatcatcgagctgctgtccatgagcagtgaccggcggctggagtgcatccactttggacctgtgttcttcggcagcagcaagatcaagcacgcccgggtgtacaacaacagccctgagcccatcaactgggtggccatcatccaggatgatgctgtgggggaggagctgggcacagacatccagcagaggacagacatcgccctgaacaacctgacctacatcaggaagatcaagaacatcgacaccaccatcatcatcagctgcctgcccaatgaaggcaccctgcagccctaccagaagacagtcatcaccttctgcttcacccccaagctgatggctgtgggcaagaaggacatcggccccagctaccggcaggactatgccctcttcctgcgctttgagagcgtgggcagcaaggatggcttcctgagagatgatgactacaagaccatcaagtctgagcgcttccagaaggtggagctggccctgactggaacaggcctgcctgtgctgctgcagtttgatcctggccctgtgctgaacttcaagccctgcttcatgggagagaggtctgagatccagtgcatcatcaagaaccagtgtgagctgctgcctgtgacctaccacttcaagaagacagccaactttgaaattgatcctgagaagggcaagatcactggaggcggcatggtggatgtgatgtgcagctttgtgccccaccagctgggcgtcttcaaggtgaagcagatgattgagatcatcggcctggtggccgaggaggacctgcagagcctgtctgtgaagagcttccaccacgtgtacctggccttcaacagcatctgcaaggccagcaccaagaaggtggtgatgaagtttgatcctggcatcctgcccagcatccggaaccccaccgggaagtttgtggtgaaggacctggccaagaggaagaactatgcccctgtggccatgctgcagagcgccatgaccaggacccacaaccacaggagctgtgaggagcctgtgaaggacatgctgctggccttccccaatgaccgggccgccaccatccgcagcaaggaccaccacaagcacttccggcccatcttcaccaaggtgccccgcttcaactacgtgaaccacgactttgcctacaccacctttgagaagcagcagaagaagctgcacgagaactactatgccatgtacctgaagtacctgcggtctgtgcggctgcagaagaagcaggccgagcgggagaggatgtacagctatgatgacacagacatcggcctggagcccggcagcggcctgaagagccccagcctgtctgaggccgagattgaggaggagctgagcagcgctgccaacagcatccgggccaaccggctgctgaccacccggggcatcgccagccaggaggaggagagcgtgcggaggaaggtgctgaagggcctgaagtctgagcccagcaccccccaggagaagcatgactgcagcctgatgctgacccccaagcagatccaccaggtgattgtgggccccagcgtgctgaactttggaaacatctgtgtgaacagccccaacacccacctgctgcacgtgatcaacatgctgcccatgcacgtgctgctgcagctggacacagacctggaggagctgcagaagaccaaccagttctcctatgtgatcctgcccaccagcagcacctacatctccatggtgtttgacagccccaccatcggcaagttctggaagagcttcaccttcaccgtgaacaacgtgcccagcggccacatcctggtggtggccgtggtgcagcctgtgaccctggagctgagcagcaatgagctggtgctgcggccccggggcttcttcatgaagacctgcttccggggcaccgtgcggctgtacaaccggcagaactgctgtgcccagttccagtggcagcctgtgaacacaggccggggcatcgccttcagcatctgcccagccaagggcaccgtggaggcctacagcagcctggagtgtgaggtgacctggcagcagggcttcagcagccctgaggagggggagttcatcctgcacgtgttccagggcaatgccctgaagctgaagtgtgtggcccacgtgatcatcttcctggagcacggcttctgctttgagggctatgaatttgtgggctacaccctggtgtacatcgtgacctacatctag

SEQ ID NO: 37317 - DNA, 705 bp, Artificial Sequence
  Description of Artificial Sequence: Synthetic coding sequence
tgaagccagaagctgcctgatgtgaagcccagccccatcaacctgaggaagaagagcctgactgtgaaggtggatgtgaagaagacagtggacaccttccgggtggccagcagctacagcacagagcggcagatgagccatgacctggtggccgtgggcaggaagtctgagaacttccaccctgtgtttgagcacctggacagcacccagaacacagagaacaagcccactggagaatttgcccaggagatcatcaccatcatccaccaggtgaaggccaactacttccccagccctggcatcaccctgcacgagcgcttcagcaccatgcaggacatccacaaggcagatgtgaatgagatccccctgaacagcgaccctgagatccacagaagaattgacatgagcctggccgagctgcagagcaagcaggccgtcatctatgagagcgagcagaccctcatcaagatcatcgaccccaatgacctgcggcatgacattgaaagaagaaggaaggagcggctgcagaatgaagatgagcacatcttccacatcgccagcgctgctgagagagatgaccagaacagcagcttcagcaagggcctggccctgagcccccggctggagtgtggggtgaccatcacagcctactgcagcctgtacctgcaggacagcagctacctgcccccccagcccccagagtag

SEQ ID NO: 37318 - DNA, 1878 bp, Artificial Sequence
  Description of Artificial Sequence: Synthetic coding sequence
atggcccggagccgcagccgcagcccccgctggaagcacaggagcctgagccctgtgcccagaaatgctgagcactacaagcagaggcacagccacggccactacggctgtgagtacaggaaggaccccaagaggcctgtggcctggaggatggattctgagaagcacggccagagcaagccccgcatccccagccggggcaacatctactaccagagctatgagcacaggagccccagccccaacatccggaacagcctggagaatgtgtacatgtacaagccccaccggggctacagccctggccgcggggacagcaacagaagagcccagtacatgcccaagtacagcgagggcatcccctacaaggagcatgaaagaaattcctacccccagaaggtgcagggcggccacagcccagatgaccaccgggtgcggggcagcggcaagggcggcaagccaccccagaggagcattgctgacagcttccgctttgagggcaagtggcatgaagatgagctgcggcaccagaggatccaggaggagaagtacagccagagcacccggcggggctctgaagattttgagaccaggagcagcttccagaagcgctacccagaagatcgggacttcagaaaatatggccacaccagcaagaggcccaaggatgtggagagatatgagagccgggagcccgccaggaaccccaagtggaagccagagcacagcctgcccccctaccaggaggacacagaccagtggaacctgggcccccagacctacagacatgctgagcgggagcaccctgagaccagcagcgccaccaaggtgtcctatgactaccgccacaagaggcccaagctgctggatggagaccaggacttcagtgatggccgcacccagaagtactgcaaggaggaggacaggaagtacagcttccagaagggccccctgaaccgggagctggactgcttcaacacaggccggggccgggagacccaggacggccaggtgaaggagcccttcaagcccagcaagaaggacagcatcgcctgcacctacagcaacaagaatgatgtggacctgcggagcagcaatgacaagtggaaggagaagatcaagaaggagggggactgcaggaaggagagcaacagcagcagcaaccagctggacaagagccagaagctgcctgatgtgaagcccagccccatcaacctgaggaagaagagcctgactgtgaaggtggatgtgaagaagacagtggacaccttccgggtggccagcagctacagcacagagcggcagatgagccatgacctggtggccgtgggcaggaagtctgagaacttccaccctgtgtttgagcacctggacagcacccagaacacagagaacaagcccaccggggagtttgcccaggagatcatcaccatcatccaccaggtgaaggccaactacttccccagccctggcatcaccctgcacgagcgcttcagcaccatgcaggacatccacaaggcagatgtgaatgagatccccctgaacagcgaccctgagatccacagaagaattgacatgagcctggccgagctgcagagcaagcaggccgtcatctatgaaagtgagcagaccctcatcaagatcatcgaccccaatgacctgcggcatgacatcgagaggaggaggaaggagcggctgcagaatgaagatgagcacatcttccacatcgccagcgctgctgagagagatgaccagaacagcagcttcagcaagggcctggccctgagcccccggctggagtgtggggtgaccatcacagcctactgcagcctgtacctgcaggacagcagctacctgcccccccagcccccagagtag

SEQ ID NO: 37319 - DNA, 2049 bp, Artificial Sequence
  Description of Artificial Sequence: Synthetic coding sequence
atggcccggagccgcagccgcagcccccgctggaagcacaggagcctgagccctgtgcccagaaatgctgagcactacaagcagaggcacagccacggccactacggctgtgagtacaggaaggaccccaagaggcctgtggcctggaggatggattctgagaagcacggccagagcaagccccgcatccccagccggggcaacatctactaccagagctatgagcacaggagccccagccccaacatccggaacagcctggagaatgtgtacatgtacaagccccaccggggctacagccctggccgcggggacagcaacagaagagcccagtacatgcccaagtacagcgagggcatcccctacaaggagcatgaaagaaattcctacccccagaaggtgcagggcggccacagcccagatgaccaccgggtgcggggcagcggcaagggcggcaagccaccccagaggagcattgctgacagcttccgctttgagggcaagtggcatgaagatgagctgcggcaccagaggatccaggaggagaagtacagccagagcacccggcggggctctgaagattttgagaccaggagcagcttccagaagcgctacccagaagatcgggacttcagaaaatatggccacaccagcaagaggcccaaggatgtggagagatatgagagccgggagcccgccaggaaccccaagtggaagccagagcacagcctgcccccctaccaggaggacacagaccagtggaacctgggcccccagacctacagacatgctgagcgggagcaccctgagaccagcagcgccaccaaggtgtcctatgactaccgccacaagaggcccaagctgctggatggagaccaggacttcagtgatggccgcacccagaagtactgcaaggaggaggacaggaagtacagcttccagaagggccccctgaaccgggagctggactgcttcaacacaggccggggccgggagacccaggacggccaggtgaaggagcccttcaagcccagcaagaaggacagcatcgcctgcacctacagcaacaagaatgatgtggacctgcggagcagcaatgacaagtggaaggagaagatcaagaaggagggggactgcaggaaggagagcaacagcagcagcaaccagctggacaagagccagaagctgcctgatgtgaagcccagccccatcaacctgaggaagaagagcctgactgtgaaggtggatgtgaagaagacagtggacaccttccgggtggccagcagctacagcacagagcggcagatgagccatgacctggtggccgtgggcaggaagtctgagaacttccaccctgtgtttgagcacctggacagcacccagaacacagagaacaagcccaccggggagtttgcccaggagatcatcaccatcatccaccaggtgaaggccaactacttccccagccctggcatcaccctgcacgagcgcttcagcaccatgcaggacatccacaaggcagatgtgaatgagatccccctgaacagcgaccctgagatccacagaagaattgacatgagcctggccgagctgcagagcaagcaggccgtcatctatgaaagtgagcagaccctcatcaagatcatcgaccccaatgacctgcggcatgacatcgagaggaggaggaaggagcggctgcagaatgaagatgagcacatcttccacatcgccagcgctgctgagagagatgaccagaacagcagcttcagcaagaactacaccacccagaggaaggacatcatcacccacaagccctttgaggtggagggcaaccacaggaacaccagggtgcggcccttcaagagcaacttccggggcggccgctgccagcccaactacaagagcggcctggtgcagaagagcctgtacatccaggccaagtaccagaggctgcgcttcaccggcccccggggcttcatcacccacaagttccgggagcggctgatgaggaagaagaaggagtacacagatgtggccaccggcatctag

SEQ ID NO: 37320 - DNA, 1467 bp, Artificial Sequence
  Description of Artificial Sequence: Synthetic coding sequence
atgcccaagtacagcgagggcatcccctacaaggagcatgaaagaaattcctacccccagaaggtgcagggcggccacagcccagatgaccaccgggtgcggggcagcggcaagggcggcaagccaccccagaggagcattgctgacagcttccgctttgagggcaagtggcatgaagatgagctgcggcaccagaggatccaggaggagaagtacagccagagcacccggcggggctctgaagattttgagaccaggagcagcttccagaagcgctacccagaagatcgggacttcagaaaatatggccacaccagcaagaggcccaaggatgtggagagatatgagagccgggagcccgccaggaaccccaagtggaagccagagcacagcctgcccccctaccaggaggacacagaccagtggaacctgggcccccagacctacagacatgctgagcgggagcaccctgagaccagcagcgccaccaaggtgtcctatgactaccgccacaagaggcccaagctgctggatggagaccaggacttcagtgatggccgcacccagaagtactgcaaggaggaggacaggaagtacagcttccagaagggccccctgaaccgggagctggactgcttcaacacaggccggggccgggagacccaggacggccaggtgaaggagcccttcaagcccagcaagaaggacagcatcgcctgcacctacagcaacaagaatgatgtggacctgcggagcagcaatgacaagtggaaggagaagatcaagaaggagggggactgcaggaaggagagcaacagcagcagcaaccagctggacaagagccagaagctgcctgatgtgaagcccagccccatcaacctgaggaagaagagcctgactgtgaaggtggatgtgaagaagacagtggacaccttccgggtggccagcagctacagcacagagcggcagatgagccatgacctggtggccgtgggcaggaagtctgagaacttccaccctgtgtttgagcacctggacagcacccagaacacagagaacaagcccaccggggagtttgcccaggagatcatcaccatcatccaccaggtgaaggccaactacttccccagccctggcatcaccctgcacgagcgcttcagcaccatgcaggacatccacaaggcagatgtgaatgagatccccctgaacagcgaccctgagatccacagaagaattgacatgagcctggccgagctgcagagcaagcaggccgtcatctatgaaagtgagcagaccctcatcaagatcatcgaccccaatgacctgcggcatgacatcgagaggaggaggaaggagcggctgcagaatgaagatgagcacatcttccacatcgccagcgctgctgagagagatgaccagaacagcagcttcagcaaggtgaacaccagcaaatgtgccggcatctag

SEQ ID NO: 37321 - DNA, 285 bp, Artificial Sequence
  Description of Artificial Sequence: Synthetic coding sequence
atgggcgccctcttccggctgctgctgcaggagcggggcaaggctgctgagttctacagccggggcaggaagcagaggcggcccagcgccagctgcaccttcggcggcatctggagcagcggcgtggacatgctgcccaatggagctgtgggcagcctgacccagctgggccccagcaggcctgtgctgggcatcgactacagcaagaaggagttccggggcacagcagaaaatgtgacaggcctgaacaccatcctgcacttcaggaagaggaccaggagctag

SEQ ID NO: 37322 - DNA, 699 bp, Artificial Sequence
  Description of Artificial Sequence: Synthetic coding sequence
atggccgccaccagcggcacagatgagcctgtgtctggagagctggtgtctgtggcccacgccctgagcctgcctgctgagagctatggaaatgaccctgacatcgagatggcctgggccatgagggccatgcagcacgccgaggtgtactacaagctgatcagctctgtggacccccagttcctgaagctgaccaaggtggatgaccagatctacagcgagttcaggaagaactttgagaccctgagaattgatgtgctggaccctgaggagctgaagtctgagagcgccaaggagcccccaggctacaacagcctgcccctgaagctgctgggcaccgggaaggccatcaccaagctgttcatctctgtgttccgcaccaagaaggagaggaaggagagcaccatggaggagaagaaggagctgactgtggagaagaagaggacccccaggatggaggagaggaaggagctgattgtggagaagaagaagaggaaggagagcacagagaagaccaagctgaccaaggaggagaagaagggcaagaagctgaccaagaagagcaccaaggtggtgaagaagctgtgcaaggtgtaccgggagcagcacagccgctcctatgacagcattgagaccaccagcaccaccgtgctgctggcccagacccccctggtgaagtgcaagttcctgtacaactag

SEQ ID NO: 37323 - DNA, 702 bp, Artificial Sequence
  Description of Artificial Sequence: Synthetic coding sequence
atggccgccaccagcggcacagatgagcctgtgtctggagagctggtgtctgtggcccacgccctgagcctgcctgctgagagctatggaaatgaccctgacatcgagatggcctgggccatgagggccatgcagcacgccgaggtgtactacaagctgatcagctctgtggacccccagttcctgaagctgaccaaggtggatgaccagatctacagcgagttcaggaagaactttgagaccctgagaattgatgtgctggaccctgaggagctgaagtctgagagcgccaaggagaagtggaggcccttctgcctgaagttcaatggaattgtggaggacttcaactacggcaccctgctgcggctggactgcagccagggctacacagaggagaacaccatctttgccccccgcatccagttctttgccattgaaattgccaggaaccgggagggctacaacaaggctgtgtacatctctgtgcaggacaaggagggggagaagggcgtgaacaatggaggagagaagagagctgacagcggggaggaggagaacaccaagaatggaggagagaagggagctgacagcggggaggagaaggaggagggcatcaaccgggaggacaagacagacaagggcggggagaagggcaaggaggccgacaaggagatcaacaagagcggggagaaggccatgtag

SEQ ID NO: 37324 - DNA, 354 bp, Artificial Sequence
  Description of Artificial Sequence: Synthetic coding sequence
atgtctgagaagaagaactgcaagaacagcagcaccaacaacaaccagacccaggaccccagcagaaatgagctgcaggtgcccaggagctttgtggacagagtggtgcaggatgaaagagatgtgcagagccagagcagcagcaccatcaacaccctgctgaccctgctggactgcctggccgactacatcatggagcgggtgggcctggaggccagcaacaacggctccatgaggaacaccagccaggaccgggagcgggaggtggacaacaaccgggagccccacagcgctgagagtgatgtgacccgcttcctgtttgatgagatgcccaagagcaggaagaatgactag

SEQ ID NO: 37325 - DNA, 270 bp, Artificial Sequence
  Description of Artificial Sequence: Synthetic coding sequence
atgggagagctggccgccagcgccaaccacggccacagcccctgctacccagagaggaagggcacccctggggacctgagcaagaggaagatgctggtgcacttctacccccggcggcacagccacccccgggccacccagcagtggatcctgaagaacaagacccaggagggcagccacctgcagaccaagagaagagtgctgagccggccctggatctgctggcacccagacctgggcctgcctgccagcaggaccatgaggaactag

SEQ ID NO: 37326 - DNA, 189 bp, Artificial Sequence
  Description of Artificial Sequence: Synthetic coding sequence
atgggagagctggccgccagcgccaaccacggccacagcccctgctacccagagaggaagggcacccctggggacctgagcaagaggaagatgctggtgcacttctacccccggcggcacagccacccccgggccacccagcagtggatcctgaagaacaagaccctgtgccgccgcatcaaggagtag

SEQ ID NO: 37327 - DNA, 2757 bp, Artificial Sequence
  Description of Artificial Sequence: Synthetic coding sequence
atcctgattgccagtgatggctctgtgcccctgcccctgcagttcctgcccctgcagagcggccgctacccctgcaagatcctgctgaagagccgctatgatgtgcgggcctactacgtggagggcatcgtgaatgaggagcagcctgaggccaagtttgaatttgagaccccagcctttgaggccctgacccagaacatccccatcaagaaccagaccaatgacaagtggaccttccaggtgaccattgaaggagagtggttctacggccctgtggacctgcacgtgggcccagatgaaattgtggagtaccccctgaccttcaagcccatctttgaatgtgtgatcaccgggaagctgatcctgcagaatgaggtggatggccgggagcacatctttgacatcaagggcgtgggcaagaagcccagcgccctggagcacatcaccgtggagtgccaggtgggcaatgtgacccagaagcacatcaccctgccccacttcaccaacacagccctgaccttcaaggtgacagctgacctgcccatcgtgtggggcaacccccagatcaccgtgtacccctacaaggagatcctgtacctgatccacgtgcggccctggaagaggggcatcctgaagggcaccatcaccttcagcaccacccggcgctgcaccaccaggaggaagcatgatgattatgaggaggacacagaccaggaccaggccctgagctgcctggacagcatcacagagcagagcagcatcctggatgatgctgacacctacggcaacttcaacaacctgcgcttctggtacaacctggagatccacagcaccccaggcccccccatcgagatcatggagatgacctgcatcgccctggacagcacctgcatcgagatccccctgagcaaccccaaggaccggggcctgcacctggaggtgcagctgaccagcgctgccctgaatggagacaatgagatcatcctgagccccctgcagtgcaccaagtacatcgtgtggtacagccctgccaccaccggctacagtgatgagagcatcatcttccagcctgagatggccgaggagttctggtacctgctgaagctgaccatcgagctgcccaagcccaccaccatgcctgagatccagtgtgacctgggcaagcacgtgacccagatcatccccctggtgaactgcacccatgagaccctgaagctgcaggtgaccaacagcaaccctgagaactttgtgctggacatcaacaggaagagccagctgatcatcagcccccacagcaccacagagctgcctgtgctcttctaccccagcgccctgggccgggctgaccaccaggcctgcatcaacttctactgcacccagttcacagagtggaagttctacctgtctggagtgggcctcttcccccagcccctggacacagagcgcatcaccaccagaattggcctgcagagcaccatcgtcatccccttcaagaaccccaccatggaggatgtgctgattgacatcatcctgacctctgtggagcaccccaggaacctggtgatggaccactgctgggacagcttcatctatgagagcagcgccttccgcttcagcagccccagcgagatccagggcatcgccctgccccccaagggcaacatcgacatcagcctgctcttcatcccccagatcatgaagctgcacaagaccatggtgatcatcgagatgaccaaggccaacgggaagtactggcccatcgacaactttgatgagctggacatcaagttcaagagcatcgtgggcattgattctgaggagatccaggccatccactggatctaccccatcgtgggcctgccccaggcccccccacccaagagcccccctgtggtgatccagtgccagagcaggaagagagctgaggagaaggtggagatcatcctgaatgccggcttcttcggcttcagcctgaccccagacctgacagaggtgctggtgatccccaagaggaacagccacaacttctgtgaggaccccaatgagatccccaagatccatgaatttgaatatgagatccagtttgaaagtgaggccatgaagagcaagctggagagctgtgtggccctgtacatgattgagaagagctatgacatcatggccaagaggatcaccttcatcttcaacctggtgttcacccccaagaagcccctgcggagccacatcaccctgaagattgaatgtgtgacagagggcatctggaagttccccatcatgctgattgccacagagccagacacagatgctgtgattgatattgaaggagtgggcctcttcaaggagagcgtgtttgagctgcggctgaagagccagaccagaaatcctgagcccttcaccgcccacttcctgcccggcagtgacctggagttctttgtgaagccccaggccggggagctgctgcccttcaacaccaacggcaccctcatcaccgtgggcttcaagcccaagatgtactgcaggaagtacaaggccaccctggtgatccagacagaggagatgtactggaagtatgagatcaatggcctgacccccaccaccgtgccccccaagaatgccaaggccaagattgatgccacccacaagacccatgacaacatgcctgtgcggccccacaactttgtgcgggagaacaccaagctgatcagaactggagtgagcagcaccatcaagggggcccccctggtgaagaaccagtag

SEQ ID NO: 37328 - DNA, 1902 bp, Artificial Sequence
  Description of Artificial Sequence: Synthetic coding sequence
atggagatgacctgcatcgccctggacagcacctgcatcgagatccccctgagcaaccccaaggaccggggcctgcacctggaggtgcagctgaccagcgctgccctgaatggagacaatgagatcatcctgagccccctgcagtgcaccaagtacatcgtgtggtacagccctgccaccaccggctacagtgatgagagcatcatcttccagcctgagatggccgaggagttctggtacctgctgaagctgaccatcgagctgcccaagcccaccaccatgcctgagatccagtgtgacctgggcaagcacgtgacccagatcatccccctggtgaactgcacccatgagaccctgaagctgcaggtgaccaacagcaacccagaaaattttgtgctggacatcaacaggaagagccagctgatcatcagcccccacagcaccacagagctgcctgtgctcttctaccccagcgccctgggccgggctgaccaccaggcctgcatcaacttctactgcacccagttcacagagtggaagttctacctgagcggcgtgggcctcttcccccagcccctggacacagagcgcatcaccacccgcatcggcctgcagagcaccatcgtcatccccttcaagaaccccaccatggaggatgtgctgattgacatcatcctgacctctgtggagcaccccaggaacctggtgatggaccactgctgggacagcttcatctatgagagcagcgccttccgcttcagcagccccagcgagatccagggcatcgccctgccccccaagggcaacatcgacatcagcctgctcttcatcccccagatcatgaagctgcacaagaccatggtgatcatcgagatgaccaaggccaacgggaagtactggcccatcgacaactttgatgagctggacatcaagttcaagagcatcgtgggcatcgacagcgaggagatccaggccatccactggatctaccccatcgtgggcctgccccaggcccccccacccaagagcccccctgtggtgatccagtgccagagcaggaagagagctgaggagaaggtggagatcatcctgaatgccggcttcttcggcttcagcctgaccccagacctgacagaggtgctggtgatccccaagaggaacagccacaacttctgtgaggaccccaatgagatccccaagatccacgagtttgaatatgagatccagtttgagagcgaggccatgaagagcaagctggagagctgtgtggccctgtacatgattgagaagagctatgacatcatggccaagaggatcaccttcatcttcaacctggtgttcacccccaagaagcccctgcggagccacatcaccctgaagattgaatgtgtgacagagggcatctggaagttccccatcatgctgattgccacagagccagacacagatgctgtgattgacatcgagggcgtgggcctcttcaaggagagcgtgtttgagctgcggctgaagagccagaccaggaaccctgagcccttcaccgcccacttcctgcccggcagtgacctggagttctttgtgaagccccaggccggggagctgctgcccttcaacaccaacggcaccctcatcaccgtgggcttcaagcccaagatgtactgcaggaagtacaaggccaccctggtgatccagacagaggagatgtactggaagtatgagatcaatggcctgacccccaccaccgtgccccccaagaatgccaaggccaagattgatgccacccacaagacccatgacaacatgcctgtgcggccccacaactttgtgcgggagaacaccaagctgatcagaactggagtgagcagcaccatcaagggggcccccctggtgaagaaccagtag

SEQ ID NO: 37329 - DNA, 543 bp, Artificial Sequence
  Description of Artificial Sequence: Synthetic coding sequence
ctggagatccccaagatccatgaatttgaatatgagatccagtttgaaagtgaggccatgaagagcaagctggagagctgtgtggccctgtacatgattgagaagagctatgacatcatggccaagaggatcaccttcatcttcaacctggtgttcacccccaagaagcccctgcggagccacatcaccctgaagattgaatgtgtgacagagggcatctggaagttccccatcatgctgattgccacagagccagacacagatgctgtgattgatattgaaggagtgggcctcttcaaggagagcgtgtttgagctgcggctgaagagccagaccagaaatcctgagcccttcaccgcccacttcctgcccggcagtgacctggagttctttgtgaagccccaggccggggagctgctgcccttcaacaccaacggcaccctcatcaccgtgggcttcaagcccaagatgtactgcaggaagtacaaggccaccctggtgatccaggtgagcagcatccgggccatcgccaaggatgtgtag

SEQ ID NO: 37330 - DNA, 240 bp, Artificial Sequence
  Description of Artificial Sequence: Synthetic coding sequence
atgtacaggatgaagaggagccaggtgaggacccccatccggcggctcatcagaaatgtgaacctggactgggaggacagcatggccctgggctgcaccaccgtcatcgagcggggcaccctgcggcggctgaagagggccaccctgaacaccttcctggacagccctgtgcacgtgctgctggtgatgcccaagctgatccctgagcactgggagaagtgggaggatgtgaagaggtag

SEQ ID NO: 37331 - DNA, 960 bp, Artificial Sequence
  Description of Artificial Sequence: Synthetic coding sequence
atggtgctgtctgagctggccgcccggctgaactgtgccgagtacaagaactgggtgaaggccggccactgcctgctgctgctgcggagctgcctgcagggctttgtgggccgggaggtgctgtccttccaccggggcctgctggccgccgcccctggcctgggccccagggctgtgtgccggggcggcagccgctgcagcccccgggcccggcagttccagccccagtgccaggtgtgtgccgagtggaagcgggagatcctgcggcaccacgtgaacagaaatggagatgtgcactggggcaactgcaggcctggccgctggcctgtggatgcctgggaggtggccaaggccttcatgccccggggcctggccgacaagcagggccctgaggagtgtgatgctgtggccctgctgagcctcatcaacagctgtgaccactttgtggtggacaggaagaaggtgacagaggtgatcaagtgcagaaatgagatcatgcacagcagcgagatgaaggtgagcagcacctggctgcgggacttccagatgaagatccagaacttcctgaatgagttcaagaacatccctgagatcgtggccgtgtacagcagaattgagcagctgctgaccagtgactgggccgtgcacatccctgaggaggaccagagagatggctgtgaatgtgagatgggcacctacctgtctgagagccaggtgaatgaaattgagatgcagctgctgaaggagaagctgcaggagatctacctgcaggccgaggagcaggaggtgctgcctgaggagctgagcaaccggctggaggtggtgaaggagttcctgaggaacaatgaagacctgagaaatggcctgacagaggacatgcagaagctggacagcctgtgcctgcaccagaagctggacagccaggagcccggccggcagaccccagacaggaaggcctag

SEQ ID NO: 37332 - DNA, 468 bp, Artificial Sequence
  Description of Artificial Sequence: Synthetic coding sequence
atggtgctgtctgagctggccgcccggctgaactgtgccgagtacaagaactgggtgaaggccggccactgcctgctgctgctgcggagctgcctgcagggctttgtgggccgggaggtgctgtccttccaccggggcctgctggccgccgcccctggcctgggccccagggctgtgtgccggggcggcagccgctgcagcccccgggcccggcagttccagccccagtgccaggtgtgtgccgagtggaagcgggagatcctgcggcaccacgtgaacagaaatggagatgtgcactggggcaactgcaggcctggccgctggcctgtggatgcctgggaggtggccaagggcctggacctgctgagccggctggagtgcagcggggagagcgagctgattgccaccctgaacagctgggcccaggccatcctgctgccccagcccctggagtacctgggcctgtag

SEQ ID NO: 37333 - DNA, 603 bp, Artificial Sequence
  Description of Artificial Sequence: Synthetic coding sequence
atgccccggggcctggccgacaagcagggcccagaagaatgtgatgctgtggccctgctgagcctcatcaacagctgtgaccactttgtggtggacaggaagaaggtgacagaggtgatcaagtgcagaaatgagatcatgcacagcagcgagatgaaggtgagcagcacctggctgcgggacttccagatgaagatccagaacttcctgaatgagttcaagaacatccctgagatcgtggccgtgtacagccgcatcgagcagctgctgaccagtgactgggccgtgcacatccctgaggaggaccagagagatggctgtgaatgtgagatgggcacctacctgtctgagagccaggtgaatgaaattgagatgcagctgctgaaggagaagctgcaggagatctacctgcaggccgaggagcaggaggtgctgcctgaggagctgagcaaccggctggaggtggtgaaggagttcctgagaaataatgaagacctgagaaatggcctgacagaggacatgcagaagctggacagcctgtgcctgcaccagaagctggacagccaggagcccggccggcagaccccagacaggaaggcctag

SEQ ID NO: 37334 - DNA, 603 bp, Artificial Sequence; identical to SEQ ID NO: 37333
  Description of Artificial Sequence: Synthetic coding sequence

SEQ ID NO: 37335 - DNA, 705 bp, Artificial Sequence
  Description of Artificial Sequence: Synthetic coding sequence
atggtgctgtctgagctggccgcccggctgaactgtgccgagtacaagaactgggtgaaggccggccactgcctgctgctgctgcggagctgcctgcagggctttgtgggccgggaggtgctgtccttccaccggggcctgctggccgccgcccctggcctgggccccagggctgtgtgccggggcggcagccgctgcagcccccgggcccggcaggtgatcaagtgcagaaatgagatcatgcacagcagcgagatgaaggtgagcagcacctggctgcgggacttccagatgaagatccagaacttcctgaatgagttcaagaacatccctgagatcgtggccgtgtacagccgcatcgagcagctgctgaccagtgactgggccgtgcacatccctgaggaggaccagagagatggctgtgaatgtgagatgggcacctacctgtctgagagccaggtgaatgaaattgagatgcagctgctgaaggagaagctgcaggagatctacctgcaggccgaggagcaggaggtgctgcctgaggagctgagcaaccggctggaggtggtgaaggagttcctgagaaataatgaagacctgagaaatggcctgacagaggacatgcagaagctggacagcctgtgcctgcaccagaagctggacagccaggagcccggccggcagaccccagacaggaaggcctag

SEQ ID NO: 37336 - DNA, 477 bp, Artificial Sequence
  Description of Artificial Sequence: Synthetic coding sequence
atgaagtttggctgcctgtccttccggcagccctatgccggctttgtgctgaatggcatcaagacagtggagacccgctggaggcccctgctgagcagccagaggaactgcaccatcgctgtgcacatcgcccaccgggactgggagggagatgcctggagggagctgctggtggagcggctgggcatgaccccagcccagatccagaccctgctgaggaagggggagaagtttggccggggcgtgattgctggcctggtggacattggagagaccctgcagtgcccagaggacctgaccccagatgaggtggtggagctggagaaccaggccgtgctgaccaacctgaagcagaagtacctgaccgtcatcagcaacccccgctggctgctggagcccatccccaggaaaggaggcaaggatgtgttccaggtggacatccctgagcacctgatccccctgggccacgaggtgtag

SEQ ID NO: 37337 - DNA, 477 bp, Artificial Sequence; identical to SEQ ID NO: 37336
  Description of Artificial Sequence: Synthetic coding sequence

SEQ ID NO: 37338 - DNA, 477 bp, Artificial Sequence; identical to SEQ ID NO: 37336
  Description of Artificial Sequence: Synthetic coding sequence

SEQ ID NO: 37339 - DNA, 477 bp, Artificial Sequence; identical to SEQ ID NO: 37336
  Description of Artificial Sequence: Synthetic coding sequence

SEQ ID NO: 37340 - DNA, 93 bp, Artificial Sequence
  Description of Artificial Sequence: Synthetic coding sequence
atgaagtttggctgcctgtccttccggcagccctatgccggctttgtgctgaatggcatcaagacagtggagacccgctggaggcccctgtag

SEQ ID NO: 37341 - DNA, 477 bp, Artificial Sequence; identical to SEQ ID NO: 37336
  Description of Artificial Sequence: Synthetic coding sequence

SEQ ID NO: 37342 - DNA, 477 bp, Artificial Sequence; identical to SEQ ID NO: 37336
  Description of Artificial Sequence: Synthetic coding sequence

SEQ ID NO: 37343 - DNA, 441 bp, Artificial Sequence
  Description of Artificial Sequence: Synthetic coding sequence
atgaagtttggctgcctgtccttccggcagccctatgccggctttgtgctgaatggcatcaagacagtggagacccgctggaggcccctgctgagcagccagaggaactgcaccatcgctgtgcacatcgcccaccgggactgggagggagatgcctggagggagctgctggtggagcggctgggcatgaccccagcccagatccagaccctgctgaggaagggggagaagtttggccggggcgtgattgctggcctggtggacattggagagaccctgcagtgcccagaggacctgaccccagatgaggtggtggagctggagaaccaggccgtgctgaccaacctgaagcagaagtacctgaccgtcatcagcaacccccgctggctgctggagcccatccccaggaaaggaggcaaggatgtgttccagaacccctag

SEQ ID NO: 37344 - DNA, 477 bp, Artificial Sequence
  Description of Artificial Sequence: Synthetic coding sequence
atgaagtttggctgcctgtccttccggcagccctatgccggctttgtgctgaatggcatcaagacagtggagacccgctggaggcccctgctgagcagccagaggaactgcaccatcgctgtgcacatcgcccaccgggactgggagggagatgcctggagggagctgctggtggagcggctgggcatgaccccagcccagatccaggccctgctgaggaagggggagaagtttggccggggcgtgattgctggcctggtggacattggagagaccctgcagtgcccagaggacctgaccccagatgaggtggtggagctggagaaccaggccgtgctgaccaacctgaagcagaagtacctgaccgtcatcagcaacccccgctggctgctggagcccatccccaggaaaggaggcaaggatgtgttccaggtggacatccctgagcacctgatccccctgggccacgaggtgtag

SEQ ID NO: 37345 - DNA, 477 bp, Artificial Sequence; identical to SEQ ID NO: 37344
  Description of Artificial Sequence: Synthetic coding sequence

SEQ ID NO: 37346 - DNA, 477 bp, Artificial Sequence
  Description of Artificial Sequence: Synthetic coding sequence
atgaagtttggctgcctgtccttccggcagccctatgccggctttgtgctgaatggcatcaagacagtggagacccgctggaggcccctgctgagcagccagaggaactgcaccatcgctgtgcacatcgcccaccgggactgggagggagatgcctgccgggagctgctggtggagcggctgggcatgaccccagcccagatccaggccctgctgaggaagggggagaagtttggccggggcgtgattgctggcctggtggacattggagagaccctgcagtgcccagaggacctgaccccagatgaggtggtggagctggagaaccaggccgccctgaccaacctgaagcagaagtacctgaccgtcatcagcaacccccgctggctgctggagcccatccccaggaaaggaggcaaggatgtgttccaggtggacatccctgagcacctgatccccctgggccacgaggtgtag

SEQ ID NO: 37347 - DNA, 477 bp, Artificial Sequence; identical to SEQ ID NO: 37346
  Description of Artificial Sequence: Synthetic coding sequence

SEQ ID NO: 37348 - DNA, 477 bp, Artificial Sequence; identical to SEQ ID NO: 37346
  Description of Artificial Sequence: Synthetic coding sequence

SEQ ID NO: 37349 - DNA, 441 bp, Artificial Sequence
  Description of Artificial Sequence: Synthetic coding sequence
atgaagtttggctgcctgtccttccggcagccctatgccggctttgtgctgaatggcatcaagacagtggagacccgctggaggcccctgctgagcagccagaggaactgcaccatcgctgtgcacatcgcccaccgggactgggagggagatgcctgccgggagctgctggtggagcggctgggcatgaccccagcccagatccaggccctgctgaggaagggggagaagtttggccggggcgtgattgctggcctggtggacattggagagaccctgcagtgcccagaggacctgaccccagatgaggtggtggagctggagaaccaggccgccctgaccaacctgaagcagaagtacctgaccgtcatcagcaacccccgctggctgctggagcccatccccaggaaaggaggcaaggatgtgttccagaacccctag

SEQ ID NO: 37350 - DNA, 477 bp, Artificial Sequence; identical to SEQ ID NO: 37346
  Description of Artificial Sequence: Synthetic coding sequence

SEQ ID NO: 37351 - DNA, 645 bp, Artificial Sequence
  Description of Artificial Sequence: Synthetic coding sequence
atggagagcgagaacatggacagcgagaacatgaagacagagaacatggagagccagaatgtggactttgaatctgtgtcctctgtgacagccctggaggccctgagcaagctgctgaaccctgaggaggaggatgacagcgactatggccagaccaacggcctgagcaccatcggggccatgggccctggcaacatcggccccccccagatcgaggagctgaaggtgattcctgagaccagtgaagaaaataatgaagacatctggaacagcgaggagatccctgagggcgcagaatatgatgacatgtgggatgtgcgggagatcccagaatatgagatcatcttccggcagcaggtgggcacagaggacatcttcctgggcctgagcaagaaggacagcagcacaggctgctgcagcgagctggtggccaagatcaagctgcccaacaccaaccccagcgacatccagattgacatccaggagaccatcctggacctgcggaccccccagaagaagctgctgatcaccctgcctgagctggtggagtgcaccagcgccaaggccttctacatccctgagacagagaccctggagatcaccatgaccatgaagcgggagctggacatcgccaacttcttctag

SEQ ID NO: 37352 - DNA, 645 bp, Artificial Sequence; identical to SEQ ID NO: 37351
  Description of Artificial Sequence: Synthetic coding sequence

SEQ ID NO: 37353 - DNA, 645 bp, Artificial Sequence; identical to SEQ ID NO: 37351
  Description of Artificial Sequence: Synthetic coding sequence

SEQ ID NO: 37354 - DNA, 795 bp, Artificial Sequence
  Description of Artificial Sequence: Synthetic coding sequence
atgctgcggctgctgcggctggccctggccttctacggccgcacagctgaccctgctgagcggcagggcccccagcagcagggcctgccccagggcgacacccagctgaccaccgtgcagggcgtggtgaccagcttctgtggggactatggcatgattgatgagagcatctacttcagcagtgatgtggtgactggaaatgtgcccctgaaggtgggccagaaggtgaatgtggtggtggaggaggacaagccccactacggcctgcgggccatcaaggtggatgtggtgcccaggcacctgtatggagctggccccagcgacagcggcaccagggtgctgattggctgtgtgaccagcatcaatgaagacaacatctacatcagcaacagcatctacttcagcatcgccatcgtgtctgaagattttgtgccctacaagggggacctgctggaggtggagtacagcacagagcccggcatcagcaacatcaaggccacctctgtgaagcccatccgctgcatccacacagaggaggtgtgcatcacctctgtgcacggcagaaatggagtcatcgactacaccatcttcttcaccctggacagcgtgaagctgcctgatggctacgtgccccaggtggatgacatcgtgaatgtggtgatggtggagagcatccagttctgcttcatctggagggccatcagcatcacccctgtgcacaagagcagcagcggcttccaggatgatggcggcctgggccggcccaagcgggagaggaggagccagagcatctag

SEQ ID NO: 37355 - DNA, 729 bp, Artificial Sequence
  Description of Artificial Sequence: Synthetic coding sequence
atgctgcggctgctgcggctggccctggccttctacggccgcacagctgaccctgctgagcggcagggcccccagcagcagggcctgccccagggcgacacccagctgaccaccgtgcagggcgtggtgaccagcttctgtggggactatggcatgattgatgagagcatctacttcagcagtgatgtggtgactggaaatgtgcccctgaaggtgggccagaaggtgaatgtggtggtggaggaggacaagccccactacggcctgcgggccatcaaggtggatgtggtgcccaggcacctgtatggagctggccccagcgacagcggcaccagggtgctgattggctgtgtgaccagcatcaatgaagacaacatctacatcagcaacagcatctacttcagcatcgccatcgtgtctgaagattttgtgccctacaagggggacctgctggaggtggagtacagcacagagcccggcatcagcaacatcaaggccacctctgtgaagcccatccgctgcatccacacagaggaggtgtgcatcacctctgtgcacggcagaaatggagtcatcgactacaccatcttcttcaccctggacagcgtgaagctgcctgatggctacgtgccccaggtggatgacatcgtgaatgtggtgatggtggagagcatccagttctgcttcatctggagggccatcagcatcacccctgtgcacaagagctag

SEQ ID NO: 37356 - DNA, 522 bp, Artificial Sequence
  Description of Artificial Sequence: Synthetic coding sequence
atgaggccccgggacaggagccgggtgattgatgctgccaagcacgcccacaagttctgcaacacagaagatgaggagaccatgtacctgcggcggcctgagggcatcgagcggcagtacaggaagaagtgtgccaagtgtggcctgcccctcttctaccagagccagcccaagaatgcccctgtgaccttcatcgtggatggagctgtggtgaagtttggccagggctttgggaagaccaacatctacacccagaagcaggagccccccaagaaggtgatgatgaccaagaggaccaaggacatgggcaagttcagctctgtgacagtgtccaccattgatgaggaggaggaggagattgaggcccgggaggtggccgacagctatgcccagaatgccaaggtgattgagaagcagctggagaggaagggcatgagcaagaggcggctgcaggagctggccgagctggaggccaagaaggccaagatgaagggcaccctgattgacaaccagttcaagtag

SEQ ID NO: 37357 - DNA, 669 bp, Artificial Sequence
  Description of Artificial Sequence: Synthetic coding sequence
atgcccaaggtggtgagccgctctgtggtgtgcagcgacacccgggaccgggaggagtatgatgatggagagaagcccctgcacgtgtactactgcctgtgtggccagatggtgctggtgctggactgccagctggagaagctgcccatgaggccccgggacaggagccgggtgattgatgctgccaagcacgcccacaagttctgcaacacagaagatgaggagaccatgtacctgcggcggcctgagggcatcgagcggcagtacaggaagaagtgtgccaagtgtggcctgcccctcttctaccagagccagcccaagaatgcccctgtgaccttcatcgtggatggagctgtggtgaagtttggccagggctttgggaagaccaacatctacacccagaagcaggagccccccaagaaggtgatgatgaccaagaggaccaaggacatgggcaagttcagctctgtgacagtgtccaccattgatgaggaggaggaggagattgaggcccgggaggtggccgacagctatgcccagaatgccaaggtgattgagaagcagctggagaggaagggcatgagcaagaggcggctgcaggagctggccgagctggaggccaagaaggccaagatgaagggcaccctgattgacaaccagttcaagtag

SEQ ID NO: 37358 - DNA, 669 bp, Artificial Sequence; identical to SEQ ID NO: 37357
  Description of Artificial Sequence: Synthetic coding sequence

SEQ ID NO: 37359 - DNA, 669 bp, Artificial Sequence; identical to SEQ ID NO: 37357
  Description of Artificial Sequence: Synthetic coding sequence

SEQ ID NO: 37360 - DNA, 627 bp, Artificial Sequence
  Description of Artificial Sequence: Synthetic coding sequence
atgcccaaggtggtgagccgctctgtggtgtgcagcgacacccgggaccgggaggagtatgatgatggagagaagcccctgcacgtgtactactgcctgtgtggccagatggtgctggtgctggactgccagctggagaagctgcccatgaggccccgggacaggagccgggtgattgatgctgccaagcacgcccacaagttctgcaacacagaagatgaggagaccatgtacctgcggcgctgtggcctgcccctcttctaccagagccagcccaagaatgcccctgtgaccttcatcgtggatggagctgtggtgaagtttggccagggctttgggaagaccaacatctacacccagaagcaggagccccccaagaaggtgatgatgaccaagaggaccaaggacatgggcaagttcagctctgtgacagtgtccaccattgatgaggaggaggaggagattgaggcccgggaggtggccgacagctatgcccagaatgccaaggtgattgagaagcagctggagaggaagggcatgagcaagaggcggctgcaggagctggccgagctggaggccaagaaggccaagatgaagggcaccctgattgacaaccagttcaagtag

SEQ ID NO: 37361 - DNA, 2277 bp, Artificial Sequence
  Description of Artificial Sequence: Synthetic coding sequence
atgtctggagagagcggccagcctgaggccggccccagccatgctggcctggactggcccaaccctgagaggaacagagctggggtgcctgggggcgtcatcagaagagctggcagccagggccccaggtcctggatccagaaggtgctggagcagatcatggacagcccccggcagtgtgtgacccccagcgaggtggtgcctgtgacagtgctggccgtgcagcgctacctgctggaggatgagccccgggacacagtgcccaagccacccctgtactgctatgatgtgaccatcagtgatggagtgtaccaggagaagtgctacctggaccccagcctgaacagcctggtgtaccagaacatcctgaaggtgggcatccagatgaggatcagccgggtgtcctgcctgtacaatgagaagagaattggccagggcatcctgtgcatcgacaacgtgcactgtggggagaccagtgacagcatcagcctggagacccccttcaggaacagagcccaccaggagaagccagagcggcccctgcggggcggcaagagccactacctggccctgtggaacaatgaagacccctacggggacatctggctgacagacaagcagcctgaggagcacaacttcagtgacaccaagatcatcagcctgagccacctggagatgacctggaccaacagaagaaacttccctgccctgctggtgcgcatcctgcacaagagcaagctgcgctactacggcaagccagacaagaagatgattgagccctaccagaccttcctggaggtggccgacagcagcggcaccgtgtctgtcatcatgtggaatgccctgtgcccagagtggtacaagagcctgcgggtgggcctggtgctgctgctgcaggactacagcgtgaagaagagctaccccttccgcatccagcctgtgcctgtggacccccagatcaagctgatcagcaccatggagatctgcctgaacctgcgggacccccccaccaacatcatcatcatccctgagaagcaggtgaagccagagtggaggctgcccaagctgaaccaccgcttcaccaccaggtctgagctggatgacatgcctgagaactgcatctgtgatgtgattggcctgctggtgtttgtgggccgggtgcagaggagcaagaagaaggagaaccgggaggacttctggagctaccgctggatccacatcgcagatggcaccagcgagcagcccttcatcgtggagctgttcagcaccagccagcctgagatctttgagaacatctaccccatggcctactttgtgtgcacccagctgaaggtggtgagaaatgacaaccaggtgcccaagctgctgtacctgaccaccaccaatgaaagtggagtcttcatcaccggccaccggggccagccctacacctatgatgccaagaatgccaaccggcccagcaccagccaggccgcccgggtggagatccaggagagaaatggcaagaggcaccaggatgatgagcctgtgaacagccagtacttccagaccaccagcaccaacctgagcctgagcaacaagatccgcatcctgcagggcccccacgccaaccctgtggccgtgccccagcccggggcctctgtgcagaccaagggcatcaagccaggcatgcccagcatcttcaacagaagagccaacatcaatgccaacctgcagggcaaggccaggaagaccatcagtgaccgctgggagagccagctgtggagggagaagaagtttggcctgattgaccacctgcactacagccgggtgtacccagagagcatccccaggaagttcatgtttgagcacaggaagttcctgagtgaccagtacaacagccagcctgccaagtatgtgcccccagagggccggccccccaagctggatgacttcaagagcgcccggagcctgggccactttgaggtgaccatcctgggcctgaaccatgaaattgccattgatgtggccttcctgcccatgtactgcccagaggacatccgcaccagccagattgacaccctgctgacctccatgaactacagctgtgcctacccccaggacaccactggaaatgaccggctgcccggccccagggctgtggccggggacatcatcaaggccgccacagagctggacagagtgcacatcgtgggcatcctggacatctgcaacctgggcaacaacaaggtggaggtgtacctgcacaagatctacagccctgagaacaccagctag

SEQ ID NO: 37362 - DNA, 2568 bp, Artificial Sequence
  Description of Artificial Sequence: Synthetic coding sequence
atgtctggagagagcggccagcctgaggccggccccagccatgctggcctggactggcccaaccctgagaggaacagagctggggtgcctgggggcgtcatcagaagagctggcagccagggccccaggtcctggatccagaaggtgctggagcagatcatggacagcccccggcagtgtgtgacccccagcgaggtggtgcctgtgacagtgctggccgtgcagcgctacctgctggaggatgagccccgggacacagtgcccaagccacccctgtactgctatgatgtgaccatcagtgatggagtgtaccaggagaagtgctacctggaccccagcctgaacagcctggtgtaccagaacatcctgaaggtgggcatccagatgaggatcagccgggtgtcctgcctgtacaatgagaagagaattggccagggcatcctgtgcatcgacaacgtgcactgtggggagaccagtgacagcatcagcctggagacccccttcaggaacagagcccaccaggagaagccagagcggcccctgcggggcggcaagagccactacctggccctgtggaacaatgaagacccctacggggacatctggctgacagacaagcagcctgaggagcacaacttcagtgacaccaagatcatcagcctgagccacctggagatgacctggaccaacagaagaaacttccctgccctgctggtgcgcatcctgcacaagagcaagctgcgctactacggcaagccagacaagaagatgattgagccctaccagaccttcctggaggtggccgacagcagcggcaccgtgtctgtcatcatgtggaatgccctgtgcccagagtggtacaagagcctgcgggtgggcctggtgctgctgctgcaggactacagcgtgaagaagagctaccccttccgcatccagcctgtgcctgtggacccccagatcaagctgatcagcaccatggagatctgcctgaacctgcgggacccccccaccaacatcatcatcatccctgagaagcaggtgaagccagagtggaggctgcccaagctgaaccaccgcttcaccaccaggtctgagctggatgacatgcctgagaactgcatctgtgatgtgattggcctgctggtgtttgtgggccgggtgcagaggagcaagaagaaggagaaccgggaggacttctggagctaccgctggatccacatcgcagatggcaccagcgagcagcccttcatcgtggagctgttcagcaccagccagcctgagatctttgagaacatctaccccatggcctactttgtgtgcacccagctgaaggtggtgagaaatgacaaccaggtgcccaagctgctgtacctgaccaccaccaatgaaagtggagtcttcatcaccggccaccggggccagccctacacctatgatgccaaggtgaagaacttcatccagtggatccgcaccaagagtgacagcggggagcagaagaacatggtgattggaggctactacccctacccacctgtgcctgagaccttcagcaagtacagcagcagcatcaaggtggagagcctgctgacagccatcagcgaggtgaggaaggagattgaggacctgcagtaccgggagcagaagagaattgccatccagggcatcatcacagccatcaagtacatcccccacagcagcgccacagagagcgccagcgccagcgagaccctgagaaatgccaaccggcccagcaccagccaggccgcccgggtggagatccaggagagaaatggcaagaggcaccaggatgatgagcctgtgaacagccagtacttccagaccaccagcaccaacctgagcctgagcaacaagatccgcatcctgcagggcccccacgccaaccctgtggccgtgccccagcccggggcctctgtgcagaccaagggcatcaagccaggcatgcccagcatcttcaacagaagagccaacatcaatgccaacctgcagggcaaggccaggaagaccatcagtgaccgctgggagagccagctgtggagggagaagaagtttggcctgattgaccacctgcactacagccgggtgtacccagagagcatccccaggaagttcatgtttgagcacaggaagttcctgagtgaccagtacaacagccagcctgccaagtatgtgcccccagagggccggccccccaagctggatgacttcaagagcgcccggagcctgggccactttgaggtgaccatcctgggcctgaaccacgagatcgccattgatgtggccttcctgcccatgtactgcccagaggacatccgcaccagccagattgacaccctgctgacctccatgaactacagctgtgcctacccccaggacaccactggaaatgaccggctgcccggccccagggctgtggccggggacatcatcaaggccgccacagagctggacagagtgcacatcgtgggcatcctggacatctgcaacctgggcaacaacaaggtggaggtgtacctgcacaagatctacagccctgagaacaccagctag

SEQ ID NO: 37363 - DNA, 1701 bp, Artificial Sequence
  Description of Artificial Sequence: Synthetic coding sequence
aacaatgaagacccctacggggacatctggctgacagacaagcagcctgaggagcacaacttcagtgacaccaagatcatcagcctgagccacctggagatgacctggaccaacagaagaaacttccctgccctgctggtgcgcatcctgcacaagagcaagctgcgctactacggcaagccagacaagaagatgattgagccctaccagaccttcctggaggtggccgacagcagcggcaccgtgtctgtcatcatgtggaatgccctgtgcccagagtggtacaagagcctgcgggtgggcctggtgctgctgctgcaggactacagcgtgaagaagagctaccccttccgcatccagcctgtgcctgtggacccccagatcaagctgatcagcaccatggagatctgcctgaacctgcgggacccccccaccaacatcatcatcatccctgagaagcaggtgaagccagagtggaggctgcccaagctgaaccaccgcttcaccaccaggtctgagctggatgacatgcctgagaactgcatctgtgatgtgattggcctgctggtgtttgtgggccgggtgcagaggagcaagaagaaggagaaccgggaggacttctggagctaccgctggatccacatcgcagatggcaccagcgagcagcccttcatcgtggagctgttcagcaccagccagcctgagatctttgagaacatctaccccatggcctactttgtgtgcacccagctgaaggtggtgagaaatgacaaccaggtgcccaagctgctgtacctgaccaccaccaatgaaagtggagtcttcatcaccggccaccggggccagccctacacctatgatgccaagaatgccaaccggcccagcaccagccaggccgcccgggtggagatccaggagagaaatggcaagaggcaccaggatgatgagcctgtgaacagccagtacttccagaccaccagcaccaacctgagcctgagcaacaagatccgcatcctgcagggcccccacgccaaccctgtggccgtgccccagcccggggcctctgtgcagaccaagggcatcaagccaggcatgcccagcatcttcaacagaagagccaacatcaatgccaacctgcagggcaaggccaggaagaccatcagtgaccgctgggagagccagctgtggagggagaagaagtttggcctgattgaccacctgcactacagccgggtgtacccagagagcatccccaggaagttcatgtttgagcacaggaagttcctgagtgaccagtacaacagccagcctgccaagtatgtgcccccagagggccggccccccaagctggatgacttcaagagcgcccggagcctgggccactttgaggtgaccatcctgggcctgaaccatgaaattgccattgatgtggccttcctgcccatgtactgcccagaggacatccgcaccagccagattgacaccctgctgacctccatgaactacagctgtgcctacccccaggacaccactggaaatgaccggctgcccggccccagggctgtggccggggacatcatcaaggccgccacagagctggacagagtgcacatcgtgggcatcctggacatctgcaacctgggcaacaacaaggtggaggtgtacctgcacaagatctacagccctgagaacaccagctag

SEQ ID NO: 37364 - DNA, 999 bp, Artificial Sequence
  Description of Artificial Sequence: Synthetic coding sequence
atgaacagaagcagcaatgtgcccaggaagggcatcctgaagagcggcaccaggagcctgcagaaggtgcggcgggtgcactttgccaatgccagaaatgcccggagcctgctgtccatgctgaaggacatcagcgcccagatcatccagagggcctggctgagccacaccaacaagatgatcttccggctgctgaagcacgccatctgtgccgctgagttctacgtgacccatgagatcctgaagaaggtggcccccctggaggccaagctgatcaaggaccccaccatgcagtgcaagatccgcttccgcttccggggggagaccttcccccccttcatcgtgttcaagatcttcctgcacacagatggccacggctacaagtacttcagcggcaagaatgtgctgatgcccagcagcaaggctgtggatgatgcctgcaagctgatgggagagaggaagttccaccgcatcatcatggaggatgagcgcatcttccccaagagcaaggtgacagacatcatggatgtggtgaccatgcaggactatgtgcagtaccgctccttctttgatgaggccccagccttcagcggcggcaggaacaacagctggaggaagctgaacctggagaacatccccaggaccatgctgatgtatgacatcgtgcactacagcgagagcggggtcatcagcaaccggctgagaaatgagatgaagttcctgctgcagaggcctgtgacccaggagatccacaagcaccagctgagaattgtgtctgagatccggggcccctacctgactgtgcagcccctgtaccggccctacaagcagcagaaccaggtgaagttcctgggccgccgcagcaagcaggcccagatgaaggtggagaagatgaggaaggtgtacctggccaaggagaagaacaccagcgaggtgacagagcccaagacaggccccagcggcaccaaggacaactaccacctgcacagcatcttctag

SEQ ID NO: 37365 - DNA, 381 bp, Artificial Sequence
  Description of Artificial Sequence: Synthetic coding sequence
tgatttgccaatgccagaaatgcccggagcctgctgtccatgctgaaggacatcagcgcccagatcatccagagggcctggctgagccacaccaacaagatgatcttccggctgctgaagcacgccatctgtgccgctgagttctacgtgacccatgagatcctgaagaaggtggcccccctggaggccaagctgatcaaggaccccaccatgcagtgcaagatccgcttccgcttccggggggagaccttcccccccttcatcgtgttcaagatcttcctgcacacagatggccacggctacaagtacttcagcggcaagaatgtgctgatgcccagcagcaaggtgaccttccatgatgtgcacttcatgctgacctag

SEQ ID NO: 37366 - DNA, 897 bp, Artificial Sequence
  Description of Artificial Sequence: Synthetic coding sequence
atggcctgcattgaaaatgtgctgggcggccacgcccccagccccctggtggtgtctgtggacaagaatggaaaccaggagctgcaccacgacatgcccctgcagtgcctgagcagcaagccagaagatgatgctgagccctggggccagccccaggtgcccctgcggcccagcgtgaatgtgctgacagacctggacagcaagcagctggagtggcccagcgagaggacaggcagctgcatccccctgcacagcctgcgggcccaccgccacccctacggccccccacctgctgtggccgaggagagcctggccacagctgaggtgaacagcagtgatgccctggccggctggaggcaggagggccaggatgccatcaacgtgtcctgggaggtgtctgggggccccccagccctgattgtgggcggcaccaaggtgaacaacggcggcacagagcggggcagcaacaatgcccggctgcacgtggccctgccccagggcaagggcttcttccccccccggggcccccaggtgcggggccccagccacatccccaccctgcggtctggaattgtgatggaggtgcccccaggcaacacccgcatcgcctgccggggcaagctggcccacgtgtccttccccctgcggggcccctgccaccccatgcacaactggccccggcccatccccctgagcagcagcaccccaggcctgcccagctgcagcacagtgcactgcttcatccccccccggccccccatcttcaaccccttcctgaccatgcccctgccctttgcccccccacccatctttggaccacccctgcccagctactttgcccacttccacagcggcggcatgcctgccccagccagccccaaccgggagcacagctag

SEQ ID NO: 37367 - DNA, 552 bp, Artificial Sequence
  Description of Artificial Sequence: Synthetic coding sequence
atgttcatcttcatcaagcatggagacaaccagcagttcctggtgaacaccaactgtgctgtggtggtgctgctgtactacatccgcagcaaggtgaagctgcccaagaccaacaccatcgacctgtgtgagcagacaggcaagatgaagatgctgttcctgatgaagcccaaccacgccgagtatgccagcaagtacctgacagcccggagcacctactacgtgtgcaaggtggagcggggccccccaggcacccggctggagaatgcctaccgggcctttgtgcccctgctgaagaaccctgagccctggctgctggtggccctgcgcatccagtgtgatgccctggagcggcggcgcatccagatgctgaagatgaaggaggccaagaaggtggtgatcatcgagcccccagcctctgtgcccagcaagcagagcggccgcagtgacaagaagaagagcaccaggaagagccccaccttcaggaacagaccagacttcaggaagaacaagggccggcagctgaacaagaccaccaagcagaagaagtag

SEQ ID NO: 37368 - DNA, 612 bp, Artificial Sequence
  Description of Artificial Sequence: Synthetic coding sequence
atgttcatcttcatcaagcatggagacaaccagcagttcctggtgaacaccaactgtgctgtggtggtgctgctgtactacatccgcagcaaggtgaagctgcccaagaccaacaccatcgacctgtgtgagcagacaggcaagatgaagatgctgttcctgatgaagcccaaccacgccgagtatgccagcaagtacctgacagcccggagcacctactacgtgtgcaaggtggagcggggccccccaggcacccggctggagaatgcctaccgggcctttgtgcccctgctgaagaaccctgagccctggctgctggtggccctgcgcatccagtgtgatgccctggagcggcggcgcatccagatgctgaagatgaaggaggccaagaaggtggtgatcatcgagcccccagcctctgtgcctgtgcggctggccaagtgtgacctgccccagcacccccccctgcccaccagccggctgaacagcaagcagagcggccgcagtgacaagaagaagagcaccaggaagagccccaccttcaggaacagaccagacttcaggaagaacaagggccggcagctgaacaagaccaccaagcagaagaagtag

SEQ ID NO: 37369 - DNA, 1512 bp, Artificial Sequence
  Description of Artificial Sequence: Synthetic coding sequence
atggccacccagagcgacatggagaaggagcagaagcaccagcaggatgagggccagggcggcctgaacaatgaaacagccctggccagcggagatgcctgtggcaccggcaaccaggaccctgctgcctctgtgaccaccgtgagcagccaggccagccccagcggcggggccgccctgagcagcagcacagctggcagcagcgctgctgctgccaccagcgctgccatcttcatcacagatgaggccagcggcctgcccatcatcgctgctgtgctgacagagcggcacagcgaccggcaggactgccgcagcccccatgaggtgtttggctgtgtggtgcctgagggcggcagccaggccgctgtgggcccccagaaggccactggacatgctgatgagcacctggcccagaccaagagccctggcaacagcagaagaaggaagcagccctgcaggaaccaggccgccccagcccagaagcccccaggaagaagactcttccctgagcccctgccccccagcagccctggcttccggcccagcagctacccctgcagcggggccagcaccagcagccaggccacccagcccggccctgccctgctgagccacgccagcgaggcccggcctgccaccaggagccgcatcaccctggtggccagcgccctgcggcggcgggccagcggccctggccctgtgatccggggctgcacagcccagcccggccctgccttcccccaccgggccacccacctggaccctgcccggctgagccctgagagcgcccctggccctgcccggcggggccgggcctctgtgcccggccctgcccggcggggctgtgacagcgcccctggccctgcccggcggggccgggacagcgcccctgtgtctgccccccggggccgggacagcgcccctggcagcgcccggcggggccgggacagcgcccctggccctgccctgcgggtgaggacagcccggagtgatgctggccacaggagcaccagcaccaccccaggcaccggcctgcggagccgcagcacccagcagaggtctgccctgctgagcagaagaagcctgagcggcagcgcagatgagaaccccagctgtggcaccggcagcgagcggctggccttccagagccgcagcggcagcccagaccctgaggtgcccagccgggccagcccccctgtgtggcatgctgtgaggatgagggccagcagccccagccccccaggccgcttcttcctgcccatcccccagcagtgggatgagagcagcagcagcagctatgccagcaacagcagcagccccagccgcagccctggcctgagccccagcagccccagccctgagttcctgggcctgcggagcatcagcacccccagccctgagagcctgcgctatgccctgatgcctgagttctacgccctgagccctgtgcccccagaggagcaggccgagattgagagcacagcccacccagccaccccacctgagccctag

SEQ ID NO: 37370 - DNA, 252 bp, Artificial Sequence
  Description of Artificial Sequence: Synthetic coding sequence
atggaggccctgggcagcggccactacgtgggcggcagcatccgctccatggctgctgctgccctgagcggcctggccgtgcggctgagccggccccagggcacccggggcagctatggagccttctgcaagaccctgaccaggaccctgctgaccttctttgacctggcctggaggctgaggaagaacttcttctacttctacatcctggccagcgtcatcctgaatgtgcacctgcaggtgtacatctag

SEQ ID NO: 37371 - DNA, 549 bp, Artificial Sequence
  Description of Artificial Sequence: Synthetic coding sequence
atgatgagaagaagccccagcggcctgaagagcccccgggtgtcccagggcaggaagccccgggaccctgagagcctgctcttcctgcgctgctgcctgggcagcgagccccacaacctgagcagcctgctgagccctgaggccggccaggagcccctgcccaagctgctgccccagcccctggccggccatgctgcctggggcatccacggcgtgcccaccagcctgctgctggccggggagtgctggggccagggcatggctgtgcctgctgaccccccaccagccagcccctaccgcaccagccccaggcctcctcctggccccctgccccgctaccggccccagcagcacctgctgctgcccctgggccgcctgcacgccctgtgccccggctgccccctgcagcagagcctgcagtttgagcggggcaccctgagcgccccccggctgtggagctggatgaagctggagaccatcatcctgagcaagctgagccagggccagaagaccaagcacaggatgttcagcctcatcagcgagagctag

SEQ ID NO: 37372 - DNA, 549 bp, Artificial Sequence; identical to SEQ ID NO: 37371
  Description of Artificial Sequence: Synthetic coding sequence

SEQ ID NO: 37373 - DNA, 306 bp, Artificial Sequence
  Description of Artificial Sequence: Synthetic coding sequence
atgaacaagctgggccacaatgagctgaaggaatgtctgaagacagccacagacagcctgcagacagtgcagcccagcatcagccagacctgcaccagctatggccctgccctgggcgcccccctgcctggaagaaatgaggtggccctgctgaccagcctgccccccaactatgagatcagcgagggcaagccccgggccatcagcgcctacgtgcgggccgggaaaggaaatgtgaccaggaggaggaagaagacccacctgggcaatgatgatggcaagaaggaggcccaggagaagatgtag

SEQ ID NO: 37374 - DNA, 306 bp, Artificial Sequence; identical to SEQ ID NO: 37373
  Description of Artificial Sequence: Synthetic coding sequence

SEQ ID NO: 37375 - DNA, 1416 bp, Artificial Sequence
  Description of Artificial Sequence: Synthetic coding sequence
atgtgtggggactgtgtggagaaggagtaccccaacagaggcaacacctgcctggagaatggcagcttcctgctgaacttcaccggctgtgctgtgtgcagcaagagggacttcatgctgatcaccaacaagagcctgaaggaggaggatggagaggagatcgtgacctatgaccacctgtgcaagaactgccaccacgtgattgcccggcatgagtacaccttcagcatcatggatgagttccaggccaaggtggaggagaagatccaggaggtgttcagcagctacaagttcaaccacctggtgccccggctggtgctgcagcgggagaagcacttccactacctgaagaggggcctgcggcagctgacagatgcctatgagtgcctggatgccagccggccctggctgtgctactggatcctgcacagcctggagctgctggatgagcccatcccccagatcgtggccacagatgtgtgccagttcctggagctgtgccagagccctgagggcggctttggaggcggccctggccagtacccccacctggcccccacctatgctgctgtgaatgccctgtgcatcattggaacagaggaggcctatgacatcatcaaccgggagaagctgctgcagtacctgtacagcctgaagcagccagatggcagcttcctgatgcacgtgggcggggaggtggatgtgcgcagcgcctactgtgccgcctctgtggccagcctgaccaacatcatcaccccagacctgtttgagggcacagctgagtggatcgcccgctgccagaactgggagggcggcattggaggagtgcccggcatggaggcccacggcggctacaccttctgtggcctggccgccctggtgatcctgaagcgggagaggagcctgaacctgaagagcctgctgcagtgggtgaccagccggcagatgagatttgagggcggcttccagggccgctgcaacaagctggtggatggctgctacagcttctggcaggccggcctgctgcccctgctgcaccgggccctgcacgcccagggcgaccctgccctgtccatgagccactggatgttccaccagcaggccctgcaggagtacatcctgatgtgctgccagtgcccagctgggggcctgctggacaagccaggcaagagccgggacttctaccacacctgctactgcctgagcggcctgagcatcgcccagcacttcggcagcggggccatgctgcatgatgtggtgctgggcgtgcctgaaaatgccctgcagcccacccaccctgtgtacaacattggaccagacaaggtgatccaggccaccacctacttcctgcagaagcctgtgcccggctttgaggagctgaaggatgagaccagcgctgagcccgccacagactag

SEQ ID NO: 37376 - DNA, 582 bp, Artificial Sequence
  Description of Artificial Sequence: Synthetic coding sequence
atggaggcccacggcggctacaccttctgtggcctggccgccctggtgatcctgaagcgggagaggagcctgaacctgaagagcctgctgcagtgggtgaccagccggcagatgagatttgagggcggcttccagggccgctgcaacaagctggtggatggctgctacagcttctggcaggccggcctgctgcccctgctgcaccgggccctgcacgcccagggcgaccctgccctgtccatgagccactggatgttccaccagcaggccctgcaggagtacatcctgatgtgctgccagtgcccagctgggggcctgctggacaagccaggcaagagccgggacttctaccacacctgctactgcctgagcggcctgagcatcgcccagcacttcggcagcggggccatgctgcatgatgtggtgctgggcgtgcctgaaaatgccctgcagcccacccaccctgtgtacaacattggaccagacaaggtgatccaggccaccacctacttcctgcagaagcctgtgcccggctttgaggagctgaaggatgagaccagcgctgagcccgccacagactag

SEQ ID NO: 37377 - DNA, 1176 bp, Artificial Sequence
  Description of Artificial Sequence: Synthetic coding sequence
atgattgccaaggtggaggagaagatccaggaggtgttcagcagctacaagttcaaccacctggtgccccggctggtgctgcagcgggagaagcacttccactacctgaagaggggcctgcggcagctgacagatgcctatgagtgcctggatgccagccggccctggctgtgctactggatcctgcacagcctggagctgctggatgagcccatcccccagatcgtggccacagatgtgtgccagttcctggagctgtgccagagccctgagggcggctttggaggcggccctggccagtacccccacctggcccccacctatgctgctgtgaatgccctgtgcatcattggaacagaggaggcctatgacatcatcaaccgggagaagctgctgcagtacctgtacagcctgaagcagccagatggcagcttcctgatgcacgtgggcggggaggtggatgtgcgcagcgcctactgtgccgcctctgtggccagcctgaccaacatcatcaccccagacctgtttgagggcacagctgagtggatcgcccgctgccagaactgggagggcggcattggaggagtgcccggcatggaggcccacggcggctacaccttctgtggcctggccgccctggtgatcctgaagcgggagaggagcctgaacctgaagagcctgctgcagtgggtgaccagccggcagatgagatttgagggcggcttccagggccgctgcaacaagctggtggatggctgctacagcttctggcaggccggcctgctgcccctgctgcaccgggccctgcacgcccagggcgaccctgccctgtccatgagccactggatgttccaccagcaggccctgcaggagtacatcctgatgtgctgccagtgcccagctgggggcctgctggacaagccaggcaagagccgggacttctaccacacctgctactgcctgagcggcctgagcatcgcccagcacttcggcagcggggccatgctgcatgatgtggtgctgggcgtgcctgaaaatgccctgcagcccacccaccctgtgtacaacattggaccagacaaggtgatccaggccaccacctacttcctgcagaagcctgtgcccggctttgaggagctgaaggatgagaccagcgctgagcccgccacagactag

SEQ ID NO: 37378 - DNA, 1419 bp, Artificial Sequence
  Description of Artificial Sequence: Synthetic coding sequence
gccatgtgtggggactgtgtggagaaggagtaccccaacagaggcaacacctgcctggagaatggcagcttcctgctgaacttcaccggctgtgctgtgtgcagcaagagggacttcatgctgatcaccaacaagagcctgaaggaggaggatggagaggagatcgtgacctatgaccacctgtgcaagaactgccaccacgtgattgcccggcatgagtacaccttcagcatcatggatgagttccaggccaaggtggaggagaagatccaggaggtgttcagcagctacaagttcaaccacctggtgccccggctggtgctgcagcgggagaagcacttccactacctgaagaggggcctgcggcagctgacagatgcctatgaatgtctggatgccagccggccctggctgtgctactggatcctgcacagcctggagctgctggatgagcccatcccccagatcgtggccacagatgtgtgccagttcctggagctgtgccagagccctgagggcggctttggaggcggccctggccagtacccccacctggcccccacctacgccgctgtgaatgccctgtgcatcatcggcacagaggaggcctatgacatcatcaaccgggagaagctgctgcagtacctgtacagcctgaagcagccagatggcagcttcctgatgcacgtgggcggggaggtggatgtgcgcagcgcctactgtgccgcctctgtggccagcctgaccaacatcatcaccccagacctgtttgagggcacagctgagtggatcgcccgctgccagaactgggagggcggcatcggcggcgtgcccggcatggaggcccatggaggctacaccttctgtggcctggccgccctggtgatcctgaagcgggagaggagcctgaacctgaagagcctgctgcagtgggtgaccagccggcagatgagatttgaaggaggcttccagggccgctgcaacaagctggtggatggctgctacagcttctggcaggccggcctgctgcccctgctgcaccgggccctgcacgcccagggcgaccctgccctgtccatgagccactggatgttccaccagcaggccctgcaggagtacatcctgatgtgctgccagtgcccagctgggggcctgctggacaagccaggcaagagccgggacttctaccacacctgctactgcctgagcggcctgagcatcgcccagcactttggaagtggggccatgctgcatgatgtggtgctgggcgtgcctgaaaatgccctgcagcccacccaccctgtgtacaacatcggccctgacaaggtgatccaggccaccacctacttcctgcagaagcctgtgcccggctttgaggagctgaaggatgagaccagcgctgagcccgccacagactag

SEQ ID NO: 37379 - DNA, 342 bp, Artificial Sequence
  Description of Artificial Sequence: Synthetic coding sequence
atgtgtggggactgtgtggagaaggagtaccccaacagaggcaacacctgcctggagaatggcagcttcctgctgaacttcaccggctgtgctgtgtgcagcaagagggacttcatgctgatcaccaacaagagcctgaaggaggaggatggagaggagatcgtgacctatgaccctgacctgtgcaagaactgccaccacgtgattgcccggcatgagtacaccttcagcatcatggatgagttccaggagtacaccatgctgtgcctgctgtgtgggaaggccgaggacaccatcagcatcctgcctgatgacccccggcagatgaccctgctcttctag

SEQ ID NO: 37380 - DNA, 318 bp, Artificial Sequence
  Description of Artificial Sequence: Synthetic coding sequence
atgaggcagccctacctgagcagccgggaggtgagcagcagcaggaagcgctggaggaccttccctgtggactgtgtggccatgtgtggggactgtgtggagaaggagtaccccaacagaggcaacacctgcctggagaatggcagcttcctgctgaacttcaccggctgtgctgtgtgcagcaagagggacttcatgctgatcaccaacaagagcctgaaggaggaggatggagaggagatcgtgacctatgacagagtgtaccacgctgtgtctgtgatgaggcagagccgccgctactaccagtacagcccctag

SEQ ID NO: 37381 - DNA, 420 bp, Artificial Sequence
  Description of Artificial Sequence: Synthetic coding sequence
atgaggcagccctacctgagcagccgggaggtgagcagcagcaggaagcgctggaggaccttccctgtggactgtgtggccatgtgtggggactgtgtggagaaggagtaccccaacagaggcaacacctgcctggagaatggcagcttcctgctgaacttcaccggctgtgctgtgtgcagcaagagggacttcatgctgatcaccaacaagagcctgaaggaggaggatggagaggagatcgtgacctatgaccacctgtgcaagaactgccaccacgtgattgcccggcatgagtacaccttcagcatcatggatgagttccaggagtacaccatgctgtgcctgctgtgtgggaaggccgaggacaccatcagcatcctgcctgatgacccccggcagatgaccctgctcttctag

SEQ ID NO: 37382 - DNA, 423 bp, Artificial Sequence
  Description of Artificial Sequence: Synthetic coding sequence
atgaggcagccctacctgagcagccgggaggtgagcagcagcaggaagcgctggaggaccttccctgtggactgtgtggccatgtgtggggactgtgtggagaaggagtaccccaacagaggcaacacctgcctggagaatggcagcttcctgctgaacttcaccggctgtgctgtgtgcagcaagagggacttcatgctgatcaccaacaagagcctgaaggaggaggatggagaggagatcgtgacctatgaccctgacctgtgcaagaactgccaccacgtgattgcccggcatgagtacaccttcagcatcatggatgagttccaggagtacaccatgctgtgcctgctgtgtgggaaggccgaggacaccatcagcatcctgcctgatgacccccggcagatgaccctgctcttctag

SEQ ID NO: 37383 - DNA, 381 bp, Artificial Sequence
  Description of Artificial Sequence: Synthetic coding sequence
tgtggggtgtccacctacgccccagacatgagcaggatgctgggcggggaggaggcccggcccaacagctggccctggcaggtgtccctgcagtacagcagcaatggccagtggtaccacacctgtggcggcagcctgattgccaacagctgggtgctgacagctgcccactgcatccggcagatcatcaaggcccacaaggtgctgcagcgctgcagcctcatcctcttctttgtgcgggacctgtgcagcagccagctggagctgactggagtgtctgctggcagcagcggcatctacagagtgatgctgggccagcacaacctgtatgtggccgagagcggcagcctggccgtgtctgtgtccaagatcgtggtgtag

SEQ ID NO: 37384 - DNA, 813 bp, Artificial Sequence
  Description of Artificial Sequence: Synthetic coding sequence
atgatgctgcggctgctgagcagcctgctgctggtggccgtggccagcggctacggcccccccagcagccacagcagcagccgggtggtgcatggagaagatgctgtgccctacagctggccctggcaggtgtccctgcagtatgagaagagcggcagcttctaccacacctgtggcggcagcctgattgccccagactgggtggtgacagctggccactgcatcagccgggacctgacctaccaggtggtgctgggggagtacaacctggccgtgaaggagggccctgagcaggtgatccccatcaacagcgaggagctgtttgtgcaccccctgtggaacagaagctgtgtggcctgtggaaatgacatcgccctgatcaagctgagccgcagcgcccagctgggagatgctgtgcagctggccagcctgcccccagctggggacatcctgcccaacaagaccccctgctacatcaccggctggggccgcctgtacaccaacggccccctgcctgacaagctgcagcaggcccggctgcctgtggtggactacaagcactgcagccgctggaactggtggggcagcacagtgaagaagaccatggtgtgtgccggcggctacatccgcagcggctgcaatggagacagcggcggccccctgaactgccccacagaagatggcggctggcaggtgcatggagtgaccagctttgtgtctgccttcggctgcaacttcatctggaagcccaccgtcttcaccagggtgtctgccttcatcgactggattgaggagaccatcgccagccactag

SEQ ID NO: 37385 - DNA, 495 bp, Artificial Sequence
  Description of Artificial Sequence: Synthetic coding sequence
atgaggagctgctacgtggcccaggccggcctgaagctgcccggcagcagtgaccccccagccagcgccagccagagcacccgcatcacagccagcggctacggcccccccagcagccacagcagcagccgggtggtgcatggagaagatgctgtgccctacagctggccctggcaggtgtccctgcagtatgagaagagcggcagcttctaccacacctgtggcggcagcctgattgccccagactgggtggtgacagctggccactgcatcagccgggacctgacctaccaggtggtgctgggggagtacaacctggccgtgaaggagggccctgagcaggtgatccccatcaacagcgaggagctgtttgtgcaccccctgtggaacagaagctgtgtggcctgtggaaatgacatcgccctgatcaagctgagccgcagcgcccagctgggagatgctgtgcagctggccagcctgcccccagctggatag

SEQ ID NO: 37386 - DNA, 366 bp, Artificial Sequence
  Description of Artificial Sequence: Synthetic coding sequence
atgatgctgcggctgctgagcagcctgctgctggtggccgtggccagcggctacggcccccccagcagccacagcagcagccgggtggtgcatggagaagatgctgtgccctacagctggccctggcaggtgtccctgcagtatgagaagagcggcagcttctaccacacctgtggcggcagcctgattgccccagactgggtggtgacagctggccactgcatcagccgggacctgacctaccaggtggtgctgggggagtacaacctggccgtgaaggagggccctgagcaggtgatccccatcaacagcgaggagctgtttgtgcaccccctgtggaacagaagctgtgtggcctgtggctag

SEQ ID NO: 37387 - DNA, 228 bp, Artificial Sequence
  Description of Artificial Sequence: Synthetic coding sequence
tggtggggcagcacagtgaagaagaccatggtgtgtgccggcggctacatccgcagcggctgcaatggagacagcggcggccccctgaactgccccacagaagatggcggctggcaggtgcatggagtgaccagctttgtgtctgccttcggctgcaacttcatctggaagcccaccgtcttcaccagggtgtctgccttcatcgactggattgaggagggcggctag

SEQ ID NO: 37388 - DNA, 348 bp, Artificial Sequence
  Description of Artificial Sequence: Synthetic coding sequence
atggacaacgtgcagcccaagatcaagcaccggcccttctgcttctctgtgaagggccacgtgaagatgctgcggctggacctgaccaacagcatcatcacagctgtgttcctgtctgtggtggccatcctggccatgcaggagaagaagagaagacacctgctgtatgtgggcggcagcctgtgcctgacagctgtgattgtgtgctgcattgatgcctttgtggtgaccaccaagatgaggaccaacctgaagcgcttcctgggcgtggaggtggagaggaagctgagccctgccaaggatgcctacccagagaccggcccagatgccccccagaggcctgcctag

SEQ ID NO: 37389 - DNA, 195 bp, Artificial Sequence
  Description of Artificial Sequence: Synthetic coding sequence
atcaacagcctggtgaccaccgtcttcatgctgattgtgtctgtgctggccctgatccctgagaccaccaccctgactgtgggcggcggggacctgaccaacagcatcatcacagctgtgttcctgtctgtggtggccatcctggccatgcaggagaagaagagaagacacctgctgtatgtgggcggccgctag

SEQ ID NO: 37390 - DNA, 1395 bp, Artificial Sequence
  Description of Artificial Sequence: Synthetic coding sequence
atgaggatcatcgagagcaacagcagcaagatccagagccagattgaccacatcaagcagtgcagagcagaatatgacaccaaggaggtgaagtactgcaccttcagcaaggaccccagcaagcccatccctggcatgaccctgcaggagagcatgaacctggatgccctgaccaagtacatgaagcacctggaggacaagtatgcagagatcaagcaggccatgctgatcaagtatgtgcctgcccagaggaaggctgacctggatgaggagatgattgtgctgctgaagagaagagatgtggccgagaacctgaacaagaagctgcagttctgccaccagaggctgcagatcatcagccaggccctgagctcctgggtgaagagtgacatgagcagccccttccaggactttgtggagcagatccagaagaccaagtacctgcagggcgaccagggcatcgtggaggagctgatggaggatgacccccggcgggccaaggaggccgagatcatgctgcactacatcgagcgcttcaatgagctgatcagcctgggggagtatgagaaggccgcctgctatgctgccaacagcccccggcgcatcctgaggaacatcggcaccatgaacaccttcaaggctgtgggcaagatccggggcaagcccctgcccctgctgctcttctttgaggccctcttcatcaccagccacgccttcccctgccctgtggatgctgccctgaccctggagggcatcaagtgtggcctgtctgagaagaggctggacctggtgaccaactgggtgacccaggagcggctgaccttcagcgaggaggccggagatgtgatctgtgactatggagagcaggacacctacaacaaggccaagtgcctggccctggcccagatcgtgtacagtgaatgtggcctgcacaagaaggccatcctgtgcctgtgcaagcagggccagacccaccgggtgatggagtacatccagcagctgaaggacttcaccacagatgacctgctgcagctgctgatgagctgcccccaggtggagctgatccagtgcctgaccaaggagctgaatgagaagcagcccagcctgagctttggcctggccatcctgcacctgttctctgctgacatgaagaaggtgggcatcaagctgctgcaggagatcaacaagggcggcattgatgctgtggagagcctgatgatcaatgacagcttctgcagcattgagaagtggcaggaggtggccaacatctgcagccagaatggatttgacaagctgagcaatgacatcaccagcatcctgcggagccaggccgctgtgacagagatcagcgaggaggatgatgctgtgaacctgatggagcacgtgttctggtag

SEQ ID NO: 37391 - DNA, 663 bp, Artificial Sequence
  Description of Artificial Sequence: Synthetic coding sequence
atggccctgatcttcagaacagccatgcagagcgtgggcctgctgctgagcctgctgggctggatcctgagcatcatcaccacctacctgccccactggaagaacctgaacctggacctgaatgagatggagaactggaccatgggcctgtggcagacctgtgtgatccaggaggaggtgggcatgcagtgcaaggactttgacagcttcctggccctgcctgctgagctgcgggtgagccgcatcctgatgttcctgagcaatggcctgggcttcctgggcctgctggtgtctggcttcggcctggactgcctgagaattggagagagccagagggacctgaagaggcggctgctgatcctgggcggcatcctgtcctgggccagcggcatcacagccctggtgcctgtgtcctgggtggcccacaagacagtgcaggagttctgggatgaaaatgtgcctgactttgtgccccgctgggagtttggagaggccctcttcctgggctggtttgctggcctgagcctgctgctgggcggctgcctgctgaactgtgccgcctgcagcagccacgcccccctggccctgggccactatgctgtggcccagatgcagacccagtgcccctacctggaggatggaacagctgacccccaggtgtag

SEQ ID NO: 37392 - DNA, 630 bp, Artificial Sequence
  Description of Artificial Sequence: Synthetic coding sequence
atggcctccatgggcctgcaggtgatgggcatcgccctggccgtgctgggctggctggccgtgatgctgtgctgtgccctgcccatgtggagggtgacagccttcatcggcagcaacatcgtgaccagccagaccatctgggagggcctgtggatgaactgtgtggtgcagagcacaggccagatgcagtgcaaggtgtatgacagcctgctggccctgccccaggacctgcaggccgcccgggccctggtgatcatcagcatcatcgtggccgccctgggcgtgctgctgtctgtggtgggcggcaagtgcaccaactgcctggaggatgagagcgccaaggccaagaccatgattgtggccggcgtggtgttcctgctggccggcctgatggtgattgtgcctgtgtcctggacagcccacaacatcatccaggacttctacaaccccctggtggccagcggccagaagcgggagatgggcgccagcctgtatgtgggctgggccgccagcggcctgctgctgctgggcggcggcctgctgtgctgcaactgcccccccaggacagacaagccctacagcgccaagtacagcgctgcccggtctgctgctgccagcaactacgtgtag

SEQ ID NO: 37393 - DNA, 630 bp, Artificial Sequence; identical to SEQ ID NO: 37392
  Description of Artificial Sequence: Synthetic coding sequence

SEQ ID NO: 37394 - DNA, 540 bp, Artificial Sequence
  Description of Artificial Sequence: Synthetic coding sequence
atgcaggaggtgattgctggcctggagcgcttcacctttgcctttgagaaggatgtggagatgcagaagggcaccggcctgctgcccttccagggcatggacaagagcgccagcgctgtgtgcaacttcttcaccaagggcctgtgtgagaagggcaagctgtgccccttcagacatgacagaggagagaagatggtggtgtgcaagcactggctgcggggcctgtgcaagaagggggaccactgcaagttcctgcaccagtatgacctgaccaggatgcctgagtgctacttctacagcaagtttggagactgcagcaacaaggaatgttccttcctgcacgtgaagccagccttcaagagccaggactgcccctggtatgaccagggcttctgcaaggatggccccctgtgcaagtaccgccacgtgccccgcatcatgtgcctgaactacctggtgggcttctgcccagagggccccaagtgccagtttgcccagaagatccgggagttcaagctgctgcccggcagcaagatctag

SEQ ID NO: 37395 - DNA, 459 bp, Artificial Sequence
  Description of Artificial Sequence: Synthetic coding sequence
atggtggtgtgcaagcactggctgcggggcctgtgcaagaagggggaccactgcaagttcctgcaccagtatgacctgaccaggatgcctgagtgctacttctacagcaagtttggagactgcagcaacaaggaatgttccttcctgcacgtgaagccagccttcaagagccaggactgcccctggtatgaccagggcttctgcaaggatgctggccccctgtgcaagtacagacatgtgccccgcatcatgtgcctgaactacctggtgggcttctgcccagagggccccaagtgccagtttgcccactgcagcctgcctgctggccctggcatccagcacctgctcttcctgctgtggaagctgggcaacccccacccccagcagagcgcctgcagccctgcctggggcagcggcgtgaagggccgggcctgtgccaccggccccctgtgccagtag

SEQ ID NO: 37396 - DNA, 678 bp, Artificial Sequence
  Description of Artificial Sequence: Synthetic coding sequence
atgagcaaggagatcttccccttctgccgggtgggcaacatcccctatgaggccacagaggagcagctgaaggacatcttcagcgaggtgggccctgtggtgtccttccggctggtgtatgaccgggagaccgggaagcccaagggctacggcttctgtgagtaccaggaccaggagacagccctgagcgccatgaggaacctgaatggccgggagttcagcggccgggccctgcgggtggacaatgctgccagcgagaagaacaaggaggagctgaagagcctgggcactggagcccctgtgattgagagcccctacggggagaccatcagcccagaagatgcccctgagagcatcagcaaggctgtggccagcctgcccccagagcagatgtttgagctgatgaagcagatgaagctgtgtgtgcagaacagcccccaggaggccaggaacatgctgctgcagaacccccagctggcctatgccctgctgcaggcccaggtggtgatgagaattgtggaccctgagatcgccctgaagatcctgcaccggcagaccaacatccccaccctgattgctggcaacccccagcctgtgcacggggccggccctggcagcggcagcaatgtgtccatgaaccagcagaacccccaggccccccaggcccagagcctgtag

SEQ ID NO: 37397 - DNA, 1794 bp, Artificial Sequence
  Description of Artificial Sequence: Synthetic coding sequence
atggccggcctgactgtgcgggaccctgctgtggacaggagcctgcggtctgtgtttgtgggcaacatcccctatgaggccacagaggagcagctgaaggacatcttcagcgaggtgggccctgtggtgtccttccggctggtgtatgaccgggagaccgggaagcccaagggctacggcttctgtgagtaccaggaccaggagacagccctgagcgccatgaggaacctgaatggccgggagttcagcggccgggccctgcgggtggacaatgctgccagcgagaagaacaaggaggagctgaagagcctgggcaccggggcccctgtgattgagagcccctatggagagaccatcagcccagaagatgcccctgagagcatcagcaaggctgtggccagcctgcccccagagcagatgtttgagctgatgaagcagatgaagctgtgtgtgcagaacagcccccaggaggccaggaacatgctgctgcagaacccccagctggcctatgccctgctgcaggcccaggtggtgatgagaattgtggaccctgagatcgccctgaagatcctgcaccggcagaccaacatccccaccctgattgctggcaacccccagcctgtgcatggagctggccctggcagcggcagcaatgtgtccatgaaccagcagaacccccaggccccccaggcccagagcctgggcggcatgcacgtgaatggagccccacccctgatgcaggcctccatgcagggcggcgtgcctgcccctggccagatgcctgctgctgtgactggacctggccctggcagcctggcccctgggggcggcatgcaggcccaggtgggcatgcctggcagcggccctgtgtccatggagcggggccagggcaccctgcagcacagccctgtgggccctgctggccctgccagcattgaaagagtgcaggtgcccatgcaggacccccgggccgccatgcagaggggcagcctgcctgccaacgtgcccaccccccggggcctgctgggagatgccccaaatgacccccggggcggcaccctgctgtctgtgactggagaggtggagccccggggctacctgggccccccccaccagggcccccccatgcaccacgtgcccggccacgagagccggggccccccacctcatgagctgcggggcggccccctgcctgagccccggcccctgatggccgagccccggggccccatgctggaccagaggggcccccccctggatggccggggcggccgggacccccggggcattgatgcccggggcatggaggcccgggccatggaggcccggggcctggatgcccggggcctggaggcccgggccatggaggcccgggccatggaggcccgggccatggaggcccgggccatggaggcccgggccatggaggtgcggggcatggaggcccggggcatggacacccggggccctgtgcccggcccccggggccccatccccagcggcatgcagggccccagccccatcaacatgggcgctgtggtgccccagggcagccggcaggtgcctgtgatgcagggcaccggcatgcagggcgccagcatccagggcggcagccagcccggcggcttcagccctggccagaaccaggtgaccccccaggaccacgagaaggccgccctgatcatgcaggtgctgcagctgacagctgaccagatcgccatgctgcccccagagcagaggcagagcatcctgatcctgaaggagcagatccagaagagcactggagccccctag

SEQ ID NO: 37398 - DNA, 786 bp, Artificial Sequence
  Description of Artificial Sequence: Synthetic coding sequence
atgcacggggaggccagtgatggagagggggagggggacacagaggtgatgcagcaggagaccgtgcctgtgcctgtgcccagcgagaagaccaagcagcccaaggagtgcttcctgatccagcccaaggagaggaaagaaaacaccaccaagaccaggaagaggaggaagaagaagatcacagatgtgctggccaagtctgagcccaagccaggcctgcctgaggacctgcagaagctgatgaaggactactacagcagccggcggctggtgattgagctggaggagctgaacctgcctgacagctgcttcctgaaggccaatgacctgacccacagcctgagcagctacctgaaggagatctgccccaagtgggtgaagctgaggaagaaccacagcgagaagaagtctgtgctgatgctgatcatctgcagcagcgctgtgcgggccctggagctgatccgctccatgacagccttcagaggagatggcaaggtgatcaagctgtttgccaagcacatcaaggtgcaggcccaggtgaagctgctggagaagagggtggtgcacctgggcgtgggcaccccaggccgcatcaaggagctggtgaagcagggcggcctgaacctgagccccctgaagttcctggtgtttgactggaactggagggaccagaagctgcggaggatgatggacatccctgagatcaggaaggaggtgtttgagctgctggagatgggcgtgctgagcctgtgcaagtctgagagcctgaagctgggcctcttctag

SEQ ID NO: 37399 - DNA, 732 bp, Artificial Sequence
  Description of Artificial Sequence: Synthetic coding sequence
atgagcccagaccagttcctgctgactgtgtctgccctgcagcacgccagaaattctggagaatttgcctacccctgccggccccagacagagatcacagatgtgtggggccccagcatctcctaccccaggaaggtgctgaacttcaagggcaagagcatccagagagctgtggaccggctgcggctgagcaacccccccattgatgtgaagaggaccagcatccccctggagatccagaagctgcagcccaacctgaagatcagcctgcacagcccccgggcccagagcaccatccctgagcccatgatcatccgcagccgcttcagcggcagcctgaagggcggggaccaggtgaccagcagcattgaaagagctgtgtgcagcacaggccccctgacctccatgcaggtgatcaagcccaacaggatgctggccccccaggtgggcacagccaccctgagcctgaagaaggagcggccccgcatctacacagccctggaccccttccgggtgaatgctgagtttgtgctgctgactgtgaaggaggagaaggagcaccaggaggccaagatgaaggagtaccaggcccgggagagcactggagtggtggaccccgggaaggccagcaaggccgcctggatcaggaagatcaagggcctgcccatcgacaacttcaccaagcagggcaagacagctgcccctgagctgggccagaatgtgttcatctag

SEQ ID NO: 37400 - DNA, 759 bp, Artificial Sequence
  Description of Artificial Sequence: Synthetic coding sequence
atggacctgtgcaagaaccggctggtgtctgggggccgggactgccaggtgaaggtgtgggatgtggacaccgggaagtgcctgaagaccttccgccacaaggaccccatcctggccacccgcatcaatgacacctacatcgtgagcagctgtgagcggggcctggtgaaggtgtggcacatcgccatggcccagctggtgaagaccctgagcggccatgaaggagctgtgaagtgcctcttctttgaccagtggcacctgctgagcggcagcacagatggcctggtgatggcctggagcatggtgggcaagtatgagcgctgcctgatggccttcaagcaccccaaggaggtgctggatgtgtccctgctcttcctgcgggtcatcagcgcctgtgctgatggcaagatccgcatctacaacttcttcaacggcaactgcatgaaggtgatcaaggccaacggccgcggggaccctgtgctgtccttcttcatccagggcaaccgcatctctgtgtgccacatcagcacctttgccaagaggatcaacgtgggctggaatggaattgagcccagcgccacagcccagggcggcaatgccagcctgacagaatgtgcccacgtgcggctgcacatcgccggccacctgcctgccagccggctgcctgtggccgctgtgcagcccatgactggaggcatggcccccaccacagcccccacccacgtgctggccatgctgatcctcttcagcggcgtgtag

SEQ ID NO: 37401 - DNA, 2259 bp, Artificial Sequence
  Description of Artificial Sequence: Synthetic coding sequence
atggagaacctggagagccggctgaagaatgccccctacttccgctgtgagaagggcacagacagcatccccctgtgcaggaaatgtgagaccagggtgctggcctggaagatcttcagcaccaaggagtggttctgccgcatcaatgacatcagccagaggcgcttcctggtgggcatcctgaagcagctgaacagcctgtacctgctgcactacttccagaacatcctgcagaccacccagggcaaggacttcatctacaacagaagcagaattgacctgagcaagaaggagggcaaggtggtgaagagcagcctgaaccagatgctggacaagacagtggagcagaagatgaaggagatcctgtactggtttgccaacagcacccagtggaccaaggccaactacaccctgctgctgctgcagatgtgcaaccccaagctgctgctgacagctgccaacgtcatccgggtgctcttcctgcgggaggagaacaacatcagcggcctgaaccaggacatcacagatgtgtgcttcagccctgagaaggaccacagcagcaagagcgccaccagccaggtgtactggacagccaagacccagcacaccagcctgcccctgagcaaggccccagaaaatgagcacttcctgggcgccgccagcaaccctgaggagccctggaggaacagcctgcgctgcatcagcgagatgaacagactcttcagcggcaaggctgacatcaccaagccaggctatgacccctgcaacctgctggtggacctggatgacatccgggacctgagcagcggcttcagcaagtacagagacttcatccgctacctgcccatccacctgagcaagtacatcctgaggatgctggacagacacaccctgaacaagtgtgcctctgtgtcccagcactgggccgccatggcccagcaggtgaagatggacctgagcgcccacggcttcatccagaaccagatcaccttcctgcagggcagctacacccggggcatcgaccccaactatgccaacaaggtgtccatccctgtgcccaagatggtggatgatggcaagtccatgagggtgaagcaccccaagtggaagctgcggaccaagaatgagtacaacctgtggacagcctaccagaatgaggagacccagcaggtgctgatggaggagagaaatgtgttctgtggcacctacaacgtgcgcatcctgagtgacacctgggaccagaacagagtcatccactacagcggcggggacctgattgctgtgagcagcaacaggaagatccacctgctggacatcatccaggtgaaggccatccctgtggagttccggggccatgctggctctgtgcgggccctcttcctgtgtgaggaggagaacttcctgctgagcggcagctatgacctgagcatccgctactgggacctgaagagcggcgtgtgcacccgcatctttggaggccaccagggcaccatcacctgcatggacctgtgcaagaaccggctggtgtctgggggccgggactgccaggtgaaggtgtgggatgtggacaccgggaagtgcctgaagaccttccgccacaaggaccccatcctggccacccgcatcaatgacacctacatcgtgagcagctgtgagcggggcctggtgaaggtgtggcacatcgccatggcccagctggtgaagaccctgagcggccatgaaggagctgtgaagtgcctcttctttgaccagtggcacctgctgagcggcagcacagatggcctggtgatggcctggagcatggtgggcaagtatgagcgctgcctgatggccttcaagcaccccaaggaggtgctggatgtgtccctgctcttcctgcgggtcatcagcgcctgtgctgatggcaagatccgcatctacaacttcttcaacggcaactgcatgaaggtgatcaaggccaacggccgcggggaccctgtgctgtccttcttcatccagggcaaccgcatctctgtgtgccacatcagcacctttgccaagaggatcaacgtgggctggaatggaattgagcccagcgccacagcccagggcggcaatgccagcctgacagaatgtgcccacgtgcggctgcacatcgccggccacctgcctgccagccggctgcctgtggccgctgtgcagcccatgactggaggcatggcccccaccacagcccccacccacgtgctggccatgctgatcctcttcagcggcgtgtag

SEQ ID NO: 37402 - DNA, 567 bp, Artificial Sequence
  Description of Artificial Sequence: Synthetic coding sequence
atgttcagctgctgcttccccaccagccggggctgctgcttcagaaatggaggcagcgagagcctcttccgccgctgcagaagaagactcatcccccacccccggcggctgagccctgtggtgatccgccgcatccaggtgccccaggacagcctgggccaggccctggccggccaggccaccccagagatccccctgggcctgcagctgcacacagtgctggtgcaggagatccaggagctgattgaggcccagaccctggcccctggcccctgtgccgaggtgcgggccctgcctgccccagctgctgagcctgagcccgcctgggaggaggcccctcctgagcgggccctggagctggagggcgccccagccaaggaccagaccaatgaggagctgcctgagatcacagaggtgcctgagagcatcaagaggcggctgggcagaagagtgcctgctgccaccccagccccccggggcaacctgctgctgcaggcctggatgagggtgcacagctgggccagccggctgtttgccccaaatgtgctgcccggcaccggcccctag

SEQ ID NO: 37403 - DNA, 369 bp, Artificial Sequence
  Description of Artificial Sequence: Synthetic coding sequence
atgcccaagaaggcccaccccagcccccagacccctgtggcccgctgcaacaaggcccacccagcccctggcccctgtgccgaggtgcgggccctgcctgccccagctgctgagcctgagcccgcctgggaggaggcccctcctgagcgggccctggagctggagggcgccccagccaaggaccagaccaatgaggagctgcctgagatcacagaggtgcctgagagcatcaagaggcggctgggcagaagagtgcctgctgccaccccagccccccggggcaacctgctgctgcaggcctggatgagggtgcacagctgggccagccggctgtttgccccaaatgtgctgcccggcaccggcccctag

SEQ ID NO: 37404 - DNA, 846 bp, Artificial Sequence
  Description of Artificial Sequence: Synthetic coding sequence
atgttcagctgctgcttccccaccagccggggctgctgcttcagaaatggaggcagcgagagcctcttccggcagtgcagaagaagactcatcccccacccccggcggctgtggccctttgtgagaagaaggacccaggtgccccaggacagccctggccaggccctggccggccaggccaccccagagatccccagcggcctgcccctgcacatcgtgctggtgcaggaggagatccgggagcccatggaggcccagacccacgcccctggcccctatgctgacattgctgccctggccgccccagctgtggagcccaagccagcctgggaggagcccccacctgagcgggccctggaggtggagggcgccccagccaaggaccagcccagccaggagctgcctgagatcatggcccccaccgtggccaccggcctgaatgctggagcagaaaatgtggccggggagaggagcggccgggagggcgtgaccagcacagccccagccagccgcagccacgccgcccccagccctggccacggcggcaagcacggcggcggggaccagggcatccagacaggcctgctgtacctggccggggagcggctgctgagctttgctggcaccacagccctgctgctgcagggcctcttcatcgtgctgatcctggtgggctacatctctgtgaaggtgatgctgaagagcatcaagacccggctgggccggcgggtgcctgctgcccccccagccctgcggaggaacctgctgctgcaggcctggaagtgtgtgtgcaactgggccagccggctgtttgcccccaacgtgctgcccaggacaggcagctag

SEQ ID NO: 37405 - DNA, 456 bp, Artificial Sequence
  Description of Artificial Sequence: Synthetic coding sequence
atggatgcccggaggatgaagaaggagggcctgacagaaaatacaggcctgcccaggaagctgctggagaagcatgacccctggccagcctacgtgacctacaccagccagacagtgaagaggctgattgagaagagcaagacccgggagctggagtgcatgagggccctggaggagcggccctgggccagccggcagaacaagcccagcagcgtcatccagcccaagaggaggaagagcagcaagagcagcggcaaggctgtgttccgggacaccctgtctgagagcaccctgtccatgtggggcgcctacagcgtgctggccatggcccccaccatgatccctgagcccacccacctgcacgccgacagccgggactgccccacagagaactacaacaagatcatctttgccaggaagcccatgatgaggatgctgcccaccgtgcgctactag

SEQ ID NO: 37406 - DNA, 459 bp, Artificial Sequence
  Description of Artificial Sequence: Synthetic coding sequence
atggatgcccggaggatgaagaaggaggagggcctgacagagaacacaggcctgcccaggaagctgctggagaagcatgacccctggccagcctacgtgacctacaccagccagacagtgaagaggctcatcgagaagagcaagacccgggagctggagtgcatgagggccctggaggagcggccctgggccagccggcagaacaagcccagcagcgtcatccagcccaagaggaggaagagcagcaagagcagcggcaaggctgtgttccgggacaccctgtctgagagcaccctgtccatgtggggcgcctacagcgtgctggccatggcccccaccatgatccctgagcccacccacctgcatgctgacagccgggactgccccacagagaactacaacaagatcatctttgccaggaagcccatgatgaggatgctgcccaccgtgcgctactag

SEQ ID NO: 37407 - DNA, 75 bp, Artificial Sequence
  Description of Artificial Sequence: Synthetic coding sequence
atggatgcccggaggatgaagaaggaggagggcctgacagagaacacaggcctgcccaggaagctgctggagtag

SEQ ID NO: 37408 - DNA, 627 bp, Artificial Sequence
  Description of Artificial Sequence: Synthetic coding sequence
atgcagaggcctgagtggccccggccccaccctggagagggcgctgctgctgctggccggggccctgcccccccagcccgggccggggagcccagcggcctgcggctgcaggagcccagcctgtacaccatcaaggctgtgttcatcctggacaatgatggaagaaggctgctggccaagtactatgatgacaccttccccagcatgaaggagcagatggtgtttgagaagaatgtgttcaacaagaccagcaggacagagagcgagatcgccttctttggaggcatgaccatcgtgtacaagaacagcattgacctcttcctgtatgtggtgggcagcagctatgaaaatgagctgatgctgatgtctgtgctgacctgcctgtttgagagcctgaaccacatgctgaggaagaatgtggagaagcgctggctgctggagaacatggatggagccttcctggtgctggatgaaattgtggatggaggagtcatcctggagagtgacccccagcaggtgatccagaaggtgaacttccgggcagatgatggcggcctgacagagcagagcgtggcccaggtgctgcagagcgccaaggagcagatcaagtggagcctgctgaagtag

SEQ ID NO: 37409 - DNA, 3702 bp, Artificial Sequence
  Description of Artificial Sequence: Synthetic coding sequence
atgccacccagctggagccccctgatgtgtggccgggctgctgaggccgccgccagcagcaggaccccaggccgggagatgggccaggccgtgacccggcggctgggcgctggggcccgggccgccccccggcgggccatggatggccgcaccccccggccccaggatgccccagcccggcgggagattgctggctcctggaggaagcccaaggccaaggcccccctgcccccagctgagaccaagtacacagatgtgagcagcgctgctgacagcgtggagagcacagccttcatcatggagcagaaggagaacatgattgacaaggatgtggagctgtctgtggtgctgcccggggacatcatcaagagcaccaccgtgcacggcagcaagcccatgatggacctgctgatcttcctgtgtgcccagtaccacctgaaccccagcagctacaccatcgacctgctgtctgctgagcagaaccacatcaagttcaagcccaacacccccatcggcatgctggaggtggagaaggtgatcctgaagcccaagatgctggacaagaagaagcccacccccatcatccctgagaagacagtgcgggtggtgatcaacttcaagaagacccagaagaccatcgtgcgggtgagcccccacgccagcctgcaggagctggcccccatcatctgcagcaaatgtgaatttgaccccctgcacaccctgctgctgaaggactaccagagccaggagcccctggacctgaccaagagcctgaatgacctgggcctgcgggagctgtatgccatggatgtgaacagagccacctctgtgaccgtcttcagcaagagcagcctgcaggagagctgccagatcagccagaacctggacatcatgaaggagaaggagaacaagggcttcttctccttcttccagaggagcaagaagaagagggaccagacagccagcgccccagccacccccctggtgaacaagcaccggcccaccttcaccaggagcaacaccatcagcaagccctacatcagcaacaccctgcccagtgatgcccccaagaagagaagagcccccctgccccccatgcctgccagccagagcgtgccccaggacctggcccacatccaggagaggcctgccagctgcatcgtgaagtccatgtctgtggatgaaacagacaagagcccctgtgaggccggccgggtgcgggccggcagcctgcagctgagctccatgtctgctggcaacagcagcctgcggaggaccaagaggaaggcccccagcccccccagcaagatccccccccaccagagtgatgagaacagccgggtgacagccctgcagcctgtggatggagtgcccccagattctgccagcgaggccaacagccctgaggagctgagcagccctgagaccttccaccctggcctgagcagccaggagcagtgcacagcccccaagctgatggaggagacctctgtgtttgagtgccccggcaccccagaggccgccatcaccagcctgaccagcggcatcagcagtgactacagcctggaggagattgatgagaaggaggagctgtctgaggtgcccaaggtggaggccgagaacatcagccccaagagccaggacatcccctttgtgtccacagacatcatcaacaccctgaagaatgaccctgacagcgccctgggcaatggcagcggggagttcagccagaacagcatggaggagaagcaggagaccaagagcacagatggccaggagccccacagcgtggtgtatgacaccagcaatggcaagaaggtggtggacagcatccggaacctgaagagcctgggccccaaccaggagaatgtggtgcagaatgagatcatcgtgtacccagagaacacagaggacaacatgaagaatggagtgaagaagacagagatcaacgtggagggcgtggccaagaacaacaacatcgacatggaggtggagcggcccagcaacagcgaggcccatgaaacagacacagccatctcctacaaggagaaccacctggccgccagctctgtgcctgaccagaagctgaaccagcccagcgctgagaagaccaaggatgctgccatccagaccacccccagctgcaacagctttgatggcaagcaccaggaccacaacctgagtgacagcaaggtggaggagtgtgtgcagaccagcaacaacaacatcagcacccagcacagctgcctgagcagccaggacagcgtgaacaccagccgggagttccgcagccagggcaccctcatcatccacagcgaggaccccctgactgtgaaggaccccatctgtgcccatggaaatgatgacctgctgccccctgtggacagaattgacaagaacagcacagccagctacctgaagaactaccccctgtaccggcaggactacaaccccaagcccaagcccagcaatgagatcacccgggagtacatccccaagattggcatgaccacctacaagatcgtgccccccaagagcctggagatcagcaaggactggcagagcgagaccatcgagtacaaggatgaccaggacatgcacgccctgggcaagaagcacacccatgaaaatgtgaaggagacagccatccagacagaggacagcgccatcagcgagagccctgaggagcccctgcccaacctgaagcccaagcccaacctgaggacagagcaccaggtgcccagctctgtgagcagcccagatgatgccatggtgagccccctgaagccagcccccaagatgacccgggacaccggcacagccccctttgcccccaacctggaggagatcaacaacatcctggagagcaagttcaagagccgggccagcaatgcccaggccaagcccagcagcttcttcctgcagatgcagaagagggtgtctggccactacgtgaccagcgctgctgccaagtctgtgcatgctgcccccaacccagcccccaaggagctgaccaacaaggaggccgagcgggacatgctgcccagccctgagcagaccctgagccccctgagcaagatgccccacagcgtgccccagcccctggtggagaagacagatgatgatgtgattggccaggccccagctgaggccagccccccacccatcgcccccaagcctgtgaccatcccagccagccaggtgtccacccagaacctgaagaccctgaagacctttggagccccccggccctacagcagcagcggccccagcccctttgccctggccgtggtgaagaggagccagagcttcagcaaggagaggacagagagccccagcgccagcgccctggtgcagcccccagccaacacagaggagggcaagacccacagcgtgaacaagtttgtggacatcccccagctgggcgtgtctgacaaggagaacaacagcgcccacaatgagcagaacagccagatccccacccccacagatggccccagcttcaccgtgatgaggcagagcagcctgaccttccagagcagtgaccctgagcagatgaggcagagcctgctgacagccatccgcagcggggaggccgccgccaagctgaagagggtgaccatccccagcaacaccatctctgtgaatggccgcagccggctgagccacagcatgagcccagatgcccaggacggccactag

SEQ ID NO: 37410 - DNA, 3501 bp, Artificial Sequence
  Description of Artificial Sequence: Synthetic coding sequence
atggatggccgcaccccccggccccaggatgccccagcccggaggaagcccaaggccaaggcccccctgcccccagctgagaccaagtacacagatgtgtcctctgctgctgacagcgtggagagcacagccttcatcatggagcagaaggagaacatgattgacaaggatgtggagctgtctgtggtgctgcccggggacatcatcaagagcaccaccgtgcacggcagcaagcccatgatggacctgctgatcttcctgtgtgcccagtaccacctgaaccccagcagctacaccatcgacctgctgtctgctgagcagaaccacatcaagttcaagcccaacacccccatcggcatgctggaggtggagaaggtgatcctgaagcccaagatgctggacaagaagaagcccacccccatcatccctgagaagacagtgcgggtggtgatcaacttcaagaagacccagaagaccatcgtgcgggtgagcccccacgccagcctgcaggagctggcccccatcatctgcagcaaatgtgaatttgaccccctgcacaccctgctgctgaaggactaccagagccaggagcccctggacctgaccaagagcctgaatgacctgggcctgcgggagctgtatgccatggatgtgaaccgggagagctgccagatcagccagaacctggacatcatgaaggagaaggagaacaagggcttcttctccttcttccagaggagcaagaagaagagggaccagacagccagcgccccagccacccccctggtgaacaagcaccggcccaccttcaccaggagcaacaccatcagcaagccctacatcagcaacaccctgcccagtgatgcccccaagaagagaagagcccccctgccccccatgcctgccagccagagcgtgccccaggacctggcccacatccaggagaggcctgccagctgcatcgtgaagtccatgtctgtggatgaaacagacaagagcccctgtgaggccggccgggtgcgggccggcagcctgcagctgagctccatgtctgctggcaacagcagcctgcggaggaccaagaggaaggcccccagcccccccagcaagatccccccccaccagagtgatgagaacagccgggtgacagccctgcagcctgtggatggagtgcccccagattctgccagcgaggccaacagccctgaggagctgagcagccctgagaccttccaccctggcctgagcagccaggagcagtgcacagcccccaagctgatggaggagacctctgtgtttgagtgccccggcaccccagaggccgccatcaccagcctgaccagcggcatcagcagtgactacagcctggaggagattgatgagaaggaggagctgtctgaggtgcccaaggtggaggccgagaacatcagccccaagagccaggacatcccctttgtgtccacagacatcatcaacaccctgaagaatgaccctgacagcgccctgggcaatggcagcggggagttcagccagaacagcatggaggagaagcaggagaccaagagcacagatggccaggagccccacagcgtggtgtatgacaccagcaatggcaagaaggtggtggacagcatccggaacctgaagagcctgggccccaaccaggagaatgtgcagaatgagatcatcgtgtacccagaaaatacagaggacaacatgaagaatggagtgaagaagacagagatcaacgtggagggcgtggccaagaacaacaacatcgacatggaggtggagcggcccagcaacagcgaggcccacgagacagacacagccatctcctacaaggagaaccacctggccgccagctctgtgcctgaccagaagctgaaccagcccagcgctgagaagaccaaggatgctgccatccagaccacccccagctgcaacagctttgatggcaagcaccaggaccacaacctgagtgacagcaaggtggaggagtgtgtgcagaccagcaacaacaacatcagcacccagcacagctgcctgagcagccaggacagcgtgaacaccagccgggagttccgcagccagggcaccctcatcatccacagcgaggaccccctgactgtgaaggaccccatctgtgcccacggcaatgatgacctgctgccccctgtggacagaattgacaagaacagcacagccagctacctgaagaactaccccctgtaccggcaggactacaaccccaagcccaagcccagcaatgagatcacccgggagtacatccccaagattggcatgaccacctacaagatcgtgccccccaagagcctggagatcagcaaggactggcagagcgagaccatcgagtacaaggatgaccaggacatgcacgccctgggcaagaagcacacccatgaaaatgtgaaggagacagccatccagacagaagattctgccatcagcgagagccctgaggagcccctgcccaacctgaagcccaagcccaacctgaggacagagcaccaggtgcccagctctgtgagcagcccagatgatgccatggtgagccccctgaagccagcccccaagatgacccgggacacaggaacagccccctttgcccccaacctggaggagatcaacaacatcctggagagcaagttcaagagccgggccagcaatgcccaggccaagcccagcagcttcttcctgcagatgcagaagagggtgtctggccactacgtgaccagcgctgctgccaagtctgtgcacgccgcccccaacccagcccccaaggagctgaccaacaaggaggccgagcgggacatgctgcccagccctgagcagaccctgagccccctgagcaagatgccccacagcgtgccccagcccctggtggagaagacagatgatgatgtgattggccaggccccagctgaggccagccccccacccatcgcccccaagcctgtgaccatcccagccagccaggtgtccacccagaacctgaagaccctgaagaccttcggggccccccggccctacagcagcagcggccccagcccctttgccctggccgtggtgaagaggagccagagcttcagcaaggagaggacagagagccccagcgccagcgccctggtgcagcccccagccaacacagaggagggcaagacccacagcgtgaacaagtttgtggacatcccccagctgggcgtgtctgacaaggagaacaacagcgcccacaatgagcagaacagccagatccccacccccacagatggccccagcttcaccgtgatgaggcagagcagcctgaccttccagagcagtgaccctgagcagatgaggcagagcctgctgacagccatccgctctggagaggccgccgccaagctgaagagggtgaccatccccagcaacaccatctctgtgaatggccgcagccggctgagccacagcatgagcccagatgcccaggacggccactag

SEQ ID NO: 37411 - DNA, 3387 bp, Artificial Sequence
  Description of Artificial Sequence: Synthetic coding sequence
atggatggccgcaccccccggccccaggatgccccagcccggaggaagcccaaggccaaggcccccctgcccccagctgagaccaagtacacagatgtgtcctctgctgctgacagcgtggagagcacagccttcatcatggagcagaaggagaacatgattgacaaggatgtggagctgtctgtggtgctgcccggggacatcatcaagagcaccaccgtgcacggcagcaagcccatgatggacctgctgatcttcctgtgtgcccagtaccacctgaaccccagcagctacaccatcgacctgctgtctgctgagcagaaccacatcaagttcaagcccaacacccccatcggcatgctggaggtggagaaggtgatcctgaagcccaagatgctggacaagaagaagcccacccccatcatccctgagaagacagtgcgggtggtgatcaacttcaagaagacccagaagaccatcgtgcgggtgagcccccacgccagcctgcaggagctggcccccatcatctgcagcaaatgtgaatttgaccccctgcacaccctgctgctgaaggactaccagagccaggagcccctggacctgaccaagagcctgaatgacctgggcctgcgggagctgtatgccatggatgtgaaccgggagagctgccagatcagccagaacctggacatcatgaaggagaaggagaacaagggcttcttctccttcttccagaggagcaagaagaagagggaccagacagccagcgccccagccacccccctggtgaacaagcaccggcccaccttcaccaggagcaacaccatcagcaagccctacatcagcaacaccctgcccagtgatgcccccaagaagagaagagcccccctgccccccatgcctgccagccagagcgtgccccaggacctggcccacatccaggagaggcctgccagctgcatcgtgaagtccatgtctgtggatgaaacagacaagagcccctgtgaggccggccgggtgcgggccggcagcctgcagctgagctccatgtctgctggcaacagcagcctgcggaggaccaagaggaaggcccccagcccccccagcaagatccccccccaccagagtgatgagaacagccgggtgacagccctgcagcctgtggatggagtgcccccagattctgccagcgaggccaacagccctgaggagctgagcagccctgctggcatcagcagtgactacagcctggaggagattgatgagaaggaggagctgtctgaggtgcccaaggtggaggccgagaacatcagccccaagagccaggacatcccctttgtgtccacagacatcatcaacaccctgaagaatgaccctgattctgccctgggcaatggaagtggagagttcagccagaacagcatggaggagaagcaggagaccaagagcacagatggccaggagccccacagcgtggtgtatgacaccagcaatggcaagaaggtggtggacagcatccggaacctgaagagcctgggccccaaccaggagaatgtggtgcagaatgagatcatcgtgtacccagaaaatacagaggacaacatgaagaatggagtgaagaagacagagatcaacgtggagggcgtggccaagaacaacaacatcgacatggaggtggagcggcccagcaacagcgaggcccacgagacagacacagccatctcctacaaggagaaccacctggccgccagctctgtgcctgaccagaagctgaaccagcccagcgctgagaagaccaaggatgctgccatccagaccacccccagctgcaacagctttgatggcaagcaccaggaccacaacctgagtgacagcaaggtggaggagtgtgtgcagaccagcaacaacaacatcagcacccagcacagctgcctgagcagccaggacagcgtgaacaccagccgggagttccgcagccagggcaccctcatcatccacagcgaggaccccctgactgtgaaggaccccatctgtgcccacggcaatgatgacctgctgccccctgtggacagaattgacaagaacagcacagccagctacctgaagaactaccccctgtaccggcaggactacaaccccaagcccaagcccagcaatgagatcacccgggagtacatccccaagattggcatgaccacctacaagatcgtgccccccaagagcctggagatcagcaaggactggcagagcgagaccatcgagtacaaggatgaccaggacatgcacgccctgggcaagaagcacacccatgaaaatgtgaaggagacagccatccagacagaagattctgccatcagcgagagccctgaggagcccctgcccaacctgaagcccaagcccaacctgaggacagagcaccaggtgcccagctctgtgagcagcccagatgatgccatggtgagccccctgaagccagcccccaagatgacccgggacacaggaacagccccctttgcccccaacctggaggagatcaacaacatcctggagagcaagttcaagagccgggccagcaatgcccaggccaagcccagcagcttcttcctgcagatgcagaagagggtgtctggccactacgtgaccagcgctgctgccaagtctgtgcacgccgcccccaacccagcccccaaggagctgaccaacaaggaggccgagcgggacatgctgcccagccctgagcagaccctgagccccctgagcaagatgccccacagcgtgccccagcccctggtggagaagacagatgatgatgtgattggccaggccccagctgaggccagccccccacccatcgcccccaagcctgtgaccatcccagccagccaggtgtccacccagaacctgaagaccctgaagaccttcggggccccccggccctacagcagcagcggccccagcccctttgccctggccgtggtgaagaggagccagagcttcagcaaggagaggacagagagccccagcgccagcgccctggtgcagcccccagccaacacagaggagggcaagacccacagcgtgaacaagtttgtggacatcccccagctgggcgtgtctgacaaggagaacaacagcgcccacaatgagcagaacagccagatccccacccccacagatggccccagcttcaccgtgatgaggcagagcagcctgaccttccagagcagtgaccctgagcagatgaggcagagcctgctgacagccatccgctctggagaggccgccgccaagctgaagagggtgaccatccccagcaacaccatctctgtgaatggccgcagccggctgagccacagcatgagcccagatgcccaggacggccactag

SEQ ID NO: 37412 - DNA, 3615 bp, Artificial Sequence
  Description of Artificial Sequence: Synthetic coding sequence
atgtgtggccgggctgctgaggccgccgccagcagcaggaccccaggccgggagatgggccaggccgtgacccggcggctgggcgctggggcccgggccgccccccggcgggccatggatggccgcaccccccggccccaggatgccccagcccggaggaagcccaaggccaaggcccccctgcccccagctgagaccaagtacacagatgtgtcctctgctgctgacagcgtggagagcacagccttcatcatggagcagaaggagaacatgattgacaaggatgtggagctgtctgtggtgctgcccggggacatcatcaagagcaccaccgtgcacggcagcaagcccatgatggacctgctgatcttcctgtgtgcccagtaccacctgaaccccagcagctacaccatcgacctgctgtctgctgagcagaaccacatcaagttcaagcccaacacccccatcggcatgctggaggtggagaaggtgatcctgaagcccaagatgctggacaagaagaagcccacccccatcatccctgagaagacagtgcgggtggtgatcaacttcaagaagacccagaagaccatcgtgcgggtgagcccccacgccagcctgcaggagctggcccccatcatctgcagcaaatgtgaatttgaccccctgcacaccctgctgctgaaggactaccagagccaggagcccctggacctgaccaagagcctgaatgacctgggcctgcgggagctgtatgccatggatgtgaaccgggagagctgccagatcagccagaacctggacatcatgaaggagaaggagaacaagggcttcttctccttcttccagaggagcaagaagaagagggaccagacagccagcgccccagccacccccctggtgaacaagcaccggcccaccttcaccaggagcaacaccatcagcaagccctacatcagcaacaccctgcccagtgatgcccccaagaagagaagagcccccctgccccccatgcctgccagccagagcgtgccccaggacctggcccacatccaggagaggcctgccagctgcatcgtgaagtccatgtctgtggatgaaacagacaagagcccctgtgaggccggccgggtgcgggccggcagcctgcagctgagctccatgtctgctggcaacagcagcctgcggaggaccaagaggaaggcccccagcccccccagcaagatccccccccaccagagtgatgagaacagccgggtgacagccctgcagcctgtggatggagtgcccccagattctgccagcgaggccaacagccctgaggagctgagcagccctgagaccttccaccctggcctgagcagccaggagcagtgcacagcccccaagctgatggaggagacctctgtgtttgagtgccccggcaccccagaggccgccatcaccagcctgaccagcggcatcagcagtgactacagcctggaggagattgatgagaaggaggagctgtctgaggtgcccaaggtggaggccgagaacatcagccccaagagccaggacatcccctttgtgtccacagacatcatcaacaccctgaagaatgaccctgacagcgccctgggcaatggcagcggggagttcagccagaacagcatggaggagaagcaggagaccaagagcacagatggccaggagccccacagcgtggtgtatgacaccagcaatggcaagaaggtggtggacagcatccggaacctgaagagcctgggccccaaccaggagaatgtgcagaatgagatcatcgtgtacccagaaaatacagaggacaacatgaagaatggagtgaagaagacagagatcaacgtggagggcgtggccaagaacaacaacatcgacatggaggtggagcggcccagcaacagcgaggcccacgagacagacacagccatctcctacaaggagaaccacctggccgccagctctgtgcctgaccagaagctgaaccagcccagcgctgagaagaccaaggatgctgccatccagaccacccccagctgcaacagctttgatggcaagcaccaggaccacaacctgagtgacagcaaggtggaggagtgtgtgcagaccagcaacaacaacatcagcacccagcacagctgcctgagcagccaggacagcgtgaacaccagccgggagttccgcagccagggcaccctcatcatccacagcgaggaccccctgactgtgaaggaccccatctgtgcccacggcaatgatgacctgctgccccctgtggacagaattgacaagaacagcacagccagctacctgaagaactaccccctgtaccggcaggactacaaccccaagcccaagcccagcaatgagatcacccgggagtacatccccaagattggcatgaccacctacaagatcgtgccccccaagagcctggagatcagcaaggactggcagagcgagaccatcgagtacaaggatgaccaggacatgcacgccctgggcaagaagcacacccatgaaaatgtgaaggagacagccatccagacagaagattctgccatcagcgagagccctgaggagcccctgcccaacctgaagcccaagcccaacctgaggacagagcaccaggtgcccagctctgtgagcagcccagatgatgccatggtgagccccctgaagccagcccccaagatgacccgggacacaggaacagccccctttgcccccaacctggaggagatcaacaacatcctggagagcaagttcaagagccgggccagcaatgcccaggccaagcccagcagcttcttcctgcagatgcagaagagggtgtctggccactacgtgaccagcgctgctgccaagtctgtgcacgccgcccccaacccagcccccaaggagctgaccaacaaggaggccgagcgggacatgctgcccagccctgagcagaccctgagccccctgagcaagatgccccacagcgtgccccagcccctggtggagaagacagatgatgatgtgattggccaggccccagctgaggccagccccccacccatcgcccccaagcctgtgaccatcccagccagccaggtgtccacccagaacctgaagaccctgaagaccttcggggccccccggccctacagcagcagcggccccagcccctttgccctggccgtggtgaagaggagccagagcttcagcaaggagaggacagagagccccagcgccagcgccctggtgcagcccccagccaacacagaggagggcaagacccacagcgtgaacaagtttgtggacatcccccagctgggcgtgtctgacaaggagaacaacagcgcccacaatgagcagaacagccagatccccacccccacagatggccccagcttcaccgtgatgaggcagagcagcctgaccttccagagcagtgaccctgagcagatgaggcagagcctgctgacagccatccgctctggagaggccgccgccaagctgaagagggtgaccatccccagcaacaccatctctgtgaatggccgcagccggctgagccacagcatgagcccagatgcccaggacggccactag

SEQ ID NO: 37413 - DNA, 3501 bp, Artificial Sequence
  Description of Artificial Sequence: Synthetic coding sequence
atgtgtggccgggctgctgaggccgccgccagcagcaggaccccaggccgggagatgggccaggccgtgacccggcggctgggcgctggggcccgggccgccccccggcgggccatggatggccgcaccccccggccccaggatgccccagcccggaggaagcccaaggccaaggcccccctgcccccagctgagaccaagtacacagatgtgtcctctgctgctgacagcgtggagagcacagccttcatcatggagcagaaggagaacatgattgacaaggatgtggagctgtctgtggtgctgcccggggacatcatcaagagcaccaccgtgcacggcagcaagcccatgatggacctgctgatcttcctgtgtgcccagtaccacctgaaccccagcagctacaccatcgacctgctgtctgctgagcagaaccacatcaagttcaagcccaacacccccatcggcatgctggaggtggagaaggtgatcctgaagcccaagatgctggacaagaagaagcccacccccatcatccctgagaagacagtgcgggtggtgatcaacttcaagaagacccagaagaccatcgtgcgggtgagcccccacgccagcctgcaggagctggcccccatcatctgcagcaaatgtgaatttgaccccctgcacaccctgctgctgaaggactaccagagccaggagcccctggacctgaccaagagcctgaatgacctgggcctgcgggagctgtatgccatggatgtgaaccgggagagctgccagatcagccagaacctggacatcatgaaggagaaggagaacaagggcttcttctccttcttccagaggagcaagaagaagagggaccagacagccagcgccccagccacccccctggtgaacaagcaccggcccaccttcaccaggagcaacaccatcagcaagccctacatcagcaacaccctgcccagtgatgcccccaagaagagaagagcccccctgccccccatgcctgccagccagagcgtgccccaggacctggcccacatccaggagaggcctgccagctgcatcgtgaagtccatgtctgtggatgaaacagacaagagcccctgtgaggccggccgggtgcgggccggcagcctgcagctgagctccatgtctgctggcaacagcagcctgcggaggaccaagaggaaggcccccagcccccccagcaagatccccccccaccagagtgatgagaacagccgggtgacagccctgcagcctgtggatggagtgcccccagattctgccagcgaggccaacagccctgaggagctgagcagccctgctggcatcagcagtgactacagcctggaggagattgatgagaaggaggagctgtctgaggtgcccaaggtggaggccgagaacatcagccccaagagccaggacatcccctttgtgtccacagacatcatcaacaccctgaagaatgaccctgattctgccctgggcaatggaagtggagagttcagccagaacagcatggaggagaagcaggagaccaagagcacagatggccaggagccccacagcgtggtgtatgacaccagcaatggcaagaaggtggtggacagcatccggaacctgaagagcctgggccccaaccaggagaatgtggtgcagaatgagatcatcgtgtacccagaaaatacagaggacaacatgaagaatggagtgaagaagacagagatcaacgtggagggcgtggccaagaacaacaacatcgacatggaggtggagcggcccagcaacagcgaggcccacgagacagacacagccatctcctacaaggagaaccacctggccgccagctctgtgcctgaccagaagctgaaccagcccagcgctgagaagaccaaggatgctgccatccagaccacccccagctgcaacagctttgatggcaagcaccaggaccacaacctgagtgacagcaaggtggaggagtgtgtgcagaccagcaacaacaacatcagcacccagcacagctgcctgagcagccaggacagcgtgaacaccagccgggagttccgcagccagggcaccctcatcatccacagcgaggaccccctgactgtgaaggaccccatctgtgcccacggcaatgatgacctgctgccccctgtggacagaattgacaagaacagcacagccagctacctgaagaactaccccctgtaccggcaggactacaaccccaagcccaagcccagcaatgagatcacccgggagtacatccccaagattggcatgaccacctacaagatcgtgccccccaagagcctggagatcagcaaggactggcagagcgagaccatcgagtacaaggatgaccaggacatgcacgccctgggcaagaagcacacccatgaaaatgtgaaggagacagccatccagacagaagattctgccatcagcgagagccctgaggagcccctgcccaacctgaagcccaagcccaacctgaggacagagcaccaggtgcccagctctgtgagcagcccagatgatgccatggtgagccccctgaagccagcccccaagatgacccgggacacaggaacagccccctttgcccccaacctggaggagatcaacaacatcctggagagcaagttcaagagccgggccagcaatgcccaggccaagcccagcagcttcttcctgcagatgcagaagagggtgtctggccactacgtgaccagcgctgctgccaagtctgtgcacgccgcccccaacccagcccccaaggagctgaccaacaaggaggccgagcgggacatgctgcccagccctgagcagaccctgagccccctgagcaagatgccccacagcgtgccccagcccctggtggagaagacagatgatgatgtgattggccaggccccagctgaggccagccccccacccatcgcccccaagcctgtgaccatcccagccagccaggtgtccacccagaacctgaagaccctgaagaccttcggggccccccggccctacagcagcagcggccccagcccctttgccctggccgtggtgaagaggagccagagcttcagcaaggagaggacagagagccccagcgccagcgccctggtgcagcccccagccaacacagaggagggcaagacccacagcgtgaacaagtttgtggacatcccccagctgggcgtgtctgacaaggagaacaacagcgcccacaatgagcagaacagccagatccccacccccacagatggccccagcttcaccgtgatgaggcagagcagcctgaccttccagagcagtgaccctgagcagatgaggcagagcctgctgacagccatccgctctggagaggccgccgccaagctgaagagggtgaccatccccagcaacaccatctctgtgaatggccgcagccggctgagccacagcatgagcccagatgcccaggacggccactag

SEQ ID NO: 37414 - DNA, 420 bp, Artificial Sequence
  Description of Artificial Sequence: Synthetic coding sequence
atggatggccgcaccccccggccccaggatgccccagcccggaggaagcccaaggccaaggcccccctgcccccagctgagaccaagtacacagatgtgtcctctgctgctgacagcgtggagagcacagccttcatcatggagcagaaggagaacatgattgacaaggatgtggagctgtctgtggtgctgcccggggacatcatcaagagcaccaccgtgcacggcagcaagcccatgatggacctgctgatcttcctgtgtgcccagtaccacctgaaccccagcagctacaccatcgacctgctgtctgctgagcagaaccacatcaagttcaagcccaacacccccatcggcatgctggaggtggagaaggtgatcctgaagcccaagatgctggacaagaagaagcccacctag

SEQ ID NO: 37415 - DNA, 474 bp, Artificial Sequence
  Description of Artificial Sequence: Synthetic coding sequence
atggatggccgcaccccccggccccaggatgccccagcccggaggaagcccaaggccaaggcccccctgcccccagctgagaccaagtacacagatgtgtcctctgctgctgacagcgtggagagcacagccttcatcatggagcagaaggagaacatgattgacaaggatgtggagctgtctgtggtgctgcccggggacatcatcaagagcaccaccgtgcacggcagcaagcccatgatggacctgctgatcttcctgtgtgcccagtaccacctgaaccccagcagctacaccatcgacctgctgtctgctgagcagaaccacatcaagttcaagcccaacacccccatcggcatgctggaggtggagaaggtgatcctgaagcccaagatgctggacaagaagaagcccacccccatcatccctgagaagacagtgcgggtggtgatcaacttcaagaagacccagtag

SEQ ID NO: 37416 - DNA, 1080 bp, Artificial Sequence
  Description of Artificial Sequence: Synthetic coding sequence
atgtacttcaagagggccccccgggccttccctgtgctgctgactggagctgggaagaccaccctgctgaactacatcctgacagagcagcacagcaagagggtggccgtcatcctgaatgaaagtggagagggcagcgccctggagaagagcctggccgtgtcccagggcggggagctgtatgaggagtggctggagctgagaaatggctgcctgtgctgcagcgtgaaggacaatggcctgcgggccatcgagaacctgatgcagaagaagggcaagtttgatgacatcctgctggagaccaccggcctggccgaccctggagctgtgacctccatgttctgggtggatgctgagctgggcagtgacatctacctggatggcatcatcaccatcgtggacagcaaatatggcctgaagcacctgacagaggagaagccagatggcctcatcaatgaggccacccggcaggtggccctggccgacatcatcctgatcaacaagacagacctggtgcctgaagaagatgtgaagaagctgcggaccaccatccgcagcatcaatggcctgggccagatcctggagacccagaggagccgggtggacctgagcaatgtgctggacctgcacgcctttgacagcctgagcggcatcagcctgcagaagaagctgcagcacgtgcccggcacccagccccacctggaccagagcatcgtgaccatcacctttgaggtgcctggaaatgccaaggaggagcacctgaacatgttcatccagaacctgctgtgggagaagaatgtgaggaacaaggacaaccactgcatggaggtgatccggctgaagggcctggtgtccatcaaggacaagagccagcaggtgattgtgcagggcgtgcatgagctgtatgacctggaggagacccctgtgtcctggaaggatgacacagagaggaccaaccggctggtgctgattggaagaaacctggacaaggacatcctgaagcagctgttcatcgccaccgtgacagaaacagagaagcagtggaccacccacttcaaggaggaccaggtgtgcacctag

SEQ ID NO: 37417 - DNA, 1188 bp, Artificial Sequence
  Description of Artificial Sequence: Synthetic coding sequence
atgctgcctgctgtgggctctgtggatgaggaggaggaccctgctgaggaggactgcccagagctggtgcccatcgagaccacccagagcgaggaggaggagaagagcggcctgggcgccaagatccctgtgaccatcatcaccggctacctgggcgccggcaagaccaccctgctgaactacatcctgacagagcagcacagcaagagggtggccgtcatcctgaatgaaagtggagagggcagcgccctggagaagagcctggccgtgtcccagggcggggagctgtatgaggagtggctggagctgagaaatggctgcctgtgctgcagcgtgaaggacaatggcctgcgggccatcgagaacctgatgcagaagaagggcaagtttgatgacatcctgctggagaccaccggcctggccgaccctggagctgtgacctccatgttctgggtggatgctgagctgggcagtgacatctacctggatggcatcatcaccatcgtggacagcaaatatggcctgaagcacctgacagaggagaagccagatggcctcatcaatgaggccacccggcaggtggccctggccgacatcatcctgatcaacaagacagacctggtgcctgaagaagatgtgaagaagctgcggaccaccatccgcagcatcaatggcctgggccagatcctggagacccagaggagccgggtggacctgagcaatgtgctggacctgcacgcctttgacagcctgagcggcatcagcctgcagaagaagctgcagcacgtgcccggcacccagccccacctggaccagagcatcgtgaccatcacctttgaggtgcctggaaatgccaaggaggagcacctgaacatgttcatccagaacctgctgtgggagaagaatgtgaggaacaaggacaaccactgcatggaggtgatccggctgaagggcctggtgtccatcaaggacaagagccagcaggtgattgtgcagggcgtgcatgagctgtatgacctggaggagacccctgtgtcctggaaggatgacacagagaggaccaaccggctggtgctgattggaagaaacctggacaaggacatcctgaagcagctgttcatcgccaccgtgacagaaacagagaagcagtggaccacccacttcaaggaggaccaggtgtgcacctag

SEQ ID NO: 37418 - DNA, 1044 bp, Artificial Sequence
  Description of Artificial Sequence: Synthetic coding sequence
atgctgcctgctgtgggctctgtggatgaggaggaggaccctgctgaggaggactgcccagagctggtgcccatcgagaccacccagagcgaggaggaggagaagagcggcctgggcgccaagatccctgtgaccatcatcaccggctacctgggcgccggcaagaccaccctgctgaactacatcctgacagagcagcacagcaagagggtggccgtcatcctgaatgaaagtggagagggcagcgccctggagaagagcctggccgtgtcccagggcggggagctgtatgaggagtggctggagctgagaaatggctgcctgtgctgcagcgtgaaggacaatggcctgcgggccatcgagaacctgatgcagaagaagggcaagtttgatgacatcctgctggagaccaccggcctggccgaccctggagctgtgacctccatgttctgggtggatgctgagctgggcagtgacatctacctggatggcatcatcaccatcgtggacagcaaatatggcctgaagcacctgacagaggagaagccagatggcctcatcaatgaggccaccaggagcatcaatggcctgggccagatcctggagacccagaggagcagcctgcagaagaagctgcagcacgtgcccggcacccagccccacctggaccagagcatcgtgaccatcacctttgaggtgcctggaaatgccaaggaggagcacctgaacatgttcatccagaacctgctgtgggagaagaatgtgaggaacaaggacaaccactgcatggaggtgatccggctgaagggcctggtgtccatcaaggacaagagccagcaggtgattgtgcagggcgtgcatgagctgtatgacctggaggagacccctgtgtcctggaaggatgacacagagaggaccaaccggctggtgctgattggaagaaacctggacaaggacatcctgaagcagctgttcatcgccaccgtgacagaaacagagaagcagtggaccacccacttcaaggaggaccaggtgtgcacctag

SEQ ID NO: 37419 - DNA, 249 bp, Artificial Sequence
  Description of Artificial Sequence: Synthetic coding sequence
atgctgcctgctgtgggctctgtggatgaggaggaggaccctgctgaggaggactgcccagagctggtgcccatcgagaccacccagagcgaggaggaggagaagagcggcctgggcgccaagatccctgtgaccatcatcaccggctacctgggcgccggcaagaccaccctgctgaactacatcctgacagagcagcacagcaagagggtggccgtcatcctgaatgaaagtggagagggcaagtag

SEQ ID NO: 37420 - DNA, 342 bp, Artificial Sequence
  Description of Artificial Sequence: Synthetic coding sequence
atgctgcctgctgtgggctctgtggatgaggaggaggaccctgctgaggaggactgcccagagctggtgcccatcgagaccacccagagcgaggaggaggagaagagcggcctgggcgccaagatccctgtgaccatcatcaccggctacctgggcgccggcaagaccaccctgctgaactacatcctgacagagcagcacagcaagagggtggccgtcatcctgaatgaaagtggagagggcagcgccctggagaagagcctggccgtgtcccagggcggggagctgtatgaggagtggctggagctgagaaatggctgcctgtgctgcagcgtgaagtag

SEQ ID NO: 37421 - DNA, 729 bp, Artificial Sequence
  Description of Artificial Sequence: Synthetic coding sequence
atgctgcctgctgtgggctctgtggatgaggaggaggaccctgctgaggaggactgcccagagctggtgcccatcgagaccacccagagcgaggaggaggagaagagcggcctgggcgccaagatccctgtgaccatcatcaccggctacctgggcgccggcaagaccaccctgctgaactacatcctgacagagcagcacagcaagagggtggccgtcatcctgaatgaaagtggagagggcagcgccctggagaagagcctggccgtgtcccagggcggggagctgtatgaggagtggctggagctgagaaatggctgcctgtgctgcagcgtgaaggacaatggcctgcgggccatcgagaacctgatgcagaagaagggcaagtttgatgacatcctgctggagaccaccggcctggccgaccctggagctgtggcctccatgttctgggtggatgctgagctgggcagtgacatctacctggatggcatcatcaccatcgtggacagcaaatatggcctgaagcacctgacagaggagaagccagatggcctcatcaatgaggccacccggcaggtggccctggccgacatcatcctgatcaacaagacagacctggtgcctgaagaagatgtgaagaagctgcggaccaccctgcgctacaagatgatgtgtgtgaagtgcctgcagatccacatcgtgtacacagagtgcttcctgctgtag

SEQ ID NO: 37422 - DNA, 1080 bp, Artificial Sequence
  Description of Artificial Sequence: Synthetic coding sequence
atgtacttcaagagggccccccgggccttccctgtgctgctgactggagctgggaagaccaccctgctgaactacatcctgacagagcagcacagcaagagggtggccgtcatcctgaatgaaagtggagagggcagcgccctggagaagagcctggccgtgtcccagggcggggagctgtatgaggagtggctggagctgagaaatggctgcctgtgctgcagcgtgaaggacaatggcctgcgggccatcgagaacctgatgcagaagaagggcaagtttgatgacatcctgctggagaccaccggcctggccgaccctggagctgtggcctccatgttctgggtggatgctgagctgggcagtgacatctacctggatggcatcatcaccatcgtggacagcaaatatggcctgaagcacctgacagaggagaagccagatggcctcatcaatgaggccacccggcaggtggccctggccgacatcatcctgatcaacaagacagacctggtgcctgaagaagatgtgaagaagctgcggaccaccctgcggagcatcaatggcctgggccagatcctggagacccagaggagccgggtggacctgagcaatgtgctggacctgcacgcctttgacagcctgagcggcatcagcctgcagaagaagctgcagcacgtgcccggcacccagccccacctggaccagagcatcgtgaccatcacctttgatgtgcctggaaatgccaaggaggagcacctgaacatgttcatccagaacctgctgtgggagaagaatgtgaggaacaaggacaaccactgcatggaggtgatccggctgaagggcctggtgtccatcaaggacaagagccagcaggtgattgtgcagggcgtgcatgagctgtgtgacctggaggagacccctgtgtcctggaaggatgacacagagaggaccaaccggctggtgctgattggaagaaacctggacaaggacatcctgaagcagctgttcatcgccaccgtgacagaaacagagaagcagtggaccacccacttcaaggaggaccaggtgtgcacctag

SEQ ID NO: 37423 - DNA, 1044 bp, Artificial Sequence
  Description of Artificial Sequence: Synthetic coding sequence
atgctgcctgctgtgggctctgtggatgaggaggaggaccctgctgaggaggactgcccagagctggtgcccatcgagaccacccagagcgaggaggaggagaagagcggcctgggcgccaagatccctgtgaccatcatcaccggctacctgggcgccggcaagaccaccctgctgaactacatcctgacagagcagcacagcaagagggtggccgtcatcctgaatgaaagtggagagggcagcgccctggagaagagcctggccgtgtcccagggcggggagctgtatgaggagtggctggagctgagaaatggctgcctgtgctgcagcgtgaaggacaatggcctgcgggccatcgagaacctgatgcagaagaagggcaagtttgatgacatcctgctggagaccaccggcctggccgaccctggagctgtggcctccatgttctgggtggatgctgagctgggcagtgacatctacctggatggcatcatcaccatcgtggacagcaaatatggcctgaagcacctgacagaggagaagccagatggcctcatcaatgaggccaccaggagcatcaatggcctgggccagatcctggagacccagaggagcagcctgcagaagaagctgcagcacgtgcccggcacccagccccacctggaccagagcatcgtgaccatcacctttgatgtgcctggaaatgccaaggaggagcacctgaacatgttcatccagaacctgctgtgggagaagaatgtgaggaacaaggacaaccactgcatggaggtgatccggctgaagggcctggtgtccatcaaggacaagagccagcaggtgattgtgcagggcgtgcatgagctgtgtgacctggaggagacccctgtgtcctggaaggatgacacagagaggaccaaccggctggtgctgattggaagaaacctggacaaggacatcctgaagcagctgttcatcgccaccgtgacagaaacagagaagcagtggaccacccacttcaaggaggaccaggtgtgcacctag

SEQ ID NO: 37424 - DNA, 1188 bp, Artificial Sequence
  Description of Artificial Sequence: Synthetic coding sequence
atgctgcctgctgtgggctctgtggatgaggaggaggaccctgctgaggaggactgcccagagctggtgcccatcgagaccacccagagcgaggaggaggagaagagcggcctgggcgccaagatccctgtgaccatcatcaccggctacctgggcgccggcaagaccaccctgctgaactacatcctgacagagcagcacagcaagagggtggccgtcatcctgaatgaaagtggagagggcagcgccctggagaagagcctggccgtgtcccagggcggggagctgtatgaggagtggctggagctgagaaatggctgcctgtgctgcagcgtgaaggacaatggcctgcgggccatcgagaacctgatgcagaagaagggcaagtttgatgacatcctgctggagaccaccggcctggccgaccctggagctgtggcctccatgttctgggtggatgctgagctgggcagtgacatctacctggatggcatcatcaccatcgtggacagcaaatatggcctgaagcacctgacagaggagaagccagatggcctcatcaatgaggccacccggcaggtggccctggccgacatcatcctgatcaacaagacagacctggtgcctgaagaagatgtgaagaagctgcggaccaccctgcggagcatcaatggcctgggccagatcctggagacccagaggagccgggtggacctgagcaatgtgctggacctgcacgcctttgacagcctgagcggcatcagcctgcagaagaagctgcagcacgtgcccggcacccagccccacctggaccagagcatcgtgaccatcacctttgatgtgcctggaaatgccaaggaggagcacctgaacatgttcatccagaacctgctgtgggagaagaatgtgaggaacaaggacaaccactgcatggaggtgatccggctgaagggcctggtgtccatcaaggacaagagccagcaggtgattgtgcagggcgtgcatgagctgtgtgacctggaggagacccctgtgtcctggaaggatgacacagagaggaccaaccggctggtgctgattggaagaaacctggacaaggacatcctgaagcagctgttcatcgccaccgtgacagaaacagagaagcagtggaccacccacttcaaggaggaccaggtgtgcacctag

SEQ ID NO: 37425 - DNA, 1128 bp, Artificial Sequence
  Description of Artificial Sequence: Synthetic coding sequence
atgctgcctgctgtgggctctgtggatgaggaggaggaccctgctgaggaggactgcccagagctggtgcccatcgagaccacccagagcgaggaggaggagaagagcggcctgggcgccaagatccctgtgaccatcatcaccggctacctgggcgccggcaagaccaccctgctgaactacatcctgacagagcagcacagcaagagggtggccgtcatcctgaatgaaagtggagagggcagcgccctggagaagagcctggccgtgtcccagggcggggagctgtatgaggagtggctggagctgagaaatggctgcctgtgctgcagcgtgaaggacaatggcctgcgggccatcgagaacctgatgcagaagaagggcaagtttgatgacatcctgctggagaccaccggcctggccgaccccggcatcatcaccatcgtggacagcaaatatggcctgaagcacctgacagaggagaagccagatggcctcatcaatgaggccacccggcaggtggccctggccgacatcatcctgatcaacaagacagacctggtgcctgaagaagatgtgaagaagctgcggaccaccctgcggagcatcaatggcctgggccagatcctggagacccagaggagccgggtggacctgagcaatgtgctggacctgcacgcctttgacagcctgagcggcatcagcctgcagaagaagctgcagcacgtgcccggcacccagccccacctggaccagagcatcgtgaccatcacctttgatgtgcctggaaatgccaaggaggagcacctgaacatgttcatccagaacctgctgtgggagaagaatgtgaggaacaaggacaaccactgcatggaggtgatccggctgaagggcctggtgtccatcaaggacaagagccagcaggtgattgtgcagggcgtgcatgagctgtgtgacctggaggagacccctgtgtcctggaaggatgacacagagaggaccaaccggctggtgctgattggaagaaacctggacaaggacatcctgaagcagctgttcatcgccaccgtgacagaaacagagaagcagtggaccacccacttcaaggaggaccaggtgtgcacctag

SEQ ID NO: 37426 - DNA, 282 bp, Artificial Sequence
  Description of Artificial Sequence: Synthetic coding sequence
tgactggacctgcacgcctttgacagcctgagcggcatcagcctgcagaagaagctgcagcacgtgcccggcacccagccccacctggaccagagcatcgtgaccatcacctttgatgtgcctggaaatgccaaggaggagcacctgaacatgttcatccagaacctgctgtgggagaagaatgtgaggaacaaggacaaccactgcatggaggtgatccggctgaaggtgcagttcaccgtggccgacttctggaccaagagcttctcctggctgctgtag

SEQ ID NO: 37427 - DNA, 543 bp, Artificial Sequence
  Description of Artificial Sequence: Synthetic coding sequence
atgctgcctgctgtgggctctgtggatgaggaggaggaccctgctgaggaggactgcccagagctggtgcccatcgagaccacccagagcgaggaggaggagaagagcggcctgggcgccaagatccctgtgaccatcatcaccggctacctgggcgccggcaagaccaccctgctgaactacatcctgacagagcagcacagcaagagggtggccgtcatcctgaatgaaagtggagagggcagcgccctggagaagagcctggccgtgtcccagggcggggagctgtatgaggagtggctggagctgagaaatggctgcctgtgctgcagcgtgaaggacaatggcctgcgggccatcgagaacctgatgcagaagaagggcaagtttgatgacatcctgctggagaccaccggcctggccgaccctggagctgtggcctccatgttctgggtggatgctgagctgggcagtgacatctacctggatggcatcatcaccatcgtggacagcaaatatggcctgaaggtgagccaccactag

SEQ ID NO: 37428 - DNA, 759 bp, Artificial Sequence
  Description of Artificial Sequence: Synthetic coding sequence
tgagctgtgacctccatgttctgggtggatgctgagctgggcagtgacatctacctggatggcatcatcaccatcgtggacagcaaatatggcctgaagcacctgacagaggagaagccagatggcctcatcaatgaggccacccggcaggtggccctggccgacatcatcctgatcaacaagacagacctggtgcctgaggaggatgtgaagaagctgcggaccaccatccgcagcatcaatggcctgggccagatcctggagacccagaggagccgggtggacctgagcaatgtgctggacctgcacgcctttgacagcctgagcggcatcagcctgcagaagaagctgcagcacgtgcccggcacccagccccacctggaccagagcatcgtgaccatcacctttgaggtgcctggaaatgccaaggaggagcacctgaacatgttcatccagaacctgctgtgggagaagaatgtgaggaacaaggacaaccactgcatggaggtgatccggctgaagggcctggtgtccatcaaggacaagagccagcaggtgattgtgcagggcgtgcatgagctgtatgacctggaggagacccctgtgtcctggaaggatgacacagagaggaccaaccggctggtgctgattggaagaaacctggacaaggacatcctgaagcagctgttcatcgccaccgtgacagaaacagagaagcagtggaccacccacttcaaggaggaccaggtgtgcacctag

SEQ ID NO: 37429 - DNA, 702 bp, Artificial Sequence
  Description of Artificial Sequence: Synthetic coding sequence
tgagctgtgacctccatgttctgggtggatgctgagctgggcagtgacatctacctggatggcatcatcaccatcgtggacagcaaatatggcctgaagcacctgacagaggagaagccagatggcctcatcaatgaggccacccggcaggtggccctggccgacatcatcctgatcaacaagacagacctggtgcctgaggaggatgtgaagaagctgcggaccaccatccgcagcatcaatggcctgggccagatcctggagacccagaggagcagcctgcagaagaagctgcagcacgtgcccggcacccagccccacctggaccagagcatcgtgaccatcacctttgaggtgcctggaaatgccaaggaggagcacctgaacatgttcatccagaacctgctgtgggagaagaatgtgaggaacaaggacaaccactgcatggaggtgatccggctgaagggcctggtgtccatcaaggacaagagccagcaggtgattgtgcagggcgtgcatgagctgtatgacctggaggagacccctgtgtcctggaaggatgacacagagaggaccaaccggctggtgctgattggaagaaacctggacaaggacatcctgaagcagctgttcatcgccaccgtgacagaaacagagaagcagtggaccacccacttcaaggaggaccaggtgtgcacctag

SEQ ID NO: 37430 - DNA, 420 bp, Artificial Sequence
  Description of Artificial Sequence: Synthetic coding sequence
tgagaagaggtgaggaagagggccatccgcatgttcaagaatgagaagagcatcgtgaccatcacctttgaggtgcctggaaatgccaaggaggagcacctgaacatgttcatccagaacctgctgtgggagaagaatgtgaggaacaaggacaaccactgcatggaggtgatccggctgaagggcctggtgtccatcaaggacaagagccagcaggtgattgtgcagggcgtgcatgagctgtatgacctggaggagacccctgtgtcctggaaggatgacacagagaggaccaaccggctggtgctgattggaagaaacctggacaaggacatcctgaagcagctgttcatcgccaccgtgacagaaacagagaagcagtggaccacccacttcaaggaggaccaggtgtgcacctag

SEQ ID NO: 37431 - DNA, 531 bp, Artificial Sequence
  Description of Artificial Sequence: Synthetic coding sequence
atgtacttcacagagttccccacagcccacgtgtccttcctgcccttccgggtggacctgagcaatgtgctggacctgcacgcctttgacagcctgagcggcatcagcctgcagaagaagctgcagcacgtgcccggcacccagccccacctggaccagagcatcgtgaccatcacctttgaggtgcctggaaatgccaaggaggagcacctgaacatgttcatccagaacctgctgtgggagaagaatgtgaggaacaaggacaaccactgcatggaggtgatccggctgaagggcctggtgtccatcaaggacaagagccagcaggtgattgtgcagggcgtgcatgagctgtatgacctggaggagacccctgtgtcctggaaggatgacacagagaggaccaaccggctggtgctgattggaagaaacctggacaaggacatcctgaagcagctgttcatcgccaccgtgacagaaacagagaagcagtggaccacccacttcaaggaggaccaggtgtgcacctag

SEQ ID NO: 37432 - DNA, 2559 bp, Artificial Sequence
  Description of Artificial Sequence: Synthetic coding sequence
atgatgcctggcccccggcccaggaagggcccccaggcccggggccagggcgtggccgccgccaagcagatgggcctcttcatggagtttggacctgaggacatgctgctgggcatggatgaagcagaagatgatgaggacctggaggccgagctgctggccctgaccggggaggcccagaccaccgggaagaagccagcccccaagggccaggcccccctgcccatggcccacatcgagaagctggccgctgactgcatgagagatgtggaggaggaggaggaggaggagggcctggaggaggatgctgagctgctgacagagctgcaggaggtgctgggcgtggatgaggagacagagcccctggatggagatgaggtggccgaccccggcggcagcgaggaggagaatggcctggaggacacagagccccctgtgcagacagctgtgctgacagccagcgccccagctgcccaggccggggccagccagggcctgcacgccctgctggaggagcgcatccacaactaccgggaggccgccgccagcgccaaggaggccggggaggccgccaaggcccggcgctgtgagcggggcctgaagaccctggagagccagctggcctctgtgagaagaggaaggaagatcaatgaagatgagatccccccacctgtggccctgggcaagaggcccctggccccccaggagcccgccaacagaagccctgagacagaccccccagcccccccagccctggagagtgacaaccccagccagcctgagaccagcctgcccggcatcagcgcccagcctgtgtctgacctggaccctgacccccgggccctgctgagcagccggcagcgggagtacaaggtggccgccctgagcgccaagagagctggggagctggaccgggcccgggagctgatgagaattggcaagagatttggagctgtgctggaggccctggagaagggccagcctgtggacctgagcgccatgcccccagcccctgaggacctgaagccccagcaggccagccaggcccccacagcccccagcgtcatccccccagctgtggagcgggtgcagcctgtgatggccccagatgtgcctgccacccctgtggcccccacagagagccagacagtgctggatgccctgcagcagaggctgaacaagtaccgggaggccggcatccaggcccggtctggaggagatgagaggaaggccaggatgcatgaaagaattgccaagcagtaccaggatgccatccgggcccaccgggccggcaggaaggtgaactttgctgagctgcctgtgcccccaggcttcccccccatccctggcctggagagcaccatgggcgtggaggaggatgctgtggccgccaccctggccgctgctgagaagctggccagcgctgaggacagcgccccagctgacaaggatgaagatgaaggagagcccccagcccaggcccctgtggccaagaagccagcccggcccaccgtgcccagcagccagaggctgcctgagccccgggccagcagcagcaaggagagccccagccccagcgtgcgggagcagctggccctgctggaggccaggaagctgcagtaccagagagctgccctgcaggccaagaggagccaggacctggagcaggccaaggcctacctgcgggtggccaagtggctggaggcccagatcatccaggcccggagcggccggcctgtggacctgagcaaggtgcccagccccctgacagatgaggagggggacttcatcctgatccaccacgaggacctgcggctgagccagaaggccgaggaggtgtatgcccagctgcagaagatgctgctggagcagcaggagaagtgcctgctcttcagcaagcagttcatgcaccagggcaatgtggccgagaccaccaggtttgagaagctggcccaggacaggaagaagcagctggagatcctgcagctggcccaggcccagggcctggacccccccacccaccactttgagctgaagaccttccagacagtgcgcatcttcagcgagctgaacagcacagagatgcacctgatcatcgtgcggggcatgaacctgcctgcccctcctggggtgaccccagatgacctggatgcctttgtgcgctttgagttccactaccccaacagcgaccaggcccagaagagcaagacagctgtggtgaagaacaccaacagccctgagtttgaccagctgttcaagctgaacatcaacagaaaccaccggggcttcaagagggtcatccagagcaagggcatcaagtttgagatcttccacaagggcagcttcttcagaagtgacaagctggtgggcacagcccacctgaagctggagcggctggagaatgaatgtgagatccgggagatcgtggaggtgctggatggcaggaagcccaccggcggcaagctggaggtgaaggtgcggctgcgggagcccctgagcggccaggatgtgcagatggtgacagagaactggctggtgctggagccccggggcctgtag

SEQ ID NO: 37433 - DNA, 2268 bp, Artificial Sequence
  Description of Artificial Sequence: Synthetic coding sequence
atgagagatgtggaggaggaggaggaggaggagggcctggaggaggatgctgagctgctgacagagctgcaggaggtgctgggcgtggatgaggagacagagcccctggatggagatgaggtggccgaccccggcggcagcgaggaggagaatggcctggaggacacagagccccctgtgcagacagctgtgctgacagccagcgccccagctgcccaggccggggccagccagggcctgcacgccctgctggaggagcgcatccacaactaccgggaggccgccgccagcgccaaggaggccggggaggccgccaaggcccggcgctgtgagcggggcctgaagaccctggagagccagctggcctctgtgagaagaggaaggaagatcaatgaagatgagatccccccacctgtggccctgggcaagaggcccctggccccccaggagcccgccaacagaagccctgagacagaccccccagcccccccagccctggagagtgacaaccccagccagcctgagaccagcctgcccggcatcagcgcccagcctgtgtctgacctggaccctgacccccgggccctgctgagcagccggcagcgggagtacaaggtggccgccctgagcgccaagagagctggggagctggaccgggcccgggagctgatgagaattggcaagagatttggagctgtgctggaggccctggagaagggccagcctgtggacctgagcgccatgcccccagcccctgaggacctgaagccccagcaggccagccaggcccccacagcccccagcgtcatccccccagctgtggagcgggtgcagcctgtgatggccccagatgtgcctgccacccctgtggcccccacagagagccagacagtgctggatgccctgcagcagaggctgaacaagtaccgggaggccggcatccaggcccggtctggaggagatgagaggaaggccaggatgcatgaaagaattgccaagcagtaccaggatgccatccgggcccaccgggccggcaggaaggtgaactttgctgagctgcctgtgcccccaggcttcccccccatccctggcctggagagcaccatgggcgtggaggaggatgctgtggccgccaccctggccgctgctgagaagctggccagcgctgaggacagcgccccagctgacaaggatgaagatgaaggagagcccccagcccaggcccctgtggccaagaagccagcccggcccaccgtgcccagcagccagaggctgcctgagccccgggccagcagcagcaaggagagccccagccccagcgtgcgggagcagctggccctgctggaggccaggaagctgcagtaccagagagctgccctgcaggccaagaggagccaggacctggagcaggccaaggcctacctgcgggtggccaagtggctggaggcccagatcatccaggcccggagcggccggcctgtggacctgagcaaggtgcccagccccctgacagatgaggagggggacttcatcctgatccaccacgaggacctgcggctgagccagaaggccgaggaggtgtatgcccagctgcagaagatgctgctggagcagcaggagaagtgcctgctcttcagcaagcagttcatgcaccagggcaatgtggccgagaccaccaggtttgagaagctggcccaggacaggaagaagcagctggagatcctgcagctggcccaggcccagggcctggacccccccacccaccactttgagctgaagaccttccagacagtgcgcatcttcagcgagctgaacagcacagagatgcacctgatcatcgtgcggggcatgaacctgcctgcccctcctggggtgaccccagatgacctggatgcctttgtgcgctttgagttccactaccccaacagcgaccaggcccagaagagcaagacagctgtggtgaagaacaccaacagccctgagtttgaccagctgttcaagctgaacatcaacagaaaccaccggggcttcaagagggtcatccagagcaagggcatcaagtttgagatcttccacaagggcagcttcttcagaagtgacaagctggtgggcacagcccacctgaagctggagcggctggagaatgaatgtgagatccgggagatcgtggaggtgctggatggcaggaagcccaccggcggcaagctggaggtgaagcccatggccagcaccaggagaggagtgcggccccggctgtgcagaagatag

SEQ ID NO: 37434 - DNA, 372 bp, Artificial Sequence
  Description of Artificial Sequence: Synthetic coding sequence
atgatgcctggcccccggcccaggaagggcccccaggcccggggccagggcgtggccgccgccaagcagatgggcctcttcatggagtttggacctgaggacatgctgctgggcatggatgaagcagaagatgatgaggacctggaggccgagctgctggccctgaccggggaggcccagaccaccgggaagaagccagcccccaagggccaggcccccctgcccatggcccacatcgagaagctggccgctgactgcatgagagatgtggaggaggaggaggaggaggagggcctggaggaggatgctggccgggactgtgctggagatgacttccccagctttgctggcttccgcagcctgtgcacctag

SEQ ID NO: 37435 - DNA, 2577 bp, Artificial Sequence
  Description of Artificial Sequence: Synthetic coding sequence
atgatgcctggcccccggcccaggaagggcccccaggcccggggccagggcgtggccgccgccaagcagatgggcctcttcatggagtttggacctgaggacatgctgctgggcatggatgaagcagaagatgatgaggacctggaggccgagctgctggccctgaccggggaggcccagaccaccgggaagaagccagcccccaagggccaggcccccctgcccatggcccacatcgagaagctggccgctgactgcatgagagatgtggaggaggaggaggaggaggagggcctggaggaggatgctgagctgctgacagagctgcaggaggtgctgggcgtggatgaggagacagagcccctggatggagatgaggtggccgaccccggcggcagcgaggaggagaatggcctggaggacacagagccccctgtgcagacagctgtgctgacagccagcgccccagctgcccaggccggggccagccagggcctgcacgccctgctggaggagcgcatccacaactaccgggaggccgccgccagcgccaaggaggccggggaggccgccaaggcccggcgctgtgagcggggcctgaagaccctggagagccagctggcctctgtgagaagaggaaggaagatcaatgaagatgagatccccccacctgtggccctgggcaagaggcccctggccccccaggagcccgccaacagaagccctgagacagaccccccagcccccccagccctggagagtgacaaccccagccagcctgagaccagcctgcccggcatcagcgcccagcctgtgtctgacctggaccctgacccccgggccctgctgagcagccggcagcgggagtacaaggtggccgccctgagcgccaagagagctggggagctggaccgggcccgggagctgatgagaattggcaagagatttggagctgtgctggaggccctggagaagggccagcctgtggacctgagcgccatgcccccagcccctgaggacctgaagccccagcaggccagccaggcccccacagcccccagcgtcatccccccagctgtggagcgggtgcagcctgtgatggccccagatgtgcctgccacccctgtggcccccacagagagccagacagtgctggatgccctgcagcagaggctgaacaagtaccgggaggccggcatccaggcccggtctggaggagatgagaggaaggccaggatgcatgaaagaattgccaagcagtaccaggatgccatccgggcccaccgggccggcaggaaggtgaactttgctgagctgcctgtgcccccaggcttcccccccatccctggcctggagagcaccatgggcgtggaggaggatgctgtggccgccaccctggccgctgctgagaagctggccagcgctgaggacagcgccccagctgacaaggatgaagatgagcccccaggccacctgcagggcgagcccccagcccaggcccctgtggccaagaagccagcccggcccaccgtgcccagcagccagaggctgcctgagccccgggccagcagcagcaaggagagccccagccccagcgtgcgggagcagctggccctgctggaggccaggaagctgcagtaccagagagctgccctgcaggccaagaggagccaggacctggagcaggccaaggcctacctgcgggtggccaagtggctggaggcccagatcatccaggcccggagcggccggcctgtggacctgagcaaggtgcccagccccctgacagatgaggagggggacttcatcctgatccaccacgaggacctgcggctgagccagaaggccgaggaggtgtatgcccagctgcagaagatgctgctggagcagcaggagaagtgcctgctcttcagcaagcagttcatgcaccagggcaatgtggccgagaccaccaggtttgagaagctggcccaggacaggaagaagcagctggagatcctgcagctggcccaggcccagggcctggacccccccacccaccactttgagctgaagaccttccagacagtgcgcatcttcagcgagctgaacagcacagagatgcacctgatcatcgtgcggggcatgaacctgcctgcccctcctggggtgaccccagatgacctggatgcctttgtgcgctttgagttccactaccccaacagcgaccaggcccagaagagcaagacagctgtggtgaagaacaccaacagccctgagtttgaccagctgttcaagctgaacatcaacagaaaccaccggggcttcaagagggtcatccagagcaagggcatcaagtttgagatcttccacaagggcagcttcttcagaagtgacaagctggtgggcacagcccacctgaagctggagcggctggagaatgaatgtgagatccgggagatcgtggaggtgctggatggcaggaagcccaccggcggcaagctggaggtgaaggtgcggctgcgggagcccctgagcggccaggatgtgcagatggtgacagagaactggctggtgctggagccccggggcctgtag

SEQ ID NO: 37436 - DNA, 1887 bp, Artificial Sequence
  Description of Artificial Sequence: Synthetic coding sequence
tgaaaaatcaatgaagatgagatccccccacctgtggccctgggcaagaggcccctggccccccaggagcccgccaacagaagccctgagacagatcctccagcccccccagccctggagagtgacaaccccagccagcctgagaccagcctgcccggcatcagcgcccagcctgtgtctgacctggaccctgacccccgggccctgctgagcagccggcagcgggagtacaaggtggccgccctgagcgccaagagagctggggagctggaccgggcccgggagctgatgagaattggcaagagatttggagctgtgctggaggccctggagaagggccagcctgtggacctgagcgccatgcccccagcccctgaggacctgaagccccagcaggccagccaggcccccacagcccccagcgtcatccccccagctgtggagcgggtgcagcctgtgatggccccagatgtgcctgccacccctgtggcccccacagagagccagacagtgctggatgccctgcagcagaggctgaacaagtaccgggaggccggcatccaggcccggtctggaggagatgagaggaaggccaggatgcatgagcgcatcgccaagcagtaccaggatgccatccgggcccacagagctggcaggaaggtgaactttgctgagctgcctgtgcccccaggcttcccccccatccctggcctggagagcaccatgggcgtggaggaggatgctgtggccgccaccctggccgctgctgagaagctggccagcgcagaagattctgccccagctgacaaggatgaagatgaaggagagcccccagcccaggcccctgtggccaagaagccagcccggcccaccgtgcccagcagccagaggctgcctgagccccgggccagcagcagcaaggagagccccagccccagcgtgcgggagcagctggccctgctggaggccaggaagctgcagtaccagagagctgccctgcaggccaagaggagccaggacctggagcaggccaaggcctacctgcgggtggccaagtggctggaggcccagatcatccaggcccggagcggccggcctgtggacctgagcaaggtgcccagccccctgacagatgaggagggggacttcatcctgatccaccacgaggacctgcggctgagccagaaggccgaggaggtgtatgcccagctgcagaagatgctgctggagcagcaggagaagtgcctgctcttcagcaagcagttcatgcaccagggcaatgtggccgagaccaccaggtttgagaagctggcccaggacaggaagaagcagctggagatcctgcagctggcccaggcccagggcctggacccccccacccaccactttgagctgaagaccttccagacagtgcgcatcttcagcgagctgaacagcacagagatgcacctgatcatcgtgcggggcatgaacctgcctgcccctcctggggtgaccccagatgacctggatgcctttgtgcgctttgagttccactaccccaacagcgaccaggcccagaagagcaagacagctgtggtgaagaacaccaacagccctgagtttgaccagctgttcaagctgaacatcaacagaaaccaccggggcttcaagagggtcatccagagcaagggcatcaagtttgagatcttccacaagggcagcttcttcagaagtgacaagctggtgggcacagcccacctgaagctggagcggctggagaatgaatgtgagatccgggagatcgtggaggtgctggatggcaggaagcccactggaggcaagctggaggtgaagcccatggccagcacccggcggggcgtgcggccccggctgtgcagaagatag

SEQ ID NO: 37437 - DNA, 645 bp, Artificial Sequence
  Description of Artificial Sequence: Synthetic coding sequence
atgctgctggagcagcaggagaagtgcctgctcttcagcaagcagttcatgcaccagggcaatgtggccgagaccaccaggtttgagaagctggcccaggacaggaagaagcagctggagatcctgcagctggcccaggcccagggcctggacccccccacccaccactttgagctgaagaccttccagacagtgcgcatcttcagcgagctgaacagcacagagatgcacctgatcatcgtgcggggcatgaacctgcctgcccctcctggggtgaccccagatgacctggatgcctttgtgcgctttgagttccactaccccaacagcgaccaggcccagaagagcaagacagctgtggtgaagaacaccaacagccctgagtttgaccagctgttcaagctgaacatcaacagaaaccaccggggcttcaagagggtcatccagagcaagggcatcaagtttgagatcttccacaagggcagcttcttcagaagtgacaagctggtgggcacagcccacctgaagctggagcggctggagaatgaatgtgagatccgggagatcgtggagatggagcgcttccgccgctctgagaagagccaccggggcacccaggagaaggccgccagcctcttcccctag

SEQ ID NO: 37438 - DNA, 2319 bp, Artificial Sequence
  Description of Artificial Sequence: Synthetic coding sequence
tgaacaacaggcaagaagccagcccccaagggccaggcccccctgcccatggcccacatcgagaagctggccgctgactgcatgagagatgtggaggaggaggaggaggaggagggcctggaggaggatgctgagctgctgacagagctgcaggaggtgctgggcgtggatgaggagacagagcccctggatggagatgaggtggccgaccccggcggcagcgaggaggagaatggcctggaggacacagagccccctgtgcagacagctgtgctgacagccagcgccccagctgcccaggccggggccagccagggcctgcacgccctgctggaggagcgcatccacaactaccgggaggccgccgccagcgccaaggaggccggggaggccgccaaggcccggcgctgtgagcggggcctgaagaccctggagagccagctggcctctgtgcggcggggcaggaagatcaatgaagatgagatccccccacctgtggccctgggcaagaggcccctggccccccaggagcccgccaacagaagccctgagacagatcctccagcccccccagccctggagagtgaccctgacccccgggccctgctgagcagccggcagcgggagtacaaggtggccgccctgagcgccaagagagctggggagctggaccgggcccgggagctgatgagaattggcaagagatttggagctgtgctggaggccctggagaagggccagcctgtggacctgagcgccatgcccccagcccctgaggacctgaagccccagcaggccagccaggcccccacagcccccagcgtcatccccccagctgtggagcgggtgcagcctgtgatggccccagatgtgcctgccacccctgtggcccccacagagagccagacagtgctggatgccctgcagcagaggctgaacaagtaccgggaggccggcatccaggcccggtctggaggagatgagaggaaggccaggatgcatgaaagaattgccaagcagtaccaggatgccatccgggcccaccgggccggcaggaaggtgaactttgctgagctgcctgtgcccccaggcttcccccccatccctggcctggagagcaccatgggcgtggaggaggatgctgtggccgccaccctggccgctgctgagaagctggccagcgctgaggacagcgccccagctgacaaggatgaagatgaaggagagcccccagcccaggcccctgtggccaagaagccagcccggcccaccgtgcccagcagccagaggctgcctgagccccgggccagcagcagcaaggagagccccagccccagcgtgcgggagcagctggccctgctggaggccaggaagctgcagtaccagagagctgccctgcaggccaagaggagccaggacctggagcaggccaaggcctacctgcgggtggccaagtggctggaggcccagatcatccaggcccggagcggccggcctgtggacctgagcaaggtgcccagccccctgacagatgaggagggggacttcatcctgatccaccacgaggacctgcggctgagccagaaggccgaggaggtgtatgcccagctgcagaagatgctgctggagcagcaggagaagtgcctgctcttcagcaagcagttcatgcaccagggcaatgtggccgagaccaccaggtttgagaagctggcccaggacaggaagaagcagctggagatcctgcagctggcccaggcccagggcctggacccccccacccaccactttgagctgaagaccttccagacagtgcgcatcttcagcgagctgaacagcacagagatgcacctgatcatcgtgcggggcatgaacctgcctgcccctcctggggtgaccccagatgacctggatgcctttgtgcgctttgagttccactaccccaacagcgaccaggcccagaagagcaagacagctgtggtgaagaacaccaacagccctgagtttgaccagctgttcaagctgaacatcaacagaaaccaccggggcttcaagagggtcatccagagcaagggcatcaagtttgagatcttccacaagggcagcttcttcagaagtgacaagctggtgggcacagcccacctgaagctggagcggctggagaatgaatgtgagatccgggagatcgtggaggtgctggatggcaggaagcccaccggcggcaagctggaggtgaaggtgcggctgcgggagcccctgagcggccaggatgtgcagatggtgacagagaactggctggtgctggagccccggggcctgtag

SEQ ID NO: 37439 - DNA, 969 bp, Artificial Sequence
  Description of Artificial Sequence: Synthetic coding sequence
atgatgacagagaagcatgaggaccactgcctgaagagctgcagcggccacagctacatcaggaagaactggctgggctgcatcgtgttccccttcagcgccctgctgcagcagagcgagttcctggaccagacagaggtgctgcagagggcccagatcttcaagaagaactgcaaggccatgttccccaacagaagaattgtgaccaccgtcttcaatgatgagggcatccagttcctggtgacccgctacatcaaggccctgaaccccccccagcagctgctggacatcttcctgcacaacagcaatgccacctttgacctgattgccaggtttgtgtccctcatcccctttgtgcccaacaccccagatgaaaatgatggcagtgacatctggatgaccagcgagcactgcatcagcctggccatcggcaacaaggaggagcacgccatcctgctgtgcaacttcttcctgtactttgggaagaaggccctggtgctgctgggcacctctgtgctggagggccacgtggcctacgtggtgacccaggagaccaatgagtacctgctgtggaaccccagcacaggccagtgctacaagcagtttgaccccttctgccccctgaagtctgtggactgcctgtttgatgacagaaatgtgtggttcaacatccagcagaacaacacccccatggctgtgttctttgactacagcaaggagagcttctggaagcagctgctgcccaagaatgtgcagggcaccaagatccagagcatccaggtgacaggcttccccatccagatgccctacattgatgtgcagagcatcattgatgctgtgtaccagacaggcatccacagcgctgagttcccccagacagaatttgccctggccgtgtacatccacccctaccccaacaacatcctgtctgtgtgggtgtacctggccagcctggtgcagcaccagtag

SEQ ID NO: 37440 - DNA, 417 bp, Artificial Sequence
  Description of Artificial Sequence: Synthetic coding sequence
atgcccacctgcctgaagagcagcatcagctgcctgcggcaccgggagaccatcaagtctgtggccagtgatgagaccctgcatgaagatactgtgcacccctttgtggaggtgtccttccagcacacagtgtacaagaccaacacagccagcggcagccacccctgctggaatgaggagatcaaggtggactttgtgtccccaggccatgactacagcttcagcagcctgagcaagatcaaggacaacatctacatcaacatctttgatgagatgatgacagagaagcatgaggaccactgcctgaagagctgcagcggccacagctacatcaggaagaactggctgggctgcatcgtgttccccttcagcgccctgctgcagcagagcgaggacaggaaggacagcgaggagtag

SEQ ID NO: 37441 - DNA, 1206 bp, Artificial Sequence
  Description of Artificial Sequence: Synthetic coding sequence
atgatgacagagaagcatgaggaccactgcctgaagagctgcagcggccacagctacatcaggaagaactggctgggctgcatcgtgttccccttcagcgccctgctgcagcagagcgagttcctggaccagacagaggtgctgcagagggcccagatcttcaagaagaactgcaaggccatgttccccaacagaagaattgtgaccaccgtcttcaatgatgagggcatccagttcctggtgacccgctacatcaaggccctgaaccccccccagcagctgctggacatcttcctgcacaacagcaatgccacctttgacctgattgccaggtttgtgtccctcatcccctttgtgcccaacaccccagatgaaaatgatggcagtgacatctggatgaccagcgagcactgcatcagcctggccatcggcaacaaggaggagcacgccatcctgctgtgcaacttcttcctgtactttgggaagaaggccctggtgctgctgggcacctctgtgctggagggccacgtggcctacgtggtgacccaggagaccaatgagtacctgctgtggaaccccagcacaggccagtgctacaagcagtttgaccccttctgccccctgaagtctgtggactgcctgtttgatgacagaaatgtgtggttcaacatccagcagaacaacacccccatggctgtgttctttgactacagcaaggagagcttctggaagcagctgctgcccaagaatgtgcagggcaccaagatccagagcatccagcctgaggagatcatctactttgaaacagacaagtccatggtggaggacctgaggaacagaattgaaagaaccctgaagagcaaggtgatggagtggaggcccaagcaccccacccactggaaccggcagtgcaccttcatcctgcggcagatcctgcccaagctggagtttggaattggcagctttgtgtcctctgagggggacaatgaatttgagcgcatcctgcagttctactgggtgacaggcttccccatccagatgccctacattgatgtgcagagcatcattgatgctgtgtaccagacaggcatccacagcgctgagttcccccagacagaatttgccctggccgtgtacatccacccctaccccaacaacatcctgtctgtgtgggtgtacctggccagcctggtgcagcaccagtag

SEQ ID NO: 37442 - DNA, 1653 bp, Artificial Sequence
  Description of Artificial Sequence: Synthetic coding sequence
atgagccacggccccagcccccggctggccgagagcccccagctgagcaagggcagcctgctgaccatcctgggcagccccagccctgagaggatgggccctgctgacagcctgccccccaccccacccagcggcacccccagccctggccccccaccagccctgcccctgcccccagccccagccctgctggctgatggagactgggagagccgggaggagctgcggctgcgggagctggaggaggcccgggcccgggccgcccagatggagaagaccatgaggcgctggagcgactgcacagccaactggagggagaagtggagcaaggtgcgggcagagaggaacagagcccgggaggaggtgcggcagctgcggcagaggctggatgccctgaccaaggagctggccggggcccggcgggagcggcaggaggcccagggagaatgtgaggcccggggccgggagctggcccggctgcggggggcccggggcgtggccgaccagaccagagatggccctgagcctgaggccgagcgggagcctgtgagagatgtgggcagcgagaggcctcctggcagccaggagctggagctggtggagagcctgctgaagtccatgcctgaggagagcgaggactgctgggaggcccggagcctgggcgctgggggcccccggggcagcagcggccggcaggagaggagccggctgccctgggaggacacagctgccacagaggaggaggccagcaagctgacagccctgcggctgcggctggatgagagccagaaggtgctgctgaaggagcgggaggacaagctggccctgagcaggaacatcgagaagctggagggggagctgagccagtggaagatcaagtatgaggagctgagcaagaccaagcaggagatgctgaagcagctgagcatcctgaaggaggcccaccaggatgagctgggccgcatgtctgaggacctggaggatgagctgggcgcccggagctccatggacaggaagatggccgagctgcggggggagatggagcggctgcaggctgaaaatgctgctgagtggggccggcgggagcggctggagacagagaagctgggcctggagcgggagaacaagaagctgcgggcccaggtgggggacctggaggaggccctggccaggagaagacggcagacagccagcgccctggactgtgacctgcgggccagccaggccgccctgtttgagaagaacaaggagctggccgacctgaagcacgtgcacggcaagctgaagaagcagttccaggagaaggtggccgagctggcccacgccaacagaagagtggagcagcatgaagctgaggtgaagaagctgcggctgcgggtggaggagctgaagaaggagctggcccaggctgaagatgagctggatgaggcccacaaccaggccaggaagctgcagaggagcctggatgagcagacagagcagagcgagaacctgcaggtgcagctggagcacctgcagagccggctgcggcggcagcagcagaatgcccccctgtttgggaagatccgcagcgccaggtttggaacagaggaggctgaagatggcaccagtgacctggatgaagatgaggacctgcagatccaggtggcctag

SEQ ID NO: 37443 - DNA, 1542 bp, Artificial Sequence
  Description of Artificial Sequence: Synthetic coding sequence
atgaacctggacagcatccacaggctcatcgaggagacccagatcttccagatgcagcagagcagcatcaagagcagaggagacatggtggccccagccagccccccccgggacacctgcaacacctgcttccccctgcacggcctgcagagccatgctgcccacaacttctgtgcccacagctacaacaccaacaagtgggacatctgtgaggagctgcggctgcgggagctggaggaggtgaaggcccgggccgcccagatggagaagaccatgcgctggtggagcgactgcacagccaactggagggagaagtggagcaaggtgcgggcagagagaaattctgcccgggaggagggccggcagctgcgcatcaagctggagatggccatgaaggagctgagcaccctgaagaagaagcagagcctgcccccccagaaggaggccctggaggccaaggtgacccaggacctgaagctgcccggctttgtggaggagagctgtgagcacacagaccagttccagctgagcagccagatgcatgagagcatccgggagtacctggtgaagaggcagttcagcaccaaggaggacaccaacaacaaggagcagggcgtggtgattgacagcctgaagctgtctgaggagatgaagcccaacctggatggagtggacctcttcaacaatggaggcagcggaaatggagagaccaagacaggcctgcggctgaaggccatcaacctgcccctggagaatgaggtgacagagatcagcgccctgcaggtgcacctggatgagttccagaagatcctgtggaaggagcgggagatgaggacagccctggagaaggagattgagcggctggagagcgccctgagcctgtggaagtggaagtatgaggagctgaaggagagcaagcccaagaatgtgaaggagtttgacatcctgctgggccagcacaatgatgagatgcaggagctgagcggcaacatcaaggaggagagcaagagccagaacagcaaggacagagtcatctgtgagctgcgggcagagctggagcggctgcaggccgagaacaccagcgagtgggacaagcgggagatcctggagcgggagaagcagggcctggagagagaaaatagaaggctgaagatccaggtgaaggagatggaggagctgctggacaagaagaaccggctgagcgccaacagccagagcccagacttcaagatgagccagattgacctgcaggagaagaaccaggagctgctgaacctgcagcacgcctactacaagctgaaccggcagtaccaggccaacattgctgagctgacccacgccaacaacagagtggaccagaatgaggccgaggtgaagaagctgcggctgcgggtggaggagctgaagcagggcctgaaccagaaggaggatgagctggatgacagcctgaaccagatcaggaagctgcagaggagcctggatgaggagaaggagagaaatgaaaacctggagacagagctgcggcacctgcagaactggtag

SEQ ID NO: 37444 - DNA, 1275 bp, Artificial Sequence
  Description of Artificial Sequence: Synthetic coding sequence
atgaacctggacagcatccacaggctcatcgaggagacccagatcttccagatgcagcagagcagcatcaagagcagaggagacatggtggccccagccagccccccccgggacacctgcaacacctgcttccccctgcacggcctgcagagccatgctgcccacaacttctgtgcccacagctacaacaccaacaagtgggacatctgtgaggagctgcggctgcgggagctggaggaggtgaaggcccgggccgcccagatggagaagaccatgcgctggtggagcgactgcacagccaactggagggagaagtggagcaaggtgcgggcagagagaaattctgcccgggaggagggccggcagctgcgcatcaagctggagatggccatgaaggagctgagcaccctgaagaagaagcagagcctgcccccccagaaggaggccctggaggccaaggtgacccaggacctgaagctgcccggctttgtggaggagagctgtgagcacacagaccagttccagctgagcagccagatgcatgagagcatccgggagtacctggtgaagaggcagttcagcaccaaggaggacaccaacaacaaggagcagggcgtggtgattgacagcctgaagctgtctgaggagatgaagcccaacctggatggagtggacctcttcaacaatggaggcagcggaaatggagagaccaagacaggcctgcggctgaaggccatcaacctgcccctggagaatgaggtgacagagatcagcgccctgcaggtgcacctggatgagttccagaagatcctgtggaaggagcgggacctgtccttcaagagcctgaagatcgtgaacacagaccggctgaatgcccacagctttgggaagaggaaccgggagaccggggtgggctttgtgtctgtggaggtggagtttgacatcctgctgggccagcacaatgatgagatgcaggagctgagcggcaacatcaaggaggagagcaagagccagaacagcaaggacagagtcatctgtgagctgcgggcagagctggagcggctgcaggccgagaacaccagcgagtgggacaagcgggagatcctggagcgggagaagcagggcctggagagagaaaatagaaggctgaagatccaggtgaaggagatggaggagctgctggacaagaagaaccggctgagcgccaacagccagagcccagacttcaagatgagccagattgacctgcaggagaagaaccaggatgtgaagtag

SEQ ID NO: 37445 - DNA, 1542 bp, Artificial Sequence; identical to SEQ ID NO: 37443
  Description of Artificial Sequence: Synthetic coding sequence

SEQ ID NO: 37446 - DNA, 714 bp, Artificial Sequence
  Description of Artificial Sequence: Synthetic coding sequence
atggagagaaatgacatcatcaacttcaaggccctggagaaggagctgcaggccgccctgacagcagatgagaagtacaagagagaaaatgctgccaagctgcgggctgtggagcagagggtggccagctatgaggagttccggggcatcgtgctggccagccacctgaagcccctggagaggaaggacaagatgggcggcaagaggacagtgccctggaactgccacaccatccagggccgcaccttccaggatgtggccacagagatcagccctgagaaggcccccctgcagcctgagaccagcgctgacttctacagagactggaggaggcacctgcccagcggccctgagcgctaccaggccctgctgcagctgggcggcccccggctgggctgcctcttccagacagatgtgggcttcggcctgctgggggagctgctggtggccctggccgaccacgtgggccctgctgacagagctgctgtgctgggcatcctgtgcagcctggccagcacaggccgcttcaccctgaacctgagcctgctgagcagagctgagcgggagagctgcaagggcctcttccagaagctgcaggccatgggcaaccccaggtctgtgaaggagggcctgtcctgggaggagcagggcctggaggagcagagcggcggcctgcaggaggaggagcggctgctgcaggagctgctggagtag

SEQ ID NO: 37447 - DNA, 729 bp, Artificial Sequence
  Description of Artificial Sequence: Synthetic coding sequence
atggagagaaatgacatcatcaacttcaaggccctggagaaggagctgcaggccgccctgacagcagatgagaagtacaagagagaaaatgctgccaagctgcgggctgtggagcagagggtggccagctatgaggagttccggggcatcgtgctggccagccacctgaagcccctggagaggaaggacaagatgggcggcaagaggacagtgccctggaactgccacaccatccagggccgcaccttccaggatgtggccacagagatcagccctgagaaggcccccctgcagcctgagaccagcgctgacttctacagagactggaggaggcacctgcccagcggccctgagcgctaccaggccctgctgcagctgggcggcccccggctgggctgcctcttccagacagatgtgggcttcggcctgctgggggagctgctggtggccctggccgaccacgtgggccctgctgacagagctgctgtgctgggcatcctgtgcagcctggccagcacaggccgcttcaccctgaacctgagcctgctgagcagagctgagcgggagagctgcaagggcctcttccagaagctgcaggccatgggcaaccccaggtctgtgaaggagggcctgtcctgggaggagcagggcctggaggagcagagcggcggcctgcaggaggaggagcggctgctgcaggagctgctggagctgtaccaggtggactag

SEQ ID NO: 37448 - DNA, 729 bp, Artificial Sequence; identical to SEQ ID NO: 37447
  Description of Artificial Sequence: Synthetic coding sequence

SEQ ID NO: 37449 - DNA, 1104 bp, Artificial Sequence
  Description of Artificial Sequence: Synthetic coding sequence
atggctgctgaggaggaggatgaggtggagtgggtggtggagagcattgctggcttcctgcggggccctgactggagcatccccatcctggactttgtggagcagaagtgtgaggtgaactgcaagggcggccacgtgatcaccccaggcagccctgagcccgtcatcctggtggcctgtgtgcccctggtgtttgatgatgaggaggagagcaagctgacctacacagagatccaccaggagtacaaggagctggtggagaagctgctggagggctacctgaaggagatcggcatcaatgaagaccagttccaggaggcctgcaccagccccctggccaagacccacaccagccaggccatcctgcagcctgtgctggccgctgaggacttcaccatcttcaaggccatgatggtgcagaagaacatcgagatgcagctgcaggccatccgcatcatccaggagagaaatggagtgctgcctgactgcctgacagatggcagtgatgtggtgtctgacctggagcacgaggagatgaagatcctgcgggaggtgctgaggaagagcaaggaggagtatgaccaggaggaggagaggaagaggaagaagcagctgtctgaggccaagacagaggagcccaccgtgcacagcagcgaggccgccatcatgaacaacagccagggagatggagagcactttgcccacccccccagcgaggtgaagatgcactttgccaaccagagcattgagcccctgggcaggaaggtggagaggtctgagaccagcagcctgccccagaaggacctgaagatccctggcctggagcacgccagcattgagggccccatcgccaacctgtctgtgctgggcacagaggagctgcggcagcgggagcactacctgaagcagaagagggacaagctgatgtccatgaggaaggacatgaggaccaagcagatccagaacatggagcagaagggcaagcccaccggggaggtggaggagatgacagagaagccagagatgacagctgaggagaagcagaccctgctgaagaggcggctgctggccgagaagctgaaggaggaggtgatcaacaagtag

SEQ ID NO: 37450 - DNA, 1029 bp, Artificial Sequence
  Description of Artificial Sequence: Synthetic coding sequence
atggctgctgaggaggaggatgaggtggagtgggtggtggagagcattgctggcttcctgcggggccctgactggagcatccccatcctggactttgtggagcagaagtgtgaggtgtttgatgatgaggaggagagcaagctgacctacacagagatccaccaggagtacaaggagctggtggagaagctgctggagggctacctgaaggagatcggcatcaatgaagaccagttccaggaggcctgcaccagccccctggccaagacccacaccagccaggccatcctgcagcctgtgctggccgctgaggacttcaccatcttcaaggccatgatggtgcagaagaacatcgagatgcagctgcaggccatccgcatcatccaggagagaaatggagtgctgcctgactgcctgacagatggcagtgatgtggtgtctgacctggagcacgaggagatgaagatcctgcgggaggtgctgaggaagagcaaggaggagtatgaccaggaggaggagaggaagaggaagaagcagctgtctgaggccaagacagaggagcccaccgtgcacagcagcgaggccgccatcatgaacaacagccagggagatggagagcactttgcccaccccccatctgaggtgaagatgcactttgccaaccagagcattgagcccctgggcaggaaggtggagaggtctgagaccagcagcctgccccagaaggacctgaagatccctggcctggagcacgccagcattgagggccccatcgccaacctgtctgtgctgggcacagaggagctgcggcagcgggagcactacctgaagcagaagagggacaagctgatgtccatgaggaaggacatgaggaccaagcagatccagaacatggagcagaagggcaagcccactggagaggtggaggagatgacagagaagccagagatgacagctgaggagaagcagaccctgctgaagaggcggctgctggccgagaagctgaaggaggaggtgatcaacaagtag

SEQ ID NO: 37451 - DNA, 1545 bp, Artificial Sequence
  Description of Artificial Sequence: Synthetic coding sequence
atgtacagccagcgcttcggcaccgtgcagcgggaggtgaagggccccacccccaaggtggtgattgtgcgcagcaagccacccaagggccagggcgctgagcaccacctggagcgcatcagaagaagccaccagaagcacaatgccatcctggccagcatcaagagcagcgagcgggaccggctgaaggccgagtgggaccagcacaatgactgcaagatcctggacagcctggtgcgggcccgcatcaaggatgctgtgcagggcttcatcatcaacatcgaggagaggaggaacaagctgcgggagctgctggccctggaggagaatgagtacttcacagagatgcagctgaagaaggagaccatcgaggagaagaaggacaggatgagggagaagaccaagctgctgaaggagaagaatgagaaggagcggcaggactttgtggccgagaagctggaccagcagttccgggagcgctgtgaggagctgcgggtggagctgctgagcatccaccagaagaaggtgtgtgaggagaggaaggcccagatcgccttcaatgaggagctgagccggcagaagctggtggaggagcagatgttcagcaagctgtgggaggaggaccggctggccaaggagaagcgggaggcccaggaggcccggcggcagaaggagctgatggagaacacccggctgggcctgaatgcccagatcaccagcatcaaggcccagaggcaggccacccagctgctgaaggaggaggaggcccggctggtggagagcaacaatgcccagatcaagcatgaaaatgagcaggacatgctgaagaagcagaaggccaagcaggagaccaggaccatcctgcagaaggccctgcaggagcgcatcgagcacatccagcaggagtacagagatgagcaggacctgaacatgaagctggtgcagagggccctgcaggacctgcaggaggaggccgacaagaagaagcagaagcgggaggacatgatccgggagcagaagatctaccacaagtacctggcccagaggcgggaggaggagaaggcccaggagaaggagtttgaccgcatcctggaggaggacaaggccaagaagctggccgagaaggacaaggagctgcggctggagaaggaggcccggcggcagctggtggatgaggtgatgtgcaccaggaagctgcaggtgcaggagaagctgcagcgggaggccaaggagcaggaggagcgggccatggagcagaagcacatcaatgaaagcctgaaggagctgaactgtgaggagaaggaaaattttgcccggcggcagaggctggcccaggagtacaggaagcagctgcagatgcagatcgcctaccagcagcagagccaggaggccgagaaggaggagaagaggcgggagtttgaagctggggtggccgccaacaagatgtgcctggacaaggtgcaggaggtgctgagcacccaccaggtgctgccccagaacatccaccccatgaggaaggcctgccccagcaagctgcccccatag

SEQ ID NO: 37452 - DNA, 1683 bp, Artificial Sequence
  Description of Artificial Sequence: Synthetic coding sequence
atgaacaggaagtgggaggccaagctgaagcagatcgaggagcgggccagccactatgaaaggaagcccctgagctctgtgtaccggccccggctgagcaagccagaggagccccccagcatctggaggctcttccaccggcaggcccaggccttcaactttgtgaagagctgcaaggaggatgtgcacgtgtttgccctggagtgcaaggtgggagatggccagaggatctacctggtgaccacctacgccgagttctggttctactacaagagcaggaagaacctgctgcactgctatgaggtgatcccagaaaatgctgtgtgcaagctgtactttgacctggagttcaacaagccagccaaccctggagcagatggcaagaagatggtggccctgctgattgaatatgtgtgcaaggccctgcaggagctgtatggagtgaactgcagcgcagaagatgtgctgaacctggacagcagcacagatgagaagttcagccagcacctgatcttccagctgcatgatgtggccttcaaggacaacatccacgtgggcaacttcctgaggaagatcctgcagcctgccctggacctgctgggctctgaagatgatgattctgcccctgagaccaccggccacggcttcccccacttcagcgaggccccagcccggcagggcttctccttcaacaagatgttcacagagaaggccacagaggagagctggaccagcaacagcaagaagctggagcggctgggcagcgctgagcagagcagcccagacctgtccttcctggtggtgaagaacaacatgggagagaagcacctgtttgtggacctgggcgtgtacaccaggaacagaaacttccggctgtacaagagcagcaagattggcaagagggtggccctggaggtgacagaggacaacaagttcttccccatccagagcaaggatgtgtctgatgagtaccagtacttcctgagcagcctggtgtccaatgtgcgcttcagtgacaccctgcgcatcctgacctgtgagcccagccagaacaagcagaagggcgtgggctacttcaacagcatcggcacctctgtggagaccatcgagggcttccagtgcagcccctacccagaggtggaccactttgtgctgagcctggtgaacaaggatggcatcaagggcggcatccgccgctggaactacttcttccctgaggagctgctggtgtatgacatctgcaagtaccgctggtgtgagaacatcggccgggcccacaagagcaacaacatcatgatcctggtggacctgaagaatgaggtgtggtaccagaagtgccacgaccctgtgtgcaaggccgagaacttcaagagtgactgcttccccctgcctgctgaggtgtgcctgctcttcctgttcaaggaggaggaggagttcaccacagatgaagcagatgagaccaggagcaatgagacccagaacccccacaagcccagccccagccggctgagcactggagccagcgcagatgctgtgtgggacaatggaattgatgatgcctacttcctggaggccacagaagatgctgagctggccgaggccgctgagaacagcctgctgagctacaacagcgaggtggatgagatcccagatgagctgatcatcgaggtgctgcaggagtag

SEQ ID NO: 37453 - DNA, 1590 bp, Artificial Sequence
  Description of Artificial Sequence: Synthetic coding sequence
atggccgccctgaccaccgtggtggtggccgccgccgccacagctgtggccggggctgtggccggggccggggccgccactggaactggagtgggcgccaccccagccccccagcagagtgatggctgcttcagcaccagcggcggcatccggcccttccacctgcagaactggaagcagaaggtgaaccagaccaagaaggccgagtttgtgaggacagctgagaagttcaagaaccaggtgatcaacatggagaaggacaagcacagccacttctacaaccagaagagtgacttcagaattgagcacagcatgctggaggagctggagaacaagctgatccacagcaggaagacagagcgggccaagatccagcagcagctggccaagatccacaacaacgtgaagaagctgcagcaccagctgaaggatgtgaagcccaccccagactttgtggagaagctgcgggagatgatggaggagattgaaaatgccatcaacaccttcaaggaggagcagaggctcatctatgaggagctgatcaaggaggagaagaccaccaacaatgagctgagcgccatcagcaggaagattgacacctgggccctgggcaacagcgagacagagaaggccttccgggccatcagcagcaaggtgcctgtggacaaggtgacccccagcaccctgcctgaggaggtgctggactttgagaagttcctgcagcagacaggaggccggcagggcgcctgggatgattatgaccaccagaactttgtgaaggtgaggaacaagcacaagggcaagcccaccttcatggaggaggtgctggagcacctgcccgggaagacccaggatgaggtgcagcagcacgagaagtggtaccagaagttcctggccctggaggagaggaagaaggagagcatccagatctggaagaccaagaagcagcagaagcgggaggagatcttcaagctgaaggagaaggctgacaacacccctgtgctcttccacaacaagcaggaggacaaccagaagcagaaggaggagcagaggaagaagcagaagctggccgtggaggcctggaagaagcagaagagcattgagatgtccatgaagtgtgccagccagctgaaggaggaggaggagaaggagaagaagcaccagaaggagcggcagaggcagttcaagctgaagctgctgctggagagctacacccagcagaagaaggagcaggaggagttcctgcggctggagaaggagatccgggagaaggccgagaaggccgagaagaggaagaatgctgctgatgagatcagccgcttccaggagcgggacctgcacaagctggagctgaagatcctggaccggcaggccaaggaggatgagaagagccagaagcagaggcggctggccaagctgaaggagaaggtggagaacaacgtgtcccgggaccccagccggctgtacaagcccaccaagggctgggaggagaggaccaagaagattggccccactggaagtggccccctgctgcacatcccccaccgggccatccccacctggaggcagggcatccagaggagagtgtag

SEQ ID NO: 37454 - DNA, 1341 bp, Artificial Sequence
  Description of Artificial Sequence: Synthetic coding sequence
atggagaaggacaagcacagccacttctacaaccagaagagtgacttccgcatcgagcacagcatgctggaggagctggagaacaagctgatccacagcaggaagacagagcgggccaagatccagcagcagctggccaagatccacaacaacgtgaagaagctgcagcaccagctgaaggatgtgaagcccaccccagactttgtggagaagctgcgggagatgatggaggagattgaaaatgccatcaacaccttcaaggaggagcagaggctcatctatgaggagctgatcaaggaggagaagaccaccaacaatgagctgagcgccatcagcaggaagattgacacctgggccctgggcaacagcgagacagagaaggccttccgggccatcagcagcaaggtgcctgtggacaaggtgacccccagcaccctgcctgaggaggtgctggactttgagaagttcctgcagcagacaggaggccggcagggcgcctgggatgattatgaccaccagaactttgtgaaggtgaggaacaagcacaagggcaagcccaccttcatggaggaggtgctggagcacctgcccgggaagacccaggatgaggtgcagcagcacgagaagtggtaccagaagttcctggccctggaggagaggaagaaggagagcatccagatctggaagaccaagaagcagcagaagcgggaggagatcttcaagctgaaggagaaggctgacaacacccctgtgctcttccacaacaagcaggaggacaaccagaagcagaaggaggagcagaggaagaagcagaagctggccgtggaggcctggaagaagcagaagagcattgagatgtccatgaagtgtgccagccagctgaaggaggaggaggagaaggagaagaagcaccagaaggagcggcagaggcagttcaagctgaagctgctgctggagagctacacccagcagaagaaggagcaggaggagttcctgcggctggagaaggagatccgggagaaggccgagaaggccgagaagaggaagaatgctgctgatgagatcagccgcttccaggagcgggacctgcacaagctggagctgaagatcctggaccggcaggccaaggaggatgagaagagccagaagcagaggcggctggccaagctgaaggagaaggtggagaacaacgtgtcccgggaccccagccggctgtacaagcccaccaagggctgggaggagaggaccaagaagattggccccaccggcagcggccccctgctgcacatcccccaccgggccatccccacctggaggcagggcatccagaggagagtgtag

SEQ ID NO: 37455 - DNA, 798 bp, Artificial Sequence
  Description of Artificial Sequence: Synthetic coding sequence
atgtctgctgcccccctggtgggctacagcagcagcggctctgaagatgaaagtgaagatggcatgaggaccaggcctggagatggcagccaccggcggggccagagccccctgccccggcagcgcttccctgtgcctgacagcgtgctgaacatgtttcctggaacagaggagggcccagaagatgacagcaccaagcatggaggccgggtgaggaccttcccccatgagcggggcaactgggccacccacgtgtatgtgccctatgaggccaaggaggagttcctggacctgctggatgtgctgctgccccacgcccagacctacgtgccccggctggtgaggatgaaggtgttccacctgagcctgagccagagcgtggtgctgcggcaccactggatcctgccctttgtgcaggccctgaaggccaggatgaccagcttccaccgcttcttcttcaccgccaaccaggtgaagatctacaccaaccaggagaagaccaggaccttcatcggcctggaggtgaccagcggccacgcccagttcctggacctggtgtctgaggtggacagagtgatggaggagttcaacctgaccaccttctaccaggaccccagcttccacctgagcctggcctggtgtgtgggagatgcccggctgcagctggagggccagtgcctgcaggagctgcaggccatcgtggatggctttgaagatgctgaggtgctgctgcgggtgcacacagagcaggtgcgctgcaagagcggcaacaagttcttctccatgcccctgaagtag

SEQ ID NO: 37456 - DNA, 972 bp, Artificial Sequence
  Description of Artificial Sequence: Synthetic coding sequence
atgacagatgatgagagcgagagcgtgctgagtgacagccatgagggcagcgagctggagctgcccgtcatccagctgtgtggcctggtggaggagctgtcctatgtgaacagcgccctgaagacagaaacagagatgtttgagaagtactatgccaagctggagccccgggaccagaggcctccccggctgtctgagatcaagatctctgctgctgactatgcccaggccatcatcgaggaggccgagatccgctggagcgaggtgtcccgggaggtgcatgaatttgagaaggacatcctgaaggccatcagcaagaagaagggcagcatcctggccacccagaaggtgatgaagtacatcgaggacatgaacagaagaagagacaacatgaaggagaagctgcggctgaagaatgtgtccctgaaggtgcagaggaagaagatgctgctgcagctgcggcagaaggaggaggtgtctgaggccctgcatgatgtggacttccagcagctgaagattgaaaatgcccagttcctggagaccatcgaggccaggaaccaggagctgacccagctgaagctgagcagcggcaacaccctgcaggtgctgaatgcctacaagagcaagctgcacaaggccatggagatctacctgaacctggacaaggagatcctgctgaggaaggagctgctggagaagattgagaaggagaccctgcaggtggaggaggaccgggccaaggccgaggccgtgaacaagaggctgaggaagcagctggccgagttccgggccccccaggtgatgacctacgtgcgggagaagatcctgaatgctgacctggagaagagcatccgcatgtgggagaggaaggtggagattgctgagatgagcctgaagggccacaggaaggcctggaacaggatgaagatcaccaatgagcagctgcaggccgactacctggccggcaagtag

SEQ ID NO: 37457 - DNA, 2013 bp, Artificial Sequence
  Description of Artificial Sequence: Synthetic coding sequence
atggagggggagcggcgggcctacagcaaggaggtgcaccagaggatcaacaagcagctggaggagatccggcggctggaggaggtgcggggggacctgcaggtgcagatctctgctgcccagaaccaggtgaagaggctgcgggacagccagaggctggagaacatggaccggctgctgaagggccgggcccaggtgcaggccgagattgaggagctgcaggagcagacccgggccctggacaagcagatccaggagtgggagacccgcatcttcacccacagcaagaatgtgcgcagccctggcttcatcctggaccagaaggtgaagatcagaagacgcatccgcatcctggagaaccagctggacagagtgacctgccactttgacaaccagctggtgagaaatgctgccctgcgggaggagctggacctgctgagaattgacaggaaccgctacctgaatgtggacaggaagctgaagaaggagatccaccacctgcaccacctggtgtccaccctcatcctgagcagcaccagcgcctatgctgtgcgggaggaggccaaggccaagatgggcctgctgcgggagagagctgagaaggaggaggcccagagcgagatggaggcccaggtgctgcagaggcagatcctgcacctggagcagctgcaccacttcctgaagctgaagaacaatgaccggcagcctgaccctgatgtgctggagaagcgggagaagcaggccggggaggtggccgagggcgtgtggaagaccagccaggagcggctggtgctgtgctatgaagatgccctgaacaagctgagccagctgatgggagagagtgaccctgacctgctggtgcagaagtacctggagattgaggagaggaactttgctgagttcaacttcatcaatgagcagaacctggagctggagcacgtgcaggaggagatcaaggagatgcaggaggccctggtgtctgcccgggccagcaaggatgaccagcacctgctgcaggagcagcagcagaaggtgctgcagcagaggatggacaaggtgcacagcgaggccgagcggctggaggcccgcttccaggatgtgcggggccagctggagaagctgaaggctgacatccagctgctcttcaccaaggcccactgtgacagctccatgattgatgacctgctgggcgtgaagacctccatgggagaccgggacatgggcctcttcctgagcctcatcgagaagaggctggtggagctgctgactgtgcaggccttcctgcacgcccagagcttcaccagcctggctgatgctgccctgctggtgctgggccagagcctggaggacctgcccaagaagatggcccccctgcagcccccagacaccctggaggaccccccaggctttgaggccagtgatgactaccccatgagccgggaggagctgctgagccaggtggagaagctggtggagctgcaggagcaggccgaggcccagaggcagaaggacctggccgctgctgctgccaagctggatggcaccctgtctgtggacctggccagcacccagagagctggcagcagcacagtgctggtgcccaccaggcacccccacgccatccctggcagcatcctgagccacaagaccagccgggaccggggcagcctgggccacgtgaccttcggcggcctgagcagcagcacaggccacctgcccagccacatcacccacggggaccccaacacaggccacgtgaccttcggcagcaccagcgccagcagcggcggccacgtgaccttccggcctgtgtctgccagcagctacctgggcagcacaggctacgtgggcagcagcagaggaggagaaaatacagaaggaggagtggagagcggcggcacagccagtgacagcagcggcggcctgggcagcagccgggaccacgtgagcagcacaggccctgccagcagcacaggccctggcagcagcaccagcaaggacagccggggctag

SEQ ID NO: 37458 - DNA, 1842 bp, Artificial Sequence
  Description of Artificial Sequence: Synthetic coding sequence
atggcccgctgccgccaccacagcggctacctggctgatgatgaggccagccacagcatgtgcagcgcccgggtgcagctgcccaagaagcccctggtgcctgagatgaggcctgcctgcaagccaggccgggtgccccacccccccagcacctgtggcagcagcgccctgcagggccagaggaggaacaagaggcacccccagcccttcggccacttcctggacttcctgacagagagccaggtgctggacagcctggagaccgtggtggagaaggccacagagaggatggccgccatgaagacagaggccggcgtgcccctggtggaggtgcaggaccctgtggaggtgcccagcggcggccggcgggcccacgcccggcccagcctgagcacagtgcaccgccaccgggtgcggcccaccctgtgcaccggccaccccaacaactaccccagcagcagcagctccatgagcaactgccacagcagcctgatggccggctgcctgggcagccacagccgggacagcgacctgggcgcccagggcagcctgccccctgtgcgggacaagctgctgctggagaagaacctgaagaggctgctgcagctggagcgggagggcaagggcctgagccagagctgcagccagagggacagcctgctgtgggacagcctgggcagccagaccagcttccagtggacccaggagcagcccctgtcctggttcagcggcctgctgggcagcagcagcggcgtgcctgaggccagcgagcccaggcctggagagcaggagcccatcttcaggaagcgggagttcaacaaggagatcaagagcctgctgagccagctggagagcctggacctgcccggctactgccccctgcgggagccccacaggaccctgaacttcctggccgaccacaggctcttccctgccctgcagagcgtggtgtcccaggccgtggacaagctgcggggggcccactgcagagatggccggcccctcttccccaccagcctggagcccaccagtgacctgccccccctgggcagcgagcccgccaagcccaccaacggcggccagccctatgccagcccccggcccaccgtgagcagccccaagatgctgcagaggaagaggaaggaccggggcggcagccccagcatgagcagcgcccaggtggccacccgcttcaagctgaagagcccctgcagcagcagccgcttcaccaagaagaagcccctgcccagcatcagcagcaagagctccatgagccacttcagcaaccggctgtatgaggagctggccgacttcctgacccagcaggccgccagcctggtgatcagaaaatatgaatttgagaaggacctgagcaagcagctgggcttcttctccttccccatcacccacgtgctgcgggacctgagcctgggcctgaagaaggtgaagggcagccgcatccacctgagcagcgagacccacaggagctgcctgctgaggaagctggaggagagcaagagggcccggcaggccagccggctgagcaccagccactgcagcacagagaccccatctgtgcagcaggagcccgccacccacacagcccaggaccaggccacagagccctgccgcagcctgtacaccaacctgcctgccagccggcagctgagccccctggagcccaagctgtacatgtctgcctgcaccggcatgggcagcagcccccccaagagcaaggacatggacaatgaaggccgggacaaggccgagattgaagatgaagatgaagatgagttcaaggatgaggaccaggatgaggacaaggatgaagatggagtgtag

SEQ ID NO: 37459 - DNA, 840 bp, Artificial Sequence
  Description of Artificial Sequence: Synthetic coding sequence
atggccgccctgggccggcccttcagcggcctgcccctgagcggcggcagtgacttcctgcagcccccccagcctgccttccctggccgggccttccccccaggagcagatggagctgagctggcccccaggcctggccccagggctgtgcccagcagccctgctggcagcgctgcccggggccgggtgtctgtgcactgcaagaagaagcacaagcgggaggaggaggaggatgatgactgccctgtgaggaagaagaggatcacagaagctgagctgtgtgccggccccaatgactggatcctgtgtgcccaccaggatgtggagggccatggagtgaaccccagcgtgtctggcctgagcatccctggcatcctggatgtgatctgtgaggagatggaccagaccactggagagccccagtgtgaggtggcccggaggaagctgcaggagattgaagatcgcatcattgatgaagatgaggaggtggaggccgacagaaatgtgaaccacctgcccagcctggtgctgagtgacaccatgaagacaggcctgaagcgggagtttgatgaggtgttcaccaagaagatgattgagagcatgagccggcccagcatggagctggtgctgtggaagcccctgcctgagctgctgagtgacaagcccaagcccagcagcaacaccaagaactacaccggggagagccaggccaagcacgtggccgccggcacagccttcccccagaggacagagctgttcagcgagccccggcccaccggcatgagcctgtacaacagcctggagacagccaccagcacagaggaggagatggagctgtag

SEQ ID NO: 37460 - DNA, 615 bp, Artificial Sequence
  Description of Artificial Sequence: Synthetic coding sequence
atggccgccctgggccggcccttcagcggcctgcccctgagcggcggcagtgacttcctgcagcccccccagcctgccttccctggccgggccttccccccaggagcagatggagctgagctggcccccaggcctggccccagggctgtgcccagcagccctgctggcagcgctgcccggggccgggtgtctgtgcactgcaagaagaagcacaagcgggaggaggaggaggatgatgagatcattgatgaagatgaggaggtggaggccgacagaaatgtgaaccacctgcccagcctggtgctgagtgacaccatgaagacaggcctgaagcgggagtttgatgaggtgttcaccaagaagatgattgaatccatgagccggcccagcatggagctggtgctgtggaagcccctgcctgagctgctgagtgacaagcccaagcccagcagcaacaccaagaactacacaggagagagccaggccaagcacgtggccgccggcacagccttcccccagaggacagagctgttcagcgagccccggcccaccggcatgagcctgtacaacagcctggagacagccaccagcacagaggaggagatggagctgtag

SEQ ID NO: 37461 - DNA, 444 bp, Artificial Sequence
  Description of Artificial Sequence: Synthetic coding sequence
atggaccagaccactggagagccccagtgtgaggtggcccggaggaagctgcaggagattgaagatcgcatcattgatgaagatgaggaggtggaggccgacagaaatgtgaaccacctgcccagcctggtgctgagtgacaccatgaagacaggcctgaagcgggagtttgatgaggtgttcaccaagaagatgattgagagcatgagccggcccagcatggagctggtgctgtggaagcccctgcctgagctgctgagtgacaagcccaagcccagcagcaacaccaagaactacaccggggagagccaggccaagcacgtggccgccggcacagccttcccccagaggacagagctgttcagcgagccccggcccaccggcatgagcctgtacaacagcctggagacagccaccagcacagaggaggagatggagctgtag

SEQ ID NO: 37462 - DNA, 786 bp, Artificial Sequence
  Description of Artificial Sequence: Synthetic coding sequence
atggccgccctgggccggcccttcagcggcctgcccctgagcggcggcagtgacttcctgcagcccccccagcctgccttccctggccgggccttccccccaggagcagatggagctgagctggcccccaggcctggccccagggctgtgcccagcagccctgctggcagcgctgcccggggccgctgccctgtgaggaagaagaggatcacagaagctgagctgtgtgccggccccaatgactggatcctgtgtgcccaccaggatgtggagggccatggagtgaaccccagcgtgtctggcctgagcatccctggcatcctggatgtgatctgtgaggagatggaccagaccactggagagccccagtgtgaggtggcccggaggaagctgcaggagattgaagatcgcatcattgatgaagatgaggaggtggaggccgacagaaatgtgaaccacctgcccagcctggtgctgagtgacaccatgaagacaggcctgaagcgggagtttgatgaggtgttcaccaagaagatgattgagagcatgagccggcccagcatggagctggtgctgtggaagcccctgcctgagctgctgagtgacaagcccaagcccagcagcaacaccaagaactacaccggggagagccaggccaagcacgtggccgccggcacagccttcccccagaggacagagctgttcagcgagccccggcccaccggcatgagcctgtacaacagcctggagacagccaccagcacagaggaggagatggagctgtag

SEQ ID NO: 37463 - DNA, 540 bp, Artificial Sequence
  Description of Artificial Sequence: Synthetic coding sequence
atgcaggacggcaggaagggcggggcctatgccggcaagatggaggccaccacagctggggtgggccgcctggaggaggaggccctgcggaggaaggagcggctgaaggccctgcgggagaagacaggcaggaaggacaaggaggatggagagcccaagaccaagcacctgcgggaggaggaggaggagggggagaagcaccgggagctgcggctgagaaattatgtgcctgaagatgaggacctgaagaagagaagagtgccccaggccaagcctgtggccgtggaggagaaggtgaaggagcagctggaggccgccaagccagagcccgtcatcgaggaggtggacctggccaacctggcccccaggaagccagactgggacctgaagagagatgtggccaagaagctggagaagctgaagaagaggacccagagggccatcgccgagctgatccgggagcggctgaagggccaggaggacagcctggccagcgctgtggatgctgccacagagcagaagacctgtgacagcgactag

SEQ ID NO: 37464 - DNA, 540 bp, Artificial Sequence; identical to SEQ ID NO: 37463
  Description of Artificial Sequence: Synthetic coding sequence

SEQ ID NO: 37465 - DNA, 309 bp, Artificial Sequence
  Description of Artificial Sequence: Synthetic coding sequence
atgcaggacggcaggaagggcggggcctatgccggcaagatggaggccaccacagctggggtgggccgcctggaggaggaggccctgcggaggaaggagcggctgaaggccctgcgggagaagacaggcaggaaggacaaggaggatggagagcccaagaccaagcacctgcgggaggaggaggaggagggggagaagcaccgggagctgcggctgagaaattatgtgcctgaagatgaggacctgaagaagagaagagtgccccaggccaagcctgtggccgtggaggagaaggtgaaggagcagtag

SEQ ID NO: 37466 - DNA, 501 bp, Artificial Sequence
  Description of Artificial Sequence: Synthetic coding sequence
atggaggccaccacagctggggtgggccgcctggaggaggaggccctgcggaggaaggagcggctgaaggccctgcgggagaagacaggcaggaaggacaaggaggatggagagcccaagaccaagcacctgcgggaggaggaggaggagggggagaagcaccgggagctgcggctgaggaactacgtgcctgaagatgaggacctgaagaagagaagagtgccccaggccaagcctgtggccgtggaggagaaggtgaaggagcagctggaggccgccaagccagagcctgtgattgaggaggtggacctggccaacctggcccccaggaagccagactgggacctgaagagagatgtggccaagaagctggagaagctgaagaagaggacccagagggccatcgccgagctgatccgggagcggctgaagggccaggaggacagcctggccagcgctgtggatgctgccacagagcagaagacctgtgacagcgactag

SEQ ID NO: 37467 - DNA, 1893 bp, Artificial Sequence
  Description of Artificial Sequence: Synthetic coding sequence
atggaggtgaagggccagctgatcagcagccccaccttcaatgccccagctgccctgtttggagaggccgccccccaggtgaagtctgagcggctgcggggcctgctggaccggcagaggaccctgcaggaggccctgagcctgaagctgcaggagctgaggaaggtgtgcctgcaggaggccgagctgaccggccagctgcccccagagtgccccctggagcctggagagcggccccagctggtgagaagaagaccacccacagcccgggcctaccccccaccccaccccaaccaggcccaccacagcctgtgcccagctgaggagctggccctggaggccctggagcgggaggtgtctgtgcagcagcagattgctgctgctgcccggcggctggccctggccccagacctgagcacagagcagaggagaagaagacggcaggtgcaggctgatgccctgcggcggctgcacgagctggaggagcagctgagagatgtgcgggcccggctgggcctgcctgtgctgcccctgccccagcccctgcccctgagcacaggcagcgtcatcaccacccagggcgtgtgcctgggcatgaggctggcccagctgagccaggaggatgtggtgctgcacagcgagagcagcagcctgtctgagagcggggccagccatgacaatgaggagccccacggctgcttcagcctggccgagcggcccagcccccccaaggcctgggaccagctgcgggctgtgtctgggggcagccctgagaggaggaccccctggaagcccccacccagcgacctgtatggagacctgaagagcagaagaaacagcgtggccagccccaccagccccaccaggagcctgcccaggtctgccagcagctttgagggccgctctgtgcctgccacccctgtgctgaccagaggagctggcccccagctgtgcaagccagagggcctgcacagccggcagtggagcggcagccaggacagccagatgggcttccccagggctgaccctgccagtgaccgggccagcctgtttgtggcccggacccggcgcagcaacagcagcgaggccctgctggtggacagagctgctgggggcggggccggcagccccccagcccccctggcccccagcgccagcggcccccctgtgtgcaagagcagcgaggtgctgtatgaaagaccccagcccaccccagccttcagcagcaggacagctggccccccagaccccccccgggccgcccggcccagcagcgctgccccagccagcagaggagccccccggctgccccctgtgtgtggggacttcctgctggactacagcctggaccggggcctgcccaggtctgggggcggcaccggctggggcgagctgcccccagctgctgaggtgcccggccccctgagcagaagagatggcctgctgaccatgctgcccggccccccacctgtgtatgctgctgacagcaacagccccctgctgcggaccaaggacccccacacccgggccaccaggaccaagccctgtggcctgcccccagaggccgctgagggccctgaggtgcaccccaaccccctgctgtggatgcccccacccacccgcatccccagcgctggggagaggagcggccacaagaacctggccctggagggcctgcgggactggtacatcagaaattctggcctggccgccggcccccagaggaggcctgtgctgcccagcgtgggccccccccacccccccttcctgcacgcccgctgctatgaggtgggccaggccctgtatggagcccccagccaggcccccctgccccacagccgctccttcaccgcccctcctgtgtctggccgctatggaggctgcttctactag

SEQ ID NO: 37468 - DNA, 1986 bp, Artificial Sequence
  Description of Artificial Sequence: Synthetic coding sequence
atggaggtgaagggccagctgatcagcagccccaccttcaatgccccagctgccctgtttggagaggccgccccccaggtgaagtctgagcggctgcggggcctgctggaccggcagaggaccctgcaggaggccctgagcctgaagctgcaggagctgaggaaggtgtgcctgcaggaggccgagctgaccggccagctgcccccagagtgccccctggagcctggagagcggccccagctggtgagaagaagaccacccacagcccgggcctaccccccaccccaccccaaccaggcccaccacagcctgtgcccagctgaggagctggccctggaggccctggagcgggaggtgtctgtgcagcagcagattgctgctgctgcccggcggctggccctggccccagacctgagcacagagcagaggagaagaagacggcaggtgcaggctgatgccctgcggcggctgcacgagctggaggagcagctgagagatgtgcgggcccggctgggcctgcctgtgctgcccctgccccagcccctgcccctgagcacaggcagcgtcatcaccacccagggcgtgtgcctgggcatgaggctggcccagctgagccaggaggatgtggtgctgcacagcgagagcagcagcctgtctgagagcggggccagccatgacaatgaggagccccacggctgcttcagcctggccgagcggcccagcccccccaaggcctgggaccagctgcgggctgtgtctgggggcagccctgagaggaggaccccctggaagcccccacccagcgacctgtatggagacctgaagagcagaagaaacagcgtggccagccccaccagccccaccaggagcctgcccaggtctgccagcagctttgagggccgctctgtgcctgccacccctgtgctgaccagaggagctggcccccagctgtgcaagccagagggcctgcacagccggcagtggagcggcagccaggacagccagatgggcttccccagggctgaccctgccagtgaccgggccagcctgtttgtggcccggacccggcgcagcaacagcagcgaggccctgctggtggacagagctgctgggggcggggccggcagccccccagcccccctggcccccagcgccagcggcccccctgtgtgcaagagcagcgaggtgctgtatgaaagaccccagcccaccccagccttcagcagcaggacagctggccccccagaccccccccgggccgcccggcccagcagcgctgccccagccagcagaggagccccccggctgccccctgtgtgtggggacttcctgctggactacagcctggaccggggcctgcccaggtctgggggcggcaccggctggggcgagctgcccccagctgctgaggtgcccggccccctgagcagaagagatggcctgctgaccatgctgcccggccccccacctgtgtatgctgctgacagcaacagccccctgctgcggaccaaggacccccacacccgggccaccaggaccaagccctgtggcctgcccccagaggccgctgagggccctgaggtgcaccccaaccccctgctgtggatgcccccacccacccgcatccccagcgctggggagaggagcggccacaagaacctggccctggagggcctgcgggactggtacatcagaaattctggcctggccgccggcccccagaggaggcctgtgctgcccagcgtgggccccccccacccccccttcctgcacgcccgctgctatgaggtgggccaggccctgtatggagcccccagccaggcccccctgccccacagccgctccttcaccgcccctcctgtgtctggccgctactatgctgacttcctgtacccacctgagctgagcgcccggctgagtgacctgaccctggagggggagcagagcagcagcagtgacacccagaccccaggcaccctggtgtag

SEQ ID NO: 37469 - DNA, 1857 bp, Artificial Sequence
  Description of Artificial Sequence: Synthetic coding sequence
atggaggtgaaggccgccctgtttggagaggccgccccccaggtgaagtctgagcggctgcggggcctgctggaccggcagaggaccctgcaggaggccctgagcctgaagctgcaggagctgaggaaggtgtgcctgcaggaggccgagctgaccggccagctgcccccagagtgccccctggagcctggagagcggccccagctggtgagaagaagaccacccacagcccgggcctaccccccaccccaccccaaccaggcccaccacagcctgtgcccagctgaggagctggccctggaggccctggagcgggaggtgtctgtgcagcagcagattgctgctgctgcccggcggctggccctggccccagacctgagcacagagcagaggagaagaagacggcaggtgcaggctgatgccctgcggcggctgcacgagctggaggagcagctgagagatgtgcgggcccggctgggcctgcctgtgctgcccctgccccagcccctgcccctgagcacaggcagcgtcatcaccacccagggcgtgtgcctgggcatgaggctggcccagctgagccaggaggatgtggtgctgcacagcgagagcagcagcctgtctgagagcggggccagccatgacaatgaggagccccacggctgcttcagcctggccgagcggcccagcccccccaaggcctgggaccagctgcgggctgtgtctgggggcagccctgagaggaggaccccctggaagcccccacccagcgacctgtatggagacctgaagagcagaagaaacagcgtggccagccccaccagccccaccaggagcctgcccaggtctgccagcagctttgagggccgctctgtgcctgccacccctgtgctgaccagaggagctggcccccagctgtgcaagccagagggcctgcacagccggcagtggagcggcagccaggacagccagatgggcttccccagggctgaccctgccagtgaccgggccagcctgtttgtggcccggacccggcgcagcaacagcagcgaggccctgctggtggacagagctgctgggggcggggccggcagccccccagcccccctggcccccagcgccagcggcccccctgtgtgcaagagcagcgaggtgctgtatgaaagaccccagcccaccccagccttcagcagcaggacagctggccccccagaccccccccgggccgcccggcccagcagcgctgccccagccagcagaggagccccccggctgccccctgtgtgtggggacttcctgctggactacagcctggaccggggcctgcccaggtctgggggcggcaccggctggggcgagctgcccccagctgctgaggtgcccggccccctgagcagaagagatggcctgctgaccatgctgcccggccccccacctgtgtatgctgctgacagcaacagccccctgctgcggaccaaggacccccacacccgggccaccaggaccaagccctgtggcctgcccccagaggccgctgagggccctgaggtgcaccccaaccccctgctgtggatgcccccacccacccgcatccccagcgctggggagaggagcggccacaagaacctggccctggagggcctgcgggactggtacatcagaaattctggcctggccgccggcccccagaggaggcctgtgctgcccagcgtgggccccccccacccccccttcctgcacgcccgctgctatgaggtgggccaggccctgtatggagcccccagccaggcccccctgccccacagccgctccttcaccgcccctcctgtgtctggccgctatggaggctgcttctactag

SEQ ID NO: 37470 - DNA, 837 bp, Artificial Sequence
  Description of Artificial Sequence: Synthetic coding sequence
atgacagacctgaacaagcacatcaagcaggcccagacccagaggaagcagctgctggaggagagccgggagctgcaccgggagaagctgctggtgcaggctgaaaatcgcttcttcctggagtacctgaccaacaagacagaggagtacacagagcagcctgagaaggtgtggaacagctacctgcagaagtctggagaaattgaaagaagacggcaggagagcgccagccgctatgcagagcagatctctgtgctgaagacagccctgctgcagaaggagaacatccagagcagcctgaagaggaagctgcaggccatgagggacatcgccatcctgaaggagaagcaggagaaggagatccagaccctgcaggaggagaccaagaaggtgcaggccgagacagccagcaagacccgggaggtgcaggcccagctgctgcaggagaagaggctgctggagaagcagctgtctgagccagaccggcggctgctgggcaagaggaagaggcgggagctgaacatgaaggcccaggccctgaagctggccgccaagcgcttcatctttgagtacagctgtggcatcaaccgggagaaccagcagttcaagaaggagctgctgcagctgattgagcaggcccagaagctgacagccacccagagccacctggagaacaggaagcagcagctgcagcaggagcagtggtacctggagagcctcatccaggcccggcagaggctgcagggcagccacaaccagtgcctgaaccggcaggatgtgcccaagaccacccccagcctgccccagggcaccaagagccgcatcaaccccaagtag

SEQ ID NO: 37471 - DNA, 1323 bp, Artificial Sequence
  Description of Artificial Sequence: Synthetic coding sequence
atgggcagccggggccagggcagccacagcaagaagaccaggtccatgcctgtgatcctgagcccccagaggactggaagtggggccaccggcggccctgctgcccgggcctacagcgtggccgaggccgtgaagcagttccgggccggccctgctggcaccggggccggctgcagcctgcagggctgctgggccgccccccggccctttgagcacaggaccaacaagctgcgggagctgagcaccctggcccactgcagccgggagctgcagacccaggtgcctgatgccagcgcccacagcctggccgtgaccctgtctgagctgcacagctgccgggacctgcaggatgagtgcctggacagcagatttgctgagggcccccggcggctgctgcccccctaccacagcctcatcaacaactttgtgaagccagagaagctgaccaaggtggagacccggctgaaggagaagatcgtggccgagatgacagacctgaacaagcacatcaagcaggcccagacccagaggaagcagctgctggaggagagccgggagctgcaccgggagaagctgctggtgcaggctgaaaatcgcttcttcctggagtacctgaccaacaagacagaggagtacacagagcagcctgagaaggtgtggaacagctacctgcagaagtctggagaaattgaaagaagacggcaggagagcgccagccgctatgcagagcagatctctgtgctgaagacagccctgctgcagaaggagaacatccagagcagcctgaagaggaagctgcaggccatgagggacatcgccatcctgaaggagaagcaggagaaggagatccagaccctgcaggaggagaccaagaaggtgcaggccgagacagccagcaagacccgggaggtgcaggcccagctgctgcaggagaagaggctgctggagaagcagctgtctgagccagaccggcggctgctgggcaagaggaagaggcgggagctgaacatgaaggcccaggccctgaagctggccgccaagcgcttcatctttgagtacagctgtggcatcaaccgggagaaccagcagttcaagaaggagctgctgcagctgattgagcaggcccagaagctgacagccacccagagccacctggagaacaggaagcagcagctgcagcaggagcagtggtacctggagagcctcatccaggcccggcagaggctgcagggcagccacaaccagtgcctgaaccggcaggatgtgcccaagaccacccccagcctgccccagggcaccaagagccgcatcaaccccaagtag

SEQ ID NO: 37472 - DNA, 672 bp, Artificial Sequence
  Description of Artificial Sequence: Synthetic coding sequence
atgcccaagaagttccagggcgagaacaccaagtctgctgctgcccgggcccggcgggcagaggccaaggctgctgctgatgccaagaagcagaaggagctggaggatgcctactggaaggatgatgacaagcacgtgatgaggaaggagcagaggaaggaggagaaggagaagaggcggctggaccagctggagaggaagaaggagacccagaggctgctggaggaggaggacagcaagctgaagggcggcaaggccccccgggtggccaccagcagcaaggtgacccgggcccagatcgaggacaccctgcggcgggaccaccagctgcgggaggccccagacacagctgagaaggccaagagccacctggaggtgcccctggaggagaatgtgaacagaagagtgctggaggagggctctgtggaggcccggaccattgaagatgccatcgctgtgctgtctgtggccgaggaggccgctgacagacaccctgagaggaggatgagagctgccttcaccgcctttgaggaggcccagctgccccggctgaagcaggagaaccccaacatgaggctgagccagctgaagcagctgctgaagaaggagtggctgcggagcccagacaaccccatgaaccagagagctgtgcccttcaatgcccccaagtag

SEQ ID NO: 37473 - DNA, 672 bp, Artificial Sequence; identical to SEQ ID NO: 37472
  Description of Artificial Sequence: Synthetic coding sequence

SEQ ID NO: 37474 - DNA, 783 bp, Artificial Sequence
  Description of Artificial Sequence: Synthetic coding sequence
atgaacaacctgaatgacccccccaactggaacatccggcccaacagcagagcagatggaggagatggcagccgctggaactatgccctgctggtgcccatgctgggcctggccgccttccgctggatctggagccgggagagccagaaggaggtggagaaggagcgggaggcctacagaagaagaacagctgccttccagcaggacctggaggccaagtaccacgccatgatcagcgagaacagaagagctgtggcccagctgagcctggagctggagaaggagcagaacagaacagccagctaccgggaggccctgatcagccagggcaggaagctggtggaggagaagaagctgctggagcaggagcgggcccaggtgatgcaggagaagaggcaggtgcagcccctgcggagcgcctacctgagctgcctgcagcgggaggagaactggcagaggcgggcccggctgctgctgaaggagtttgaggccgtgctgacagagcggcagaacatctactgcagcctcttcctgcccaggagcaagaggctggagattgagaagagcctgctggtgcgggcctctgtggaccctgtggccgctgacctggagatggctgctggcctgacagacatcttccagcacgacacctactgtggagatgtgtggaacaccaacaagaggcagaatggccgcctgatgtggctgtacctgaagtactgggagctggtggtggagctgaagaagttcaagagggtggaggaggccatcctggagaagtag

SEQ ID NO: 37475 - DNA, 210 bp, Artificial Sequence
  Description of Artificial Sequence: Synthetic coding sequence
atgaacaacctgaatgacccccccaactggaacatccggcccaacagcagagcagatggaggagatggcagccgctggaactatgccctgctggtgcccatgctgggcctggccgccttccgctggatctggagccgggagagccagaaggaggtggagaaggagcgggaggcctacagaagaagaacagctgccttccagcaggactag

SEQ ID NO: 37476 - DNA, 2691 bp, Artificial Sequence
  Description of Artificial Sequence: Synthetic coding sequence
atgatggcccagaagagccagggcagtgacaacctgcaggagggccaggagaagagcaagcgggagatcctgaagtgcaccaagagcgcctgggcccccctggatgagtggctgcccccagaccctgaggaggagagccagagcctgaccatccccatgctggaggacagcaagcaggagagcatccagcagtggctggacagcggcttctttgtgtctgccaatgaaaacttccagcaggtgattgacagaacagtgtccctgtatgagcagggcatggtgcagatgacagtgaaggactacatgaggagcctgcaccagttcagcgagacccccatcctgagccggggcaccagcttcaacagctgctacagcacagcctctgtgccccagagcatccctgagtggctggagttctgggagattgatcctgtggagatcctgctggacctgggctttggagcagatgagccagacatctgcatgcagatcccagcccgcttcctgggctgcggcagcgctgcccggggcatcaacatccgggtcttcctggaggcccagaagcagaggatggacatcgagaaccccaacctgtatggccgcttccggcagctggagatcctggaccacgtgaccaatgccttcagcagcctgctgagtgatgtgtccatcctgcccaacagagctgaggagaaggccggcggggagagcgtgcagaggacctctgtgcagagctttgaggaggagaccggcaaccccctggacatgaccagcggcaccgtgggcgcccgggtggaccgggccaacagctgccagagcgacagcagcggcttcctggaggagcccctggagcccctgcccctgcagatgcccagcctgcccaacagccagagccctgcagaaaatggaggcaggaagccccgggaccagagccacagcctggtgagcagccaggactgccagctggagagtgatggccctgacagcaagagccgggcctccatgtccttcagcagccaggaggccaatgccctggagcagagggcctctgtgtctgtgatggaggaggagttcctgctggaggccatggagggccccccagagctgtacatcccagacatggcctgtgccaagaccaccaccagaggagagtgccccaggaaggacagccacctgtggcagctgctgcccatgcctcatgctgaatatgaggtgacccggcccacagccaccagcaaatatgaccaccccctgggcttcatggtgacccacgtgacagagatgcaggacagctttgtgcggcctgagggcgctgggaaggtgcagagccaccacaatgaaagccagaggagccctggaaatgaccacacccaggacaagttcctgcacgtggacagcgaggccccccgggaggaggagagcagcggcttctgcccccacaccaaccacagcctgctggtgcctgagagcagcagccagtgcatccccaagcacagcgagatcaccccctatgccacagacctggcccagaccagcgagaagctgatcccccacctgcacaagctgcccggggaccctgcccaggtgaagagccgcagcggcaccctgggccagatcctgcctggaacagaagctgagatggagaacctgcccctgaacacaggcagcagccgctctgtgatgacccagatgagcagcagcctggtgtctgctgcccagagagctgtggccctgggcaccggcccccggggcaccagcctggagtgcaccgtgtgtgaccctgtgacagccacagagacccggctgggcaccaaggcccggcagctgaatgatgccagcatccagaccagcgccctgagcaacaagaccctgacccacggcccccagcccctgaccaagtctgtgtccctggacagcggcttcagcagcatctgccccatgggcacctgccacgccatcccagcccactgctgcatctgctgccaccaccacccccactgccacggggagcggcagagccctggccctgagcccagcgtgtgccgccactgcctgtgcagcctgaccggccaccaggaggcccagttcatgaccaccctgaaggccctgcaggacaccaccgtgcgggagctgtgcagctgcaccgtgcatgagatggaggccatgaagaccatctgccagagcttccgggagtacctggaggagattgagcagcacctgatgggccagcaggccctcttcagccgggacatgtctgaggaggagcgggaggaggccgagcagctgcagaccctgcgggaggccctgcggcagcaggtggccgagctggagttccagctgggggaccgggcccagcagatccgggagggcatcctgctgcagctggaggtgctgacagctgagcccccagagcactacagcaacctgcaccagtacaactggattgaggagagcaatggccagaccagctgcagcaagatccaccctggcatggcccccaggacagtgttccccccagatgatggccaggaggccccctgcagcggcggcacccagctggccgccttcaccccacccaccctggagaacagcaccaggatgagccccagcagcagcgcctgggccaagctgggccccacccccctgagcaactgccctgtgggggagaaggatgctgatgtgttcctgtag

SEQ ID NO: 37477 - DNA, 3135 bp, Artificial Sequence
  Description of Artificial Sequence: Synthetic coding sequence
atgatggcccagaagagccagggcagtgacaacctgcaggagggccaggagaagagcaagcgggagatcctgaagtgcaccaagagcgcctgggcccccctggatgagtggctgcccccagaccctgaggaggagagccagagcctgaccatccccatgctggaggacagcaagcaggagagcatccagcagtggctggacagcggcttctttgtgtctgccaatgaaaacttccagcaggtgattgacagaacagtgtccctgtatgagcagggcatggtgcagatgacagtgaaggactacatgaggagcctgcaccagttcagcgagacccccatcctgagccggggcaccagcttcaacagctgctacagcacagcctctgtgccccagagcatccctgagtggctggagttctgggagattgatcctgtggagatcctgctggacctgggctttggagcagatgagccagacatctgcatgcagatcccagcccgcttcctgggctgcggcagcgctgcccggggcatcaacatccgggtcttcctggaggcccagaagcagaggatggacatcgagaaccccaacctgtatggccgcttccggcagctggagatcctggaccacgtgaccaatgccttcagcagcctgctgagtgatgtgtccatcctgcccaacagagctgaggagaaggccggcggggagagcgtgcagaggacctctgtgtctgctgccaaggagcacagaagaaggatgggcaagctgctgcggcgggccagcaagcagaacatccggcgggactgcaaccctgaggtgtctgagagcttcaaggtgaaggatgaggtgtttgtgcccttcaccaagccctgggactgtggggctgagctggccgccaccagcatcaaccacaagcagaaccacctgagcctgtctgtggagcaccagagcctgcaggcctgtgatgacctgctgccctacccaccccacggcctgctgagcaagcagtggccctgcagctccatgcctgccaagcaggccccacccagctgtgtgtctgagggctctgtgaagggccgcacccagaaggagaacctcttccagaccaacaagctgaagagcctgagccacctggccgggaaaggaccagacagctttgagatggaggaggtgcagagctttgaggaggagaccggcaaccccctggacatgaccagcggcaccgtgggcgcccgggtggaccgggccaacagctgccagagcgacagcagcggcttcctggaggagcccctggagcccctgcccctgcagatgcccagcctgcccaacagccagagccctgcagaaaatggaggcaggaagccccgggaccagagccacagcctggtgagcagccaggactgccagctggagagtgatggccctgacagcaagagccgggcctccatgtccttcagcagccaggaggccaatgccctggagcagagggcctctgtgtctgtgatggaggaggagttcctgctggaggccatggagggccccccagagctgtacatcccagacatggcctgtgccaagaccaccaccagaggagagtgccccaggaaggacagccacctgtggcagctgctgcccatgcctcatgctgaatatgaggtgacccggcccacagccaccagcaaatatgaccaccccctgggcttcatggtgacccacgtgacagagatgcaggacagctttgtgcggcctgagggcgctgggaaggtgcagagccaccacaatgaaagccagaggagccctggaaatgaccacacccaggacaagttcctgcacgtggacagcgaggccccccgggaggaggagagcagcggcttctgcccccacaccaaccacagcctgctggtgcctgagagcagcagccagtgcatccccaagcacagcgagatcaccccctatgccacagacctggcccagaccagcgagaagctgatcccccacctgcacaagctgcccggggaccctgcccaggtgaagagccgcagcggcaccctgggccagatcctgcctggaacagaagctgagatggagaacctgcccctgaacacaggcagcagccgctctgtgatgacccagatgagcagcagcctggtgtctgctgcccagagagctgtggccctgggcaccggcccccggggcaccagcctggagtgcaccgtgtgtgaccctgtgacagccacagagacccggctgggcaccaaggcccggcagctgaatgatgccagcatccagaccagcgccctgagcaacaagaccctgacccacggcccccagcccctgaccaagtctgtgtccctggacagcggcttcagcagcatctgccccatgggcacctgccacgccatcccagcccactgctgcatctgctgccaccaccacccccactgccacggggagcggcagagccctggccctgagcccagcgtgtgccgccactgcctgtgcagcctgaccggccaccaggaggcccagttcatgaccaccctgaaggccctgcaggacaccaccgtgcgggagctgtgcagctgcaccgtgcatgagatggaggccatgaagaccatctgccagagcttccgggagtacctggaggagattgagcagcacctgatgggccagcaggccctcttcagccgggacatgtctgaggaggagcgggaggaggccgagcagctgcagaccctgcgggaggccctgcggcagcaggtggccgagctggagttccagctgggggaccgggcccagcagatccgggagggcatcctgctgcagctggaggtgctgacagctgagcccccagagcactacagcaacctgcaccagtacaactggattgaggagagcaatggccagaccagctgcagcaagatccaccctggcatggcccccaggacagtgttccccccagatgatggccaggaggccccctgcagcggcggcacccagctggccgccttcaccccacccaccctggagaacagcaccaggatgagccccagcagcagcgcctgggccaagctgggccccacccccctgagcaactgccctgtgggggagaaggatgctgatgtgttcctgtag

SEQ ID NO: 37478 - DNA, 429 bp, Artificial Sequence
  Description of Artificial Sequence: Synthetic coding sequence
atgatggcccagaagagccagggcagtgacaacctgcaggagggccaggagaagagcaagcgggagatcctgaagtgcaccaagagcgcctgggcccccctggatgagtggctgcccccagaccctgaggaggagagccagagcctgaccatccccatgctggaggacagcaagcaggagagcatccagcagtggctggacagcggcttctttgtgtctgccaatgaaaacttccagcaggtgattgacagaacagtgtccctgtatgagcagggcatggtgcagatgacagtgaaggactacatgaggagcctgcaccagttcagcgagacccccatcctgagccggggcaccagcttcaacagctgctacagcacagcctctgtgccccagagcatccctgagtggctggagttctgggagatctag

SEQ ID NO: 37479 - DNA, 3189 bp, Artificial Sequence
  Description of Artificial Sequence: Synthetic coding sequence
atgcccaccacagccagctgcaagaccatcagcctgctgaagctgctgtacagcgtgtccctgcagaactacagccccatgatggcccagaagagccagggcagtgacaacctgcaggagggccaggagaagagcaagcgggagatcctgaagtgcaccaagagcgcctgggcccccctggatgagtggctgcccccagaccctgaggaggagagccagagcctgaccatccccatgctggaggacagcaagcaggagagcatccagcagtggctggacagcggcttctttgtgtctgccaatgaaaacttccagcaggtgattgacagaacagtgtccctgtatgagcagggcatggtgcagatgacagtgaaggactacatgaggagcctgcaccagttcagcgagacccccatcctgagccggggcaccagcttcaacagctgctacagcacagcctctgtgccccagagcatccctgagtggctggagttctgggagattgatcctgtggagatcctgctggacctgggctttggagcagatgagccagacatctgcatgcagatcccagcccgcttcctgggctgcggcagcgctgcccggggcatcaacatccgggtcttcctggaggcccagaagcagaggatggacatcgagaaccccaacctgtatggccgcttccggcagctggagatcctggaccacgtgaccaatgccttcagcagcctgctgagtgatgtgtccatcctgcccaacagagctgaggagaaggccggcggggagagcgtgcagaggacctctgtgtctgctgccaaggagcacagaagaaggatgggcaagctgctgcggcgggccagcaagcagaacatccggcgggactgcaaccctgaggtgtctgagagcttcaaggtgaaggatgaggtgtttgtgcccttcaccaagccctgggactgtggggctgagctggccgccaccagcatcaaccacaagcagaaccacctgagcctgtctgtggagcaccagagcctgcaggcctgtgatgacctgctgccctacccaccccacggcctgctgagcaagcagtggccctgcagctccatgcctgccaagcaggccccacccagctgtgtgtctgagggctctgtgaagggccgcacccagaaggagaacctcttccagaccaacaagctgaagagcctgagccacctggccgggaaaggaccagacagctttgagatggaggaggtgcagagctttgaggaggagaccggcaaccccctggacatgaccagcggcaccgtgggcgcccgggtggaccgggccaacagctgccagagcgacagcagcggcttcctggaggagcccctggagcccctgcccctgcagatgcccagcctgcccaacagccagagccctgcagaaaatggaggcaggaagccccgggaccagagccacagcctggtgagcagccaggactgccagctggagagtgatggccctgacagcaagagccgggcctccatgtccttcagcagccaggaggccaatgccctggagcagagggcctctgtgtctgtgatggaggaggagttcctgctggaggccatggagggccccccagagctgtacatcccagacatggcctgtgccaagaccaccaccagaggagagtgccccaggaaggacagccacctgtggcagctgctgcccatgcctcatgctgaatatgaggtgacccggcccacagccaccagcaaatatgaccaccccctgggcttcatggtgacccacgtgacagagatgcaggacagctttgtgcggcctgagggcgctgggaaggtgcagagccaccacaatgaaagccagaggagccctggaaatgaccacacccaggacaagttcctgcacgtggacagcgaggccccccgggaggaggagagcagcggcttctgcccccacaccaaccacagcctgctggtgcctgagagcagcagccagtgcatccccaagcacagcgagatcaccccctatgccacagacctggcccagaccagcgagaagctgatcccccacctgcacaagctgcccggggaccctgcccaggtgaagagccgcagcggcaccctgggccagatcctgcctggaacagaagctgagatggagaacctgcccctgaacacaggcagcagccgctctgtgatgacccagatgagcagcagcctggtgtctgctgcccagagagctgtggccctgggcaccggcccccggggcaccagcctggagtgcaccgtgtgtgaccctgtgacagccacagagacccggctgggcaccaaggcccggcagctgaatgatgccagcatccagaccagcgccctgagcaacaagaccctgacccacggcccccagcccctgaccaagtctgtgtccctggacagcggcttcagcagcatctgccccatgggcacctgccacgccatcccagcccactgctgcatctgctgccaccaccacccccactgccacggggagcggcagagccctggccctgagcccagcgtgtgccgccactgcctgtgcagcctgaccggccaccaggaggcccagttcatgaccaccctgaaggccctgcaggacaccaccgtgcgggagctgtgcagctgcaccgtgcatgagatggaggccatgaagaccatctgccagagcttccgggagtacctggaggagattgagcagcacctgatgggccagcaggccctcttcagccgggacatgtctgaggaggagcgggaggaggccgagcagctgcagaccctgcgggaggccctgcggcagcaggtggccgagctggagttccagctgggggaccgggcccagcagatccgggagggcatcctgctgcagctggaggtgctgacagctgagcccccagagcactacagcaacctgcaccagtacaactggattgaggagagcaatggccagaccagctgcagcaagatccaccctggcatggcccccaggacagtgttccccccagatgatggccaggaggccccctgcagcggggagctgctgtctgctgagctggaccccttcttcttcagcagcaaggccaacaacagcgccaaggatgagaagatcaagagcaaggacttcctgaagacccaggacagcggcctgctgtag

SEQ ID NO: 37480 - DNA, 492 bp, Artificial Sequence
  Description of Artificial Sequence: Synthetic coding sequence
atgatggcccagaagagccagggcagtgacaacctgcaggagggccaggagaagagcaagcgggagatcctgaagtgcaccaagagcgcctgggcccccctggatgagtggctgcccccagaccctgaggaggagagccagagcctgaccatccccatgctggaggacagcaagcaggagagcatccagcagtggctggacagcggcttctttgtgtctgccaatgaaaacttccagcaggtgattgacagaacagtgtccctgtatgagcagggcatggtgcagatgacagtgaaggactacatgaggagcctgcaccagttcagcgagacccccatcctgagccggggcaccagcttcaacagctgctacagcacagcctctgtgccccagagcatccctgagtggctggagttctgggagattgatcctgtggagatcctgctggacctgggctttggagcagatgagccagacatctgcatgcagtag

SEQ ID NO: 37481 - DNA, 507 bp, Artificial Sequence
  Description of Artificial Sequence: Synthetic coding sequence
atgatggcccagaagagccagggcagtgacaacctgcaggagggccaggagaagagcaagcgggagatcctgaagtgcaccaagagcgcctgggcccccctggatgagtggctgcccccagaccctgaggaggagagccagagcctgaccatccccatgctggaggacagcaagcaggagagcatccagcagtggctggacagcggcttctttgtgtctgccaatgaaaacttccagcaggtgattgacagaacagtgtccctgtatgagcagggcatggtgcagatgacagtgaaggactacatgaggagcctgcaccagttcagcgagacccccatcctgagccggggcaccagcttcaacagctgctacagcacagcctctgtgccccagagcatccctgagtggctggagttctgggagattgatcctgtggagatcctgctggacctgggctttggagcagatgagccagacatctgcatgcagatcccagcccgcttctag

SEQ ID NO: 37482 - DNA, 3165 bp, Artificial Sequence
  Description of Artificial Sequence: Synthetic coding sequence
atgtccttcagcctgcagaactacagccccatgatggcccagaagagccagggcagtgacaacctgcaggagggccaggagaagagcaagcgggagatcctgaagtgcaccaagagcgcctgggcccccctggatgagtggctgcccccagaccctgaggaggagagccagagcctgaccatccccatgctggaggacagcaagcaggagagcatccagcagtggctggacagcggcttctttgtgtctgccaatgaaaacttccagcaggtgattgacagaacagtgtccctgtatgagcagggcatggtgcagatgacagtgaaggactacatgaggagcctgcaccagttcagcgagacccccatcctgagccggggcaccagcttcaacagctgctacagcacagcctctgtgccccagagcatccctgagtggctggagttctgggagattgatcctgtggagatcctgctggacctgggctttggagcagatgagccagacatctgcatgcagatcccagcccgcttcctgggctgcggcagcgctgcccggggcatcaacatccgggtcttcctggaggcccagaagcagaggatggacatcgagaaccccaacctgtatggccgcttccggcagctggagatcctggaccacgtgaccaatgccttcagcagcctgctgagtgatgtgtccatcctgcccaacagagctgaggagaaggccggcggggagagcgtgcagaggacctctgtgtctgctgccaaggagcacagaagaaggatgggcaagctgctgcggcgggccagcaagcagaacatccggcgggactgcaaccctgaggtgtctgagagcttcaaggtgaaggatgaggtgtttgtgcccttcaccaagccctgggactgtggggctgagctggccgccaccagcatcaaccacaagcagaaccacctgagcctgtctgtggagcaccagagcctgcaggcctgtgatgacctgctgccctacccaccccacggcctgctgagcaagcagtggccctgcagctccatgcctgccaagcaggccccacccagctgtgtgtctgagggctctgtgaagggccgcacccagaaggagaacctcttccagaccaacaagctgaagagcctgagccacctggccgggaaaggaccagacagctttgagatggaggaggtgcagagctttgaggaggagaccggcaaccccctggacatgaccagcggcaccgtgggcgcccgggtggaccgggccaacagctgccagagcgacagcagcggcttcctggaggagcccctggagcccctgcccctgcagatgcccagcctgcccaacagccagagccctgcagaaaatggaggcaggaagccccgggaccagagccacagcctggtgagcagccaggactgccagctggagagtgatggccctgacagcaagagccgggcctccatgtccttcagcagccaggaggccaatgccctggagcagagggcctctgtgtctgtgatggaggaggagttcctgctggaggccatggagggccccccagagctgtacatcccagacatggcctgtgccaagaccaccaccagaggagagtgccccaggaaggacagccacctgtggcagctgctgcccatgcctcatgctgaatatgaggtgacccggcccacagccaccagcaaatatgaccaccccctgggcttcatggtgacccacgtgacagagatgcaggacagctttgtgcggcctgagggcgctgggaaggtgcagagccaccacaatgaaagccagaggagccctggaaatgaccacacccaggacaagttcctgcacgtggacagcgaggccccccgggaggaggagagcagcggcttctgcccccacaccaaccacagcctgctggtgcctgagagcagcagccagtgcatccccaagcacagcgagatcaccccctatgccacagacctggcccagaccagcgagaagctgatcccccacctgcacaagctgcccggggaccctgcccaggtgaagagccgcagcggcaccctgggccagatcctgcctggaacagaagctgagatggagaacctgcccctgaacacaggcagcagccgctctgtgatgacccagatgagcagcagcctggtgtctgctgcccagagagctgtggccctgggcaccggcccccggggcaccagcctggagtgcaccgtgtgtgaccctgtgacagccacagagacccggctgggcaccaaggcccggcagctgaatgatgccagcatccagaccagcgccctgagcaacaagaccctgacccacggcccccagcccctgaccaagtctgtgtccctggacagcggcttcagcagcatctgccccatgggcacctgccacgccatcccagcccactgctgcatctgctgccaccaccacccccactgccacggggagcggcagagccctggccctgagcccagcgtgtgccgccactgcctgtgcagcctgaccggccaccaggaggcccagttcatgaccaccctgaaggccctgcaggacaccaccgtgcgggagctgtgcagctgcaccgtgcatgagatggaggccatgaagaccatctgccagagcttccgggagtacctggaggagattgagcagcacctgatgggccagcaggccctcttcagccgggacatgtctgaggaggagcgggaggaggccgagcagctgcagaccctgcgggaggccctgcggcagcaggtggccgagctggagttccagctgggggaccgggcccagcagatccgggagggcatcctgctgcagctggaggtgctgacagctgagcccccagagcactacagcaacctgcaccagtacaactggattgaggagagcaatggccagaccagctgcagcaagatccaccctggcatggcccccaggacagtgttccccccagatgatggccaggaggccccctgcagcggcggcacccagctggccgccttcaccccacccaccctggagaacagcaccaggatgagccccagcagcagcgcctgggccaagctgggccccacccccctgagcaactgccctgtgggggagaaggatgctgatgtgttcctgtag

SEQ ID NO: 37483 - DNA, 2148 bp, Artificial Sequence
  Description of Artificial Sequence: Synthetic coding sequence
atggctgctgatgagagcagccagaacaccctgcggctgcagttcaaggccatgcaggagatgcagcacaagaggctgcagaagcagatggagaagaagcgggagaaggagctgagcctgaagagcagagcagatgaccaggaggagcccctggaggtgtctgatggcctgagcctgctgcacgccggggagcccaacagcaagaacagctttgagaagagggtgctggaggatgaaattgagcacctgagaaatgagctgcgggagaccgtggatgaaaatggccgcctgtacaagctgctgaaggagcgggactttgagatcaagcacctgaagaagaagattgaagaagatagatttgccttcaccggcacagctggggtggccggagatgtggtggccaccaagatcgtggagctgagcaagaagaaccggctgctgatggccgagagcgagggcgccaagaccagggtgaagcagctgaccaaccgcatccaggagctggagcgggagctgcagacagccctgacccggctgagcgccaagggggccacagatgctggggccaagccaccccgggcccagatgggagaccgggccctgctggagaccccagaggtgaaggccctgcaggaccggctggtggccaccaacctgaagatgtctgacctgaggaaccagatccagagcgtgaagcaggagctgaggatggcccagaaggtgctggcccgggaggtgggggaggacatcaacgtgcagcagctgctgagcagccctggcacctggaggggccgggcccagcagatcctggtgctgcagagcaaggtgcaggagctggagaagcagctgggccaggcccggagccagagcgctggaacagccagtgatgagctgtctgtgtacccagaccccaggaagctgagcgcccaggagaagaacctgctgcgcatccgcagcctggagcgggagaagcaggagggcctggagaagctggccagcgagagagatgtgctgcagcgggagctggaggagctgaagaagaagtttgagggcatgaggagcaggaacaagctgctgagcagcgagatgaagaccctgaagagccagatgggcaccctggtggagaagggcagacatgatgatgagctgattgatgccctgatggaccagctgaagcagctgcaggagatcctgggcagcctgagcctgcaggaggagaagaccagggtgtcccagcaccacctggaccagcagctgaacagcgaggcccagaggagcaacagcctggtggcccagctgcaggccatggtggccgagcgggaggccaaggtgcggcagctggagatggagatcggccagctgaatgtgcactacctgaggaacaagggcgtgggggagggcagcagcggccgggaggtgtccccagcctacacccagttcctggaggaccccggcctgaccaagagccctgccagcgctggggaccacgtgggccgcctgggcagcagccgctctgtgaccagcctgggccacaccctggtggagagcgccctgacccggcccagcctgcccagcccccacaggaccagcccccgcttcagtgacagccctgagcagaagggctggcaggcccaggtgtctgagatcaaggccctgtggcaggccgctgaggtggagcgggaccggctgacagaatttgtgacagtgctgcagaagagggtggaggagagcaacagcaagctgctggagagcgagaggaagctgcaggaggagcggcacaggacagtggtgctggagcagcacctggagaagatccggctggagcccgggaaggccagcgccagccagagagctgcccccaggaccaagacaggcctgcccaccagcaacaacagacacaaccccaccggcagcgagaagaaggaccccagctttgcccagctgagtgatgtgcctgtggagagccagatggaggagctgaccacccggctggccatccaggtggaggagaatgagatgctgaaggccgccctgggcagcgccctgcggggcaaggaggaggacttcaggatgtaccacgagatcctgggccaggtgaagtctgtgttcctgcaggccctgcggcagcagaagacaggcaagcagtag

SEQ ID NO: 37484 - DNA, 1947 bp, Artificial Sequence
  Description of Artificial Sequence: Synthetic coding sequence
atggagggcgccggctacagagtggtgtttgagaagggcggcgtgtacctgcacaccagcgccaagaagtaccaggaccgggacagcctgattgctggggtcatccgggtggtggagaaggacaatgatgtgctgctgcactgggcccctgtggaggaggccggggacagcacccagatcctcttcagcaagaaggacagcagcggcggggacagctgtgccagcgaggaggagcccacctttgatcctgactatgagccagactgggccgtcatcagcacagtgcggccccagctgtgccacagcgagcccaccagaggagctgagcccagctgcccccagggctcctgggccttctctgtgtccctgggggagctgaagagcatccgccgcagcaagccaggcctgtcctgggcctacctggtgctggtgacccaggccggcggcagcctgcctgccctgcacttccacagaggaggcacccgggccctgctgcgggtgctgagccgctacctgctgctggccagcagcccccaggacagccggctgtacctggtgttcccccatgacagcagcgccctgagcaacagcttccaccacctgcagctgtttgaccaggacagcagcaatgtggtgagccgcttcctgcaggacccctacagcaccaccttcagcagcttcagccgggtgaccaacttcttccggggggccctgcagccccagcctgagggcgccgccagtgacctgcccccacctccagatgatgagcctgagcccggctttgaagtcatcagctgtgtggagctgggcccccggcccaccgtggagcggggcccccctgtgacagaggaggagtgggcccggcacgtgggccctgagggccgcctgcagcaggtgcctgagctgaagaaccgcatcttcagcggcggcctgagccccagcctgcggcgggaggcctggaagttcctgctgggctacctgtcctgggagggcacagctgaggagcacaaggcccacatcaggaagaagacagatgagtacttcaggatgaagctgcagtggaagtctgtgtccccagagcaggagaggaggaacagcctgctgcacggctaccgcagcctgattgaaagagatgtgtccaggacagacaggaccaacaagttctatgagggcccagaaaatcctggcctgggcctgctgaatgacatcctgctgacctactgcatgtaccactttgacctgggctacgtgcagggcatgtctgacctgctgagccccatcctgtatgtgatccagaatgaggtggatgccttctggtgcttctgtggcttcatggagctggtgcagggcaactttgaggagagccaggagaccatgaagaggcagctgggccgcctgctgctgctgctgcgggtgctggaccccctgctgtgtgacttcctggacagccaggacagcggcagcctgtgcttctgcttccgctggctgctgatctggttcaagcgggagttccccttcccagatgtgctgcggctgtgggaggtgctgtggacaggcctgcccggccccaacctgcacctgctggtggcctgtgccatcctggacatggagcgggacaccctgatgctgagcggcttcggcagcaatgagatcctgaagcacatcaatgagctgaccatgaagctgtctgtggaggatgtgctgaccagggctgaggccctgcaccggcagctgacagcctgcccagagctgccccacaacgtgcaggagatcctgggcctggcccccccagctgagccccacagccccagccccacagccagccccctgcccctgagccccacccgggccccacccaccccaccacccagcacagacacagccccccagcctgacagcagcctggagatcctgcctgaggaggaggatgaaggagctgacagctag

SEQ ID NO: 37485 - DNA, 480 bp, Artificial Sequence
  Description of Artificial Sequence: Synthetic coding sequence
atgggagagaggaaaggagtgaacaagtactaccccccagacttcaaccctgagaagcacggcagcctgaaccgctaccacaacagccaccccctgcgggagcgggccaggaagctgagccagggcatcctgatcatccgctttgagatgccctacaacatctggtgtgatggctgcaagaaccacatcggcatgggcgtgcgctacaatgctgagaagaagaaggtgggcaactactacaccacccccatctaccgcttcaggatgaagtgccacctgtgtgtgaactacatcgagatgcagacagatcctgccaactgtgactatgtgattgtgtctggggcccagaggaaggaggagcgctgggacatggctgacaatgagcaggtgctgaccactggagagcggcaccccctgacctgcctgggcgccctggccctgagcctgcgctggggcccccagagccctgctgagctgtag

SEQ ID NO: 37486 - DNA, 984 bp, Artificial Sequence
  Description of Artificial Sequence: Synthetic coding sequence
atgcagaagatcaagagcctgatgacccggcagggcctgaagagcccccaggagagcctgagtgacctgggcgccatcgagagcctgcgggtgcctgggaaggaggagttccgggagctgcgggagcagcccagcgacccccaggccgagcaggagctgatcaacagcattgagcaggtgtacttctctgtggacagctttgatattgtgaagtatgagctggagaagctgccccctgtgctgaacctgcaggagctggaggcctacagagacaagctgaagcagcagcaggccgctgtgtccaagaaggtggccgacctgatcctggagaagcagcctgcctacgtgaaggagctggagcgggtgaccagcctgcagacaggcctgcagctggccgctgtgatctgcaccaacggccgccgccacctgaacatcgccaaggagggcttcacccaggccagcctgggcctgctggccaaccagaggaagaggcagctgctgattggcctgctgaagagcctgcggaccatcaagaccctgcagaggacagatgtgcggctgtctgagatgctggaggaggaggactacccaggggccatccagctgtgcctggagtgccagaaggccgccagcaccttcaagcactacagctgcatcagcgagctgaacagcaagctgcaggacaccctggagcagatcgaggagcagctggatgtggccctgagcaagatctgcaagaactttgacatcaaccactacaccaaggtgcagcaggcctaccgcctgctgggcaagacccagacagccatggaccagctgcacatgcacttcacccaggccatccacaacacagtgttccaggtggtgctgggctacgtggagctgtgtgccggcaacacagacaccaagttccagaagctgcagtacaaggacctgtgcaccgtgtgcagcgacctgatcaccatccacatcagcctgctgtag

SEQ ID NO: 37487 - DNA, 2895 bp, Artificial Sequence
  Description of Artificial Sequence: Synthetic coding sequence
atgcagaagatcaagagcctgatgacccggcagggcctgaagagcccccaggagagcctgagtgacctgggcgccatcgagagcctgcgggtgcctgggaaggaggagttccgggagctgcgggagcagcccagcgacccccaggccgagcaggagctgatcaacagcattgagcaggtgtacttctctgtggacagctttgatattgtgaagtatgagctggagaagctgccccctgtgctgaacctgcaggagctggaggcctacagagacaagctgaagcagcagcaggccgctgtgtccaagaaggtggccgacctgatcctggagaagcagcctgcctacgtgaaggagctggagcgggtgaccagcctgcagacaggcctgcagctggccgctgtgatctgcaccaacggccgccgccacctgaacatcgccaaggagggcttcacccaggccagcctgggcctgctggccaaccagaggaagaggcagctgctgattggcctgctgaagagcctgcggaccatcaagaccctgcagaggacagatgtgcggctgtctgagatgctggaggaggaggactacccaggggccatccagctgtgcctggagtgccagaaggccgccagcaccttcaagcactacagctgcatcagcgagctgaacagcaagctgcaggacaccctggagcagatcgaggagcagctggatgtggccctgagcaagatctgcaagaactttgacatcaaccactacaccaaggtgcagcaggcctaccgcctgctgggcaagacccagacagccatggaccagctgcacatgcacttcacccaggccatccacaacacagtgttccaggtggtgctgggctacgtggagctgtgtgccggcaacacagacaccaagttccagaagctgcagtacaaggacctgtgcacccacgtgaccccagacagctacatcccctgcctggccgacctgtgcaaggccctgtgggaggtgatgctgagctactaccgcaccatggagtggcatgagaagcatgacaatgaagacacagccagcgccagcgagggcagcaacatgattggaacagaggagaccaactttgaccggggctacatcaagaagaagctggagcacggcctgacccgcatctggcaggatgtgcagctgaaggtgaagacctacctgctgggcacagacctgagcatcttcaagtatgatgacttcatctttgtgctggacatcatcagccggctgatgcaggtgggggaggagttctgtggcagcaagtctgaggtgctgcaggagagcatcaggaagcagagcgtgaactacttcaagaactaccacaggacccggctggatgagctgaggatgttcctggagaatgagacctgggagctgtgccctgtgaagagcaacttcagcatcctgcagctgcacgagttcaagttcatggagcagagccgcagccccagcgtgagccccagcaagcagcctgtgtccaccagcagcaagacagtgaccctgtttgagcagtactgcagcggcggcaacccctttgagatccaggccaaccacaaggatgaggagacagaagatgtgctggccagcaatggctatgaaagtgatgagcaggagaagagcgcctaccaggagtatgacagcgacagtgatgtgcctgaggagctgaagagggactatgtggatgagcagacaggagatggccctgtgaagtctgtgtcccgggagaccctgaagagcaggaagaagagtgactacagcctgaacaaggtgaatgcccccatcctgaccaacaccaccctgaatgtcatccggctggtgggcaagtacatgcagatgatgaacatcctgaagcccatcgcctttgatgtgatccacttcatgagccagctgtttgactactacctgtatgccatctacaccttcttcggcagaaatgacagcctggagagcacaggcctgggcctgagcagcagccggctgcggaccaccctgaaccgcatccaggagagcctgattgacctggaggtgtctgctgaccccacagccaccctgacagctgctgaggagaggaaggagaaggtgcccagcccccacctgagccacctggtggtgctgaccagcggggacaccctgtatggcctggccgagcgggtggtggccacagagagcctggtgttcctggccgagcagtttgagttcctgcagccccacctggatgctgtgatgcctgctgtgaagaagcccttcctgcagcagttctacagccagacagtgtccacagccagcgagctgaggaagcccatctactggatcgtggccggcaaggccctggactatgagcagatgctgctgctgatggccaacgtgaagtgggatgtgaaggagatcatgagccagcacaacatctacgtggatgccctgctgaaggagtttgagcagttcaacagaaggctgaatgaggtgtccaagagggtgcgcatccccctgcctgtgagcaacatcctgtgggagcactgcatccggctggccaacagaaccatcgtggagggctacgccaacgtgaagaagtgcagcaatgaaggccgggccctgatgcagctggacttccagcagttcctgatgaagctggagaagctgacagacatccggcccatcccagacaaggagtttgtggagacctacatcaaggcctactacctgacagaaaatgacatggagcgctggatcaaggagcaccgggagtacagcaccaagcagctgaccaacctggtgaatgtgtgcctgggcagccacatcaacaagaaggcccggcagaagctgctggccgccattgatgacatcgaccggcccaagaggtag

SEQ ID NO: 37488 - DNA, 1242 bp, Artificial Sequence
  Description of Artificial Sequence: Synthetic coding sequence
atggaccagctgcacatgcacttcacccaggccatccacaacacagtgttccaggtggtgctgggctacgtggagctgtgtgccggcaacacagacaccaagttccagaagctgcagtacaaggacctgtgcacccacgtgaccccagacagctacatcccctgcctggccgacctgtgcaaggccctgtgggaggtgatgctgagctactaccgcaccatggagtggcatgagaagcatgacaatgaagacacagccagcgccagcgagggcagcaacatgattggaacagaggagaccaactttgaccggggctacatcaagaagaagctggagcacggcctgacccgcatctggcaggatgtgcagctgaaggtgaagacctacctgctgggcacagacctgagcatcttcaagtatgatgacttcatctttgtgctggacatcatcagccggctgatgcaggtgggggaggagttctgtggcagcaagtctgaggtgctgcaggagagcatcaggaagcagagcgtgaactacttcaagaactaccacaggacccggctggatgagctgaggatgttcctggagaatgagacctgggagctgtgccctgtgaagagcaacttcagcatcctgcagctgcacgagttcaagttcatggagcagagccgcagccccagcgtgagccccagcaagcagcctgtgtccaccagcagcaagacagtgaccctgtttgagcagtactgcagcggcggcaacccctttgagatccaggccaaccacaaggatgaggagacagaagatgtgctggccagcaatggctatgaaagtgatgagcaggagaagagcgcctaccaggagtatgacagcgacagtgatgtgcctgaggagctgaagagggactatgtggatgagcagacaggagatggccctgtgaagtctgtgtcccgggagaccctgaagagcaggaagaagagtgactacagcctgaacaaggtgaatgcccccatcctgaccaacaccaccctgaatgtcatccggctggtggatggagtgtccctgtgctgcctgggctggagcacagtggcccacctgcacagcctgcaggcccctcctcctggcttcaagcccttcagctgcctgagcctgcccaggtcctgggactaccgccggcccccacccaggcctgccaacttcctgtacttcctgttcttcagcagagatggagtgagcccctgctag

SEQ ID NO: 37489 - DNA, 2055 bp, Artificial Sequence
  Description of Artificial Sequence: Synthetic coding sequence
atgcagaagatcaagagcctgatgacccggcagggcctgaagagcccccaggagagcctgagtgacctgggcgccatcgagagcctgcgggtgcctgggaagcacgtgaccccagacagctacatcccctgcctggccgacctgtgcaaggccctgtgggaggtgatgctgagctactaccgcaccatggagtggcatgagaagcatgacaatgaagacacagccagcgccagcgagggcagcaacatgattggaacagaggagaccaactttgaccggggctacatcaagaagaagctggagcacggcctgacccgcatctggcaggatgtgcagctgaaggtgaagacctacctgctgggcacagacctgagcatcttcaagtatgatgacttcatctttgtgctggacatcatcagccggctgatgcaggtgggggaggagttctgtggcagcaagtctgaggtgctgcaggagagcatcaggaagcagagcgtgaactacttcaagaactaccacaggacccggctggatgagctgaggatgttcctggagaatgagacctgggagctgtgccctgtgaagagcaacttcagcatcctgcagctgcacgagttcaagttcatggagcagagccgcagccccagcgtgagccccagcaagcagcctgtgtccaccagcagcaagacagtgaccctgtttgagcagtactgcagcggcggcaacccctttgagatccaggccaaccacaaggatgaggagacagaagatgtgctggccagcaatggctatgaaagtgatgagcaggagaagagcgcctaccaggagtatgacagcgacagtgatgtgcctgaggagctgaagagggactatgtggatgagcagacaggagatggccctgtgaagtctgtgtcccgggagaccctgaagagcaggaagaagagtgactacagcctgaacaaggtgaatgcccccatcctgaccaacaccaccctgaatgtcatccggctggtgggcaagtacatgcagatgatgaacatcctgaagcccatcgcctttgatgtgatccacttcatgagccagctgtttgactactacctgtatgccatctacaccttcttcggcagaaatgacagcctggagagcacaggcctgggcctgagcagcagccggctgcggaccaccctgaaccgcatccaggagagcctgattgacctggaggtgtctgctgaccccacagccaccctgacagctgctgaggagaggaaggagaaggtgcccagcccccacctgagccacctggtggtgctgaccagcggggacaccctgtatggcctggccgagcgggtggtggccacagagagcctggtgttcctggccgagcagtttgagttcctgcagccccacctggatgctgtgatgcctgctgtgaagaagcccttcctgcagcagttctacagccagacagtgtccacagccagcgagctgaggaagcccatctactggatcgtggccggcaaggccctggactatgagcagatgctgctgctgatggccaacgtgaagtgggatgtgaaggagatcatgagccagcacaacatctacgtggatgccctgctgaaggagtttgagcagttcaacagaaggctgaatgaggtgtccaagagggtgcgcatccccctgcctgtgagcaacatcctgtgggagcactgcatccggctggccaacagaaccatcgtggagggctacgccaacgtgaagaagtgcagcaatgaaggccgggccctgatgcagctggacttccagcagttcctgatgaagctggagaagctgacagacatccggcccatcccagacaaggagtttgtggagacctacatcaaggcctactacctgacagaaaatgacatggagcgctggatcaaggagcaccgggagtacagcaccaagcagctgaccaacctggtgaatgtgtgcctgggcagccacatcaacaagaaggcccggcagaagctgctggccgccattgatgacatcgaccggcccaagaggtag

SEQ ID NO: 37490 - DNA, 1782 bp, Artificial Sequence
  Description of Artificial Sequence: Synthetic coding sequence
atgctggaggaggaggactacccaggggccatccagctgtgcctggagtgccagaaggccgccagcaccttcaagcactacagctgcatcagcgagctgaacagcaagctgcaggacaccctggagcagatcgaggagcagctggatgtggccctgagcaagatctgcaagaactttgacatcaaccactacaccaaggtgcagcaggcctaccgcctgctgggcaagacccagacagccatggaccagctgcacatgcacttcacccaggccatccacaacacagtgttccaggtggtgctgggctacgtggagctgtgtgccggcaacacagacaccaagttccagaagctgcagtacaaggacctgtgcacccacgtgaccccagacagctacatcccctgcctggccgacctgtgcaaggccctgtgggaggtgatgctgagctactaccgcaccatggagtggcatgagaagcatgacaatgaagacacagccagcgccagcgagggcagcaacatgattggaacagaggagaccaactttgaccggggctacatcaagaagaagctggagcacggcctgacccgcatctggcaggatgtgcagctgaaggtgaagacctacctgctgggcacagacctgagcatcttcaagtatgatgacttcatctttgtgctggacatcatcagccggctgatgcaggtgggggaggagttctgtggcagcaagtctgaggtgctgcaggagagcatcaggaagcagagcgtgaactacttcaagaactaccacaggacccggctggatgagctgaggatgttcctggagaatgagacctgggagctgtgccctgtgaagagcaacttcagcatcctgcagctgcacgagttcaagttcatggagcagagccgcagccccagcgtgagccccagcaagcagcctgtgtccaccagcagcaagacagtgaccctgtttgagcagtactgcagcggcggcaacccctttgagatccaggccaaccacaaggatgaggagacagaagatgtgctggccagcaatggctatgaaagtgatgagcaggagaagagcgcctaccaggagtatgacagcgacagtgatgtgcctgaggagctgaagagggactatgtggatgagcagacaggagatggccctgtgaagtctgtgtcccgggagaccctgaagagcaggaagaagagtgactacagcctgaacaaggtgaatgcccccatcctgaccaacaccaccctgaatgtcatccggctggtgggcaagtacatgcagatgatgaacatcctgaagcccatcgcctttgatgtgatccacttcatgagccagctgtttgactactacctgtatgccatctacaccttctttggaagaaatgacagcctggagagcacaggcctgggcctgagcagcagccggctgcggaccaccctgaaccgcatccaggagagcctgattgacctggaggtgtctgctgaccccacagccaccctgacagctgctgaggagaggaaggagaaggtgcccagcccccacctgagccacctggtggtgctgaccagcggggacaccctgtatggcctggccgagcgggtggtggccacagagagcctggtgttcctggccgagcagtttgagttcctgcagccccacctggatgctgtgatgcctgctgtgaagaagcccttcctgcagcagttctacagccagagccagccccctgtgaactacggcaaccagttcaccggcctgtag

SEQ ID NO: 37491 - DNA, 2805 bp, Artificial Sequence
  Description of Artificial Sequence: Synthetic coding sequence
atgctgaccctggaggagttccgggagctgcgggagcagcccagcgacccccaggccgagcaggagctgatcaacagcattgagcaggtgtacttctctgtggacagctttgatattgtgaagtatgagctggagaagctgccccctgtgctgaacctgcaggagctggaggcctacagagacaagctgaagcagcagcaggccgctgtgtccaagaaggtggccgacctgatcctggagaagcagcctgcctacgtgaaggagctggagcgggtgaccagcctgcagacaggcctgcagctggccgctgtgatctgcaccaacggccgccgccacctgaacatcgccaaggagggcttcacccaggccagcctgggcctgctggccaaccagaggaagaggcagctgctgattggcctgctgaagagcctgcggaccatcaagaccctgcagaggacagatgtgcggctgtctgagatgctggaggaggaggactacccaggggccatccagctgtgcctggagtgccagaaggccgccagcaccttcaagcactacagctgcatcagcgagctgaacagcaagctgcaggacaccctggagcagatcgaggagcagctggatgtggccctgagcaagatctgcaagaactttgacatcaaccactacaccaaggtgcagcaggcctaccgcctgctgggcaagacccagacagccatggaccagctgcacatgcacttcacccaggccatccacaacacagtgttccaggtggtgctgggctacgtggagctgtgtgccggcaacacagacaccaagttccagaagctgcagtacaaggacctgtgcacccacgtgaccccagacagctacatcccctgcctggccgacctgtgcaaggccctgtgggaggtgatgctgagctactaccgcaccatggagtggcatgagaagcatgacaatgaagacacagccagcgccagcgagggcagcaacatgattggaacagaggagaccaactttgaccggggctacatcaagaagaagctggagcacggcctgacccgcatctggcaggatgtgcagctgaaggtgaagacctacctgctgggcacagacctgagcatcttcaagtatgatgacttcatctttgtgctggacatcatcagccggctgatgcaggtgggggaggagttctgtggcagcaagtctgaggtgctgcaggagagcatcaggaagcagagcgtgaactacttcaagaactaccacaggacccggctggatgagctgaggatgttcctggagaatgagacctgggagctgtgccctgtgaagagcaacttcagcatcctgcagctgcacgagttcaagttcatggagcagagccgcagccccagcgtgagccccagcaagcagcctgtgtccaccagcagcaagacagtgaccctgtttgagcagtactgcagcggcggcaacccctttgagatccaggccaaccacaaggatgaggagacagaagatgtgctggccagcaatggctatgaaagtgatgagcaggagaagagcgcctaccaggagtatgacagcgacagtgatgtgcctgaggagctgaagagggactatgtggatgagcagacaggagatggccctgtgaagtctgtgtcccgggagaccctgaagagcaggaagaagagtgactacagcctgaacaaggtgaatgcccccatcctgaccaacaccaccctgaatgtcatccggctggtgggcaagtacatgcagatgatgaacatcctgaagcccatcgcctttgatgtgatccacttcatgagccagctgtttgactactacctgtatgccatctacaccttcttcggcagaaatgacagcctggagagcacaggcctgggcctgagcagcagccggctgcggaccaccctgaaccgcatccaggagagcctgattgacctggaggtgtctgctgaccccacagccaccctgacagctgctgaggagaggaaggagaaggtgcccagcccccacctgagccacctggtggtgctgaccagcggggacaccctgtatggcctggccgagcgggtggtggccacagagagcctggtgttcctggccgagcagtttgagttcctgcagccccacctggatgctgtgatgcctgctgtgaagaagcccttcctgcagcagttctacagccagacagtgtccacagccagcgagctgaggaagcccatctactggatcgtggccggcaaggccctggactatgagcagatgctgctgctgatggccaacgtgaagtgggatgtgaaggagatcatgagccagcacaacatctacgtggatgccctgctgaaggagtttgagcagttcaacagaaggctgaatgaggtgtccaagagggtgcgcatccccctgcctgtgagcaacatcctgtgggagcactgcatccggctggccaacagaaccatcgtggagggctacgccaacgtgaagaagtgcagcaatgaaggccgggccctgatgcagctggacttccagcagttcctgatgaagctggagaagctgacagacatccggcccatcccagacaaggagtttgtggagacctacatcaaggcctactacctgacagaaaatgacatggagcgctggatcaaggagcaccgggagtacagcaccaagcagctgaccaacctggtgaatgtgtgcctgggcagccacatcaacaagaaggcccggcagaagctgctggccgccattgatgacatcgaccggcccaagaggtag

SEQ ID NO: 37492 - DNA, 1998 bp, Artificial Sequence
  Description of Artificial Sequence: Synthetic coding sequence
atggagccccgggtggtgaagcccccaggccaggacctggtggtggagagcctgaagagccgctatggcctgggcggcagctgcccagatgaatatgacttcagcaacttctaccagagcaagtacaagaggaggaccctgaccagccctggggacctggacatctacagcggggacaaggtgggcagcagcctgaagtacagtgatgagagcaagcactgcaggacccccctgggcagcctcttcaagcacgtgaatgtgaactgcctggatgatgagctggacagcttccatgacctgaagaagcaggagacagaggaggagctgattgaaaatgactacagagtgtccaccagcaagatcaccaagcagagcttcaaggagattgagaaggtggccctgcccaccaacaccaccagcagccggcccaggacagagtgctgcagtgatgctggggacagccccctgaagcctgtgtcctgccccaagagcaaggccagtgacaagaggagcctgctgccccaccagatcagccagatctatgatgagctgttccagatccacctgaagctgcagtgtgaaacagctgcccagcagaagtttgctgaggagctgcagaagcgggagcgcttcctgctggagcgggagcagctgctcttcagacatgaaaatgccctgagcaagatcaagggcgtggaggaggaggtgctgacccgcttccagatcatcaaggagcagcatgatgctgaggtggagcacctgacagaggtgctgaaggagaagaacaaggagaccaagaggctgcggagcagctttgatgccctgaaggagctgaatgacaccctgaagaagcagctgaatgaggccagcgaggagaacaggaagattgacatccaggccaagagggtgcaggcccggctggacaacctgcagaggaaatatgagttcatgaccatccagaggctgaagggcagcagccatgctgtgcatgagatgaagagcctgaagcaggagaaggcccctgtgtccaagacctacaaggtgcccctgaatggccaggtgtatgagctgctgactgtgttcatggactggatcagtgaccaccacctgagcaaggtgaagcatgaggagagcggcatggatggcaagaagccccagctgaagtttgccagccagagaaatgacatccaggagaagtgtgtgaagctgctgcccctgatgacagagcagctgcagtggatgccctttgtgaacatcaagctgcacgagccctttgtgaagttcatctactggagcctgcggcagctggatgctggggcccagcacagcaccatgaccagcaccctgcggcggctgggggaggacatcttcaagggcgtggtgaccaagggcatccaggacaacagcccccagcacagcgtggagaacaagcccaagacagctgccttcttcaagagcagcaacctgcccctgcgcttcctgagcaccctcatcgtgctgaagacagtgacccaggccgactacctggcccaggcctttgacagcctgtgcctggacctgaagacagaggagggcaagaccctcttcctggagtaccaggccgtgcctgtgatcctgagccacctgcgcatcagcagcaagggcctgctgagcaatgtcatcgacagcctgctgcagatgacagtggagagcaagagcctgcagcccttcctggaggcctgcagcaacagcctcttcttccgcacctgcagcgtgctgctgcgggcccccaagctggacctgcagatcctggagaagctgagcatcatcctgcagaagctgagcaagatcaagagcaacaagaagctgtttgagctgttcaccatccacctgatgctgcaggagatccagaggaccaccaaccctgagcacgccttcctgtgcatcaacctgaacagcaccctcttcaacctgggcctgaccaagtgcaacagcctggtgagcagcgccagcccctag

SEQ ID NO: 37493 - DNA, 1734 bp, Artificial Sequence
  Description of Artificial Sequence: Synthetic coding sequence
atggagccccgggtggtgaagcccccaggccaggacctggtggtggagagcctgaagagccgctatggcctgggcggcagctgcccagatgaatatgacttcagcaacttctaccagagcaagtacaagaggaggaccctgaccagccctggggacctggacatctacagcggggacaaggtgggcagcagcctgaagtacagtgatgagagcaagcactgcaggacccccctgggcagcctcttcaagcacgtgaatgtgaactgcctggatgatgagctggacagcttccatgacctgaagaagcaggagacagaggaggagctgattgaaaatgactacagagtgtccaccagcaagatcaccaagcagagcttcaaggagattgagaaggtggccctgcccaccaacaccaccagcagccggcccaggacagagtgctgcagtgatgctggggacagccccctgaagcctgtgtcctgccccaagagcaaggccagtgacaagaggagcctgctgccccaccagatcagccagatctatgatgagctgttccagatccacctgaagctgcagtgtgaaacagctgcccagcagaagtttgctgaggagctgcagaagcgggagcgcttcctgctggagcgggagcagctgctcttcagacatgaaaatgccctgagcaagatcaagggcgtggaggaggaggtgctgacccgcttccagatcatcaaggagcagcatgatgctgaggtggagcacctgacagaggtgctgaaggagaagaacaaggagaccaagaggctgcggagcagctttgatgccctgaaggagctgaatgacaccctgaagaagcagctgaatgaggccagcgaggagaacaggaagattgacatccaggccaagagggtgcaggcccggctggacaacctgcagaggaaatatgagttcatgaccatccagaggctgaagggcagcagccatgctgtgcatgagatgaagagcctgaagcaggagaaggcccctgtgtccaagacctacaaggtgcccctgaatggccaggtgtatgagctgctgactgtgttcatggactggatcagtgaccaccacctgagcaaggtgaagcatgaggagagcggcatggatggcaagaagccccagctgaagtttgccagccagagaaatgacatccaggagaagtgtgtgaagctgctgcccctgatgacagagcagctgcagtggatgccctttgtgaacatcaagctgcacgagccctttgtgaagttcatctactggagcctgcggcagctggatgctggggcccagcacagcaccatgaccagcaccctgcggcggctgggggaggacatcttcaagggcgtggtgaccaagggcatccaggacaacagcccccagcacagcgtggagaacaagcccaagacagctgccttcttcaagagcagcaacctgcccctgcgcttcctgagcaccctcatcgtgctgaagacagtgacccaggccgactacctggcccaggcctttgacagcctgtgcctggacctgaagacagaggagggcaagaccctcttcctggagtaccaggccgtgcctgtgatcctgagccacctgcgcatcagcagcaagggcctgctgagcaatgtcatcgacagcctgctgcagatgacagtggagagcagggtcatccgcagcagcctgaacttcctgcgcttcatctag

SEQ ID NO: 37494 - DNA, 492 bp, Artificial Sequence
  Description of Artificial Sequence: Synthetic coding sequence
atgggagatgagtgcagcaacccagacctgctggccgagcccggcagcagccccccctgggaccacggcaaccagaggcaggaggccgccaatgaaagcaacaccagggtgccccgggtgctgaaggcccacctgggccctgagacagcccagcccaccaagaggagcaagaggaaccgctggaggcggcagagctgccagggccccagccctgcccggagcggccagttcctgggcagcgctgacctgggcctgcagaggggcgtgctgaagtctgctgcccggacctgcctgtctgagatcagcaacagcacccgggccagccctgagagcgcccagagcacagatcctggccgggccgcccggcccaggaccaggaccctgcccaccccccacagcttcaagatcggggaggaggccgaggagatgaagaagaagaaggagaggaagaggaggaaggagaggaagaaggagaggaacttcaagaagtag

SEQ ID NO: 37495 - DNA, 54 bp, Artificial Sequence
  Description of Artificial Sequence: Synthetic coding sequence
atgggagatgagtgcagcaacccagacctgctggccgagcccggcagcagctag

SEQ ID NO: 37496 - DNA, 2628 bp, Artificial Sequence
  Description of Artificial Sequence: Synthetic coding sequence
atgcagttccagagcctgaaggagttctatgaaacagagatcccccagaaggagcaggatgatgccaaggccaagcactgcagcgacagcgctgagaagcagtggcagctgttcctgaagaagagcttcatcacccaggacctgggcctggagttcctgaacctgatcaacatggccaaggaaaatgagatcctggatgtgaagaatgaggtgtacctgatgaagaacaccatggagaaccagaaggccgagcgggaggagctgagcctgctgcggctggcctggcagctgaaggccacagagagcaagccaggcaagcagcagtgggccgccttcaaggagcagctgaagaagaccagccacaacctgaagctgctgcaggaggccctgatgcctgtgtctgccctggacctgggcggcagcctgcagttcatcctggacctgcggcagaagtggaatgacatgaagccccagttccagcagctgaatgatgaggtgcagtacatcatgaaggagagcgaggagctgaccggccgcggggcccctgtgaaggagaagagccagcagctgaaggacctgatccacttccaccagaagcagaaggagcgcatccaggactatgaggacatcctgtacaaggtggtgcagttccaccaggtgaaggaggagctgggccgcctcatcaagagccgggagctggagtttgtggagcagcccaaggagctgggagatgcccatgatgtgcagatccacctgcgctgcagccaggagaagcaggcccgggtggaccacctgcaccggctggccctgagcctgggcgtggacatcatcagctctgtgcagaggccccactgcagcaatgtgtctgccaagaacctgcagcagcagctggagctgctggaggaggacagcatgaagtggagggccaaggccgaggagtatggccgcaccctgagccgctctgtggagtactgtgccatgagagatgagatcaatgagctgaaggacagcttcaaggacatcaagaagaagttcaacaacctgaagttcaactacaccaagaagaatgagaagagcaggaacctgaaggccctgaagtaccagatccagcaggtggacatgtatgcagagaagatgcaggccctgaagaggaagatggagaaggtgagcaacaagaccagtgacagcttcctgaactaccccagcgacaaggtgaatgtgctgctggaggtgatgaaggacctgcagaagcacgtggatgactttgacaaggtggtgacagactacaagaagaacctggacctgacagagcacttccaggaggtgattgaggagtgccacttctggtatgaagatgccagcgccaccgtggtgcgggtgggcaagtacagcacagagtgcaagaccaaggaggccgtgaagatcctgcaccagcagttcaacaagttcatcgcccccagcgtgccccagcaggaggagcgcatccaggaggccacagacctggcccagcacctgtatggcctggaggagggccagaagtacatcgagaagatcgtgaccaagcacaaggaggtgctggagagcgtgacagagctgtgtgagagcctgacagagctggaggagaagctgaagcagggagatgtgctgaagatgaaccccaacctggaggacttccactatgactacatcgacctgctgaaggagcccgccaagaacaagcagaccatcttcaatgaggagagaaataaaggccaggtgcaggtggccgacctgctgggcatcaatggaactggagaggagcggctgccccaggacctgaaggtgtccacagacaaggagggcggcgtgcaggacctgctgctgcctgaggacatgctgtctggagaggagtatgaatgtgtgtccccagatgacatcagcctgccccccctgcccggcagccctgagagccccctggcccccagcgacatggaggtggaggagcctgtgagcagcagcctgagcctgcacatcagcagctatggagtgcaggccggcaccagcagccctggagatgcccaggagagcgtgctgcccccacctgtggcctttgctgatgcctgcaatgacaagcgggagaccttcagcagccactttgagcggccctacctgcagttcaaggccgagccccccctgaccagccggggctttgtggagaagagcacagccctgcaccgcatctctgctgagcaccctgagagcatgatgtctgaggtgcatgagcgggccctgcagcagcacccccaggcccagggcggcctgctggagacccgggagaagatgcacgccgacaacaacttcaccaagacccaggaccggctgcacgccagcagtgatgccttcagcggcctgcgcttccagagcggcaccagccggggctaccagaggcagatggtgccccgggaggagatcaagagcaccagcgccaagagctctgtggtgtccctggccgaccaggcccccaacttcagccggctgctgagcaatgtgacagtgatggagggcagccctgtgaccctggaggtggaggtgacaggcttccctgagcccaccctgacctggtgggtggcctacaatgacaagccctag

SEQ ID NO: 37497 - DNA, 2685 bp, Artificial Sequence
  Description of Artificial Sequence: Synthetic coding sequence
cgcagccaggtgctgcagacctacgtggccttcctgaagagcagcgaggaggtggagatgcagttccagagcctgaaggagttctatgaaacagagatcccccagaaggagcaggatgatgccaaggccaagcactgcagcgacagcgctgagaagcagtggcagctgttcctgaagaagagcttcatcacccaggacctgggcctggagttcctgaacctgatcaacatggccaaggaaaatgagatcctggatgtgaagaatgaggtgtacctgatgaagaacaccatggagaaccagaaggccgagcgggaggagctgagcctgctgcggctggcctggcagctgaaggccacagagagcaagccaggcaagcagcagtgggccgccttcaaggagcagctgaagaagaccagccacaacctgaagctgctgcaggaggccctgatgcctgtgtctgccctggacctgggcggcagcctgcagttcatcctggacctgcggcagaagtggaatgacatgaagccccagttccagcagctgaatgatgaggtgcagtacatcatgaaggagagcgaggagctgaccggccgcggggcccctgtgaaggagaagagccagcagctgaaggacctgatccacttccaccagaagcagaaggagcgcatccaggactatgaggacatcctgtacaaggtggtgcagttccaccaggtgaaggaggagctgggccgcctcatcaagagccgggagctggagtttgtggagcagcccaaggagctgggagatgcccatgatgtgcagatccacctgcgctgcagccaggagaagcaggcccgggtggaccacctgcaccggctggccctgagcctgggcgtggacatcatcagctctgtgcagaggccccactgcagcaatgtgtctgccaagaacctgcagcagcagctggagctgctggaggaggacagcatgaagtggagggccaaggccgaggagtatggccgcaccctgagccgctctgtggagtactgtgccatgagagatgagatcaatgagctgaaggacagcttcaaggacatcaagaagaagttcaacaacctgaagttcaactacaccaagaagaatgagaagagcaggaacctgaaggccctgaagtaccagatccagcaggtggacatgtatgcagagaagatgcaggccctgaagaggaagatggagaaggtgagcaacaagaccagtgacagcttcctgaactaccccagcgacaaggtgaatgtgctgctggaggtgatgaaggacctgcagaagcacgtggatgactttgacaaggtggtgacagactacaagaagaacctggacctgacagagcacttccaggaggtgattgaggagtgccacttctggtatgaagatgccagcgccaccgtggtgcgggtgggcaagtacagcacagagtgcaagaccaaggaggccgtgaagatcctgcaccagcagttcaacaagttcatcgcccccagcgtgccccagcaggaggagcgcatccaggaggccacagacctggcccagcacctgtatggcctggaggagggccagaagtacatcgagaagatcgtgaccaagcacaaggaggtgctggagagcgtgacagagctgtgtgagagcctgacagagctggaggagaagctgaagcagggagatgtgctgaagatgaaccccaacctggaggacttccactatgactacatcgacctgctgaaggagcccgccaagaacaagcagaccatcttcaatgaggagaggaacaagggccaggtgcaggtggccgacctgctgggcatcaatggcaccggggaggagcggctgccccaggacctgaaggtgtccacagacaaggagggcggcgtgcaggacctgctgctgcctgaggacatgctgagcggggaggagtatgaatgtgtgtccccagatgacatcagcctgccccccctgcccggcagccctgagagccccctggcccccagcgacatggaggtggaggagcctgtgagcagcagcctgagcctgcacatcagcagctatggagtgcaggccggcaccagcagccctggagatgcccaggagagcgtgctgcccccacctgtggcctttgctgatgcctgcaatgacaagcgggagaccttcagcagccactttgagcggccctacctgcagttcaaggccgagccccccctgaccagccggggctttgtggagaagagcacagccctgcaccgcatctctgctgagcaccctgagagcatgatgtctgaggtgcatgagcgggccctgcagcagcacccccaggcccagggcggcctgctggagacccgggagaagatgcatgctgacaacaacttcaccaagacccaggaccggctgcacgccagcagtgatgccttcagcggcctgcgcttccagagcggcaccagccggggctaccagaggcagatggtgccccgggaggagatcaagagcaccagcgccaagagctctgtggtgtccctggccgaccaggcccccaacttcagccggctgctgagcaatgtgacagtgatggagggcagccctgtgaccctggaggtggaggtgacaggcttccctgagcccaccctgacctggtgggtggcctacaatgacaagccctag

SEQ ID NO: 37498 - DNA, 4593 bp, Artificial Sequence
  Description of Artificial Sequence: Synthetic coding sequence
atgagcagccagggcagccccagcgtggccctgagcaccaccaccgtgtcctctgtggccgtgcaggccggggacagcaagatcgtgattgctgtgatcaagtgtgggaagtgggtgcagctgcagctggccgagagccagcccaacctgctggagatcggcagcagccaggatgagaccaagaagctgctgcatgaccacgagctgctgctggccaagctgaaggccctggaggacagagtgtgggagctgctgcaggaggccgacaagacagctgaggagaacaaggaccagagccaggtgtatgatgccatggccgagaccctgggggaggcctgggccgccctggtgtccatgctggagaggagaacagagctgctgcggctgaccagcgagttctttgaaaatgccctggagtttgccatcaagattgaccaggccgaggacttcctgcagaacacccatgaatttgaatctgctgagagcctgaagagcctgctgcagctgcacgagcaccacaccaaggagctgctggagaggagcctggccctgctgaacaagagccagcagctgacagacttcatcgagaagttcaagtgtgagggccccaacgtgaaccctgagctgacccagggcgcccacagcagctgcctgaaggtggaccggctgctggagctgctgcaggacagaagacggcagctggacaagtacctgaagcagcagtggcaggagctgagccaggtgctgcagatctgccagtgggaccagcaggagaaccaggtgacctgctggttccagaagaccatccggaacctgcaggagcagagcctgggcagcagcctgagtgacaatgaagatcgcatccacaagcaggaggagctgatcatcaaggccaaggagtggaacagcgctgtggagaagctgaagtctgaggccctgcgcatcctgctgagcaaggactatgtggagaaggagcacctgcagctgagccaccagaagctgagccagctgcaggaggagtttggccagctgatggtggagaggaacacctggctgaagaaggccaatgagttcttcaacagcgccaacaaggcctttgatgtgctgggccgggtggaggcctacctgaagctgctgaagtctgagggcctgagcctggccgtgctggccgtgagacatgaggagctgcacaggaagatcaaggactgcaccacagatgccctgcagaagggccagaccctcatcagccaggtggacagctgcagcagccaggtgtctggcatccacgagatgatgggctgcatcaagagaagagtggaccacctgacagagcagtgcagcgcccacaaggagtatgccctgaagaagcagcagctgacagcctctgtggagggctacctgaggaaggtggagatgagcatccagaagatcagccctgtgctgagcaatgccatggatgtgggcagcaccaggtctgagagcgagaagatcctgaacaagtacctggagctggacatccaggccaaggagaccagccatgagctggaggccgccgccaagaccatgatggagaagaatgaatttgtgtctgatgagatggtgtccctgagcagcaaggcccgctggctggccgaggagctgaacctgtttggccagagcattgactaccgcagccaggtgctgcagacctacgtggccttcctgaagagcagcgaggaggtggagatgcagttccagagcctgaaggagttctatgaaacagagatcccccagaaggagcaggatgatgccaaggccaagcactgcagcgacagcgctgagaagcagtggcagctgttcctgaagaagagcttcatcacccaggacctgggcctggagttcctgaacctgatcaacatggccaaggaaaatgagatcctggatgtgaagaatgaggtgtacctgatgaagaacaccatggagaaccagaaggccgagcgggaggagctgagcctgctgcggctggcctggcagctgaaggccacagagagcaagccaggcaagcagcagtgggccgccttcaaggagcagctgaagaagaccagccacaacctgaagctgctgcaggaggccctgatgcctgtgtctgccctggacctgggcggcagcctgcagttcatcctggacctgcggcagaagtggaatgacatgaagccccagttccagcagctgaatgatgaggtgcagtacatcatgaaggagagcgaggagctgaccggccgcggggcccctgtgaaggagaagagccagcagctgaaggacctgatccacttccaccagaagcagaaggagcgcatccaggactatgaggacatcctgtacaaggtggtgcagttccaccaggtgaaggaggagctgggccgcctcatcaagagccgggagctggagtttgtggagcagcccaaggagctgggagatgcccatgatgtgcagatccacctgcgctgcagccaggagaagcaggcccgggtggaccacctgcaccggctggccctgagcctgggcgtggacatcatcagctctgtgcagaggccccactgcagcaatgtgtctgccaagaacctgcagcagcagctggagctgctggaggaggacagcatgaagtggagggccaaggccgaggagtatggccgcaccctgagccgctctgtggagtactgtgccatgagagatgagatcaatgagctgaaggacagcttcaaggacatcaagaagaagttcaacaacctgaagttcaactacaccaagaagaatgagaagagcaggaacctgaaggccctgaagtaccagatccagcaggtggacatgtatgcagagaagatgcaggccctgaagaggaagatggagaaggtgagcaacaagaccagtgacagcttcctgaactaccccagcgacaaggtgaatgtgctgctggaggtgatgaaggacctgcagaagcacgtggatgactttgacaaggtggtgacagactacaagaagaacctggacctgacagagcacttccaggaggtgattgaggagtgccacttctggtatgaagatgccagcgccaccgtggtgcgggtgggcaagtacagcacagagtgcaagaccaaggaggccgtgaagatcctgcaccagcagttcaacaagttcatcgcccccagcgtgccccagcaggaggagcgcatccaggaggccacagacctggcccagcacctgtatggcctggaggagggccagaagtacatcgagaagatcgtgaccaagcacaaggaggtgctggagagcgtgacagagctgtgtgagagcctgacagagctggaggagaagctgaagcagggagatgtgctgaagatgaaccccaacctggaggacttccactatgactacatcgacctgctgaaggagcccgccaagaacaagcagaccatcttcaatgaggagaggaacaagggccaggtgcaggtggccgacctgctgggcatcaatggcaccggggaggagcggctgccccaggacctgaaggtgtccacagacaaggagggcggcgtgcaggacctgctgctgcctgaggacatgctgagcggggaggagtatgaatgtgtgtccccagatgacatcagcctgccccccctgcccggcagccctgagagccccctggcccccagcgacatggaggtggaggagcctgtgagcagcagcctgagcctgcacatcagcagctatggagtgcaggccggcaccagcagccctggagatgcccaggagagcgtgctgcccccacctgtggcctttgctgatgcctgcaatgacaagcgggagaccttcagcagccactttgagcggccctacctgcagttcaaggccgagccccccctgaccagccggggctttgtggagaagagcacagccctgcaccgcatctctgctgagcaccctgagagcatgatgtctgaggtgcatgagcgggccctgcagcagcacccccaggcccagggcggcctgctggagacccgggagaagatgcatgctgacaacaacttcaccaagacccaggaccggctgcacgccagcagtgatgccttcagcggcctgcgcttccagagcggcaccagccggggctaccagaggcagatggtgccccgggaggagatcaagagcaccagcgccaagagctctgtggtgtccctggccgaccaggcccccaacttcagccggctgctgagcaatgtgacagtgatggagggcagccctgtgaccctggaggtggaggtgacaggcttccctgagcccaccctgacctggtacaagaagggccagaagctgtctgcagatggccacctgcaggtgctgcacaaggagaccaggcacagcgtcttcatccccaaggtgtgcaaggcagatgctggcctgtatgtggcccgggcccagaacagcagcggggccctgagcagcaatgtcatcctgcacgtgactggaaactgccgcctgcccatcaccagggtgaactggatcaccctgtgtgtggtgtatgtgtctgtgtccctgatgtactggctgctgacccagtag

SEQ ID NO: 37499 - DNA, 2253 bp, Artificial Sequence
  Description of Artificial Sequence: Synthetic coding sequence
atggcccaggccagccgcagcggcagcctgccccccctggtgattgtgccccccctgcgggcccagcccggcggcaccggggaggagcagtgggagaggagcaggactggaggcctgcgctgggaggtgcactgctggcccagcggcaccagcggcggcaccccctggtggcccaccccagcagatgtgtctgaagattatgaagcagatgctgctgcctggaggcggggccctgctgggggcggccccatccccccagccctgcagaggctgcgggctgtgctgctgcggctgcaccgggagcgggagcagctgctgcaggcccgggactgtgcctaccacctgcagagcgctgtgcggctgatgaagaccctgagccctggcagccccagcggcggccccagccccctgccccagtggtgccgggacctgcagctgcaccccagccagggcgctgtgctgcgcatcggccctggagagaccctggagcccctgctgctggcccggcccatcggcctggccgcccagtgcctggaggccgtcatcgagatgcagctgcgggccctgggccgggagcccgccagccctggcctgagcagccagctggccgagctgctgtttgccctgcctgcctaccacaccctgcagaggaaggccctgagccacgtgcctggggccgcccggcccttccccaccagccgggtgctgcggctgctgaccggggagcggggctgccaggtggccagccggctggatgaggccctgcagggcagcgccctgcgggaccagctgcggcggcgctgccaggaggagggggacctgctgcccggcctgctgggcctggtgggcggcgtggccggcagcgccagctgtggcctgggcctgggcggggccggggccctgtggagccagtactggaccctgctgtgggccgcctgtgcccagagcctggacctgaacctgggcccctggagggacccccgggccacagcccagcagctgagccaggccctgggccaggccagcctgccccaggagtgtgagaaggagctggccagcctgtgccaccggctgctgcaccagagcctcatctggagctgggaccagggcttctgccaggccctgggcagcgccctgggcggccagagcagcctgcccaccagcagcggcacagctgagctgctgcagcagctgttcccccccctgctggatgccctgcgggagccccggctgcggcgcatcttctgccagcctgctgaccctgcccctgtggccctgggcctgtgcaccctgcagaccaccctgctgtggttcctgggccgggcccagcagtacctggccgcctgggaccctgccagcttcctgctgctgatccagaaggacctgccccccctgctgcatgaagctgaggccctgtacagcctggccagcgaggagagcctggccctggaggtggagcagcagctgggcctggagatccagaagctgacagcccagatccagctgctgcctgaggagagcctgtctgtgttcagccaggagtgccacaagcaggccatgcagggcttcaagctgtacatgccccggggccgctactggaggctgcggctgtgcccagagcccccatctgcccccagtgaatatgccggcctggtggtgaggacagtgctggagcctgtgctgcagggcctgcagggcctgcccccccaggcccaggccccagccctgggccaggccctgacagccatcgtgggcgcctggctggaccacatcctgacccacggcatccgcttcagcctgcagggcgccctgcagctgaagcaggactttggagtggtgcgggagctgctggaggaggagcagtggagcctgagcccagacctgcggcagaccctgctgatgctgagcatcttccagcagctggatggagccctgctgtgcctgctgcagcagcccctgcccaagagccaggtgcaccggcggcccccctgctgctgtgcctgccaggaggtgcagaccaccaagctgcccagcagctgcctgaacagcctggagagcctggagccccccctgcagcccggcaccagccctgcccagacaggccagctgcagagcaccctgggcggccggggccccagccctgagggctacctggtgggcaaccagcaggcctggctggccctgcggcagcaccagaggccccgctggcacctgcccttcttcagctgcctgggcaccagccctgagagctag

SEQ ID NO: 37500 - DNA, 2232 bp, Artificial Sequence
  Description of Artificial Sequence: Synthetic coding sequence
atggcccaggccagccgcagcggcagcctgccccccctggtgattgtgccccccctgcgggcccagcccggcggcaccggggaggagcagtgggagaggagcaggactggaggcctgcgctgggaggtgcactgctggcccagcggcaccagcggcggcaccccctggtggcccaccccagcagatgtgtctgaagattatgaagcagatgctgctgcctggaggcggggccctgctgggggcggccccatccccccagccctgcagaggctgcgggctgtgctgctgcggctgcaccgggagcgggagcagctgctgcaggcccgggactgtgcctaccacctgcagagcgctgtgcggctgatgaagaccctgagccctggcagccccagcggcggccccagccccctgccccagtggtgccgggacctgcagctgcaccccagccagggcgctgtgctgcgcatcggccctggagagaccctggagcccctgctgctggcccggcccatcggcctggccgcccagtgcctggaggccgtcatcgagatgcagctgcgggccctgggccgggagcccgccagccctggcctgagcagccagctggccgagctgctgtttgccctgcctgcctaccacaccctgcagaggaaggccctgagccacgtgcctggggccgcccggcccttccccaccagccgggtgctgcggctgctgaccggggagcggggctgccaggtggccagccggctggatgaggccctgcagggcagcgccctgcgggaccagctgcggcggcgctgccaggaggagggggacctgctgcccggcctgctgggcctggtgggcggcgtggccggcagcgccagctgtggcctgggcctgggcggggccggggccctgtggagccagtactggaccctgctgtgggccgcctgtgcccagagcctggacctgaacctgggcccctggagggacccccgggccacagcccagcagctgagccaggccctgggccaggccagcctgccccaggagtgtgagaaggagctggccagcctgtgccaccggctgctgcaccagagcctcatctggagctgggaccagggcttctgccaggccctgggcagcgccctgggcggccagagcagcctgcccaccagcagcggcacagctgagctgctgcagcagctgttcccccccctgctggatgccctgcgggagccccggctgcggcgcatcttctgccagcctgctggcctgtgcaccctgcagaccaccctgctgtggttcctgggccgggcccagcagtacctggccgcctgggaccctgccagcttcctgctgctgatccagaaggacctgccccccctgctgcacgaggccgaggccctgtacagcctggccagcgaggagagcctggccctggaggtggagcagcagctgggcctggagatccagaagctgacagcccagatccagctgctgcctgaggagagcctgagcgtcttcagccaggagtgccacaagcaggccatgcagggcttcaagctgtacatgccccggggccgctactggaggctgcggctgtgcccagagccccccagcgcccccagtgaatatgccggcctggtggtgaggacagtgctggagcctgtgctgcagggcctgcagggcctgcccccccaggcccaggccccagccctgggccaggccctgacagccatcgtgggcgcctggctggaccacatcctgacccacggcatccgcttcagcctgcagggcgccctgcagctgaagcaggactttggagtggtgcgggagctgctggaggaggagcagtggagcctgagcccagacctgcggcagaccctgctgatgctgagcatcttccagcagctggatggagccctgctgtgcctgctgcagcagcccctgcccaagagccaggtgcacagaagaccaccctgctgctgtgcctgccaggaggtgcagaccaccaagctgcccagcagctgcctgaacagcctggagagcctggagccccccctgcagcccggcaccagccctgcccagacaggccagctgcagagcaccctgggcggccggggccccagccctgagggctacctggtgggcaaccagcaggcctggctggccctgcggcagcaccagaggccccgctggcacctgcccttcttcagctgcctgggcaccagccctgagagctag

SEQ ID NO: 37501 - DNA, 666 bp, Artificial Sequence
  Description of Artificial Sequence: Synthetic coding sequence
atggcctcctggggcggggagaagaggggcggggccggcggcagccccaagccagctgtgtatgccaccaggaagacccccagcgtgggcagccaggaggaccagtggtacctggactacccaggggaccagtggagcctgggcttctcctacagctggtggaagaacagcgtgggcagcgagagcaagcacggggagggcgccctggaccagctgcagcatgatgtgcggctggaggacctgggggagctgcacagagctgcccggtctggagatgtgcctggggtggagcacgtgctggcccctggggacacaggagtggacaagagggacaggaagaagagcatccagcagctggtgcctgagtacaaggagaagcagaccccagagagcctgccccagaacaacaacccagctgcccccagccaggccgagggcggggagggcggcgtggcctgtggcaccgtggagcagatgacctggctgtgcagcctgccccatgctgtgggcggcggagatggagaccacagcagcactggagctgtgggcggccacccccggggccctggagagtactgccacctgcacgagcagagggtgcaccaccacatctttgcccggggcaagaggaagggcaagaaccacgtgtccaatgtggtgaggtag

SEQ ID NO: 37502 - DNA, 2757 bp, Artificial Sequence
  Description of Artificial Sequence: Synthetic coding sequence
tgaaaaggctgtgagaacaagcagccccaggtggaggaggagatggagaagcacaggagcaacagcacagagctgagcggcaccctgacagatggcaccaccgtgggcaatgatgatgatggcctgaaccagcagatccccaggaaagaaaatggagaacatgacaggcctgctgacaagaccagcaatgagaagaatgaggtgaagaaccagatctacccagaggccgactttgctgacagcatggagcccagcgagatcgccagcgaggactgtgagctgagccacagcgtgtatgagaacttcatgctgctgattgagcagctgaggatggagtacaaggacagcgccagcctgccccgcatccaggacaccttctgcctgtgtgagcacctgctgaagctgaagaacaaccactgtgaccagctgactgtgaagctgaagcagatggagaacatggtgtctgtgctgcagaatgagctgtctgagaccaagaagaccaagctgcagctggagctgcagaagattgagtgggagaaggagctgtatgacctgcggctggccctgaagcaggagaatgaggagaagagaaatgctgacatgctgtacaacaaggacagcgagcagctgcgcatcaaggaggaggagtgtgggaaggtggtggagaccaagcagcagctgaagtggaacctgcggcggctggtgaaggagctgaggacagtgaggaacaacctggacctggtggtgcaggagagaaatgatgcccagaagcagctgtctgaggagcaggatgcccgcatcctgcaggaccagatcctgaccagcaagcagaaggagctggagatggccaggaagaagatgaacagcgagatcagccaccgccaccagaaggagaaggacctcttccacgaggactgcatgctgcaggaggagatcgccctgctgcggctggagattgacaccatcaagaaccagaacaagcagaaggagaagaagtactttgaagatattgaagctgtgaaggagaagaatgacaacctgcagaagatcatcaagctgaatgaggagaccctgacagagaccatcctgcagtacagcggccagctgaacaacctgacagctgagaacaagatcctgaacagcgagctggagaatggcaagcagaaccaggagcggctggagattgagatggagagctaccgctgccgcctggccgctgctgtgcgggactgtgaccagagccagacagcccgggacctgaagctggacttccagaggacccggcaggagtgggtgcggctgcatgacaagatgaaggtggacatgagcggcctgcaggccaagaatgagatcctgtctgagaagctgagcaatgctgagagcaagatcaacagcctgcagatccagctgcacaacaccagagatgccctgggccgggagagcctcatcctggagcgggtgcagagggacctgagccagacccagtgccagaagaaggagacagagcagatgtaccagatcgagcagagcaagctgaagaagtacatcgccaagcaggagagcgtggaggagcggctgagccagctgcagagcgagaacatgctgctgcggcagcagctggatgatgcccacaagaaggccaacagccaggagaagaccagcagcaccatccaggaccagttccacagcgctgccaagaacctgcaggccgagagcgagaagcagatcctgagcctgcaggagaagaacaaggagctgatggatgagtacaaccacctgaaggagaggatggaccagtgtgagaaggagaaggccggcaggaaggtggtgatgagggagttccagcaggagtggacagacctgctgaagcagcagcccaccagcgaggccaccagccgctgccacatcaacctggatgagacccaggacagcaagaagaagctgggccagatccgctcagaaattgacctgacagaggcccaggagaccgtgcccagccgctgcctgcacctggatgctgaaaatgaggtgctgcagctgcagcagaccctcttctccatgaaggccatccagaagcagtgtgagaccctgcagaagaacaagaagcagctgaagcaggaggtggtgaacctgaagagctacatggagaggaacatgctggagcggggcaaggccgagtggcacaagctgctgattgaggagcgggccaggaaggagattgaggagaagctgaatgaggccatcctgaccctgcagaagcaggccgctgtgtcccatgagcagctggtgcagctgcgggaggacaacaccaccagcatcaagacccagatggagctgaccatcaaggacctggagagcgagatcagccgcatcaagaccagccaggccgacttcaacaagacagagctggagcgctacaaggagctgtacctggaggaggtgaaggtgcgggagagcctgagcaatgagctgagcaggaccaatgagatgattgctgaggtgtccacccagctgactgtggagaaggagcagaccaggagccgcagcctcttcaccgcctatgccaccaggcctgtgctggagagcccctgtgtgggcaacctgaatgattctgagggcctgaacaggaagcacatccccaggaagaagaggtctgccctgaaggacatggagagctacctgctgaaggtgtcctacctgttctcctttggagtgcagatcagtgaccgcatcctggtgtgctacctggtgaagtag

SEQ ID NO: 37503 - DNA, 1716 bp, Artificial Sequence
  Description of Artificial Sequence: Synthetic coding sequence
atggcctcctggggcggggagaagaggggcggcgctgagggcagccccaagccagctgtgtatgccaccaggaagacccccagcgtgggcagccagggcgaccagtggtacctgggctacccaggggaccagtggagcagcggcttcccctacagctggtggaagaacagcgtgggcagcgagagcaagcacggggagggcgccctggaccagccccagcatgatgtgcggctggaggacctgggggagctgcacagagctgcccggtctggagatgtgcctggggtggagcacatcctggcccctggggacacaggagtggacaagagggacaggaagaagagcatccagcagctggtgcctgagtacaaggagaagcagaccccagagagcctgccccagaacaacaacccagactggcaccccaccaacctgaccctgagtgatgagacctgccagaggagcaagaacctgaaggtggatgacaagtgccccagcgtgagccccagcatgcctgagaaccagagcgccaccaaggagctgggccagatgaacctgacagagcgggagaagatggacaccggggtggtgctgctgtctggaaatgacaccctgcatgacctgtgccagagccagctgcctgagaacaaggagagcaaggaggagcaggacagcgagctgaccagcgaggaggagcaggagcggctgaagggctgtgagaacaagcagccccagaagaccagccaggagcctgagatggccaaggactgtgaccgggaggacatccccatctaccctgtgctgccccacgtgcagaagtctgaggagatgtggattgagcagggcaagctggagtggaagaaccagctgaagctggtgatcaatgagctgaagcagagatttggagagatctatgagaagtacaagatcccagcctgcccagaggaggagcccctgctggacaacagcacccggggcacagatgtgaaggacatccccttcaacctgaccaacaacatccctggctgtgaggaggaggatgccagcgagatctctgtgtctgtggtgtttgagaccttccctgagcagaaggagcccagcctgaagaacatcatccacccctactaccacccctacagcggcagccaggagcacgtgtgccagagcagcagcaagttccacctgcacgagaacaagctggactgtgacaatgacaacaagccaggcatcggccacatcttcagcacagacaagaacttccacaatgatgccagcaccaagaaggccaggaaccctgaggtggtgatggtggagatgaaggaggaccaggagtttgacctgcagatgaccaagaacatgaaccagaacagcgacagcggcagcaccaacaactacaagagcctgaagcccaagctggagaacctgagcagcctgcccccagacagcgacaggaccagcgaggtgtacctgcacgaggagctgcagcaggacatgcagaagttcaagaatgaggtgaacaccctggaggaggagttcctggccctgaagaaggaggatgtgcagctgcacaaggatgtggaggaggagatggagaagcacaggagcaacagcacagagctgagcggcaccctgacagatggcaccaccgtgggcaatgatgatgatggcctgaaccagcagatccccaggaaagaaaatggagaacatgacagatag

SEQ ID NO: 37504 - DNA, 2181 bp, Artificial Sequence
  Description of Artificial Sequence: Synthetic coding sequence
atggcctcctggggcggggagaagaggggcggcgctgagggcagccccaagccagctgtgtatgccaccaggaagacccccagcgtgggcagccagggcgaccagtggtacctgggctacccaggggaccagtggagcagcggcttcccctacagctggtggaagaacagcgtgggcagcgagagcaagcacggggagggcgccctggaccagccccagcatgatgtgcggctggaggacctgggggagctgcacagagctgcccggtctggagatgtgcctggggtggagcacatcctggcccctggggacacaggagtggacaagagggacaggaagaagagcatccagcagctggtgcctgagtacaaggagaagcagaccccagagagcctgccccagaacaacaacccagactggcaccccaccaacctgaccctgagtgatgagacctgccagaggagcaagaacctgaaggtggatgacaagtgccccagcgtgagccccagcatgcctgagaaccagagcgccaccaaggagctgggccagatgaacctgacagagcgggagaagatggacaccggggtggtgctgctgtctggaaatgacaccctgcatgacctgtgccagagccagctgcctgagaacaaggagagcaaggaggccgagcaggacagcgagctgaccagcgaggaggagcaggagcggctgaagggctgtgagaacaagcagccccagaagaccagccaggagcctgagatggccaaggactgtgaccgggaggacatccccatctaccctgtgctgccccacgtgcagaagtctgaggagatgtggattgagcagggcaagctggagtggaagaaccagctgaagctggtgatcaatgagctgaagcagagatttggagagatctatgagaagtacaagatcccagcctgcccagaggaggagcccctgctggacaacagcacccggggcacagatgtgaaggacatccccttcaacctgaccaacaacatccctggctgtgaggaggaggatgccagcgagatctctgtgtctgtggtgtttgagaccttccctgagcagaaggagcccagcctgaagaacatcatccacccctactaccacccctacagcggcagccaggagcacgtgtgccagagcagcagcaagttccacctgcacgagaacaagctggactgtgacaatgacaacaagccaggcatcggccacatcttcagcacagacaagaacttccacaatgatgccagcaccaagaaggccagaaatcctgaggtggtgatggtggagatgaaggaggaccaggagtttgacctgcagatgaccaagaacatgaaccagaacagcgacagcggcagcaccaacaactacaagagcctgaagcccaagctggagaacctgagcagcctgcccccagacagcgacaggaccagcgaggtgtacctgcacgaggagctgcagcaggacatgcagaagttcaagaatgaggtgaacaccctggaggaggagttcctggccctgaagaaggaggatgtgcagctgcacaaggatgtggaggaggagatggagaagcacaggagcaacagcacagagctgagcggcaccctgacagatggcaccaccgtgggcaatgatgatgatggcctgaaccagcagatccccaggaaagaaaatggagaacatgacaggcctgctgacaagaccagcaatgagaagaatgaggtgaagaaccagatctacccagaggccgactttgctgacagcatggagcccagcgagatcgccagcgaggactgtgagctgagccacagcgtgtatgagaacttcatgctgctgattgagcagctgaggatggagtacaaggacagcgccagcctgccccgcatccaggacaccttctgcctgtgtgagcacctgctgaagctgaagaacaaccactgtgaccagctgactgtgaagctgaagcagatggagaacatggtgtctgtgctgcagaatgagctgtctgagaccaagaagaccaagctgcagctggagctgcagaagattgagtgggagaaggagctgtatgacctgcgcttcctgattggcatcaggaagaagaggatctccttcatgaagatcgcctgctgcaggaagaagctgccctgctag

SEQ ID NO: 37505 - DNA, 4284 bp, Artificial Sequence
  Description of Artificial Sequence: Synthetic coding sequence
atggcctcctggggcggggagaagaggggcggcgctgagggcagccccaagccagctgtgtatgccaccaggaagacccccagcgtgggcagccagggcgaccagtggtacctgggctacccaggggaccagtggagcagcggcttcccctacagctggtggaagaacagcgtgggcagcgagagcaagcacggggagggcgccctggaccagccccagcatgatgtgcggctggaggacctgggggagctgcacagagctgcccggtctggagatgtgcctggggtggagcacatcctggcccctggggacacaggagtggacaagagggacaggaagaagagcatccagcagctggtgcctgagtacaaggagaagcagaccccagagagcctgccccagaacaacaacccagactggcaccccaccaacctgaccctgagtgatgagacctgccagaggagcaagaacctgaaggtggatgacaagtgccccagcgtgagccccagcatgcctgagaaccagagcgccaccaaggagctgggccagatgaacctgacagagcgggagaagatggacaccggggtggtgctgctgtctggaaatgacaccctgcatgacctgtgccagagccagctgcctgagaacaaggagagcaaggaggccgagcaggacagcgagctgaccagcgaggaggagcaggagcggctgaagggctgtgagaacaagcagccccagaagaccagccaggagcctgagatggccaaggactgtgaccgggaggacatccccatctaccctgtgctgccccacgtgcagaagtctgaggagatgtggattgagcagggcaagctggagtggaagaaccagctgaagctggtgatcaatgagctgaagcagagatttggagagatctatgagaagtacaagatcccagcctgcccagaggaggagcccctgctggacaacagcacccggggcacagatgtgaaggacatccccttcaacctgaccaacaacatccctggctgtgaggaggaggatgccagcgagatctctgtgtctgtggtgtttgagaccttccctgagcagaaggagcccagcctgaagaacatcatccacccctactaccacccctacagcggcagccaggagcacgtgtgccagagcagcagcaagttccacctgcacgagaacaagctggactgtgacaatgacaacaagccaggcatcggccacatcttcagcacagacaagaacttccacaatgatgccagcaccaagaaggccagaaatcctgaggtggtgatggtggagatgaaggaggaccaggagtttgacctgcagatgaccaagaacatgaaccagaacagcgacagcggcagcaccaacaactacaagagcctgaagcccaagctggagaacctgagcagcctgcccccagacagcgacaggaccagcgaggtgtacctgcacgaggagctgcagcaggacatgcagaagttcaagaatgaggtgaacaccctggaggaggagttcctggccctgaagaaggaggatgtgcagctgcacaaggatgtggaggaggagatggagaagcacaggagcaacagcacagagctgagcggcaccctgacagatggcaccaccgtgggcaatgatgatgatggcctgaaccagcagatccccaggaaagaaaatggagaacatgacaggcctgctgacaagaccagcaatgagaagaatgaggtgaagaaccagatctacccagaggccgactttgctgacagcatggagcccagcgagatcgccagcgaggactgtgagctgagccacagcgtgtatgagaacttcatgctgctgattgagcagctgaggatggagtacaaggacagcgccagcctgccccgcatccaggacaccttctgcctgtgtgagcacctgctgaagctgaagaacaaccactgtgaccagctgactgtgaagctgaagcagatggagaacatggtgtctgtgctgcagaatgagctgtctgagaccaagaagaccaagctgcagctggagctgcagaagattgagtgggagaaggagctgtatgacctgcggctggccctgaagcaggagaatgaggagaagagaaatgctgacatgctgtacaacaaggacagcgagcagctgcgcatcaaggaggaggagtgtgggaaggtggtggagaccaagcagcagctgaagtggaacctgcggcggctggtgaaggagctgaggacagtgaggaacaacctggacctggtggtgcaggagagaaatgatgcccagaagcagctgtctgaggagcaggatgcccgcatcctgcaggaccagatcctgaccagcaagcagaaggagctggagatggccaggaagaagatgaacagcgagatcagccaccgccaccagaaggagaaggacctcttccacgaggactgcatgctgcaggaggagatcgccctgctgcggctggagattgacaccatcaagaaccagaacaagcagaaggagaagaagtactttgaagatattgaagctgtgaaggagaagaatgacaacctgcagaagatcatcaagctgaatgaggagaccctgacagagaccatcctgcagtacagcggccagctgaacaacctgacagctgagaacaagatcctgaacagcgagctggagaatggcaagcagaaccaggagcggctggagattgagatggagagctaccgctgccgcctggccgctgctgtgcgggactgtgaccagagccagacagcccgggacctgaagctggacttccagaggacccggcaggagtgggtgcggctgcatgacaagatgaaggtggacatgagcggcctgcaggccaagaatgagatcctgtctgagaagctgagcaatgctgagagcaagatcaacagcctgcagatccagctgcacaacaccagagatgccctgggccgggagagcctcatcctggagcgggtgcagagggacctgagccagacccagtgccagaagaaggagacagagcagatgtaccagatcgagcagagcaagctgaagaagtacatcgccaagcaggagagcgtggaggagcggctgagccagctgcagagcgagaacatgctgctgcggcagcagctggatgatgcccacaagaaggccaacagccaggagaagaccagcagcaccatccaggaccagttccacagcgctgccaagaacctgcaggccgagagcgagaagcagatcctgagcctgcaggagaagaacaaggagctgatggatgagtacaaccacctgaaggagaggatggaccagtgtgagaaggagaaggccggcaggaagattgacctgacagaggcccaggagaccgtgcccagccgctgcctgcacctggatgctgaaaatgaggtgctgcagctgcagcagaccctcttctccatgaaggccatccagaagcagtgtgagaccctgcagaagaacaagaagcagctgaagcaggaggtggtgaacctgaagagctacatggagaggaacatgctggagcggggcaaggccgagtggcacaagctgctgattgaggagcgggccaggaaggagattgaggagaagctgaatgaggccatcctgaccctgcagaagcaggccgctgtgtcccatgagcagctggtgcagctgcgggaggacaacaccaccagcatcaagacccagatggagctgaccatcaaggacctggagagcgagatcagccgcatcaagaccagccaggccgacttcaacaagacagagctggagcgctacaaggagctgtacctggaggaggtgaaggtgcgggagagcctgagcaatgagctgagcaggaccaatgagatgattgctgaggtgtccacccagctgactgtggagaaggagcagaccaggagccgcagcctcttcaccgcctatgccaccaggcctgtgctggagagcccctgtgtgggcaacctgaatgattctgagggcctgaacaggaagcacatccccaggaagaagaggtctgccctgaaggacatggagagctacctgctgaagatgcagcagaagctgcagaatgacctgacagctgaggtggccggcagcagccagacaggcctgcaccgcatcccccagtgcagcagcttcagcagcagcagcctgcacctgctgctgtgcagcatctgccagcccttcttcctgatcctgcagctgctgctgaacatgaacctggaccccatctag

SEQ ID NO: 37506 - DNA, 681 bp, Artificial Sequence
  Description of Artificial Sequence: Synthetic coding sequence
atggcctcctggggcggggagaagaggggcggcgctgagggcagccccaagccagctgtgtatgccaccaggaagacccccagcgtgggcagccagggcgaccagtggtacctgggctacccaggggaccagtggagcagcggcttcccctacagctggtggaagaacagcgtgggcagcgagagcaagcacggggagggcgccctggaccagccccagcatgatgtgcggctggaggacctgggggagctgcacagagctgcccggtctggagatgtgcctggggtggagcacatcctggcccctggggacacaggagtggacaagagggacaggaagaagagcatccagcagctggtgcctgagtacaaggagaagcagaccccagagagcctgccccagaacaacaacccagactggcaccccaccaacctgaccctgagtgatgagacctgccagaggagcaagaacctgaaggtggatgacaagtgccccagcgtgagccccagcatgcctgagaaccagagcgccaccaaggagctgggccagatgaacctgacagagcgggagaagatggacaccggggtggtgctgctgtctggaaatgacaccctgcatgacctgtgccagagccagctgcctgagaacaaggagagcaaggagggcaacaaggaggcctag

SEQ ID NO: 37507 - DNA, 4278 bp, Artificial Sequence
  Description of Artificial Sequence: Synthetic coding sequence
atggcctcctggggcggggagaagaggggcggcgctgagggcagccccaagccagctgtgtatgccaccaggaagacccccagcgtgggcagccagggcgaccagtggtacctgggctacccaggggaccagtggagcagcggcttcccctacagctggtggaagaacagcgtgggcagcgagagcaagcacggggagggcgccctggaccagccccagcatgatgtgcggctggaggacctgggggagctgcacagagctgcccggtctggagatgtgcctggggtggagcacatcctggcccctggggacacaggagtggacaagagggacaggaagaagagcatccagcagctggtgcctgagtacaaggagaagcagaccccagagagcctgccccagaacaacaacccagactggcaccccaccaacctgaccctgagtgatgagacctgccagaggagcaagaacctgaaggtggatgacaagtgccccagcgtgagccccagcatgcctgagaaccagagcgccaccaaggagctgggccagatgaacctgacagagcgggagaagatggacaccggggtggtgctgctgtctggaaatgacaccctgcatgacctgtgccagagccagctgcctgagaacaaggagagcaaggaggccgagcaggacagcgagctgaccagcgaggaggagcaggagcggctgaagggctgtgagaacaagcagccccagaagaccagccaggagcctgagatggccaaggactgtgaccgggaggacatccccatctaccctgtgctgccccacgtgcagaagtctgaggagatgtggattgagcagggcaagctggagtggaagaaccagctgaagctggtgatcaatgagctgaagcagagatttggagagatctatgagaagtacaagatcccagcctgcccagaggaggagcccctgctggacaacagcacccggggcacagatgtgaaggacatccccttcaacctgaccaacaacatccctggctgtgaggaggaggatgccagcgagatctctgtgtctgtggtgtttgagaccttccctgagcagaaggagcccagcctgaagaacatcatccacccctactaccacccctacagcggcagccaggagcacgtgtgccagagcagcagcaagttccacctgcacgagaacaagctggactgtgacaatgacaacaagccaggcatcggccacatcttcagcacagacaagaacttccacaatgatgccagcaccaagaaggccagaaatcctgaggtggtgatggtggagatgaaggaggaccaggagtttgacctgcagatgaccaagaacatgaaccagaacagcgacagcggcagcaccaacaactacaagagcctgaagcccaagctggagaacctgagcagcctgcccccagacagcgacaggaccagcgaggtgtacctgcacgaggagctgcagcaggacatgcagaagttcaagaatgaggtgaacaccctggaggaggagttcctggccctgaagaaggaggatgtgcagctgcacaaggatgtggaggaggagatggagaagcacaggagcaacagcacagagctgagcggcaccctgacagatggcaccaccgtgggcaatgatgatgatggcctgaaccagcagatccccaggaaagaaaatggagaacatgacaggcctgctgacaagaccagcaatgagaagaatgaggtgaagaaccagatctacccagaggccgactttgctgacagcatggagcccagcgagatcgccagcgaggactgtgagctgagccacagcgtgtatgagaacttcatgctgctgattgagcagctgaggatggagtacaaggacagcgccagcctgccccgcatccaggacaccttctgcctgtgtgagcacctgctgaagctgaagaacaaccactgtgaccagctgactgtgaagctgaagcagatggagaacatggtgtctgtgctgcagaatgagctgtctgagaccaagaagaccaagctgcagctggagctgcagaagattgagtgggagaaggagctgtatgacctgcggctggccctgaagcaggagaatgaggagaagagaaatgctgacatgctgtacaacaaggacagcgagcagctgcgcatcaaggaggaggagtgtgggaaggtggtggagaccaagcagcagctgaagtggaacctgcggcggctggtgaaggagctgaggacagtgaggaacaacctggacctggtggtgcaggagagaaatgatgcccagaagcagctgtctgaggagcaggatgcccgcatcctgcaggaccagatcctgaccagcaagcagaaggagctggagatggccaggaagaagatgaacagcgagatcagccaccgccaccagaaggagaaggacctcttccacgaggactgcatgctgcaggaggagatcgccctgctgcggctggagattgacaccatcaagaaccagaacaagcagaaggagaagaagtactttgaagatattgaagctgtgaaggagaagaatgacaacctgcagaagatcatcaagctgaatgaggagaccctgacagagaccatcctgcagtacagcggccagctgaacaacctgacagctgagaacaagatcctgaacagcgagctggagaatggcaagcagaaccaggagcggctggagattgagatggagagctaccgctgccgcctggccgctgctgtgcgggactgtgaccagagccagacagcccgggacctgaagctggacttccagaggacccggcaggagtgggtgcggctgcatgacaagatgaaggtggacatgagcggcctgcaggccaagaatgagatcctgtctgagaagctgagcaatgctgagagcaagatcaacagcctgcagatccagctgcacaacaccagagatgccctgggccgggagagcctcatcctggagcgggtgcagagggacctgagccagacccagtgccagaagaaggagacagagcagatgtaccagatcgagcagagcaagctgaagaagtacatcgccaagcaggagagcgtggaggagcggctgagccagctgcagagcgagaacatgctgctgcggcagcagctggatgatgcccacaagaaggccaacagccaggagaagaccagcagcaccatccaggaccagttccacagcgctgccaagaacctgcaggccgagagcgagaagcagatcctgagcctgcaggagaagaacaaggagctgatggatgagtacaaccacctgaaggagaggatggaccagtgtgagaaggagaaggccggcaggaagattgacctgacagaggcccaggagaccgtgcccagccgctgcctgcacctggatgctgaaaatgaggtgctgcagctgcagcagaccctcttctccatgaaggccatccagaagcagtgtgagaccctgcagaagaacaagaagcagctgaagcaggaggtggtgaacctgaagagctacatggagaggaacatgctggagcggggcaaggccgagtggcacaagctgctgattgaggagcgggccaggaaggagattgaggagaagctgaatgaggccatcctgaccctgcagaagcaggccgctgtgtcccatgagcagctggtgcagctgcgggaggacaacaccaccagcatcaagacccagatggagctgaccatcaaggacctggagagcgagatcagccgcatcaagaccagccaggccgacttcaacaagacagagctggagcgctacaaggagctgtacctggaggaggtgaaggtgcgggagagcctgagcaatgagctgagcaggaccaatgagatgattgctgaggtgtccacccagctgactgtggagaaggagcagaccaggagccgcagcctcttcaccgcctatgccaccaggcctgtgctggagagcccctgtgtgggcaacctgaatgattctgagggcctgaacaggaagcacatccccaggaagaagaggtctgccctgaaggacatggagagctacctgctgaagatgcagcagaagctgcagaatgacctgacagctgaggtggccgccgccaccaagtatgagcccggcagctacatcgccagccccctgggcttcacccacaaggagaacctgaaccaggaccctgtgctggaggtgaccaaggagtatgcccagatcctgcggaggaagtacatcctgtag

SEQ ID NO: 37508 - DNA, 984 bp, Artificial Sequence
  Description of Artificial Sequence: Synthetic coding sequence
atggcctcctggggcggggagaagaggggcggcgctgagggcagccccaagccagctgtgtatgccaccaggaagacccccagcgtgggcagccagggcgaccagtggtacctgggctacccaggggaccagtggagcagcggcttcccctacagctggtggaagaacagcgtgggcagcgagagcaagcacggggagggcgccctggaccagccccagcatgatgtgcggctggaggacctgggggagctgcacagagctgcccggtctggagatgtgcctggggtggagcacatcctggcccctggggacacaggagtggacaagagggacaggaagaagagcatccagcagctggtgcctgagtacaaggagaagcagaccccagagagcctgccccagaacaacaacccagactggcaccccaccaacctgaccctgagtgatgagacctgccagaggagcaagaacctgaaggtggatgacaagtgccccagcgtgagccccagcatgcctgagaaccagagcgccaccaaggagctgggccagatgaacctgacagagcgggagaagatggacaccggggtggtgctgctgtctggaaatgacaccctgcatgacctgtgccagagccagctgcctgagaacaaggagagcaaggaggccgagcaggacagcgagctgaccagcgaggaggagcaggagcggctgaagggctgtgagaacaagcagccccagaagaccagccaggagcctgagatggccaaggactgtgaccgggaggacatccccatctaccctgtgctgccccacgtgcagaagtctgaggagatcagcctgcccccagacagcgacaggaccagcgaggtgtacctgcacgaggagctgcagcaggacatgcagaagttcaagaatgaggtgaacaccctggaggaggagttcctggccctgaagaaggaggatgtgcagctgcacaaggactag

SEQ ID NO: 37509 - DNA, 783 bp, Artificial Sequence
  Description of Artificial Sequence: Synthetic coding sequence
atggcctcctggggcggggagaagaggggcggcgctgagggcagccccaagccagctgtgtatgccaccaggaagacccccagcgtgggcagccagggcgaccagtggtacctgggctacccaggggaccagtggagcagcggcttcccctacagctggtggaagaacagcgtgggcagcgagagcaagcacggggagggcgccctggaccagccccagcatgatgtgcggctggaggacctgggggagctgcacagagctgcccggtctggagatgtgcctggggtggagcacatcctggcccctggggacacaggagtggacaagagggacaggaagaagagcatccagcagctggtgcctgagtacaaggagaagcagaccccagagagcctgccccagaacaacaacccagactggcaccccaccaacctgaccctgagtgatgagacctgccagaggagcaagaacctgaaggtggatgacaagtgccccagcgtgagccccagcatgcctgagaaccagagcgccaccaaggagctgggccagatgaacctgacagagcgggagaagatggacaccggggtggtgctgctgtctggaaatgacaccctgcatgacctgtgccagagccagctgcctgagaacaaggagagcaaggaggccgagcaggacagcgagctgaccagcgaggaggagcaggagcggctgaagggctgtgagaacaagcagccccaggacaaggccatcttcaagacctgcagccccacagagaagacctag

SEQ ID NO: 37510 - DNA, 4284 bp, Artificial Sequence; identical to SEQ ID NO: 37505
  Description of Artificial Sequence: Synthetic coding sequence

SEQ ID NO: 37511 - DNA, 2178 bp, Artificial Sequence
  Description of Artificial Sequence: Synthetic coding sequence
atggcctcctggggcggggagaagaggggcggcgctgagggcagccccaagccagctgtgtatgccaccaggaagacccccagcgtgggcagccagggcgaccagtggtacctgggctacccaggggaccagtggagcagcggcttcccctacagctggtggaagaacagcgtgggcagcgagagcaagcacggggagggcgccctggaccagccccagcatgatgtgcggctggaggacctgggggagctgcacagagctgcccggtctggagatgtgcctggggtggagcacatcctggcccctggggacacaggagtggacaagagggacaggaagaagagcatccagcagctggtgcctgagtacaaggagaagcagaccccagagagcctgccccagaacaacaacccagactggcaccccaccaacctgaccctgagtgatgagacctgccagaggagcaagaacctgaaggtggatgacaagtgccccagcgtgagccccagcatgcctgagaaccagagcgccaccaaggagctgggccagatgaacctgacagagcgggagaagatggacaccggggtggtgctgctgtctggaaatgacaccctgcatgacctgtgccagagccagctgcctgagaacaaggagagcaaggaggccgagcaggacagcgagctgaccagcgaggaggagcaggagcggctgaagggctgtgagaacaagcagccccagaagaccagccaggagcctgagatggccaaggactgtgaccgggaggacatccccatctaccctgtgctgccccacgtgcagaagtctgaggagatgtggattgagcagggcaagctggagtggaagaaccagctgaagctggtgatcaatgagctgaagcagagatttggagagatctatgagaagtacaagatcccagcctgcccagaggaggagcccctgctggacaacagcacccggggcacagatgtgaaggacatccccttcaacctgaccaacaacatccctggctgtgaggaggaggatgccagcgagatctctgtgtctgtggtgtttgagaccttccctgagcagaaggagcccagcctgaagaacatcatccacccctactaccacccctacagcggcagccaggagcacgtgtgccagagcagcagcaagttccacctgcacgagaacaagctggactgtgacaatgacaacaagccaggcatcggccacatcttcagcacagacaagaacttccacaatgatgccagcaccaagaaggccagaaatcctgaggtggtgatggtggagatgaaggaggaccaggagtttgacctgcagatgaccaagaacatgaaccagaacagcgacagcggcagcaccaacaactacaagagcctgaagcccaagctggagaacctgagcagcctgcccccagacagcgacaggaccagcgaggtgtacctgcacgaggagctgcagcaggacatgcagaagttcaagaatgaggtgaacaccctggaggaggagttcctggccctgaagaaggaggatgtgcagctgcacaaggaggtggaggaggagatggagaagcacaggagcaacagcacagagctgagcggcaccctgacagatggcaccaccgtgggcaatgatgatgatggcctgaaccagcagatccccaggaaagaaaatggagaacatgacaggcctgctgacaagaccagcaatgagaagaatgaggtgaagaaccagatctacccagaggccgactttgctgacagcatggagcccagcgagatcgccagcgaggactgtgagctgagccacagcgtgtatgagaacttcatgctgctgattgagcagctgaggatggagtacaaggacagcgccagcctgccccgcatccaggacaccttctgcctgtgtgagcacctgctgaagctgaagaacaaccactgtgaccagctgactgtgaagctgaagcagatggagaacatggtgtctgtgctgcagaatgagctgtctgagaccaagaagaccaagctgcagctggagctgcagaagattgagtgggagaaggagctgtatgacctgcggctggccctgaagcaggagaacagaaggaaggagatgcccatctgctgcatcatcaagatcgtgaacagctag

SEQ ID NO: 37512 - DNA, 3465 bp, Artificial Sequence
  Description of Artificial Sequence: Synthetic coding sequence
atggcctcctggggcggggagaagaggggcggcgctgagggcagccccaagccagctgtgtatgccaccaggaagacccccagcgtgggcagccagggcgaccagtggtacctgggctacccaggggaccagtggagcagcggcttcccctacagctggtggaagaacagcgtgggcagcgagagcaagcacggggagggcgccctggaccagccccagcatgatgtgcggctggaggacctgggggagctgcacagagctgcccggtctggagatgtgcctggggtggagcacatcctggcccctggggacacaggagtggacaagagggacaggaagaagagcatccagcagctggtgcctgagtacaaggagaagcagaccccagagagcctgccccagaacaacaacccagactggcaccccaccaacctgaccctgagtgatgagacctgccagaggagcaagaacctgaaggtggatgacaagtgccccagcgtgagccccagcatgcctgagaaccagagcgccaccaaggagctgggccagatgaacctgacagagcgggagaagatggacaccggggtggtgctgctgtctggaaatgacaccctgcatgacctgtgccagagccagctgcctgagaacaaggagagcaaggaggccgagcaggacagcgagctgaccagcgaggaggagcaggagcggctgaagggctgtgagaacaagcagccccaggtggaggaggagatggagaagcacaggagcaacagcacagagctgagcggcaccctgacagatggcaccaccgtgggcaatgatgatgatggcctgaaccagcagatccccaggaaagaaaatggagaacatgacaggcctgctgacaagaccagcaatgagaagaatgaggtgaagaaccagatctacccagaggccgactttgctgacagcatggagcccagcgagatcgccagcgaggactgtgagctgagccacagcgtgtatgagaacttcatgctgctgattgagcagctgaggatggagtacaaggacagcgccagcctgccccgcatccaggacaccttctgcctgtgtgagcacctgctgaagctgaagaacaaccactgtgaccagctgactgtgaagctgaagcagatggagaacatggtgtctgtgctgcagaatgagctgtctgagaccaagaagaccaagctgcagctggagctgcagaagattgagtgggagaaggagctgtatgacctgcggctggccctgaagcaggagaatgaggagaagagaaatgctgacatgctgtacaacaaggacagcgagcagctgcgcatcaaggaggaggagtgtgggaaggtggtggagaccaagcagcagctgaagtggaacctgcggcggctggtgaaggagctgaggacagtgaggaacaacctggacctggtggtgcaggagagaaatgatgcccagaagcagctgtctgaggagcaggatgcccgcatcctgcaggaccagatcctgaccagcaagcagaaggagctggagatggccaggaagaagatgaacagcgagatcagccaccgccaccagaaggagaaggacctcttccacgaggactgcatgctgcaggaggagatcgccctgctgcggctggagattgacaccatcaagaaccagaacaagcagaaggagaagaagtactttgaagatattgaagctgtgaaggagaagaatgacaacctgcagaagatcatcaagctgaatgaggagaccctgacagagaccatcctgcagtacagcggccagctgaacaacctgacagctgagaacaagatcctgaacagcgagctggagaatggcaagcagaaccaggagcggctggagattgagatggagagctaccgctgccgcctggccgctgctgtgcgggactgtgaccagagccagacagcccgggacctgaagctggacttccagaggacccggcaggagtgggtgcggctgcatgacaagatgaaggtggacatgagcggcctgcaggccaagaatgagatcctgtctgagaagctgagcaatgctgagagcaagatcaacagcctgcagatccagctgcacaacaccagagatgccctgggccgggagagcctcatcctggagcgggtgcagagggacctgagccagacccagtgccagaagaaggagacagagcagatgtaccagatcgagcagagcaagctgaagaagtacatcgccaagcaggagagcgtggaggagcggctgagccagctgcagagcgagaacatgctgctgcggcagcagctggatgatgcccacaagaaggccaacagccaggagaagaccagcagcaccatccaggaccagttccacagcgctgccaagaacctgcaggccgagagcgagaagcagatcctgagcctgcaggagaagaacaaggagctgatggatgagtacaaccacctgaaggagaggatggaccagtgtgagaaggagaaggccggcaggaaggtggtgatgagggagttccagcaggagtggacagacctgctgaagcagcagcccaccagcgaggccaccagccgctgccacatcaacctggatgagacccaggacagcaagaagaagctgggccagatccgctcagaaattgacctgacagaggcccaggagaccgtgcccagccgctgcctgcacctggatgctgaaaatgaggtgctgcagctgcagcagaccctcttctccatgaaggccatccagaagcagtgtgagaccctgcagaagaacaagaagcagctgaagcaggaggtggtgaacctgaagagctacatggagaggaacatgctggagcggggcaaggccgagtggcacaagctgctgattgaggagcgggccaggaaggagattgaggagaagctgaatgaggccatcctgaccctgcagaagcaggccgctgtgtcccatgagcagctggtgcagctgcgggaggacaacaccaccagcatcaagacccagatggagctgaccatcaaggacctggagagcgagatcagccgcatcaagaccagccaggccgacttcaacaagacagagctggagcgctacaaggagctgtacctggaggaggtgaaggtgcgggagagcctgagcaatgagctgagcaggaccaatgagatgattgctgaggtgtccacccagctgactgtggagaaggagcagaccaggagccgcagcctcttcaccgcctatgccaccaggcctgtgctggagagcccctgtgtgggcaacctgaatgattctgagggcctgaacaggaagcacatccccaggaagaagaggtctgccctgaaggacatggagagctacctgctgaaggtgtcctacctgttctcctttggagtgcagatcagtgaccgcatcctggtgtgctacctggtgaagtag

SEQ ID NO: 37513 - DNA, 681 bp, Artificial Sequence
  Description of Artificial Sequence: Synthetic coding sequence
atggtgtcctggggcggggagaagaggggcggcgctgagggcagccccaagccagctgtgtatgccaccaggaagacaggctctgtgcgcagccaggaggaccagtggtacctgggctacccaggggaccagtggagcagcggcttctcctacagctggtggaagaacagcgtgggcagcgagagcaagcacggggagggcgccctggaccagccccagcatgatgtgcggctggaggacctgggggagctgcacagagctgcccggtctggagatgtgcctggggtggagcacgtgctggtgcctggggacacaggagtggacaagagggacaggaagaagagcatccagcagctggtgcctgagtacaaggagaagcagaccccagagagcctgccccagaacaacaacccagactggcaccccaccaacctgaccctgagtgatgagacctgccagaggagcaagaacctgaaggtggatgacaagtgccccagcgtgagccccagcatgcctgagaaccagagcgccaccaaggagctgggccagatgaacctgacagagcgggagaagatggacaccggggtggtgctgctgtctggaaatgacaccctgcatgacctgtgccagagccagctgcctgagaacaaggagagcaaggagggcaacaaggaggcctag

SEQ ID NO: 37514 - DNA, 3714 bp, Artificial Sequence
  Description of Artificial Sequence: Synthetic coding sequence
atggtgtcctggggcggggagaagaggggcggcgctgagggcagccccaagccagctgtgtatgccaccaggaagacaggctctgtgcgcagccaggaggaccagtggtacctgggctacccaggggaccagtggagcagcggcttctcctacagctggtggaagaacagcgtgggcagcgagagcaagcacggggagggcgccctggaccagccccagcatgatgtgcggctggaggacctgggggagctgcacagagctgcccggtctggagatgtgcctggggtggagcacgtgctggtgcctggggacacaggagtggacaagagggacaggaagaagagcatccagcagctggtgcctgagtacaaggagaagcagaccccagagagcctgccccagaacaacaacccagactggcaccccaccaacctgaccctgagtgatgagacctgccagaggagcaagaacctgaaggtggatgacaagtgccccagcgtgagccccagcatgcctgagaaccagagcgccaccaaggagctgggccagatgaacctgacagagcgggagaagatggacaccggggtgaagaccagccaggagcctgagatggccaaggactgtgaccgggaggacatccccatctaccctgtgctgccccacgtgcagaagtctgaggagatgagaattgagcagggcaagctggagtggaagaaccagctgaagctggtgatcaatgagctgaagcagagatttggagagatctatgagaagtacaagatcccagcctgcccagaggaggagcccctgctggacaacagcacccggggcacagatgtgaaggacatccccttcaacctgaccaacaacatccctggctgtgaggaggaggatgccagcgagatctctgtgtctgtggtgtttgagaccttccctgagcagaaggagcccagcctgaagaacatcatccacagctactaccacccctacagcggcagccaggagcacgtgtgccagagcagcagcaagctgcacctgcacgagaacaagctggactgtgacaatgacaacaagccaggcatcggccacatcttcagcacagacaagaacttccacaatgatgccagcaccaagaaggccagaaatcctgaggtggtgacagtggagatgaaggaggaccaggagtttgacctgcagatgaccaagaacatgaaccagaacagcgacagcggcagcaccaacaactacaagagcctgaagcccaagctggagaacctgagcagcctgcccccagacagcgacaggaccagcgaggtgtacctgcacgaggagctgcagcaggacatgcagaagttcaagaatgaggtgaacaccctggaggaggagttcctggccctgaagaaggaaaatgtgcagctgcacaaggaggtggaggaggagatggagaagcacaggagcaacagcacagagctgagcggcaccctgacagatggcaccaccgtgggcaatgatgatgatggcctgaaccagcagatccccaggaaagaaaatggagaacatgaccggctggccctgaagcaggagaatgaggagaagagaaatgctgacatgctgtacaacaaggacagcgagcagctgcgcatcaaggaggaggagtgtgggaaggtggtggagaccaagcagcagctgaagtggaacctgcggcggctggtgaaggagctgaggacagtggtgcaggagagaaatgatgcccagaagcagctgtctgaggagcaggatgcccgcatcctgcaggaccagatcctgaccagcaagcagaaggagctggagatggcccagaagaagaggaaccctgagatcagccaccgccaccagaaggagaaggacctcttccacgagaactgcatgctgcaggaggagatcgccctgctgcggctggagattgacaccatcaagaaccagaacaagcagaaggagaagaagtactttgaggacatcgaggtggtgaaggagaagaatgacaacctgcagaagatcatcaagagaaatgaggagaccctgacagagaccatcctgcagtacagcggccagctgaacaacctgacagctgagaacaagatgctgaacagcgagctggagaatggcaaggagaaccaggagcggctggagattgagatggagagctaccgctgccgcctggccgctgctgtgcatgactgtgaccagagccagacagcccgggacctgaagctggacttccagaggacccggcaggagtgggtgcggctgcatgacaagatgaaggtggacatgagcggcctgcaggccaagaatgagatcctgtctgagaagctgagcaatgctgagagcaagatcaacagcctgcagatccagctgcacaacaccagagatgccctgggccgggagagcctcatcctggagcgggtgcagagggacctgagccagacccagtgccagaagaaggagacagagcagatgtaccagagcaagctgaagaagtacatcgccaagcaggagagcgtggaggagcggctgagccagctgcagagcgagaacatgctgctgcggcagcagctggatgatgtgcacaagaaggccaacagccaggagaagaccatcagcaccatccaggaccagttccacagcgctgccaagaacctgcaggccgagagcgagaagcagatcctgagcctgcaggagaagaacaaggagctgatggatgagtacaaccacctgaaggagaggatggaccagtgtgagaaggagaaggccggcaggaagattgacctgacagaggcccaggagaccgtgcccagccgctgcctgcacctggatgctgaaaatgaggtgctgcagctgcagcagaccctcttctccatgaaggccatccagaagcagtgtgagaccctgcagaagaacaagaagcagctgaagcaggaggtggtgaacctgaagagctacatggagaggaacatgctggagcggggggaggccgagtggcacaagctgctgattgaggagcgggccaggaaggagattgaggagaagctgaatgaggccatcctgaccctgcagaagcaggccgctgtgtcccatgagcagctggcccagctgcgggaggacaacaccaccagcatcaagacccagatggagctgaccgtcatcgacctggagagcgagatcagccgcatcaagaccagccaggccgacttcaacaagaccaagctggagcgctacaaggagctgtacctggaggaggtgaaggtgcgggagagcctgagcaatgagctgagcaggaccaatgagatgattgctgaggtgtccacccagctgactgtggagaaggagcagaccaggagccgcagcctcttcaccgcctatgccaccaggcctgtgctggagagcccctgtgtgggcaacctgaatgattctgagggcctgaacaggaagcacatccccaggaagaagaggtctgccctgaaggacatggagagctacctgctgaagatgcagcagaagctgcagaatgacctgacagctgaggtggccggcagcagccagacaggcctgcaccgcatcccccagtgcagcagcttcagcagcagcagcctgcacctgctgctgtgcagcatctgccagcccttcttcctgatcctgcagctgctgctgaacatgaacctggaccccatctag

SEQ ID NO: 37515 - DNA, 2868 bp, Artificial Sequence
  Description of Artificial Sequence: Synthetic coding sequence
atggaggacagcagcacagacacagagaaggaggaggaggaggagaaggatgagaaggaccaggagcccatctatgccatcgtgcccaccatcaacatccaggatgaaagatttgtggacctgtctgagaccccagccttcatcttcctgcacgagctgcacgccatgggcaagctgcccggcaccaggatggccgccctgaaggccaagtacaccctgctgcatgatgctgtgatgagcacccaggagagcgaggtgcagctgctgcagaatgccaagcgcttcacagagcagatccagcagcagcagttccacctgcagcaggccgacaacttccctgaggccttcagcacagaggtgtccaagatgagggagcagctgctgaagtaccagaatgagtacaatgctgtgaaggagcgggagttccacaaccagtaccgcctgaacagcctgaaggaggagaagatcatcatcgtgaaggagtttgagaagatcaccaagccaggagagatggagaagaagatgaagatcctgcgggagagcacagaggagctgaggaaggagatcatgcagaagaagctggagatcaagaacctgcgggaggacctggccagcaagcagaagcagctgctgaaggagcagaaggagctggaggagctgctgggccaccaggtggtgctgaaggatgaggtggcccaccaccagaccatccctgtgcagatcggcaaggagattgagaagatcaccaggaagaaggtggagatggagaagaagaagatcgtgctggagcaggaggtgaagaccctgaatgacagcctgaagaaggtggagaacaaggtgtctgccatcgtggatgagaaggaaaatgtcatcaaggaggtggagggcaagagggccctgctggagatcaaggagcgggagcacaaccagctggtgaagctgctggagctggcccgggagaatgaggccaccagcctgacagagcggggcatcctggacctgaacctgaggaacagcctgattgacaagcagaactaccatgatgagctgagcaggaagcagcgggagaaggagcgggacttcaggaacctgaggaagatggagctgctgctgaaggtgtcctgggatgccctgcggcagacccaggccctgcaccagaggctgctgctggagatggaggccatccccaaggatgacagcaccctgtctgaaagaagaagagagctgcacaaggaggtggaggtggccaagaggaacctggcccagcagaagatcatcagcgagatggagagcaagctggtggagcagcagctggccgaggagaacaagctgctgaaggagcaggagaacatgaaggagctggtggtgaacctgctgaggatgacccagatcaagattgatgagaaggagcagaagagcaaggacttcctgaaggcccagcagaagtacaccaacatcgtgaaggagatgaaggccaaggacctggagatccgcatccacaagaagaagaagtgtgagatctacagaaggctgcgggagtttgccaagctgtatgacaccatcagaaatgaaagaaacaagtttgtgaacctgctgcacaaggcccaccagaaggtgaatgagatcaaggagcggcacaagatgagcctgaatgagctggagatcctgagaaattctgctgtgtcccaggagaggaagctgcagaacagcatgctgaagcacgccaacaacgtgaccatccgggagagcatgcagaatgatgtgaggaagatcgtgtccaagctgcaggagatgaaggagaagaaggaggcccagctgaacaacatcgaccggctggccaacaccatcaccatgattgaggaggagatggtgcagctgaggaagagatatgagaaggctgtgcagcacagaaatgaaagtggagtgcagctgattgagcgggaggaggagatctgcatcttctatgagaagatcaacatccaggagaagatgaagctgaatggagaaattgagatccacctgctggaggagaagatccagttcctgaagatgaagattgctgagaagcagaggcagatctgtgtgacccagaagctgctgcctgccaagaggagcctggatgctgacctggccgtgctgcagatccagttcagccagtgcacagaccgcatcaaggacctggagaagcagtttgtgaagccagatggagaaaatagagcccgcttcctgcccgggaaggacctgacagagaaggagatgatccagaagctggacaagctggagctgcagctggccaagaaggaggagaagctgctggagaaggacttcatctatgagcaggtgtcccggctgacagaccggctgtgcagcaagacccagggctgcaagcaggacaccctgctgctggccaagaagatgaatggctaccagaggcgcatcaagaatgccacagagaagatgatggccctggtggccgagctgtccatgaagcaggccctgaccatcgagctgcagaaggaggtgcgggagaaggaggacttcatcttcacctgcaacagcagaattgagaagggcctgcccctgaacaaggagattgagaaggagtggctgaaggtgctgagagatgaggagatgcacgccctggccatcgccgagaagagccaggagttcctggaggccgacaaccggcagctgcccaacggggtgtacaccacagctgagcagaggcccaatgcctacatccctgaggctgatgccaccctgcccctgcccaagccctatggagccctggcccccttcaagcccagcgagcccggggccaacatgaggcacatcaggaagcctgtgatcaagcctgtggagatctag

SEQ ID NO: 37516 - DNA, 513 bp, Artificial Sequence
  Description of Artificial Sequence: Synthetic coding sequence
atggaggacagcagcacagacacagagaaggaggaggaggaggagaaggatgagaaggaccaggagcccatctatgccatcgtgcccaccatcaacatccaggatgaaagatttgtggacctgtctgagaccccagccttcatcttcctgcacgagctgcacgccatgggcaagctgcccggcaccaggatggccgccctgaaggccaagtacaccctgctgcatgatgctgtgatgagcacccaggagagcgaggtgcagctgctgcagaatgccaagcgcttcacagagcagatccagcagcagcagttccacctgcagcaggccgacaacttccctgaggccttcagcacagaggtgtccaagatgagggagcagctgctgaagtaccagaatgagtacaatgctgtgaaggagcgggagttccacaaccagtaccgcctgaacagcctgaaggaggagaagatcatcatcgtgaaggagtttgagaagatcaccaagccaggagtgtag

SEQ ID NO: 37517 - DNA, 2010 bp, Artificial Sequence
  Description of Artificial Sequence: Synthetic coding sequence
atggagaagaagaagatcgtgctggagcaggaggtgaagaccctgaatgacagcctgaagaaggtggagaacaaggtgtctgccatcgtggatgagaaggaaaatgtcatcaaggaggtggagggcaagagggccctgctggagatcaaggagcgggagcacaaccagctggtgaagctgctggagctggcccgggagaatgaggccaccagcctgacagagcggggcatcctggacctgaacctgaggaacagcctgattgacaagcagaactaccatgatgagctgagcaggaagcagcgggagaaggagcgggacttcaggaacctgaggaagatggagctgctgctgaaggtgtcctgggatgccctgcggcagacccaggccctgcaccagaggctgctgctggagaagatcatcagcgagatggagagcaagctggtggagcagcagctggccgaggagaacaagctgctgaaggagcaggagaacatgaaggagctggtggtgaacctgctgaggatgacccagatcaagattgatgagaaggagcagaagagcaaggacttcctgaaggcccagcagaagtacaccaacatcgtgaaggagatgaaggccaaggacctggagatccgcatccacaagaagaagaagtgtgagatctacagaaggctgcgggagtttgccaagctgtatgacaccatcagaaatgaaagaaacaagtttgtgaacctgctgcacaaggcccaccagaaggtgaatgagatcaaggagcggcacaagatgagcctgaatgagctggagatcctgagaaattctgctgtgtcccaggagaggaagctgcagaacagcatgctgaagcacgccaacaacgtgaccatccgggagagcatgcagaatgatgtgaggaagatcgtgtccaagctgcaggagatgaaggagaagaaggaggcccagctgaacaacatcgaccggctggccaacaccatcaccatgattgaggaggagatggtgcagctgaggaagagatatgagaaggctgtgcagcacagaaatgaaagtggagtgcagctgattgagcgggaggaggagatctgcatcttctatgagaagatcaacatccaggagaagatgaagctgaatggagaaattgagatccacctgctggaggagaagatccagttcctgaagatgaagattgctgagaagcagaggcagatctgtgtgacccagaagctgctgcctgccaagaggagcctggatgctgacctggccgtgctgcagatccagttcagccagtgcacagaccgcatcaaggacctggagaagcagtttgtgaagccagatggagaaaatagagcccgcttcctgcccgggaaggacctgacagagaaggagatgatccagaagctggacaagctggagctgcagctggccaagaaggaggagaagctgctggagaaggacttcatctatgagcaggtgtcccggctgacagaccggctgtgcagcaagacccagggctgcaagcaggacaccctgctgctggccaagaagatgaatggctaccagaggcgcatcaagaatgccacagagaagatgatggccctggtggccgagctgtccatgaagcaggccctgaccatcgagctgcagaaggaggtgcgggagaaggaggacttcatcttcacctgcaacagcagaattgagaagggcctgcccctgaacaaggagattgagaaggagtggctgaaggtgctgagagatgaggagatgcacgccctggccatcgccgagaagagccaggagttcctggaggccgacaaccggcagctgcccaacggggtgtacaccacagctgagcagaggcccaatgcctacatccctgaggctgatgccaccctgcccctgcccaagccctatggagccctggcccccttcaagcccagcgagcccggggccaacatgaggcacatcaggaagcctgtgatcaagcctgtggagatctag

SEQ ID NO: 37518 - DNA, 279 bp, Artificial Sequence
  Description of Artificial Sequence: Synthetic coding sequence
atggatgagctgctgcgggagcgggacatcctgaacaagaacatgctgaaggctgtgaatgccacccagaagcagacagacctggtgaagctgcacgagcaggccaagaggaacctggagggggagatccagaactacaaggatgaggcccagaagcagaggaagatcatcttccacctggagaaggagcgggaccgctacatcaaccaggccagtgacctgacccagaaggctgacagcgtgaggatgccctggcccctggacaagggcaagtggtag

SEQ ID NO: 37519 - DNA, 279 bp, Artificial Sequence; identical to SEQ ID NO: 37518
  Description of Artificial Sequence: Synthetic coding sequence

SEQ ID NO: 37520 - DNA, 2619 bp, Artificial Sequence
  Description of Artificial Sequence: Synthetic coding sequence
atggccgaggagaagggcggcaagcaggtgctggaggagagcgcctttgaggagatggagcgggacttccagggcgtgctgcacgagctgagcggggacaagagcctggagaagttcagaattgaatatgagcggctgcatgctgtgatgaagaagagctatgacaatgagaagaggctgatggccaagtgccgggagctgaatgctgagatcgtggtgaacagcgccaaggtggccacagccctgaagctgagccaggatgaccagaccaccatcgccagcctgaagaaggagattgagaaggcctggaagatggtggacagcgcctatgacaaggagcagaaggccaaggagaccatcctggccctgaaggaggagatcgtgaacctgaccaagctggtggagcagggcagcggcctgtccatggaccagcacagcaacatccgggacctgctgcgcttcaaggaggaggtgaccaaggagcgggaccagctgctgtctgaggtggtgaagctgcgggagagcctggcccagaccacagagcagcagcaggagacagagaggagcaaggaggaggccgagcacgccatcagccagttccagcaggagatccagcagaggcagaatgaggccagccgggagttcaggaagaaggagaagctggagaaggagctgaagcagatccaggccgacatggacagccggcagacagagatcaaggccctgcagcagtatgtgcagaagagcaaggaggagctgcagaagctggagcagcagctgaaggagcagaagatcctgaatgaaagagctgccaaggagctggagcagttccagatgagaaatgccaagctgcagcaggagaatgagcagcacagcctggtgtgtgagcagctgagccaggagaaccagcagaaggccctggagctgaaggccaaggaggaggaggtgcaccagatgaggctggacatcggcaagctgaacaagatccgggagcagatccacaagaagctgcaccacacagaggaccagaaggccgaggtggagcagcacaaggagaccctgaagaaccagatcgtgggcctggagcgggaggtggaggccagcaagaagcaggccgagctggacaggaaggccatggatgagctgctgcgggagcgggacatcctgaacaagaacatgctgaaggctgtgaatgccacccagaagcagacagacctggtgaagctgcacgagcaggccaagaggaacctggagggggagatccagaactacaaggatgaggcccagaagcagaggaagatcatcttccacctggagaaggagcgggaccgctacatcaaccaggccagtgacctgacccagaaggtgctgatgaacatggaggacatcaaggtgcgggagacccagatctttgactacaggaagaagattgctgagagcgagatcaagctgaagcagcagcagaacctgtatgaagctgtgcggagtgacaggaacctgtacagcaagaacctggtggaggcccaggatgagatcacagacatgaagaggaagctgaagatcatgatccaccaggtggatgagctgaaggaggacatcagcgccaaggagagcgccctggtgaagctgcacctggagcagcagagaattgagaaggagaaggagaccctgaaggccgagctgcagaagctgcggcagcaggccctggagaccaagcacttcatcgagaagcaggaggccgaggagaggaagctgctgcgcatcatcgccgaggctgatggagagcggctgcggcagaagaaggagctggaccaggtgatcagcgagcgggacatcctgggcagccagctggtgagaagaaatgatgagctggccctgctgtatgagaagatcaagatccagcagagcgtgctgaacaagggggagagccagtacaaccagaggctggaggacatgaggatcctgcggctggagatcaagaagctgcggcgggagaagggcatcctggcccgctccatggccaacgtggaggagctgcggcaggagttcttccacatgcagcgggagctgctgaaggagaggacccgctgccgggccctggaggaggagctggagaaccccctgaatgtgcaccgctggaggaagctggaggccagtgaccccaatgcctatgagctgatccagaagatccacaccctgcagaagaggctcatcagcaagacagaggaggtggtggagaaggagctgctgctgcaggagaaggagaagctgtacatggagctgaagcacgtgctggcccggcagcccggccctgaggccgctgagcagctgaagctgtacagaaggaccctgcatgacaagaagcagcagctgaaggtgctgagcagcgagctgaacatgtatgaggtgcagagcaaggagtacaagtatgaggtggagaagctgaccaatgagctgcagaacctgaagaagaagtacctggcccagaagaggaaggagcagctgcagaagaacaaggacacagcccccatggacaacaccttcctgatggtgaagcccaacggccctggcttcaccggcggcggcttccccctgcggagcaccaagatgaccttctag

SEQ ID NO: 37521 - DNA, 1776 bp, Artificial Sequence
  Description of Artificial Sequence: Synthetic coding sequence
atgtgtgccgccagcgccagcccagacaacctggtgttccacatgaagaatgagatgaggaacatcaagtacaagcctgtggactaccagcagctgcgggccctgacagaggccaagaagctggccagcgccagcgccaagctgaagatcaggaaggccatgctgaccagcaagctgagcaaggagcagaccctcatcaagcagcacaagcaggtgtggtggcaggagtaccagaggctgaatgaggtgcgctgcaagatggagagcgagatcaagagcctgctgaatgaggagaacattggaaatgaatgtctgtgtgacctgaccaactttgagcaggagctgtctgagcagcagtgcacctacctgaagaatgtcatcaaccccatccagcagctgcgggctgacctgaagtaccggcagcaccacaccctgcagcacagccacccccacatcgagttcaacagcatgaaggtgctggaggaggtggactttgtgaagaagcagctgaagacagtgtttgagcggctgcggctggagcagcagagaattgaaaatgacctgagtgactggagcatcaagatcctggaccacagcctggaggagaagaccaaccccctgtctgagctgcccatcgagctggagagcctggagtgcccctacccagacctgaagagcagcatcctgtctgagttctacaagttcacccagaagtaccagaagaagctgcaggacttcaacctgcagctggaggacatctacagaaactgccagctgtctgaggaggaccactggatctaccaggccatcctggaccagtacccaggggacctgtttggaagaaggaccctgtacctggacatgctgcagcgctacttcccccacaagagcagacatgacctggtggagcacgagaagtactgtgaccagtacagatttgccatcgagcagcagaacatcctgatcagcaactggaacaagaacaagaaggacttcatccagaaggctgtgctgaccctgacagaggcctgtgccacccatgagatggagagcatgctggccaaggacaagaagaagcagcaggagctgtgtgccgacctgaaggccaaggtgcggcagtggagggcccaccaggaggaggtggcccggctggagatggagatcagcgcccggcggcgggagaaggaggaggagaaggagaagctgtggaagaagaaggagctgctgcagagagctgagaagaagaagaagatcaagaagtactgggccaagaagaagcagaagtggcaggagatggagatgagggacctgcagaggctggaggagctgaagaagctgattgctgagcagagcctgaaggaccgggagcgggtgaagtaccggcaggagctgctggagcggcggctgatggagaagaaggaggtggccctgcaggaggcccacgaggacaaggagcgggcccggcggctggaggccctgaggaagcaggtggccgtggtggcccagtttgatcctgtgaggatgatgtctgacaccatggccagcaaggccaggatgggcattgaaattgaggaggagttcatcctgcagaagcccctcttcaccctgaacacctacaatgagcagcagatcatcagtgacccccggctgcgctttgagctggccctgcgggaggccggcctgcacaggaccctgtatgccaaggagatcctgcccaagatcagcccccagaagccacccaggaaggacatggagagcacagtgttcaagatctag

SEQ ID NO: 37522 - DNA, 795 bp, Artificial Sequence
  Description of Artificial Sequence: Synthetic coding sequence
atgaatgtgtttgtgaccctgcagatcctggtggactttgtgaagaagcagctgaagacagtgtttgagcggctgcggctggagcagcagagaattgaaaatgacctgagtgactggagcatcaagatcctggaccacagcctggaggagaagaccaaccccctgtctgagctgcccatcgagctggagagcctggagtgcccctacccagacctgaagagcagcatcctgtctgagttctacaagttcacccagaagtaccagaagaagctgcaggacttcaacctgcagctggaggacatctacagaaactgccagctgtctgaggaggaccactggatctaccaggccatcctggaccagtacccaggggacctgtttggaagaaggaccctgtacctggacatgctgcagcgctacttcccccacaagagcagacatgacctggtggagcacgagaagtactgtgaccagtacagatttgccatcgagcagcagaacatcctgatcagcaactggaacaagaacaagaaggacttcatccagaaggctgtgctgaccctgacagaggcctgtgccacccatgagatggagagcatgctggccaaggacaagaagaagcagcaggagctgtgtgccgacctgaaggccaaggtgcggcagtggagggcccaccaggaggaggtggcccggctggagatggagatcagcgcccggcggcgggagaaggaggaggagaaggagaagctgtggaagaagaaggagctgctgcagagagctgagaagaagaagtag

SEQ ID NO: 37523 - DNA, 900 bp, Artificial Sequence
  Description of Artificial Sequence: Synthetic coding sequence
atggagagcgagatcaagagcctgctgaatgaggagaacattggaaatgaatgtctgtgtgacctgaccaactttgagcaggagctgtctgagcagcagtgcacctacctgaagaatgtcatcaaccccatccagcagctgcgggctgacctgaagtaccggcagcaccacaccctgcagcacagccacccccacatcgagttcaacagcatgaaggtgctggaggaggtggactttgtgaagaagcagctgaagacagtgtttgagcggctgcggctggagcagcagagaattgaaaatgacctgagtgactggagcatcaagatcctggaccacagcctggaggagaagaccaaccccctgtctgagctgcccatcgagctggagagcctggagtgcccctacccagacctgaagagcagcatcctgtctgagttctacaagttcacccagaagtaccagaagaagctgcaggacttcaacctgcagctggaggacatctacagaaactgccagctgtctgaggaggaccactggatctaccaggccatcctggaccagtacccaggggacctgtttggaagaaggaccctgtacctggacatgctgcagcgctacttcccccacaagagcagacatgacctggtggagcacgagaagtactgtgaccagtacagatttgccatcgagcagcagaacatcctgatcagcaactggaacaagaacaagaaggacttcatccagaaggctgtgctgaccctgacagaggcctgtgccacccatgagatggagagcatgctggccaaggacaagaagaagcagcaggagctgtgtgccgacctgaaggccaagagccaggtgtgcctgtaccagcagcatgaaaatggcctcatccagtag

SEQ ID NO: 37524 - DNA, 1362 bp, Artificial Sequence
  Description of Artificial Sequence: Synthetic coding sequence
atggagatccaccacttcctgctgaagaggaagcaggccaacctggcccagctgctgcgggacagccaggacaggaacaagcacctgggggaggagatcaaggagctgcagcagaggctgggggaggtgcagggcgacaacaagctgctgaggatgaccatcgccaagcagaggctgggagatgaggccatcggcgtgcgccactttgctgcccacgagcgggaggacctggtgcagcagctggagcgggccaaggagcagatcgagagcctggagcatgacctgcaggcctctgtggatgagctgcaggatgtgaaggaggagaggagcagctaccaggacaaggtggagcggctgaaccaggagctgaaccacatcctgagcggccatgaaaatcgcatcattgatgtggatgccctgtgcatggagaaccgctacctgcaggagcggctgaagcagctgcacgaggaggtgaacctgctgaagagcaacatcgccaagtacaagaatgccctggagaggaggaagaacagcaagggccagggcaagagcagcagcagcgccctgactggagtgctgagcgccaagcaggtgcaggacctgctgtctgaggaccacggctgcagcctgcctgccaccccccagagcatcagtgacctgaagagcctggccacagccctgctggagaccatccacgagaagaacatggtgatccagcaccagaggcagaccaacaagatcctgggcaacagagtggccgagctggagaagaagctgcggaccctggaggtgtctggcctgtggagcctgcccggcggcaaggacaccatcctcttcagtgaccccaccctgcccagcggccagaggagccgcagccccctgctgaagtttgtggagcagcccacagagaacaaggctgaccccaaggatggagaggcccagaagcaggaggaggatgagagctgtgccgctgctgaggccctgacagccccagaagatgctggccggcctgctgtgaacagccctgccaaccagagccggggcaaccagtgcaagctgttccaccccagcctgccccagctgcccagcgaggaggaggtgaacagcctgggccgggagatcatcaagctgaccaaggagcaggccgctgctgagctggaggaggtgcggcgggagagccccatcgagggccagaggtctgagaccggccctgcccctcctggcctggccatccagggcgagctgcccaagagccacctggacagctttgaggccagcaggcctgctgccaaggccagcaccccagaagatggcaagggcatccctgagggcggcggcatgaggagcacagtgaagacctag

SEQ ID NO: 37525 - DNA, 261 bp, Artificial Sequence
  Description of Artificial Sequence: Synthetic coding sequence
atggccaaccagctgcgggagcggcaccagagcctgaagaagaagtaccgggagctgattgatggagaccccagcctgcccccagagaagaggaagcaggccaacctggcccagctgctgcgggacagccaggacaggaacaagcacctgggggaggagatcaaggagctgcagcagaggctgggggaggtgcagggcgacaacaagggccgcctgcggagcaagaagaagatgaaggtggtgcccctgctgcggaggtag

SEQ ID NO: 37526 - DNA, 1590 bp, Artificial Sequence
  Description of Artificial Sequence: Synthetic coding sequence
atggaggaggaggccatgaatggagacagaacagaaagtgactggcagggcctggtgtctgagtacctggtgtgcaagaggaagctggagagcaagaaggaggccctgctgatcctgagcaaggagctggacacctgccagcaggagcgggaccagtacaagctgatggccaaccagctgcgggagcggcaccagagcctgaagaagaagtaccgggagctgattgatggagaccccagcctgcccccagagaagaggaagcaggccaacctggcccagctgctgcgggacagccaggacaggaacaagcacctgggggaggagatcaaggagctgcagcagaggctgggggaggtgcagggcgacaacaagctgctgaggatgaccatcgccaagcagaggctgggagatgaggccatcggcgtgcgccactttgctgcccacgagcgggaggacctggtgcagcagctggagcgggccaaggagcagatcgagagcctggagcatgacctgcaggcctctgtggatgagctgcaggatgtgaaggaggagaggagcagctaccaggacaaggtggagcggctgaaccaggagctgaaccacatcctgagcggccatgaaaatcgcatcattgatgtggatgccctgtgcatggagaaccgctacctgcaggagcggctgaagcagctgcacgaggaggtgaacctgctgaagagcaacatcgccaagtacaagaatgccctggagaggaggaagaacagcaagggccagggcaagagcagcagcagcgccctgactggagtgctgagcgccaagcaggtgcaggacctgctgtctgaggaccacggctgcagcctgcctgccaccccccagagcatcagtgacctgaagagcctggccacagccctgctggagaccatccacgagaagaacatggtgatccagcaccagaggcagaccaacaagatcctgggcaacagagtggccgagctggagaagaagctgcggaccctggaggtgtctggcctgtggagcctgcccggcggcaaggacaccatcctcttcagtgaccccaccctgcccagcggccagaggagccgcagccccctgctgaagtttgtggagcagcccacagagaacaaggctgaccccaaggatggagaggcccagaagcaggaggaggatgagagctgtgccgctgctgaggccctgacagccccagaagatgctggccggcctgctgtgaacagccctgccaaccagagccggggcaaccagtgcaagctgttccaccccagcctgccccagctgcccagcgaggaggaggtgaacagcctgggccgggagatcatcaagctgaccaaggagcaggccgctgctgagctggaggaggtgcggcgggagagccccatcgagggccagaggtctgagaccggccctgcccctcctggcctggccatccagggcgagctgcccaagagccacctggacagctttgaggccagcaggcctgctgccaaggccagcaccccagaagatggcaagggcatccctgagggcggcggcatgaggagcacagtgaagacctag

SEQ ID NO: 37527 - DNA, 1590 bp, Artificial Sequence
  Description of Artificial Sequence: Synthetic coding sequence
atggtggtgattgtggtggtgatcatcatcatcatcgcccgggccgccacctgggacagcgagtacctggtgtgcaagaggaagctggagagcaagaaggaggccctgctgatcctgagcaaggagctggacacctgccagcaggagcgggaccagtacaagctgatggccaaccagctgcgggagcggcaccagagcctgaagaagaagtaccgggagctgattgatggagaccccagcctgcccccagagaagaggaagcaggccaacctggcccagctgctgcgggacagccaggacaggaacaagcacctgggggaggagatcaaggagctgcagcagaggctgggggaggtgcagggcgacaacaagctgctgaggatgaccatcgccaagcagaggctgggagatgaggccatcggcgtgcgccactttgctgcccacgagcgggaggacctggtgcagcagctggagcgggccaaggagcagatcgagagcctggagcatgacctgcaggcctctgtggatgagctgcaggatgtgaaggaggagaggagcagctaccaggacaaggtggagcggctgaaccaggagctgaaccacatcctgagcggccatgaaaatcgcatcattgatgtggatgccctgtgcatggagaaccgctacctgcaggagcggctgaagcagctgcacgaggaggtgaacctgctgaagagcaacatcgccaagtacaagaatgccctggagaggaggaagaacagcaagggccagggcaagagcagcagcagcgccctgactggagtgctgagcgccaagcaggtgcaggacctgctgtctgaggaccacggctgcagcctgcctgccaccccccagagcatcagtgacctgaagagcctggccacagccctgctggagaccatccacgagaagaacatggtgatccagcaccagaggcagaccaacaagatcctgggcaacagagtggccgagctggagaagaagctgcggaccctggaggtgtctggcctgtggagcctgcccggcggcaaggacaccatcctcttcagtgaccccaccctgcccagcggccagaggagccgcagccccctgctgaagtttgtggagcagcccacagagaacaaggctgaccccaaggatggagaggcccagaagcaggaggaggatgagagctgtgccgctgctgaggccctgacagccccagaagatgctggccggcctgctgtgaacagccctgccaaccagagccggggcaaccagtgcaagctgttccaccccagcctgccccagctgcccagcgaggaggaggtgaacagcctgggccgggagatcatcaagctgaccaaggagcaggccgctgctgagctggaggaggtgcggcgggagagccccatcgagggccagaggtctgagaccggccctgcccctcctggcctggccatccagggcgagctgcccaagagccacctggacagctttgaggccagcaggcctgctgccaaggccagcaccccagaagatggcaagggcatccctgagggcggcggcatgaggagcacagtgaagacctag

SEQ ID NO: 37528 - DNA, 2247 bp, Artificial Sequence
  Description of Artificial Sequence: Synthetic coding sequence
atgagcctgcacgaggccagcgagaaggcccaggtgctgaatgaccagctgaccaagaagtgcagcgagctgagctgcatgctgcagacagtgaccatggagaaggcccgcatcatcgctgaccaccaggccatcctgcaggtggagcagaagatgatgacccagaccttccaggagcagaacctgctgctggatgctgcccacgccagcatcaccaatgagctgcagacagtgcagaatgagaagacccagctgcaggcccacctggaccacctgatcctggagcacaaccagtgcatccagaaggcccaggatgctgagaagaggacagctgtgcagaaggagctgctggagagcaccatcgcccggctgcggggggagctggaggcctccatgcaggagaagaagagcctgctggaggagaaggagcgcttccagcgggaggtgaacaagacagagaaggagatcgtgcaggagcgctgcaacctggagaaggagctggccaagaacaaggtggacatcaacaccctgacccacaacctgcagaccctggaggaggagaacaagcacctggccgaccagatggccagcctggagctgcagcaggtgaccagtgactaccacggcctggcccagcagaaggtggagaagatcacagagagcaagaacaagctggcctatgaaaatggcaagctgcagatcaaggtgaagcagctggaggagcaggtgcagagcttcacagacaccagcctgcagaatgaccacctgaggaagatgaacaagtacctgcagaccaagtatgcccaggtgaagagcatcctggagaggagcaaggaggagctgagcaggacagtgaagtgcagaaatgctgccctgaaggagagccagaagctgaaggaggacctggaggccgtggaggaccgggagaacaagaaggtgggcaacttccagaggcagctggccgaggccaaggaggacaactgcaaggtgaccatcatgctggagaatgtgctggccagccacagcaagatgcagggcgccctggagaaggtgcagatcgagctgggcagaagagacagcgagattgctggcctgaagaaggagcgggacctgaaccagcagagggtgcagaagctggaggccgaggtggaccagtggcaggccaggatgctggtgatggaggaccagcacaacagcgagattgagagcctgcagaaggccctgggcgtggcccgggaggacaacaggaagctggccatgagcctggagcaggccctgcagaccaacaaccacctgcagaccaagctggaccacatccaggagcagctggagagcaaggagctggagcggcagaacctggagaccttcaaggacaggatgacagaggagagcaaggtggaggccgagctgcacgccgagagaattgaggccctgaggaagcagttccagacagagcgggagaccaccaagaaggtggcccagcgggaggtggccgagctgaagaaggccctggatgaggccaacttccgctctgtggaggtgtccaggaccaaccgggagctgcggcagaagctggccgagctggagaagatcctggagagcaacaaggagaagatcaagaaccagaagacccagatcaagctgcacctgagcgccaaggccaacaatgcccagaacatcgagaggatgaagcagatcgagaaggagctgaagcagatggagctgatcaaggaccagtaccagaagaagaactatgagcagagcctgagcatccagagatttgtgtgtgagatgaccaacctgcagaaggagatgcagatgctggccaagagccagtatgatgcctctgtgaggaacaagcagcaggagctgcacctggaggccgagaggaagatccggcaggagctggagaaccgctgccaggagctggaggagaccgtgcgccacctgaagaagtgcaaggaggccacagagaacaccctgaaggaggcctctgtggagagcgagcagatcacagccaacctggaggaggcccaccgctggttcaagcacagatttgatggcctgcagctggagctgaccaagaaccggctgcagaggcccagcggggaggaccgctggcaggagaaggaccaggatgtgaagcatgatgtgatgagcaaccagagcgtgctgcaccgctgggagaggaagcagaacctgcggcccatgcccaagaagtaccacagcgaggtgcagaggaagtag

SEQ ID NO: 37529 - DNA, 3306 bp, Artificial Sequence
  Description of Artificial Sequence: Synthetic coding sequence
atggactgcaaggtgcacatggagaccaccgtgtccaggcctgtgctgagccccacccacatcaatgccacagccagcgagaccttcaccgtgctgcagcagaggatgagaattgtggaggagcagaccagcagcctgagagatgacctgatcatgctggactttggagagaagaggggctacctggaggccccagactgcctggaggacctggacagccagaaggtgatcagccccatccagaatgaggccatctgtgccggcaagacagacatcctgtggaagaactgtgagttcctggtgaacaggatgtgccgcctggagagcctgatgcagagcctgaagatgaacatcttccggctgcagacagagaaggacctgaacccccagaagacagccttcctgaaggaccggctgaatgccatccaggaggagcacagcaaggacctgaagctgctgcacctggaggtgatgaacctgcggcagcagctgcgggctgtgaaggaggaggaggacaaggcccaggatgaggtgcagaggctgacagccaccctgaagatcgccagccagaccaagaagaatgctgccatcatcgaggaggagctgaagaccaccaagaggaagatgaacctgaagatccaggagctgcggcggcagctggcccaggagaagtacctgcgggagagcctggagaagagcgccagcgccatgctgctgaagatccaggagatgggcagcacagtggaggtggagaggaagcaggtgcacatcctgcagcagaactgcatcgccctgcgggacagcatccagagcgcccaggagctgctggcccaggagcagaagaagaaggaggagctggagatcgccaccagccagctgaagagtgacctgaccagcagagatgacctgatcagcaagctggtggaggagaacaagaacctgcagatctccttcaacaaggagcacgaggagaatgcctacctgcggtctgagatcatgagcctgcacgaggccagcgagaaggcccaggtgctgaatgaccagctgaccaagaagtgcagcgagctgagctgcatgctgcagacagtgaccatggagaaggcccgcatcatcgctgaccaccaggccatcctgcaggtggagcagaagatgatgacccagaccttccaggagcagaacctgctgctggatgctgcccacgccagcatcaccaatgagctgcagacagtgcagaatgagaagacccagctgcaggcccacctggaccacctgatcctggagcacaaccagtgcatccagaaggcccaggatgctgagaagaggacagctgtgcagaaggagctgctggagagcaccatcgcccggctgcggggggagctggaggcctccatgcaggagaagaagagcctgctggaggagaaggagcgcttccagcgggaggtgaacaagacagagaaggagatcgtgcaggagcgctgcaacctggagaaggagctggccaagaacaaggtggacatcaacaccctgacccacaacctgcagaccctggaggaggagaacaagcacctggccgaccagatggccagcctggagctgcagcaggtgaccagtgactaccacggcctggcccagcagaaggtggagaagatcacagagagcaagaacaagctggcctatgaaaatggcaagctgcagatcaaggtgaagcagctggaggagcaggtgcagagcttcacagacaccagcctgcagaatgaccacctgaggaagatgaacaagtacctgcagaccaagtatgcccaggccaacagcgagctgagcgccaagagggtgcacctgcagcaggctgatgcccacctgaaggaggtgaagagcatcctggagaggagcaaggaggagctgagcaggacagtgaagtgcagaaatgctgccctgaaggagagccagaagctgaaggaggacctggaggccgtggaggaccgggagaacaagaaggtgggcaacttccagaggcagctggccgaggccaaggaggacaactgcaaggtgaccatcatgctggagaatgtgctggccagccacagcaagatgcagggcgccctggagaaggtgcagatcgagctgggccggcgggacagcgagattgctggcctgaagaaggagcgggacctgaaccagcagagggtgcagaagctggaggccgaggtggaccagtggcaggccaggatgctggtgatggaggaccagcacaacagcgagattgagagcctgcagaaggccctgggcgtggcccgggaggacaacaggaagctggccatgagcctggagcaggccctgcagaccaacaaccacctgcagaccaagctggaccacatccaggagcagctggagagcaaggagctggagcggcagaacctggagaccttcaaggacaggatgacagaggagagcaaggtggaggccgagctgcatgctgagcgcatcgaggccctgaggaagcagttccagacagagcgggagaccaccaagaaggtggcccagcgggaggtggccgagctgaagaaggccctggatgaggccaacttccgctctgtggaggtgtccaggaccaaccgggagctgcggcagaagctggccgagctggagaagatcctggagagcaacaaggagaagatcaagaaccagaagacccagatcaagctgcacctgagcgccaaggccaacaatgcccagaacattgaaagaatgaagcagatcgagaaggagctgaagcagatggagctgatcaaggaccagtaccagaagaagaactatgagcagagcctgagcatccagagatttgtgtgtgagatgaccaacctgcagaaggagatgcagatgctggccaagagccagtatgatgcctctgtgaggaacaagcagcaggagctgcacctggaggccgagaggaagatccggcaggagctggagaaccgctgccaggagctggaggagaccgtgcgccacctgaagaagtgcaaggaggccacagagaacaccctgaaggaggcctctgtggagagcgagcagatcacagccaacctggaggaggcccaccgctggttcaagcacagatttgatggcctgcagctggagctgaccaagaaccggctgcagaggccttctggagaagatcgctggcaggagaaggaccaggatgtgaagcatgatgtgatgagcaaccagagcgtgctgcaccgctgggagaggaagcagaacctgcggcccatgcccaagaagtaccacagcgaggtgcagaggaagtag

SEQ ID NO: 37530 - DNA, 1767 bp, Artificial Sequence
  Description of Artificial Sequence: Synthetic coding sequence
atgcccctgaggaagaggaagagccctgagaggacagccagcagcaagagccctgagatcagccgcagccacgtgaacagcatcaaggagaggaccagctctgtgggcctgcccagcgtcatccccaacagcacccggcgggtgtcctttgcccccaacctgcccagcatgaagaccagccaggacattggagacagccgcatcagcctgaagaccctgctgaatgccatcaagaccatggagggccgcctggagggcaagattgagatcctggccagccggcccctcatcaatgatgagagccccaacttcctgaagcaggacagcgtgaagagcatcctggagaggagcaaggaggagctgagcaggacagtgaagtgcagaaatgctgccctgaaggagagccagaagctgaaggaggacctggaggccgtggaggaccgggagaacaagaaggtgggcaacttccagaggcagctggccgaggccaaggaggacaactgcaaggtgaccatcatgctggagaatgtgctggccagccacagcaagatgcagggcgccctggagaaggtgcagatcgagctgggcagaagagacagcgagattgctggcctgaagaaggagcgggacctgaaccagcagagggtgcagaagctggaggccgaggtggaccagtggcaggccaggatgctggtgatggaggaccagcacaacagcgagattgagagcctgcagaaggccctgggcgtggcccgggaggacaacaggaagctggccatgagcctggagcaggccctgcagaccaacaaccacctgcagaccaagctggaccacatccaggagcagctggagagcaaggagctggagcggcagaacctggagaccttcaaggacaggatgacagaggagagcaaggtggaggccgagctgcacgccgagagaattgaggccctgaggaagcagttccagacagagcgggagaccaccaagaaggtggcccagcgggaggtggccgagctgaagaaggccctggatgaggccaacttccgctctgtggaggtgtccaggaccaaccgggagctgcggcagaagctggccgagctggagaagatcctggagagcaacaaggagaagatcaagaaccagaagacccagatcaagctgcacctgagcgccaaggccaacaatgcccagaacatcgagaggatgaagcagatcgagaaggagctgaagcagatggagctgatcaaggaccagtaccagaagaagaactatgagcagagcctgagcatccagagatttgtgtgtgagatgaccaacctgcagaaggagatgcagatgctggccaagagccagtatgatgcctctgtgaggaacaagcagcaggagctgcacctggaggccgagaggaagatccggcaggagctggagaaccgctgccaggagctggaggagaccgtgcgccacctgaagaagtgcaaggaggccacagagaacaccctgaaggaggcctctgtggagagcgagcagatcacagccaacctggaggaggcccaccgctggttcaagcacagatttgatggcctgcagctggagctgaccaagaaccggctgcagaggcccagcggggaggaccgctggcaggagaaggaccaggatgtgaagcatgatgtgatgagcaaccagagcgtgctgcaccgctgggagaggaagcagaacctgcggcccatgcccaagaagtaccacagcgaggtgcagaggaagtag

SEQ ID NO: 37531 - DNA, 456 bp, Artificial Sequence
  Description of Artificial Sequence: Synthetic coding sequence
atgagcctgcacgaggccagcgagaaggcccaggtgctgaatgaccagctgaccaagaagtgcagcgagctgagctgcatgctgcagacagtgaccatggagaaggcccgcatcatcgctgaccaccaggccatcctgcaggtggagcagaagatgatgacccagaccttccaggagcagaacctgctgctggatgctgcccacgccagcatcaccaatgagctgcagacagtgcagaatgagaagacccagctgcaggcccacctggaccacctgatcctggagcacaaccagtgcatccagaaggcccaggatgctgagaagaggacagctgtgcagaaggagctgctggagagcaccatcgcccggctgcggggggagctggaggcctccatgcaggagaagaagagcctgctggaggagaaggagcgcttccagcgggagggctacctgtag

SEQ ID NO: 37532 - DNA, 387 bp, Artificial Sequence
  Description of Artificial Sequence: Synthetic coding sequence
atgtgccgcctggagagcctgatgcagagcctgaagatgaacatcttccggctgcagacagagaaggacctgaacccccagaagacagccttcctgaaggaccggctgaatgccatccaggaggagcacagcaaggacctgaagctgctgcacctggaggtgatgaacctgcggcagcagctgcgggctgtgaaggaggaggaggacaaggcccaggatgaggtgcagaggctgacagccaccctgaagatcgccagccagaccaagaagaatgctgccatcatcgaggaggagctgaagaccaccaagaggaagatgaacctgaagatccaggagctgctggagatgaccagcttccccagctggctgaagaagatccgcttctag

SEQ ID NO: 37533 - DNA, 891 bp, Artificial Sequence
  Description of Artificial Sequence: Synthetic coding sequence
atggactgcaaggtgcacatggagaccaccgtgtccaggcctgtgctgagccccacccacatcaatgccacagccagcgagaccttcaccgtgctgcagcagaggatgagaattgtggaggagcagaccagcagcctgagagatgacctgatcatgctggactttggagagaagaggggctacctggaggccccagactgcctggaggacctggacagccagaaggtgatcagccccatccagaatgaggccatctgtgccggcaagacagacatcctgtggaagaactgtgagttcctggtgaacaggatgtgccgcctggagagcctgatgcagagcctgaagatgaacatcttccggctgcagacagagaaggacctgaacccccagaagacagccttcctgaaggaccggctgaatgccatccaggaggagcacagcaaggacctgaagctgctgcacctggaggtgatgaacctgcggcagcagctgcgggctgtgaaggaggaggaggacaaggcccaggatgaggtgcagaggctgacagccaccctgaagatcgccagccagaccaagaagaatgctgccatcatcgaggaggagctgaagaccaccaagaggaagatgaacctgaagatccaggagctgcggcggcagctggcccaggagaagtacctgcgggagagcctggagaagagcgccagcgccatgctgctgaagatccaggagatgggcagcacagtggaggtggagaggaagcaggtgcacatcctgcagcagaactgcatcgccctgcgggacagcatccagagcgcccaggagctgctggcccaggagcagaagaagaagaagtcctggaggctgctgctgcacagcagcaacctgatctag

SEQ ID NO: 37534 - DNA, 1788 bp, Artificial Sequence
  Description of Artificial Sequence: Synthetic coding sequence
atgaccagccccctgtgccgggccgccagcgccaatgccctgcccccccaggaccaggccagcacccccagcagccgggtgaagggccgggaggccagcggcaagcccagccacctgcggggcaagggcacagcccaggcctggaccccaggccgcagcaagggcggcagcttccacagaggagctgggaagcccagcgtgcacagccaggtggccgagctgcacaagaagatccagctgctggagggggacaggaaggccttctttgagagcagccagtggaacatcaagaagaaccaggagaccatcagccagctgaggaaggagaccaaggccctggagctgaagctgctggacctgctgaagggagatgagaaggtggtgcaggccgtcatccgggagtggaagtgggagaagccctacctgaagaacagaacaggccaggccctggagcacctggaccaccggctgcgggagaaggtgaagcagcagaatgccctgcggcaccaggtggtgctgcggcagaggcggctggaggagctgcagctgcagcacagcctgcggctgctggagatggccgaggcccagaacagacacacagaggtggccaagaccatgaggaacctggagaaccggctggagaaggcccagatgaaggcccaggaggccgagcacatcacctctgtgtacctgcagctgaaggcctacctgatggatgagagcctgaacctggagaaccggctggacagcatggaggccgaggtggtgaggaccaagcatgagctggaggccctgcacgtggtgaaccaggaggccctgaatgcccgggacatcgccaagaaccagctgcagtacctggaggagaccctggtgcgggagaggaagaagcgggagcgctacatcagcgagtgcaagaagagagctgaggagaagaagctggagaatgaaagaatggagaggaagacccaccgggagcacctgctgctgcagagtgatgacaccatccaggacagcctgcacgccaaggaggaggagctgcggcagcgctggagcatgtaccagatggaggtgatctttgggaaggtgaaggatgccaccggcacagatgagacccacagcctggtgcggcgcttcctggcccagggcgacacctttgcccagctggagaccctgaagtcagaaaatgagcagaccctggtgcggctgaagcaggagaagcagcagctgcagcgggagctggaggacctgaagtacagcggggaggccaccctggtgtcccagcagaagctgcaggccgaggcccaggagcggctgaagaaggaggagaggagacatgctgaggccaaggaccagctggagcgggccctgcgggccatgcaggtggccaaggacagcctggagcacctggccagcaagctgatccacatcaccgtggaggatggccgctttgctgggaaggagctggacccccaggccgacaactacgtgcccaacctgctgggcctggtggaggagaagctgctgaagctgcaggcccagctgcagggccatgatgtgcaggagatgctgtgccacatcgccaaccgggagttcctggccagcctggagggccgcctgcctgagtacaacacccgcatcgccctgcccctggccaccagcaaggacaagttctttgatgaggagagcgaggaggaggacaatgaggtggtgacccgggccagcctgaagatccgcagccagaagctgattgagagccacaagaagcaccggcgcagcagaagaagctag

SEQ ID NO: 37535 - DNA, 1725 bp, Artificial Sequence
  Description of Artificial Sequence: Synthetic coding sequence
ctgcccccccaggaccaggccagcacccccagcagcggcaagcccagccacctgcggggcaaaggaacagcccaggcctggaccccaggccgcagcaaaggaggcagcttccacagaggagctgggaagcccagcgtgcacagccaggtggccgagctgcacaagaagatccagctgctggagggggacaggaaggccttctttgagagcagccagtggaacatcaagaagaaccaggagaccatcagccagctgaggaaggagaccaaggccctggagctgaagctgctggacctgctgaagggagatgagaaggtggtgcaggccgtcatccgggagtggaagtgggagaagccctacctgaagaacagaacaggccaggccctggagcacctggaccaccggctgcgggagaaggtgaagcagcagaatgccctgcggcaccaggtggtgctgcggcagaggcggctggaggagctgcagctgcagcacagcctgcggctgctggagatggccgaggcccagaacagacacacagaggtggccaagaccatgaggaacctggagaaccggctggagaaggcccagatgaaggcccaggaggccgagcacatcacctctgtgtacctgcagctgaaggcctacctgatggatgagagcctgaacctggagaaccggctggacagcatggaggccgaggtggtgaggaccaagcatgagctggaggccctgcacgtggtgaaccaggaggccctgaatgcccgggacatcgccaagaaccagctgcagtacctggaggagaccctggtgcgggagaggaagaagcgggagcgctacatcagcgagtgcaagaagagagctgaggagaagaagctggagaatgaaagaatggagaggaagacccaccgggagcacctgctgctgcagagtgatgacaccatccaggacagcctgcacgccaaggaggaggagctgcggcagcgctggagcatgtaccagatggaggtgatctttgggaaggtgaaggatgccactggaacagatgagacccacagcctggtgcggcgcttcctggcccagggcgacacctttgcccagctggagaccctgaagtcagaaaatgagcagaccctggtgcggctgaagcaggagaagcagcagctgcagcgggagctggaggacctgaagtacagcggggaggccaccctggtgtcccagcagaagctgcaggccgaggcccaggagcggctgaagaaggaggagaggagacatgctgaggccaaggaccagctggagcgggccctgcgggccatgcaggtggccaaggacagcctggagcacctggccagcaagctgatccacatcaccgtggaggatggccgctttgctgggaaggagctggacccccaggccgacaactacgtgcccaacctgctgggcctggtggaggagaagctgctgaagctgcaggcccagctgcagggccatgatgtgcaggagatgctgtgccacatcgccaaccgggagttcctggccagcctggagggccgcctgcctgagtacaacaccagaattgccctgcccctggccaccagcaaggacaagttctttgatgaggagagcgaggaggaggacaatgaggtggtgacccgggccagcctgaagatccgcagccagaagctgattgagagccacaagaagcacagaagaagccgccgctcctag

SEQ ID NO: 37536 - DNA, 1626 bp, Artificial Sequence
  Description of Artificial Sequence: Synthetic coding sequence
atgcacccccctgtggccccctgcaagaagctgcgctgcccccccaccaggagcttcacccccacccggggccgcagcaaggagggggacaggaaggccttctttgagagcagccagtggaacatcaagaagaaccaggagaccatcagccagctgaggaaggagaccaaggccctggagctgaagctgctggacctgctgaagggagatgagaaggtggtgcaggccgtcatccgggagtggaagtgggagaagccctacctgaagaacagaacaggccaggccctggagcacctggaccaccggctgcgggagaaggtgaagcagcagaatgccctgcggcaccaggtggtgctgcggcagaggcggctggaggagctgcagctgcagcacagcctgcggctgctggagatggccgaggcccagaacagacacacagaggtggccaagaccatgaggaacctggagaaccggctggagaaggcccagatgaaggcccaggaggccgagcacatcacctctgtgtacctgcagctgaaggcctacctgatggatgagagcctgaacctggagaaccggctggacagcatggaggccgaggtggtgaggaccaagcatgagctggaggccctgcacgtggtgaaccaggaggccctgaatgcccgggacatcgccaagaaccagctgcagtacctggaggagaccctggtgcgggagaggaagaagcgggagcgctacatcagcgagtgcaagaagagagctgaggagaagaagctggagaatgaaagaatggagaggaagacccaccgggagcacctgctgctgcagagtgatgacaccatccaggacagcctgcacgccaaggaggaggagctgcggcagcgctggagcatgtaccagatggaggtgatctttgggaaggtgaaggatgccaccggcacagatgagacccacagcctggtgcggcgcttcctggcccagggcgacacctttgcccagctggagaccctgaagtcagaaaatgagcagaccctggtgcggctgaagcaggagaagcagcagctgcagcgggagctggaggacctgaagtacagcggggaggccaccctggtgtcccagcagaagctgcaggccgaggcccaggagcggctgaagaaggaggagaggagacatgctgaggccaaggaccagctggagcgggccctgcgggccatgcaggtggccaaggacagcctggagcacctggccagcaagctgatccacatcaccgtggaggatggccgctttgctgggaaggagctggacccccaggccgacaactacgtgcccaacctgctgggcctggtggaggagaagctgctgaagctgcaggcccagctgcagggccatgatgtgcaggagatgctgtgccacatcgccaaccgggagttcctggccagcctggagggccgcctgcctgagtacaacacccgcatcgccctgcccctggccaccagcaaggacaagttctttgatgaggagagcgaggaggaggacaatgaggtggtgacccgggccagcctgaagatccgcagccagaagctgattgagagccacaagaagcaccggcgcagcagaagaagctag

SEQ ID NO: 37537 - DNA, 765 bp, Artificial Sequence
  Description of Artificial Sequence: Synthetic coding sequence
atggaccagagcagcgagggctgcatgaagaagatcagctctgtgaacctggacaagctgatcaatgacttcagccagatcgagaagaagatggtggagaccaacgggaagaacaacatcctggacatccagctggagaagagcaactgcctgctgaaggtgatgcaggccaaggaggtgtccatcaaggaggagtgtgccaccctgcacaacatcatcaagggcctgcagcagaccatcgagtaccagcagaacctgaagggagaaaatgagcagctgaagatctctgctgacctgatcaaggagaagctgaagagccatgagcaggagtacaagaacaacatcgccaagctggtgtctgagatgaagatcaaggaggagggctacaagaaggagatcagcaagctgtaccaggacatgcagaggaaggtggagctgaatgaggagaagcacaaggagctgattgagaagaaggagatggagatcagcgagctgaatgccaagctgcggagccaggagaaggagaagcagaatgagatcatcaagctgcagctggagtttgatgccaagctggcccgggtgcagaccaagagcaagagctaccaggacagcacagtgctgccccagagcatctacagaaggaagctgcagcacttccaggaggagaagaacaaggagatcgccatcctgaggaacaccatccgggacctggagcagaggctgtctgtgggcaaggacagccacctgaagagaagacgcttctag

SEQ ID NO: 37538 - DNA, 633 bp, Artificial Sequence
  Description of Artificial Sequence: Synthetic coding sequence
atgccacccaagaacaaggagaagggcaagaagagcggggcccagaagaagaagaagaactggggcgcagatgtggtggccgagagccgccaccggctggtggtgctggagaaggagctgctgcgggaccacctggccctgcggagagatgaggcccggcgggccaaggccagcgaggaccagctgcggcagaggctgcagggcgtggaggccgagctggagggcgcccggtctgagggcaaggccatctatgcagagatgagccggcagtgccacgccctgcaggaggacatgcagaccaggagcaagcagctggaggaggaggtgaagggcctgcggggccagctggaggcctgccagcgggaggccgctgctgcccgggaggaggccgagcaggccctgggggagcgggaccaggccctggcccagctgcgggcccacatggctgacatggaggccaagtatgaggagatcctgcatgacagcctggaccggctgctggccaagctgcgggccatcaagcagcagtgggatggagctgccctgcggctgcacgcccggcacaaggagcagcagaggcagtttggcctgaccccacctggcagcctgcggcccccagcccccagcctgtag

SEQ ID NO: 37539 - DNA, 633 bp, Artificial Sequence; identical to SEQ ID NO: 37538
  Description of Artificial Sequence: Synthetic coding sequence

SEQ ID NO: 37540 - DNA, 2025 bp, Artificial Sequence
  Description of Artificial Sequence: Synthetic coding sequence
atgtctgagctggccgacagcggccccagcggggccagcgcccccagccagctgcgggctgtgaccctggaggacctgggcctgctgctggccggcggcctggccagccctgagcccctgagcctggaggagctgtctgaaagatatgagagcagccaccccaccagcacagcctctgtgcctgagcaggacacagccaagcactggaaccagctggagcagtgggtggtggagctgcaggccgaggtggcctgcctgcgggagcacaagcagagatgtgagcgggccaccaggagcctgctgcgggagctgctgcaggtgcgggcccgggtgcagctgcagggcagcgagctgcggcagctgcagcaggaggcccggcctgctgcccaggcccctgagaaggaggcccctgagttcagcggcctgcagaaccagatgcaggccctggacaagaggctggtggaggtgcgggaggccctgacccggctgcggcggcggcaggtgcagcaggaggccgagaggagaggagctgagcaggaggccggcctgcggctggccaagctgacagacctgctgcagcaggaggagcagggccgggaggtggcctgtggggccctgcagaagaaccaggaggacagcagcagaagagtggacctggaggtggccaggatgcaggcccaggtgaccaagctgggggaggaggtgtccctgcgcttcctgaagcgggaggccaagctgtgtggcttcctgcagaagagcttcctggccctggagaagaggatgaaggccagcgagagcagccggctgaagctggagggcagcctgcggggggagctggagagccgctgggagaagctgcggggcctgatggaggagcggctgcgggccctgcagggccagcacgaggtgggccctgggggccggcgggcagaggagagccacctgctggagcagtgccagggcctggatgctgctgtggcccagctgaccaagtttgtgcagcagaaccaggccagcctgaacagagtgctgctggccgaggagaaggcctgggatgccaagggccgcctggaggagagccgggccggggagctggccgcctacgtgcaggagaacctggaggccgcccagctggccggggagctggcccggcaggagatgcacggggagctggtgctgctgcgggagaagagccgggccctggaggcctctgtggcccagctggccggccagctgaaggagctgagcggccacctgcctgccctgagcagccggctggacctgcaggagcagatgctgggcctgcggctgtctgaggccaagacagagtgggagggcgctgagaggaagagcctggaggacctggcccgctggaggaaggaggtgacagagcacctgcggggcgtgcgggagaaggtggatggcctgccccagcagatcgagagcgtgtctgacaagtgcctgctgcacaagagtgacagcgacctgcgcatctctgctgagggcaaggcccgggagttcaaggtgggcgccctgcggcaggagctggccaccctgctgagctctgtgcagctgctgaaggaggacaaccctggcaggaagattgctgagatgcagggcaagctggccaccaaccagatcatgaagctggagaactgtgtgcaggccaacaagaccatccagaacctgcgcttcaacacagaggcccggctgcggacccaggagatggccaccctgtgggagagcgtgctgcggctgtggagcgaggagggccccaggacccccctgggctcctggaaggccctgcccagcctggtgcggcccagggtcttcatcaaggacatggcccctgggaaggtggtgcccatgaactgctggggcgtgtaccaggccgtgcgctggctgcgctggaaggccagcctcatcaagctgcgggccctgcggcggcctgggggcgtgctggagaagccccacagccaggagcaggtgcagcagctgacccccagcctcttcatccagaagtag

SEQ ID NO: 37541 - DNA, 1569 bp, Artificial Sequence
  Description of Artificial Sequence: Synthetic coding sequence
atgcaggccctggacaagaggctggtggaggtgcgggaggccctgacccggctgcggcggcggcaggtgcagcaggaggccgagaggagaggagctgagcaggaggccggcctgcggctggccaagctgacagacctgctgcagcaggaggagcagggccgggaggtggcctgtggggccctgcagaagaaccaggaggacagcagccggcgggtggacctggaggtggccaggatgcaggcccaggtgaccaagctgggggaggaggtgtccctgcgcttcctgaagcgggaggccaagctgtgtggcttcctgcagaagagcttcctggccctggagaagaggatgaaggccagcgagagcagccggctgaagctggagggcagcctgcggggggagctggagagccgctgggagaagctgcggggcctgatggaggagcggctgcgggccctgcagggccagcacgaggagagccacctgctggagcagtgccagggcctggatgctgctgtggcccagctgaccaagtttgtgcagcagaaccaggccagcctgaacagagtgctgctggccgaggagaaggcctgggatgccaagggccgcctggaggagagccgggccggggagctggccgcctacgtgcaggagaacctggaggccgcccagctggccggggagctggcccggcaggagatgcacggggagctggtgctgctgcgggagaagagccgggccctggaggcctctgtggcccagctggccggccagctgaaggagctgagcggccacctgcctgccctgagcagccggctggacctgcaggagcagatgctgggcctgcggctgtctgaggccaagacagagtgggagggcgctgagaggaagagcctggaggacctggcccgctggaggaaggaggtgacagagcacctgcggggcgtgcgggagaaggtggatggcctgccccagcagatcgagagcgtgtctgacaagtgcctgctgcacaagagtgacagcgacctgcgcatctctgctgagggcaaggcccgggagttcaaggtgggcgccctgcggcaggagctggccaccctgctgagctctgtgcagctgctgaaggaggacaaccctggcaggaagattgctgagatgcagggcaagctggccaccttccagaaccagatcatgaagctggagaactgtgtgcaggccaacaagaccatccagaacctgcgcttcaacacagaggcccggctgcggacccaggagatggccaccctgtgggagagcgtgctgcggctgtggagcgaggagggccccaggacccccctgggctcctggaaggccctgcccagcctggtgcggcccagggtcttcatcaaggacatggcccctgggaaggtggtgcccatgaactgctggggcgtgtaccaggccgtgcgctggctgcgctggaaggccagcctcatcaagctgcgggccctgcggcggcctgggggcgtgctggagaagccccacagccaggagcaggtgcagcagctgacccccagcctcttcatccagaagtag

SEQ ID NO: 37542 - DNA, 2259 bp, Artificial Sequence
  Description of Artificial Sequence: Synthetic coding sequence
atggcccacctgctgggcagccaggcctgcatggagagcctgaggacagacctgacagacctgcagggcgccatcgtggatgtgttcagccgggccggccctgtgcgcttccccagctggaagttcccagacaggatggcctgtgacctggacatggtggccctgctggagcactatgaccacgtgcctggggaccctgagttcacccagctgagccatgctgtgctgctggagctggtgattgaccggctgctgctgctgctgcagagctgcatgagctacctggagaacctgggcagcgagcagatgatgcccccagcccaggccgccggcccctgcatgtctgtgggcctgactgtgcggcgcttctgggacagcctgctgcggctgggcaccctgcaccagcagcccctgccccagaagggggccaaccagcgggagacccccaccagcaagcccaccaccaagggggagcccgcccggagccctgagtacctgaccaccaagctgatcaagcccagcagccctgtgctgggcctgccccagacctgccaggagcctgagagcatccctgtgcgggccagcctgcagtttcctgccaccaccttcaagaacaccaggtctgtgcacagccagaccatcgagacagccctggtgccctgtgatgcctgtgcctctgtgcagggcagcctgcagaaggtgggcaaggtggtgatcagcctgtgccagagccagaacctgcccagcagcctgggccagttccagcagctggtgcaggacagcatgggcctgcggcccctgcctgctgccaccgtgggccgctgggccgctgagcagaggaaggacctgacccggctgagcaagcacgtggaggccctgcgggcccagctggaggaggccgagggccagaaggatggcctgaggaagcaggccggcaagctggagcaggccctgaagcaggagcagggcgcccggcggcggcaggccgaggaggatgagcagtgcctgtctgagtgggagcatgacaagcagcagctgctgacagagaccagtgacctgaagaccaagatggccaccctggagcgggagctgaagcagcagcgggagagcacccaggccgtggaggccaaggcccagcagctgcaggaggagggggagaggagagctgctgctgagcggcaggtgcagcagctggaggagcaggtgcagcagctggaggcccaggtgcagctgctggtgggccgcctggagggcgccggccagcaggtgtgctgggccagcacagagctggacaaggagaaggcccgggtggacagcatggtgcgccaccaggagagcctgcaggccaagcagagggccctgctgaagcagctggacagcctggaccaggagcgggaggagctgcggggcagcctggatgaagctgaggcccagagggcccgggtggaggagcagctgcagagcgagcgggagcagggccagtgccagctgcgggcccagcaggagctgctgcagagcctgcagcgggagaagcagggcctggagcaggccaccacagacctgcggctgaccatcctggagctggagcgggagctggaggagctgaaggagcgggagcggctgctggtggccttcccagacctgcaccggcccacagagacccagatccatggaggccgcagcagctctgtggagagccagatcacctgccccacagacagcggaaatgtgacagaccacatggagcggcaggtgcagagcaatgacatccgcatccgggtgctgcaggaggagaatggccgcctgcagagcatgctgagcaagatccgggaggtggcccagcagggcggcctgaagctgatcccccaggaccggctgtggagccccagcagcaagggcacccagggcgccaccccacctgtgcaggccaagagcaccagccctggccccctgggccggcagcacctgcccagcagcaggactggaagaaccctgctgggccagccctgcaccagccccccccggcagccctgcaccagccccccccggcagccctgcaccagccccccccggcagccctgcaccagccccagccggcagccctgcagccagcccagcaagagcctgctggagggcgtgacccacctggacacctgcacccagaaccccatcaaggtgctggtgcggctgaggaagaggctgagccctggccggggccaggccagcagcgcccaccagccccaggagcggcccatgtag

SEQ ID NO: 37543 - DNA, 2259 bp, Artificial Sequence; identical to SEQ ID NO: 37542
  Description of Artificial Sequence: Synthetic coding sequence

SEQ ID NO: 37544 - DNA, 1602 bp, Artificial Sequence
  Description of Artificial Sequence: Synthetic coding sequence
atggagagcaaggcctgggagagcaacaatgaagacctgctgagcagcagtggagtgaccagcaatggaggcagcagcagcagcttctttgtgagcagcatccggggcaccatcatcgagaacaccagcagcgctggcaccctgacccaggtgcccttcttccccaagtatgaggtggagctggacagccccaggaagatcatccccagccctgggaaggagcactttgagcgggtgctggaggagtacagccaccaggtgaaggacctgcagaggcggctgaatgaaagcaatgagctgcacgagaagcagaagttctacctgcggcagagcgtgattgacctgcagaccaagctgcaggagatgcagatggagagagatgccatggctgacatcagaagaagagagagccagagccaggaggacctgaggaaccagctgcagaacacagtgcatgagctggaggccgccaagtgcctgaaggaggacatgctgaaggacagcaacacccagatcgagcagctgaggaagatgatgctgagccatgagggcgtgctgcaggagatccgcagcatcctggtggactttgaggaggccagcggcaagaagatctgtgaacatgacagcatgagcaccctgcacttccgcagcctgggcagcgccatcagcaagatcctgcgggagctggacacagagatctcctacctgaagggccgcatcttccctgtggaggaccagctggaggccctgaagtctgagagccagaacaagattgagctgctgctgcagcagcaccaggacagaattgagcagctgatcagcgagcacgaggtggagatcaccggcctgacagagaaggccagcagcgcccggagccaggccaacagcatccagagccagatggagatcatccaggagcaggccaggaaccagaacagcatgtacatgaggcagctgagtgacctggagagcacagtgtcccagctgcggtctgagctgcgggaggccaagaggatgtatgaggacaagacagaggagctggagaagcagctggtgctggccaacagcgagctgacagaggccaggacagagcgggaccagagcagcctgcggagtgacatgtgccacaggagcaacaacagcctgcgggacagcacagagggcagcaagagcagcgagaccctgagccgggagcctgtgaccctgcacgccggggaccgggaggaccccagcggctgcttcaccttcaccagcgctgccagccccagcgtgaagaacagcgccagccgctccttcaacagcagccccaagaagagccctgtgcacagcctgctgaccagctctgtggagggcagcatcggcagcaccagccagtacagaagtgccaagcccatccacagcagtgacagcgtgaaggacagccagagcccccccatcgagaccaccgggaagacctgcaggaagctgcagaaccggctggagagcctgcagaccctggtggaggacctgcagctgaagaaccaggccatgagctccatgatccggaaccaggagaagaggatccagaaggtgaaggaccaggagaagatgctgctgaagtag

SEQ ID NO: 37545 - DNA, 3342 bp, Artificial Sequence
  Description of Artificial Sequence: Synthetic coding sequence
atggagagcaaggcctgggagagcaacaatgaagacctgctgagcagcagtggagtgaccagcaatggaggcagcagcagcagcttctttgtgagcagcatccggggcaccatcatcgagaacaccagcagcgctggcaccctgacccaggtgcccttcttccccaagtatgaggtggagctggacagccccaggaagatcatccccagccctgggaaggagcactttgagcgggtgctggaggagtacagccaccaggtgaaggacctgcagaggcggctgaatgaaagcaatgagctgcacgagaagcagaagttctacctgcggcagagcgtgattgacctgcagaccaagctgcaggagatgcagatggagagagatgccatggctgacatcagaagaagagagagccagagccaggaggacctgaggaaccagctgcagaacacagtgcatgagctggaggccgccaagtgcctgaaggaggacatgctgaaggacagcaacacccagatcgagcagctgaggaagatgatgctgagccatgagggcgtgctgcaggagatccgcagcatcctggtggactttgaggaggccagcggcaagaagatctgtgaacatgacagcatgagcaccctgcacttccgcagcctgggcagcgccatcagcaagatcctgcgggagctggacacagagatctcctacctgaagggccgcatcttccctgtggaggaccagctggaggccctgaagtctgagagccagaacaagattgagctgctgctgcagcagcaccaggacagaattgagcagctgatcagcgagcacgaggtggagatcaccggcctgacagagaaggccagcagcgcccggagccaggccaacagcatccagagccagatggagatcatccaggagcaggccaggaaccagaacagcatgtacatgaggcagctgagtgacctggagagcacagtgtcccagctgcggtctgagctgcgggaggccaagaggatgtatgaggacaagacagaggagctggagaagcagctggtgctggccaacagcgagctgacagaggccaggacagagcgggaccagttcagccaggagagcggcaacctggatgaccagctgcagaagctgctggccgacctgcacaagcgggagaaggagctgagcctggagaaggagcagaacaagaggctgtgggaccgggacaccggcaacagcatcaccatcgaccacctgcggcgggagctggacaacagaaacatggaggtgcagaggctggaggccctgctgaaggccctgaagtctgagtgccagggccagatggagcggcagatggccgccatccagggcaagaatgaaagcctggagaaggtgagcagcctgacagcccagctggagagcaccaaggagatgctgaggaaggtggtggaggagctgacagccaagaagatgaccctggagagcagcgagaggaccatcagtgacctgaccaccagcctgcaggagaaggagcgggccatcgaggccaccaatgctgagatcaccaagctgcggagccgggtggacctgaagctgcaggagctgcagcacctgaagaatgaaggagaccacctgagaaatgtgcagacagaatgtgaggccctgaagctgcagatgacagagaaggacaaggtgattgagatcctgcggcagcagatcgagaacatgacccagctggtgggccagcacggccgcacagctggggccatgcaggtggagaaggcccagctggagaaggagatcaatgacaggaggatggagctgaaggagctgaagatcctgaaggacaagaaggatgccaagatccgggagctggaggcccgggtgtctgacctggagctggagaaggtgaagctggtgaatgccggcagcgagcggctgcgggctgtgaaggacatcaagcaggagcgggaccagctgctgaatgaggtgaagaccagccgctctgagctgaacaacctgtctgaggagtatgaggtgctgaagaggaacttcaggaacaagtctgaggagatggagatgaccaccaacaagctgaagatgcagctgaagagcgcccagagcgagctggagcagaccaggaacaccctgaagtccatggagggcagtgatggccacgccatgaaggtggccatgggcatgcagaagcagatcacagccaagaggggccagattgatgccctgcagagcaagatccagttcctggaggaggccatgaccaatgccaacaaggagaagcacttcctgaaggaggagaagagcaagctgagccaggagctgagcacagtggccacagagaagaacaagatggccggggagctggaggtgctgcggagccaggagcggcggctgaaggagaaggtgaccaacatggaggtggccctggacaaggccagcctgcagtttgctgagtgccaggacatcatccagaggcaggagcaggagagcgtgcggctgaagctgcagcacaccctggacatcaaggagctgcagggccctggctacaccagcaacagcagcctgaagccccggctgctgcagcctgcctctgtgaccaggagccacagcaatgtgcccagcagccagagcacagccagcttcctgagccaccacagcaccaaggccaacaccctgaaggaggaccccacccgggacctgaagcagctgctgcaggagctgcggagcgtcatcaatgaggagcctgctgtgtccctgagcaagacagaggaggatggccgcaccagcctgggcgccctggaggacagagtgcgggactgcatcacagagagcagcctgcggagtgacatgtgccacaggagcaacaacagcctgcgggacagcacagagggcagcaagagcagcgagaccctgagccgggagcctgtgaccctgcacgccggggaccgggaggaccccagcggctgcttcaccttcaccagcgctgccagccccagcgtgaagaacagcgccagccgctccttcaacagcagccccaagaagagccctgtgcacagcctgctgaccagctctgtggagggcagcatcggcagcaccagccagtacagaagtgccaagcccatccacagcagtgacagcgtgaaggacagccagagcccccccatcgagaccaccgggaagacctgcaggaagctgcagaaccggctggagagcctgcagaccctggtggaggacctgcagctgaagaaccaggccatgagctccatgatccggaaccaggagaagaggatccagaaggtgaaggaccaggagaagatgctgctgaagtag

SEQ ID NO: 37546 - DNA, 1239 bp, Artificial Sequence
  Description of Artificial Sequence: Synthetic coding sequence
atgctgctgcctgccagtgaccccctgctggccggcctgccccgggaccctgactacagcgtgtcctgcctgtacagcccccccagccccagctccatgtgcctgcctgccaacatgaagtgtgacaagtactggggcagcagcagtgacaaggccctggagaggacagcccactggagcaggaccccagagcctgagaccctgggctgcccagccagcggggacacagtgaggacagctgactgccggcccggctggggcagcggccccagcccccatgaagctgcccccagccccagcccagacctgcagaagcagtgctgcaatgaccaggacatcctgaagaggcaccacaacgtggccaagaagcccctggagaccagcagcagcaaggtgaaggccaagaccatcgtgatgatcccagacagccagaagctgctgcgctgtgagctggagagcctgaagagccagctgcaggcccagaccaaggcctttgagttcctgaaccacagcgtgaccatgctggagaaggagagctgcctgcagcagatcaagatccagcagctggaggaggtgctgagccccaccggccggcagggcgagaaggaggagcacaagtggggcatggagcagggccggcaggagctgtatggagccctgacccagggcctgcagggcctggagaagaccctgcgggacagcgaggagatgcagagggcccggaccacccgctgcctgcagctgctggcccaggagatccgggacagcaagaagttcctgtgggaggagctggagctggtgcgggaggaggtgaccttcatctaccagaagctgcaggcccaggaggatgagatcagcgagaacctggtgaacatccagaagatgcagaagacccaggtgaagtgcaggaagatcctgaccaagatgaagcagcagggccacgagacagctgcctgcccagagacagaggagatcccccagggcgccagcggctgctggaaggatgacctgcagaaggagctgagtgacatctggagcgctgtgcacgtgctgcagaacagcattgacagcctgaccctgtgcagcggggcctgccccaaggccagcagcctgcggggccacaagggccaccagtgcctgagcccccccctgcccagctgggacagcgacagcgactgtgaccaggacctgagccagccccccttcagcaagagcggccgctccttccccccaggatag

SEQ ID NO: 37547 - DNA, 894 bp, Artificial Sequence
  Description of Artificial Sequence: Synthetic coding sequence
atgggagagcacgagcaggtgaagcccctggagaccagcagcagcaaggtgaaggccaagaccatcgtgatgatcccagacagccagaagctgctgcgctgtgagctggagagcctgaagagccagctgcaggcccagaccaaggcctttgagttcctgaaccacagcgtgaccatgctggagaaggagagctgcctgcagcagatcaagatccagcagctggaggaggtgctgagccccaccggccggcagggcgagaaggaggagcacaagtggggcatggagcagggccggcaggagctgtatggagccctgacccagggcctgcagggcctggagaagaccctgcgggacagcgaggagatgcagagggcccggaccacccgctgcctgcagctgctggcccaggagatccgggacagcaagaagttcctgtgggaggagctggagctggtgcgggaggaggtgaccttcatctaccagaagctgcaggcccaggaggatgagatcagcgagaacctggtgaacatccagaagatgcagaagacccaggtgaagtgcaggaagatcctgaccaagatgaagcagcagggccatgaaacagctgcctgcccagagacagaggagatcccccagggcgccagcggctgctggaaggatgacctgcagaaggagctgagtgacatctggagcgctgtgcacgtgctgcagaacagcattgacagcctgaccctgtgcagcggggcctgccccaaggccagcagcctgcggggccacaagggccaccagtgcctgagcccccccctgcccagctgggacagcgacagcgactgtgaccaggacctgagccagccccccttcagcaagagcggccgctccttccccccagcctag

SEQ ID NO: 37548 - DNA, 894 bp, Artificial Sequence; identical to SEQ ID NO: 37547
  Description of Artificial Sequence: Synthetic coding sequence

SEQ ID NO: 37549 - DNA, 978 bp, Artificial Sequence
  Description of Artificial Sequence: Synthetic coding sequence
atggatgcccggaggaagcactggaaggagaacatgttcacccccttcttcagcgcccaggatgtgctggaggagaccagcgagcctgagagcagcagcgagcagaccacagctgacagcagcaagggcatggaggagatctacaacctgagcagcaggaagttccaggaggagagcaagttcaagaggaagaagtacatcttccagctgaatgaaattgagcaggagcagaacctgcgggagaacaagaggaacatcagcaagaatgaaacagacaccaacagcgccagctatgagagcagcaatgtggatgtgaccacagaggagagcttcaacagcacagaggacaacagcacctgcagcacagacaacctgcctgccctgctgcggcaggacatcaggaagaagttcatggagaggatgagccccaagctgtgcctgaacctgctgaatgaggagctggaggagctgaacatgaagtacaggaagattgaggaggagtttgaaaatgctgagaaggagctgctgcactacaagaaggagatcttcaccaagcccctgaacttccaggagacagaaacagatgccagcaagagtgactatgagctgcaggccctgagaaatgacctgtctgagaaggccaccaacgtgaagaacctgtctgagcagctgcagcaggccaaggaggtgatccacaagctgaacctggagaacagaaacctgaaggaggccgtgaggaagctgaagcaccagacagaggtgggcaatgtgctgctgaaggaggagatgaagagctactatgagctggagatggccaagatccggggggagctgagcgtcatcaagaatgagctgaggacagagaagaccctgcaggccaggaacaacagagccctggagctgctgaggaagtactatgccagctccatggtgaccagcagcagcatcctggaccacttcaccggggacttcttctag

SEQ ID NO: 37550 - DNA, 978 bp, Artificial Sequence; identical to SEQ ID NO: 37549
  Description of Artificial Sequence: Synthetic coding sequence

SEQ ID NO: 37551 - DNA, 2223 bp, Artificial Sequence
  Description of Artificial Sequence: Synthetic coding sequence
atgaaccccccaggcagcctggaggccctggaccccaacgtggatgagcacctgagcacccagatcctggcccccagcgtgcacagcgacaacagccaggagcgcatccaggcccggcggctgagaattgctgcccggctggaggccaggagaagagaggccctgggggagtacctggatggcaagaaggagagcgaggaggaccagagcaagagctacaagcagaaggaggagagccggctgaagctggccaagctgctgctgtgtggcacagagctggtgaccaacatccaggtggccatcgacatccgggagatccaccggcgggtggaggaggaggagatcaagaggcagagaattgagaagctggagaatgaggtgaagaccagccaggacaagtttgatgagatcaccagcaagtgggaggagggcaagcagaagaggatcccccaggagctgtgggagatgctgaacacccagcagctgcactgtgccggcctgctggaggacaagaacaagctgatcagcgagctgcagcaggagctgaagaccaaggatgaccagtatgtgaaggacctgaagaagcagagtgatgacatctgcctgctgctggagaggatggaggagcaggtgaagaatgtgatgaagaccttccgggaggagctgtacaacatcgagaaggcctttgaggtggagcggcaggagctgctggccagcaacaagaagaagtgggagcaggccctgcaggcccacaatgccaaggagctggagtacctgaacaacaggatgaagaaggtggaggactatgagaagcagctgaaccggcagaggatctgggactgtgaggagtacaacatgatcaagatcaagctggagcaggatgtgcagatcctggagcagcagctgcagcagaggaaggccatctaccagctgaaccaggagaagctggagtacaacctgcaggtgctgaagaagagagatgaggagagcaccgtcatcaagagccagcagaagaggaagatcaaccggctgcatgacatcctgaacaacctgcggagcaaatatgccaagcagatcaagcagttccaggaggagaaccagagcctgaccagtgactacaagaggctggtgatgcagttcaaggagctgcagaaggccatgaggcactttgccctgattgatgatgagaagttctgggagatctggctgatgaatgaggaggaggccaaggacctgattgcccgggcctttgatgtggaccgcatcatccacacccaccacctgggcctgccctgggccgccccagacttctggttcctgaacaacgtgggccccatcagccagcagccccagaagagcgccacccagatcgtggaggagatgctgatgaggtctgaggaggaggaggccgaggaggccgctgctgagcctgagagctacctggacctgcccaagcagatcagcgagaagaccaccaagaggatcctgatgctgctgtgtgatgaaagtggcttcctgattgagagcaagctgctgagcctgctgctgcccctggagcagaatgaatgctacctgctgcggctggatgccatcttcagcgccctgggcattgaaagtgaagatgacctgtacaagctggtgaacttcttcctgaagtaccgggcccaccggctgagcagcagcctgcagatcaagccctgcagccaggcctccatggagaaggcctccatggaggagaccagcaccaggtctgagctggagctggccgagcagacagagatggagggggagaaggaggagagcctggtggagggggagaaggaggaggaggaggagaccccacccagcccctgggtgatccaccccaatgatgtgctgaagatcctggaggcctttgtgatgggcctgaagaagccccgggacagccgggcccccctgcgggtgcagaagaatgtgcgggacaacagcaaggacagcgagtactggcaggccctgaccaccgtcatccccagcagcaagcagaacctgtgggatgccctgtacacagccctggagaagtaccacctggtgctgacccagagggccaagctgctgctggagaacagcagcctggagcagcagaacacagagctgcaggccctgctgcagcagtacctgaacagcaagatcaacagcgagctgcaggtgccccccacccaggtgctgcgggtgcccaccaagtag

SEQ ID NO: 37552 - DNA, 522 bp, Artificial Sequence
  Description of Artificial Sequence: Synthetic coding sequence
atgggcagccacagccccagccacttcctggtgcacggctggatcctgtccatgatgtttcctgaggaggaggaggccgaggaggccgctgctgagcctgagagctacctggacctgcccaagcagatcagcgagaagaccaccaagaggatcctgatgctgctgtgtgatgaaagtggcttcctgattgagagcaagctgctgagcctgctgctgcccctggagcagaatgaatgctacctgctgcggctggatgccatcttcagcgccctgggcattgaaagtgaagatgacctgtacaagctggtgaacttcttcctgaagtaccgggcccaccggctgagcagcagcctgcagatcaagccctgcagccaggcctccatggagaaggcctccatggaggagaccagcaccaggtctgagctggagctggccgagcagacagagatggagggggagaaggaggagagcctggtggagggggagaaggaggaggaggaggagaccccacccagcccctag

SEQ ID NO: 37553 - DNA, 2931 bp, Artificial Sequence
  Description of Artificial Sequence: Synthetic coding sequence
atgcacagcctggccctgcagaacaccctgcacgagaggacctggagcgatgagaagaacctgatgcagcaggagctgcggagcctgaagcagaacatcttcctgttctacgtgaagctgcgctggctgctgaagcactggaggcagggcaagcagatggaggaggagggggaggagttcacagaaggagagcaccctgagaccctgagccggctgggggagctgggcgtgcagggcggccaccaggctgatggccctgaccatgacagcgaccggggctgcggcttccctgtgggggagcacagcccccacagccgggtgcagattggagaccacagcctgcggctgcagacagctgaccggggccagccccacaagcaggtggtggagaaccagcagctgttcagcgccttcaaggccctgctggaggacttccgggcagagctgagagaagatgagcgggcccggctgcggctgcagcagcagtatgccagtgacaaggccgcctgggatgtggagtgggccgtgctgaagtgccgcctggagcagaactgctgcggctacccccgcatcaacatcgaggaggagaccctgggcttcacccggctgcctgctggcagcacagtgaagaccctgaagagcctgggcctgcagaggctggagctggaggagaagacagagaacaagctgggggagctgggcagcagcgctgagagcaagggggccctgaagaaggagcgggaggtgcaccagaagctgctggccgacagccacagcctggtgatggacctgcgctggcagatccaccacagcgagaagaactggaaccgggagaaggtggagctgctggaccggctggaccgggaccggcaggagtgggagcggcagaagaaggagttcctgtggagaattgagcagggcagcctgaggatgcccaggcctgtggccatgtggccctgtgctgatgctgacagcatcccctttgaagatcggcccctgagcaagctgaaggagagtgaccgctgcagcgccagcgagaacctgtacctggatgccctgagcctggatgatgagcctgaggagcccccagcccacaggcctgagcgggagttcaggaaccggctgcctgaggaggaggagaaccacaagggcaacctgcagagagctgtgtctgtgtcctccatgtctgagttccagaggctgatggacatcagccccttcctgcctgagaagggcctgcccagcaccagcagcaaggaggatgtgaccccacccctgagcccagatgacctgaagtacatcgaggagttcaacaagtcctgggactacacccccaacagaggccacaacggcggcggccctgacctgtgggccgacagaacagaggtgggccgggccggccacgaggacagcacagagcccttcccagacagctcctggtacctgaccacctctgtgaccatgaccacagacaccatgaccagccctgagcactgccagaagcagcccctgcggagccacgtgctgacagagcagagcggcctgcgggtgctgcacagccccccagctgtgagaagagtggacagcatcacagctgctggaggagagggccccttccccaccagccgggcccggggcagccctggggacaccaagggcggccccccagagcccatgctgagccgctggccctgcaccagccccaggcacagccgggactatgtggagggcgcccggcggcccctggacagccccctgtgcaccagcctgggctttgccagccccctgcacagcctggagatgagcaagaacctgagtgatgacatgaaggaggtggccttctctgtgagaaatgccatctgcagcggccctggagagctgcaggtgaaggacatggcctgccagaccaacggcagcaggaccatgggcacccagacagtgcagaccatctctgtgggcctgcagacagaggccctgcggggcagcggcgtgaccagcagcccccacaagtgcctgacccccaaggccggcggcggggccacccctgtgagcagccccagccgcagcctgcggagccggcaggtggccccagccatcgagaaggtgcaggccaagtttgagaggacctgctgcagccccaagtatggcagccccaagctgcagaggaagcccctgcccaaggctgaccagcccaacaacagaaccagccctggcatggcccagaagggctacagcgagagcgcctgggcccggagcaccaccacccgggagagccctgtgcacaccaccatcaatgatggcctgagcagcctcttcaacatcatcgaccacagccctgtggtgcaggaccccttccagaagggcctgcgggccggcagccgcagccgctctgctgagcccaggcctgagctgggccctggccaggagaccggcaccaacagccggggccgcagccccagccccatcggcgtgggcagcgagatgtgccgggaggagggcggggagggcacccctgtgaagcaggacctgagcgcccctcctggctacaccctgacagaaaatgtggcccgcatcctgaacaagaagctgctggagcacgccctgaaggaggagcggcggcaggccgcccacggccccccaggcctgcacagcgacagccacagcctgggggacacagctgagcccggccccatggaggagctgccctgcagcgccctggcccccagcctggagccctgcttcagcaggcctgagaggcctgccaacagaagaccacccagccgctgggccccccacagccccacagccagccagccccagagccctggggaccccaccagcctggaggagcacggcggggaggagcccccagaggagcagccccacagagatgccagcctgcacggcctgagccagtacaacagcctgtag

SEQ ID NO: 37554 - DNA, 4761 bp, Artificial Sequence
  Description of Artificial Sequence: Synthetic coding sequence
atggaggagatgagggacagctacctggaggaggatgtgtaccagctgcaggagctgcggcgggagctggaccgggccaacaagaactgccgcatcctgcagtaccgcctgaggaaggccgagcagaagagcctgaaggtggccgagaccggccaggtggatggagagctgatccgcagcctggagcaggacctgaaggtggccaaggatgtgtctgtgcggctgcaccacgagctgaagacagtggaggagaagagggccaaggccgaggatgaaaatgagaccctgcggcagcagatgattgaggtggagatcagcaagcaggccctgcagaatgagctggagcggctgaaggagagcagcctgaagaggaggagcacccgggagatgtacaaggagaagaagaccttcaaccaggatgacagcgctgacctgcgctgccagctgcagtttgccaaggaggaggccttcctgatgaggaagaagatggccaagctgggccgggagaaggatgagctggagcaggagctgcagaagtacaagagcctgtatggagatgtggacagccccctgcccactggagaggccggcggcccccccagcacccgggaggccgagctgaagctgcggctgaagctggtggaggaggaggccaacatcctgggcaggaagatcgtggagctggaggtggagaacagaggcctgaaggccgagatggaggacatgaggggccagcaggagcgggagggccctggccgggaccacgcccccagcatccccaccagcccctttggagacagcctggagagcagcacagagctgcggcggcacctgcagtttgtggaggaggaggccgagctgctgcggcgcagcatcagcgagattgaggaccacaaccggcagctgacccatgagctgagcaagttcaagtttgagcccccccgggagcccggctggctgggggagggcgccagccctggggccggcggcggggcccccctgcaggaggagctgaagagcgcccggctgcagatcagcgagctgagcggcaaggtgctgaagctgcagcacgagaaccacgccctgctgagcaacatccagagatgtgacctggccgcccacctgggcctgcgggcccccagcccccgggacagtgatgctgagagtgatgctgggaagaaggagagtgatggagaggagagccggctgccccagcccaagcgggagggccctgtgggcggggagagtgacagcgaggagatgtttgagaagaccagcggcttcggcagcggcaagcccagcgaggccagcgagccctgccccacagagctgctgaaggccagagaagattctgagtacctggtgaccctgaagcatgaggcccagaggctggagaggacagtggagcggctcatcacagacacagacagcttcctgcatgatgctggcctgcggggcggggcccccctgcccggccctggcctgcagggcgaggaggagcagggcgagggggaccagcaggagccccagctgctgggcaccatcaatgccaagatgaaggccttcaagaaggagctgcaggccttcctggagcaggtgaacagaattggagatggcctgagccccctgccccacctgacagagagcagcagcttcctgagcacagtgacctctgtgtcccgggacagccccatcggcaacctgggcaaggagctgggccctgacctgcagagccggctgaaggagcagctggagtggcagctgggccctgcccggggagatgagcgggagagcctgcggctgcgggccgcccgggagctgcacagaagagcagatggagacaccggcagccacggcctgggcggccagacctgcttcagcctggagctgcggggcccccctgtgctgcctgagcagagcgtgtccattgaggagctgcagggccagctggtgcaggccgcccggctgcaccaggaggagacagagaccttcaccaacaagatccacaagatggaggaggagcacctgtatgccctgcgctggaaggagctggagatgcacagcctggccctgcagaacaccctgcacgagaggacctggagcgatgagaagaacctgatgcagcaggagctgcggagcctgaagcagaacatcttcctgttctacgtgaagctgcgctggctgctgaagcactggaggcagggcaagcagatggaggaggagggggaggagttcacagaaggagagcaccctgagaccctgagccggctgggggagctgggcgtgcagggcggccaccaggctgatggccctgaccatgacagcgaccggggctgcggcttccctgtgggggagcacagcccccacagccgggtgcagatcggggaccacagcctgcggctgcagacagctgaccggggccagccccacaagcaggtggtggagaaccagcagctgttcagcgccttcaaggccctgctggaggacttccgggcagagctgcgggaggatgagcgggcccggctgcggctgcagcagcagtatgccagtgacaaggccgcctgggatgtggagtgggccgtgctgaagtgccgcctggagcagctggaggagaagacagagaacaagctgggggagctgggcagcagcgctgagagcaaaggagccctgaagaaggagcgggaggtgcaccagaagctgctggccgacagccacagcctggtgatggacctgcgctggcagatccaccacagcgagaagaactggaaccgggagaaggtggagctgctggaccggctggaccgggaccggcaggagtgggagcggcagaagaaggagttcctgtggagaattgagcagctgcagaaggagaacagccccaggagaggaggcagcttcctgtgtgaccagaaggatggaaatgtgcggcccttcccccaccagggcagcctgaggatgcccaggcctgtggccatgtggccctgtgctgatgctgacagcatcccctttgaggaccggcccctgagcaagctgaaggagagtgaccgctgcagcgcctctgaaaatctctacctggatgccctgagcctggatgatgagcctgaggagcccccagcccacaggcctgagcgggagttcaggaaccggctgcctgaggaggaggagaaccacaagggcaacctgcagagagctgtgtctgtgtcctccatgtctgagttccagaggctgatggacatcagccccttcctgcctgagaagggcctgcccagcaccagcagcaaagaagatgtgaccccacccctgagcccagatgacctgaagtacatcgaggagttcaacaagtcctgggactacacccccaacagaggccacaatggaggcggccctgacctgtgggccgacagaacagaggtgggccgggccggccacgaggacagcacagagcccttcccagacagctcctggtacctgaccacctctgtgaccatgaccacagacaccatgaccagccctgagcactgccagaagcagcccctgcggagccacgtgctgacagagcagagcggcctgcgggtgctgcacagccccccagctgtgcggcgggtggacagcatcacagctgctggaggagagggccccttccccaccagccgggcccggggcagccctggggacaccaagggcggccccccagagcccatgctgagccgctggccctgcaccagccccaggcacagccgggactatgtggagggcgcccggcggcccctggacagccccctgtgcaccagcctgggctttgccagccccctgcacagcctggagatgagcaagaacctgagtgatgacatgaaggaggtggccttctctgtgagaaatgccatctgcagcggccctggagagctgcaggtgaaggacatggcctgccagaccaacggcagcaggaccatgggcacccagacagtgcagaccatctctgtgggcctgcagacagaggccctgcggggcagcggcgtgaccagcagcccccacaagtgcctgacccccaaggccggcggcggggccacccctgtgagcagccccagccgcagcctgcggagccggcaggtggccccagccatcgagaaggtgcaggccaagtttgagaggacctgctgcagccccaagtatggcagccccaagctgcagaggaagcccctgcccaaggctgaccagcccaacaacagaaccagccctggcatggcccagaagggctacagcgagagcgcctgggcccggagcaccaccacccgggagagccctgtgcacaccaccatcaatgatggcctgagcagcctcttcaacatcatcgaccacagccctgtggtgcaggaccccttccagaagggcctgcgggccggcagccgcagccgctctgctgagcccaggcctgagctgggccctggccaggagaccggcaccaacagccggggccgcagccccagccccatcggcgtgggcagcgagatgtgccgggaggagggcggggagggcacccctgtgaagcaggacctgagcgcccctcctggctacaccctgacagaaaatgtggcccgcatcctgaacaagaagctgctggagcacgccctgaaggaggagcggcggcaggccgcccacggccccccaggcctgcacagcgacagccacagcctgggggacacagctgagcccggccccatggagaaccagacagtgctgctgacagccccctggggcctgtag

SEQ ID NO: 37555 - DNA, 4638 bp, Artificial Sequence
  Description of Artificial Sequence: Synthetic coding sequence
atggaggagatgagggacagctacctggaggaggatgtgtaccagctgcaggagctgcggcgggagctggaccgggccaacaagaactgccgcatcctgcagtaccgcctgaggaaggccgagcagaagagcctgaaggtggccgagaccggccaggtggatggagagctgatccgcagcctggagcaggacctgaaggtggccaaggatgtgtctgtgcggctgcaccacgagctgaagacagtggaggagaagagggccaaggccgaggatgaaaatgagaccctgcggcagcagatgattgaggtggagatcagcaagcaggccctgcagaatgagctggagcggctgaaggagagcagcctgaagaggaggagcacccgggagatgtacaaggagaagaagaccttcaaccaggatgacagcgctgacctgcgctgccagctgcagtttgccaaggaggaggccttcctgatgaggaagaagatggccaagctgggccgggagaaggatgagctggagcaggagctgcagaagtacaagagcctgtatggagatgtggacagccccctgcccactggagaggccggcggcccccccagcacccgggaggccgagctgaagctgcggctgaagctggtggaggaggaggccaacatcctgggcaggaagatcgtggagctggaggtggagaacagaggcctgaaggccgagatggaggacatgaggggccagcaggagcgggagggccctggccgggaccacgcccccagcatccccaccagcccctttggagacagcctggagagcagcacagagctgcggcggcacctgcagtttgtggaggaggaggccgagctgctgcggcgcagcatcagcgagattgaggaccacaaccggcagctgacccatgagctgagcaagttcaagtttgagcccccccgggagcccggctggctgggggagggcgccagccctggggccggcggcggggcccccctgcaggaggagctgaagagcgcccggctgcagatcagcgagctgagcggcaaggtgctgaagctgcagcacgagaaccacgccctgctgagcaacatccagagatgtgacctggccgcccacctgggcctgcgggcccccagcccccgggacagtgatgctgagagtgatgctgggaagaaggagagtgatggagaggagagccggctgccccagcccaagcgggagggccctgtgggcggggagagtgacagcgaggagatgtttgagaagaccagcggcttcggcagcggcaagcccagcgaggccagcgagccctgccccacagagctgctgaaggccagagaagattctgagtacctggtgaccctgaagcatgaggcccagaggctggagaggacagtggagcggctcatcacagacacagacagcttcctgcatgatgctggcctgcggggcggggcccccctgcccggccctggcctgcagggcgaggaggagcagggcgagggggaccagcaggagccccagctgctgggcaccatcaatgccaagatgaaggccttcaagaaggagctgcaggccttcctggagcaggtgaacagaattggagatggcctgagccccctgccccacctgacagagagcagcagcttcctgagcacagtgacctctgtgtcccgggacagccccatcggcaacctgggcaaggagctgggccctgacctgcagagccggctgaaggagcagctggagtggcagctgggccctgcccggggagatgagcgggagagcctgcggctgcgggccgcccgggagctgcacagaagagcagatggagacaccggcagccacggcctgggcggccagacctgcttcagcctggagatggaggaggagcacctgtatgccctgcgctggaaggagctggagatgcacagcctggccctgcagaacaccctgcacgagaggacctggagcgatgagaagaacctgatgcagcaggagctgcggagcctgaagcagaacatcttcctgttctacgtgaagctgcgctggctgctgaagcactggaggcagggcaagcagatggaggaggagggggaggagttcacagaaggagagcaccctgagaccctgagccggctgggggagctgggcgtgcagggcggccaccaggctgatggccctgaccatgacagcgaccggggctgcggcttccctgtgggggagcacagcccccacagccgggtgcagattggagaccacagcctgcggctgcagacagctgaccggggccagccccacaagcaggtggtggagaaccagcagctgttcagcgccttcaaggccctgctggaggacttccgggcagagctgagagaagatgagcgggcccggctgcggctgcagcagcagtatgccagtgacaaggccgcctgggatgtggagtgggccgtgctgaagtgccgcctggagcagctggaggagaagacagagaacaagctgggggagctgggcagcagcgctgagagcaagggggccctgaagaaggagcgggaggtgcaccagaagctgctggccgacagccacagcctggtgatggacctgcgctggcagatccaccacagcgagaagaactggaaccgggagaaggtggagctgctggaccggctggaccgggaccggcaggagtgggagcggcagaagaaggagttcctgtggagaattgagcagctgcagaaggagaacagcccccggcggggcggcagcttcctgtgtgaccagaaggatggaaatgtgcggcccttcccccaccagggcagcctgaggatgcccaggcctgtggccatgtggccctgtgctgatgctgacagcatcccctttgaagatcggcccctgagcaagctgaaggagagtgaccgctgcagcgccagcgagaacctgtacctggatgccctgagcctggatgatgagcctgaggagcccccagcccacaggcctgagcgggagttcaggaaccggctgcctgaggaggaggagaaccacaagggcaacctgcagagagctgtgtctgtgtcctccatgtctgagttccagaggctgatggacatcagccccttcctgcctgagaagggcctgcccagcaccagcagcaaggaggatgtgaccccacccctgagcccagatgacctgaagtacatcgaggagttcaacaagtcctgggactacacccccaacagaggccacaacggcggcggccctgacctgtgggccgacagaacagaggtgggccgggccggccacgaggacagcacagagcccttcccagacagctcctggtacctgaccacctctgtgaccatgaccacagacaccatgaccagccctgagcactgccagaagcagcccctgcggagccacgtgctgacagagcagagcggcctgcgggtgctgcacagccccccagctgtgagaagagtggacagcatcacagctgctggaggagagggccccttccccaccagccgggcccggggcagccctggggacaccaagggcggccccccagagcccatgctgagccgctggccctgcaccagccccaggcacagccgggactatgtggagggcgcccggcggcccctggacagccccctgtgcaccagcctgggctttgccagccccctgcacagcctggagatgagcaagaacctgagtgatgacatgaaggaggtggccttctctgtgagaaatgccatctgcagcggccctggagagctgcaggtgaaggacatggcctgccagaccaacggcagcaggaccatgggcacccagacagtgcagaccatctctgtgggcctgcagacagaggccctgcggggcagcggcgtgaccagcagcccccacaagtgcctgacccccaaggccggcggcggggccacccctgtgagcagccccagccgcagcctgcggagccggcaggtggccccagccatcgagaaggtgcaggccaagtttgagaggacctgctgcagccccaagtatggcagccccaagctgcagaggaagcccctgcccaaggctgaccagcccaacaacagaaccagccctggcatggcccagaagggctacagcgagagcgcctgggcccggagcaccaccacccgggagagccctgtgcacaccaccatcaatgatggcctgagcagcctcttcaacatcatcgaccacagccctgtggtgcaggaccccttccagaagggcctgcgggccggcagccgcagccgctctgctgagcccaggcctgagctgggccctggccaggagaccggcaccaacagccggggccgcagccccagccccatcggcgtgggcagcgagatgtgccgggaggagggcggggagggcacccctgtgaagcaggacctgagcgcccctcctggctacaccctgacagaaaatgtggcccgcatcctgaacaagaagctgctggagcacgccctgaaggaggagcggcggcaggccgcccacggccccccaggcctgcacagcgacagccacagcctgggggacacagctgagcccggccccatggagaaccagacagtgctgctgacagccccctggggcctgtag

SEQ ID NO: 37556 - DNA, 1320 bp, Artificial Sequence
  Description of Artificial Sequence: Synthetic coding sequence
atggcccccaagaagaagaggggccccagcgctggcagccagcctggaggagctgctgctgctggagctgagcagcccctgtctgagcgggcccagtacctgcagcgggagcacgccctgctgtctgagcagctggacacctgtgaggagagcgtggaccaggtgctgcgggagaatgccttcctggaccgggaggccctgcggctgcgggaggagaaccggctgtatgccagctatgtgtctgcccgggcccagagatgtgccaaggccatcgtgcggctggatgagcagaacagagtggacctggcccagatccactggcagagagctgagctggccagcctgtaccacggccgggaggatggagtgcgggcccagctgctggagatggaggcccgggccgcccagatggcccagcaggtgcaggagctgcagccctacaaggtgctgcagctggagcagctggcccgcatccgggccctggagcgggagctgctgcacatgagggtggagcacacccagctgctgcaccgggtgaagaggcgcttcctggaggacaaggccgcctttgagcgggaggcccggcagagggtgcagagcctggccaggagagctgagcgggaggccgtgcgggccctggtggcccacacccaggccatcaaggctgacaatggccgcctgcggcaggagctgctgctgctgctgcggaggacccagctgctgcaccacacccggcggcagctgctggagcagcgggagcagctgcaccgggagcacgaggacacccgggacctggcccgggtgcacggctggctgcggcggggccctgggggcccccccctgtgggagaggcctgccttcagccagcccaccagccggcccggcagcctggccgcccccatcagccccagccgggccgccagccagacccccagcgtggtgcccagccgggccgccccccgggccagctctgtggtgcccagccgggaggccagccgggtgcccagcctggtgctgagctccatggacagccgggtgcccagcctggccaccagcaaggtgggcagcaggatgcccagcctgacagccagccgggccggcagccgggccctgagcctggtgcagagcctggagggcagcggcatcagcagcggcagcagcccccgggtgagcagccaggacaccctgcggagcaccaagagcggccccaagctgctgagcggcctgagccgggaccgggaccctgccctgctgcccccccagagtgaagattctgtgaatgctgaggccgctgctgaggccagccctggccgggcctag

SEQ ID NO: 37557 - DNA, 7359 bp, Artificial Sequence
  Description of Artificial Sequence: Synthetic coding sequence
atggcccagatccagaaggacaaggccaacatcagcgagaagtctgtgatgcaccctgagtacatcgctgtgaaggccgagaagagccccctgagccacatcctgaagaccaaggagctgcaggtgaacatcagccagcagggcgagaaggcccaggagggggaggtggagatcgtggtgctgctgagcaagacctgcccctttgtgaccagcagcgccttcctggagctggacagcatcaaggaggaggagggggagccccgcatcaccaggagcttcatgccccacctggagatccaggagagcctgcccagccggcagacagcccccaccaagcccacagagagcctggtgaagaaggagaagcagctgctgccccagaaggaggacagagtgcagacagtgtccatgcacggcctgatgcaccccaacggggctgtgttcaaggccaagaccagcgccccaccccaggtgttcagcatcacagagcacagccccctgagcaagaggaaggagccccagtggggcatgaaggagagagctggccagaagcaggacagaacaggccggccccacgtgatcctgaccaagacccaccccttcatgcccagcctgagccaccaccgcttcagccccagccagcccaagctgcccatcagcagtggagctgggaagagccggctggccaacagcaatgaaggcatcagcagccacaaggtgatcctgaaggccaaccagcagatgccctacaaggaggccaaggacagagtgaagattgagggccgggagggccgcatcctgcccaagaggatccacctgcgggcagaggccctgcccctggccctgctgtgcaatggcaagaactacagcctgcacatcgaggagcagggcgagggcgtgcaggagagcaagaaggagcccggggtggtgcccaggaagagcgccagcttccccccaccacccttctacctgaactgtgacaccaggagaaatgagaaggagggcaccctgggcaagacccagttctccttcccccccctgaagatccaggacagcagtgacagcggcaagaaggcctacacagagagcctgcacggctacaccctgagcaacagcaaaggacctgtgcagcccacagcccagggcgaggagaagggcggcctgagaattgacatggaggacaagatgctgcccaagtgcacagacctgaaggccaagcagctgctgctgagtgacatcctgaacaccaagaagctgcagtggaagagcaaggagcagaagaggaagatccaggaggacaagaacaagcaggtgaagggcctgcccagcatcaacaccagcctgctgaccccaccctacctgaagtttgacaccacagagggccaggagaatgtcatccgcatcgccaaggtgtccctgccccagagccgcagcaaggagagcagtgatgctggaagaattgcctgcccagaggccacccacggggagctgagcagtgatgtgaagcagctgaaggcccacctgctgcagaaggaggagaaggaccgggagaaggtggccgacatgacctctgtgctggaccccaacaagatgtacctgaaggccaagaagagccctgtgctgcacacccacagcttcagtgacctgcagtggaagacccgggagcaggaggaggagaaggtgcagaaggtgaagagcggccctggggtgatgctgagcaagagccccagccgcagcagccccctgcacctgaatgtgaacacaggcttccaggaggagagcatccccatcctgacccggcccagcttccccctggtgaagctgcaggtgtccccagacacagagggcggcacctgcatccggcccatcgccggggacatcctgatctacctgcagaagggcaagcacgtgtcccagaacaaggaggaggatgatgtgcagatcgtgtccatcctgatcttccccaagcaccaggaggagaaggtgcaggagtgtgagggggagcccggggtggtgctgaccaagagcaccagcctgcccagcctgagccagctggagctggacaaggagacccacctgggcaatgagatgctgcggctgaagaggcccatcctgcggcgcatcagccacatcggggagaccgtgcaccgggagagcgtggtgggggacatccccaaggatgtgaagaatgagaagcagcacatcccccagaaggaggagaggaaccagaagaagatcatcgacatgaggggcacagacatcaccctgaagagcaagaagagccccaggagctgcatgctgcacaggacagagctgcacgtgaacatcggcggccagggcaggaaggagcacgagggccaggacaagcccccaggcatgatccagaggaagatgtgcatcctcttcagcaagcccctgcccagcaacctgaagctggagcgggccacccatgctgatgaggagcggctgggcggcaagaccagctttgtgctgcccctgatgcccagcgccctgcctgacacagagaagacagcagatgctgaggcccggtctggagatgtgaggaagggcaagccccacaggagccagaaggaaaatagacatgaggtgaagaccatcgacatgaggttccgcatccactgccaggaggcccgcatcagccccatgagccacatcctgaatgccaaggagctggtgctgaacatcaacaagctggagaagaaggtgcacaaggacaaggatgaggcctgtgtggtgctgagcaggaccttcctgagcatccccagcgccccacccctgtacctggacagcggcaacaagacagacaaggacaccccaggcatcaccggcagcagctgcccccagaggaccctgcacgtgcccagcaacacccagaagatcaccaacagagacagcgtggagggcgtggacaagaatgtggtgaagcaggccgagcagtatgtgcccaggcctgaggccgagcagcagctgaccagcaacttcatgatctctgtgcagcagaggaaccagcccagccgggtgcgctctgaggaggacctgaaccagctggtgctgaacagcagagatgaggacatctacttcaccggcttcggcaccatccgcagcggcaagaggcctgagtggctgttcaccgggaagaaggcccagcctgtgaagtacaagacagagaccctgacagccttcctgagctaccccaccatggatgccaccaagatgggcggcctggaggaggacacagagatcatggacaacctgaaccacaagatcagccccaaggcctctgtgtccctcatcaggaagatcagcaaggagctgtatgtgaccctgggcaccccagccaacagcaagggcttctctgtgtctgaaagatatgcccaccagcaggagaccagcagcaaggtgtccccagagctggccggcagctgcaagtttgacaagcccaaggaggatggccagagcaatgaccgcatcagcaagatgttcagccccaaggtgctggccccccagaccaagggcagcctgaagaagatcagcatcgtgaccaactggaatgccccccagaacatcgaggagcaggacatcgtgatgaagaagcaggtgatcagaagatgtgaacatggccacaagaccaggaccaacaccatcctgagcaagttccccctgcagagcggcaagcagaagaccccatctgaaacagatgtggacaagaagaccacagcccacctgagcctgcagatgctgcccggcatccacatggacatgacagaaattgatcctgccaagggcggcaggaagcaggccctgctgatcagcgagcaggaggagggcgtgctggagttcctgcccaagagcctcttccccccctggaccttccagttccagagcggggacctggaggagaagcaccagacagatgccaacaccaacatcaacctggagcagaagaagctggagatggacaatgacagcacagtgaaccagaaggagggcaagctgaagattggcaccaacagagccctgcacctgcaggaggagaagacagagatgcacaaggccaggacagccaacctggagaaggagcggggccgcatggacaccagcagcagcgcccacccccacctgctgagcctgaaggccgaggagagccagatgaagacccaggtgatcacccaccgggagaacagccgcctcatcatgcagaagcagaagaaggagctggaggccagcaatgccaagcagagcatccagctgcagaagctgttccagagaaatgtgctggacagcttctacagctatgtgcccctgagccccaagaggaaggaccagaagggccgcctgaccatccgggacctgaagcgggagctgagcaccaagtacctgaccatgaagatccagaaccaccccatcccccagatgctgaacatcaccggccggggcacccccagcaacaggaagaagctggagtatgatgtgaagctgaagaacatcgcctcctggagcaaggatgtgtctggcatcttcatccgcagcctgagcatcagcatcatgaggagcccccacacagaccccaagaccaacctggagcgggagaagaggatctgcctgcccaagttccaggagaagagccccaacaccagcgagatgagcaagagggacaccctgaccatcgtgaagggggagcagaacttcaccaacacagtgccccaggacccccagccctttgctgtggacaagcagcagatgcagaagctgcccaacgtgaagtctgaggccaacctgcggtctgagatgaacaagaagtacctgaaggcccagaccaaggagagaattgtgcctgagcatgatgtgagccgcatcatcaagaagccagacctgcgcatcatcgagcaggaggagaagatcctgaagaggatcctgacccccacagagtgccccagcatgctggaggaccccaagctgcccaagcagagggaccagagcgagcctgtgtgggacatgaccacccagaaggtgcagcagcagaaggccttccctggcaccgtgcccatccccccccaggtgaagagcagcgaggtgaagatcgtggccgacagcaccaatgctgagcacctgctgcccatctgtgaggccaccaaggccatcagcgagagccaggtgaagaacatgatccaggacaaggtgtccagtgacaagctggacaacatccaggcctacaagccagatgacctgaagagcccccccttccctgagggccctgacaccatcagcacagccatctaccccaagacccagcacaagagcctgctggagcagttcacccccaaggagaagaacaagctgaccagccacctggagagcaaggccctggagatccagctgaacctgatccctgagatggccaggaagagcctgcagatgttcaacttctaccccaagggcaccatcagcaaggacaacagctggaggttctacagccgccacaagaccatgaacttcatgagcctggagggcacagacaccatcgagcccaacagcaagcacaagcaccagaaggacagccccctggccagcaacatgaagaccctcatcgtggatgtgtccagtgacagcgaggagaccatcaccaagctgcagagcatcaacaagctggagaatggcaccagcgctgtgaccagcgccagcgagatgctgctgccccacaccctgcagaaccacagcgtgaaggagaagggcaagctgctgatgcacttctctgtgaagaccctggagatccagatgaaggccttccccagaattgtgcgggagagctatgccatgaccagcgcccacgagaggaagaagcccctgagcaactgcatccaccctggcttcaccggccccaagaggcagaaccgcatcctgctgctgtctgaggagaagagcctgcaccagattgacctggacctgcagtacaagtacctgcgcttcctgctgggcctgcctgtgggcagcaccttccccaagcccaacgtgctgcccaagcacagcaagctgaacaccatcgctgtgtgcaagaatgtgaatgccggcggccagagcggcagcctgagcattgacacagagctgctggagcagcacatctccttcaagaagcagagcccccatgagaacagcagcctcatcaggaagttcccccagcccaccctggtgtgtgccagtgaccgggacctgcacagccccaggaagaaggacacccaggtgctgtctgagagcgagttccacgtgaccccagagaagaacaagcagtaccacgtgtggttccaggagaggaacacctgtgagagcgtggacctgcggacccagagaaatgccactggatctgctgtgtcctgtgagacccagatcagtgaagattttgtggacatccagacagacatcgagagccctgctgacctggatgagtgcagctgcctggaggtgtctgagagtgaagaatgtgtgttcctggaggccaacagctacctgagccaggagagcgagaacatcctgtttgagctgcagacaggcatccccctggagaatgtgtacaagatcaccacagacctgaagagcttctacagcgaggacagcggcagccactgcaccagagaatgtaggaaggagaccctcatcatcaccccacccagctgcaagagccacaagagcaggaagtaccgcagcagcagcaagatgaagagcccagactggctgtgccacagcagcagcaacacagctgagatccagagccgcagcagctctgtgtccttcagcgaggagaagatctcctggaccaccaagagcaggaccagctacagcagcgcccccctgacagagagcaacatcaagagccacctggccaagaaccagggcaagagccaccgccaccctgagagccaggagaggaagaaggcccggagtgacctcttcaggaagaacagcagccactgggaccatgactacagctgcacccacagcaagggcaagagggacaggaagaagagggtgtatgactatgaaagtgagcggctggactgcttccagagcaagcacaagagcgccagcaagccccaccatgatgacatcaacttctacagcgagaggaagcagaaccggcccttcttctttgcctgtgtgcctgctgacagcctggaggtgatccccaagaccatccgctggaccatccccccagagaccctgaggaagaggaacttccgcatccccctggtggccaagatcagcagctcctggaacatctggagcagcagcaagaagctgctgggcagcctgagcggcagcctgaccaccgtcttccacagctag

SEQ ID NO: 37558 - DNA, 645 bp, Artificial Sequence
  Description of Artificial Sequence: Synthetic coding sequence
atgaaggaggagaggaactacaactttgatggagtgtccaccaaccggctgaagcagcagctgctggaggaggtgaggaagaaggatgctgtgcagctgagcatctttgagctgcggcacaagatcacagagctggaggccaagctgaacacagacaatgaaggcagcgagtggaagaccaggtatgagacccagctggagctgaatgatgagctggagaagcagatcgtgtacctgaaggagaaggtggagaagatccacggcaacagcagtgaccggctgagcagcatccgggtgtatgaaagaatgcctgtggagagcctgaacaccctgctgaagcagctggaggaggagaagaagaccctggagagccaggtgaagtactatgccctgaagctggagcaggagagcaaggcctaccagaagatcaacaatgaaagaaggacctacctggccgagatgagccagggcagcggcctgcaccaggtgtccaagaggcagcaggtggaccagctgcccaggatgcaggagaacctggtgaagacaggccgctacaacccagccaagcagaagacagtgtctgccaagaggggccctgtgaagaagatcacccggcccaaccacctgcctgagctgcacccctag

SEQ ID NO: 37559 - DNA, 426 bp, Artificial Sequence
  Description of Artificial Sequence: Synthetic coding sequence
atggagaccctgcaggagagcctgaacaccctgctgaagcagctggaggaggagaagaagaccctggagagccaggtgaagtactatgccctgaagctggagcaggagagcaaggcctaccagaagatcaacaatgaaagaaggacctacctggccgagatgagccagggcagcggcctgcaccaggtgtccaagaggcagcaggtggaccagctgcccaggatgcaggagaacctggtgaagaccctgctgctgaaggaggagctggaccccctgaaggtgtcctgcctggagaccctgggcttctctgctgctggggtggccggcccagaaaatagaacctgcctgggccagaaggccctgtggccagcctgcctgcacggcagcagcaccctggccgtgtgccagacccacctgaagagctag

SEQ ID NO: 37560 - DNA, 339 bp, Artificial Sequence
  Description of Artificial Sequence: Synthetic coding sequence
atgcctgtggagagcctgaacaccctgctgaagcagctggaggaggagaagaagaccctggagagccaggtgaagtactatgccctgaagctggagcaggagagcaaggcctaccagaagatcaacaatgaaagaaggacctacctggccgagatgagccagggcagcggcctgcaccaggtgtccaagaggcagcaggtggaccagctgcccaggatgcaggagaacctggtgaagacaggccgctacaacccagccaagcagaagacagtgtctgccaagaggggccctgtgaagaagatcacccggcccaaccacctgcctgagctgcacccctag

SEQ ID NO: 37561 - DNA, 420 bp, Artificial Sequence
  Description of Artificial Sequence: Synthetic coding sequence
atgcctgtggagagcctgaacaccctgctgaagcagctggaggaggagaagaagaccctggagagccaggtgaagtactatgccctgaagctggagcaggagagcaaggcctaccagaagatcaacaatgaaagaaggacctacctggccgagatgagccagggcagcggcctgcaccaggtgtccaagaggcagcaggtggaccagctgcccaggatgcaggagaacctggtgaagaccctgctgctgaaggaggagctggaccccctgaaggtgtcctgcctggagaccctgggcttctctgctgctggggtggccggcccagaaaatagaacctgcctgggccagaaggccctgtggccagcctgcctgcacggcagcagcaccctggccgtgtgccagacccacctgaagagctag

SEQ ID NO: 37562 - DNA, 420 bp, Artificial Sequence; identical to SEQ ID NO: 37561
  Description of Artificial Sequence: Synthetic coding sequence

SEQ ID NO: 37563 - DNA, 339 bp, Artificial Sequence; identical to SEQ ID NO: 37560
  Description of Artificial Sequence: Synthetic coding sequence

SEQ ID NO: 37564 - DNA, 726 bp, Artificial Sequence
  Description of Artificial Sequence: Synthetic coding sequence
atgaaggaggagaggaactacaactttgatggagtgtccaccaaccggctgaagcagcagctgctggaggaggtgaggaagaaggatgctgtgcagctgagcatctttgagctgcggcacaagatcacagagctggaggccaagctgaacacagacaatgaaggcagcgagtggaagaccaggtatgagacccagctggagctgaatgatgagctggagaagcagatcgtgtacctgaaggagaaggtggagaagatccacggcaacagcagtgaccggctgagcagcatccgggtgtatgaaagaatgcctgtggagagcctgaacaccctgctgaagcagctggaggaggagaagaagaccctggagagccaggtgaagtactatgccctgaagctggagcaggagagcaaggcctaccagaagatcaacaatgaaagaaggacctacctggccgagatgagccagggcagcggcctgcaccaggtgtccaagaggcagcaggtggaccagctgcccaggatgcaggagaacctggtgaagaccctgctgctgaaggaggagctggaccccctgaaggtgtcctgcctggagaccctgggcttctctgctgctggggtggccggcccagaaaatagaacctgcctgggccagaaggccctgtggccagcctgcctgcacggcagcagcaccctggccgtgtgccagacccacctgaagagctag

SEQ ID NO: 37565 - DNA, 1773 bp, Artificial Sequence
  Description of Artificial Sequence: Synthetic coding sequence
atggacagccacagcggggagcccgccctgctgccctgtggcacctgtgacatggtgttccgcagcagcgccctgctggccacccacacccagcgcttctgcatcggccaccccacccaggagatgaccttcggggcccaggcctctgtggccacagagccccagagagctgctgtgcagtggctgcggctgagcctgcaggagatgaggccctggatcacagaggtgccccgggtgtttgctggcccctggaccaggtctgaggcccggccccagagccccatgtctgaggccgtgggcagccccagcgagcggctgcgggccctcttccgcacccgggccaggagagtggccgagatggaggcccagagccgggccctgcagctgcggggggaggagctgagccggcggctgcaggtggtggcctgcacccggggcggcatgagccggctgtttggcctggagcaggagatccgggagctgcaggccgaggccggccgcaccaggggggccctggaggtgctgggcgcccgcatccaggagctgcaggccgagcccggcaaccccctgagcagcagaagagaggccgagctgtacagccctgtgcagaaggccaaccctggcaccctggccgctgagatccgggccctgcgggaggcctacatcagagatggcggccgggaccccggggtgctgggccagatctggcagctgcaggtggaggccagcgccctggagctgcagaggagccagacccggcggggccgggccggggccaccagcggggagctgcctgtggtggaggccgagaacagaaggctggaggccgagatcctggccctgcagatgcagaggggccgggcccccctgggcccccaggacctgcggctgctgggagatgccagcctgcagcccaagggccggcgggacccccccctgctgcccccacctgtggccccacccctgccccccctgcccggcttcagcgagccccagctgcccggcaccatgaccaggaacctgggcctggacagccacttcctgctgcccaccagtgacatgctgggccctgccccctatgaccccggggccggcctggtgatcttctatgacttcctgcggggcctggaggcctcctggatctgggtgcagctgaggacaggcctggccagagatggccgggacaccggccgcaccacagccctgcccccagccctgtgcctgcccccacctccagcccctggccccatgggcaactgtgccatcctggccagccggcagcctgtgccccggctgccccccagcagctctgtgtccctggtgtgtgagctgcaggtgtggcagggcctggcctgggcccgggccccccagcccaaggcctgggtgtccctgggcctgtttgaccaggaccagagggtgctgagcggccgctggaggctgcccctgcgggccctgcccctggaccccagcctgagcctgggccagctgaatggcatcccccaggccggccaggccgagctgttcctgcggctggtgaatgccagagatgctgctgtgcagaccctggccgagatcaacccagcctctgtgcatgagtaccagtacccacctcctgtgagcagcaccagcagcctggaggccagcttcctgaccccagctgtgggctttgctgaccccccacccaggacagaggagcccctgagcggcgtgaaggacagagatgagggcctgggcccccaccacagcagtgacctgccccctgtgtccttctag

SEQ ID NO: 37566 - DNA, 333 bp, Artificial Sequence
  Description of Artificial Sequence: Synthetic coding sequence
atggacagccacagcggggagcccgccctgctgccctgtggcacctgtgacatggtgttccgcagcagcgccctgctggccacccacacccagcgcttctgcatcggccaccccacccaggagatgaccttcggggcccaggcctctgtggccacagagccccagagagctgctgtgagcagcaccagcagcctggaggccagcttcctgaccccagctgtgggctttgctgaccccccacccaggacagaggagcccctgagcggcgtgaaggacagagatgagggcctgggcccccaccacagcagtgacctgccccctgtgtccttctag

SEQ ID NO: 37567 - DNA, 1842 bp, Artificial Sequence
  Description of Artificial Sequence: Synthetic coding sequence
atggacagccacagcggggagcccgccctgctgccctgtggcacctgtgacatggtgttccgcagcagcgccctgctggccacccacacccagcgcttctgcatcggccaccccacccaggagatgaccttcggggcccaggcctctgtggccacagagccccagagagctgctgtggtgccccaggagcaccagggcgtgccccaggagccccagggcctgcctgaccagcaggccagccgcagcgccctgaagaggctgacagaggaggagatgaggccctggatcacagaggtgccccgggtgtttgctggcccctggaccaggtctgaggcccggccccagagccccatgtctgaggccgtgggcagccccagcgagcggctgcgggccctcttccgcacccgggcccggcgggtggccgagatggaggcccagagccgggccctgcagctgcggggggaggagctgagccggcggctgcaggtggtggcctgcacccggggcggcatgagccggctgtttggcctggagcaggagatccgggagctgcaggccgaggccggccgcaccaggggggccctggaggtgctgggcgcccgcatccaggagctgcaggccgagcccggcaaccccctgagcagccggcgggaggccgagctgtacagccctgtgcagaaggccaaccctggcaccctggccgctgagatccgggccctgcgggaggcctacatcagagatggcggccgggaccccggggtgctgggccagatctggcagctgcaggtggaggccagcgccctggagctgcagaggagccagacccggcggggccgggccggggccaccagcggggagctgcctgtggtggaggctgaaaatagaaggctggaggccgagatcctggccctgcagatgcagaggggccgggcccccctgggcccccaggacctgcggctgctgggagatgccagcctgcagcccaagggcagaagagacccccccctgctgcccccacctgtggccccacccctgccccccctgcccggcttcagcgagccccagctgcccggcaccatgaccaggaacctgggcctggacagccacttcctgctgcccaccagtgacatgctgggccctgccccctatgaccctggagctggcctggtgatcttctatgacttcctgcggggcctggaggcctcctggatctgggtgcagctgaggacaggcctggccagagatggccgggacaccggccgcaccacagccctgcccccagccctgtgcctgcccccacctccagcccctggccccatgggcaactgtgccatcctggccagccggcagcctgtgccccggctgccccccagcagctctgtgtccctggtgtgtgagctgcaggtgtggcagggcctggcctgggcccgggccccccagcccaaggcctgggtgtccctgggcctgtttgaccaggaccagagggtgctgagcggccgctggaggctgcccctgcgggccctgcccctggaccccagcctgagcctgggccagctgaatggcatcccccaggccggccaggccgagctgttcctgcggctggtgaatgccagagatgctgctgtgcagaccctggccgagatcaacccagcctctgtgcatgagtaccagtacccacctcctgtgagcagcaccagcagcctggaggccagcttcctgaccccagctgtgggctttgctgaccccccacccaggacagaggagcccctgtctggagtgaaggacagagatgagggcctgggcccccaccacagcagtgacctgccccctgtgtccttctag

SEQ ID NO: 37568 - DNA, 1869 bp, Artificial Sequence
  Description of Artificial Sequence: Synthetic coding sequence
atggacagccacagcggggagcccgccctgctgccctgtggcacctgtgacatggtgttccgcagcagcgccctgctggccacccacacccagcgcttctgcatcggccaccccacccaggagatgaccttcggggcccaggcctctgtggccacagagccccagagagctgctgtggtgccccaggagcaccagggcgtgccccaggagccccagggcctgcctgaccagcaggccagccgcagcgccctgaagaggctgacagaggaggtgcagtggctgcggctgagcctgcaggagatgaggccctggatcacagaggtgccccgggtgtttgctggcccctggaccaggtctgaggcccggccccagagccccatgtctgaggccgtgggcagccccagcgagcggctgcgggccctcttccgcacccgggccaggagagtggccgagatggaggcccagagccgggccctgcagctgcggggggaggagctgagccggcggctgcaggtggtggcctgcacccggggcggcatgagccggctgtttggcctggagcaggagatccgggagctgcaggccgaggccggccgcaccaggggggccctggaggtgctgggcgcccgcatccaggagctgcaggccgagcccggcaaccccctgagcagcagaagagaggccgagctgtacagccctgtgcagaaggccaaccctggcaccctggccgctgagatccgggccctgcgggaggcctacatcagagatggcggccgggaccccggggtgctgggccagatctggcagctgcaggtggaggccagcgccctggagctgcagaggagccagacccggcggggccgggccggggccaccagcggggagctgcctgtggtggaggccgagaacagaaggctggaggccgagatcctggccctgcagatgcagaggggccgggcccccctgggcccccaggacctgcggctgctgggagatgccagcctgcagcccaagggccggcgggacccccccctgctgcccccacctgtggccccacccctgccccccctgcccggcttcagcgagccccagctgcccggcaccatgaccaggaacctgggcctggacagccacttcctgctgcccaccagtgacatgctgggccctgccccctatgaccccggggccggcctggtgatcttctatgacttcctgcggggcctggaggcctcctggatctgggtgcagctgaggacaggcctggccagagatggccgggacaccggccgcaccacagccctgcccccagccctgtgcctgcccccacctccagcccctggccccatgggcaactgtgccatcctggccagccggcagcctgtgccccggctgccccccagcagctctgtgtccctggtgtgtgagctgcaggtgtggcagggcctggcctgggcccgggccccccagcccaaggcctgggtgtccctgggcctgtttgaccaggaccagagggtgctgagcggccgctggaggctgcccctgcgggccctgcccctggaccccagcctgagcctgggccagctgaatggcatcccccaggccggccaggccgagctgttcctgcggctggtgaatgccagagatgctgctgtgcagaccctggccgagatcaacccagcctctgtgcatgagtaccagtacccacctcctgtgagcagcaccagcagcctggaggccagcttcctgaccccagctgtgggctttgctgaccccccacccaggacagaggagcccctgagcggcgtgaaggacagagatgagggcctgggcccccaccacagcagtgacctgccccctgtgtccttctag

SEQ ID NO: 37569 - DNA, 852 bp, Artificial Sequence
  Description of Artificial Sequence: Synthetic coding sequence
atgaagaaggatgaggccctgaaggccctgcagaaccaggtgtctgaggagaccatcaaggtgcggcagctggacagcgccctggagatctgcaaggaggagctggtgctgcacctgaaccagctggagggcaacaaggagaagtttgagaagcagctgaagaagaagtctgaggaggtgtactgcctgcagaaggagctgaagatcaagaaccacagcctgcaggagaccagcgagcagaatgtcatcctgcagcacaccctgcagcagcagcagcagatgctgcagcaggagaccatcagaaatggagagctggaggacacccagaccaagctggagaagcaggtgtccaagctggagcaggagctgcagaagcagcgggagagcagcgctgagaagctgaggaagatggaggagaagtgtgagagcgctgcccacgaggccgacctgaagaggcagaaggtgattgagctgactggaacagcccggcaggtgaagattgagatggaccagtacaaggaggagctgagcaagatggagaaggagatcatgcacctgaagagagatggagagaacaaggccatgcacctgagccagctggacatgatcctggaccagaccaagacagagctggagaagaagaccaatgctgtgaaggagctggagaagctgcagcacagcacagaaacagagctgacagaggccaagaatggcaagtacctgcggaccaccaagtgctcctggaggatcaagaagtacttcaagaccaccccaggcatcgagcgctgcaccacagagggcagcatcatcatccggggcaagatccactactacaagggcagccacagctag

SEQ ID NO: 37570 - DNA, 2412 bp, Artificial Sequence
  Description of Artificial Sequence: Synthetic coding sequence
atggtgattgagaaggagcagagcctgcaggagagcaaggaggagtgcatcaagctgaaggtggacctgctggagcagaccaagcagggcaagagagctgagcggcagagaaatgaggccctgtacaatgctgaggagctgagcaaggccttccagcagtacaagaagaaggtggccgagaagctggagaaggtgcaggccgaggaggagatcctggagaggaacctgaccaactgtgagaaggagaacaagaggctgcaggagcgctgtggcctgtacaagtctgagctggagatcctgaaggagaagctgcggcagctgaaggaggagaacaacaacgggaaggagaagctgcgcatcatggctgtgaagaacagcgaggtgatggcccagctgacagagagccggcagagcatcctgaagctggagagcgagctggagaacaaggatgagatcctgcgggacaagttcagcctgatgaatgaaaatcgggagctgaaggtgcgggtggccgcccagaatgaaaggctggacctgtgccagcaggagattgagagcagccgggtggagctgcggagcctggagaagatcatcagccagctgcccctgaagcgggagctgtttggcttcaagagctacctgagcaagtaccagatgagcagcttcagcaacaaggaggaccgctgcatcggctgctgtgaggccaacaagctggtgatcagcgagctgcgcatcaagctggccatcaaggaggccgagatccagaagctgcacgccaacctgacagccaaccagctgagccagagcctcatcacctgcaatgacagccaggagagcagcaagctgagcagcctggagacagagcctgtgaagctgggcggccaccaggtggccgagagcgtgaaggaccagaaccagcacaccatgaacaagcagtatgagaaggagcggcagaggctggtgacaggcatcgaggagctgcggaccaagctgatccagatcgaggctgaaaattctgacctgaaggtgaacatggcccacaggaccagccagttccagctgatccaggaggagctgctggagaaggccagcaacagcagcaagctggagagcgagatgaccaagaagtgcagccagctgctgaccctggagaagcagctggaggagaagatcgtggcctacagcagcattgctgccaagaatgctgagctggagcaggagctgatgctggaggcccagctggagaagaaggaccagcagttcaaggagcaggagaagaccatgtccatgctgcagcaggacatcatctgcaagcagcaccacctggagagcctggaccggctgctgacagagagcaaaggagagatgaagaaggagaacatgaagaaggatgaggccctgaaggccctgcagaaccaggtgtctgaggagaccatcaaggtgcggcagctggacagcgccctggagatctgcaaggaggagctggtgctgcacctgaaccagctggagggcaacaaggagaagtttgagaagcagctgaagaagaagtctgaggaggtgtactgcctgcagaaggagctgaagatcaagaaccacagcctgcaggagaccagcgagcagaatgtcatcctgcagcacaccctgcagcagcagcagcagatgctgcagcaggagaccatcagaaatggagagctggaggacacccagaccaagctggagaagcaggtgtccaagctggagcaggagctgcagaagcagcgggagagcagcgctgagaagctgaggaagatggaggagaagtgtgagagcgctgcccacgaggccgacctgaagaggcagaaggtgattgagctgactggaacagcccggcaggtgaagattgagatggaccagtacaaggaggagctgagcaagatggagaaggagatcatgcacctgaagagagatggagagaacaaggccatgcacctgagccagctggacatgatcctggaccagaccaagacagagctggagaagaagaccaatgctgtgaaggagctggagaagctgcagcacagcacagaaacagagctgacagaggccctgcagaagcgggaggtgctggagacagagctgcagaatgcccacggggagctgaagagcaccctgcggcagctgcaggagctgagagatgtgctgcagaaggcccagctgagcctggaggagaagtacaccaccatcaaggacctgacagctgagctgcgggagtgcaagatggagattgaggacaagaagcaggagctgctggagatggaccaggccctgaaggagaggaactgggagctgaagcagagagctgcccaggtgacccacctggacatgaccatccgggagcacagaggagagatggagcagaagatcatcaagtag

SEQ ID NO: 37571 - DNA, 3900 bp, Artificial Sequence
  Description of Artificial Sequence: Synthetic coding sequence
atggagagcagcagcagtgactactacaacaaggacaatgaggaggagagcctgctggccaacgtggccagcctgcggcatgagctgaagatcacagagtggagcctgcagagcctgggggaggagctgagctctgtgagccccagcgagaacagcgactatgcccccaaccccagccgctctgagaagctgatcctggatgtgcagcccagccaccctggcctgctgaactacagcccctatgaaaatgtgtgcaagatcagcggcagcagcacagacttccagaagaagccccgggacaagatgttcagcagcagcgcccctgtggaccaggagatcaagagcctgcgggagaagctgaacaagctgcggcagcagaatgcctgcctggtgacccagaaccacagcctgatgaccaagtttgagagcatccactttgagctgacccagagccgggccaaggtgtccatgctggagagcgcccagcagcaggccgcctctgtgcccatcctggaggagcagatcatcaacctggaggccgaggtgtctgcccaggacaaggtgctgcgggaggccgagaacaagctggagcagagccagaagatggtgattgagaaggagcagagcctgcaggagagcaaggaggagtgcatcaagctgaaggtggacctgctggagcagaccaagcagggcaagagagctgagcggcagagaaatgaggccctgtacaatgctgaggagctgagcaaggccttccagcagtacaagaagaaggtggccgagaagctggagaaggtgcaggccgaggaggagatcctggagaggaacctgaccaactgtgagaaggagaacaagaggctgcaggagcgctgtggcctgtacaagtctgagctggagatcctgaaggagaagctgcggcagctgaaggaggagaacaacaacgggaaggagaagctgcgcatcatggctgtgaagaacagcgaggtgatggcccagctgacagagagccggcagagcatcctgaagctggagagcgagctggagaacaaggatgagatcctgcgggacaagttcagcctgatgaatgaaaatcgggagctgaaggtgcgggtggccgcccagaatgaaaggctggacctgtgccagcaggagattgagagcagccgggtggagctgcggagcctggagaagatcatcagccagctgcccctgaagcgggagctgtttggcttcaagagctacctgagcaagtaccagatgagcagcttcagcaacaaggaggaccgctgcatcggctgctgtgaggccaacaagctggtgatcagcgagctgcgcatcaagctggccatcaaggaggccgagatccagaagctgcacgccaacctgacagccaaccagctgagccagagcctcatcacctgcaatgacagccaggagagcagcaagctgagcagcctggagacagagcctgtgaagctgggcggccaccaggtggccgagagcgtgaaggaccagaaccagcacaccatgaacaagcagtatgagaaggagcggcagaggctggtgactggaattgaggagctgcggaccaagctgatccagattgaagctgagaacagcgacctgaaggtgaacatggcccacaggaccagccagttccagctgatccaggaggagctgctggagaaggccagcaacagcagcaagctggagagcgagatgaccaagaagtgcagccagctgctgaccctggagaagcagctggaggagaagatcgtggcctacagcagcattgctgccaagaatgctgagctggagcaggagctgatggagaagaatgagaagatccgcagcctggagaccaacatcaacacagaacatgagaagatctgcctggcctttgagaaggccaagaagatccacctggagcagcacaaggagatggagaagcagatcgagcggctggaggcccagctggagaagaaggaccagcagttcaaggagcaggagaagaccatgtccatgctgcagcaggacatcatctgcaagcagcaccacctggagagcctggaccggctgctgacagagagcaagggggagatgaagaaggagaacatgaagaaggatgaggccctgaaggccctgcagaaccaggtgtctgaggagaccatcaaggtgcggcagctggacagcgccctggagatctgcaaggaggagctggtgctgcacctgaaccagctggagggcaacaaggagaagtttgagaagcagctgaagaagaagtctgaggaggtgtactgcctgcagaaggagctgaagatcaagaaccacagcctgcaggagaccagcgagcagaatgtcatcctgcagcacaccctgcagcagcagcagcagatgctgcagcaggagaccatcagaaatggagagctggaggacacccagaccaagctggagaagcaggtgtccaagctggagcaggagctgcagaagcagcgggagagcagcgctgagaagctgaggaagatggaggagaagtgtgagagcgctgcccatgaagctgacctgaagaggcagaaggtgattgagctgaccggcacagcccggcaggtgaagattgagatggaccagtacaaggaggagctgagcaagatggagaaggagatcatgcacctgaagagagatggagagaacaaggccatgcacctgagccagctggacatgatcctggaccagaccaagacagagctggagaagaagaccaatgctgtgaaggagctggagaagctgcagcacagcacagaaacagagctgacagaggccctgcagaagcgggaggtgctggagacagagctgcagaatgcccatggagagctgaagagcaccctgcggcagctgcaggagctgagagatgtgctgcagaaggcccagctgagcctggaggagaagtacaccaccatcaaggacctgacagctgagctgcgggagtgcaagatggagattgaggacaagaagcaggagctgctggagatggaccaggccctgaaggagaggaactgggagctgaagcagagagctgcccaggtgacccacctggacatgaccatccgggagcacagaggagagatggagcagaagatcatcaagctggagggcaccctggagaagtctgagctggagctgaaggagtgcaacaagcagatcgagagcctgaatgacaagctgcagaatgccaaggagcagctgcgggagaaggagttcatcatgctgcagaatgagcaggagatcagccagctgaagaaggagattgaaagaacccagcagaggatgaaggagatggagagcgtgatgaaggagcaggagcagtacatcgccacccagtacaaggaggccatcgacctgggccaggagctgcggctgacccgggagcaggtgcagaacagccacacagagctggccgaggcccggcaccagcaggtgcaggcccagcgggagattgagcggctgagcagcgagctggaggacatgaagcagctgagcaaggagaaggatgcccacggcaaccacctggccgaggagctgggcgccagcaaggtgcgggaggcccacctggaggccaggatgcaggccgagatcaagaagctgtctgctgaggtggagagcctgaaggaggcctaccacatggagatgatcagccaccaggagaaccacgccaagtggaagatctctgctgacagccagaagagctctgtgcagcagctgaatgagcagctggagaaggccaagctggagctggaggaggcccaggacacagtgagcaacctgcaccagcaggtgcaggacagaaatgaggtgattgaagctgccaatgaggccctgctgaccaagggagaaaatgtgtag

SEQ ID NO: 37572 - DNA, 4254 bp, Artificial Sequence
  Description of Artificial Sequence: Synthetic coding sequence
atggccagccccaccaacggccaccacggcggcaactgtgggaagtgcagccctggccgggcccccctggtgggcagcggggccctggccgaccatgacccccggcaggccccccggctgcggcggcggctgacccagagcgcccctggccggggcagtgacagagtgggcgccagccagaggctgcccaggagatttgagttctgtgccgccggcgtgcgctggttcagcgagctgtgcccccggctgccccgggccggggcccgggagcgggtgcggggcttcctgacccagaccagggtgcgcagcgcccagagccctgggggcagcctgcccagtgatgacctgggggagatggagagcagcagcagtgactactacaacaaggacaatgaggaggagagcctgctggccaacgtggccagcctgcggcatgagctgaagatcacagagtggagcctgcagagcctgggggaggagctgagctctgtgagccccagcgagaacagcgactatgcccccaaccccagccgctctgagaagctgatcctggatgtgcagcccagccaccctggcctgctgaactacagcccctatgaaaatgtgtgcaagatcagcggcagcagcacagacttccagaagaagccccgggacaagatgttcagcagcagcgcccctgtggaccaggagatcaagagcctgcgggagaagctgaacaagctgcggcagcagaatgcctgcctggtgacccagaaccacagcctgatgaccaagtttgagagcatccactttgagctgacccagagccgggccaaggtgtccatgctggagagcgcccagcagcaggccgcctctgtgcccatcctggaggagcagatcatcaacctggaggccgaggtgtctgcccaggacaaggtgctgcgggaggccgagaacaagctggagcagagccagaagatggtgattgagaaggagcagagcctgcaggagagcaaggaggagtgcatcaagctgaaggtggacctgctggagcagaccaagcagggcaagagagctgagcggcagagaaatgaggccctgtacaatgctgaggagctgagcaaggccttccagcagtacaagaagaaggtggccgagaagctggagaaggtgcaggccgaggaggagatcctggagaggaacctgaccaactgtgagaaggagaacaagaggctgcaggagcgctgtggcctgtacaagtctgagctggagatcctgaaggagaagctgcggcagctgaaggaggagaacaacaacgggaaggagaagctgcgcatcatggctgtgaagaacagcgaggtgatggcccagctgacagagagccggcagagcatcctgaagctggagagcgagctggagaacaaggatgagatcctgcgggacaagttcagcctgatgaatgaaaatcgggagctgaaggtgcgggtggccgcccagaatgaaaggctggacctgtgccagcaggagattgagagcagccgggtggagctgcggagcctggagaagatcatcagccagctgcccctgaagcgggagctgtttggcttcaagagctacctgagcaagtaccagatgagcagcttcagcaacaaggaggaccgctgcatcggctgctgtgaggccaacaagctggtgatcagcgagctgcgcatcaagctggccatcaaggaggccgagatccagaagctgcacgccaacctgacagccaaccagctgagccagagcctcatcacctgcaatgacagccaggagagcagcaagctgagcagcctggagacagagcctgtgaagctgggcggccaccaggtggccgagagcgtgaaggaccagaaccagcacaccatgaacaagcagtatgagaaggagcggcagaggctggtgactggaattgaggagctgcggaccaagctgatccagattgaagctgagaacagcgacctgaaggtgaacatggcccacaggaccagccagttccagctgatccaggaggagctgctggagaaggccagcaacagcagcaagctggagagcgagatgaccaagaagtgcagccagctgctgaccctggagaagcagctggaggagaagatcgtggcctacagcagcattgctgccaagaatgctgagctggagcaggagctgatggagaagaatgagaagatccgcagcctggagaccaacatcaacacagaacatgagaagatctgcctggcctttgagaaggccaagaagatccacctggagcagcacaaggagatggagaagcagatcgagcggctggaggcccagctggagaagaaggaccagcagttcaaggagcaggagaagaccatgtccatgctgcagcaggacatcatctgcaagcagcaccacctggagagcctggaccggctgctgacagagagcaagggggagatgaagaaggagaacatgaagaaggatgaggccctgaaggccctgcagaaccaggtgtctgaggagaccatcaaggtgcggcagctggacagcgccctggagatctgcaaggaggagctggtgctgcacctgaaccagctggagggcaacaaggagaagtttgagaagcagctgaagaagaagtctgaggaggtgtactgcctgcagaaggagctgaagatcaagaaccacagcctgcaggagaccagcgagcagaatgtcatcctgcagcacaccctgcagcagcagcagcagatgctgcagcaggagaccatcagaaatggagagctggaggacacccagaccaagctggagaagcaggtgtccaagctggagcaggagctgcagaagcagcgggagagcagcgctgagaagctgaggaagatggaggagaagtgtgagagcgctgcccatgaagctgacctgaagaggcagaaggtgattgagctgaccggcacagcccggcaggtgaagattgagatggaccagtacaaggaggagctgagcaagatggagaaggagatcatgcacctgaagagagatggagagaacaaggccatgcacctgagccagctggacatgatcctggaccagaccaagacagagctggagaagaagaccaatgctgtgaaggagctggagaagctgcagcacagcacagaaacagagctgacagaggccctgcagaagcgggaggtgctggagacagagctgcagaatgcccatggagagctgaagagcaccctgcggcagctgcaggagctgagagatgtgctgcagaaggcccagctgagcctggaggagaagtacaccaccatcaaggacctgacagctgagctgcgggagtgcaagatggagattgaggacaagaagcaggagctgctggagatggaccaggccctgaaggagaggaactgggagctgaagcagagagctgcccaggtgacccacctggacatgaccatccgggagcacagaggagagatggagcagaagatcatcaagctggagggcaccctggagaagtctgagctggagctgaaggagtgcaacaagcagatcgagagcctgaatgacaagctgcagaatgccaaggagcagctgcgggagaaggagttcatcatgctgcagaatgagcaggagatcagccagctgaagaaggagattgaaagaacccagcagaggatgaaggagatggagagcgtgatgaaggagcaggagcagtacatcgccacccagtacaaggaggccatcgacctgggccaggagctgcggctgacccgggagcaggtgcagaacagccacacagagctggccgaggcccggcaccagcaggtgcaggcccagcgggagattgagcggctgagcagcgagctggaggacatgaagcagctgagcaaggagaaggatgcccacggcaaccacctggccgaggagctgggcgccagcaaggtgcgggaggcccacctggaggccaggatgcaggccgagatcaagaagctgtctgctgaggtggagagcctgaaggaggcctaccacatggagatgatcagccaccaggagaaccacgccaagtggaagatctctgctgacagccagaagagctctgtgcagcagctgaatgagcagctggagaaggccaagctggagctggaggaggcccaggacacagtgagcaacctgcaccagcaggtgcaggacagaaatgaggtgattgaagctgccaatgaggccctgctgaccaagggagaaaatgtgtag

SEQ ID NO: 37573 - DNA, 201 bp, Artificial Sequence
  Description of Artificial Sequence: Synthetic coding sequence
atggaccccccagccaggaaggagaagaccaaggtgaaggagagcgtgtcccgggtggagaaggccaagcagaagagcgcccagcaggagctgaagcagaggcagagagctgagatctatgccctgaacagagtgatgacagagctggagcagcagcagtttgatgagttctgcaagcagatgcagcccccaggagagtag

SEQ ID NO: 37574 - DNA, 201 bp, Artificial Sequence; identical to SEQ ID NO: 37573
  Description of Artificial Sequence: Synthetic coding sequence

SEQ ID NO: 37575 - DNA, 201 bp, Artificial Sequence; identical to SEQ ID NO: 37573
  Description of Artificial Sequence: Synthetic coding sequence

SEQ ID NO: 37576 - DNA, 924 bp, Artificial Sequence
  Description of Artificial Sequence: Synthetic coding sequence
atgctgcggcacagccccagcctgtgggagctggtggaggagcacgtgcccctgcgggagcggcgggaggtgaagaggatcctgggggaggccgctgtggacctgagcctggagctgcgggcagaggtggccatgctgcgggccctgctgcaggaggcccggagcagccaggcccccagcagccggcccatcagtgaccccagcagcctgctggcccccccacccctgctgaaggacctgctgcggcaggagctgcggcagctgctgcagggcctgcggcacaaggccatctgtgagggccgggaccaggcccaggcctgggtgcagtacagcccccgggtgctgcactttgccctggaggagccccgctgtgacctgcctgagcaggagatcttccagatgaggggcggcggccccagcagcggccaccgggacctgagcatcatcaaggaccagctgaatgtgagcaacatcgaccaggtggcccggcacctgcggggcctgctggaggaggagtgccacaccctggagcgggagatcctgatcctgcagcgctgcctggaggaggagtacctgcggccctgccaccccagcgaggccgccctggagcccaccctggccgagctgaaggagcagaagaaggccatggagcaggagctgcaggcctctgtgggccccagctgtgtgagccccaaccaccggcagaggcccctgggcagcagcacccagggcctgcggccccccctgcccctgtgtggggtggcccccctgcagtgctgcctgcctgccccacccctggagccctacctgcggccccggggccagagcgccacccaccgctggggccggcagctgcagtgcagcccccgggagggccctgccagcacccccatgagcagcgctgccccccaggccccagcctag

SEQ ID NO: 37577 - DNA, 627 bp, Artificial Sequence
  Description of Artificial Sequence: Synthetic coding sequence
atggtgttctacttcaccagcagctctgtgaacagcagcgcctacaccatctacatgggcaaggacaagtatgaaaatgaagatctcatcaagcacggctggccagaggacatctggttccacgtggacaagctgagcagcgcccacgtgtacctgcggctgcacaagggggagaacatcgaggacatccccaaggaggtgctgatggactgtgcccacctggtgaaggccaacagcatccagggctgcaagatgaacaacgtgaatgtggtgtacaccccctggagcaacctgaagaagacagctgacatggatgtgggccagatcggcttccaccggcagaaggatgtgaagatcgtgacagtggagaagaaggtgaatgagatcctgaaccggctggagaagaccaaggtggagcgcttcccagacctggccgctgagaaggaatgtcgggaccgggaggagagaaatgagaagaaggcccagatccaggagatgaagaagcgggagaaggaggagatgaagaagaagcgggagatggatgagctgcggagctacagcagcctgatgaaggtggagaacatgagcagcaaccaggatggaaatgacagtgatgagttcatgtag

SEQ ID NO: 37578 - DNA, 423 bp, Artificial Sequence
  Description of Artificial Sequence: Synthetic coding sequence
atggactgtgcccacctggtgaaggccaacagcatccagggctgcaagatgaacaacgtgaatgtggtgtacaccccctggagcaacctgaagaagacagctgacatggatgtgggccagatcggcttccaccggcagaaggatgtgaagatcgtgacagtggagaagaaggtgaatgagatcctgaaccggctggagaagaccaaggtggagcgcttcccagacctggccgctgagaaggaatgtcgggaccgggaggagagaaatgagaagaaggcccagatccaggagatgaagaagcgggagaaggaggagatgaagaagaagcgggagatggatgagctgcggagctacagcagcctgatgaaggtggagaacatgagcagcaaccaggatggaaatgacagtgatgagttcatgtag

SEQ ID NO: 37579 - DNA, 1971 bp, Artificial Sequence
  Description of Artificial Sequence: Synthetic coding sequence
atgtttgaggccatcttccccagcaccccccaggcccggctgaagagggacccccgggagaagccaggcctgagcagcttccgcagcaccttccggcagcagagcagcctgggcctgtgcatcccccggctgatgctgcccaaggaggccagccccagccagaggcacagctccatgagcagctccatggcccgggccctggtgctgctgcagagcatggccagcagagatgcccgctgcccagagtggaagccccaccagaagcccaggaccctgagcaagtctgtgcagaccatcagccgctactacaggaagaccagcgagcccaaggatgctgccagcctgaccggcttcatgagcaagatggagctgcggcgggtcttccccacccacccagactgcccccagttcagcacccgggccacctccatgagccactgcggcagccccacagaagctgacctgagcggggagattgacaacagcagcgagacctggaggggcacccaggacctcttcctggcccggcggggcagtgacaccaacgtggatggctacctgctgcccttcagcaagagcatctgtgaatttgactacctgaggaagaggaggaagagccagaccctgagccctgtgaccagcagctctgtggccagccagagctgcctgaggaagaggatgccctggtacctgagcgtcatccacgagaaggaccactgcctgtctgagctggagatccaggtgcagaagaaggatgaggagatcctgctgctgcaggaggagcgggaggccctgaagatgcagctgaagtgcctgctgaagggcaagggccaggagacctccatgagccctggccggcgggagcagctgagtgatgccagcctgaagctgggccgcctgagcctgctgaaggccttcagcagacatgaggaggagctgcagcactggtggcagatgcaggaggagagcgctgcccctgagcggggcaaggagccagacctgggcggcggggaggaggatgagggcctggagggggagccagatggagtggaggacacaggagcctggggcggcgtgtcccagatgggctctgtgcatgaggagggcagcgaggaggaggaggaggaggagggggacagagatgaggacagcgaggagcgggagctgcctgaggaggaggagatcccccggcggcgggccagcagcctggccgagagctttgaggaggagctgctggcccagctggaggagtatgagcaggtgatcctggacttccagttcaacctggaggccaccaggacccgctacagcctggccaccggggtgattgccagcctgcagcagcaggtggacttccaggagacccagctgaggaagatcaacacagaaaatgagaccctgcagaaggagctgcgggagcggcggcagcagctgcaggccatgacagacaagttcagcaacctgcgggaggacaagaagcaccaggagatgatgggcctgattgagaaggacaaccagctgctgcggcagcaggtgtctgagctggagaggaagctgaccaagagggactgtgtgatcagcgagctggacaccaaggtgtcccagctgcaggagcaggtggagctggaccagaaccacctgcagcgctggaagcagctgcaggaggacctgcagagcaagaaggagatgatccagcaggccgagcagcacaccagggtggccctggagagcagccagagccggctggagcggctgaggaacaagatcatccaggccaccttcagcatcagcggcaccaagagcctggccaatgagatcagtgacaatgacatcctggaggccctgcagaggatcatcagcgagaggagtgactactacaaccagctgaagcagaagggcgtgaaggtgccccccctgcagcagagcgaggccttcctgaccagcaagagcaagaagggcaccagcaagtag

SEQ ID NO: 37580 - DNA, 486 bp, Artificial Sequence
  Description of Artificial Sequence: Synthetic coding sequence
atgcccaagaatgccatccctgtgtccaagagcacaggcttcagcaacccagccagccagagcaccagccagaggcccaagctgaagagggtgatgaaggagaagaccaagccccagggcggggagggcaagggggcccagagcacccccatccagcacagcttcctgacagatgtgtctgatgtgcaggagatggagcggggcctgctgagcctgctgaatgacttccacagcggcaagctgcaggcctttggaaatgaatgttccattgagcagatggagcacgtgcggggcatgcaggagaagctggcccggctgaacctggagctgtatggagagctggaggagctgcctgaggacaagaggaagacagccagtgacagcaacctggaccggctgctgagtgacctggaggagctgaacagcagcatccagaagctgcacctggctgatgcccaggatgtgcccaacaccagcgccagctag

SEQ ID NO: 37581 - DNA, 825 bp, Artificial Sequence
  Description of Artificial Sequence: Synthetic coding sequence
atgcccagggctgagccccgggccaccctgggggagcaggagaaggccggcctgcccctgggcgcctggaggctgtacctgctgcggcacttcaggaagcagacagagctgcggcgcagcggcagcagagatgtgactggagccctgctggtggccgctgctgtggccagcgaggccgtgggcagcctgcgggtggccgagggcggccccaacaccctgctgctgcaggtgctgcgctcctggccctggtgcaacaaggagctgaagaccatggaggagaggaaggtgaagaggaggagccccaagagcttcagcgcccactgcacccaggtggtgaatgccaagaagaatgccatccctgtgtccaagagcacaggcttcagcaacccagccagccagagcaccagccagaggcccaagctgaagagggtgatgaaggagaagaccaagccccagggcggggagggcaaaggagcccagagcacccccatccagcacagcttcctgacagatgtgtctgatgtgcaggagatggagcggggcctgctgagcctgctgaatgacttccacagcggcaagctgcaggcctttggaaatgaatgttccattgagcagatggagcacgtgcggggcatgcaggagaagctggcccggctgaacctggagctgtatggagagctggaggagctgcctgaggacaagaggaagacagccagtgacagcaacctggaccggctgctgagtgacctggaggagctgaacagcagcatccagaagctgcacctggctgatgcccaggatgtgcccaacaccagcgccagctag

SEQ ID NO: 37582 - DNA, 2352 bp, Artificial Sequence
  Description of Artificial Sequence: Synthetic coding sequence
atgagccaggagaagaatgagatgtttgaaagtgagtggagcaaggagcgggagcgggagaagcagctggccagcggcctggacacagctgagaaggccctgaaggtggagagcgaggagctgcagaagagcaagtctgagctgatctgcctgtacaatgaggtgcacaacctgcctggagagagcgagagcaaggaccacttcctgattgcctgtgacctgctgcagcgggagaacagcgagctggagaccaaggtgctgaagctgagccaggagtttgcccagctgaaccacttcaccctgggcggcaagacagcccccagcaacctgatcaccagcgagaacacctgcaaggaccctgagagcaatgagcccatcctggagacagagatccagagcaggaaggaggagacagaggagctgtgccccaagctgggggagaggaagcagaaggagatccctgaggagagcgtgaaggagggcagcttcccccgggagggccagaaggaggagggcagccagcagaacagagacatgaaggatgaggagaaggagcagcagctgaccatgaagccagaggagatcgtgcggctgcgggaggagctgagccacatcaaccagagcctgctgcagagccagagcagcggggacagcagtgatgacagcggggcccagcaccccagcagtggagagaagctgaagtacaaccagcagggcgaggtgcagcagctgcaccagaacctgcaccggctgcagatcctgtgcaacagcgcagaaaatgagctgcgctatgaaagaggccagaacctggacctgaagcagcacaacagcctgctgcaggaggagaacatcaagatcaagattgagctgaagcacgcccagcagaagctgctggacagcaccaagatgtgcagcagcctgacagctgagtacaagcactgccagcagaagatcaaggagctggagctggaggtgctgaagcacacccagagcatcaagagccagaacaacctgcaggagaagctggtgcaggagaagagcaaggtggctgatgctgaggagaagatcctggacctgcagaggaagctggagcacgcccacaaggtgtgcctgacagacacctgcatcagcgagaagcagcagctggaggagaagatcaaggaggccacccagaatgaggccaaggtgaagcagcagtaccaggaggagcagcagaagaggaagctgctgtaccagaatgtggatgagctgcaccggcaggtgaggaccctgcaggacaaggagaacctgctggagatgacctgcagccagcagcagagccgcatccagcagcaggaggccctgctgaagcagctggagaatgagaagaggaaatatgatgagcacgtgaagagcaaccaggagctgtctgagaagctgagcaagctgcagcaggagaaggaggccctgcgggaggagtacctgcggctgctgaagctgctgaatgtgcacgtgaggaactacaatgagaagcaccaccagcagaaggtgaagctgcagaaggtgaagtaccgcctgaccaatgaggtggagctgcgggacaagaggatcaaccagtttgaagatgaaattggcatcctgcagcacaagattgagaaggagaaggccatccaggaccagatcacagcccagaatgacaccctgctgctggagaagaggaagctgcaggagcaggtgattgagcaggagcagctgatccacagcaacaagtggaccatcagcagcatccagagccgggtgctgtacatggacaaggagaacaagcagctgcaggagaacagcctgcggctgacccagcagatcggcttcctggagcgcatcatccgcagcatccacatcagaagaggagagaacctgaaggagttccctgtgcccaagtggtggcaccggggcaagctggccagcctgccccccaccaagaagcagaaggagatctacagcacagaggtgttcaccagcaacaatgctgagctgcagcatgaagatgaatctgtgcctgaggccacagagaagtggaagcacagcgagcagatggagaccaccatcagtgacatcctggagagcgaggtggtgaatgagatcctgcccctgagcaacagcagcttcagcggcaagggcctggtggagagctttgccagcctgcaggagacagaggagatcaagagcaaggaggccatggccagcagcaagagccctgagaagagccctgagaacctggtgtgcagccagaacagcgaggccggctacatcaacgtggccagcctgaaggagacccacggcatccaggagcaggaccagaagtctgagctgtag

SEQ ID NO: 37583 - DNA, 2352 bp, Artificial Sequence; identical to SEQ ID NO: 37582
  Description of Artificial Sequence: Synthetic coding sequence

SEQ ID NO: 37584 - DNA, 1719 bp, Artificial Sequence
  Description of Artificial Sequence: Synthetic coding sequence
atgatccacccccccaggcctcccaaggtgctgggcctgcagcaccccagcagcggggagaagctgaagtacaaccagcagggcgaggtgcagcagctgcaccagaacctgcaccggctgcagatcctgtgcaacagcgcagaaaatgagctgcgctatgagcggggccagaacctggacctgaagcagcacaacagcctgctgcaggaggagaacatcaagatcaagattgagctgaagcacgcccagcagaagctgctggacagcaccaagatgtgcagcagcctgacagctgagtacaagcactgccagcagaagatcaaggagctggagctggaggtgctgaagcacacccagagcatcaagagccagaacaacctgcaggagaagctggtgcaggagaagagcaaggtggctgatgctgaggagaagatcctggacctgcagaggaagctggagcacgcccacaaggtgtgcctgacagacacctgcatcagcgagaagcagcagctggaggagaagatcaaggaggccacccagaatgaggccaaggtgaagcagcagtaccaggaggagcagcagaagaggaagctgctgtaccagaatgtggatgagctgcaccggcaggtgaggaccctgcaggacaaggagaacctgctggagatgacctgcagccagcagcagagccgcatccagcagcaggaggccctgctgaagcagctggagaatgagaagaggaaatatgatgaacatgtgaagagcaaccaggagctgtctgagaagctgagcaagctgcagcaggagaaggaggccctgcgggaggagtacctgcggctgctgaagctgctgaatgtgcacgtgaggaactacaatgagaagcaccaccagcagaaggtgaagctgcagaaggtgaagtaccgcctgaccaatgaggtggagctgcgggacaagaggatcaaccagtttgaagatgagatcggcatcctgcagcacaagattgagaaggagaaggccatccaggaccagatcacagcccagaatgacaccctgctgctggagaagaggaagctgcaggagcaggtgattgagcaggagcagctgatccacagcaacaagtggaccatcagcagcatccagagccgggtgctgtacatggacaaggagaacaagcagctgcaggagaacagcctgcggctgacccagcagatcggcttcctggagcgcatcatccgcagcatccacatcagaagaggagagaacctgaaggagttccctgtgcccaagtggtggcaccggggcaagctggccagcctgccccccaccaagaagcagaaggagatctacagcacagaggtgttcaccagcaacaatgctgagctgcagcatgaagatgagagcgtgcctgaggccacagagaagtggaagcacagcgagcagatggagaccaccatcagtgacatcctggagagcgaggtggtgaatgagatcctgcccctgagcaacagcagcttcagcggcaagggcctggtggagagctttgccagcctgcaggagacagaggagatcaagagcaaggaggccatggccagcagcaagagccctgagaagagccctgagaacctggtgtgcagccagaacagcgaggccggctacatcaacgtggccagcctgaaggagacccacggcatccaggagcaggaccagaagtctgagctgtag

SEQ ID NO: 37585 - DNA, 2352 bp, Artificial Sequence; identical to SEQ ID NO: 37582
  Description of Artificial Sequence: Synthetic coding sequence

SEQ ID NO: 37586 - DNA, 120 bp, Artificial Sequence
  Description of Artificial Sequence: Synthetic coding sequence
atgagccaggagaagaatgagatgtttgaaagtgagtggagcaaggagcgggagcgggagaagcagctggccagcggcctggacacagctgagaaggccctgaaggtggagagcgagtag

SEQ ID NO: 37587 - DNA, 1104 bp, Artificial Sequence
  Description of Artificial Sequence: Synthetic coding sequence
atgggagagcccggcccccccagccccccagcccccaaggccgcccctggcctgattgacagcttcagcgagatgaacaactacagaagagccatgcagaagatggccgaggacatcctgagcctgcggcggcaggccagcatcctggagggggagaaccgcatcctgcggagccggctggcccagcaggaggaggaggagggccagggcaaggccagcgaggcccagaacacagtgtccatgaagcagaagctgctgctgtctgagctggacatgaagaagctgcgggacagagtgcagcacctgcagaatgagctgatcaggaagaatgaccgggagaaggagctgctgctgctgtaccaggcccagcagccccaggccgccctgctgaagcagtaccagggcaagctgcagaagatgaaggccctggaggagaccgtgcgccaccaggagaaggtgattgagaagatggagcgggtgctggaggaccggctgcaggacaggagcaagcccccacccctgaaccggcagcagggcaagccctacacaggcttccccatgctgagcgccagcggcctgcccctgggctccatgggagagaacctgcctgtggagctgtacagcgtgctgctggctgaaaatgccaagctgaggacagagctggacaagaacagacaccagcaggcccccatcatcctgcagcagcaggccctgcctgtggaccccggggagctgggcgccggcggggacctgacagagcggctgcaggagacccacggccctggccacagtgaatgtacagagaccctgcctgcccaggacctgctgagcggcaccagtgacaagttcaacctgctggccaagctggagcacgcccagagccgcatcctgagcctggagagccagctggaggacagcgcccggcgctggggccgggagaagcaggacctggccacccggctgcaggagcaggagaagggcttccgccaccccagcaacagcatcatcatcgagcagcctgtgtctgaccccccaggagtggccccccggggcagcggcggcggggccggcagccacaggacccccaaggtgacaggcccctag

SEQ ID NO: 37588 - DNA, 3072 bp, Artificial Sequence
  Description of Artificial Sequence: Synthetic coding sequence
atggccttccggggccctgagccctgggtgtctgccagcctgctgcggcagaggctgaaggccgaggagaagaccctggacctggagtttgaggtgctgtctgtgggcttcaatgaggccggccgctatgccctgcggctgtctgctgagaaccccctgcaggtgggcagcggggccggcgtgcagctgcaggtgaatgatggagaccccttccctgcctgcagcgccatcacagatgtgattgagcagcaggagcccggccagagcctgaccctgaccaggagcaagttcatcttcaccctgcccaagggcttctgcaagaatgatggccagcatgatgcccagctgcacgtggaggccctgcggctggatgagcccctgggccgggccgcccagagggtgggggaggccatcttccccatctaccccaggccagaccagcccaggatgaaccccaaggcccaggaccacgaggacctgtaccgctactgcggcaacctggccctgctgcgggccagcacagaccccacagcccggcactgcggcagcctggcctacagcgtggccttccacgtgcaccggggcccccagccccctgtgtctgacagcccccccagggctggccagcctgagctgatcagccctgaggagcccctcatcgccagccagagcacagagcctgagatcggccacctgagccccagcaagaaggagaccatcatggtgaccctgcatggagccaccaacctgcctgcctgcaaggatggcagcgagccctggccctacgtggtggtgaagagcaccagcgaggagaagaacaaccagagcagcaaggctgtgacctctgtgaccagcgagcccacccgggcccccatctggggagacacagtgaatgtggagatccaggccgaggatgctggccaggaggatgtgatcctgaaggtggtggacaacaggaagaagcaggagctgctgagctacaagatccccatcaagtacctgcgggtcttccacccctaccactttgagctggtgaagcccacagagagcggcaaggcagatgaggccacagccaagacccagctgtatgccaccgtggtgaggaagagcagcttcatcccccgctacatcggctgcaaccacatggccctggagatcttcctgcggggcgtgaatgagcccctggccaacaaccccaaccccatcgtggtgattgcccgggtggtgcccaactacaaggagttcaaggtgtcccaggccaacagagacctggcctctgtgggcctgcccatcacccccctgtccttccccatccccagcatgatgaactttgatgtgccccgggtgtcccagaatggctgcccccagctgagcaagccaggcggccccccagagcagcccctgtggaaccagagcttcctgttccagggcagagatggagccaccagcttcagcgaggacacagccctggtgctggagtactacagcagcacctccatgaagggcagccagccctggaccctgaaccagcccctgggcatctctgtgctgcccctgaagagccggctgtaccagaagatgctgaccgggaagggcctggatggcctgcacgtggagcggctgcccatcatggacaccagcctgaagaccatcaatgatgaggcccccaccgtggccctgtccttccagctgctgagcagcgagaggcctgagaacttcctgacccccaacaacagcaaggccctgcccaccctggaccccaagatcctggacaagaagctgcggaccatccaggagagctggagcaaggacacagtgagcagcaccatggacctgagcaccagcaccccccgggaggccgaggaggagcccctggtgcctgagatgagccatgacacagagatgaacaactacagaagagccatgcagaagatggccgaggacatcctgagcctgcggcggcaggccagcatcctggagggggagaaccgcatcctgcggagccggctggcccagcaggaggaggaggagggccagggcaaggccagcgaggcccagaacacagtgtccatgaagcagaagctgctgctgtctgagctggacatgaagaagctgcgggacagagtgcagcacctgcagaatgagctgatcaggaagaatgaccgggagaaggagctgctgctgctgtaccaggcccagcagccccaggccgccctgctgaagcagtaccagggcaagctgcagaagatgaaggccctggaggagaccgtgcgccaccaggagaaggtgattgagaagatggagcgggtgctggaggaccggctgcaggacaggagcaagcccccacccctgaaccggcagcagggcaagccctacacaggcttccccatgctgagcgccagcggcctgcccctgggctccatgggagagaacctgcctgtggagctgtacagcgtgctgctggctgaaaatgccaagctgaggacagagctggacaagaacagacaccagcaggcccccatcatcctgcagcagcaggccctgcctgtggaccccggggagctgggcgccggcggggacctgacagagcggctgcaggagacccacggccctggccacagtgaatgtacagagaccctgcctgcccaggacctgctgagcggcaccagtgacaagttcaacctgctggccaagctggagcacgcccagagccgcatcctgagcctggagagccagctggaggacagcgcccggcgctggggccgggagaagcaggacctggccacccggctgcaggagcaggagaagggcttccgccaccccagcaacagcatcatcatcgagcagcccccctacagcctgcccccagcccctggggccagcatctttgggaagccccgggccaccgtggaccccggcggctggagggaggaggccttccagagccggggccagggagatggccccctgcctgaccctgagaagaagcagggccaccagaggcctgccctgctgggcaacacccgggaggcctgccccttccacctgccccagaacatctaccacgtgtag

SEQ ID NO: 37589 - DNA, 2268 bp, Artificial Sequence
  Description of Artificial Sequence: Synthetic coding sequence
atgggcctgaagaacaagaagaacacagaggaccctgaggagcccctgattgccagccagagcacagagcctgagatcggccacctgagccccagcaagaaggagaccatcatggtgaccctgcacggggccaccaacctgcctgcctgcaaggatggcagcgagccctggccctacgtggtggtgaagagcaccagcgaggagaagaacaaccagagcagcaaggctgtgacctctgtgaccagcgagcccacccgggcccccatctggggagacacagtgaatgtggagatccaggctgaagatgctggccaggaggatgtgatcctgaaggtggtggacaacaggaagaagcaggagctgctgagctacaagatccccatcaagtacctgcgggtcttccacccctaccactttgagctggtgaagcccacagaaagtggcaaggcagatgaggccacagccaagacccagctgtatgccaccgtggtgaggaagagcagcttcatcccccgctacatcggctgcaaccacatggccctggagatcttcctgcggggcgtgaatgagcccctggccaacaaccccaaccccatcgtggtgattgcccgggtggtgcccaactacaaggagttcaaggtgtcccaggccaacagagacctggcctctgtgggcctgcccatcacccccctgtccttccccatccccagcatgatgaactttgatgtgccccgggtgtcccagaatggctgcccccagctgagcaagccaggcggccccccagagcagcccctgtggaaccagagcttcctgttccagggcagagatggagccaccagcttcagcgaggacacagccctggtgctggagtactacagcagcacctccatgaagggcagccagccctggaccctgaaccagcccctgggcatctctgtgctgcccctgaagagccggctgtaccagaagatgctgaccgggaagggcctggatggcctgcacgtggagcggctgcccatcatggacaccagcctgaagaccatcaatgatgaggcccccaccgtggccctgtccttccagctgctgagcagcgagaggcctgagaacttcctgacccccaacaacagcaaggccctgcccaccctggaccccaagatcctggacaagaagctgcggaccatccaggagagctggagcaaggacacagtgagcagcaccatggacctgagcaccagcaccccccgggaggccgaggaggagcccctggtgcctgagatgagccatgacacagagatgaacaactaccgccgggccatgcagaagatggccgaggacatcctgagcctgcggcggcaggccagcatcctggagggagaaaatcgcatcctgcggagccggctggcccagcaggaggaggaggagggccagggcaaggccagcgaggcccagaacacagtgtccatgaagcagaagctgctgctgtctgagctggacatgaagaagctgcgggacagagtgcagcacctgcagaatgaactcatcaggaagaatgaccgggagaaggagctgctgctgctgtaccaggcccagcagccccaggccgccctgctgaagcagtaccagggcaagctgcagaagatgaaggccctggaggagaccgtgcgccaccaggagaaggtgattgagaagatggagcgggtgctggaggaccggctgcaggacaggagcaagcccccacccctgaaccggcagcagggcaagccctacacaggcttccccatgctgagcgccagcggcctgcccctgggctccatgggagagaacctgcctgtggagctgtacagcgtgctgctggccgagaatgccaagctgaggacagagctggacaagaacagacaccagcaggcccccatcatcctgcagcagcaggccctgcctgacctgctgagcggcaccagtgacaagttcaacctgctggccaagctggagcacgcccagagccgcatcctgagcctggagagccagctggaggacagcgcccggcgctggggccgggagaagcaggacctggccacccggctgcaggagcaggagaagggcttccgccaccccagcaacagcatcatcatcgagcagcccagcgccctgacccacagcatggacctgaagcagcccagcgagctggagcccctgctgcccagcagtgacagcaagctgaacaagcccctgagcccccagaaggagacagccaacagccagcagacctag

SEQ ID NO: 37590 - DNA, 1002 bp, Artificial Sequence
  Description of Artificial Sequence: Synthetic coding sequence
atgggagagcccggcccccccagccccccagcccccaaggccgcccctggcctgattgacagcttcagcgagatgaacaactacagaagagccatgcagaagatggccgaggacatcctgagcctgcggcggcaggccagcatcctggagggggagaaccgcatcctgcggagccggctggcccagcaggaggaggaggagggccagggcaaggccagcgaggcccagaacacagtgtccatgaagcagaagctgctgctgtctgagctggacatgaagaagctgcgggacagagtgcagcacctgcagaatgagctgatcaggaagaatgaccgggagaaggagctgctgctgctgtaccaggcccagcagccccaggccgccctgctgaagcagtaccagggcaagctgcagaagatgaaggccctggaggagaccgtgcgccaccaggagaaggtgattgagaagatggagcgggtgctggaggaccggctgcaggacaggagcaagcccccacccctgaaccggcagcagggcaagccctacacaggcttccccatgctgagcgccagcggcctgcccctgggctccatgggagagaacctgcctgtggagctgtacagcgtgctgctggctgaaaatgccaagctgaggacagagctggacaagaacagacaccagcaggcccccatcatcctgcagcagcaggccctgcctgacctgctgagcggcaccagtgacaagttcaacctgctggccaagctggagcacgcccagagccgcatcctgagcctggagagccagctggaggacagcgcccggcgctggggccgggagaagcaggacctggccacccggctgcaggagcaggagaagggcttccgccaccccagcaacagcatcatcatcgagcagcctgtgtctgaccccccaggagtggccccccggggcagcggcggcggggccggcagccacaggacccccaaggtgacaggcccctag

SEQ ID NO: 37591 - DNA, 1785 bp, Artificial Sequence
  Description of Artificial Sequence: Synthetic coding sequence
atgaacttcaacgtgtggaacatcaaggagatgctgagcatccccagcggcagcggcaacaagaagagcagcaactggaacaacaaccagaatgactacagcagcctgagtgacagccagttcctgtttggcagccagttctgcccagagaacagcgagaccctgagcgcccccctggactttggagcccacctgcggcacagcaagcagagccagcagaactacctggagggggagcccagcatcttcaccaagtaccagaccaagccccagctgtttggaggagacatcaaggatggcggcctcttccccccacccctgtctgtgggcaagagcaagggcctgctggagcagtttgaggagaagaagaagagggccaaggacaagtgtgacagcgagaccctgtacaactttgtgtccaatgtgcgggagagcatcctgcggctgcagacctctgtggagaagtctgaggaccacctgagcagccgcagccagagcatcctggacagcctggagaccgtggccaagaccctgcaggagaccatccaggcccagaatgacctggtgtttgaggccgtgcaggacaagggcaacatggagcaggccatcctggagatgaagaagagatttgaggcccggcagggcgagttcatcgagatgaagagcaacctgaagcacctggaggtgctggtggcccagcagagccaggagttccagcagctgtgtgagcagctgggccagctgaatgtgcccagcgtgctggccgagctgaagaggctcatctctgtgccccctgtgaaggacagcgccagccagaccagcccccccctggcccagagcctgaacctgacccggcaggagaagtacaccagcgagaagcctgtgctgtggcaggcccaggccctgcctgctgcctggaaccctggcatgggcagcctgcagcctggagaatttgatgtgtggggcgagggcgccaagaatgatgacctgcaggaggaggccgccctgcctgccttcggcagccatgagaggaacagacatgtgaaggacaaggtggtgcagaccaactgcaagaactgggccgtgaccaagacaggagccaagaaccacggcagctctgtgcccggccacaagatccccagcgaccgggacctggtgtcccagggcgccagccagctgaccagcctggagatcaacttcagcaccagcatcaagaatgcctgccagaagtaccaggcccagagcatgttcctgtgtgacccccgggagcacctggtgatcaagcagaaggatggcaccgtggagatgaggggcaaggacaagaagcagcagcccaggaaggcccaccgggcccaccggggccgcctgattgccagcaagcagaagcagatccccatccagacctgcaagttcaacagcaagtaccagagcccccagcctgccatctctgtgccccagagccccttcctgggccagcaggagccccgggcccagcccctgcacctgcagtgccccaggagccccaggaagcctgtgtgccccatcctgggcggcaccgtgatgcccaacaagacagtgcgggctgtgcagggccgcctgctgcagctgagccgctgcagcagccaggacaactggctgctgagcagcagcagccagggcgaccaccagatgtcctggttcagtgacctgaacctgggctgcagcgagacccccctgtgcaaggaggccggcaagaacctgctgtatgacctgggctttgacagcagtgatgatgatggcttctag

SEQ ID NO: 37592 - DNA, 1725 bp, Artificial Sequence
  Description of Artificial Sequence: Synthetic coding sequence
atggcccgggtggatgccaaggccaaggaggccccccgggccagcgagggctgccagcacgctgtgaccagccagaggaacaagaagagcagcaactggaacaacaaccagaatgactacagcagcctgagtgacagccagttcctgtttggcagccagttctgcccagaaaattctgagaccctgagcgcccccctggactttggagcccacctgcggcacagcaagcagagccagcagaactacctggagggggagcccagcatcttcaccaagtaccagaccaagccccagtttgaggagaagaagaagagggccaaggacaagtgtgacagcgagaccctgtacaactttgtgtccaatgtgcgggagagcatcctgcggctgcagacctctgtggagaagtctgaggaccacctgagcagccgcagccagagcatcctggacagcctggagaccgtggccaagaccctgcaggagaccatccaggcccagaatgacctggtgtttgaggccgtgcaggacaagggcaacatggagcaggccatcctggagatgaagaagagatttgaggcccggcagggcgagttcatcgagatgaagagcaacctgaagcacctggaggtgctggtggcccagcagagccaggagttccagcagctgtgtgagcagctgggccagctgaatgtgcccagcgtgctggccgagctgaagaggctcatctctgtgccccctgtgaaggacagcgccagccagaccagcccccccctggcccagagcctgaacctgacccggcaggagaagtacaccagcgagaagcctgtgctgtggcaggcccaggccctgcctgctgcctggaaccctggcatgggcagcctgcagcctggagaatttgatgtgtggggcgagggcgccaagaatgatgacctgcaggaggaggccgccctgcctgccttcggcagccatgagaggaacagacatgtgaaggacaaggtggtgcagaccaactgcaagaactgggccgtgaccaagacaggagccaagaaccacggcagctctgtgcccggccacaagatccccagcgaccgggacctggtgtcccagggcgccagccagctgaccagcctggagatcaacttcagcaccagcatcaagaatgcctgccagaagtaccaggcccagagcatgttcctgtgtgacccccgggagcacctggtgatcaagcagaaggatggcaccgtggagatgaggggcaaggacaagaagcagcagcccaggaaggcccaccgggcccaccggggccgcctgattgccagcaagcagaagcagatccccatccagacctgcaagttcaacagcaagtaccagagcccccagcctgccatctctgtgccccagagccccttcctgggccagcaggagccccgggcccagcccctgcacctgcagtgccccaggagccccaggaagcctgtgtgccccatcctgggcggcaccgtgatgcccaacaagacagtgcgggctgtgcagggccgcctgctgcagctgagccgctgcagcagccaggacaactggctgctgagcagcagcagccagggcgaccaccagatgtcctggttcagtgacctgaacctgggctgcagcgagacccccctgtgcaaggaggccggcaagaacctgctgtatgacctgggctttgacagcagtgatgatgatggcttctag

SEQ ID NO: 37593 - DNA, 612 bp, Artificial Sequence
  Description of Artificial Sequence: Synthetic coding sequence
atgaacttcaacgtgtggaacatcaaggagatgctgagcatccccagcggcagcggcaacaagaagagcagcaactggaacaacaaccagaatgactacagcagcctgagtgacagccagttcctgtttggcagccagttctgcccagagaacagcgagaccctgagcgcccccctggactttggagcccacctgcggcacagcaagcagagccagcagaactacctggagggggagcccagcatcttcaccaagtaccagaccaagccccagctgtttggaggagacatcaaggatggcggcctcttccccccacccctgtctgtgggcaagagcaagggcctgctggagcagtttgaggagaagaagaagagggccaaggacaagtgtgacagctgccggcggctgtggaagagcctgcggaccatctctgtgcaggaggccaacctcttctggatcctgtggaggctgtggcccaggcatgtgtctgccagctgcctgcgctaccagcagagggccctggtgaatgatgaacatgagctgagtgaccccagcctggtgtcctctggagaggtgccccaccgggtgtctgatgagaggatgggcatctag

SEQ ID NO: 37594 - DNA, 1785 bp, Artificial Sequence; identical to SEQ ID NO: 37591
  Description of Artificial Sequence: Synthetic coding sequence

SEQ ID NO: 37595 - DNA, 582 bp, Artificial Sequence
  Description of Artificial Sequence: Synthetic coding sequence
atgctgagcacccccaagagccagggcaacaagaagagcagcaactggaacaacaaccagaatgactacagcagcctgagtgacagccagttcctgtttggcagccagttctgcccagagaacagcgagaccctgagcgcccccctggactttggagcccacctgcggcacagcaagcagagccagcagaactacctggagggggagcccagcatcttcaccaagtaccagaccaagccccagctgtttggaggagacatcaaggatggcggcctcttccccccacccctgtctgtgggcaagagcaagggcctgctggagcagtttgaggagaagaagaagagggccaaggacaagtgtgacagctgccggcggctgtggaagagcctgcggaccatctctgtgcaggaggccaacctcttctggatcctgtggaggctgtggcccaggcatgtgtctgccagctgcctgcgctaccagcagagggccctggtgaatgatgaacatgagctgagtgaccccagcctggtgtcctctggagaggtgccccaccgggtgtctgatgagaggatgggcatctag

SEQ ID NO: 37596 - DNA, 1785 bp, Artificial Sequence; identical to SEQ ID NO: 37591
  Description of Artificial Sequence: Synthetic coding sequence

SEQ ID NO: 37597 - DNA, 1836 bp, Artificial Sequence
  Description of Artificial Sequence: Synthetic coding sequence
atgtctgagatccccagcaccatcgtgtccaagaacatgaccaatgacaagaacagcctggagagcatgaacatcagcagcagcagcagcacagaggagaaccccaagaagcaggccaggaagaatgaggagcacggccctgaccccagcgccaaccccttccacctgtctggagatgtggacttcttcctgctgcgggaccaggagaggaacaaggccctgtctgagcggcagcagcagaagaccatgagggtgcaccagaagatgacctacagcagcaaggtgtctgccaagcacaccagcctgcggcggcagctgcagctggaggacaagcaggaggacctggaggcccgggcagaggccgagcaccagagggccttccgggactacaccacctggaagctgaccctgaccaaggagaagaatgtggagcctgagaacatgagcggctacatcaagcagaagaggcagatgttcctgctgcagtatgccctggatgtgaagagaagagagatccagaggctggagaccctggccaccaaggaggaggcccggctggagagagctgagaagagcctggagaaggatgctgccctgtttgatgaatttgtgcgggagaatgactgcagctctgtgcaggccatgagagctgctgagaaggagaccaaggccaagattgagaagatcctggagatccgggacctgaccacccagatcgtgaacatcaagtctgagatcagcagatttgaggacaccctgaagcactacaaggtgtacaaggacttcctgtacaagctgagccccaaggagtggctggaggagcaggagaagaagcacagcttcctgaagaaggccaaggaggtgtctgaggccagcaaggagagctctgtgaacagcacccctggggacaagggccctggcatcaagggcaaggccagctccatgtgggccaaggagggccagggcaccaagaagccctggaggttcctgcagaccatgaggctgggccgcagccccagctacctgagcagcccccagcagggcagccagcccagcgagagcagtggaggagacagccggggcagcaacagccccatcccccccacccaggaggacacagacagtgatggagaggagccccagctgtacttcacagagccccagcagctgctggatgtgttccgggagctggaggagcagaacctgagcctcatccagaacagccaggagacagagaagaccctggaggagctgagccacaccctgaagcacacccagatccgcatggaccgggaggtgaaccagctgaagcagtgggtgaccaccatgatgatgagcatcaccaaggaggaggacacagctgctgagctggagctgaaggcccgggtcttccactttggagagtacaagggggaccagcaggacaagctgctggagagcctgaactgcaaggtgctggatgtgtaccgccactgcaccggcacccagcaggaggccaacctgggcaccgtgcagatgctgaccatcatcgagcaccagctggatgagctgctggagaacctggagcacgtgccccaggtgaagattgagcaggccgagcgggccaaggagaaggagcggcgcatccggctgcgggaggagaagctgcagatgcagaagatcctgcaggaggagcacctgcagagggcccgggcccgggcccaggccgagatcaagaagaagaggggccgcaccctggtgtgccgcagccggcccccagcccaccgcatcaagcagcagagcgagcacaccctgatggacaaggaggaggaggagctgctcttcttcttcacctag

SEQ ID NO: 37598 - DNA, 1839 bp, Artificial Sequence
  Description of Artificial Sequence: Synthetic coding sequence
atgtctgagatccccagcaccatcgtgtccaagaacatgaccaatgacaagaacagcctggagagcatgaacatcagcagcagcagcagcacagaggagaaccccaagaagcaggccaggaagaatgaggagcacggccctgaccccagcgccaaccccttccacctgtctggagatgtggacttcttcctgctgcgggaccaggagaggaacaaggccctgtctgagcggcagcagcagaagaccatgagggtgcaccagaagatgacctacagcagcaaggtgtctgccaagcacaccagcctgcggcggcagctgcagctggaggacaagcaggaggacctggaggcccgggcagaggccgagcaccagagggccttccgggactacaccacctggaagctgaccctgaccaaggccgagaagaatgtggagcctgagaacatgagcggctacatcaagcagaagaggcagatgttcctgctgcagtatgccctggatgtgaagaggcgggagatccagaggctggagaccctggccaccaaggaggaggcccggctggagcgggcagagaagagcctggagaaggatgctgccctgtttgatgaatttgtgagagaaaatgactgcagctctgtgcaggccatgagagctgctgagaaggagaccaaggccaagattgagaagatcctggagatccgggacctgaccacccagatcgtgaacatcaagtctgagatcagcagatttgaggacaccctgaagcactacaaggtgtacaaggacttcctgtacaagctgagccccaaggagtggctggaggagcaggagaagaagcacagcttcctgaagaaggccaaggaggtgtctgaggccagcaaggagagctctgtgaacagcacccctggggacaagggccctggcatcaagggcaaggccagctccatgtgggccaaggagggccagggcaccaagaagccctggaggttcctgcagaccatgaggctgggccgcagccccagctacctgagcagcccccagcagggcagccagcccagcgagagcagcggcggggacagccggggcagcaacagccccatcccccccacccaggaggacacagacagtgatggagaggagccccagctgtacttcacagagccccagcagctgctggatgtgttccgggagctggaggagcagaacctgagcctcatccagaacagccaggagacagagaagaccctggaggagctgagccacaccctgaagcacacccagatccgcatggaccgggaggtgaaccagctgaagcagtgggtgaccaccatgatgatgagcatcaccaaggaggaggacacagctgctgagctggagctgaaggcccgggtcttccactttggagagtacaagggggaccagcaggacaagctgctggagagcctgaactgcaaggtgctggatgtgtaccgccactgcaccggcacccagcaggaggccaacctgggcaccgtgcagatgctgaccatcatcgagcaccagctggatgagctgctggagaacctggagcacgtgccccaggtgaagattgagcaggccgagcgggccaaggagaaggagcggcgcatccggctgcgggaggagaagctgcagatgcagaagatcctgcaggaggagcacctgcagagggcccgggcccgggcccaggccgagatcaagaagaagaggggccgcaccctggtgtgccgcagccggcccccagcccaccgcatcaagcagcagagcgagcacaccctgatggacaaggaggaggaggagctgctcttcttcttcacctag

SEQ ID NO: 37599 - DNA, 1692 bp, Artificial Sequence
  Description of Artificial Sequence: Synthetic coding sequence
atgagcagcaacctgctgcccaccctgaacagcggcggcaaggtgaaggatggcagcaccaaggaggaccggccctacaagatcttcttccgggacctcttcctggtgaaggaaaatgagatggccgccaaggagacagagaagttcatgaacagaaacatgaaggtgtaccagaagaccaccttcagcagcaggatgaagagccacagctacctgagccagctggccttctaccccaagaggagcggccgcagctttgagaagtttggacctggccctgcccccatccccaggctcatcgagggcagtgacaccaagaggacagtgcatgagttcatcaatgaccagagggaccgcttcctgctggagtatgccctgagcaccaagaggaacaccatcaagaagtttgagaaggacatcgccatgagggagcggcagctgaagaaggccgagaagaagctgcaggatgatgccctggcctttgaggagttcctgagagaaaatgaccagaggtctgtggatgccctgaagatggccgcccaggagaccatcaacaagctgcagatgacagctgagctgaagaaggcctccatggaggtgcaggccgtgaagtcagaaattgccaagacagagttcctgctgcgggagtacatgaagtatggcttcttcctgctgcagatgagccccaagcactggcagatccagcaggccctgaagagggcccaggccagcaagagcaaggccaacatcatcctgcccaagatcctggccaagctgagcctgcacagcagcaacaaggagggcatcctggaggagagcggccgcacagctgtgctgtctgaagatgccagccagggccgggacagccagggcaagcccagccgcagcctgaccaggaccccagagaagaagaagagcaacctggccgagagctttggaagtgaggacagcctggagttcctgctggatgatgagatggatgtggacctggagcccgccctgtacttcaaggagcctgaggagctgctgcaggtgctgcgggagctggaggagcagaacctgaccctcttccagtacagccaggatgtggatgagaacctggaggaggtgaacaagcgggagaaggtgatccaggacaagaccaacagcaacatcgagttcctgctggagcaggagaagatgctgaaggccaactgtgtgcgggaggaggagaaggctgctgagctgcagctgaagagcaagctgttctcctttggagagttcaacagtgatgcccaggagatcctgattgacagcctgagcaagaagatcacccaggtgtacaaggtgtgcattggagatgctgaagatgatggcctgaaccccatccagaagctggtgaaggtggagagccggctggtggagctgtgtgacctgattgagagcatccccaaggaaaatgtggaggccatcgagaggatgaagcagaaggagtggaggcagaagttcagagatgagaagatgaaggagaagcagaggcaccagcaggagcggctgaaggccgccctggagaaggctgtggcccagcccaagaagaagctgggccgccgcctggtgttccacagcaagcccccatctggcaacaagcagcagctgcccctggtgaatgagaccaagaccaagagccaggaggaggagtacttcttcacctag

SEQ ID NO: 37600 - DNA, 2106 bp, Artificial Sequence
  Description of Artificial Sequence: Synthetic coding sequence
atggtggtgtccaccttcacagacatggacaccttccccaacaacttccccccaggaggagacagcggcctgaccggcagccagagcgagttccagaagatgctgattgatgagcggctgcgctgtgagcaccacaaggccaactaccagaccctgaaggccgagcacacccggctgcagaatgaacatgtgaagctgcagaatgagctgaagcacctgttcaatgagaagcagacccagcaggagaagctgcagctgctgctggaggagctgcggggggagctggtggagaagaccaaggacctggaggagatgaagctgcagatcctgaccccccagaagctggagctgctgcgggcccagatccagcaggagctggagacccccatgagggagcgcttcaggaacctggatgaggaggtggagaagtacagagctgtgtacaacaagctgcgctatgagcacaccttcctgaagtcagaatttgagcaccagaaggaggagtatgcccgcatcctggatgagggcaagatcaagtatgagagcgagatcgcccggctggaggaggacaaggaggagctgaggaaccagctgctgaatgtggacctgaccaaggacagcaagagggtggagcagctggcccgggagaaggtgtacctgtgccagaagctgaagggcctggaggccgaggtggccgagctgaaggccgagaaggaaaattctgaggcccaggtggagaatgcccagaggatccaggtgcggcagctggccgagatgcaggccaccgtgcgcagcctggaggccgagaagcagagcgccaacctgcgggcagagcggctggagaaggagctgcagagcagcagcgagcagaacaccttcctgatcaacaagctgcacaaggccgagcgggagatcaacaccctgagcagcaaggtgaaggagctgaagcacagcaacaagctggagatcacagacatcaagctggagacagcccgggccaagtctgagctggagcgggagaggaacaagatccagagcgagctggatggcctgcagagcgacaatgagatcctgaaggctgctgtggagcaccacaaggtgctgctggtggagaaggaccgggagctgatcaggaaggtgcaggccgccaaggaggagggctaccagaagctggtggtgctgcaggatgagaagctggagctggagaaccggctggccgacctggagaagatgaaggtggagcatgatgtgtggaggcagagcgagaaggaccagtatgaggagaagctgcgggccagccagatggccgaggagatcaccaggaaggagctgcagagcgtgcggctgaagctgcagcagcagatcgtgaccattgaaaatgctgagaaggagaagaatgaaaattctgacctgaagcagcagatcagcagcctgcagatccaggtgaccagcctggcccagagtgaaaatgacctgctgaacagcaaccagatgctgaaggagatggtggagcggctgaagcaggagtgcaggaacttccgcagccaggccgagaaggcccagctggaggccgagaagaccctggaggagaagcagatccagtggctggaggagaagcacaagctgcacgagcgcatcacagaccgggaggagaagtacaaccaggccaaggagaagctgcagagagctgccatcgcccagaagaagaggaagagcctgcacgagaacaagctgaagaggctgcaggagaaggtggaggtgctggaggccaagaaggaggagctggagacagagaaccaggtgctgaaccggcagaatgtgccctttgaggactacacccggctgcagaagaggctgaaggacatccagaggaggcacaatgagttccgcagcctcatcctggtgcccaacatgccacccacagccagcatcaaccctgtgtccttccagagcagcgccatggtgcccagcatggagctgcccttccccccccacatgcaggaggagcagcaccagcgggagctgagcctgctgaggaagaggctggaggagctggagaccacccagaggaagcagctggaggagctgggcagcagtggagagtag

SEQ ID NO: 37601 - DNA, 1707 bp, Artificial Sequence
  Description of Artificial Sequence: Synthetic coding sequence
atgctgattgatgagcggctgcgctgtgagcaccacaaggccaactaccagaccctgaaggccgagcacacccggctgcagaatgagcacgtgaagctgcagaatgagctgaagcacctgttcaatgagaagcagacccagcaggagaagctgcagctgctgctggaggagctgcggggggagctggtggagaagaccaaggacctggaggagatgaagctgcagatcctgaccccccagaagctggagctgctgcgggcccagatccagcaggagctggagacccccatgagggagcgcttcaggaacctggatgaggaggtggagaagtacagagctgtgtacaacaagctgcgctatgagcacaccttcctgaagtcagaatttgagcaccagaaggaggagtatgcccgcatcctggatgagggcaagatcaagtatgaaagtgaaattgcccggctggaggaggacaaggaggagctgaggaaccagctgctgaatgtggacctgaccaaggacagcaagagggtggagcagctggcccgggagaaggtgtacctgtgccagaagctgaagggcctggaggccgaggtggccgagctgaaggccgagaaggagaacagcgaggcccaggtggagaatgcccagaggatccaggtgcggcagctggccgagatgcaggccaccgtgcgcagcctggaggccgagaagcagagcgccaacctgcgggcagagcggctggagaaggagctgcagagcagcagcgagcagaacaccttcctgatcaacaagctgcacaaggccgagcgggagatcaacaccctgagcagcaaggtgaaggagctgaagcacagcaacaagctggagatcacagacatcaagctggagacagcccgggccaagtctgagctggagcgggagaggaacaagatccagagcgagctggatggcctgcagagcgacaatgagatcctgaaggctgctgtggagcaccacaaggtgctgctggtggagaaggaccgggagctgatcaggaaggtgcaggccgccaaggaggagggctaccagaagctggtggtgctgcaggatgagaagctggagctggagaaccggctggccgacctggagaagatgaaggtggagcatgatgtgtggaggcagagcgagaaggaccagtatgaggagaagctgcgggccagccagatggccgaggagatcaccaggaaggagctgcagagcgtgcggctgaagctgcagcagcagatcgtgaccattgaaaatgctgagaaggagaagaatgaaaacagcgacctgaagcagcagatcagcagcctgcagatccaggtgaccagcctggcccagagtgaaaatgacctgctgaacagcaaccagatgctgaaggagatggtggagcggctgaagcaggagtgcaggaacttccgcagccaggccgagaaggcccagctggaggccgagaagaccctggaggagaagcagatccagtggctggaggagaagcacaagctgcacgagcgcatcacagaccgggaggagaagtacaaccaggccaaggagaagctgcagagagctgccatcgcccagaagaagctggagcaggacctggagctgggctgccccagcgtgacagacacctaccgggagagcgtcttccccccaccacccctgaagagggacctgctgaagtag

SEQ ID NO: 37602 - DNA, 2106 bp, Artificial Sequence; identical to SEQ ID NO: 37600
  Description of Artificial Sequence: Synthetic coding sequence

SEQ ID NO: 37603 - DNA, 9 bp, Artificial Sequence
  Description of Artificial Sequence: Synthetic coding sequence
atggtgtag

SEQ ID NO: 37604 - DNA, 951 bp, Artificial Sequence
  Description of Artificial Sequence: Synthetic coding sequence
atgagcctgggcatcatggaggaggaggacctggccgagtacttccggctgcagtatggagagcggctgctgcagatgctgcagaagctgcccaacgtggagggcgccagcgagagccccagcatctggctgctggagaagaagaaggagacagagatcatgcaccagaccatggtgcagaagaagaagatgttccagaggaggatggagaccctgaacctgcgctgggaggagctgggcgtgaaggaggcccagctgaaggcccacatccagaagtctgagcagttcatccaggagaatgaccagaagaggatccgggccatgaagaaggccaacaaggagcgggagctgaagtgccagcacatgcaggagctgaccaagaggaagcaggagatggtggccctgcggctggagcaccagaggctgagcgccaagctgaaggactactacatcttcaacaagtacctggagaaggtggtggagaacagcgagtttgaggagatccatgaagtcatcgcccgctacaagaccctggtgtccatgagacatgacctgatgcagagcgcccaggagggccaggagaagattgaaagagccaaggcccggctggcccgctacatggaggagaaggatgatgagatcctgcagcagaacaatgagctggcccggctgcagatgagatttgaccgggcccggagcaatgtcatcttctgggagagccgctgggcccacatccagaacacagctgccaagaagaccctgctgctgggcaccatcaagatggccaccctgaacctcttccagatcgtgtccaagcacctgaaggaggtgacagaggtggccctggaggacacccacaagcagctggacatgatccagcagttcatccaggacagaagtgacatctgggccgaggtgaagaagaaggagcagcagagggtgcgcatctag

SEQ ID NO: 37605 - DNA, 729 bp, Artificial Sequence
  Description of Artificial Sequence: Synthetic coding sequence
atgagcctgggcatcatggaggaggaggacctggccgagtacttccggctgcagtatggagagcggctgctgcagatgctgcagaagctgcccaacgtggagggcgccagcgagagccccagcatctggctgctggagaagaagaaggagacagagatcatgcaccagaccatggtgcagaagaagaagatgttccagaggaggatggagaccctgaacctgcgctgggaggagctgggcgtgaaggaggcccagctgaaggcccacatccagaagtctgagcagttcatccaggagaatgaccagaagaggatccgggccatgaagaaggccaacaaggagcgggagctgaagtgccagcacatgcaggagctgaccaagaggaagcaggagatggtggccctgcggctggagcaccagaggctgagcgccaagctgaaggactactacatcttcaacaagtacctggagaaggtggtggagaacagcgaggagagccgctgggcccacatccagaacacagctgccaagaagaccctgctgctgggcaccatcaagatggccaccctgaacctcttccagatcgtgtccaagcacctgaaggaggtgacagaggtggccctggaggacacccacaagcagctggacatgatccagcagttcatccaggacagaagtgacatctgggccgaggtgaagaagaaggagcagcagagggtgcgcatctag

SEQ ID NO: 37606 - DNA, 927 bp, Artificial Sequence
  Description of Artificial Sequence: Synthetic coding sequence
atggctgtgccctgggaggagtacttccggctggccctgcaggagaagctgagcaccaagctgcctgagcaggccgaggaccacgtgccccctgtgctgcggctgctggagaagaggcaggagctggtggatgctgaccaggccctgcaggcccagaaggaggtgttccgcaccaagacagctgccctgaagcagcgctgggagcagctggagcagaaggagcgggagctgaagggcagcttcatccgctttgacaagttcctgcaggacagcgaggcccggaggaacagagccctgcggcgggctgctgaggagcggcaccaggccggcagaagagaggtggaggccctgcggctgtggacccagctgcaggagctgcggcgggagcacgcccggctgcagaggcggctgaagaggctggagccctgtgcccggctgctggagcaggccctggagctgctgcccggcttccaggaggtgcctgagctggtggccaggtttgatggcctggccgagacccaggccgccctgcggctgcgggagcgggagcagctggccgagctggaggccgcccgggcccggctgcagcagctgagagatgcctggccagatgaggtgctggcccagggccagaggcgggcccagctgcaggagcggctggaggccgcccgggagaggaccctgcagtgggagagcaagtggatccagatccagaacacagctgctgagaagaccctgctgctgggccgcagcaggatggctgtgctgaacctcttccagctggtgtgccagcaccagggccagccccccaccctggacatcgaggacacagagggccagctggagcacgtgaagctgttcatgcaggacctgagcgccatgctggccggcctgggccaggccgagcctgctgccccagccagctag

SEQ ID NO: 37607 - DNA, 675 bp, Artificial Sequence
  Description of Artificial Sequence: Synthetic coding sequence
atggccgcccccagcgaggtggccgccatcgcccctggagaaggagatggcggcggcggcggcttcggctcctggctggatggccgcctggaggccctgggcgtggacagagctgtgtatggagcctacatcctgggcatcctgcaggaggaggaggaggaggagaagctggatgccctgcagggcatcctgagcgccttcctggaggaggacagcctgctgaacatctgcaaggagatcgtggagcgctggagcgagacccagaatgtggtgaccaaggtgaagaaggaggatgaggtgcaggccatcgccaccctgattgagaagcaggcccagatcgtggtgaagcccaggatggtgtctgaggaggagaagcagaggaaggccgccctgctggcccagtatgcagatgtgacagatgaggaggatgaagcagatgagaaggatgattctggggccaccaccatgaacatcggcagtgacaagctgctcttcaggaacaccaacgtggaggatgtgctgaatgccaggaagctggagcgggacagcctgagagatgagagccagaggaagaaggagcaggacaagctgcagcgggagcgggacaagctggccaagcaggagaggaaggagaaggagaagaagaggacccagagaggagagaggaagaggtag

SEQ ID NO: 37608 - DNA, 465 bp, Artificial Sequence
  Description of Artificial Sequence: Synthetic coding sequence
atggccgcccccagcgaggtggccgccatcgcccctggagaaggagatggcggcggcggcggcttcggctcctggctggatggccgcctggaggccctgggcgtggacagagctgtgtatggagcctacatcctgggcatcctgcaggaggaggaggaggaggagaagctggatgccctgcagggcatcctgagcgccttcctggaggaggacagcctgctgaacatctgcaaggagatcgtggagcgctggagcgagacccagaatgtggtgaccaaggtgaagaaggaggatgaggtgcaggccatcgccaccctgattgagaagcaggcccagatcgtggtgaagcccaggatggtgtctgaggaggagaagcagaggaaggccgccctgctggcccagtatgcagatgtgacagatgaggaggacagcgtgcccaagcaccagtgtggccgctgcccctag

SEQ ID NO: 37609 - DNA, 486 bp, Artificial Sequence
  Description of Artificial Sequence: Synthetic coding sequence
atgacctacttcggccactttggaggagccaaccacgcccacaccctgggggagctggaggcctgcatcgccatgctggtggagcagctgcggacccagggctgcggcggccgcaccctgggcaccagcgaggaggaggccgagctgcagcagaaggtggaggagaatgagcacctgcggctggagctgcagatggtggagacagagcgggtgcggctgagcctgctggaggagaagctggtggatgtgctgcagctgctgcagaggctgcgggacctgaacatcagcaagagggccctgggcaagatcctgctgagcaccctggatgccttccgggaccccacccatgagggccggcccagccctgctgccatcctggatgccctgcaccaggccctggccgcctgccagctgctgcggcggcagcccagcgccccagccagcgctgctgctgccctgaccaaccccctgctggtgtcctgctag

SEQ ID NO: 37610 - DNA, 987 bp, Artificial Sequence
  Description of Artificial Sequence: Synthetic coding sequence
atgtacaccctgcacaccaagagggtgaaggccgccgcccggcagatgtggaccagcaacctgagcaaggtgcggcagagcctgaagaatgtgtaccacaagtgcaagatccgccaccaggacagcacaggctaccccaccgtgaccagtgatgactgcaaccaggatgatgacagctatgatggcaagatgaacctgcctgtggtgctgcaggatgtgaagacagcccaggtggagctgttcagccagatgacagacatcgtgcacatgatccccaaggtgcaggagaagacagacctgtaccagaagcagatggaggtgctggagaccaggatgaatgtgaatgaagacaagcagtgcaccaccaccaaggacatcctgtccatgaaggaggacatcaaggccctgaagaagaaggtgacagagctggagatccagaacagctgcagcaccatccactgcctggagatcctggagggggagcggggcaaggagatcacagagctgctgtacaagctgatccagcctgccaccctgaagaacaccctggccagcacagacatggagatcagcagcgctgagcctgagaaggtgcccagctaccccaagagcacagaccacctggagaagaagaccatcagcccccagatgaagaccctgaagaagaggaaccaccagaatgccagccgcagctttgagaaggccaagcccaacatctacatctacccagacttcagcacctggatcaagctgacctttgtgcatggaggcaagtggaccttcttcctgagcgccaccaagctggaggagttcatccagtggctgctgagccggcccaccatcctgcctgaggagccccaggtgatcacccagcgctactgccccttcaccggccccatcctgagcctgaccaccatctgcctgagcatcttcaacaacatctacggcttcatctgcagcctgaaggaggaggtgacccggctgtag

SEQ ID NO: 37611 - DNA, 906 bp, Artificial Sequence
  Description of Artificial Sequence: Synthetic coding sequence
atgggcaaccggctgcgggcagagctgggccggcctgagcgctggctgctgcaccacgccctgcccccagcccctgaggccaggaagccaggagaggagccccggcggcccctggacaggagcccccccctgggccaggtgcagccccacttcaccagccaggatgccaagtctgcagaagatgaggcccccagccgccacctgggcaagcaccagcccaggtctgcccaggtgggcagccggctggatgccctgcagggccccaagacccagcacagcatccacacagtgacctgcaagagcccccggcagaaggaggacaggagccccaagccaccccaggccccccagcaccctgaggagcacggccggcagagccacagcagcagcagctttgccagcggcaccctgcaggacatgtggaggctgctggacctgggcagcagccccagcggcgtgaccagccagggcgacagcaccccagagatgggcagccactacgtgacccaggccggcctggagctgctgggcagcagcagccctgctgccctggccagccagagcgctgagatgactggagtgggccccacccccagcctggcctggagcggggccctgcaccccaacatgaaccaggaggccagcctggtgcgcagcacctgggcccctggcatgagaggaggcatgaatggaggcagcagctctgtgtgcaagaacatgcagaggggcccccactggagccccagccagcagccctgcagcggcatcagaacagtgctgctgagcaggaaggagaggaccctgctgagctgcttcagcctgcctgcccctgtggtgctggtgcccctgctgctgagcggccaggccgtgacagagcgggccggccatgctggggacatcctgtag

SEQ ID NO: 37612 - DNA, 2751 bp, Artificial Sequence
  Description of Artificial Sequence: Synthetic coding sequence
atgctgcccctgggcagcgagcccgccctgaatgagctgctgctgaggaaggaggaggagtggagggccctgcaggcccacaggacccagctgcaggaggccgccctgcaggacaccaggagccagctggaggaggcccagggcaagctgcgctgcctgcaggaggactttgtgtacaacctgcaggtgctggaggagcgggacctggagctggagagatatgatgctgcctttgcccaggcccgggagtgggaggaggcccggcgggcagaggtgtctgagctgaagattgaagctgccaagctgcggcaggccctggcccgggaggccaggaaggtggaggagctgcagcagcagcagcagctggccttccaggagcaccggctggagctggagcgggtgcacagcgacaagaatggagaaattgaccaccaccgggagcagtatgagaacctgaagtggaccctggagaggaagctggaggagctggatggagagctggccctgcagaggcaggagctgctgctggagtttgagagcaagatgaggaagcgggagcacgagttccggctgcaggccgacaacatgagcaacacagccctgagccgggagctgaaggtgaagctgctgcacaaggagctggaggccctgaaggaggccggggccaaggctgctgagagcctgcagagagctgaggccaccaatgctgagctggagaggaagctgcagagccgggccggggagctgcaggacctggaggccatgagccgggcccgggtgaaggacctggaggacaagctgcacagcgtgcagctgaccaggaagaaggaggaggagaccttcaagaggaagcatgaggagctggaccggctggcccgggagaaggatgctgtgctggtggccgtgaagggggcccacgtggagcagctgcaggagctgcagaccagggtgctggagctgcaggcccactgtgagaccctggaggcccagctgcggcgggcagagtggaggcaggccgacacagccaaggagaaggatgctgccatcgaccagctgcgggaggatgccagcacagtgaagagcgcctgggatgcccagatcgcccagctgagcaaggagatggtgtcccgggacctgcagatccagaccctgcaggaggaggaggtgaagctgaaggcccaggtggcccggagccagcaggacatcgagcgctacaagcagcagctgagcctggccgtggagcgggagaggagcctggagcgggaccaggtgcagctgggcctggactggcagaggcgctgtgatgacatcgagcgggaccagatccagaagtctgaggccctgatccagggcctgtccatggccaagagccaggtggccgccaagctgcaggagacagagcaggccctgcaggagcaggaggtggtgctgaaggctgtgaccctggagcgggaccaggccgtgcaggccctgaggatgcacggcctgcccaggcctggggcccagatgctgctgcggcagcacgaggaggagatcagcaaggacttccccagcagcgagatccagaggctgcgggagcagaacaccagcctgagaaatgccatcgcccagatgaggaaggagatggaggccctgagccaccagatccccccacccatccagacagctgctgagagcacagatgccaaccagcctgaccctgaggccggaggagatgctgccaccccagactatgtgctggccctggaggccgagatccgcaccctgaagcacaagttcaagaccctggagaagcacctggaggatgtgctggaccccctgaagatgagcagcccccacgccgagagccagcccagcgtgaggaccagcacagagaccactggaggcagcgcccaggccggccaggccggcggctctgtgcaggccggccaggccggcggctctgtgcaggccggccctgtgagcagcggcctggccctgaggaagctgggggacagagtgcagctgctgaacctgctggtgacccggctgcggcagaaggtgctgcgggagcccctggagcctgctgccctgcagcgggagctgccccgggaggtggaccaggtgcacctggaggtgctggagctgaggaagcaggtggccgagctgggcaagcacctgcgcatcgcccagcacggcggcgctgagcccagcggcaggaagcagcccccagccagtgatgctgtggccctgggccgggagcaggatgccaagtctgcagaagatgaggcccccagccgccacctgggcaagcaccagcccaggtctgcccaggtgggcagccggctggatgccctgcagggccccaagacccagcacagcatccacacagtgacctgcaagagcccccggcagaaggaggacaggagccccaagccaccccaggccccccagcaccctgaggagcacggccggcagagccacagcagcagcagctttgccagcggcaccctgcaggacatgtggaggctgctggacctgggcagcagccccagcggcgtgaccagccagggcgacagcaccccagagctgcctgcccccccagctgctgacagaagacctgtgaagatgcaggccggcatcgccaccccaggcatgaagacagctgcccaggccaaggccaagaccaccggggccagccgcagccacccagccaaggccaagggctgccagaggcctcccaagatccggaactacaacatcatggactag

SEQ ID NO: 37613 - DNA, 2751 bp, Artificial Sequence; identical to SEQ ID NO: 37612
  Description of Artificial Sequence: Synthetic coding sequence

SEQ ID NO: 37614 - DNA, 1653 bp, Artificial Sequence
  Description of Artificial Sequence: Synthetic coding sequence
atgaccaaggtgcctgccaccaagaagctgcagagcagccccaacagcggggctgtgcggcccttctacgccagcgagaacctgcggcaggtgcctgacaagcccatgaagagcatcaagtacatggacaaggagatcatcaacctgaagaaggacctgatccgcagccgcttcctgatccagagcgtgaagattggccggggctactttgccatcctgcgggaggagacagccaagaagaagaagcagcagcagctgcagaagctgaaggaggaggagaggaacaagttccagcctgctgagaagatcagcgagatccactacggggacaccctgctgagcacctatgatgatgagaagctgaagaccctgggcgcccgggtgacccggcggcccttcacccccatccacagctgcatcatcagccccagcctgacagaggcccacgtggagcccctcttccggcagctgtgtgccctgcactggctgctggaggccctgaccatcgaccacacccaccacaccatgaagcctgtgatcacctgctggaaccccaaggaccccggcggcagcaagagcaccatcaagaagatcaacaaggacaagtccatgggccagaagtgggagcacttcatcacagcccccaagaccaagaagttcaagatccccaccatgagggtgaccaacaggaagcccagccggcggggcagcaccctgagcctgagccgggccagcggcggcagcagcccccagagctccatgatctctgtgaaccctggcagtgatgagccccccagcgtgaacacccaggtgaccagcagcaaggacatcgaggacaatgaaagcagcagcaccaagccagatgaggagcccctgtacatgaacctgcagaagctgctggagatggtgagagaagatgcccggaggacagtgaccattgaaaatggcatgcagaggaaggcccccagcatcctgtctgtgctgaagcagaacaagagcaacagcgcctacaaggagatgcagaccaccctgaagagcagcgagaggagcagcagcaccagcgctgagagccacatccagcctgtgcagaagaagagcaagaacagaaccaactgtgacatcaacatccactacaagagcggcgtgtgcaacaccatgagggccaagttctacagcgtggcccaggaggccggcttctgcctgcaggacaagatggagatcctgatgaagaggcaggaggagcggggcatccagaagttccgggcctttgtgctggtgagcaacttccagaaggacatcgccaagatgaggcaccacatctctgtggtgaagggagatgctgaggagattgctgaccactggtactttgacctgctgagcaagctgcctgaggacctgaagaacttccggcctgccaagaagatcctggtgaagctgcagaagtttggagagaacctggacctgcgcatccggccccacgtgctgctgaaggtgctgcaggacctgcgcatctgggagctgtgcagcccagacattgctgtggccatcgagtttgtgcgggagcacatcatccacatgccccaggaggactacatctcctggctgcagagccgcatcaacatccccatcggcccctacagcgccctgaggtag

SEQ ID NO: 37615 - DNA, 1692 bp, Artificial Sequence
  Description of Artificial Sequence: Synthetic coding sequence
atgtctgtgctgaagaagaacagaaggaaggacagcgacaccccccaggagcccagcgagaaggccaaggagcagcaggccgaggccgagctgaggaagctgcggcagcagttcaggaagatggtggagagcaggaagagcttcaagttcaggaaccagcagaagatcgccagccagtacaaggagatcaagaccctgaagacagagcaggatgagatcaccctgctgctgagcctgatgaagagcagcaggaacatgaacagaagtgagaagaactacatggagctgcggctgctgctgcagaccaaggaggactatgaggccctgatcaagagcctgaaggtgctgctggccgagctggatgagaagatcctgcagatggagaagaagatcgccaaccagaagcagatctttgccaagatgcaggaggccaacaaccccaggaagctgcagaagcagatccacatcctggagacccggctgaacctggtgacagtgcactttgacaagatgctgaccaccaatgccaagctgaggaaggagattgaggacctgcgctttgagaaggccgcctatgacaacgtgtaccagcagctgcagcactgcctgctgatggagaagaagaccatgaacctggccatcgagcagagcagccaggcctatgagcagagggtggaggccatggccaggatggccgccatgaaggaccggcagaagaaggacaccagccagtacaacctggagatccgggagctggagcggctgtatgcccacgagagcaagctgaagagcttcctgctggtgaagctgaatgacagaaatgaatttgaggagcaggccaagcgggaggaggccctgaaggccaagaagcacgtgaagaagaacagaggagagagctttgagagctatgaggtggcccacctgcggctgctgaagctggccgagagcggcaacctgaaccagctgattgaggacttcctggccaaggaggagaagaactttgcccgcttcacctacgtgacagagctgaacaatgacatggagatgatgcacaagaggacccagaggatccaggatgagatcatcctgctgcggagccagcagaagctgagccatgatgacaaccacagcgtgctgcggcagctggaggacaagctgaggaagaccacagaggaggccgacatgtatgagagcaagtacggggaggtgtccaagaccctggacctgctgaagaacagcgtggagaagctgttcaagaagatcaactgtgatgccaccaagatcctggtgcagctgggggagaccgggaaggtgacagacatcaacctgccccagtactttgccatcatcgagaagaagaccaatgacctgctgctgctggagacctaccgccgcatcctggaggtggagggcgctgaggccgagatccccccacccttcatcaaccccttctggggcggcagcgccctgctgaagcccccagagcccatcaaggtgattcctcctgtgctgggcgctgaccccttcagtgaccggctggatgatgtggagcagcccctggaccacagcagcctgcggcagctggtgctggacaactacatcctgaaggaaaatagaagcaaggaggtgcggggggacagcctgcctgagaaggtggatgacttccgcagcaggaagaaggtgaccatgtag

SEQ ID NO: 37616 - DNA, 1527 bp, Artificial Sequence
  Description of Artificial Sequence: Synthetic coding sequence
atgagcagcccagatggccccagcttccccagcggccccctgtctggaggagccagccccagcggagatgagggcttcttcccctttgtgctggagcggcgggacagcttcctgggcggcggccctggccctgaggagcctgaggacctggccctgcagctgcagcagaaggagaaggacctgctgctggccgctgagctgggcaagatgctgctggagagaaatgaggagctgcggcggcagctggagaccctgagcgcccagcacctggagcgggaggagcggctgcagcaggagaaccacgagctgcggcggggcctggccgcccggggagctgagtgggaggcccgggctgtggagctggagggagatgtggaggccctgcgggcccagctgggggagcagaggtctgagcagcaggacagcggccgggagcgggcccgggccctgtctgagctgtctgagcagaacctgcggctgagccagcagctggcccaggccagccagacagagcaggagctgcagcgggagctggatgccctgcggggccagtgccaggcccaggccctggccggggctgagctgcggacccggctggagagcctgcagggcgagaaccagatgctgcagagccggcggcaggacctggaggcccagatccggggcctgcgggaggaggtggagaagggggagggccgcctgcagaccacccatgaggagctgctgctgctgcggcgggagcggcgggagcacagcctggagctggagcgggcccggtctgaggccggggaggccctgagcgccctgcggcggctgcagaggagagtgtctgagctggaggaggagagccggctgcaggatgctgatgtgtctgctgccagcctgcagagcgagctggcccacagcctggatgatggagaccagggccagggcgcagatgcccctggggacacccccaccaccaggagccccaagaccaggaaggccagcagcccccagcccagccccccagaggagatcctggagccccccaagaagaggaccagcctgagccctgctgagatcctggaggagaaggaggtggaggtggccaagctgcaggatgagatcagcctgcagcaggccgagctgcagagcctgcgggaggagctgcagaggcagaaggagctgcgggcccaggaggaccccggggaggccctgcacagcgccctgagtgacagagatgaggccgtgaacaaggccctggagctgagcctgcagctgaacagagtgtccctggagcgggacagcctgagccgggagctgctgcgggccatccggcagaaggtggccctgacccaggagctggaggcctggcaggatgacatgcaggtggtgattggccagcagctgcggagccagaggcagaaggagctgagcgccagcgccagcagcagcaccccccggcgggccgccccccgcttcagcctgcggctgggccctggccctgctgggggcttcctgagcaacctcttccggaggacatag

SEQ ID NO: 37617 - DNA, 2745 bp, Artificial Sequence
  Description of Artificial Sequence: Synthetic coding sequence
atgggcaacaaggccaagatcgccaagtgccccctgcggaccaagacaggccacatcctgaagagcacccaggacacctgcatcggcagcgagaagctgctgcagaagaagcctgtgggcagcgagaccagccaggccaagggggagaagaatggcatgaccttcagcagcaccaaggacctgtgcaagcagtgcatcgacaaggactgcctgcacatccagaaggagatcagccctgccacccccaacatgcagaagaccaggaacacagtgaacaccagcctggtgggcaagcagaagccccacaagaagcacatcacagctgagaacatgaagagcagcctggtgtgcctgacccaggaccagctgcagcagatcctgatgacagtgaaccagggcaacagaagcctgagcctgacagaaaatggcaaggaggccaagagccagtacagcctgtacctgaacagcatcagcaaccagcccaaggatgagaacatcatgggcctcttcaagaagacagagatggtgtcctctgtgcctgctgagaacaagtctgtgctgaatgagcaccaggagaccagcaagcagtgtgagcagaagatcgccattgaaaatgagtggaagccagctgacatcttcagcaccctgggggagcgggagtgtgacaggagcagcctggaggccaagaaggcccagtggaggaaggagctggatgagcaggtggccctgaagaagaaggagaaggaggtgtctgagaagtggaatgacccctggaagaagtctgagagtgacaagatcatctgggagaagcaccagatcctggaccagagccgggagaccgtgctgctggagcaccccttctctgctgtgaagcaggagctgcagaggaagtggattgaggagctgaacaagcagattgaagatgaccggcagaggaagattgaggagaagatcatctacagcaagggggaggagcatgaccgctgggccatgcactttgacagcctgaagagctacccaggcagccagagccagctgttcagccagagcacccacaagcagcctgagtacttctgtgtgtccccagacacccaggagctggctgatgtgtcctctgtgtgcacccccaccaccggcagccaggtggagcccagcgaggaggagcacatcgccaagcccatcaaggatgtggtgatggccaacagcaagaagaccaacttcctgcgctccatgacagccctgctggaccctgcccagatcgaggagcgggacagaagacggcagaagcagctggagcaccagaaggccatcacagcccaggtggaggagaagaggaggaagaagcagctggaggaggagcagaggaagaaggaggagcaggaggaggagctgcggctggcccaggagcgggaggagatgcagaagcagtatgaggaggacatcctgaagcagaagcagaaggaggagatcatgaccctgaagaccaatgagctgttccagaccatgcagagggcccaggagctggcccagaggctgaagcaggagcagaggatccgggagctggcccagaagggccatgacaccagccgcctcatcaagaacctgggcgtggacaccatccagatggagtacaatgccagcaacatcagcaacagcagacatgacagtgatgagatcagcggcaagatgaacacctacatgaacagcaccaccagcaagaaggacaccggggtgcagacagatgacctgaacatcggcatcttcaccaatgctgagagccactgcggcagcctgatggagcgggacatcaccaactgcagcagccctgagatctctgctgagctgattggccagttcagcaccaagaagaacaagcaggagctgacccaggacaagggggccagcctggagaaggagaacaaccgctgcaatgaccagtgcaaccagttcaccagaattgagaagcagaccaagcacatgaagaagtaccccaagaggccagactggaacatcaacaagccacccaagcgctacatcccagccagcgagaagtaccccaagcagctgcagaagcagcgggaggagaagaaggtgcggcggcagatggagctgctgcacctggtggagaagaacaaccctggccacctgagccagaacagaggcatcagccctgagatcttccacagcagccaccaggagacagagagcaagctgcgctggcacctggtgaagaaggaggaggagcccctgaacatccacagcttcagcaaggagaggagccccagcagccctgtgcctgtggtgaagaacagaacccagcagacccagaacaccctgcacctgcccctgaagaacagcagctatgaaagagaaaatctcatcagcggcagcaaccagacagagctgagcagcggcatcagcgagagcagccacttcatcccctacgtgaggaccaatgagatctactacctggaccctgatgcccccctgagcggccccagcacccaggacccccagtaccagaacagccaggactgtggccagaagaggcagctgtttgacagcgactgtgtgcgggaccccctgctgaaccccaacatggtgaagaacagagaccggcagcaggccatcctgaagggcctgtctgagctgcggcagggcctgctgcagaagcagaaggagctggagagcagcctgctgcccctggccgagaaccaggaggagagctttggcagcagcttctag

SEQ ID NO: 37618 - DNA, 2847 bp, Artificial Sequence
  Description of Artificial Sequence: Synthetic coding sequence
atgaacctgggagatggcctgaagctggagacagagctgctggatggcaagaccaagctgatcctgagcccctatgagcacaagagcaagatctctgtgaagatgggcaacaaggccaagatcgccaagtgccccctgcggaccaagacaggccacatcctgaagagcacccaggacacctgcatcggcagcgagaagctgctgcagaagaagcctgtgggcagcgagaccagccaggccaagggggagaagaatggcatgaccttcagcagcaccaaggacctgtgcaagcagtgcatcgacaaggactgcctgcacatccagaaggagatcagccctgccacccccaacatgcagaagaccaggaacacagtgaacaccagcctggtgggcaagcagaagccccacaagaagcacatcacagctgagaacatgaagagcagcctggtgtgcctgacccaggaccagctgcagcagatcctgatgacagtgaaccagggcaacagaagcctgagcctgacagaaaatggcaaggaggccaagagccagtacagcctgtacctgaacagcatcagcaaccagcccaaggatgagaacatcatgggcctcttcaagaagacagagatggtgtcctctgtgcctgctgagaacaagtctgtgctgaatgagcaccaggagaccagcaagcagtgtgagcagaagatcgccattgaaaatgagtggaagccagctgacatcttcagcaccctgggggagcgggagtgtgacaggagcagcctggaggccaagaaggcccagtggaggaaggagctggatgagcaggtggccctgaagaagaaggagaaggaggtgtctgagaagtggaatgacccctggaagaagtctgagagtgacaagatcatctgggagaagcaccagatcctggaccagagccgggagaccgtgctgctggagcaccccttctctgctgtgaagcaggagctgcagaggaagtggattgaggagctgaacaagcagattgaagatgaccggcagaggaagattgaggagaagatcatctacagcaagggggaggagcatgaccgctgggccatgcactttgacagcctgaagagctacccaggcagccagagccagctgttcagccagagcacccacaagcagcctgagtacttctgtgtgtccccagacacccaggagctggctgatgtgtcctctgtgtgcacccccaccaccggcagccaggtggagcccagcgaggaggagcacatcgccaagcccatcaaggatgtggtgatggccaacagcaagaagaccaacttcctgcgctccatgacagccctgctggaccctgcccagatcgaggagcgggacagaagacggcagaagcagctggagcaccagaaggccatcacagcccaggtggaggagaagaggaggaagaagcagctggaggaggagcagaggaagaaggaggagcaggaggaggagctgcggctggcccaggagcgggaggagatgcagaagcagtatgaggaggacatcctgaagcagaagcagaaggaggagatcatgaccctgaagaccaatgagctgttccagaccatgcagagggcccaggagctggcccagaggctgaagcaggagcagaggatccgggagctggcccagaagggccatgacaccagccgcctcatcaagaacctgggcgtggacaccatccagatggagtacaatgccagcaacatcagcaacagcagacatgacagtgatgagatcagcggcaagatgaacacctacatgaacagcaccaccagcaagaaggacaccggggtgcagacagatgacctgaacatcggcatcttcaccaatgctgagagccactgcggcagcctgatggagcgggacatcaccaactgcagcagccctgagatctctgctgagctgattggccagttcagcaccaagaagaacaagcaggagctgacccaggacaagggggccagcctggagaaggagaacaaccgctgcaatgaccagtgcaaccagttcaccagaattgagaagcagaccaagcacatgaagaagtaccccaagaggccagactggaacatcaacaagccacccaagcgctacatcccagccagcgagaagtaccccaagcagctgcagaagcagcgggaggagaagaaggtgcggcggcagatggagctgctgcacctggtggagaagaacaaccctggccacctgagccagaacagaggcatcagccctgagatcttccacagcagccaccaggagacagagagcaagctgcgctggcacctggtgaagaaggaggaggagcccctgaacatccacagcttcagcaaggagaggagccccagcagccctgtgcctgtggtgaagaacagaacccagcagacccagaacaccctgcacctgcccctgaagaacagcagctatgaaagagaaaatctcatcagcggcagcaaccagacagagctgagcagcggcatcagcgagagcagccacttcatcccctacgtgaggaccaatgagatctactacctggaccctgatgcccccctgagcggccccagcacccaggacccccagtaccagaacagccaggactgtggccagaagaggcagctgtttgacagcgactgtgtgcgggaccccctgctgaaccccaacatggtgaagaacagagaccggcagcaggccatcctgaagggcctgtctgagctgcggcagggcctgctgcagaagcagaaggagctggagagcagcctgctgcccctggccgagaaccaggaggagagctttggcagcagcttctag

SEQ ID NO: 37619 - DNA, 2847 bp, Artificial Sequence
  Description of Artificial Sequence: Synthetic coding sequence
atggacctgctggatggcctgaagctggagacagagctgctggatggcaagaccaagctgatcctgagcccctatgagcacaagagcaagatctctgtgaagatgggcaacaaggccaagatcgccaagtgccccctgcggaccaagacaggccacatcctgaagagcacccaggacacctgcatcggcagcgagaagctgctgcagaagaagcctgtgggcagcgagaccagccaggccaagggggagaagaatggcatgaccttcagcagcaccaaggacctgtgcaagcagtgcatcgacaaggactgcctgcacatccagaaggagatcagccctgccacccccaacatgcagaagaccaggaacacagtgaacaccagcctggtgggcaagcagaagccccacaagaagcacatcacagctgagaacatgaagagcagcctggtgtgcctgacccaggaccagctgcagcagatcctgatgacagtgaaccagggcaacagaagcctgagcctgacagaaaatggcaaggaggccaagagccagtacagcctgtacctgaacagcatcagcaaccagcccaaggatgagaacatcatgggcctcttcaagaagacagagatggtgtcctctgtgcctgctgagaacaagtctgtgctgaatgagcaccaggagaccagcaagcagtgtgagcagaagatcgccattgaaaatgagtggaagccagctgacatcttcagcaccctgggggagcgggagtgtgacaggagcagcctggaggccaagaaggcccagtggaggaaggagctggatgagcaggtggccctgaagaagaaggagaaggaggtgtctgagaagtggaatgacccctggaagaagtctgagagtgacaagatcatctgggagaagcaccagatcctggaccagagccgggagaccgtgctgctggagcaccccttctctgctgtgaagcaggagctgcagaggaagtggattgaggagctgaacaagcagattgaagatgaccggcagaggaagattgaggagaagatcatctacagcaagggggaggagcatgaccgctgggccatgcactttgacagcctgaagagctacccaggcagccagagccagctgttcagccagagcacccacaagcagcctgagtacttctgtgtgtccccagacacccaggagctggctgatgtgtcctctgtgtgcacccccaccaccggcagccaggtggagcccagcgaggaggagcacatcgccaagcccatcaaggatgtggtgatggccaacagcaagaagaccaacttcctgcgctccatgacagccctgctggaccctgcccagatcgaggagcgggacagaagacggcagaagcagctggagcaccagaaggccatcacagcccaggtggaggagaagaggaggaagaagcagctggaggaggagcagaggaagaaggaggagcaggaggaggagctgcggctggcccaggagcgggaggagatgcagaagcagtatgaggaggacatcctgaagcagaagcagaaggaggagatcatgaccctgaagaccaatgagctgttccagaccatgcagagggcccaggagctggcccagaggctgaagcaggagcagaggatccgggagctggcccagaagggccatgacaccagccgcctcatcaagaacctgggcgtggacaccatccagatggagtacaatgccagcaacatcagcaacagcagacatgacagtgatgagatcagcggcaagatgaacacctacatgaacagcaccaccagcaagaaggacaccggggtgcagacagatgacctgaacatcggcatcttcaccaatgctgagagccactgcggcagcctgatggagcgggacatcaccaactgcagcagccctgagatctctgctgagctgattggccagttcagcaccaagaagaacaagcaggagctgacccaggacaagggggccagcctggagaaggagaacaaccgctgcaatgaccagtgcaaccagttcaccagaattgagaagcagaccaagcacatgaagaagtaccccaagaggccagactggaacatcaacaagccacccaagcgctacatcccagccagcgagaagtaccccaagcagctgcagaagcagcgggaggagaagaaggtgcggcggcagatggagctgctgcacctggtggagaagaacaaccctggccacctgagccagaacagaggcatcagccctgagatcttccacagcagccaccaggagacagagagcaagctgcgctggcacctggtgaagaaggaggaggagcccctgaacatccacagcttcagcaaggagaggagccccagcagccctgtgcctgtggtgaagaacagaacccagcagacccagaacaccctgcacctgcccctgaagaacagcagctatgaaagagaaaatctcatcagcggcagcaaccagacagagctgagcagcggcatcagcgagagcagccacttcatcccctacgtgaggaccaatgagatctactacctggaccctgatgcccccctgagcggccccagcacccaggacccccagtaccagaacagccaggactgtggccagaagaggcagctgtttgacagcgactgtgtgcgggaccccctgctgaaccccaacatggtgaagaacagagaccggcagcaggccatcctgaagggcctgtctgagctgcggcagggcctgctgcagaagcagaaggagctggagagcagcctgctgcccctggccgagaaccaggaggagagctttggcagcagcttctag

SEQ ID NO: 37620 - DNA, 864 bp, Artificial Sequence
  Description of Artificial Sequence: Synthetic coding sequence
atggacctgctggatggcctgaagctggagacagagctgctggatggcaagaccaagctgatcctgagcccctatgagcacaagagcaagatctctgtgaagatgggcaacaaggccaagatcgccaagtgccccctgcggaccaagacaggccacatcctgaagagcacccaggacacctgcatcggcagcgagaagctgctgcagaagaagcctgtgggcagcgagaccagccaggccaagggggagaagaatggcatgaccttcagcagcaccaaggacctgtgcaagcagtgcatcgacaaggactgcctgcacatccagaaggagatcagccctgccacccccaacatgcagaagaccaggaacacagtgaacaccagcctggtgggcaagcagaagccccacaagaagcacatcacagctgagaacatgaagagcagcctggtgtgcctgacccaggaccagctgcagcagatcctgatgacagtgaaccagggcaacagaagcctgagcctgacagaaaatggcaaggaggccaagagccagtacagcctgtacctgaacagcatcagcaaccagcccaaggatgagaacatcatgggcctcttcaagaagacagagatggtgtcctctgtgcctgctgagaacaagtctgtgctgaatgagcaccaggagaccagcaagcagtgtgagcagaagatcgccattgaaaatgagtggaagccagctgacatcttcagcaccctgggggagcgggagtgtgacaggagcagcctggaggccaagaaggcccagtggaggaaggagctggtgctgcagacagtgcaggcctggtaccagcacctgctgggcttctggtag

SEQ ID NO: 37621 - DNA, 1815 bp, Artificial Sequence
  Description of Artificial Sequence: Synthetic coding sequence
atggagaaccaggcccacaacaccatgggcaccagcccctgtgaggccgagctgcaggagctgatggagcagattgacatcatggtgagcaacaagaagatggactgggagaggaagatgagggccctggagacccggctggacctgcgggaccaggagctggccaatgcccagacctgcctggaccagaagggccaggaggtgggcctgctgcggcagaagctggacagcctggagaagtgcaacctggccatgacccagaactatgagggccagctgcagagcctgaaggcccagttcagcaagctgaccaacaactttgagaagctgcggctgcaccagatgaagcagaacaaggtgcccaggaaggagctgccccacctgaaggaggagatcccctttgagctgagcaacctgaaccagaagctggaggagttccgggccaagagccgggagtgggacaagcaggagatcctgtaccagacccacctgatcagcctggatgcccagcagaagctgctgtctgagaagtgcaaccagttccagaagcaggcccagagctaccagacccagctgaatggcaagaagcagtgcctggaggacagcagcagcgagatccccaggctcatctgtgaccctgaccccaactgtgagatcaatgaaagagatgagttcatcatcgagaagctgaagtctgctgtgaatgaaattgccctgagcaggaacaagctgcaggatgagaaccagaagctgctgcaggagctgaagatgtaccagaggcagtgccaggccatggaggccggcctgtctgaggtgaagtctgagctgcagagcagagatgacctgctgcgcatcatcgagatggagcggctgcagctgcaccgggagctgctgaagatcggggagtgccagaatgcccagggcaacaagacccggctggagagcagctacctgcccagcatcaaggagcctgagaggaagatcaaggagctgttctctgtgatgcaggaccagcccaaccacgagaaggagctgaacaagatccgcagccagctgcagcaggtggaggagtaccacaacagcgagcaggagaggatgagaaatgagatcagtgacctgacagaggagctgcaccagaaggagatcaccatcgccaccgtgaccaagaaggccgccctgctggagaagcagctgaagatggagctggagatcaaggagaagatgctggccaagcagaaggtgtctgacatgaagtacaaggctgtgaggacagagaacacccacctgaagggcatgatgggagacctggaccccggggagtacatgtccatggacttcaccaaccgggagcagagccgccacaccagcatcaacaagctgcagtatgaaaatgaaaggctgagaaatgacctggccaagctgcacgtgaatggcaagagcacctggaccaaccagaacacctatgaggagaccggccgctatgcctaccagagccagatcaaggtggagcagaatgaggagcggctgagccatgactgtgagcccaacagaagcaccatgccacccctgccccccagcaccttccaggccaaggagatgaccagccccctggtgtctgatgatgatgtgttccccctgagccccccagacatgtccttccctgccagcctggccgcccagcacttcctgctggaggaggagaagagggccaaggagctggagaagctgctgaacacccacattgatgagctgcagaggcacacagagttcaccctgaacaagtacagcaagctgaagcagaacagacacatctag

SEQ ID NO: 37622 - DNA, 990 bp, Artificial Sequence
  Description of Artificial Sequence: Synthetic coding sequence
atggagaaccaggcccacaacaccatgggcaccagcccctgtgaggccgagctgcaggagctgatggagcagattgacatcatggtgagcaacaagaagatggactgggagaggaagatgagggccctggagacccggctggacctgcgggaccaggagctggccaatgcccagacctgcctggaccagaagggccaggaggtgggcctgctgcggcagaagctggacagcctggagaagtgcaacctggccatgacccagaactatgagggccagctgcagagcctgaaggcccagttcagcaagctgaccaacaactttgagaagctgcggctgcaccagatgaagcagaacaaggtgcccaggaaggagctgccccacctgaaggaggagatcccctttgagctgagcaacctgaaccagaagctggaggagttccgggccaagagccgggagtgggacaagcaggagatcctgtaccagacccacctgatcagcctggatgcccagcagaagctgctgtctgagaagtgcaaccagttccagaagcaggcccagagctaccagacccagctgaatggcaagaagcagtgcctggaggacagcagcagcgagatccccaggctcatctgtgaccctgaccccaactgtgagatcaatgaaagagatgagttcatcatcgagaagctgaagtctgctgtgaatgaaattgccctgagcaggaacaagctgcaggatgagaaccagaagctgctgcaggagctgaagatgtaccagaggcagtgccaggccatggaggccggcctgtctgaggtgaagtctgagctgcagagcagagatgacctgctgcgcatcatcgagatggagcggctgcagctgcaccgggagctgctgaagatcggggagtgccagaatgcccagggcaacaagacccggctggagagcagctacctgcccagcatcaaggagcctgagaggaagatcaagtag

SEQ ID NO: 37623 - DNA, 1815 bp, Artificial Sequence; identical to SEQ ID NO: 37621
  Description of Artificial Sequence: Synthetic coding sequence

SEQ ID NO: 37624 - DNA, 1008 bp, Artificial Sequence
  Description of Artificial Sequence: Synthetic coding sequence
atgaccaccgtgacagtgaccacagagatccccccccgggacaagatggaggacaacagcgccctgtatgagagcaccagcgcccacatcatcgaggagacagaatatgtgaagaagatccgcaccaccctgcagaagatccgcacccagatgttcaaggatgagatcagacatgacagcaccaaccacaagctggatgccaagcactgcggcaacctgcagcagggcagtgacagcgagatggaccccagctgctgcagcctggacctgctgatgaagaagatcaagggcaaggacctgcagctgctggagatgaacaaggaaaatgaggtgctgaagatcaagctgcaggccagccgggaggccggggctgctgccctgagaaatgtggcccagaggctgtttgagaactaccagacccagagcgaggaggtgaggaagaagcaggaggacagcaagcagctgctgcaggtgaacaagctggagaaggagcagaagctgaagcagcacgtggagaacctgaaccaggtggccgagaagctggaggagaagcacagccagatcacagagctggagaacctggtgcagaggatggagaaggagaagaggaccctgctggagaggaagctgagcctggagaacaagctgctgcagctgaagagcagcgccacctacggcaagagctgccaggacctgcagcgggagatcagcatcctgcaggagcagatcagccacctgcagtttgtgatccacagccagcaccagaacctgcggagcgtcatccaggagatggagggcctgaagaacaacctgaaggagcaggacaagagaattgagaacctgcgggagaaggtgaacatcctggaggcccagaacaaggagctgaagacccaggtggccctgagcagcgagacccccaggaccaaggtgtccaaggctgtgtccaccagcgagctgaagacagaaggagtgagcccctacctgatgctgatccggctgaggaagtag

SEQ ID NO: 37625 - DNA, 1008 bp, Artificial Sequence; identical to SEQ ID NO: 37624
  Description of Artificial Sequence: Synthetic coding sequence

SEQ ID NO: 37626 - DNA, 1008 bp, Artificial Sequence; identical to SEQ ID NO: 37624
  Description of Artificial Sequence: Synthetic coding sequence

SEQ ID NO: 37627 - DNA, 891 bp, Artificial Sequence
  Description of Artificial Sequence: Synthetic coding sequence
atgggctgccgccacagccggctgagcagctgcaagccacccaagaagaagaggcaggagcctgagcctgagcagccccccaggcctgagccccatgagctgggccccctgaatggagacacagccatcaccgtgcagctgtgtgccagcgaggaggccgagcggcaccagaaggacatcacccgcatcctgcagcagcacgaggaggagaagaagaagtgggcccagcaggtggagaaggagcgggagctggagctgcgggaccggctggatgagcagcagagggtgctggagggcaagaatgaggaggccctgcaggtgctgcgggccagctatgagcaggagaaggaggccctgacccacagcttccgggaggccagcagcacccagcaggagaccatcgaccggctgaccagccagctggaggccttccaggccaagatgaagagggtggaggagagcatcctgagcaggaactacaagaagcacatccaggactatggcagccccagccagttctgggagcaggagctggagagcctgcactttgtgattgagatgaagaatgaaagaattcatgagctggacagaagactcatcctgatggagaccgtgaaggagaagaacctgatcctggaggagaagatcaccaccctgcagcaggagaatgaagacctgcacgtgcgcagcaggaaccaggtggtgctgagccggcagctgtctgaggacctgctgctgacccgggaggccctggagaaggaggtgcagctgcggcggcagctgcagcaggagaaggaggagctgctgtacagagtgctgggcgccaatgccagccctgccttccccctggcccctgtgacccccacagaggtgtccttcctggccacctag

SEQ ID NO: 37628 - DNA, 609 bp, Artificial Sequence
  Description of Artificial Sequence: Synthetic coding sequence
atgaggacctccatgtctgaggccgccacccgctggagctgccagggcagctgccagaagacctgcttcagccgggtgcggccctggaggcggcgctgcagctgtggggacagcagcagcagaagaagaagaagctgctgcaccggcagcctgggccccatgccccggctgcccagcctgtggcccctgagcctgcccctgcggagcctgagcagcccccaccgggtgcagggcctgggccccccccggcggctgaagagccagctgctgccccgcttcttctggaggcggcagcaggagcccctgagcagcttccctggaagaaatgaaggaggcagcgagatggagatcctgggcgtgtgccctgtgtcccctggggccctgagctacatggagagccccaccggcttctggaggccccgggaggccagcagcctggagctggccaagggcatcagcaagagaagacacttcctgcctgccccagccctgtgccccaaccccaggagcagcgaggccttccctggccagagcgtgagccgctggccctttgacatcaaggagacagcccctggccccagcctgagcgccctgctgcccacctgctag

SEQ ID NO: 37629 - DNA, 1461 bp, Artificial Sequence
  Description of Artificial Sequence: Synthetic coding sequence
atgaagcctgtgaagcacctgctgaccaccagcaacaagagcgccaacgtgcctgccctgaccaccaagaagggcctgcacaacctgcccctgagccctgagctgaaggagaagcacaatgccaagctgattcatgacaagattgagcccatggtgctgcggagcccccccaccggggagagcatcctgcgctatgccctgcccatccccagcagcaagaccaagaacctgctgcctgaagatgagatgattggcaagatcatcaagcacctgaagatggtggtgtccaccctggaggagacctacggccactgtgaccagaatggagaggagccctttgtgaagcatgagcacgaggagctgagcctgtctgtgggagatgacatgaacagcttcctgacctactgcagccagtttgctgcccagctggaggaggccctgaaggaggagcagaacatcctggagagcctcttcaagtggttccagtggcaggtgaaccagatggaggagatcagcaaggaccagaccctgctgcaggccgagccccccaagccagacaagacagtcatcctgaacattgctgagatcgtgcggctggtgcagagatttgaggagctgaagaaccggctgaagcagaggagcaagagctctgtgaaggtgatgctgagcaagaccatggacaaggaaaatagacctgaggccgtgaagagctgtgaggccctggcccagaagattgaggagttcctggaggcccacagcacagatgagttcaaggatgtgtctgccacagagccccagacagcccacagcatgaccaaccgcttcaatgccatgctgaaggtgtttgagaaccaggccaacatgctggagagagctgtgaatgaccaggtgctgctggatgctgagtacaagcagatgcagtgtgacttccagctgctgtctgaggagaagctggtgctggagaatgagctgcagaagctgaaggacaaggagaagaccaagcccaccaacaacagaaccaagaaggctgtgaagacagtgaagaagaaggacaagggcaagtctgaggacagcgagaagaagatgagccctgagaaggagttcaagatcaaggaggacctggaccaggtgcagaaggtggcccggctggagattgagaacaaggtgctgcaggagcagctgaagcaggccctgcaggaggccgagaaggccaagcaccagctgaactacttcctgaaccaggagaagctgctgaagtctgagggcaagacagagaccaccatgcaggtgggcaacagccagaccaaggtgaagggggaggacagcaagaacatccccctggagaaggagaccaggaagagcctggtgtctgattctgggggccagaggaccagtgacaagatccaggagtacccccagatcacagcccagagcggccgcctcatcgagaagcgctgctag

SEQ ID NO: 37630 - DNA, 840 bp, Artificial Sequence
  Description of Artificial Sequence: Synthetic coding sequence
atgaagcctgtgaagcacctgctgaccaccagcaacaagagcgccaacgtgcctgccctgaccaccaagaagggcctgcacaacctgcccctgagccctgagctgaaggagaagcacaatgccaagctgattcatgacaagattgagcccatggtgctgcggagcccccccaccggggagagcatcctgcgctatgccctgcccatccccagcagcaagaccaagaacctgctgcctgaagatgagatgattggcaagatcatcaagcacctgaagatggtggtgtccaccctggaggagacctacggccactgtgaccagaatggagaggagccctttgtgaagcatgagcacgaggagctgagcctgtctgtgggagatgacatgaacagcttcctgacctactgcagccagtttgctgcccagctggaggaggccctgaaggaggagcagaatgtgtgcatcctgtacatcctgagcatcttcctgaagtggttccagtggcaggtgaaccagatggaggagatcagcaaggaccagaccctgctgcaggccgagccccccaagccagacaagacagtcatcctgaacattgctgagatcgtgcggctggtgcagagatttgaggagctgaagaaccggctgaagcagaggagcaagagctctgtgaaggtgatgctgagcaagaccatggacaaggagaacagacctgaggccgtgaagagctgtgaggccctggcccagaagattgaggagttcctggaggcccacagcacagatgagttcaaggatgtgtctgccacagagcccaggaagttccccctcatcaaggccctgtag

SEQ ID NO: 37631 - DNA, 1461 bp, Artificial Sequence; identical to SEQ ID NO: 37629
  Description of Artificial Sequence: Synthetic coding sequence

SEQ ID NO: 37632 - DNA, 483 bp, Artificial Sequence
  Description of Artificial Sequence: Synthetic coding sequence
aagaccaagcccaccaacaacagaaccaagaaggctgtgaagacagtgaagaagaaggacaagggcaagtcagaagattctgagaagaagatgagccctgagaaggagttcaagatcaaggaggacctggaccaggtgcagaaggtggcccggctggagattgagaacaaggtgctgcaggagcagctgaagcaggccctgcaggaggccgagaaggccaagcaccagctgaactacttcctgaaccaggagaagctgctgaagtctgagggcaagacagagaccaccatgcaggtgggcaacagccagaccaaggtgaagggggaggacagcaagaacatccccctggagaaggagaccaggaagagcctggtgtctgacagcggcggccagaggaccagtgacaagatccaggagtacccccagatgctgattgagttcctgaagtactttgggaaggtgtcccagaccttccgggagtag

SEQ ID NO: 37633 - DNA, 516 bp, Artificial Sequence
  Description of Artificial Sequence: Synthetic coding sequence
atgaagcctgtgaagcacctgctgaccaccagcaacaagagcgccaacgtgcctgccctgaccaccaagaagggcctgcacaacctgcccctgagccctgagctgaaggagaagcacaatgccaagctgattcatgacaagattgagcccatggtgctgcggagcccccccaccggggagagcatcctgcgctatgccctgcccatccccagcagcaagaccaagaacctgctgcctgaagatgagatgattggcaagatcatcaagcacctgaagatggtggtgtccaccctggaggagacctacggccactgtgaccagaatggagaggagccctttgtgaagcatgagcacgaggagctgagcctgtctgtgggagatgacatgaacagcttcctgacctactgcagccagtttgctgcccagctggaggaggccctgaaggaggagcagaacatcctggagagcctcttcaagtggttccagtggcaggtgaaccagatggaggagggctag

SEQ ID NO: 37634 - DNA, 528 bp, Artificial Sequence
  Description of Artificial Sequence: Synthetic coding sequence
atgaagcctgtgaagcacctgctgaccaccagcaacaagagcgccaacgtgcctgccctgaccaccaagaagggcctgcacaacctgcccctgagccctgagctgaaggagaagcacaatgccaagctgattcatgacaagattgagcccatggtgctgcggagcccccccaccggggagagcatcctgcgctatgccctgcccatccccagcagcaagaccaagaacctgctgcctgaagatgagatgattggcaagatcatcaagcacctgaagatggtggtgtccaccctggaggagacctacggccactgtgaccagaatggagaggagccctttgtgaagcatgagcacgaggagctgagcctgtctgtgggagatgacatgaacagcttcctgacctactgcagccagtttgctgcccagctggaggaggccctgaaggaggagcagaacatcctggagagcctcttcaagtggttccagtggcaggtgaaccagatggaggagaagctgctgatccagtag

SEQ ID NO: 37635 - DNA, 522 bp, Artificial Sequence
  Description of Artificial Sequence: Synthetic coding sequence
atgaagcctgtgaagcacctgctgaccaccagcaacaagagcgccaacgtgcctgccctgaccaccaagaagggcctgcacaacctgcccctgagccctgagctgaaggagaagcacaatgccaagctgattcatgacaagattgagcccatggtgctgcggagcccccccaccggggagagcatcctgcgctatgccctgcccatccccagcagcaagaccaagaacctgctgcctgaagatgagatgattggcaagatcatcaagcacctgaagatggtggtgtccaccctggaggagacctacggccactgtgaccagaatggagaggagccctttgtgaagcatgagcacgaggagctgagcctgtctgtgggagatgacatgaacagcttcctgacctactgcagccagtttgctgcccagctggaggaggccctgaaggaggagcagaacatcctggagagcctcttcaagtggttccagtggcaggtgaaccagatggaggagagctgcaagtag

SEQ ID NO: 37636 - DNA, 516 bp, Artificial Sequence; identical to SEQ ID NO: 37633
  Description of Artificial Sequence: Synthetic coding sequence

SEQ ID NO: 37637 - DNA, 1404 bp, Artificial Sequence
  Description of Artificial Sequence: Synthetic coding sequence
atgtctgtggtggtgcagcacgtggaggagaaggctgtgcacagctggagccgcatcagcacagctgggaagaaggccctggaggaggccctgctggtgttcaaccccatgagccaggacctgagcgccacagaggcccagctggtggccttcctgcagggcctgagagatgatggcttccagcccaccatcctgcggtctggagatgtgtatggctacagcagctgcacagccaacccccccagccagaccaagctgcaggcccgggcccccaaccccacagccaccagccccccagccagcgcccccaggacagccatgaggctgcctgctggccgggccaccctgctgcccatgcccctgagcggccgcctggccaaggccagcaccccagccctggccaagcacgccaccaccaacctgctgctgagcagcctgaagcagagcagcgccagccacgcccggggagctgctgtgggcttccccacccacctgtacccaggagtgtacccagccatgaggctgtctgtggtgctggaggccctggtgcccctgaagacccccatgccctgcctgggcgccaagcacaaggcccagagcctgcagctgagcctggccgacagccccctgaagctgaggaagagcagcggcaagggccctggcaacccccggcccaaggcccccaggaagaccaccagcaagggccccaagtgcctgaccaggaagggccctggggccggcccccggcggggcagcggccaccagagcaagaccaacagagccaccggcagccccagcgtgcggaggatgaagggcggcagcgccctgggcaccaagacagcccaggccaaggtggcccggaccctggccaaggccgcccgggcccaggccaaggtggcccggacccaggccaaggccgccaaggcccgggccaaggccaaggccgcccaggtgaaggccaaggccaaggccaaggccgcccaggtgaaggccaaggccaaggtgatggccgcctgggccaaggccaaggccaaggccaaggctgtgcgggccaaggccaaggtggcccggacccagccccggggccggggccggcccaagggcagcgccaaggcccggaccaccaggaagggccagaagaacagacctgagaccgtgggccagaagaggaagagagctgaggaggccaaggacctgccccccaagaagaggacccggctgggccccaggagccccaaggcctggctgggccctggaacagccaagctgctgaagttccgggccatcaaggtggacagaagaagcagtgatgatgaggtgcggcagagggcccagaggatcctgcgggtgaacctgagccctgtgatccggctgcagcccctgctgccctacagcgctgtgtag

SEQ ID NO: 37638 - DNA, 708 bp, Artificial Sequence
  Description of Artificial Sequence: Synthetic coding sequence
atgaggaggtccatgaagagaagaagaagaagaagacctgtggccccagccacagctgcccggggcggggacttccgggcagaagatggagctggcctggaggcccgggaggagaaggtggtgtacagccgcagccagctgagcctggccgacagcaccaaggccctgggagatgccttcaagctgttcatgcccaggagcacagagttcatgagcagtgatgctgagctgtggagcttcctgtgcagcctgaagcaccagttcagcccccacatcctgcggagcaaggatgtgtatggctacagcagctgccgggccctggtgcctgaccccccaggccccccaacagcccggggccaggcccggcggcctgtgcccagggctgctgccaggagaagaagaagaggagcccgggctgctgctgcccggcggaggaagcccaggcctcctcctcctcctcctcctcctcctgaggagagctgcccagccaagcctgtggcccctggcccctgcttcggcggccgcaccctggaggagatctggagggctgccacccccaccctgaccaccttccccaccatccgggtgggcagtgatgtgtggggcgagaggagcctggccgccgccaggagaagagcccggcaggtgctgcgggtgaacctggagcccatggtgcggctgcggcgcttccctgtgccccgggcctag

SEQ ID NO: 37639 - DNA, 195 bp, Artificial Sequence
  Description of Artificial Sequence: Synthetic coding sequence
atgagcggccgggagggcggcaagaagaagcccctgaagcagcccaagaagcaggccaaggagatggatgaggaggacaaggccttcaagcagaagcagaaggaggagcagaagaagctggaggagctgaaggccaaggccgccggcaagggccccctggccactggaggcatcaagaagagcggcaagaagtag

SEQ ID NO: 37640 - DNA, 1137 bp, Artificial Sequence
  Description of Artificial Sequence: Synthetic coding sequence
atgtctggggccggcgtggccgccggcacccggccccccagcagccccaccccaggcagcagaagaagacggcagaggcccagcgtgggcgtgcagagcctgcggccccagagcccccagctgcggcagagcgacccccagaagaggaacctggacctggagaagagcctgcagttcctgcagcagcagcacagcgagatgctggccaagctgcacgaggagattgagcacctgaagcgggagaacaaggacctgcactacaagctgatcatgaaccagaccagccagaagaaggatggccccagcggcaaccacctgagccgggccagcgcccccctgggcgcccgctgggtgtgcatcaatggagtgtgggtggagcccggcggccccagccctgcccggctgaaggagggcagcagcaggacccacaggcctgggggcaagaggggccgcctggccggcggcagcgctgacacagtgcgcagccctgctgacagcctgtccatgagcagcttccagagcgtgaagagcatcagcaacagcggcaaggcccggccccagcccggcagcttcaacaagcaggacagcaaggcagatgtgtcccagaaggctgacctggaggaggagcccctgctgcacaacagcaagctggacaaggtgcctggggtgcagggccaggccaggaaggagaaggccgaggccagcaatgctggggccgcctgcatgggcaacagccagcaccagggccggcagatgggcgctggggcccacccccccatgatcctgcccctgcccctgaggaagcccaccaccctgcggcagtgtgaggtgctgatccgggagctgtggaacaccaacctgctgcagacccaggagctgcggcacctgaagagcctgctggagggcagccagaggccccaggccgcccctgaggaggccagcttcccccgggaccaggaggccacccacttccccaaggtgtccaccaagagcctgagcaagaagtgcctgagcccccctgtggccgagcgggccatcctgcctgccctgaagcagacccccaagaacaactttgctgagcggcagaagaggctgcaggccatgcagaagaggcggctgcacaggtctgtgctgtag

SEQ ID NO: 37641 - DNA, 993 bp, Artificial Sequence
  Description of Artificial Sequence: Synthetic coding sequence
atgggcaggaacccctgggacagcccctgcccagcccggagcctgccccagattgctgctgtggcccggccccgcatcagcagccccatggccctgagcccccacatgctgggcgcccagggcctgtggacccacagcatccagggcagcctgcctgccatctgggccgccaccatgggcaccaagggcggcagccgggtgctcttcccctgccacctgagcaaggccctgccccacccagacagcggcccccacccagcccaggaccccggcctgtggagccaggcccacttccccctgagcctgggcctgggcctgaccagcggcggccacctgactggaggctggagccagcccggcaacattgctgctggagctgtgccccgggccctgcccagccagggcgacatggagaagggcgtggagggcggccccttccccagccgctgtggcaacagcagcgagctgttctgggccaagtgtggccccagccggcagccccagccctgcagcgctggagatgctgacaggacccgggaggaggccatgctgagcctgggcacctgctgcagcatgtgccccaagcccagctgcttcccagatggccccagcggcaaccacctgagccgggccagcgcccccctgggcgcccgctgggtgtgcatcaatggagtgtgggtggagcccggcggccccagccctgcccggctgaaggagggcagcagcaggacccacaggcctgggggcaagaggggccgcctggccggcggcagcgctgacacagtgcgcagccctgctgacagcctgtccatgagcagcttccagagcgtgaagagcatcagcaacagcggcaaggcccggccccagcccggcagcttcaacaagcaggacagcaaggcagatgtgtcccagaaggctgacctggaggaggagcccctgctgcacaacagcaagctggacaaggtgcctggggtgcagggccaggccaggtag

SEQ ID NO: 37642 - DNA, 939 bp, Artificial Sequence
  Description of Artificial Sequence: Synthetic coding sequence
atgtctggggccggcgtggccgccggcacccggccccccagcagccccaccccaggcagcagaagaagacggcagaggcccagcgtgggcgtgcagagcctgcggccccagagcccccagctgcggcagagcgacccccagaagaggaacctggacctggagaagagcctgcagttcctgcagcagcagcacagcgagatgctggccaagctgcacgaggagattgagcacctgaagcgggagaacaaggacctgcactacaagctgatcatgaaccagaccagccagaagaaggacagcctgtccatgagcagcttccagagcgtgaagagcatcagcaacagcggcaaggcccggccccagcccggcagcttcaacaagcaggacagcaaggcagatgtgtcccagaaggctgacctggaggaggagcccctgctgcacaacagcaagctggacaaggtgcctggggtgcagggccaggccaggaaggagaaggccgaggccagcaatgctggggccgcctgcatgggcaacagccagcaccagggccggcagatgggcgctggggcccacccccccatgatcctgcccctgcccctgaggaagcccaccaccctgcggcagtgtgaggtgctgatccgggagctgtggaacaccaacctgctgcagacccaggagctgcggcacctgaagagcctgctggagggcagccagaggccccaggccgcccctgaggaggccagcttcccccgggaccaggaggccacccacttccccaaggtgtccaccaagagcctgagcaagaagtgcctgagcccccctgtggccgagcgggccatcctgcctgccctgaagcagacccccaagaacaactttgctgagcggcagaagaggctgcaggccatgcagaagaggcggctgcacaggtctgtgctgtag

SEQ ID NO: 37643 - DNA, 1143 bp, Artificial Sequence
  Description of Artificial Sequence: Synthetic coding sequence
atgtctggggccggcgtggccgccggcacccggccccccagcagccccaccccaggcagcagaagaagacggcagaggcccagcgtgggcgtgcagagcctgcggccccagagcccccagctgcggcagagcgacccccagaagaggaacctggacctggagaagagcctgcagttcctgcagcagcagcacagcgagatgctggccaagctgcacgaggagattgagcacctgaagcgggagaacaaggacctgcgctacaagctgatcatgaaccagaccagccagaagaaggatggccccagcggcaaccacctgagccgggccagcgcccccctgggcgcccgctgggtgtgcatcaatggagtgtgggtggagcccggcggccccagccctgcccggctgaaggagggcagcagcaggacccacaggcctgggggcaagcacggccgcctggccggcggcagcgctgacacagtgcgcagccctgctgacagcctgagcaccagcagcttccagagcgtgaagagcatcagcaacagcggcaaggcccggccccagcccggcagcttcaacaagcaggacagcaaggcagatgtgccccagaaggctgacctggaggaggagcccctgctgcacaacagcaagctggacaaggtgcctggggtgcagggccaggccaggaaggagaaggccgaggccagcaatgctggggccgcctgcatgggcaacagccagcaccagggccggcagatgggcgctgctgcccacccccccatgatcctgcccctgcccctgaggaagcccaccaccctgcggcagtgtgaggtgctgatccgggagctgtggaacaccaacctgctgcagacccaggagctgcagcacctgaagagcctgctggagggcagccagaggccccaggccgtgcctgaggaggccagcttcccccgggaccaggaggccacccacttccccaaggtgtccaccaagagcctgagcaagaagtgcctgctgctgagcccccctgtggccgagcgggccatcctgcctgccctgaagcagacccccaagaacaactttgctgagcggcagaagaggctgcaggccatgcagaagaggcggctgcacaggtctgtgctgtag

SEQ ID NO: 37644 - DNA, 1449 bp, Artificial Sequence
  Description of Artificial Sequence: Synthetic coding sequence
atgggcaggaacccctgggacagcccctgcccagcccggagcctgccccagattgctgctgtggcccggccccgcatcagcagccccatggccctgagcccagacatgctgggcgcccagggcctgtggacccacagcatccagggcagcctgcctgccatctgggccgccaccatgggcaccaagggcggcagccgggtgctcttcccctgccacctgagcaaggccctgccccacccagacagcggcccccacccagcccaggacagcggcctgtggagccgggcccacttccccctgagcctgggcctgggcctgaccagcggcggccacctgactggaggctggagccagcccggcaacatcgtggccggggctgtgccccgggccctgcccagccagagggacatggagaatggagtggagggcggccccttccccagccgctgtggcaacagcagcgagctgttctgggccaagtgtggccccagccggcagccccagccctgcagcgctggagatgctgacaggacccgggaggaggccatgctgagcctgggcacctgctgcagcatgtgccccaagcccagctgcttcccagatggccccagcggcaaccacctgagccgggccagcgcccccctgggcgcccgctgggtgtgcatcaatggagtgtgggtggagcccggcggccccagccctgcccggctgaaggagggcagcagcaggacccacaggcctgggggcaagcacggccgcctggccggcggcagcgctgacacagtgcgcagccctgctgacagcctgagcaccagcagcttccagagcgtgaagagcatcagcaacagcggcaaggcccggccccagcccggcagcttcaacaagcaggacagcaaggcagatgtgccccagaaggctgacctggaggaggagcccctgctgcacaacagcaagctggacaaggtgcctggggtgcagggccaggccaggaaggagaaggccgaggccagcaatgctggggccgcctgcatgggcaacagccagcaccagggccggcagatgggcgctgctgcccacccccccatgatcctgcccctgcccctgaggaagcccaccaccctgcggcagtgtgaggtgctgatccgggagctgtggaacaccaacctgctgcagacccaggagctgcagcacctgaagagcctgctggagggcagccagaggccccaggccgtgcctgaggaggccagcttcccccgggaccaggaggccacccacttccccaaggtgtccaccaagagcctgagcaagaagtgcctgctgctgagcccccctgtggccgagcgggccatcctgcctgccctgaagcagacccccaagaacaactttgctgagcggcagaagaggctgcaggccatgcagaagaggcggctgcacaggtctgtgctgtag

SEQ ID NO: 37645 - DNA, 945 bp, Artificial Sequence
  Description of Artificial Sequence: Synthetic coding sequence
atgtctggggccggcgtggccgccggcacccggccccccagcagccccaccccaggcagcagaagaagacggcagaggcccagcgtgggcgtgcagagcctgcggccccagagcccccagctgcggcagagcgacccccagaagaggaacctggacctggagaagagcctgcagttcctgcagcagcagcacagcgagatgctggccaagctgcacgaggagattgagcacctgaagcgggagaacaaggacctgcgctacaagctgatcatgaaccagaccagccagaagaaggacagcctgagcaccagcagcttccagagcgtgaagagcatcagcaacagcggcaaggcccggccccagcccggcagcttcaacaagcaggacagcaaggcagatgtgccccagaaggctgacctggaggaggagcccctgctgcacaacagcaagctggacaaggtgcctggggtgcagggccaggccaggaaggagaaggccgaggccagcaatgctggggccgcctgcatgggcaacagccagcaccagggccggcagatgggcgctgctgcccacccccccatgatcctgcccctgcccctgaggaagcccaccaccctgcggcagtgtgaggtgctgatccgggagctgtggaacaccaacctgctgcagacccaggagctgcagcacctgaagagcctgctggagggcagccagaggccccaggccgtgcctgaggaggccagcttcccccgggaccaggaggccacccacttccccaaggtgtccaccaagagcctgagcaagaagtgcctgctgctgagcccccctgtggccgagcgggccatcctgcctgccctgaagcagacccccaagaacaactttgctgagcggcagaagaggctgcaggccatgcagaagaggcggctgcacaggtctgtgctgtag

SEQ ID NO: 37646 - DNA, 618 bp, Artificial Sequence
  Description of Artificial Sequence: Synthetic coding sequence
tgaagcggggccggcgtggccgccggcacccggccccccagcagccccaccccaggcagcagaagaagacggcagaggcccagcgtgggcgtgcagagcctgcggccccagagcccccagctgcggcagagcgacccccagaagaggaacctggacctggagaagagcctgcagttcctgcagcagcagcacagcgagatgctggccaagctgcacgaggagattgagcacctgaagagagaaaataaaggagagcccgcccggggccccaggcctgccctgcccccccaggcccacagcaccctgcccctgccccagcacaggaacacagccatcaacagcagcacccggctgggcagcggcggcacccaggatgacctgcgctacaagctgatcatgaaccagaccagccagaagaaggatggccccagcggcaaccacctgagccgggccagcgcccccctgggcgcccgctgggtgtgcatcaatggagtgtgggtggagcccggcggccccagccctgcccggctgaaggagggcagcagcaggacccacaggcctgggggcaagcacggccgcctggccggcggcagcgctgacacagtgcgcagcccctag

SEQ ID NO: 37647 - DNA, 471 bp, Artificial Sequence
  Description of Artificial Sequence: Synthetic coding sequence
atgagcaggaagtctggaattggacatgaggccagcctgaagaggaaggccgaggagaagctggagagctacaggaagaagatccacatgaagaaccaggccgaggagaaggctgctgagcagttcaggatgaggctgaagaacaagcaggatgagatgaagctggagggggacctgcggcgcagccagagggcctgccagcagctggatgtgcagaagaacatccaggtgccccgggaggcctggtactggctgcggctggaggaggagacagaagaagatgaggaggagaaggagcaggatgaagatgagtacaagtctgaggacctgtctgtgctggagaagctgcagatcctgaccagctacctgcgggaggagcacctgtactgcatctggtgtggcacagcctatgaggacaaggaggacctgagcagcaactgccccggccccaccagcgctgaccatgactag

SEQ ID NO: 37648 - DNA, 780 bp, Artificial Sequence
  Description of Artificial Sequence: Synthetic coding sequence
atggccgaggaggaggactacatgtctgacagcttcatcaacgtgcaggaggacatccggcccggcctgcccatgctgcggcagatccgggaggcccggaggaaggaggagaagcagcaggaggccaacctgaagaaccggcagaagagcctgaaggaggaggagcaggagcggcgggacatcggcctgaagaatgccctgggctgtgagaacaagggctttgccctgctgcagaagatgggctacaagagcggccaggccctgggcaagagcggcggcggcatcgtggagcccatccccctgaacatcaagacaggcaagagcggcatcggccacgaggccagcctgaagaggaaggccgaggagaagctggagagctacaggaagaagatccacatgaagaaccaggccgaggagaaggctgctgagcagttcaggatgaggctgaagaacaagcaggatgagatgaagctggagggggacctgcggcgcagccagagggcctgccagcagctggatgtgcagaagaacatccaggtgccccgggaggcctggtactggctgcggctggaggaggagacagaggaggatgaggaggagaaggagcaggatgaagatgagtacaagtctgaggacctgtctgtgctggagaagctgcagatcctgaccagctacctgcgggaggagcacctgtactgcatctggtgtggcacagcctatgaggacaaggaggacctgagcagcaactgccccggccccaccagcgctgaccatgactag

SEQ ID NO: 37649 - DNA, 393 bp, Artificial Sequence
  Description of Artificial Sequence: Synthetic coding sequence
atggtggtggccgccggcaagcgcttctgtggggagcacgccggggctgctgaggaggaggatgccaggaagaggatcctgtgccccctggaccccaagcacacagtgtatgaggaccagctggccaagcacctgaagaagtgcaacagccgggagaagcccaagccagacttctacatccaggacatcaatgccggcctgagagatgaaacagagatccctgagcagctggtgcccatcagcagcctgtctgaggagcagctggagaagctgatcaagaagctgaggaaggccagcgaggccctgcatgatgccctgaatgaccccaagaatggagacagcgccaccaagcacctgaagcagcaggtgtgcctgggctacagcaactactag

SEQ ID NO: 37650 - DNA, 1446 bp, Artificial Sequence
  Description of Artificial Sequence: Synthetic coding sequence
atggccaccagcgccaccagcccccacgcccctggcttccctgctgagggccgctgtggctactacgtggagaagaagaagcgcttctgcaggatggtggtggccgccggcaagcgcttctgtggggagcacgccggggctgctgaggaggaggatgccaggaagaggatcctgtgccccctggaccccaagcacacagtgtatgaggaccagctggccaagcacctgaagaagtgcaacagccgggagaagcccaagccagacttctacatccaggacatcaatgccggcctgagagatgaaacagagatccctgagcagctggtgcccatcagcagcctgtctgaggagcagctggagaagctgatcaagaagctgaggaaggccagcgagggcctgaacagcaccctgaaggaccacatcatgagccacccagccctgcatgatgccctgaatgaccccaagaatggagacagcgccaccaagcacctgaagcagcaggccagcatcctgggcaacatcgagaacctgaagctgctgggcccccggcgctgctttgtggagtttggagctgggaagggcaagctgagccactgggtggacatcgccctgaaggatgctgagaaggtgcacttcatcctggtggagaaggtgaccacccgcttcaaggtggatggcaagcacaggaagaagaacagcgtgtttgagcggctgcagattgacatccagcacctgtgcctgaacaagatccctgtgctgcgggaggagaagctgcctgtggtgggcatcggcaagcacctgtgtggcatggccacagacctggccctgcgctgcctggtggagacctacgccgccagctttgaggagagaaatgaggagcccctggccaagaggatcaagaatgacaagacagagaaggagatctacaccctggccaaggagggcaatgagaagaatgtgcctgagaagtggaaccctgtggccggcatcgtcatcgccctgtgctgccaccaccgctgtgactggaggcactacgtgggcaaggagtacttccgggccctgggcctgggcgctgtggagttccactacttccagaggatgagctcctgggccacctgtggcatgaggaagaccagcctggagaccagcaacagcaccaccaagaggcaggacaaccagaatgatgattctgaggagcatgatgatggcggctaccgcatcacagatgatggagctgactgcctgcccggcctgctgtctgtggaggagaagaagaagattggccacctgtgcaagctgctgattgaccagggccgcatccagtacctgcagcagaagggcttcagccctgccctgcagtactacacagaccccctggtgtccctggagaatgtgctgctgacagccctgcccaaccacagcagcagccctgagaccacagcctag

SEQ ID NO: 37651 - DNA, 330 bp, Artificial Sequence
  Description of Artificial Sequence: Synthetic coding sequence
atggccaccagcgccaccagcccccacgcccctggcttccctgctgagggccgctgtggctactacgtggagaagaagaagcgcttctgcaggatggtggtggccgccggcaagcgcttctgtggggagcacgccggggctgctgaggaggaggatgccaggaagaggatcctgtgccccctggaccccaagcacacagtgtatgaggaccagctggccaagcacctgaagaagtgcaacagccgggagaagcccaagccagacttctacatccaggacatcaatgccggcctgagagatgaaacagagatccctgagcagctggcctag

SEQ ID NO: 37652 - DNA, 1317 bp, Artificial Sequence
  Description of Artificial Sequence: Synthetic coding sequence
atggagcacgccgccaccaccggccccaggcctggcccccccagccggcgggtggagaatgtggtgctgcgggccaaggactggctgcccggggcccctgggggcacagctgtgtgggccaccagcctggaggccgaggtgcccccagacctggccctgaacaaggagcagcagctgcagatcagcaaggagctggtggacatccagatcaccacccaccacctgcacgagcagcatgaagctgagatcttccagctgaagtctgagatcctgcggctggagagccgggtgctggagctggagctgcggggagatggcaccagccagggctgtgctgtgcctgtggagagtgaccccaggcaccccagggctgctgcccaggagctgcggcacaaggcccaggtgcccggccacagtgatgaccaccgcttccaggtgcagcccaagaacaccatgaacccagaaaatgagcagcaccggctgggcagcggcctgcagggcgaggtgaagtgggccctggagcaccaggaggcccggcagcaggccctggtgaccagggtggccaccctgggccggcagctgcagggcgcccgggaggaggcccgggccgccggccagaggctggccacccaggccgtggtgctgtgcagctgccagggccagctgcggcaggccgaggccgagaatgcccggctgcagctgcagctgaagaagctgaaggatgaatatgtgctgcggctgcagcactgtgcctggcaggccgtggagcacgcagatggagctggccaggccccagccaccacagccctgcggaccttcctggaggccaccctggaggacatccgggccgcccacaggagccgggagcagcagctggcccgggccgcccggagctaccacaagaggctggtggacctgagcagaagacatgaggagctgctggtggcctaccgggcccctggcaacccccaggccatctttgatattgccagcctggacctggagcccctgcctgtgcccctggtgacagacttcagccaccgggaggaccagcacggcggccctggggccctgctgagcagccccaagaagaggcctgggggcgccagccagggcggcaccagcgagccccagggcctggatgctgcctcctgggcccagatccaccagaagctgcgggacttcagccgcagcacccagagctggaatggaagtggccacagctgctggagcggcccccgctggctgaagagcaacttcctgagctaccgcagcacctggaccagcacctgggccggcaccagcaccaagagctag

SEQ ID NO: 37653 - DNA, 864 bp, Artificial Sequence
  Description of Artificial Sequence: Synthetic coding sequence
atgcacagcgtggcccacccccaccctggggtgcccccctgggtgcctgccaccctcatcatcaccgggaagagaagaggagctgctgctgggggcgccggcctggagcacggcggcagcggccgggcccacctgcgggaggtgtctgctgagacctggaggacccggggcgtgggcgccggccgcctggtgactggacctgccctggccagcggccccccctgcagccagctgtacaacggccagggcagccccaggaccatctcctggggcctgggccacaccagggtgggcgtggccagcctgctgatgctggagagcctgagcggcctggccctgtggttcagccccccacctgctgccagccggcccccaggccctggcctgagcctgtacacagatggcagcaaggcctggggcgccccccaggagcacggcggggcccacgccagcctgacccacagccaggtgtccccacctggcagcggcaacctgacccagcacggccacgtgtgcccctgtgtgaccatgcctgccctgaagaccaccccacccttcctgagcccccaccggggcctggatgctgcctcctgggcccagatccaccagaagctgcgggacttcagccgcagcacccaggtgggcggcaagggctggccccggcccatcctgaccccctgccccagctcctggctgaccagcccctgccaggccgagctggagcgggagcgggcccagctgctggtgcgggccaccatggccgaggagcagctgtctgagctgcaggagtatgtggaccagcacctgggccgctgggccgagggcgccggctgtgacccccgggccctggtgtggctggagtag

SEQ ID NO: 37654 - DNA, 1527 bp, Artificial Sequence
  Description of Artificial Sequence: Synthetic coding sequence
atggagagcgaggacaccaagaagacccaggagatgaagacagacctgaacctgctgctggagtgcctgaagtaccagatggacaatgccttcagccagaaggaggccctggtgaccatccacagcatctgccagcagaacagcaatgcctctgtgtacttccgggagattggaggcctgatgtttgtgaagaacctggccaagagcagcgagcacagcatggtgaaggaggccgccctgtacaccctgggcgccatcgccgagaagaatgtgtactgccagcagaccctgtgcaccagcgagctgtttgaggacctgacctggttcctgagcaatgacagcaacatcaacctgaagaggatgtctgtgtatgtgatcctggtgctggtgagcaacaacagaacaggccagaccctggtgcgggagaccggctgcatcaccgtgctgagccgcctcttcagaactgtcatcagcaagcatgagctggacctgagtgacaagaatgtgttccagagctaccagctgtggagctctgtgtgcagcaccctgtgtgtgtgtgtgaacaacccccagaatgatgagaaccagatgttctgctgcagcctcttcccccacgccaatgagtggctgaagaactgcaccaccccagagatcatccggcccatctgcagcttcatcggcctgaccctggccaacaacacctacgtgcagaagtactttgtgtctgtgggcggcctggatgtgctgagccaggtgctgatgcagctggagagtgacagccatgagaccctgagcagcgccaagctggccgtggtggtgaccaagacagtggatgcctgcatcgctgacaaccccacctttggaattgtgctgagcaagtaccacatcgtgtccaagctgctggccctgctgctgcacgagagcctggacagcggggagaagttcagcatcatgctgaccctgggccactgcacagaggactgtgccgagaagctgagcctgagcctgggggagtacccctttgatgaaaatgagacccagcagctgaaggacatctctgtgaaggagaacaacctggaggagcactggaggaaggccaaggagatcctgcacagaattgagcagctggagcgggagggcaatgaggaggagatccagcgggagaactaccaggacaacatcagctccatgaacatcagcatccagaacacctggaagcacctgcacgccgacagaattggccggggcagcaaggccgaggatgaggacaagagccacagccggcagctgcagagctacaagagccacggcgtgatgagcaaggcctgcaccaatgatgaccagatgaagacccccctgaagagcgccaaccctgtgcacgcctgctaccgggagagcgagcagaacaagaccctgtacaaggccaagagcagctgcaaccagaacctgcacgaggagaccacctttgagaagaactttgtgtcccagagccgcagcatctacatcatgttccgctacaacaagtag

SEQ ID NO: 37655 - DNA, 2043 bp, Artificial Sequence
  Description of Artificial Sequence: Synthetic coding sequence
atggagagcgaggacaccaagaagacccaggagatgaagacagacctgaacctgctgctggagtgcctgaagtaccagatggacaatgccttcagccagaaggaggccctggtgaccatccacagcatctgccagcagaacagcaatgcctctgtgtacttccgggagattggaggcctgatgtttgtgaagaacctggccaagagcagcgagcacagcatggtgaaggaggccgccctgtacaccctgggcgccatcgccgagaagaatgtgtactgccagcagaccctgtgcaccagcgagctgtttgaggacctgacctggttcctgagcaatgacagcaacatcaacctgaagaggatgtctgtgtatgtgatcctggtgctggtgagcaacaacagaacaggccagaccctggtgcgggagaccggctgcatcaccgtgctgagccgcctcttcagaactgtcatcagcaagcatgagctggacctgagtgacaagaatgtgttccagagctaccagctgtggagctctgtgtgcagcaccctgtgtgtgtgtgtgaacaacccccagaatgatgagaaccagatgttctgctgcagcctcttcccccacgccaatgagtggctgaagaactgcaccaccccagagatcatccggcccatctgcagcttcatcggcctgaccctggccaacaacacctacgtgcagaagtactttgtgtctgtgggcggcctggatgtgctgagccaggtgctgatgcagctggagagtgacagccatgagaccctgagcagcgccaagctggccgtggtggtgaccaagacagtggatgcctgcatcgctgacaaccccacctttggaattgtgctgagcaagtaccacatcgtgtccaagctgctggccctgctgctgcacgagagcctggacagcggggagaagttcagcatcatgctgaccctgggccactgcacagaggactgtgaggagaaccagtatgacctcttcaagaacaacggcctgcccctgatgatccaggccctgacagagagccagaatgaggagctgaacaaggccgccacctttgtgctgcacaactgcaagaagatcacagagaagctgagcctgagcctgggggagtacccctttgatgaaaatgagacccagcagctgaaggacatctctgtgaaggagaacaacctggaggagcactggaggaaggccaaggagatcctgcacagaattgagcagctggagcgggagggcaatgaggaggagatccagcgggagaactaccaggacaacatcagctccatgaacatcagcatccagaacacctggaagcacctgcacgccgacagaattggccggggcagcaaggccgaggatgaggacaagagccacagccggcagctgcagagctacaagagccacggcgtgatgagcaaggcctgcaccaatgatgaccagatgaagacccccctgaagagcgccaaccctgtgcacgcctgctaccgggagagcgagcagaacaagaccctgtacaaggccaagagcagctgcaaccagaacctgcacgaggagaccacctttgagaagaactttgtgtcccagagccgctacagcctcatcatcgtgtgctgcatcgctgtggagaagagcctgaacagcaggaacttcagcaagctgctgcacagctgcccctaccagtgtgacagacacaaggtgattgtggaggctgaagatcgctacaagtctgagctgaggaagagcctcatctgcaacaagaagatcctgctgaccccaagaagacggcagaggctgagcaatgaaagcaccaccccaggcggcatcaagaagaggcgcatcaggaagaacttcacagaggaggaggtgaactacctgttcaatggagtgaagaagatgggcaaccactggaacagcatcctgtggagcttccccttccagcagggcaggaaggctgtggacctggcccacaagtaccacaagctgaccaagcaccccacctgtgccgccagctag

SEQ ID NO: 37656 - DNA, 2184 bp, Artificial Sequence
  Description of Artificial Sequence: Synthetic coding sequence
atggagagcgaggacaccaagaagacccaggagatgaagacagacctgaacctgctgctggagtgcctgaagtaccagatggacaatgccttcagccagaaggaggccctggtgaccatccacagcatctgccagcagaacagcaatgcctctgtgtacttccgggagattggaggcctgatgtttgtgaagaacctggccaagagcagcgagcacagcatggtgaaggaggccgccctgtacaccctgggcgccatcgccgagaagaatgtgtactgccagcagaccctgtgcaccagcgagctgtttgaggacctgacctggttcctgagcaatgacagcaacatcaacctgaagaggatgtctgtgtatgtgatcctggtgctggtgagcaacaacagaacaggccagaccctggtgcgggagaccggctgcatcaccgtgctgagccgcctcttcagaactgtcatcagcaagcatgagctggacctgagtgacaagaatgtgttccagagctaccagctgtggagctctgtgtgcagcaccctgtgtgtgtgtgtgaacaacccccagaatgatgagaaccagatgttctgctgcagcctcttcccccacgccaatgagtggctgaagaactgcaccaccccagagatcatccggcccatctgcagcttcatcggcctgaccctggccaacaacacctacgtgcagaagtactttgtgtctgtgggcggcctggatgtgctgagccaggtgctgatgcagctggagagtgacagccatgagaccctgagcagcgccaagctggccgtggtggtgaccaagacagtggatgcctgcatcgctgacaaccccacctttggaattgtgctgagcaagtaccacatcgtgtccaagctgctggccctgctgctgcacgagagcctggacagcggggagaagttcagcatcatgctgaccctgggccactgcacagaggactgtgaggagaaccagtatgacctcttcaagaacaacggcctgcccctgatgatccaggccctgacagagagccagaatgaggagctgaacaaggccgccacctttgtgctgcacaactgcaagaagatcacagagaagctgagcctgagcctgggggagtacccctttgatgaaaatgagacccagcagctgaaggacatctctgtgaaggagaacaacctggaggagcactggaggaaggccaaggagatcctgcacagaattgagcagctggagcgggagggcaatgaggaggagatccagcgggagaactaccaggacaacatcagctccatgaacatcagcatccagaacacctggaagcacctgcacgccgacagaattggccggggcagcaaggccgaggatgaggacaagagccacagccggcagctgcagagctacaagagccacggcgtgatgagcaaggcctgcaccaatgatgaccagatgaagacccccctgaagagcgccaaccctgtgcacgcctgctaccgggagagcgagcagaacaagaccctgtacaaggccaagagcagctgcaaccagaacctgcacgaggagaccacctttgagaagaactttgtgtcccagagcagtgaccacgtgttcaagcaccctgtgcacatcgccaagaacatcaagcagcagctgcctgtgacagaccccttcaccctgtgcagcgacatcatcaacaaggaggtggtgtccttcctggccacccccagctgcagcgagatgctgacctaccgctgcagcggctgcatcgctgtggagaagagcctgaacagcaggaacttcagcaagctgctgcacagctgcccctaccagtgtgacagacacaaggtgattgtggaggccgaggaccgctacaagtctgagctgaggaagagcctcatctgcaacaagaagatcctgctgaccccccggcggcggcagaggctgagcaatgaaagcaccacccctgggggcatcaagaagaggcgcatcaggaagaacttcacagaggaggaggtgaactacctgttcaacggggtgaagaagatgggcaaccactggaacagcatcctgtggagcttccccttccagcagggcaggaaggctgtggacctggcccacaagtaccacaagctgaccaagcaccccacctgtgccgccagctag

SEQ ID NO: 37657 - DNA, 1653 bp, Artificial Sequence
  Description of Artificial Sequence: Synthetic coding sequence
atggagagcgaggacaccaagaagacccaggagatgaagacagacctgaacctgctgctggagtgcctgaagtaccagatggacaatgccttcagccagaaggaggccctggtgaccatccacagcatctgccagcagaacagcaatgcctctgtgtacttccgggagattggaggcctgatgtttgtgaagaacctggccaagagcagcgagcacagcatggtgaaggaggccgccctgtacaccctgggcgccatcgccgagaagaatgtgtactgccagcagaccctgtgcaccagcgagctgtttgaggacctgacctggttcctgagcaatgacagcaacatcaacctgaagaggatgtctgtgtatgtgatcctggtgctggtgagcaacaacagaacaggccagaccctggtgcgggagaccggctgcatcaccgtgctgagccgcctcttcagaactgtcatcagcaagcatgagctggacctgagtgacaagaatgtgttccagagctaccagctgtggagctctgtgtgcagcaccctgtgtgtgtgtgtgaacaacccccagaatgatgagaaccagatgttctgctgcagcctcttcccccacgccaatgagtggctgaagaactgcaccaccccagagatcatccggcccatctgcagcttcatcggcctgaccctggccaacaacacctacgtgcagaagtactttgtgtctgtgggcggcctggatgtgctgagccaggtgctgatgcagctggagagtgacagccatgagaccctgagcagcgccaagctggccgtggtggtgaccaagacagtggatgcctgcatcgctgacaaccccacctttggaattgtgctgagcaagtaccacatcgtgtccaagctgctggccctgctgctgcacgagagcctggacagcggggagaagttcagcatcatgctgaccctgggccactgcacagaggactgtgaggagaaccagtatgacctcttcaagaacaacggcctgcccctgatgatccaggccctgacagagagccagaatgaggagctgaacaaggccgccacctttgtgctgcacaactgcaagaagatcacagagaagctgagcctgagcctgggggagtacccctttgatgaaaatgagacccagcagctgaaggacatctctgtgaaggagaacaacctggaggagcactggaggaaggccaaggagatcctgcacagaattgagcagctggagcgggagggcaatgaggaggagatccagcgggagaactaccaggacaacatcagctccatgaacatcagcatccagaacacctggaagcacctgcacgccgacagaattggccggggcagcaaggccgaggatgaggacaagagccacagccggcagctgcagagctacaagagccacggcgtgatgagcaaggcctgcaccaatgatgaccagatgaagacccccctgaagagcgccaaccctgtgcacgcctgctaccgggagagcgagcagaacaagaccctgtacaaggccaagagcagctgcaaccagaacctgcacgaggagaccacctttgagaagaactttgtgtcccagagccgcagcatctacatcatgttccgctacaacaagtag

SEQ ID NO: 37658 - DNA, 1164 bp, Artificial Sequence
  Description of Artificial Sequence: Synthetic coding sequence
atggagaacaagctgcccatggagaccctggtggaggagtgtggggagaaccgggagaggaagtgcaagctgaaggaccagagcgacaaggaggagggcacccgggacatcagcagccccaagaggctgcgggaccggcaggccctcttccctgccaaggtgaccaacgtgtccctgctggagaagtttgagaggtctgagagcggcggcaagatcatgaccccagagagcctgagctaccccagctgcctgaagcatgacagcgagatgaagccccagaccagccctgcctgccaggaccacaacaaggccggccagatgaagagcctggccacccgggagcagaaccagaagaatgctgcctacaacctgggcgtggccgaggccatccggaaccacaagaatgagaagccagagttctacaagagcttcctgtttgacaagaggcccctgagccctgccctgaatgccctgaagcaggaggagtacagccgcagcctgctgaagcagatggacaaccggcaggagaatgagatcaagcagaggcagtaccgggagctgatggaccggctggagcaggtgcagctgacagaggagctggccgcccagagggccaagttcctgaaggacaagatggaggagacccagtgctacaagagggccctggatgcccagatcaagaacaagcccagccggctgcccccatttgagccagacagcagcgagcccatctttgggaagaatgaaggagagctgatggtggagaagcagaagcgggagcagaactacatgaagcaccagctggaggccgccgccaaccacaagaggaaggccatcctgcaccagctggtggaccagaggcgggacctgcagatgctgcagaggacccagcgggagcacctggccgacagaacagctgagctggagcgggtgaacagagtgaaccagtgcctgcaggaggactgggagaggtctgctgccatgaagaagcagagggacctggaggacaaggcctttgagcgggccagtgacaagctgttcctgctggaccagtgtgagaagtaccgccgctgcaagcagtgccagaggaggaccagcaatgtgggggagagcaacctgtggcccctgaacaagttcctgcccggcagccggctgctggtgtag

SEQ ID NO: 37659 - DNA, 1689 bp, Artificial Sequence
  Description of Artificial Sequence: Synthetic coding sequence
atgctggacaccatcgcccgggccctgcaggacctgggccggcaggtgctgcccaccctgcccagcctgagccaggaggaggtgtccatcatctggggcaatgtgtctgaatttgtgcggcggcagctgaccctgcacaagggcgtgcagatcccagccttcggcaccttcaccttcatccggcagaagctggaggtgggcaacaacaagttcatcctgatccagaggcctgtgttcatcatggtggagaagctggtgcagatccacggcctgaagcagaacaagaggcctggcaccgtggacagcgtgctgagcagccgggaggccctgaggaagtggcccagctctgtgctggccttccccagaattgagctgaaggagatggagaacaagctgcccatggagaccctggtggaggagtgtggagaaaatcgggagaggaagtgcaagctgaaggaccagagcgacaaggaggagggcacccgggacatcagcagccccaagaggctgcgggaccggcaggccctcttccctgccaaggtgaccaacgtgtccctgctggagaagtttgagaggtctgagagcggcggcaagatcatgaccccagagagcctgagctaccccagctgcctgaagcatgattctgagatgaagccccagaccagccctgcctgccaggaccacaacaaggccggccaggagatgtgctacgtgtgcctgcagagggcccagaggaacagcctgctgtactacagcgaggagcggcggcgggagattgaagatgagcggctcatccagcagtaccagatgctgaaggaccaggaggccctcttccgccaccagatgaagagcctggccacccgggagcagaaccagaagaatgctgcctacaacctgggcgtggccgaggccatccggaaccacaagaatgagaagccagagttctacaagagcttcctgtttgacaagaggcccctgagccctgccctgaatgccctgaagcaggaggagtacagccgcagcctgctgaagcagatggacaaccggcaggagaatgagatcaagcagaggcagtaccgggagctgatggaccggctggagcaggtgcagctgacagaggagctggccgcccagagggccaagttcctgaaggacaagatggaggagacccagtgctacaagagggccctggatgcccagatcaagaacaagcccagccggctgcccccatttgagccagacagcagcgagcccatctttgggaagaatgaaggagagctgatggtggagaagcagaagcgggagcagaactacatgaagcaccagctggaggccgccgccaaccacaagaggaaggccatcctgcaccagctggtggaccagaggcgggacctgcagatgctgcagaggacccagcgggagcacctggccgacagaacagctgagctggagcgggtgaacagagtgaaccagtgcctgcaggaggactgggagaggtctgctgccatgaagaagcagagggacctggaggacaaggcctttgagcgggccagtgacaagctgttcctgctggaccagtgtgagaagtaccgccgctgcaagcagtgccagaggaggaccagcaatgtgggggagagcaacctgtggcccctgaacaagttcctgcccggcagccggctgctggtgtag

SEQ ID NO: 37660 - DNA, 1959 bp, Artificial Sequence
  Description of Artificial Sequence: Synthetic coding sequence
atgctggacaccatcgcccgggccctgcaggacctgggccggcaggtgctgcccaccctgcccagcctgagccaggaggaggtgtccatcatctggggcaatgtgtctgaatttgtgcggcggcagctgaccctgcacaagggcgtgcagatcccagccttcggcaccttcaccttcatccggcagaagctggaggtgggcaacaacaagttcatcctgatccagaggcctgtgttcatcatggtggagaagctggtgcagatccacggcctgaagcagaacaaggtgtacaccccaggagagatccccatcgtgcccctgaactttgtgatgatcagcctggagggccccttcaacagagatgtggtggagggctgtgtgaaggagaccctgctcttcctgagccgcagcatctccatgaagcagaatgtggagttcaccttcaagggcattggagtgctgatgatccgggacagcaaggtgaagatgaggttctacaaggacttcctgtgcaccatggatggcagcggggccctggccaaggccctggccaacagacctggcaccgtggacagcgtgctgagcagccgggaggccctgaggaagtggcccagctctgtgctggccttccccagaattgagctgaaggagatggagaacaagctgcccatggagaccctggtggaggagtgtggagaaaatcgggagaggaagtgcaagctgaaggaccagagcgacaaggaggagggcacccgggacatcagcagccccaagaggctgcgggaccggcaggccctcttccctgccaaggtgaccaacgtgtccctgctggagaagtttgagaggtctgagagcggcggcaagatcatgaccccagagagcctgagctaccccagctgcctgaagcatgattctgagatgaagccccagaccagccctgcctgccaggaccacaacaaggccggccaggagatgtgctacgtgtgcctgcagagggcccagaggaacagcctgctgtactacagcgaggagcggcggcgggagattgaagatgagcggctcatccagcagtaccagatgctgaaggaccaggaggccctcttccgccaccagatgaagagcctggccacccgggagcagaaccagaagaatgctgcctacaacctgggcgtggccgaggccatccggaaccacaagaatgagaagccagagttctacaagagcttcctgtttgacaagaggcccctgagccctgccctgaatgccctgaagcaggaggagtacagccgcagcctgctgaagcagatggacaaccggcaggagaatgagatcaagcagaggcagtaccgggagctgatggaccggctggagcaggtgcagctgacagaggagctggccgcccagagggccaagttcctgaaggacaagatggaggagacccagtgctacaagagggccctggatgcccagatcaagaacaagcccagccggctgcccccatttgagccagacagcagcgagcccatctttgggaagaatgaaggagagctgatggtggagaagcagaagcgggagcagaactacatgaagcaccagctggaggccgccgccaaccacaagaggaaggccatcctgcaccagctggtggaccagaggcgggacctgcagatgctgcagaggacccagcgggagcacctggccgacagaacagctgagctggagcgggtgaacagagtgaaccagtgcctgcaggaggactgggagaggtctgctgccatgaagaagcagagggacctggaggacaaggcctttgagcgggccagtgacaagctgttcctgctggaccagtgtgagaagtaccgccgctgcaagcagtgccagaggaggaccagcaatgtgggggagagcaacctgtggcccctgaacaagttcctgcccggcagccggctgctggtgtag

SEQ ID NO: 37661 - DNA, 1635 bp, Artificial Sequence
  Description of Artificial Sequence: Synthetic coding sequence
atgattcatgtgagaagacatgagaccaggaggaacagcaagagccacgtgcctgagcagaagagccgggtggactggaggaggaccaagaggagcagcatcagccagctgctggacagtgatgaggagctggacagcgaggagtttgacagtgatgaggagctggacagtgatgagagctttgaaaatgatgaggagctggacagcaacaagggccctgactgcaacaagaccccaggcagcgagcgggagctgaacctgagcaagatccagagcgagggcaatgacagcaagtgcctgatcaacagcggaaatggcagcacctatgaggaggagaccaacaagatcaagcacagaaatattgacctgcaggaccaggagaagcacctgagccaggaggacaatgacctgaacaagcagacaggccagatcattgaagatgaccaggagaagcacctgagccaggaggacaatgacctgaacaagcagacaggccagatcattgaagatgacctggaggaggaggacatcaagaggggcaagaggaagaggctgagctctgtgatgtgtgacagtgatgaaagtgatgacagcgacatcctggtgaggaaggtgggcgtgaagaggcccaggagagtggtggaggatgagggcagctctgtggagatggagcagaagaccccagagaagaccctggccgcccagaagcgggagaagctgcagaagctgaaggagctgagcaagcagaggagccggcagaggaggagcagcggccgggactttgaggacagcgagaaggagagctgccccagcagtgatgaggtggatgaggaggaggaggaggacaactatgaaagtgatgaagatggagatgactacatcattgatgactttgtggtgcaggatgaggagggagatgaggagaacaagaaccagcagggcgagaagctgaccaccagccagctgaagctggtgaagcagaacagcctgtacagcttcagtgaccactacacccactttgagcgggtggtgaaggccctgctgatcaatgccctggatgagagcttcctgggcaccctgtatgatggcacccggcagaagagctatgccaaggacatgctgaccagcctgcactacctggacaacagatttgtgcagccccggctggagagcctggtgagccgcagccgctggaaggagcagtacaaggagcgggtggagaactacagcaatgtgtccatccacctgaagaaccctgagaactgcagctgccaggcctgtggcctgcaccgctactgcaagtacagcgtgcacctgagcggggagctgtacaacaccaggaccatgcagattgacaacttcatgagccatgacaagcaggtgttcaccgtgggccgcatctgtgccagcaggacccgcatctaccacaagctgaagcacttcaagttcaagctgtaccaggagtgctgcaccatcgccatgacagaggaggtggaggatgagcaggtgaaggagaccgtggagcgcatcttccgccgcagcaaagaaaatggctggatcaaggagaagtatggccagctggaggagtacctgaactttgctgactacttccaggaggagaagtttgagctgtag

SEQ ID NO: 37662 - DNA, 1635 bp, Artificial Sequence; identical to SEQ ID NO: 37661
  Description of Artificial Sequence: Synthetic coding sequence

SEQ ID NO: 37663 - DNA, 93 bp, Artificial Sequence
  Description of Artificial Sequence: Synthetic coding sequence
atgattcatgtgagaagacatgagaccaggaggaacagcaagagccacgtgcctgagcagaagagccgggtggactggaggaggaccaagtag

SEQ ID NO: 37664 - DNA, 789 bp, Artificial Sequence
  Description of Artificial Sequence: Synthetic coding sequence
atgattcatgtgagaagacatgagaccaggaggaacagcaagagccacgtgcctgagcagaagagccgggtggactggaggaggaccaagaggagcagcatcagccagctgctggacagtgatgaggagctggacagcgaggagtttgacagtgatgaggagctggacagtgatgagagctttgaaaatgatgaggagctggacagcaacaagggccctgactgcaacaagaccccaggcagcgagcgggagctgaacctgagcaagatccagagcgagggcaatgacagcaagtgcctgatcaacagcggaaatggcagcacctatgaggaggagaccaacaagatcaagcacagaaatattgacctgcaggaccaggagaagcacctgagccaggaggacaatgacctgaacaagcagacaggccagatcattgaagatgaccaggagaagcacctgagccaggaggacaatgacctgaacaagcagacaggccagatcattgaagatgacctggaggaggaggacatcaagaggggcaagaggaagaggctgagctctgtgatgtgtgacagtgatgaaagtgatgacagcgacatcctggtgaggaaggtgggcgtgaagaggcccaggagagtggtggaggatgagggcagctctgtggagatggagcagaagaccccagagaagaccctggccgcccagaagcgggagaagctgcagaagctgaaggagctgagcaagcagaggagccggcagaggaggagcagcggccgggactttgaatag

SEQ ID NO: 37665 - DNA, 1635 bp, Artificial Sequence; identical to SEQ ID NO: 37661
  Description of Artificial Sequence: Synthetic coding sequence

SEQ ID NO: 37666 - DNA, 1335 bp, Artificial Sequence
  Description of Artificial Sequence: Synthetic coding sequence
atggagaacagcggcaaggccaacaagaaggacacccatgatggcccccccaaggagatcaagctgcccaccagcgaggccctgctggactaccagtgccagatcaaggaggatgctgtggagcagttcatgttccagatcaagaccctgaggaagaagaaccagaagtaccacgagaggaacagccggctgaaggaggagcagatctggcacatccgccacctgctgaaggagctgtctgaggagaaggccgagggcctgcctgtggtgaccagagaagatgtggaggaggccatgaaggagaagtggaagtttgagcgggaccaggagaagaacctgcgggacatgaggatgcagatcagcaatgctgagaagctgttcctggagaagctgtctgagaaggagtactgggaggagtacaagaatgtgggcagcgagagacatgccaagctgatcaccagcctgcagaatgacatcaacacagtgaaggaaaatgctgagaagatgtctgagcactacaagatcaccctggaggacaccaggaagaagatcatcaaggagaccctgctgcagctggaccagaagaaggagtgggccacccagaatgctgtgaagctgattgacaagggcagctacctggagatctgggagaatgactggctgaagaaggaggtggccatccacaggaaggaggtggaggagctgaagaatgccatccacgagctggaggccgagaacctggtgctgattgaccagctgagcaactgccgcctggtggacctgaagatcccccgctaccctgtgctgcacagctgccccaccagcaaccccaggcacctgctgctgctgcccctggagagctgcctgatcagcgcccggcgctgctggaggctgtacctgacccaggccgccggcctggaggtgcccccagaggagatgagcctggagctgcctgagacccacatcgaggagaagtctgagctgcagcccacagaggtggagagccgggacctgatgagcagcagtgatgagagcaccatcctgcacctgagccatgaaaattccattgaggacctgcagtatgtgaagattgacaaggaggagaacagcggcacagaatttggagacacagacatgaagtacctgctgtatgaagatgagaaggacttcaaggactatgtgaacctgggccccctgggcgtgaagctgatgtctgtggagagcaagaagatgcccatccacttccaggagaaggagatccctgtgaagctgtacaaggatgtgcgcagccctgagagccacatcacctacaagatgatgaagagcttcctgtag

SEQ ID NO: 37667 - DNA, 1242 bp, Artificial Sequence
  Description of Artificial Sequence: Synthetic coding sequence
atggagaacagcggcaaggccaacaagaaggacacccatgatggcccccccaaggagatcaagctgcccaccagcgaggccctgctggactaccagtgccagatcaaggaggatgctgtggagcagttcatgttccagatcaagaccctgaggaagaagaaccagaagtaccacgagaggaacagccggctgaaggaggagcagatctggcacatccgccacctgctgaaggagctgtctgaggagaaggccgagggcctgcctgtggtgaccagagaagatgtggaggaggccatgaaggagaagtggaagtttgagcgggaccaggagaagaacctgcgggacatgaggatgcagatcagcaatgctgagaagctgttcctggagaagctgtctgagaaggagtactgggaggagtacaagaatgtgggcagcgagagacatgccaagctgatcaccagcctgcagaatgacatcaacacagtgaaggaaaatgctgagaagatgtctgagcactacaagatcaccctggaggacaccaggaagaagatcatcaaggagaccctgctgcagctggaccagaagaaggagtgggccacccagaatgctgtgaagctgattgacaagggcagctacctggagatctgggagaatgactggctgaagaaggaggtggccatccacaggaaggaggtggaggagctgaagaatgccatccacgagctggaggccgagaacctggtgctgattgaccagctgagcaactgccgcctggtggacctgaagatcccccggcggctgtacctgacccaggccgccggcctggaggtgcccccagaggagatgagcctggagctgcctgagacccacatcgaggagaagtctgagctgcagcccacagaggtggagagccgggacctgatgagcagcagtgatgagagcaccatcctgcacctgagccatgagaacagcattgaggacctgcagtatgtgaagattgacaaggaggagaacagcggcacagaatttggagacacagacatgaagtacctgctgtatgaagatgagaaggacttcaaggactatgtgaacctgggccccctgggcgtgaagctgatgtctgtggagagcaagaagatgcccatccacttccaggagaaggagatccctgtgaagctgtacaaggatgtgcgcagccctgagagccacatcacctacaagatgatgaagagcttcctgtag

SEQ ID NO: 37668 - DNA, 942 bp, Artificial Sequence
  Description of Artificial Sequence: Synthetic coding sequence
atgttccagatcaagaccctgaggaagaagaaccagaagtaccatgaaagaaacagccggctgaaggaggagcagatctggcacatccgccacctgctgaaggagctgtctgaggagaaggccgagggcctgcctgtggtgacccgggaggatgtggaggaggccatgaaggagaagtggaagtttgagcgggaccaggagaagaacctgcgggagcactacaagatcaccctggaggacaccaggaagaagatcatcaaggagaccctgctgcagctggaccagaagaaggagtgggccacccagaatgctgtgaagctgattgacaagggcagctacctggagatctgggagaatgactggctgaagaaggaggtggccatccacaggaaggaggtggaggagctgaagaatgccatccacgagctggaggccgagaacctggtgctgattgaccagctgagcaactgccgcctggtggacctgaagatcccccggcggctgtacctgacccaggccgccggcctggaggtgcccccagaggagatgagcctggagctgcctgagacccacatcgagaagtctgagctgcagcccacagaggtggagagccgggacctgatgagcagcagtgatgagagcaccatcctgcacctgagccatgagaacagcattgaggacctgcagtatgtgaagattgacaaggaggagaacagcggcacagaatttggagacacagacatgaagtacctgctgtatgaagatgagaaggacttcaaggactatgtgaacctgggccccctgggcgtgaagctgatgtctgtggagagcaagaagatgcccatccacttccaggagaaggagatccctgtgaagctgtacaaggatgtgcgcagccctgagagccacatcacctacaagatgatgaagagcttcctgtag

SEQ ID NO: 37669 - DNA, 999 bp, Artificial Sequence
  Description of Artificial Sequence: Synthetic coding sequence
atggccccagcccagcgctgccccctgtgccggcagaccttcttctgtggccggggccacgtgtacagcaggaagcaccagaggcagctgaaggaggccctggagcggctgctgccccaggtggaggccgccaggaaggccatccgggccgcccaggtggagcgctacgtgcctgagcacgagcgctgctgctggtgcctgtgctgcggctgtgaggtgcgggagcacctgagccacggcaacctgactgtgctgtatggaggcctgctggagcacctggccagccctgagcacaagaaggccaccaacaagttctggtgggagaacaaggccgaggtgcagatgaaggagaagttcctggtgaccccccaggactatgcccgcttcaagaagtccatggtgaagggcctggacagctatgaggagaaggaggacaaggtgatcaaggagatggccgcccagatccgggaggtggagcagagccggcaggaggtggtgcgctctgtgctggagccccaggccgtgcctgaccctgaggagggcagcagcgcccccaggtcctggaagggcatgaacagccaggtggccagcagcctgcagcagcccagcaacctggacctgcccccagcccctgagctggactggatggagaccggccccagcctgaccttcatcggccaccaggacatccctggggtgggcaacatccacagcggggccaccccaccctggatgatccaggatgaggagtacatcgccggcaaccaggagatcggccccagctatgaggagttcctgaaggagaaggagaagcagaagctgaagaagctgcccccagacagagtgggcgccaactttgaccacagcagcaggaccagcgctggctggctgcccagctttggccgggtgtggaacaacggccgccgctggcagagccgccaccagttcaagacagaggccgccgccatgaagaagcagagccacacagagaagagctag

SEQ ID NO: 37670 - DNA, 1662 bp, Artificial Sequence
  Description of Artificial Sequence: Synthetic coding sequence
atgagcaaggctgctggaggagctgctgctgctgctgctgctgctgagagctgcagccctgccccagctggcagcagcgctgcccccccagcccctgtggaggacctgagcaaggtgtctgatgaggagctgctgcagtggagcaaggaggagctgatccgcagcctgcggcgggcagaggccgagaaggtgtctgccatgctggaccacagcaacctgatccgggaggtgaacagaaggctgcagctgcacctgggggagatccggggcctgaaggacatcaaccagaagctgcaggaggacaaccaggagctgcgggacctgtgctgcttcctggatgatgaccggcagaagggcaagagggtgtcccgggagtggcagaggctgggccgctacacagctggggtgatgcacaaggaggtggccctgtacctgcagaagctgaaggacctggaggtgaagcaggaggaggtggtgaaggagaacatggagctgaaggagctgtgtgtgctgctggatgaggagaagggggccggctgtgccggcagccgctgcagcattgacagccaggccagcctgtgccagctgacagccagcacagccccctacgtgagagatgtgggagatggcagcagcaccagcagcacaggcagcacagacagcccagaccaccacaagcaccacgccagcagcggcagccctgagcacctgcagaagcccaggtctgagggcagccctgagcacagcaagcacaggtctgccagccctgagcacccccagaagccccgggcctgtggcaccccagaccggcccaaggccctgaagggccccagccctgagcaccacaagcccctgtgcaagggcagccctgagcagcagaggcacccccaccctggcagcagccctgagaccctgcccaagcacgtgctgagcggcagccctgagcacttccagaagcacaggagcggcagcagccctgagcacgcccggcacagcggcggcagccctgagcacctgcagaagcacgccctgggcggcagcctggagcacctgccccgggcccggggcaccagccctgagcacctgaagcagcactacggcggcagcccagaccacaagcacggcggcggcagcggcggcagcggcggcagcggcggcggcagccgggagggcaccctgcggcggcaggcccaggaggatggcagcccccaccacagaaatgtgtacagcggcatgaatgaaagcaccctgtcctatgtgcggcagctggaggcccgggtgcggcagctggaggaggagaacaggatgctgccccaggccagccagaacagacggcagccccccaccaggaacagcagcaacatggagaagggctggggcagccgggcccggcgggtgctgcagtggtggcagggctgccggggcatcggccgctgcctgcccaccctgcccggcagcttccggctgagcagtggagcagatggcagcaacagcagccccaacagcgctgccagcttcagcggccacgccacccccagccagcagcctgagcctgtggtgcacagcctgaaggtggtgtggaggaagctgggagatgctgctggcagctgccccggcatccggcagcacctgagcggcaaccagtacaagggccccatgtag

SEQ ID NO: 37671 - DNA, 1260 bp, Artificial Sequence
  Description of Artificial Sequence: Synthetic coding sequence
atggccaagccagctgccacagctgctgctgccagcgaggagctgagccaggtgcctgatgaggagctgctgcgctggagcaaggaggagctggcccggcggctgcggcgggcagagggggagaaggtgggcctgatgctggagcacggcggcctgatgagagatgtgaacagaaggctgcagcagcacctgctggagatccggggcctgaaggatgtgaaccagaggctgcaggatgacaaccaggagctgcgggagctgtgctgcttcctggatgatgaccggcagaagggcaggaagctggcccgggagtggcagcgcttcggcagacatgctgctggagctgtgtggcatgaggtggcccggagccagcagaagctgcgggagctggaggcccggcaggaggccctgctgcgggagaacctggagctgaaggagctggtgctgctgctggatgaggagcgggccgccctggccgccactggagctgccagcggcggcggcggcggcggcggcggggccggcagccgcagcagcattgacagccaggccagcctgagcggccccctgtctggaggagcccctggagctggggccagagatgtgggagatggcagcagcaccagcagcgctggcagcggcggcagcccagaccaccaccaccacgtgcccccacccctgctgcccccaggcccccacaaggccccagatggcaaggccggggccacccggcgcagcctggatgacctgagcgccccaccccaccacaggagcatccccaacggcctgcatgaccccagcagcacctacatccggcagctggagagcaaggtgcggctgctggagggggacaagctgctggcccagcaggccggcagcggggagttccgcaccctgaggaagggcttcagcccctaccacagcgagagccagctggccagcctgccccccagctaccaggacagcctgcagaatggacctgcctgcccagcccctgagctgcccagccccccatctgctggctacagccctgctggccagaagccagaggccgtggtgcacgccatgaaggtgctggaggtgcatgagaacctggaccggcagctgcaggacagctgtgaggaggacctgtctgagaaggagaaggccatcgtgcgggagatgtgcaatgtggtgtggaggaagctgggagatgctgccagcagcaagcccagcatccggcagcacctgagcggcaaccagttcaagggccccctgtag

SEQ ID NO: 37672 - DNA, 2550 bp, Artificial Sequence
  Description of Artificial Sequence: Synthetic coding sequence
atgatggagccccccaagccagagcctgagctgcagcgcttctaccaccggctgctgcggcccctgagcctcttccccaccaggaccaccagccctgagccccagaagaggcctccccaggagggccgcatcctgcagagcttccccctggccaagctgactgtggccagcctgtgcagccaggtggccaagctgctggccggcagcggcattgctgctggggtgcccccagaggcccggctgcggctcatcaaggtgatcctggatgagctgaagtgctcctggagggagcccccagctgagctgagcctgagccacaagaacaaccagaagctgaggaagaggctggaggcctacgtgctgctgagcagcgagcagctgttcctgcgctacctgcacctgctggtgaccatgagcaccccccggggcgtcttcacagagagcgccaccctgacccggctggccgccagcctggcccgggactgcaccctcttcctgaccagccccaacgtgtaccggggcctgctggccgacttccaggccctgctgcgggcagagcaggccagcggagatgtggacaagctgcaccctgtgtgcccagctggcaccttcaagctgtgccccatcccctggccccacagcactggatttgcccaggtgcagtgcagcaacctgaacctgaactacctgatccagctgagccggcccccagagttcctgaatgaacctggccgcatggaccctgtgaaggagctgaagagcatcccccggctgaagaggaagaagcccttccactggctgcccagcatcggcaagaagcgggagattgacatcagcagcagccagatggtgtccctgcccagctaccctgtggcccccaccagccgggccagccccagccccttctgcccagagctgcggcggggccagagcatgcccagcctgcgggagggctggaggctggctgatgagctgggcctgccccccctgcccagccggcccctgacccccctggtgctggccacagagagcaagccagagctgaccggcctcatcgtggccgaggacctgaagcagctgatcaagaagatgaagctggagggcacccgctacccacccctggacagcggcctgccccccctgctgggcgtggtgaccaggcaccctgctgctggccaccggctggaggagctggagaagatgctgaggaacctgcaggaggaggaggccagcggccagtgggacccccagccccccaagagcttccccctgcacccccagcctgtgaccatcaccctgaagctgagaaatgaggtggtggtgcaggccgctgctgtgcgggtgtctgacaggaacttcctggacagcttccacattgaaggagctggggccctgtacaaccacctggccggggagctggaccccaaggccatcgagaagatggacatcgacaactttgtgggcagcaccacccgggaggtgtacaaggagctgatgagccacgtgtccagtgaccacctgcactttgaccagggccccctggtggagcctgctgctgacaaggactggagcaccttcctgagcagcgccttcctgcggcaggagaagcagccccagatcatcaaccctgagctggtgggcctgtacagccagagggccaacaccctgcagagcaacaccaagaagatgcccagcctgcccagcctgcaggccaccaagtcctgggagaagtggagcaacaaggccagcctgatgaacagctggaagaccaccctgtctgtggatgactacttcaagtacctgaccaaccacgagacagacttcctgcacgtgatcttccagatgcatgaggaggaggtgcctgtggagatcgtggccccagcccgggagagcctggagatccagcaccccccacccctgctggaggatgaggagccagactttgtgcctggagagtgggactggaacacagtgctggagcaccggctgggcgccggcaagaccccccacctgggggagccccacaagatcctgagcctgcagaagcacctggagcagctgtggagcgtgctggaggtgcctgacaaggaccaggtggacatgaccatcaagtacagcagcaaggcccggctgcggcagctgcccagcctggtgaatgcctgggagcgggccctgaagcccatccagctgcgggaggccctgctggcccggctggagtggtttgagggccaggccagcaaccccaaccgcttcttcaagaagaccaacctgagcagcagccacttcctggaggagaaccaggtgcgcagccacctgcacaggaagctgaacctgatggagagcagcctggtgtccctgctggaggagattgagctgatctttggagagcctgtgatcttcaagggccggccctacctggacaagatgaagagtgacaaggtggagatgctgtactggctgcagcagcagaggagagtgcgccacctggtgtctgccctgaaggacccccaccagagcaccctcttccgcagcagcgctgccagcctgtag

SEQ ID NO: 37673 - DNA, 741 bp, Artificial Sequence
  Description of Artificial Sequence: Synthetic coding sequence
atgctgagcctgagcctgtgcagccacctgtggggccccctcatcctgagcgccctgcaggcccggagcacagacagcctggatggccctggagagggctctgtgcagcccctgcccacagctgggggccccagcgtgaagggcaagccaggcaagaggctgagcgccccccggggccccttcccccggctggccgactgtgcccacttccactatgaaaatgtggactttggccacatccagctgctgctgagcccagaccgggagggccccagcctgagcggggagaatgagctggtgtttggagtgcaggtgacctgccagggccgctcctggcctgtgctgcggagctatgatgacttccgcagcctggatgcccacctgcaccgctgcatctttgaccggcgcttcagctgcctgcctgagctgcccccacctcctgagggcgcccgggccgcccagatgctggtgcccctgctgctgcagtacctggagaccctgagcggcctggtggacagcaacctgaactgtggccctgtgctgacctggatggaggtgggcctgggccggggcctgggggacagcgagtgggtgcggggctgtgtgtgccaccacgcccagcaccgggagatcctggatggcaacagagtggccagcgctgtggaggatgaaggagctgaggtggatggagaggccttccgctggggcagcctgtgggtgggggagagctgggacatgtag

SEQ ID NO: 37674 - DNA, 1542 bp, Artificial Sequence
  Description of Artificial Sequence: Synthetic coding sequence
atggccgccaccctggacctgaagagcaaggaggagaaggatgctgagctggacaagagaattgaggccctgcggaggaagaatgaggccctgatccgccgctaccaggagattgaggaggacaggaagaaggccgagctggagggcgtggccgtgacagcccccaggaagggccgctctgtggagaaggaaaatgtggccgtggagagcgagaagaacctgggccccagccgccgcagccctggcaccccccggcccccaggggccagcaaaggaggccgcaccccaccccagcagggcggccgggccggcatgggccgggccagccgctcctgggagggcagccctggagagcagccccggggcggcggggccggggacaccagcatcagtgacaggaagagcaaggagtgggaggagcggcggcggcagaacatcgagaagatgaatgaggagatggagaagattgctgaatatgaaagaaaccagcgggagggcgtgctggagcccaaccctgtgaggaacttcctggatgacccccggcggcgcagcggccccctggaggagagcgagcgggaccggcgggaggagagcagaagacatggaagaaactggggcggccctgactttgagcgggtgcgctgtggcctggagcacgagcggcagggccggcgggccggcctgggcagcgctggggacatgaccctgtccatgacaggccgggagaggtctgagtacctgcgctggaagcaggagcgggagaagattgaccaggagcggctgcagaggcacaggaagcccaccggccagtggaggcgggagtgggatgctgagaagacagatggcatgttcaaggatggccctgtgcctgcccacgagcccagccacagatatgatgaccaggcctgggcccggccccccaagccacccaccttcggggagttcctgagccagcacaaggccgaggccagcagcagaagaagaaggaagagcagccggccccaggccaaggccgccccccgggcctacagcgaccatgatgaccgctgggagaccaaggagggcgccgccagccctgcccctgagaccccccagcccaccagccctgagaccagccccaaggagacccccatgcagcccccagagatcccagccccagcccaccggcccccagaagatgaaggagaagaaaatgaaggagaggaggatgaggagtgggaggacatcagtgaagatgaggaggaggaggagattgaggtggaggagggagatgaggaggagcccgcccaggaccaccaggcccctgaggccgcccccaccggcatcccctgcagcgagcaggcccatggagtgcccttcagccctgaggagcccctgctggagccccaggcccctggcacccccagcagccccttcagcccccccagcggccaccagcctgtgtctgactggggcgaggaggtggagctgaacagccccaggaccacccacctggccggggccctgagccctggagaggcctggccctttgagagcgtgtag

SEQ ID NO: 37675 - DNA, 996 bp, Artificial Sequence
  Description of Artificial Sequence: Synthetic coding sequence
atgaccagcccccacttcagcagctatgatgagggccccctggatgtgtccatggccgccaccaacctggagaaccagctgcacagcgcccagaagaacctgctcttcctgcagcgggagcacgccagcaccctgaagggcctgcacagcgagatccggcggctgcagcagcactgcacagacctgacctatgagctgactgtgaagagcagcgagcagacaggagatggcaccagcaagagcagcgagctgaagaagagatgtgaggagctggaggcccagctgaaggtgaaggaaaatgaaaatgctgagctgctgaaggagctggagcagaagaatgccatgatcaccgtgctggagaacaccatcaaggagcgggagaagaagtacctggaggagctgaaggccaagagccacaagctgaccctgctgagcagcgagctggagcagagggccagcaccatcgcctacctgaccagccagctgcacgccgccaagaagaagctgatgagcagcagcggcaccagtgatgccagccccagcggcagccctgtgctggccagctacaagccagccccacccaaggacaagctgcctgagaccccaagaagaaggatgaagaagagcctgagcgcccccctgcaccctgagtttgaggaggtgtacagatttggagctgagagcaggaagctgctgctgcgggagcctgtggatgccatgccagaccccacccccttcctgctggcccgggagagcgctgaggtgcacctgatcaaggagcggcccctggtgatcccccccatcgccagtgacagaagtggagagcagcacagccctgcccgggagaagccccacaaggcccacgtgggcgtggcccaccgcatccaccacgccaccccaccccaggcccagcctgaggtgaagaccctggccgtggaccaggtgaatggaggcaaggtggtgaggaagcacagcggcacagacagaacagtgtag

SEQ ID NO: 37676 - DNA, 291 bp, Artificial Sequence
  Description of Artificial Sequence: Synthetic coding sequence
atgaccagcccccacttcagcagctatgatgagggccccctggatgtgtccatggccgccaccaacctggagaaccagctgcacagcgcccagaagaacctgctcttcctgcagcgggagcacgccagcaccctgaagggcctgcacagcgagatccggcggctgcagcagcactgcacagacctgacctatgagctgactgtgaagagcagcgagcagacaggagatggcaccagcaagagcagcgagctgaagaagagatgtgaggagctggaggcccagctgaagtag

SEQ ID NO: 37677 - DNA, 369 bp, Artificial Sequence
  Description of Artificial Sequence: Synthetic coding sequence
atgaccagcccccacttcagcagctatgatgagggccccctggatgtgtccatggccgccaccaacctggagaaccagctgcacagcgcccagaagaacctgctcttcctgcagcgggagcacgccagcaccctgaagggcctgcacagcgagatccggcggctgcagcagcactgcacagacctgacctatgagctgactgtgaagagcagcgagcagacaggagatggcaccagcaagagcagcgagctgaagaagagatgtgaggagctggaggcccagctgaaggtgaaggaaaatgaaaatgctgagctgctgaaggagctggagcagaagaatgccatgatcaccgtgctggagaacacctag

SEQ ID NO: 37678 - DNA, 39 bp, Artificial Sequence
  Description of Artificial Sequence: Synthetic coding sequence
atgaccagcccccacttcagcagctatgatgagggctag

SEQ ID NO: 37679 - DNA, 1896 bp, Artificial Sequence
  Description of Artificial Sequence: Synthetic coding sequence
atgggcctgccccggggccctgagggccagggcctgcctgaggtggagaccagagaagatgaggagcagaatgtgaagctgacagagatcctggagctgctggtggccgccggctacttccgggcccgcatcaagggcctgagcccctttgacaaggtggtgggcggcatgacctggtgcatcaccacctgcaactttgatgtggatgtggacctgctcttccaggagaacagcaccatcggccagaagatcgccctgtctgagaagatcgtgtctgtgctgcccaggatgaagtgcccccaccagctggagccccaccagatccagggcatggacttcatccacatcttccctgtggtgcagtggctggtgaagagggccatcgagaccaaggaggagatgggagactacatccgcagctacagcgtgtcccagttccagaagacctacagcctgcctgaagatgatgacttcatcaagaggaaggagaaggccatcaagacagtggtggacctgtctgaggtgtacaagcccaggaggaagtacaagaggcaccagggcgctgaggagctgctggatgaggagagccgcatccacgccaccctgctggagtatggaagaagatatggcttcagccggcagagcaagatggagaaggccgaggacaagaagacagccctgcctgctggcctgagcgccacagagaaggcagatgcccacgaggaggatgagctgcgggctgctgaggagcagaggatccagagcctgatgaccaagatgacagccatggccaatgaggagagccggctgacagccagctctgtgggccagatcgtgggcctgtgcagcgctgagatcaagcagatcgtgtctgaatatgcagagaagcagagcgagctgtctgctgaggagagccctgagaagctgggcaccagccagctgcacaggaggaaggtgatcagcctgaacaagcagatcgcccagaagaccaagcacctggaggagctgcgggccagccacaccagcctgcaggcccgctacaatgaggccaagaagaccctgacagagctgaagacctacagcgagaagctggacaaggagcaggccgccctggagaagattgagagcaaggctgaccccagcatcctgcagaacctgcgggccctggtggccatgaatgaaaacctgaagagccaggagcaggagttcaaggcccactgccgggaggagatgacccggctgcagcaggagattgagaacctgaaggccgagcgggcccccagaggagatgagaagaccctgagcagcggggagcccccaggcaccctgaccagcgccatgacccatgatgaggacctggaccggcgctacaacatggagaaggagaagctgtacaagatccggctgctgcaggcccggaggaaccgggagatcgccatcctgcacaggaagattgatgaggtgcccagcagagctgagctgatccagtaccagaagcgcttcatcgagctgtaccggcagatctctgctgtgcacaaggagaccaagcagttcttcaccctgtacaacaccctggatgacaagaaggtgtacctggagaaggagatcagcctgctgaacagcatccacgagaacttcagccaggccatggccagccctgctgcccgggaccagttcctgcggcagatggagcagatcgtggagggcatcaagcagagcaggatgaagatggagaagaagaagcaggagaacaagatgagaagagaccagctgaatgaccagtacctggagctgctggagaagcagaggctgtacttcaagacagtgaaggagttcaaggaggagggcaggaagaatgagatgctgctgagcaaggtgaaggccaaggccagctag

SEQ ID NO: 37680 - DNA, 972 bp, Artificial Sequence
  Description of Artificial Sequence: Synthetic coding sequence
atgtctgagaggaaggtgctgaacaagtactaccccccagactttgaccccagcaagatccccaagctgaagctgcccaaggaccggcagtatgtggtgcggctgatggcccccttcaacatgcgctgcaagacctgtggggagtacatctacaagggcaagaagttcaatgccaggaaggagaccgtgcagaatgaggtgtacctgggcctgcccatcttccgcttctacatcaagtgcacccgctgcctggccgagatcaccttcaagacagatcctgagaacacagactacaccatggagcacggggccaccaggaacttccaggccgagaagctgctggaggaggaggagaagagggtgcagaaggagcgggaggatgaggagctgaacaaccccatgaaggtgctggagaacagaaccaaggacagcaagctggagatggaggtgctggagaacctgcaggagctgaaggacctgaaccagaggcaggcccacgtggactttgaggccatgctgcggcagcaccggctgtctgaggaggagcggcggcggcagcagcaggaggaggatgagcaggagacagctgccctgctggaggaggccaggaagaggcggctgctggaggacagcgacagtgaagatgaagctgcccccagccccctgcagcctgccctgcggcccaaccccacagccatcctggatgaggcccccaagcccaagaggaaggtggaggtgtgggagcagagcgtgggcagcctgggcagccggccccccctgagccggctggtggtggtgaagaaggccaaggctgaccctgactgcagcaatggccagccccaggccgcccccacccctggggccccccagaacaggaaggaggccaaccccacccccctgacccctggggccagcagcctgagccagctgggcgcctacctggacagtgatgacagcaatggcagcaactag

SEQ ID NO: 37681 - DNA, 1668 bp, Artificial Sequence
  Description of Artificial Sequence: Synthetic coding sequence
atggatgtgtcctctgagcacaccaaggaccctggaggagagggcggagatggagagagcctggccgcccggcccagcaagatcaaggccagcagcggcccccccaccagccctgagcccggggagctggagagcgagcctgaggaggaggaggaggagcaggccgccagccagggcggcacagctgctgatgagcaggccgaggcccccaagggcctgacagctgctgaggccgccggggaggagggccctggagagcccggccggcctgctgagccccagcctgagcctgaggagcctgctgaggtgggcgctgaggagcccgcccagcctgagcctggagctggccctgaggagctggaggccgaggccggggctgaggagctggagcaggccgctgagggcaaggaggtgcgcttccaggccagcctgcccctgaccagaattgatgaggaggaggccgccgccgcccctgaggccgagacagagcgggtggagggggaggaggaggacaaggaggagacccagagagatggagctgagagcaaggagagagatggagagggccgcccagccaagagccaggaggagggcaagaggctgtatggaagagatgaatttgaggacctggagtggagcgaggaggtgcagaagctgcaggagcagcagctgcggagtgacctgctggaccagtaccgcagcctgctggtggagaggaacagaagccagcgctacaacctgtacctgcagcacaagatctttgaggccctgcggaggaagaagggcctggaggccgctgaggtggccgacagaggagctgaggccgaggcccctgagaaggagcaggcctacctgcggcacctgggcatgctggaggagctgaagaagcagcaggctgatgacctgcagtggtaccaccaggagctgggccagctgaagaggcagtgccaggagaagctgaccagggtggagaaggagtggaggcgcttccaggccctgaagaagcaggtggtgatgcaggccatgggcagctgcaggatgagaggaggccggcaggccgccctgcgggaggtggagcagatccaggccctggaggacaagaaggagaaggagatgtctgctgtgcggctggagaacatccagctgaagcagagcctggtgcactttgagaccaggatgaggacccaggaggacctgacccagggcctgctgctgattgactttgagcagctgaagattgagaaccagaccttcaatgagaagattgaggagagaaatgaggagctgctgaagctgcggagcaaggtgaccaacagcgtgcaggtgatcacccacgtgaaggagaagctgcacttcatggacatggagaatgcctgcaagaagacccagctggccgagattgaggcccaggccgccctgggccgggacatcctgaccaagaccaagcaggcccgggagggcctgaggacagacaacatccggctgaaccagaagtgtggcctgctgggcaaggacagcctgctgcgggacctggaggagaaggtggacaagacagagctgctgcaccggcggctggagagcctgaagaggcaccacgccagcctgaccctgagctgccggggcgtgcggcagaagatccgggaggccaaggccttcctgcccagctag

SEQ ID NO: 37682 - DNA, 1032 bp, Artificial Sequence
  Description of Artificial Sequence: Synthetic coding sequence
atggaggccgtggccacagccacagctgccaaggagccagacaagggctgcatcgagcccggccctggccactggggcgagctgagcaggacccctgtgcccagcaagccccaggacaaggtggaggccgctgaggccacccctgtggccctggacagcgacaccagcggggctgaaaatgctgctgtgtctgccatgctgcatgctgtggccgccagccggctgcctgtgtgcagccagcagcagggcgagccagacctgacagagcacgagaaggtggccatcctggcccagctgtaccacgagaagcccctggtgttcctggagcgcttcagaacaggcctgcgggaggagcacctggcctgctttggacatgtgcggggggaccacagagctgacttctactgtgccgaggtggcccggcagggcacagcccggcccaggaccctgcggacccggctgaggaacagaagatatgctgccctgcgggagctgatccagggcggggagtacttcagtgatgagcagatgaggttccgggcccccctgctgtatgagcagtacatcggccagtacctgacccaggaggagctgagcgcccggacccccacccaccagccccccaagccaggcagccctggccggcctgcctgccccctgagcaacctgctgctgcagagctatgaggagcgggagctgcagcagaggctgctgcagcagcaggaggaggaggaggcctgcctggaggaggaggaggaggaggaggacagtgatgaggaggaccagaggtctgggaaggacagcgaggcctgggtgcctgattctgaggagcggctcatcctgcgggaggagttcaccagcaggatgcaccagcgcttcctggatggcaaggatggagactttgactacagcacagtggatgacaacccagactttgacaacctggacatcgtggccagagatgaggaggagcgctactttgatgaggaggagccagaagatgcccccagccctgagctggatggagactag

SEQ ID NO: 37683 - DNA, 462 bp, Artificial Sequence
  Description of Artificial Sequence: Synthetic coding sequence
atggagcccctgtaccaggccggcagcatcctgatgacagtgaacaccctgcagggcaagaagatgattgaaagtggcctgcagagcggggacttcagcctgagccagagctggcccagctgcctgcccccacctgctgacctggagatcctgcagcagaaggtggccggcgtgcagcgggagctggaggacttcaagaaggaggccctgaagagcatccactacctggaggatgccttctgtgagatgaatggagccctggtgcagcaggaggagcaggccgcccgggtgcggcagaggctgcgggaggaggaggaccggggcatcgtgaggaacaaggtgctgaccttcctgctgccccgggagaagcagctgcgggagcactgcaagaggctggaggacctgctgctggaccggggcagagatgccctgcgggccaccaagaagagccaggccgactag

SEQ ID NO: 37684 - DNA, 333 bp, Artificial Sequence
  Description of Artificial Sequence: Synthetic coding sequence
atgcaggccgccctggaggtgacagcccgctactgcggccgggagctggagcagtatggccagtgtgtggccgccaagccagagagctggcagagggactgccactacctgaagatgagcatcgcccagtgcaccagcagccaccccatcatccggcagatccggcaggcctgtgcccagccctttgaggcctttgaagaatgtctgcggcagaatgaggccgctgtgggcaactgtgccgagcacatgaggcgcttcctgcagtgtgccgagcaggtgcagcccccaagaagccctgccaccgtggaggcccagcccctgcctgccagctag

SEQ ID NO: 37685 - DNA, 708 bp, Artificial Sequence
  Description of Artificial Sequence: Synthetic coding sequence
atgggcagcacagagagcagcgagggccggcgggtgtcctttggagtggatgaggaggagcgggtgcgggtgctgcagggcgtgcggctgtctgaaaatgtggtgaacaggatgaaggagcccagcagccccccaccagcccccaccagcagcaccttcggcctgcaggacggcaacctgcgggccccccacaaggagagcaccctgcccaggagcggcagcagcggcggccagcagcccagcggcatgaaggagggcgtgaagagatatgagcaggagcacgccgccatccaggacaagctgttccaggtggccaagcgggagcgggaggccgccaccaagcacagcaaggccagcctgcccaccggggagggcagcatcagccatgaggagcagaagtctgtgcggctggcccgggagctggagagccgggaggccgagctgcggcggcgggacaccttctacaaggagcagctggagcgcatcgagaggaagaatgctgagatgtacaagctgagcagcgagcagttccacgaggccgccagcaagatggagagcaccatcaagcccaggagagtggagcctgtgtgcagcggcctgcaggcccagatcctgcactgctacagagaccggccccatgaggtgctgctgtgcagcgacctggtgaaggcctaccagagatgtgtgtctgctgcccacaagggctag

SEQ ID NO: 37686 - DNA, 501 bp, Artificial Sequence
  Description of Artificial Sequence: Synthetic coding sequence
tgaaccctgcccaggagcggcagcagcggcggccagcagcccagcggcatgaaggagggcgtgaagagatatgagcaggagcacgccgccatccaggacaagctgttccaggtggccaagcgggagcgggaggccgccaccaagcacagcaaggccagcctgcccaccggggagggcagcatcagccatgaggagcagaagtctgtgcggctggcccgggagctggagagccgggaggccgagctgcggcggcgggacaccttctacaaggagcagctggagcgcatcgagaggaagaatgctgagatgtacaagctgagcagcgagcagttccacgaggccgccagcaagatggagagcaccatcaaggtggagcctgtgtgcagcggcctgcaggcccagatcctgcactgctacagagaccggccccatgaggtgctgctgtgcagcgacctggtgaaggcctaccagagatgtgtgtctgctgcccacaagggctag

SEQ ID NO: 37687 - DNA, 600 bp, Artificial Sequence
  Description of Artificial Sequence: Synthetic coding sequence
atgctgctggagctgtctgaggagcacaaggagcacctggccttcctgccccaggtggacagcgctgtggtggccgagtttggaagaattgctgtggagttcctgcggcggggggccaaccccaagatctatgagggcgccgccaggaagctgaatgtgtccagtgacacagtgcagcacggcgtggagggcctgacctacctgctgacagagagcagcaagctgatgatcagcgagctggacttccaggacagcgtgtttgtgctgggcttcagcgaggagctgaacaagctgctgctgcagctgtacctggacaacaggaaggagatccgcaccatcctgtctgagctggcccccagcctgcccagctaccacaacctggagtggaggctggatgtgcagctggccagccgcagcctgcggcagcagatcaagccagctgtgaccatcaagctgcacctgaaccagaatggagaccacaacaccaaggtgctgcagacagatcctgccaccctgctgcacctggtgcagcagctggagcaggccctggaggagatgaagaccaaccactgccggcgggtggtgaggaacatcaagtag

SEQ ID NO: 37688 - DNA, 534 bp, Artificial Sequence
  Description of Artificial Sequence: Synthetic coding sequence
atggagctgtctgagagcgtgcagaagggcttccagatgctggccgaccccaggagctttgacagcaatgccttcaccctgctgctgcgggccgccttccagagcctgctggatgcccaggctgatgaggccgtgctggaccacccagacctgaagcacatcgaccctgtggtgctgaagcactgccacgccgccgccgccacctacatcctggaggccggcaagcacagagctgacaagagcaccctgagcacctacctggaggactgcaagtttgaccgggagagaattgagctgttctgcacagagtaccagaacaacaagaacagcctggagatcctgctgggccgcaccctcatcccccaccccatccagaggctggtgctggtggccgcctggaacaactaccgcacctggtggggcaacctgaagatgctgaggaaggcctggaaggagcagctgagctgcaacctgggcaagctgaccatccggcccagcgctgaggagaaccagaagaggctggccttctcctag

SEQ ID NO: 37689 - DNA, 489 bp, Artificial Sequence
  Description of Artificial Sequence: Synthetic coding sequence
atggagctgtctgagagcgtgcagaagggcttccagatgctggccgaccccaggagctttgacagcaatgccttcaccctgctgctgcgggccgccttccagagcctgctggatgcccaggctgatgaggccgtgctggaccacccagacctgaagcacatcgaccctgtggtgctgaagcactgccacgccgccgccgccacctacatcctggaggccggcaagcacagagctgacaagagcaccctgagcatcggccgcagcctgccccacatcacagatgtgtcctggaggctggagtaccagatcaagaccaaccagctgcacaggatgtacagacctgcctacctggtgaccctgtctgtgcagaacacagacagccccagctacccagagatctccttcagctgcagcatggagcagctgcaggacctggtgggcaagctgaaggatgccagcaagagcctggagcgggccacccagctgtag

SEQ ID NO: 37690 - DNA, 588 bp, Artificial Sequence
  Description of Artificial Sequence: Synthetic coding sequence
atggagctgtctgagagcgtgcagaagggcttccagatgctggccgaccccaggagctttgacagcaatgccttcaccctgctgctgcgggccgccttccagagcctgctggatgcccaggctgatgaggccgtgctggaccacccagacctgaagcacatcgaccctgtggtgctgaagcactgccacgccgccgccgccacctacatcctggaggccggcaagcacagagctgacaagagcaccctgagcacctacctggaggactgcaagtttgaccgggagagaattgagctgttctgcacagagtaccagaacaacaagaacagcctggagatcctgctgggcagcatcggccgcagcctgccccacatcacagatgtgtcctggaggctggagtaccagatcaagaccaaccagctgcacaggatgtacagacctgcctacctggtgaccctgtctgtgcagaacacagacagccccagctacccagagatctccttcagctgcagcatggagcagctgcaggacctggtgggcaagctgaaggatgccagcaagagcctggagcgggccacccagctgtag

SEQ ID NO: 37691 - DNA, 534 bp, Artificial Sequence
  Description of Artificial Sequence: Synthetic coding sequence
tgagagctgtctgagagcgtgcagaagggcttccagatgctggccgaccccaggagctttgacagcaatgccttcaccctgctgctgcgggccgccttccagagcctgctggatgcccaggctgatgaggccgtgctggaccacccagacctgaagcacatcgaccctgtggtgctgaagcactgccacgccgccgccgccacctacatcctggaggccggcaagcacagagctgacaagagcaccctgagcacctacctggaggactgcaagtttgaccgggagagaattgagctgttctgcacagagtaccagaacaacaagaacagcctggagatcctgctgggccgcaccctcatcccccaccccatccagaggctggtgctggtggccgcctggaacaactaccgcacctggtggggcaacctgaagatgctgaggaaggcctggaaggagcagctgagctgcaacctgggcaagctgaccatccggcccagcgctgaggagaaccagaagaggctggccttctcctag

SEQ ID NO: 37692 - DNA, 450 bp, Artificial Sequence
  Description of Artificial Sequence: Synthetic coding sequence
tgactgcctgatgctgggggcagccccctgctgcggctgcagaggctgcacgccagccccccaggcggcatccctgagagcgctggccggcctgggggccggggccgggtgtccacctacctggaggactgcaagtttgaccgggagagaattgagctgttctgcacagagtaccagaacaacaagaacagcctggagatcctgctgggcagcatcggccgcagcctgccccacatcacagatgtgtcctggaggctggagtaccagatcaagaccaaccagctgcacaggatgtacagacctgcctacctggtgaccctgtctgtgcagaacacagacagccccagctacccagagatctccttcagctgcagcatggagcagctgcaggacctggtgggcaagctgaaggatgccagcaagagcctggagcgggccacccagctgtag

SEQ ID NO: 37693 - DNA, 492 bp, Artificial Sequence
  Description of Artificial Sequence: Synthetic coding sequence
tgaatggagctgtctgagagcgtgcagaagggcttccagatgctggccgaccccaggagctttgacagcaatgccttcaccctgctgctgcgggccgccttccagagcctgctggatgcccaggctgatgaagctgtgctggaccacccagacctgaagcacattgatcctgtggtgctgaagcactgccacgccgctgctgccacctacatcctggaggccggcaagcacagagctgacaagagcaccctgagcatcggccgcagcctgccccacatcacagatgtgtcctggaggctggagtaccagatcaagaccaaccagctgcacaggatgtacagacctgcctacctggtgaccctgtctgtgcagaacacagacagccccagctacccagagatctccttcagctgcagcatggagcagctgcaggacctggtgggcaagctgaaggatgccagcaagagcctggagcgggccacccagctgtag

SEQ ID NO: 37694 - DNA, 603 bp, Artificial Sequence
  Description of Artificial Sequence: Synthetic coding sequence
atgggccgcctgcactgcacagaggaccctgtgcctgaggccgtgggcggggacatgcagcagctgaaccagctgggcgcccagcagttcagcgccctgacagaggtgctcttccacttcctgacagagcccaaggaggtggagcgcttcctggcccagctgtctgaatttgccaccaccaaccagatcagcctgggcagcctgcggagcatcgtgaagagcctgctgctggtgcccaacggggccctgaagaagagcctgacagccaagcaggtgcaggccgacttcatcaccctgggcctgtctgaggagaaggccacctacttcagcgagaagtggaagcagaatgcccccaccctggcccgctgggccatcggccagaccctgatgatcaaccagctgattgacatggagtggaagtttggagtgaccagcggcagcagcgagctggagaaggtgggcagcatcttcctgcagctgaagctggtggtgaagaagggcaaccagacagaaaatgtgtacatcgagctgaccctgccccagttctacagcttcctgcacgagatggagcgggtgaggacctccatggagtgcttctgctag

SEQ ID NO: 37695 - DNA, 600 bp, Artificial Sequence
  Description of Artificial Sequence: Synthetic coding sequence
atgggccgcctgcactgcacagaggaccctgtgcctgaggccgtgggcggggacatgcagcagctgaaccagctgggcgcccagttcagcgccctgacagaggtgctcttccacttcctgacagagcccaaggaggtggagcgcttcctggcccagctgtctgaatttgccaccaccaaccagatcagcctgggcagcctgcggagcatcgtgaagagcctgctgctggtgcccaatggagccctgaagaagagcctgacagccaagcaggtgcaggccgacttcatcaccctgggcctgtctgaggagaaggccacctacttcagcgagaagtggaagcagaatgcccccaccctggcccgctgggccatcggccagaccctgatgatcaaccagctgattgacatggagtggaagtttggagtgaccagcggcagcagcgagctggagaaggtgggcagcatcttcctgcagctgaagctggtggtgaagaagggcaaccagacagaaaatgtgtacatcgagctgaccctgccccagttctacagcttcctgcacgagatggagcgggtgaggacctccatggagtgcttctgctag

SEQ ID NO: 37696 - DNA, 552 bp, Artificial Sequence
  Description of Artificial Sequence: Synthetic coding sequence
atggagcctgaggagggcacccccctgtggaggctgcagaagctgcctgctgagctgggcccccagctgctgcacaagatcattgatggcatctgtggccgggcctaccctgtgtaccaggactaccacacagtgtgggagagcgaggagtggatgcacgtgctggaggacatcgccaagttcttcaaggccatcgtgggcaagaacctgcctgatgaggagatcttccagcagctgaaccagctgaacagcctgcaccaggagaccatcatgaagtgtgtgaagagcaggaaggatgagatcaagcaggccctgagccgggagatcgtggccatcagcagcgcccagctgcaggactttgactggcaggtgaagctggccctgagcagtgacaagattgctgccctgaggatgcccctgctgagcctgcacctggatgtgaaggaaaatggagaggtgaagccctacagcattgagatgagccgggaggagctgcagaacctgatccagagcctggaggccgccaacaaggtggtgctgcagctgaagtag

SEQ ID NO: 37697 - DNA, 597 bp, Artificial Sequence
  Description of Artificial Sequence: Synthetic coding sequence
atggccgccctgacagctgagcactttgctgccctgcagagcctgctgaaggccagcagcaaggatgtggtgcggcagctgtgccaggagagcttcagcagcagcgccctgggcctgaagaagctgctggatgtgacctgcagcagcctgtctgtgacccaggaggaggccgaggagctgctgcaggccctgcaccggctgacccggctggtggccttccgggacctgagcagcgctgaggccatcctggccctcttccctgagaacttccaccagaacctgaagaacctgctgaccaagatcatcctggagcacgtgtccacctggaggacagaggcccaggccaaccagatcagcctgccccggctggtggacctggactggagggtggacatcaagaccagcagtgacagcatcagcaggatggctgtgcccacctgcctgctgcagatgaagatccaggaggaccccagcctgtgtggggacaagcccagcatctctgctgtgacagtggagctgagcaaggagaccctggacaccatgctggatggcctgggccgcatccgggaccagctgtctgctgtggccagcaagtag

SEQ ID NO: 37698 - DNA, 510 bp, Artificial Sequence
  Description of Artificial Sequence: Synthetic coding sequence
atggccgccctgacagctgagcactttgctgccctgcagagcctgctgaaggccagcagcaaggatgtggtgcggcagctgtgccaggagagcttcagcagcagcgccctgggcctgaagaagctgctggatgtgacctgcagcagcctgtctgtgacccaggaggaggccgaggagctgctgcaggccctgcaccggctgacccggctggtggccttccgggacctgagcagcgctgaggccatcctggccctcttccctgagaacttccaccagaacctgaagaacctgctgaccaagatcatcctggagcacgtgtccacctggaggacagaggcccaggccaaccagatcagcctgccccggctggtggacctggactggagggtggacatcaagaccagcagtgacagcatcagcaggatggctgtgcccacctgcctgctgcagatgaagatccaggaggaccccagcctgtgtggggacaagcccagcatctctgctgtgtag

SEQ ID NO: 37699 - DNA, 471 bp, Artificial Sequence
  Description of Artificial Sequence: Synthetic coding sequence
atggccgccctgacagctgagcactttgctgccctgcagagcctgctgaagctgctgcaggccctgcaccggctgacccggctggtggccttccgggacctgagcagcgctgaggccatcctggccctcttccctgagaacttccaccagaacctgaagaacctgctgaccaagatcatcctggagcacgtgtccacctggaggacagaggcccaggccaaccagatcagcctgccccggctggtggacctggactggagggtggacatcaagaccagcagtgacagcatcagcaggatggctgtgcccacctgcctgctgcagatgaagatccaggaggaccccagcctgtgtggggacaagcccagcatctctgctgtgacagtggagctgagcaaggagaccctggacaccatgctggatggcctgggccgcatccgggaccagctgtctgctgtggccagcaagtag

SEQ ID NO: 37700 - DNA, 2067 bp, Artificial Sequence
  Description of Artificial Sequence: Synthetic coding sequence
atgtggtgcatcgtgctcttcagcctgctggcctgggtgtatgcagagcccaccatgtacggggagatcctgagccccaactacccccaggcctaccccagcgaggtggagaagtcctgggacatcgaggtgcctgagggctacggcatccacctgtacttcacccacctggacatcgagctgtctgagaactgtgcctatgattctgtgcagatcatcagcggggacacagaggagggccgcctgtgtggccagaggagcagcaacaacccccacagccccatcgtggaggagttccaggtgccctacaacaagctgcaggtgatcttcaagagtgacttcagcaatgaggagcgcttcaccggctttgctgcctactacgtggccacagacatcaatgaatgtacagactttgtggatgtgccctgcagccacttctgcaacaacttcatcggcggctacttctgcagctgccccccagagtacttcctgcatgatgacatgaagaactgtggggtgaactgcagcggagatgtgttcaccgccctgattggagaaattgccagccccaactaccccaagccctacccagagaacagccgctgtgagtaccagatccggctggagaagggcttccaggtggtggtgaccctgcggagagaagattttgatgtggaggccgctgacagcgctggcaactgcctggacagcctggtgtttgtggccggggaccggcagtttggcccctactgcggccacggcttccctggccccctgaacatcgagaccaagagcaatgccctggacatcatcttccagacagacctgaccggccagaagaagggctggaagctgcgctaccacggggaccccatgccctgccccaaggaggacacccccaacagcgtgtgggagcccgccaaggccaagtatgtgttcagagatgtggtgcagatcacctgcctggatggctttgaggtggtggagggccgggtgggcgccaccagcttctacagcacctgccagagcaatggcaagtggagcaacagcaagctgaagtgccagcctgtggactgtggcatccctgagagcattgaaaatggcaaggtggaggaccctgagagcaccctgtttggcagcgtcatccgctacacctgtgaggagccctactactacatggagaatggaggcggcggggagtaccactgtgctggaaatggctcctgggtgaatgaggtgctgggccctgagctgcccaagtgtgtgcctgtgtgtggggtgccccgggagccctttgaggagaagcagaggatcattggaggcagtgatgctgacatcaagaacttcccctggcaggtgttctttgacaacccctgggccggcggggccctgatcaatgagtactgggtgctgacagctgcccacgtggtggagggcaaccgggagcccaccatgtatgtgggcagcacctctgtgcagaccagccggctggccaagagcaagatgctgaccccagagcacgtgttcatccaccctggctggaagctgctggaggtgcctgagggccgcaccaactttgacaatgacatcgccctggtgcggctgaaggaccctgtgaagatgggccccaccgtgagccccatctgcctgcccggcaccagcagtgactacaacctgatggatggagacctgggcctcatcagcggctggggccgcacagagaagagggacagagctgtgcggctgaaggccgcccggctgcctgtggcccccctgaggaagtgcaaggaggtgaaggtggagaagcccacagcagatgctgaggcctacgtgttcacccccaacatgatctgtgccggcggggagaagggcatggacagctgcaagggggacagcggcggggcctttgctgtgcaggaccccaatgacaagaccaagttctatgctgctggcctggtgtcctggggcccccagtgtggcacctacggcctgtacaccagggtgaagaactacgtggactggatcatgaagaccatgcaggagaacagcaccccaagagaagattag

SEQ ID NO: 37701 - DNA, 2067 bp, Artificial Sequence; identical to SEQ ID NO: 37700
  Description of Artificial Sequence: Synthetic coding sequence

SEQ ID NO: 37702 - DNA, 483 bp, Artificial Sequence
  Description of Artificial Sequence: Synthetic coding sequence
atggccttcctgatgaagtccatgatcagcaaccaggtgaagaacctgggctttggaggcggcagcgaggagaacaaggaggagggcggggccagtgaccctgctgctgcccagggcatgacccgggaggagtatgaggagtaccagaagcagatgattgaggagaagatggagagagatgctgccttcacccagaagaaggccgagcgggcctgcctgcgggtgcacctgcgggagaagtaccgcctgcccaagtctgagatggatgagaaccagatccagatggctggagatgatgtggacctgcctgaggacctgaggaagatggtggatgaggaccaggaggaggaggaggacaaggacagcatcctgggccagatccagaacctgcagaacatggacctggacaccatcaaggagaaggcccaggccaccttcacagagatcaagcagacagctgagcagaagtgcagcgtgatgtag

SEQ ID NO: 37703 - DNA, 3924 bp, Artificial Sequence
  Description of Artificial Sequence: Synthetic coding sequence
atgggctctgtgactggagctgtgctgaagaccctgctgctgagcacccagaactggaacagagtggaggccggcaacagctatgactgtgatgaccccctggtgtctgccctgccccaggccagcttcagcagcagcagcgagctgagcagcagccacggccctggctttgcccggctgaacagaagagatggagctgggggctggagccccctggtgagcaacaagtaccagtggctgcagattgacctgggggagaggatggaggtgacagctgtggccacccagggcggctacggcagcagcaactgggtgaccagctacctgctgatgttcagtgacagcggctggaactggaagcagtaccggcaggaggacagcatctggggcttctctggaaatgccaatgctgacagcgtggtgtactaccgcctgcagcccagcatcaaggcccgcttcctgcgcttcatccccctggagtggaaccccaagggcagaattggcatgagaattgaggtgtttggctgtgcctacagaagtgaggtggtggacctggatggcaagagcagcctgctgtacagatttgaccagaagagcctgagccccatcaaggacatcatcagcctgaagttcaagaccatgcagagtgatggcatcctgctgcaccgggagggccccaatggagaccacatcaccctgcagctgcggcgggcccggctcttcctgctgatcaacagcggggaggccaagctgcccagcaccagcaccctggtgaacctgaccctgggcagcctgctggatgaccagcactggcacagcgtgctgatccagaggctgggcaagcaggtgaacttcaccgtggatgagcaccgccaccacttccacgcccggggggagttcaacctgatgaacctggactatgagatcagctttggaggcatcccagcccctgggaagtctgtgtccttcccccacaggaacttccacggctgcctggagaacctgtactacaacggggtggacatcatcgacctggccaagcagcagaagccccagatcatcgccatgggaaatgtgtccttcagctgcagccagccccagagcatgcctgtgaccttcctgagcagccgcagctacctggccctgcctgacttcagcggggaggaggaggtgtctgccaccttccagttccgcacctggaacaaggccggcctgctgctcttcagcgagctgcagctgatcagcggcggcatcctgctcttcctgagtgatggcaagctgaagagcaacctgtaccagcccgggaagctgcccagcgacatcacagctggggtggagctgaatgatggccagtggcacagcgtgtccctgagcgccaagaagaaccacctgtctgtggccgtggatggccagatggccagcgctgcccccctgctgggccctgagcagatctacagcggcggcacctactactttggaggctgcccagacaagagctttggcagcaagtgcaagagccccctgggcggcttccagggctgcatgaggctcatcagcatcagcggcaaggtggtggacctgatctctgtgcagcagggcagcctgggcaacttcagtgacctgcagattgacagctgtggcatcagtgaccgctgcctgcccaactactgtgaacatggaggagagtgcagccagagctggagcaccttccactgcaactgcaccaacacaggctacagaggagccacctgccacaacagcatctatgagcagagctgtgaggcctacaagcaccggggcaacaccagcggcttctactacatcgacagtgatggcagcggccccctggagcccttcctgctgtactgcaacatgacagaaacagcctggaccatcatccagcacaacggcagtgacctgaccagggtgaggaacaccaaccctgagaacccctatgccggcttctttgaatatgtggcctccatggagcagctgcaggccaccatcaacagagctgagcactgtgagcaggagttcacctactactgcaagaagagccggctggtgaacaagcaggacggcacccccctgtcctggtgggtgggccgcaccaatgagacccagacctactggggcggcagcagcccagacctgcagaagtgcacctgtggcctggagggcaactgcatcgacagccagtactactgcaactgtgatgctgacagaaatgagtggaccaatgacaccggcctgctggcctacaaggagcacctgcctgtgaccaagatcgtcatcacagacaccggccgcctgcacagcgaggccgcctacaagctgggccccctgctgtgccagggcgaccgctccttctggaacagcgccagctttgacacagaggccagctacctgcacttccccaccttccatggagagctgtctgcagatgtgtccttcttcttcaagaccacagccagcagcggggtcttcctggagaacctgggcattgctgacttcatcagaattgagctgcggagccccaccgtggtgaccttctcctttgatgtgggcaatggcccctttgagatctctgtgcagagccccacccacttcaatgacaaccagtggcaccacgtgcgggtggagaggaacatgaaggaggccagcctgcaggtggaccagctgacccccaagacccagcctgccccagcagatggccacgtgctgctgcagctgaacagccagctgtttgtgggcggcacagccacccggcagaggggcttcctgggctgcatccgcagcctgcagctgaatggcatgaccctggacctggaggagcgggcccaggtgaccccagaggtgcagcccggctgccggggccactgcagcagctatggcaagctgtgcagaaatggaggaaaatgtcgggagcggcccatcggcttcttctgtgactgcaccttcagcgcctacacaggccccttctgcagcaatgagatcagcgcctactttggaagtggcagcagcgtcatctacaacttccaggagaactacctgctgagcaagaacagcagcagccatgctgccagcttccatggagacatgaagctgagccgggagatgatcaagttctccttccgcaccaccaggacccccagcctgctgctgtttgtgtcctccttctacaaggagtacctgagcgtcatcatcgccaagaatggagacctgcagatccgctacaagctgaacaagtaccaggagccagatgtggtgaactttgacttcaagaacatggctgatggccagctgcaccacatcatgatcaaccgggaggagggcgtggtgttcatcgagattgatgacaacagaagacggcaggtgcacctgagcagcggcacagagttctctgctgtgaagagcctggtgctgggccgcatcctggagcacagtgatgtggaccaggacacagccctggccggggcccagggcttcaccggctgcctgtctgctgtgcagctgagccacgtggcccccctgaaggccgccctgcaccccagccacccagaccctgtgacagtgactggacatgtgacagagagcagctgcatggcccagcctggaacagatgccaccagccgggagaggacccacagctttgctgaccacagcggcaccattgatgaccgggagcccctggccaatgccatcaagagtgacagcgctgtgattggaggcctgattgctgtggtgatcttcatcctgctgtgcatcacagccatcgctgtgcgcatctaccagcagaagaggctgtacaagaggtctgaggccaagagaagtgaaaatgtggacagcgctgaggccgtgctgaagtctgagctgaacatccagaatgctgtgaatgaaaaccagaaggagtacttcttctag

SEQ ID NO: 37704 - DNA, 3780 bp, Artificial Sequence
  Description of Artificial Sequence: Synthetic coding sequence
atgggctctgtgactggagctgtgctgaagaccctgctgctgagcacccagaactggaacagagtggaggccggcaacagctatgactgtgatgaccccctggtgtctgccctgccccaggccagcttcagcagcagcagcgagctgagcagcagccacggccctggctttgcccggctgaacagaagagatggagctgggggctggagccccctggtgagcaacaagtaccagtggctgcagattgacctgggggagaggatggaggtgacagctgtggccacccagggcggctacggcagcagcaactgggtgaccagctacctgctgatgttcagtgacagcggctggaactggaagcagtaccggcaggaggacagcatctggggcttctctggaaatgccaatgctgacagcgtggtgtactaccgcctgcagcccagcatcaaggcccgcttcctgcgcttcatccccctggagtggaaccccaagggcagaattggcatgagaattgaggtgtttggctgtgcctacagaagtgaggtggtggacctggatggcaagagcagcctgctgtacagatttgaccagaagagcctgagccccatcaaggacatcatcagcctgaagttcaagaccatgcagagtgatggcatcctgctgcaccgggagggccccaatggagaccacatcaccctgcagctgcggcgggcccggctcttcctgctgatcaacagcggggaggccaagctgcccagcaccagcaccctggtgaacctgaccctgggcagcctgctggatgaccagcactggcacagcgtgctgatccagaggctgggcaagcaggtgaacttcaccgtggatgagcaccgccaccacttccacgcccggggggagttcaacctgatgaacctggactatgagggcaatgtgtccttcagctgcagccagccccagagcatgcctgtgaccttcctgagcagccgcagctacctggccctgcctgacttcagcggggaggaggaggtgtctgccaccttccagttccgcacctggaacaaggccggcctgctgctcttcagcgagctgcagctgatcagcggcggcatcctgctcttcctgagtgatggcaagctgaagagcaacctgtaccagcccgggaagctgcccagcgacatcacagctggggtggagctgaatgatggccagtggcacagcgtgtccctgagcgccaagaagaaccacctgtctgtggccgtggatggccagatggccagcgctgcccccctgctgggccctgagcagatctacagcggcggcacctactactttggaggctgcccagacaagagctttggcagcaagtgcaagagccccctgggcggcttccagggctgcatgaggctcatcagcatcagcggcaaggtggtggacctgatctctgtgcagcagggcagcctgggcaacttcagtgacctgcagattgacagctgtggcatcagtgaccgctgcctgcccaactactgtgaacatggaggagagtgcagccagagctggagcaccttccactgcaactgcaccaacacaggctacagaggagccacctgccacaacagcatctatgagcagagctgtgaggcctacaagcaccggggcaacaccagcggcttctactacatcgacagtgatggcagcggccccctggagcccttcctgctgtactgcaacatgacagaaacagcctggaccatcatccagcacaacggcagtgacctgaccagggtgaggaacaccaaccctgagaacccctatgccggcttctttgaatatgtggcctccatggagcagctgcaggccaccatcaacagagctgagcactgtgagcaggagttcacctactactgcaagaagagccggctggtgaacaagcaggacggcacccccctgtcctggtgggtgggccgcaccaatgagacccagacctactggggcggcagcagcccagacctgcagaagtgcacctgtggcctggagggcaactgcatcgacagccagtactactgcaactgtgatgctgacagaaatgagtggaccaatgacaccggcctgctggcctacaaggagcacctgcctgtgaccaagatcgtcatcacagacaccggccgcctgcacagcgaggccgcctacaagctgggccccctgctgtgccagggcgaccgctccttctggaacagcgccagctttgacacagaggccagctacctgcacttccccaccttccatggagagctgtctgcagatgtgtccttcttcttcaagaccacagccagcagcggggtcttcctggagaacctgggcattgctgacttcatcagaattgagctgcggagccccaccgtggtgaccttctcctttgatgtgggcaatggcccctttgagatctctgtgcagagccccacccacttcaatgacaaccagtggcaccacgtgcgggtggagaggaacatgaaggaggccagcctgcaggtggaccagctgacccccaagacccagcctgccccagcagatggccacgtgctgctgcagctgaacagccagctgtttgtgggcggcacagccacccggcagaggggcttcctgggctgcatccgcagcctgcagctgaatggcatgaccctggacctggaggagcgggcccaggtgaccccagaggtgcagcccggctgccggggccactgcagcagctatggcaagctgtgcagaaatggaggaaaatgtcgggagcggcccatcggcttcttctgtgactgcaccttcagcgcctacacaggccccttctgcagcaatgagatcagcgcctactttggaagtggcagcagcgtcatctacaacttccaggagaactacctgctgagcaagaacagcagcagccatgctgccagcttccatggagacatgaagctgagccgggagatgatcaagttctccttccgcaccaccaggacccccagcctgctgctgtttgtgtcctccttctacaaggagtacctgagcgtcatcatcgccaagaatggagacctgcagatccgctacaagctgaacaagtaccaggagccagatgtggtgaactttgacttcaagaacatggctgatggccagctgcaccacatcatgatcaaccgggaggagggcgtggtgttcatcgagattgatgacaacagaagacggcaggtgcacctgagcagcggcacagagttctctgctgtgaagagcctggtgctgggccgcatcctggagcacagtgatgtggaccaggacacagccctggccggggcccagggcttcaccggctgcctgtctgctgtgcagctgagccacgtggcccccctgaaggccgccctgcaccccagccacccagaccctgtgacagtgactggacatgtgacagagagcagctgcatggcccagcctggaacagatgccaccagccgggagaggacccacagctttgctgaccacagcggcaccattgatgaccgggagcccctggccaatgccatcaagagtgacagcgctgtgattggaggcctgattgctgtggtgatcttcatcctgctgtgcatcacagccatcgctgtgcgcatctaccagcagaagaggctgtacaagaggtctgaggccaagagaagtgaaaatgtggacagcgctgaggccgtgctgaagtctgagctgaacatccagaatgctgtgaatgaaaaccagaaggagtacttcttctag

SEQ ID NO: 37705 - DNA, 3708 bp, Artificial Sequence
  Description of Artificial Sequence: Synthetic coding sequence
atgtggaactatgactgtgatgaccccctggtgtctgccctgccccaggccagcttcagcagcagcagcgagctgagcagcagccacggccctggctttgcccggctgaacagaagagatggagctgggggctggagccccctggtgagcaacaagtaccagtggctgcagattgacctgggggagaggatggaggtgacagctgtggccacccagggcggctacggcagcagcaactgggtgaccagctacctgctgatgttcagtgacagcggctggaactggaagcagtaccggcaggaggacagcatctggggcttctctggaaatgccaatgctgacagcgtggtgtactaccgcctgcagcccagcatcaaggcccgcttcctgcgcttcatccccctggagtggaaccccaagggcagaattggcatgagaattgaggtgtttggctgtgcctacagaagtgaggtggtggacctggatggcaagagcagcctgctgtacagatttgaccagaagagcctgagccccatcaaggacatcatcagcctgaagttcaagaccatgcagagtgatggcatcctgctgcaccgggagggccccaatggagaccacatcaccctgcagctgcggcgggcccggctcttcctgctgatcaacagcggggaggccaagctgcccagcaccagcaccctggtgaacctgaccctgggcagcctgctggatgaccagcactggcacagcgtgctgatccagaggctgggcaagcaggtgaacttcaccgtggatgagcaccgccaccacttccacgcccggggggagttcaacctgatgaacctggactatgagggcaatgtgtccttcagctgcagccagccccagagcatgcctgtgaccttcctgagcagccgcagctacctggccctgcctgacttcagcggggaggaggaggtgtctgccaccttccagttccgcacctggaacaaggccggcctgctgctcttcagcgagctgcagctgatcagcggcggcatcctgctcttcctgagtgatggcaagctgaagagcaacctgtaccagcccgggaagctgcccagcgacatcacagctggggtggagctgaatgatggccagtggcacagcgtgtccctgagcgccaagaagaaccacctgtctgtggccgtggatggccagatggccagcgctgcccccctgctgggccctgagcagatctacagcggcggcacctactactttggaggctgcccagacaagagctttggcagcaagtgcaagagccccctgggcggcttccagggctgcatgaggctcatcagcatcagcggcaaggtggtggacctgatctctgtgcagcagggcagcctgggcaacttcagtgacctgcagattgacagctgtggcatcagtgaccgctgcctgcccaactactgtgaacatggaggagagtgcagccagagctggagcaccttccactgcaactgcaccaacacaggctacagaggagccacctgccacaacagcatctatgagcagagctgtgaggcctacaagcaccggggcaacaccagcggcttctactacatcgacagtgatggcagcggccccctggagcccttcctgctgtactgcaacatgacagaaacagcctggaccatcatccagcacaacggcagtgacctgaccagggtgaggaacaccaaccctgagaacccctatgccggcttctttgaatatgtggcctccatggagcagctgcaggccaccatcaacagagctgagcactgtgagcaggagttcacctactactgcaagaagagccggctggtgaacaagcaggacggcacccccctgtcctggtgggtgggccgcaccaatgagacccagacctactggggcggcagcagcccagacctgcagaagtgcacctgtggcctggagggcaactgcatcgacagccagtactactgcaactgtgatgctgacagaaatgagtggaccaatgacaccggcctgctggcctacaaggagcacctgcctgtgaccaagatcgtcatcacagacaccggccgcctgcacagcgaggccgcctacaagctgggccccctgctgtgccagggcgaccgctccttctggaacagcgccagctttgacacagaggccagctacctgcacttccccaccttccatggagagctgtctgcagatgtgtccttcttcttcaagaccacagccagcagcggggtcttcctggagaacctgggcattgctgacttcatcagaattgagctgcggagccccaccgtggtgaccttctcctttgatgtgggcaatggcccctttgagatctctgtgcagagccccacccacttcaatgacaaccagtggcaccacgtgcgggtggagaggaacatgaaggaggccagcctgcaggtggaccagctgacccccaagacccagcctgccccagcagatggccacgtgctgctgcagctgaacagccagctgtttgtgggcggcacagccacccggcagaggggcttcctgggctgcatccgcagcctgcagctgaatggcatgaccctggacctggaggagcgggcccaggtgaccccagaggtgcagcccggctgccggggccactgcagcagctatggcaagctgtgcagaaatggaggaaaatgtcgggagcggcccatcggcttcttctgtgactgcaccttcagcgcctacacaggccccttctgcagcaatgagatcagcgcctactttggaagtggcagcagcgtcatctacaacttccaggagaactacctgctgagcaagaacagcagcagccatgctgccagcttccatggagacatgaagctgagccgggagatgatcaagttctccttccgcaccaccaggacccccagcctgctgctgtttgtgtcctccttctacaaggagtacctgagcgtcatcatcgccaagaatggcagcctgcagatccgctacaagctgaacaagtaccaggagccagatgtggtgaactttgacttcaagaacatggctgatggccagctgcaccacatcatgatcaaccgggaggagggcgtggtgttcatcgagattgatgacaacagaagacggcaggtgcacctgagcagcggcacagagttctctgctgtgaagagcctggtgctgggccgcatcctggagcacagtgatgtggaccaggacacagccctggccggggcccagggcttcaccggctgcctgtctgctgtgcagctgagccacgtggcccccctgaaggccgccctgcaccccagccacccagaccctgtgacagtgactggacatgtgacagagagcagctgcatggcccagcctggaacagatgccaccagccgggagaggacccacagctttgctgaccacagcggcaccattgatgaccgggagcccctggccaatgccatcaagagtgacagcgctgtgattggaggcctgattgctgtggtgatcttcatcctgctgtgcatcacagccatcgctgtgcgcatctaccagcagaagaggctgtacaagaggtctgaggccaagagaagtgaaaatgtggacagcgctgaggccgtgctgaagtctgagctgaacatccagaatgctgtgaatgaaaaccagaaggagtacttcttctag

SEQ ID NO: 37706 - DNA, 1512 bp, Artificial Sequence
  Description of Artificial Sequence: Synthetic coding sequence
atgagcctgggcggggccagcgagaggtctgtgcctgccaccaagattgagatcaccgtgtcctgcaggaacctgctggacctggacaccttcagcaagagtgaccccatggtggtgctgtacacccagagccgggccagccaggagtggagggagtttggaagaacagaggtgattgacaacaccctgaacccagactttgtgaggaagtttgtgctggactacttctttgaggagaagcagaacctgcgctttgatgtgtacaacgtggacagcaagaccaacatcagcaagcccaaggacttcctgggccaggccttcctggccctgggggaggtgattggaggccagggcagccgggtggagaggaccctgactggagtgcctgggaagaagtgtggcaccatcctgctgacagctgaggagctgagcaactgccgggacatcgccaccatgcagctgtgtgccaacaagctggacaagaaggacttcttcggcaagagtgaccccttcctggtgttctaccgcagcaatgaagatggcaccttcaccatctgccacaagacagaggtggtgaagaacaccctgaaccctgtgtggcagcccttcagcatccctgtgcgggccctgtgcaatggagactatgacagaacagtgaagattgatgtgtatgactgggacagagatggcagccatgacttcatcggggagttcaccaccagctaccgggagctgagcaaggcccagaaccagttcaccgtgtatgaggtgctgaaccccaggaagaagtgcaagaagaagaagtatgtgaacagcggcaccgtgaccctgctgtccttctctgtggacagcgagttcacctttgtggactacatcaagggcggcacccagctgaacttcaccgtggccatcgacttcaccgccagcaatggaaaccccctgcagcccaccagcctgcactacatgagcccctaccagctgagcgcctatgccatggccctgaaggctgtgggggagatcatccaggactatgacagcgacaagctgtttcctgcctacggctttggagccaagctgcccccagagggccgcatcagccaccagttccccctgaacaacaatgatgaggaccccaactgtgccggcattgaaggagtgctggagagctacttccagagcctgaggacagtgcagctgtatggccccacctactttgcccctgtgatcaaccaggtggcccgggccgccgccaagatcagtgatggcagccagtactacgtgctgctgatcatcacagatggagtcatcagtgacatgacccagaccaaggaggccatcgtgtctgccagcagcctgcccatgagcatcatcatcgtgggcgtgggccctgccatgtttgaggccatggaggagctggatggagatgatgtgcgggtgagcagccggggccgctatgcagagcgggacatcgtgcaggagggctgctgcagcctgggcacctctgtggtgtag

SEQ ID NO: 37707 - DNA, 1662 bp, Artificial Sequence
  Description of Artificial Sequence: Synthetic coding sequence
atgagcctgggcggggccagcgagaggtctgtgcctgccaccaagattgagatcaccgtgtcctgcaggaacctgctggacctggacaccttcagcaagagtgaccccatggtggtgctgtacacccagagccgggccagccaggagtggagggagtttggaagaacagaggtgattgacaacaccctgaacccagactttgtgaggaagtttgtgctggactacttctttgaggagaagcagaacctgcgctttgatgtgtacaacgtggacagcaagaccaacatcagcaagcccaaggacttcctgggccaggccttcctggccctgggggaggtgattggaggccagggcagccgggtggagaggaccctgactggagtgcctgggaagaagtgtggcaccatcctgctgacagctgaggagctgagcaactgccgggacatcgccaccatgcagctgtgtgccaacaagctggacaagaaggacttcttcggcaagagtgaccccttcctggtgttctaccgcagcaatgaagatggcaccttcaccatctgccacaagacagaggtggtgaagaacaccctgaaccctgtgtggcagcccttcagcatccctgtgcgggccctgtgcaatggagactatgacagaacagtgaagattgatgtgtatgactgggacagagatggcagccatgacttcatcggggagttcaccaccagctaccgggagctgagcaaggcccagaaccagttcaccgtgtatgaggtgctgaaccccaggaagaagtgcaagaagaagaagtatgtgaacagcggcaccgtgaccctgctgtccttctctgtggacagcgagttcacctttgtggactacatcaagggcggcacccagctgaacttcaccgtggccatcgacttcaccgccagcaatggaaaccccctgcagcccaccagcctgcactacatgagcccctaccagctgagcgcctatgccatggccctgaaggctgtgggggagatcatccaggactatgacagcgacaagctgtttcctgcctacggctttggagccaagctgcccccagagggccgcatcagccaccagttccccctgaacaacaatgatgaggaccccaactgtgccggcattgaaggagtgctggagagctacttccagagcctgaggacagtgcagctgtatggccccacctactttgcccctgtgatcaaccaggtggcccgggccgccgccaagatcagtgatggcagccagtactacgtgctgctgatcatcacagatggagtcatcagtgacatgacccagaccaaggaggccatcgtgtctgccagcagcctgcccatgagcatcatcatcgtgggcgtgggccctgccatgtttgaggccatggaggagctggatggagatgatgtgcgggtgagcagccggggccgctatgcagagcgggacatcgtgcagtttgtgcccttccgggactatgtggacagaagtggcaaccaggtgctgtccatggcccggctggccaaggatgtgctggccgagatccctgagcagctgctgagctacatgaggacccgggacatccagccccggcccccacctccagccaaccccagccccatcccagcccctgagcagccctag

SEQ ID NO: 37708 - DNA, 1614 bp, Artificial Sequence
  Description of Artificial Sequence: Synthetic coding sequence
atggcccactgtgtgaccctggtgcagctgagcatcagctgtgaccacctgattgacaaggacatcggcagcaagagtgaccccctgtgtgtgctgctgcaggatgtgggcggcggctcctgggccgagctgggccgcacagagcgggtgaggaactgcagcagccctgagttcagcaagaccctgcagctggagtacagatttgagaccgtgcagaagctgcgcttcggcatctatgacatcgacaacaagaccccagagctgagagatgatgacttcctgggcggcgctgagtgcagcctgggccagatcgtgagcagccaggtgctgaccctgcccctgatgctgaagccaggcaagccagctggccggggcaccatcaccgtgtctgcccaggagctgaaggacaacagagtggtgaccatggaggtggaggccaggaacctggacaagaaggacttcctgggcaagagtgaccccttcctggagttcttccggcagggagatggcaagtggcacctggtgtacagaagtgaggtgatcaagaacaacctgaaccccacctggaagcgcttctctgtgcctgtgcagcacttctgtggcggcaaccccagcacccccatccaggtgcagtgcagcgactatgacagtgatggcagccatgacctgattggcaccttccacaccagcctggcccagctgcaggccgtgcctgctgagtttgagtgcatccaccctgagaagcagcagaagaagaagagctacaagaacagcggcaccatccgggtgaagatctgccgggtggagacagagtacagcttcctggactatgtgatgggcggctgccagatcaacttcaccgtgggcgtggacttcaccggcagcaatggagaccccagcagcccagacagcctgcactacctgagccccactggagtgaatgagtacctgatggccctgtggagcgtgggctctgtggtgcaggactatgacagcgacaagctgtttcctgcctttggatttggagcccaggtgcccccagactggcaggtgtcccatgaatttgccctgaacttcaaccccagcaacccctactgtgccggcatccagggcatcgtggatgcctaccggcaggccctgccccaggtgcggctgtatggccccaccaactttgcccccatcatcaaccacgtggccaggtttgctgcccaggccgcccaccagggcacagccagccagtacttcatgctgctgctgctgacagatggagctgtgacagatgtggaggccacccgggaggccgtggtgcgggccagcaacctgcccatgtctgtcatcatcgtgggcgtgggcggcgctgactttgaggccatggagcagctggatgctgatggcggccccctgcacaccaggagcggccaggccgccgcccgggacatcgtgcagtttgtgccctaccgccgcttccagaatgccccccgggaggccctggcccagacagtgctggccgaggtgcccacccagctggtgtcctacttccgggcccagggctgggcccccctgaagcccctgcccccatctgccaaggaccctgcccaggccccccaggcctag

SEQ ID NO: 37709 - DNA, 1629 bp, Artificial Sequence
  Description of Artificial Sequence: Synthetic coding sequence
atgaagatgatgcacatggcccactgtgtgaccctggtgcagctgagcatcagctgtgaccacctgattgacaaggacatcggcagcaagagtgaccccctgtgtgtgctgctgcaggatgtgggcggcggctcctgggccgagctgggccgcacagagcgggtgaggaactgcagcagccctgagttcagcaagaccctgcagctggagtacagatttgaaacagtgcagaagctgcgcttcggcatctatgacatcgacaacaagaccccagagctgagagatgatgacttcctgggcggcgcagaatgttccctgggccagatcgtgagcagccaggtgctgaccctgcccctgatgctgaagccaggcaagccagctggccggggcaccatcaccgtgtctgcccaggagctgaaggacaacagagtggtgaccatggaggtggaggccaggaacctggacaagaaggacttcctgggcaagagtgaccccttcctggagttcttccggcagggagatggcaagtggcacctggtgtacagaagtgaggtgatcaagaacaacctgaaccccacctggaagcgcttctctgtgcctgtgcagcacttctgtggcggcaaccccagcacccccatccaggtgcagtgcagcgactatgacagtgatggcagccatgacctgattggcaccttccacaccagcctggcccagctgcaggccgtgcctgctgagtttgagtgcatccaccctgagaagcagcagaagaagaagagctacaagaacagcggcaccatccgggtgaagatctgccgggtggagacagagtacagcttcctggactatgtgatgggcggctgccagatcaacttcaccgtgggcgtggacttcaccggcagcaatggagaccccagcagcccagacagcctgcactacctgagccccaccggggtgaatgagtacctgatggccctgtggagcgtgggctctgtggtgcaggactatgacagcgacaagctgtttcctgccttcggctttggagcccaggtgcccccagactggcaggtgtcccatgaatttgccctgaacttcaaccccagcaacccctactgtgccggcatccagggcatcgtggatgcctaccggcaggccctgccccaggtgcggctgtatggccccaccaactttgcccccatcatcaaccacgtggccaggtttgctgcccaggccgcccaccagggcacagccagccagtacttcatgctgctgctgctgacagatggagctgtgacagatgtggaggccacccgggaggccgtggtgcgggccagcaacctgcccatgtctgtcatcatcgtgggcgtgggcggcgctgactttgaggccatggagcagctggatgctgatggcggccccctgcacaccaggagcggccaggccgccgcccgggacatcgtgcagtttgtgccctaccgccgcttccagaatgccccccgggaggccctggcccagacagtgctggccgaggtgcccacccagctggtgtcctacttccgggcccagggctgggcccccctgaagcccctgccccccagcgccaaggaccctgcccaggccccccaggcctag

SEQ ID NO: 37710 - DNA, 1614 bp, Artificial Sequence; identical to SEQ ID NO: 37708
  Description of Artificial Sequence: Synthetic coding sequence

SEQ ID NO: 37711 - DNA, 1614 bp, Artificial Sequence; identical to SEQ ID NO: 37708
  Description of Artificial Sequence: Synthetic coding sequence

SEQ ID NO: 37712 - DNA, 1614 bp, Artificial Sequence; identical to SEQ ID NO: 37708
  Description of Artificial Sequence: Synthetic coding sequence

SEQ ID NO: 37713 - DNA, 1614 bp, Artificial Sequence; identical to SEQ ID NO: 37708
  Description of Artificial Sequence: Synthetic coding sequence

SEQ ID NO: 37714 - DNA, 915 bp, Artificial Sequence
  Description of Artificial Sequence: Synthetic coding sequence
atggcccactgtgtgaccctggtgcagctgagcatcagctgtgaccacctgattgacaaggacatcggcagcaagagtgaccccctgtgtgtgctgctgcaggatgtgggcggcggctcctgggccgagctgggccgcacagagcgggtgaggaactgcagcagccctgagttcagcaagaccctgcagctggagtacagatttgagaccgtgcagaagctgcgcttcggcatctatgacatcgacaacaagaccccagagctgagagatgatgacttcctgggcggcgctgagtgcagcctgggccagatcgtgagcagccaggtgctgaccctgcccctgatgctgaagccaggcaagccagctggccggggcaccatcaccgtgtctgcccaggagctgaaggacaacagagtggtgaccatggaggtggaggccaggaacctggacaagaaggacttcctgggcaagagtgaccccttcctggagttcttccggcagggagatggcaagtggcacctggtgtacagaagtgaggtgatcaagaacaacctgaaccccacctggaagcgcttctctgtgcctgtgcagcacttctgtggcggcaaccccagcacccccatccaggtgcagtgcagcgactatgacagtgatggcagccatgacctgattggcaccttccacaccagcctggcccagctgcaggccgtgcctgctgagtttgagtgcatccaccctgagaagcagcagaagaagaagagctacaagaacagcggcaccatccgggtgaagatctgccgggtggagacagagtacagcttcctggactatgtgatgggcggctgccagatcaacttcaccgtgggcgtggacttcaccggcagcaatggagaccccagcagcccagacagctag

SEQ ID NO: 37715 - DNA, 411 bp, Artificial Sequence
  Description of Artificial Sequence: Synthetic coding sequence
atggcccactgtgtgaccctggtgcagctgagcatcagctgtgaccacctgattgacaaggacatcggcagcaagagtgaccccctgtgtgtgctgctgcaggatgtgggcggcggctcctgggccgagctgggccgcacagagcgggtgaggaactgcagcagccctgagttcagcaagaccctgcagctggagtacagatttgagaccgtgcagaagctgcgcttcggcatctatgacatcgacaacaagaccccagagctgagagatgatgacttcctgggcggcgctgagtgcagcctgggccagatcgtgagcagccaggtgctgaccctgcccctgatgctgaagccaggcaagccagctggccggggcaccatcaccgtgtctgcccaggagctgaaggactag

SEQ ID NO: 37716 - DNA, 630 bp, Artificial Sequence
  Description of Artificial Sequence: Synthetic coding sequence
atggcccactgtgtgaccctggtgcagctgagcatcagctgtgaccacctgattgacaaggacatcggcagcaagagtgaccccctgtgtgtgctgctgcaggatgtgggcggcggctcctgggccgagctgggccgcacagagcgggtgaggaactgcagcagccctgagttcagcaagaccctgcagctggagtacagatttgagaccgtgcagaagctgcgcttcggcatctatgacatcgacaacaagaccccagagctgagagatgatgacttcctgggcggcgctgagtgcagcctgggccagatcgtgagcagccaggtgctgaccctgcccctgatgctgaagccaggcaagccagctggccggggcaccatcaccgtgtctgcccaggagctgaaggacaacagagtggtgaccatggaggtggaggccaggaacctggacaagaaggacttcctgggcaagagtgaccccttcctggagttcttccggcagggagatggcaagtggcacctggtgtacagaagtgaggtgatcaagaacaacctgaaccccacctggaagcgcttctctgtgcctgtgcagcacttctgtggcggcaaccccagcacccccatccagtag

SEQ ID NO: 37717 - DNA, 609 bp, Artificial Sequence
  Description of Artificial Sequence: Synthetic coding sequence
atggcccactgtgtgaccctggtgcagctgagcatcagctgtgaccacctgattgacaaggacatcggcagcaagagtgaccccctgtgtgtgctgctgcaggatgtgggcggcggctcctgggccgagctgggccgcacagagcgggtgaggaactgcagcagccctgagttcagcaagaccctgcagctggagtacagatttgagaccgtgcagaagctgcgcttcggcatctatgacatcgacaacaagaccccagagctgagagatgatgacttcctgggcggcgctgagtgcagcctgggccagatcgtgagcagccaggtgctgaccctgcccctgatgctgaagccaggcaagccagctggccggggcaccatcaccgtgtctgcccaggagctgaaggacaacagagtggtgaccatggaggtggaggccaggaacctggacaagaaggacttcctgggcaagagtgaccccttcctggagttcttccggcagggagatggcaagtggcacctggtgtacagaagtgaggtgatcaagaacaacctgaaccccacctggaagcgcttctctgtgcctgtgcagcacttctgtggcggctag

SEQ ID NO: 37718 - DNA, 204 bp, Artificial Sequence
  Description of Artificial Sequence: Synthetic coding sequence
atggcccactgtgtgaccctggtgcagctgagcatcagctgtgaccacctgattgacaaggacatcggcagcaagagtgaccccctgtgtgtgctgctgcaggatgtgggcggcggctcctgggccgagctgggccgcacagagcgggtgaggaactgcagcagccctgagttcagcaagaccctgcagctggagtacagatag

SEQ ID NO: 37719 - DNA, 459 bp, Artificial Sequence
  Description of Artificial Sequence: Synthetic coding sequence
atggcccactgtgtgaccctggtgcagctgagcatcagctgtgaccacctgattgacaaggacatcggcagcaagagtgaccccctgtgtgtgctgctgcaggatgtgggcggcggctcctgggccgagctgggccgcacagagcgggtgaggaactgcagcagccctgagttcagcaagaccctgcagctggagtacagatttgagaccgtgcagaagctgcgcttcggcatctatgacatcgacaacaagaccccagagctgagagatgatgacttcctgggcggcgctgagtgcagcctgggccagatcgtgagcagccaggtgctgaccctgcccctgatgctgaagccaggcaagccagctggccggggcaccatcaccgtgtctgcccaggagctgaaggacaacagagtggtgaccatggaggtggaggccaggaacctggacaagaagtag

SEQ ID NO: 37720 - DNA, 696 bp, Artificial Sequence
  Description of Artificial Sequence: Synthetic coding sequence
atggcccactgtgtgaccctggtgcagctgagcatcagctgtgaccacctgattgacaaggacatcggcagcaagagtgaccccctgtgtgtgctgctgcaggatgtgggcggcggctcctgggccgagctgggccgcacagagcgggtgaggaactgcagcagccctgagttcagcaagaccctgcagctggagtacagatttgagaccgtgcagaagctgcgcttcggcatctatgacatcgacaacaagaccccagagctgagagatgatgacttcctgggcggcgctgagtgcagcctgggccagatcgtgagcagccaggtgctgaccctgcccctgatgctgaagccaggcaagccagctggccggggcaccatcaccgtgtctgcccaggagctgaaggacaacagagtggtgaccatggaggtggaggccaggaacctggacaagaaggacttcctgggcaagagtgaccccttcctggagttcttccggcagggagatggcaagtggcacctggtgtacagaagtgaggtgatcaagaacaacctgaaccccacctggaagcgcttctctgtgcctgtgcagcacttctgtggcggcaaccccagcacccccatccaggtgcagtgcagcgactatgacagtgatggcagccatgacctgattggcaccttccacaccagcctgtag

SEQ ID NO: 37721 - DNA, 525 bp, Artificial Sequence
  Description of Artificial Sequence: Synthetic coding sequence
atggcccactgtgtgaccctggtgcagctgagcatcagctgtgaccacctgattgacaaggacatcggcagcaagagtgaccccctgtgtgtgctgctgcaggatgtgggcggcggctcctgggccgagctgggccgcacagagcgggtgaggaactgcagcagccctgagttcagcaagaccctgcagctggagtacagatttgagaccgtgcagaagctgcgcttcggcatctatgacatcgacaacaagaccccagagctgagagatgatgacttcctgggcggcgctgagtgcagcctgggccagatcgtgagcagccaggtgctgaccctgcccctgatgctgaagccaggcaagccagctggccggggcaccatcaccgtgtctgcccaggagctgaaggacaacagagtggtgaccatggaggtggaggccaggaacctggacaagaaggacttcctgggcaagagtgaccccttcctggagttcttccggcagggagatggcaagtggcacctgtag

SEQ ID NO: 37722 - DNA, 1647 bp, Artificial Sequence
  Description of Artificial Sequence: Synthetic coding sequence
atggcccacatccccagcggcggggccccagctgctggggccgcccccatgggcccccagtactgtgtgtgcaaggtggagctgtctgtgtctggccagaacctgctggacagagatgtgaccagcaagagtgaccccttctgtgtgctcttcacagaaaataatggccgctggattgaatatgacagaacagaaacagccatcaacaacctgaacccagccttcagcaagaagtttgtgctggactaccactttgaggaggtgcagaagctgaagtttgccctgtttgaccaggacaagagctccatgaggctggatgaacatgacttcctgggccagttcagctgcagcctgggcaccatcgtgagcagcaagaagatcacccggcccctgctgctgctgaatgacaagccagctgggaagggcctcatcaccatcgccgcccaggagctgagtgacaacagagtcatcaccctgagcctggccggccggcggctggacaagaaggacctgtttgggaagagtgaccccttcctggagttctacaagccaggagatgatggcaagtggatgctggtgcacaggacagaggtgatcaagtacaccctggaccctgtgtggaagcccttcaccgtgcccctggtgtccctgtgtgatggagacatggagaagcccatccaggtgatgtgctatgactatgacaatgatggcggccatgacttcatcggggagttccagacctctgtgtcccagatgtgtgaggcccgggacagcgtgcccctggagtttgagtgcatcaaccccaagaagcagaggaagaagaagaactacaagaacagcggcatcatcatcctgcggagctgcaagatcaacagagactacagcttcctggactacatcctgggcggctgccagctgatgttcaccgtgggcatcgacttcaccgccagcaatggaaaccccctggaccccagcagcctgcactacatcaaccccatgggcaccaatgagtacctgagcgccatctgggccgtgggccagatcatccaggactatgacagcgacaagatgtttcctgccctgggctttggagcccagctgcccccagactggaaggtgtcccatgaatttgccatcaacttcaaccccaccaaccccttctgcagcggcgtggatggcatcgcccaggcctacagcgcctgcctgccccacatccgcttctacggccccaccaacttcagccccatcgtgaaccacgtggccaggtttgctgcccaggccacccagcagaggacagccacccagtacttcatcctgctgatcatcacagatggagtcatcagtgacatggaggagaccaggcatgctgtggtgcaggccagcaagctgcccatgagcatcatcatcgtgggcgtgggcaatgctgactttgctgccatggagttcctggatggagacagcaggatgctgcggagccacactggagaggaggccgcccgggacatcgtgcagtttgtgcccttccgggagttcagaaatgctgccaaggagaccctggccaaggctgtgctggccgagctgccccagcaggtggtgcagtacttcaagcacaagaacctgccccccaccaacagcgagcccgcctag

SEQ ID NO: 37723 - DNA, 1647 bp, Artificial Sequence; identical to SEQ ID NO: 37722
  Description of Artificial Sequence: Synthetic coding sequence

SEQ ID NO: 37724 - DNA, 1341 bp, Artificial Sequence
  Description of Artificial Sequence: Synthetic coding sequence
atgaggctggatgaacatgacttcctgggccagttcagctgcagcctgggcaccatcgtgagcagcaagaagatcacccggcccctgctgctgctgaatgacaagccagctgggaagggcctcatcaccatcgccgcccaggagctgagtgacaacagagtcatcaccctgagcctggccggccggcggctggacaagaaggacctgtttgggaagagtgaccccttcctggagttctacaagccaggagatgatggcaagtggatgctggtgcacaggacagaggtgatcaagtacaccctggaccctgtgtggaagcccttcaccgtgcccctggtgtccctgtgtgatggagacatggagaagcccatccaggtgatgtgctatgactatgacaatgatggcggccatgacttcatcggggagttccagacctctgtgtcccagatgtgtgaggcccgggacagcgtgcccctggagtttgagtgcatcaaccccaagaagcagaggaagaagaagaactacaagaacagcggcatcatcatcctgcggagctgcaagatcaacagagactacagcttcctggactacatcctgggcggctgccagctgatgttcaccgtgggcatcgacttcaccgccagcaatggaaaccccctggaccccagcagcctgcactacatcaaccccatgggcaccaatgagtacctgagcgccatctgggccgtgggccagatcatccaggactatgacagcgacaagatgtttcctgccctgggctttggagcccagctgcccccagactggaaggtgtcccatgaatttgccatcaacttcaaccccaccaaccccttctgcagcggcgtggatggcatcgcccaggcctacagcgcctgcctgccccacatccgcttctacggccccaccaacttcagccccatcgtgaaccacgtggccaggtttgctgcccaggccacccagcagaggacagccacccagtacttcatcctgctgatcatcacagatggagtcatcagtgacatggaggagaccaggcatgctgtggtgcaggccagcaagctgcccatgagcatcatcatcgtgggcgtgggcaatgctgactttgctgccatggagttcctggatggagacagcaggatgctgcggagccacactggagaggaggccgcccgggacatcgtgcagtttgtgcccttccgggagttcagaaatgctgccaaggagaccctggccaaggctgtgctggccgagctgccccagcaggtggtgcagtacttcaagcacaagaacctgccccccaccaacagcgagcccgcctag

SEQ ID NO: 37725 - DNA, 1674 bp, Artificial Sequence
  Description of Artificial Sequence: Synthetic coding sequence
atgaagaagatgagcaacatctatgagagcgctgccaacaccctgggcatcttcaacagcccctgcctgaccaaggtggagctgcgggtggcctgcaagggcatcagtgacagagatgccctgagcaagccagacccctgtgtgatcctgaagatgcagagccacggccagtggtttgaggtggacagaacagaggtgatccgcacctgcatcaaccctgtgtacagcaagctgttcaccgtggacttctactttgaggaggtgcagaggctgcgctttgaggtgcatgacatcagcagcaaccacaacggcctgaaggaggccgacttcctgggcggcatggagtgcaccctgggccagatcgtgtcccagaggaagctgagcaagagcctgctgaagcacggcaacacagctgggaagagcagcatcaccgtgattgctgaggagctgtctggaaatgatgattatgtggagctggccttcaatgccaggaagctggatgacaaggacttcttcagcaagagtgaccccttcctggagatcttcaggatgaatgatgatgccacccagcagctggtgcacaggacagaggtggtgatgaacaacctgagccctgcctggaagagcttcaaggtgtctgtgaacagcctgtgcagcggggaccctgaccggcggctgaagtgcatcgtgtgggactgggacagcaatggcaagcatgacttcatcggggagttcaccagcaccttcaaggagatgagaggagccatggagggcaagcaggtgcagtgggagtgcatcaaccccaagtacaaggccaagaagaagaactacaagaacagcggcaccgtcatcctgaacctgtgcaagatccacaagatgcacagcttcctggactacatcatgggcggctgccagatccagttcaccgtggccatcgacttcaccgccagcaatggagaccccaggaacagctgcagcctgcactacatccacccctaccagcccaatgagtacctgaaggccctggtggccgtgggggagatctgccaggactatgacagcgacaagatgtttcctgcctttggatttggagcccgcatccccccagagtacacagtgtcccatgactttgccatcaacttcaatgaagacaacccagaatgtgccggcatccagggcgtggtggaggcctaccagagctgcctgcccaagctgcagctgtatggccccaccaacatcgcccccatcatccagaaggtggccaagagcgccagcgaggagaccaacaccaaggaggccagccagtacttcatcctgctgatcctgacagatggagtcatcacagacatggctgacacccgggaggccatcgtgcacgccagccacctgcccatgtctgtcatcatcgtgggcgtgggcaatgctgacttcagtgacatgcagatgctggatggagatgatggcatcctgcggagccccaagggggagcctgtgctgcgggacatcgtgcagtttgtgcccttcaggaacttcaagcacgccagccctgctgccctggccaagtctgtgctggccgaggtgcccaaccaggtggtggactactacaacgggaagggcatcaagcccaagtgcagcagcgagatgtatgagagcagcaggaccctggccccctag

SEQ ID NO: 37726 - DNA, 1728 bp, Artificial Sequence
  Description of Artificial Sequence: Synthetic coding sequence
atggctgtggagcccagcagcagcgagagcatcaagagaagagctggaagaaggatgaagaagatgagcaacatctatgagagcgctgccaacaccctgggcatcttcaacagcccctgcctgaccaaggtggagctgcgggtggcctgcaagggcatcagtgacagagatgccctgagcaagccagacccctgtgtgatcctgaagatgcagagccacggccagtggtttgaggtggacagaacagaggtgatccgcacctgcatcaaccctgtgtacagcaagctgttcaccgtggacttctactttgaggaggtgcagaggctgcgctttgaggtgcatgacatcagcagcaaccacaacggcctgaaggaggccgacttcctgggcggcatggagtgcaccctgggccagatcgtgtcccagaggaagctgagcaagagcctgctgaagcacggcaacacagctgggaagagcagcatcaccgtgattgctgaggagctgtctggaaatgatgattatgtggagctggccttcaatgccaggaagctggatgacaaggacttcttcagcaagagtgaccccttcctggagatcttcaggatgaatgatgatgccacccagcagctggtgcacaggacagaggtggtgatgaacaacctgagccctgcctggaagagcttcaaggtgtctgtgaacagcctgtgcagcggggaccctgaccggcggctgaagtgcatcgtgtgggactgggacagcaatggcaagcatgacttcatcggggagttcaccagcaccttcaaggagatgagaggagccatggagggcaagcaggtgcagtgggagtgcatcaaccccaagtacaaggccaagaagaagaactacaagaacagcggcaccgtcatcctgaacctgtgcaagatccacaagatgcacagcttcctggactacatcatgggcggctgccagatccagttcaccgtggccatcgacttcaccgccagcaatggagaccccaggaacagctgcagcctgcactacatccacccctaccagcccaatgagtacctgaaggccctggtggccgtgggggagatctgccaggactatgacagcgacaagatgtttcctgcctttggatttggagcccgcatccccccagagtacacagtgtcccatgactttgccatcaacttcaatgaagacaacccagaatgtgccggcatccagggcgtggtggaggcctaccagagctgcctgcccaagctgcagctgtatggccccaccaacatcgcccccatcatccagaaggtggccaagagcgccagcgaggagaccaacaccaaggaggccagccagtacttcatcctgctgatcctgacagatggagtcatcacagacatggctgacacccgggaggccatcgtgcacgccagccacctgcccatgtctgtcatcatcgtgggcgtgggcaatgctgacttcagtgacatgcagatgctggatggagatgatggcatcctgcggagccccaagggggagcctgtgctgcgggacatcgtgcagtttgtgcccttcaggaacttcaagcacgccagccctgctgccctggccaagtctgtgctggccgaggtgcccaaccaggtggtggactactacaacgggaagggcatcaagcccaagtgcagcagcgagatgtatgagagcagcaggaccctggccccctag

SEQ ID NO: 37727 - DNA, 510 bp, Artificial Sequence
  Description of Artificial Sequence: Synthetic coding sequence
atgaagaagatgagcaacatctatgagagcgctgccaacaccctgggcatcttcaacagcccctgcctgaccaaggtggagctgcgggtggcctgcaagggcatcagtgacagagatgccctgagcaagccagacccctgtgtgatcctgaagatgcagagccacggccagtggtttgaggtggacagaacagaggtgatccgcacctgcatcaaccctgtgtacagcaagctgttcaccgtggacttctactttgaggaggtgcagaggctgcgctttgaggtgcatgacatcagcagcaaccacaacggcctgaaggaggccgacttcctgggcggcatggagtgcaccctgggccagatcgtgtcccagaggaagctgagcaagagcctgctgaagcacggcaacacagctgggaagagcagcatcaccgtgattgctgaggagctgtctggaaatgatgattatgtggagctggccttcaatgccaggaagctggatgacaagtag

SEQ ID NO: 37728 - DNA, 1674 bp, Artificial Sequence; identical to SEQ ID NO: 37725
  Description of Artificial Sequence: Synthetic coding sequence

SEQ ID NO: 37729 - DNA, 1728 bp, Artificial Sequence; identical to SEQ ID NO: 37726
  Description of Artificial Sequence: Synthetic coding sequence

SEQ ID NO: 37730 - DNA, 1695 bp, Artificial Sequence
  Description of Artificial Sequence: Synthetic coding sequence
atggacagccgctacaacagcacagctggcattggagacctgaaccagctgtctgctgccatcccagccaccagggtggaggtgtctgtgtcctgcaggaacctgctggaccgggacaccttcagcaagagtgaccccatctgtgtgctgtatgtgcagggcgtgggcaacaaggagtggagggagtttggaagaacagaggtgattgacaacaccctgaacccagactttgtgaggaagttcatcctggactacttctttgaggagcgggagaacctgcgctttgacctgtatgatgtggacagcaagagccccaacctgagcaagcatgacttcctgggccaggtgttctgcaccctgggggagatcgtgggcagccagggcagccggctggagaagcccatcgtgggcatccctgggaagaagtgtggcaccatcatcctgacagctgaggagctgaactgctgcagagatgctgtgctgatgcagttctgtgccaacaagctggacaagaaggacttcttcggcaagagtgaccccttcctggtgttctaccgcagcaatgaagatggcagcttcaccatctgccacaagacagaggtggtgaagaacaccctgaaccctgtgtggcaggccttcaagatctctgtgcgggccctgtgcaatggagactatgacaggaccatcaaggtggaggtgtatgactgggacagagatggcagccatgacttcatcggggagttcaccaccagctaccgggagctgagccggggccagagccagttcaacgtgtatgaggtggtgaaccccaagaagaagggcaagaagaagaagtacaccaacagcggcaccgtgaccctgctgtccttcctggtggagacagaggtgtccttcctggactacatcaagggcggcacccagatcaacttcaccgtggccatcgacttcaccgccagcaatggaaatcctgcccagcccaccagcctgcactacatgaacccctaccagctgaatgcctacggcatggccctgaaggctgtgggggagatcgtgcaggactatgacagcgacaagatgtttcctgccctgggctttggagccaagctgcccccagatggccgcatcagccatgaatttgccctgaatggaaacccccagaacccctactgtgatggcattgaaggagtgatggaggcctactaccgcagcctgaagtctgtgcagctgtatggccccaccaactttgcccctgtgatcaaccacgtggcccgctatgccagctctgtgaaggatggcagccagtactttgtgctgctgattgtgacagatggagtcatcagtgacatggcccagaccaaggagagcatcgtgaatgccagcaagctgcccatgagcatcatcatcgtgggcgtgggccctgctgagtttgatgccatggtggagctggatggagatgatgtgcgggtgagcagccggggcaagtatgcagagcgggacatcgtgcagtttgtgcccttccgggactacatcgacagaagtggcaaccacatcctgtccatggcccggctggccaaggatgtgctggccgagatccctgagcagttcctgagctacatgagggcccggggcatcaagcccagccctgcccccccaccctacaccccacccacccacgtgctgcagacccagatctag

SEQ ID NO: 37731 - DNA, 3786 bp, Artificial Sequence
  Description of Artificial Sequence: Synthetic coding sequence
atggatgccccccgggccagcgctgccaagcccccaactggaaggaagatgaaggcccgggcccctcctcctcctgggaaggccgccaccctgcacgtgcacagcgaccagaagccccctcatgatggagccctgggcagccagcagaacctggtgaggatgaaggaggccctgcgggccagcaccatggatgtgacagtggtgctgcccagcggcctggagaagaggtctgtgctgaatggcagccacgccatgatggacctgctggtggagctgtgcctgcagaaccacctgaaccccagccaccacgccctggagatccgcagcagcgagacccagcagcccctgtccttcaagcccaacaccctcatcggcaccctgaatgtgcacacagtgttcctgaaggagaaggtgcctgaggagaaggtgaagccaggcccccccaaggtgcctgagaagtctgtgcggctggtggtgaactacctgcggacccagaaggctgtggtgcgggtgtccccagaggtgcccctgcagaacatcctgcccgtcatctgtgccaagtgtgaggtgtccccagagcacgtggtgctgctgcgggacaacattgctggggaggagctggagctgagcaagagcctgaatgagctgggcatcaaggagctgtatgcctgggacaacagaagagagaccttcaggaagagcagcctgggcaatgatgaaacagacaaggagaagaagaagttcctgggcttcttcaaggtgaacaagaggagcaacagcaagggctgcctgaccacccccaacagccccagcatgcacagccgcagcctgaccctgggccccagcctgagcctgggcagcatctctggagtgtctgtgaagtctgagatgaagaagaggcgggcccctcctcctcctggcagcggcccccctgtgcaggacaaggccagcgagaaggtgtccctgggcagccagattgacctgcagaagaagaagagaagagccccagcccctcctccaccccagcccccaccacccagccccctcatccccaacagaacagaggacaaggaggagaacaggaagagcaccatggtgtccctgcccctgggcagcggcagccactgcagcccagatggagccccccaggtgctgtctgaggccgaggagaccgtgtctgtgggcagctgctttgccagcgaggacaccacagaagattctggagtgatgagcagccccagcgacatcgtgtccctggacagccagcaggacagcatgaagtacaaggacaagtgggccacagaccaggaggactgcagcgaccaggacctggccggcaccccagacctgggcccccagaagagccccctgtgggagaagaatggaagtgagaacagccacctgaggacagagaaggctgtgacagccagcaatgatgaggaggacctgctgattgctggggagttcaggaagaccctggccgagctggatgaggacctggaggagatggaggacagctatgaaacagacaccagcagcctgaccagcagcatccatggagccagcaaccactgcccccaggatgccatgatcccccatggagacacagatgccatccctgtgaccttcatcggggaggtgtctgatgatcctgtggacagcggcctcttcagcaacagaaacaacaatgccggcagctttgattctgaaggagtggccagcagaagagacagcctggcccccctgcaggccgagcacagccagccccatgagaaggcccgggaggaggtgcctgccctgcacccagccagccatgatgtgggcaagggcatccgggtggccctgagcaacatcagcaaggatggcaacctgatggagacagccccccgggtgaccagctttgccagcaacctgcacacagacaacctgaatgccaaggtgaaggacaaggtgtatggctgtgctgatggagagaggacccaggccacagagcgggtgaacagccagcctgtgaatgagaaggacagcaatgacaagaatgctgccctggcccccacctcctggcaccagaggggccagaaccctgggaagagctaccgcctgaagcacggcctgaccacctacaagatcatcccccccaagtctgagatgcgctgctatgacagagatgtgtccctgagcactggagccatcaagattgatgagctgggcaacctggtgagcccccacgccaccggcatccgcatcatcagcctgagcagctctgtgcctgaggccgagagccagcccatcggcaaggtgcgggagttctggcgctgcaacagcgtggagaagcacctgggccggcccagcgagagcagcgcccggggcccccccagcacccctgtgcccacccagacccagaaccctgagagccggctgcaggccgaccccaagcccatcagcccccagcagaagagcgcccaccacgagggcaggaaccccctgggggagggcaggaaccagccccccaccatgggcatgggccacgtgcgggtgcctgctgcccacaccacagaggtgaccttcctgaagccccagaggaggaccagcagccagtatgtggccagcgccatcgccaagagaattggagcccccaaggtgcatgctgatgtggtgcggccccacggctacgccgagaagggctacgccggcaaggcccctgtgctggccgcccctcctgtgacagtgaaggatgacaggaccagcagcccccacagcgagacccagggctggaaggatggagcccagtggccctgtgtgaccccacccaacaaccacggggaggacctggccgtgggcgcccccccaagaggagaggtgattggcccccacaggaagctgagcacccaggacaggcctgctgccatccacaggagcagctgcttcagcctggtgcagagcagccagagggacagagtgtctgtgggccagagctgtggcttcagcggcaagcagagcaccagcagccaggaggccagcagcgccagcgagccccggcgggccccagatggaacagatcctcctccaccccacaccagtgacacccaggcctgcagccgggagctggtgaatggatctgtgcgggcccctggccacggggagcccagccaccccccaggcggcagcggcacagagagccacatcctgctggagcgggaggagaagcccagcgtcttcagcacagatggaaatgaaacagacagcatctggcccccatccatcttcggccccaagaagaagttcaagcctgtggtgcagaggcctgtgcccaaggacaccagcctgcacagcgccctgatggaggccatccacagcgctgggggcaaggaccggctgaggaagacagctgagcacactggagagggccggcctgccaagctgagctacacagaggccgagggggagaggtctgccctgctggccgccatccggggccacagcggcacctgcagcctgaggaaggtggccagcagcgccagcgaggagctgcagagcttcagagatgctgccctgagcgcccagggcagcgagagccccctgctggaggacctgggcctgctgagccccccagccatccccccacctcctcctccacccagccaggccctgagcgcccccaggacagccagccgcttcagcacaggcaccctgagcaacacagcagatgcccggcaggccctgatggatgccatccgctctggaactggagctgcccggctgaggaaggtgcccctgctggtgtag

SEQ ID NO: 37732 - DNA, 1410 bp, Artificial Sequence
  Description of Artificial Sequence: Synthetic coding sequence
atggatgccccccgggccagcgctgccaagcccccaactggaaggaagatgaaggcccgggcccctcctcctcctgggaaggccgccaccctgcacgtgcacagcgaccagaagccccctcatgatggagccctgggcagccagcagaacctggtgaggatgaaggaggccctgcgggccagcaccatggatgtgacagtggtgctgcccagcggcctggagaagaggtctgtgctgaatggcagccacgccatgatggacctgctggtggagctgtgcctgcagaaccacctgaaccccagccaccacgccctggagatccgcagcagcgagacccagcagcccctgtccttcaagcccaacaccctcatcggcaccctgaatgtgcacacagtgttcctgaaggagaaggtgcctgaggagaaggtgaagccaggcccccccaaggtgcctgagaagtctgtgcggctggtggtgaactacctgcggacccagaaggctgtggtgcgggtgtccccagaggtgcccctgcagaacatcctgcccgtcatctgtgccaagtgtgaggtgtccccagagcacgtggtgctgctgcgggacaacattgctggggaggagctggagctgagcaagagcctgaatgagctgggcatcaaggagctgtatgcctgggacaacagaagagagaccttcaggaagagcagcctgggcaatgatgaaacagacaaggagaagaagaagttcctgggcttcttcaaggtgaacaagaggagcaacagcaagggctgcctgaccacccccaacagccccagcatgcacagccgcagcctgaccctgggccccagcctgagcctgggcagcatctctggagtgtctgtgaagtctgagatgaagaagaggcgggcccctcctcctcctggcagcggcccccctgtgcaggacaaggccagcgagaaggtgtccctgggcagccagattgacctgcagaagaagaagagaagagccccagcccctcctccaccccagcccccaccacccagccccctcatccccaacagaacagaggacaaggaggagaacaggaagagcaccatggtgtatggagctgctgaggccgtcatccggctgctgagcctgctgctgaacaccacagcccctggaacagccaagcccaggaccctgtggatgtctgagggccgcagcagcctgcacaaccctgagatcaagtgcagctgcttcagcagcagcagccccttcccccagagcctgctgagcctgctgctgggcctgagcagcatctgtgagtgcatgtgcaccctgcggcacacccacgcccacacccacaaccccagctgtgtgctgcccaccagcgagatcctggccttcggccggcagagcctcatctcctag

SEQ ID NO: 37733 - DNA, 4032 bp, Artificial Sequence
  Description of Artificial Sequence: Synthetic coding sequence
atggatgccccccgggccagcgctgccaagcccccaactggaaggaagatgaaggcccgggcccctcctcctcctgggaaggccgccaccctgcacgtgcacagcgaccagaagccccctcatgatggagccctgggcagccagcagaacctggtgaggatgaaggaggccctgcgggccagcaccatggatgtgacagtggtgctgcccagcggcctggagaagaggtctgtgctgaatggcagccacgccatgatggacctgctggtggagctgtgcctgcagaaccacctgaaccccagccaccacgccctggagatccgcagcagcgagacccagcagcccctgtccttcaagcccaacaccctcatcggcaccctgaatgtgcacacagtgttcctgaaggagaaggtgcctgaggagaaggtgaagccaggcccccccaaggtgcctgagaagtctgtgcggctggtggtgaactacctgcggacccagaaggctgtggtgcgggtgtccccagaggtgcccctgcagaacatcctgcccgtcatctgtgccaagtgtgaggtgtccccagagcacgtggtgctgctgcgggacaacattgctggggaggagctggagctgagcaagagcctgaatgagctgggcatcaaggagctgtatgcctgggacaacagaagagagaccttcaggaagagcagcctgggcaatgatgaaacagacaaggagaagaagaagttcctgggcttcttcaaggtgaacaagaggagcaacagcaaggccgagcagctggtgctgagcggggctgacagtgatgaggacaccagcagagctgcccctggccggggcctgaatggctgcctgaccacccccaacagccccagcatgcacagccgcagcctgaccctgggccccagcctgagcctgggcagcatcagcggcgtgtctgtgaagtctgagatgaagaagagaagagcccctcctcctcctggcagcggcccccctgtgcaggacaaggccagcgagaaggtgtccctgggcagccagattgacctgcagaagaagaagaggcgggccccagcccctcctccaccccagcccccaccacccagccccctcatccccaacagaacagaggacaaggaggagaacaggaagagcaccatgggcggcggccggcaggtgccccagaagccaccccggggcacagcccggggccccccccagctggtgctgcccccacctccaccctacccacctccagacacagatgtggtggagcccctgtccttccctggagagggcgccggcagcgaggccagtgaccccatccccaagctgagcctgcccctgggcagcggcagccactgcagcccagatggagccccccaggtgctgtctgaggccgaggagaccgtgtctgtgggcagctgctttgccagcgaggacaccacagaagattctggagtgatgagcagccccagcgacatcgtgtccctggacagccagcaggacagcatgaagtacaaggacaagtgggccacagaccaggaggactgcagcgaccaggacctggccggcaccccagacctgggcccccagaagagccccctgtgggagaagaatggaagtgagaacagccacctgaggacagagaaggctgtgacagccagcaatgatgaggaggacctgctgattgctggggagttcaggaagaccctggccgagctggatgaggacctggaggagatggaggacagctatgaaacagacaccagcagcctgaccagcagcatccatggagccagcaaccactgcccccaggatgccatgatcccccatggagacacagatgccatccctgtgaccttcatcggggaggtgtctgatgatcctgtggacagcggcctcttcagcaacagaaacaacaatgccggcagctttgattctgaaggagtggccagcagaagagacagcctggcccccctgcaggccgagcacagccagccccatgagaaggcccgggaggaggtgcctgccctgcacccagccagccatgatgtgggcaagggcatccgggtggccctgagcaacatcagcaaggatggcaacctgatggagacagccccccgggtgaccagctttgccagcaacctgcacacagacaacctgaatgccaaggtgaaggacaaggtgtatggctgtgctgatggagagaggacccaggccacagagcgggtgaacagccagcctgtgaatgagaaggacagcaatgacaagaatgctgccctggcccccacctcctggcaccagaggggccagaaccctgggaagagctaccgcctgaagcacggcctgaccacctacaagatcatcccccccaagtctgagatgcgctgctatgacagagatgtgtccctgagcactggagccatcaagattgatgagctgggcaacctggtgagcccccacgccaccggcatccgcatcatcagcctgagcagctctgtgcctgaggccgagagccagcccatcggcaaggtgcgggagttctggcgctgcaacagcgtggagaagcacctgggccggcccagcgagagcagcgcccggggcccccccagcacccctgtgcccacccagacccagaaccctgagagccggctgcaggccgaccccaagcccatcagcccccagcagaagagcgcccaccacgagggcaggaaccccctgggggagggcaggaaccagccccccaccatgggcatgggccacgtgcgggtgcctgctgcccacaccacagaggtgaccttcctgaagccccagaggaggaccagcagccagtatgtggccagcgccatcgccaagagaattggagcccccaaggtgcatgctgatgtggtgcggccccacggctacgccgagaagggctacgccggcaaggcccctgtgctggccgcccctcctgtgacagtgaaggatgacaggaccagcagcccccacagcgagacccagggctggaaggatggagcccagtggccctgtgtgaccccacccaacaaccacggggaggacctggccgtgggcgcccccccaagaggagaggtgattggcccccacaggaagctgagcacccaggacaggcctgctgccatccacaggagcagctgcttcagcctggtgcagagcagccagagggacagagtgtctgtgggccagagctgtggcttcagcggcaagcagagcaccagcagccaggaggccagcagcgccagcgagccccggcgggccccagatggaacagatcctcctccaccccacaccagtgacacccaggcctgcagccgggagctggtgaatggatctgtgcgggcccctggccacggggagcccagccaccccccaggcggcagcggcacagagagccacatcctgctggagcgggaggagaagcccagcgtcttcagcacagatggaaatgaaacagacagcatctggcccccatccatcttcggccccaagaagaagttcaagcctgtggtgcagaggcctgtgcccaaggacaccagcctgcacagcgccctgatggaggccatccacagcgctgggggcaaggaccggctgaggaagacagctgagcacactggagagggccggcctgccaagctgagctacacagaggccgagggggagaggtctgccctgctggccgccatccggggccacagcggcacctgcagcctgaggaaggtggccagcagcgccagcgaggagctgcagagcttcagagatgctgccctgagcgcccagggcagcgagagccccctgctggaggacctgggcctgctgagccccccagccatccccccacctcctcctccacccagccaggccctgagcgcccccaggacagccagccgcttcagcacaggcaccctgagcaacacagcagatgcccggcaggccctgatggatgccatccgctctggaactggagctgcccggctgaggaaggtgcccctgctggtgtag

SEQ ID NO: 37734 - DNA, 3441 bp, Artificial Sequence
  Description of Artificial Sequence: Synthetic coding sequence
ctgcgggacaacattgctggggaggagctggagctgagcaagagcctgaatgagctgggcatcaaggagctgtatgcctgggacaacagaagagagaccttcaggaagagcagcctgggcaatgatgaaacagacaaggagaagaagaagttcctgggcttcttcaaggtgaacaagaggagcaacagcaaggccgagcagctggtgctgtctggagctgacagtgatgaggacaccagccgggccgcccctggccggggcctgaatggctgcctgaccacccccaacagccccagcatgcacagccgcagcctgaccctgggccccagcctgagcctgggcagcatctctggagtgtctgtgaagtctgagatgaagaagaggcgggcccctcctcctcctggcagcggcccccctgtgcaggacaaggccagcgagaaggtgtccctgggcagccagattgacctgcagaagaagaagagaagagccccagcccctcctccaccccagcccccaccacccagccccctcatccccaacagaacagaggacaaggaggagaacaggaagagcaccatgggcggcggccggcaggtgccccagaagccaccccggggcacagcccggggccccccccagctggtgctgcccccacctccaccctacccacctccagacacagatgtggtggagcccctgtccttccctggagagggcgccggcagcgaggccagtgaccccatccccaagctgagcctgcccctgggcagcggcagccactgcagcccagatggagccccccaggtgctgtctgaggccgaggagaccgtgtctgtgggcagctgctttgccagcgaggacaccacagaggacagcggcgtgatgagcagccccagcgacatcgtgtccctggacagccagcaggacagcatgaagtacaaggacaagtgggccacagaccaggaggactgcagcgaccaggacctggccggcaccccagacctgggcccccagaagagccccctgtgggagaagaatggaagtgagaacagccacctgaggacagagaaggctgtgacagccagcaatgatgaggaggacctgctgattgctggggagttcaggaagaccctggccgagctggatgaggacctggaggagatggaggacagctatgaaacagacaccagcagcctgaccagcagcatccacggggccagcaaccactgcccccaggatgccatgatcccccacggggacacagatgccatccctgtgaccttcatcggggaggtgtctgatgatcctgtggacagcggcctcttcagcaacagaaacaacaatgccggcagctttgacagcgagggcgtggccagccggcgggacagcctggcccccctgcaggccgagcacagccagccccatgagaaggcccgggaggaggtgcctgccctgcacccagccagccatgatgtgggcaagggcatccgggtggccctgagcaacatcagcaaggatggcaacctgatggagacagccccccgggtgaccagctttgccagcaacctgcacacagacaacctgaatgccaaggtgaaggacaaggtgtatggctgtgctgatggagagaggacccaggccacagagcgggtgaacagccagcctgtgaatgagaaggacagcaatgacaagaatgctgccctggcccccacctcctggcaccagaggggccagaaccctgggaagagctaccgcctgaagcacggcctgaccacctacaagatcatcccccccaagtctgagatgcgctgctatgacagagatgtgtccctgagcactggagccatcaagattgatgagctgggcaacctggtgagcccccacgccaccggcatccgcatcatcagcctgagcagctctgtgcctgaggccgagagccagcccatcggcaaggtgcgggagttctggcgctgcaacagcgtggagaagcacctgggccggcccagcgagagcagcgcccggggcccccccagcacccctgtgcccacccagacccagaaccctgagagccggctgcaggccgaccccaagcccatcagcccccagcagaagagcgcccaccacgagggcaggaaccccctgggggagggcaggaaccagccccccaccatgggcatgggccacgtgcgggtgcctgctgcccacaccacagaggtgaccttcctgaagccccagaggaggaccagcagccagtatgtggccagcgccatcgccaagagaattggagcccccaaggtgcatgctgatgtggtgcggccccacggctatgcagagaagggctacgccggcaaggcccctgtgctggccgcccctcctgtgacagtgaaggatgacaggaccagcagcccccacagcgagacccagggctggaaggatggagcccagtggccctgtgtgaccccacccaacaaccacggggaggacctggccgtgggcgcccccccaagaggagaggtgattggcccccacaggaagctgagcacccaggacaggcctgctgccatccacaggagcagctgcttcagcctggtgcagagcagccagagggacagagtgtctgtgggccagagctgtggcttcagcggcaagcagagcaccagcagccaggaggccagcagcgccagcgagccccggcgggccccagatggaacagaccccccaccaccccacaccagtgacacccaggcctgcagccgggagctggtgaatggatctgtgcgggcccctggccatggagagcccagccaccccccaggcggcagcggcacagagagccacatcctgctggagcgggaggagaagcccagcgtcttcagcacagatggaaatgaaacagacagcatctggccacccagcatcttcggccccaagaagaagttcaagcctgtggtgcagaggcctgtgcccaaggacaccagcctgcacagcgccctgatggaggccatccacagcgctgggggcaaggaccggctgaggaagacagctgagcacactggagagggccgcccagccaagctgagctacacagaagctgagggggagaggtctgccctgctggccgccatccggggccacagcggcacctgcagcctgaggaaggtggccagcagcgccagcgaggagctgcagagcttcagagatgctgccctgagcgcccagggcagcgagagccccctgctggaggacctgggcctgctgagccccccagccatccccccacctcctcctccacccagccaggccctgagcgcccccaggacagccagccgcttcagcacaggcaccctgagcaacacagcagatgcccggcaggccctgatggatgccatccgcagcggcaccggggccgcccggctgaggaaggtgcccctgctggtgtag

SEQ ID NO: 37735 - DNA, 1140 bp, Artificial Sequence
  Description of Artificial Sequence: Synthetic coding sequence
atggatgccccccgggccagcgctgccaagcccccaactggaaggaagatgaaggcccgggcccctcctcctcctgggaaggccgccaccctgcacgtgcacagcgaccagaagccccctcatgatggagccctgggcagccagcagaacctggtgaggatgaaggaggccctgcgggccagcaccatggatgtgacagtggtgctgcccagcggcctggagaagaggtctgtgctgaatggcagccacgccatgatggacctgctggtggagctgtgcctgcagaaccacctgaaccccagccaccacgccctggagatccgcagcagcgagacccagcagcccctgtccttcaagcccaacaccctcatcggcaccctgaatgtgcacacagtgttcctgaaggagaaggtgcctgaggagaaggtgaagccaggcccccccaaggtgcctgagaagtctgtgcggctggtggtgaactacctgcggacccagaaggctgtggtgcgggtgtccccagaggtgcccctgcagaacatcctgcccgtcatctgtgccaagtgtgaggtgtccccagagcacgtggtgctgctgcgggacaacattgctggggaggagctggagctgagcaagagcctgaatgagctgggcatcaaggagctgtatgcctgggacaacagaagagagaccttcaggaagagcagcctgggcaatgatgaaacagacaaggagaagaagaagttcctgggcttcttcaaggtgaacaagaggagcaacagcaagggctgcctgaccacccccaacagccccagcatgcacagccgcagcctgaccctgggccccagcctgagcctgggcagcatctctggagtgtctgtgaagtctgagatgaagaagaggcgggcccctcctcctcctggcagcggcccccctgtgcaggacaaggccagcgagaaggtgtccctgggcagccagattgacctgcagaagaagaagagaagagccccagcccctcctccaccccagcccccaccacccagccccctcatccccaacagaacagaggacaaggaggagaacaggaagagcaccatggtgtactgctgtgccagcttccccacccaggccaagcgcttctag

SEQ ID NO: 37736 - DNA, 825 bp, Artificial Sequence
  Description of Artificial Sequence: Synthetic coding sequence
atggaggacagctatgaaacagacaccagcagcctgaccagcagcatccatggagccagcaaccactgcccccaggatgccatgatcccccatggagacacagatgccatccctgtgaccttcatcggggaggtgtctgatgatcctgtggacagcggcctcttcagcaacagaaacaacaatgccggcagctttgattctgaaggagtggccagcagaagagacagcctggcccccctgcaggccgagcacagccagccccatgagaaggcccgggaggaggtgcctgccctgcacccagccagccatgatgtgggcaagggcatccgggtggccctgagcaacatcagcaaggatggcaacctgatggagacagccccccgggtgaccagctttgccagcaacctgcacacagacaacctgaatgccaaggtgaaggacaaggtgtatggctgtgctgatggagagaggacccaggccacagagcgggtgaacagccagcctgtgaatgagaaggacagcaatgacaagaatgctgccctggcccccacctcctggcaccagaggggccagaaccctgggaagagctaccgcctgaagcacggcctgaccacctacaagatcatcccccccaagtctgagagcagcggcggggccaccctgtggaagaacacctgggccgacccccagagggccctgcccggggaccccccaccacccctgtgccccaggagaagacgcatccagagagctgacagcaagcagacccccagccagtaccggcccagccgcagcctgcccaccatgagagctggcaccccctag

SEQ ID NO: 37737 - DNA, 2523 bp, Artificial Sequence
  Description of Artificial Sequence: Synthetic coding sequence
atgaaccgcttccgggtgtccaagttccgccacacagaggcccggcccccccggcgggagagctggatcagtgacatccgggccggcacagcccccagctgcaggaaccacatcaagagcagctgcagcctgattgccttcaacagcgacaggcctggggtgctgggcatcgtgcccctgcagggccagggcgaggacaagagaagagtggcccacctgggctgccacagcgagctggccgcccacggggacctggtgcagagcgctgtgtggagcagagatggagccctggtgggcacagcctgcaaggacaagcagctgcgcatctttgaccccaggaccaagccccgggccagccagagcacccaggcccacgagaacagccgggacagccggctggcctggatgggcacctgggagcacctggtgtccacaggcttcaaccagatgagggagcgggaggtgaagctgtgggacacccgcttcttcagcagcgccctggccagcctgaccctggacaccagcctgggctgcctggtgcccctgctggaccctgattctggcctgctggtgctggccgggaaaggagagcggcagctgtactgctatgaggtggtgccccagcagcctgccctgagccctgtgacccagtgtgtgctggagagcgtgctgcggggagctgccctggtgccccggcaggccctggccgtgatgagctgtgaggtgctgcgggtgctgcagctgagtgacacagccatcgtgcccatcggctaccacgtgcccaggaaggctgtggagttccatgaagatctcttcccagacacagctggctgtgtgcctgccacagacccccacagctggtgggccggggacaaccagcaggtgcagaaggtgtccctgaacccagcctgccggccccaccccagcttcaccagctgcctggtgcccccagctgagcccctgcctgacacagcccagcctgctgtgatggagacccctgtgggagatgctgatgccagcgagggcttcagcagcccccccagcagcctgaccagccccagcacccccagcagcctgggccccagcctgagcagcaccagcggcatcggcaccagccccagcctgcggagcctgcagagcctgctgggccccagcagcaagttcagacatgcccagggcaccgtgctgcaccgggacagccacatcaccaacctgaagggcctgaacctgaccaccccaggagagagtgatggcttctgtgccaacaagctgcgggtggccgtgcccctgctgagcagcggcggccaggtggccgtgctggagctgaggaagccaggccgcctgcctgacacagccctgcccaccctgcagaatggagctgctgtgacagacctggcctgggacccctttgacccccaccggctggccgtggccggggaggatgcccgcatccggctgtggagggtgcctgctgagggcctggaggaggtgctgaccaccccagagaccgtgctgaccggccacacagagaagatctgcagcctgcgcttccaccccctggccgccaacgtgctggccagcagcagctatgacctgactgtgcgcatctgggacctgcaggccggggctgaccggctgaagctgcagggccaccaggaccagatcttcagcctggcctggagcccagatggccagcagctggccaccgtgtgcaaggatggccgggtgcgggtgtaccggcccaggagcggccctgagcccctgcaggagggccctggccccaagggcggccgcggggcccgcatcgtgtgggtgtgtgatggccgctgcctgctggtgtctggctttgacagccagagcgagcggcagctgctgctgtatgaagctgaggccctggccggcggccccctggccgtgctgggcctggatgtggcccccagcaccctgctgcccagctatgaccctgacaccggcctggtgctgctgactggaaaaggagacaccagggtcttcctgtatgagctgctgcctgagagccccttcttcctggagtgcaacagcttcaccagcccagacccccacaagggcctggtgctgctgcccaagacagaatgtgatgtgcgggaggtggagctgatgcgctgcctgcggctgcggcagagcagcctggagcctgtggccttccggctgccccgggtgaggaaggagttcttccaggatgatgtgtttcctgacacagctgtgatctgggagcctgtgctgtctgctgaggcctggctgcagggcgccaacggccagccctggctgctgagcctgcagcccccagacatgagccctgtgtcccaggccccccgggaggccccagcccggcgggcccccagcagcgcccagtacctggaggagaagagtgaccagcagaagaaggaggagctgctgaatgccatggtggccaagctgggcaaccgggaggaccccctgccccaggacagctttgaaggagtggatgaagatgagtgggactag

SEQ ID NO: 37738 - DNA, 246 bp, Artificial Sequence
  Description of Artificial Sequence: Synthetic coding sequence
atgagcagcacctactgcggcaacagcagcgccaagatgtctgtgaatgaggtgtctgccttcagcctgaccctggagcagaagacaggctttgcctttgtgggcatcctgtgcatcttcctgggcctgctgatcatccgctgcttcaagatcctgctggacccctacagctccatgcccagcagcacctgggaggatgaggtggaggagtttgataaaggcacctttgaatatgccctggcctag

SEQ ID NO: 37739 - DNA, 246 bp, Artificial Sequence; identical to SEQ ID NO: 37738
  Description of Artificial Sequence: Synthetic coding sequence

SEQ ID NO: 37740 - DNA, 906 bp, Artificial Sequence
  Description of Artificial Sequence: Synthetic coding sequence
atgagctaccccaccaaggagggcagtgacacagctggaaatgcccacaagaacagtgaaaatgaacctccaaatgactgcagcacagacatcgagagccccagcgctgaccccaacatgatctaccaggtggagaccaaccccatcaaccgggagcctggaacagccaccagccaggaggatgtggtgccccaggccgctgagaacagcgagctggagacagagatccagaaggaccagcgggaggaggacctgaaggaggagctgctgctgctgcagacccccatccccaggaagctggtgagccacaagcccctgaatgacaggagccgcagccacagcggcaaggtggagatgaaggccaacaacttccccatcaaccacaagacccgcttccggctgagcacctcctggagggtgcccttcatcaacagccatgagatccgctccatgatcctgcacctgctgtgtgaccgctacttcagccaggccgccggctgccagaacaccatgtgggtgaagaggaagtacatcgcctgcctgtaccaccccaacagcttcacccaccacgagcgggccatcaccttcagaagacccagccgggtgcactactaccggcccctgacagagaggatgaccagcggcaagttctgcaagagcacagacaccaagggcaagtgccgcttccgggccatcgtgcgctctgtgctgtttgtgtcccagatccagatcgagagcatcttcaacatcaagggctttgtggacatcctgacctacatccacaccatgaatgtgatgatcaccaacaccaacaacggctggaagtacttctgccccatctgtggccgcctcttcaacacctacagcgagctgcggcagcacagctgcagcagcagcggcaactag

SEQ ID NO: 37741 - DNA, 906 bp, Artificial Sequence; identical to SEQ ID NO: 37740
  Description of Artificial Sequence: Synthetic coding sequence

SEQ ID NO: 37742 - DNA, 1935 bp, Artificial Sequence
  Description of Artificial Sequence: Synthetic coding sequence
atgctgaggacagatgctggggaggacctggctgatgccccagctgaggagctgcaggagaagggcagccctgctggccccccacccagccagggccagcctgctgcccggccccccaaggaggtgcctgccagccggctggcccagcagctgcgggaggagggctggaacctgcagaccagcgagagcctgaccctggccgaggtgtacctgatgatgggcaagcccagcaagctgcagctggagtatgactggctgggccctggccggcaggaccccaggcctggcagcctgcccacagccctgcacaagcagaggctgctgagctgcctgctgaagctgatcagcacagaggtgaaccccaagctggccctggaggccaacaccatcagcacagcctctgtgcggcctgcccaggaggagcagagcatgaccccacctgggaaggtggtgacagtgagcagccgcagcccccgctgccccaggaaccaggccagcctgcggagcagcaagaccttcccccccagcagcgccccctgcagcagcggcctgagaaatccaccccggcccctgctggtgcccggccccagcagcacaggcagcaatgacagtgatggcggcctgtttgctgtgcccaccaccctgccccccaacagcagacatggcaagctgttcagccccagcaaggaggccgagctgaccttccggcagcacctgaacagcatctccatgcagagcgacttcttcctgcccaagcccaggaagctgaggaacagacacctgaggaagcccctggtggtgcagaggaccctgctgccccggcccagcgagaaccagagccacaacgtgtgcagcttcagcatcctgagcaacagctctgtgacaggccggggcagcttccggcccatccagagcagcctgaccaaggccgccctgagccggcccatcgtgcccaaggtgctgcccccccaggccaccagccacctggccagcgccatcgacctggccgccaccagcgctggcatcctgagcggcaaccccctgcctgccctggacacagagggcctgagcggcatcagccccctgagcagtgatgaggtgactggagccatcagcggccaggacagcacaggcacccaccaggatggagacaccctgcccaccgtgggcggcagtgacccctttgtgtccatccccagcaggcctgagcaggagcctgtggccgacagcttccagggcagctctgtgctgagcctgtctgagctgcccaaggcccccctgcagaatggcctgagcatccccctgagcagcagcgagagcagcagcacccggctgagccccccagatgtgtctgccctgctggacatcagcctgcccggccccccagaagatgccctgagccagggcgagcccgccacccacatcagtgacagcatcatcgagatcgccatcagcagcggggagggcgtgcccctgagccctgccaagctgaatggaagtgacagcagcaagagcctgcccagccccagcagcagcccccagccccactggatcgccagccccacccatgacccccagtggtaccccagcgacagcacagacagcagcctgagcagcctgtttgccagcttcatcagccctgagaagagcaggaagatgctgcccacccccatcggcaccaacagcggcaccagcctgctgggccccagcctgctggatggcaacagccgggacagctttgtgagccgcagcctggctgatgtggccgaggtggtggacagccagctggtgtgcatgatgaatgaaaacagcattgactacatcagccgcttcaatgacctggcccaggagctgagcattgctgagcctggaagaagagaggccctgtttgatggcggcggcggcggccctgctgtgtctgacctgagccagtag

SEQ ID NO: 37743 - DNA, 3810 bp, Artificial Sequence
  Description of Artificial Sequence: Synthetic coding sequence
atgacagtgaagctgggagatggcggcagcggggaggatggcctgaagaagctgggcaagagagctgctgatgaggagagcctggagggggagggcgccggcggcgcagatgctgctgaggagagcagcggcaccaagagagatgagaagaccccccgggccggggctgatggccccccagcccctcctggggccccccaggcccccagccccccccagggcagcccccaggaccagcaccacttcctgcggagctctgtgcggccccagagcaagaggcccaggaaggacccccccagcgctgtgggcagcggaaatgccggcggcagcggcccccggggcaaaggagctgagggcggcggcagcagcagtggaaatgtgtctggagtggccccagctgccccagctgggggcagccgcagcagcagcaggaacctgggcagcagtggaggagagaaggaggagggcaagaaggtgcggcggcagtgggagagctggagcacagaggacaagaacaccttctttgagggcctgtatgaacatggcaaggactttgaggccatccagaacaacatcgccctgaagtacaagaagaagggcaagccagcctccatggtgaagaacaaggagcaggtgcgccacttctactaccgcacctggcacaagatcaccaagtacatcgactttgaccacgtgttcagccggggcctgaagaagagcagccaggagctgtatggcctcatctgctacggggagctgaggaagaagattggaggctgcatggatgacaagaatgccaccaagctgaatgagctgatccaggtgggcgccaccaccgtgcgctacaagggcaggaacctgcgcatcaaggcccccatgtgccgggccctgaagaagctgtgtgaccctgatggcctgagtgatgaggaggaccagaagcctgtgcggctgcccctgaaggtgcccatcgagctgcagcccaggaacaaccacgcctgggcccgggtgcagagcctggcccagaacccccggctgaggatgattgtggagctgcacaggaaggtgagcagcctgattgagttcctgaagcagaagtgggccctgcacgaggtgcgggtgaggaagaccctggaggagcggcagctgcaggacagctgcagcgcccccatgcaggagaaggtgaccctgcacctgtttcctggagagaactgcaccctgacccccctgcccggggtggcccgggtggtgcacagcaaggccttctgcaccgtgcactggcaggagggcggccgctgcaagcagagcgccaaggatgcccacgtgctgcccccagcccagatcctgggcatccagagcggccagggcacagcccggggccaggtgaagtgccccaggtctggagctgagggcaaaggagtgggccggcccccacctgctgctgatgccctgcagagcagcggggagagcagccctgagagcgcccctggagagggcgccgccctgagcctgagcagcccagatgccccagaccggcccccacccaggcaccaggacaccggcccctgcctggagaagaccccagctgagggccgggacagccccacccgggagcccggggccctgccctgtgcctgtggccagctgcctgacctggaggatgagctgagcctgctggaccccctgccccgctacctgaagagctgccaggacctgattgtgcctgagcagtgccgctgtgccgacacccggcccggcagcgagcagccccccctgggcggggccgccagccctgaggtgctggcccctgtgtccaaggaggccgctgacctggcccccaccggccccagccccaggcctggccctggcctgctgctggatgtgtgcaccaaggacctggctgatgccccagctgaggagctgcaggagaagggcagccctgctggccccccacccagccagggccagcctgctgcccggccccccaaggaggtgcctgccagccggctggcccagcagctgcgggaggagggctggaacctgcagaccagcgagagcctgaccctggccgaggtgtacctgatgatgggcaagcccagcaagctgcagctggagtatgactggctgggccctggccggcaggaccccaggcctggcagcctgcccacagccctgcacaagcagaggctgctgagctgcctgctgaagctgatcagcacagaggtgaaccccaagctggccctggaggccaacaccatcagcacagcctctgtgcggcctgcccaggaggagcagagcatgaccccacctgggaaggtggtgacagtgagcagccgcagcccccgctgccccaggaaccaggccagcctgcggagcagcaagaccttcccccccagcagcgccccctgcagcagcggcctgagaaatccaccccggcccctgctggtgcccggccccagcagcacaggcagcaatgacagtgatggcggcctgtttgctgtgcccaccaccctgccccccaacagcagacatggcaagctgttcagccccagcaaggaggccgagctgaccttccggcagcacctgaacagcatctccatgcagagcgacttcttcctgcccaagcccaggaagctgaggaacagacacctgaggaagcccctggtggtgcagaggaccctgctgccccggcccagcgagaaccagagccacaacgtgtgcagcttcagcatcctgagcaacagctctgtgacaggccggggcagcttccggcccatccagagcagcctgaccaaggccgccctgagccggcccatcgtgcccaaggtgctgcccccccaggccaccagccacctggccagcgccatcgacctggccgccaccagcgctggcatcctgagcggcaaccccctgcctgccctggacacagagggcctgagcggcatcagccccctgagcagtgatgaggtgactggagccatcagcggccaggacagcacaggcacccaccaggatggagacaccctgcccaccgtgggcggcagtgacccctttgtgtccatccccagcaggcctgagcaggagcctgtggccgacagcttccagggcagctctgtgctgagcctgtctgagctgcccaaggcccccctgcagaatggcctgagcatccccctgagcagcagcgagagcagcagcacccggctgagccccccagatgtgtctgccctgctggacatcagcctgcccggccccccagaagatgccctgagccagggcgagcccgccacccacatcagtgacagcatcatcgagatcgccatcagcagcggccagtatggagagggcgtgcccctgagccctgccaagctgaatggaagtgacagcagcaagagcctgcccagccccagcagcagcccccagccccactggatcgccagccccacccatgacccccagtggtaccccagcgacagcacagacagcagcctgagcagcctgtttgccagcttcatcagccctgagaagagcaggaagatgctgcccacccccatcggcaccaacagcggcaccagcctgctgggccccagcctgctggatggcaacagccgggacagctttgtgagccgcagcctggctgatgtggccgaggtggtggacagccagctggtgtgcatgatgaatgaaaattccattgactacatcagccgcttcaatgacctggcccaggagctgagcattgctgagcccggccggcgggaggccctgtttgatggcggcggcggcggccctgctgtgtctgacctgagccagtag

SEQ ID NO: 37744 - DNA, 3810 bp, Artificial Sequence; identical to SEQ ID NO: 37743
  Description of Artificial Sequence: Synthetic coding sequence

SEQ ID NO: 37745 - DNA, 3801 bp, Artificial Sequence
  Description of Artificial Sequence: Synthetic coding sequence
atgacagtgaagctgggagatggcggcagcggggaggatggcctgaagaagctgggcaagagagctgctgatgaggagagcctggagggggagggcgccggcggcgcagatgctgctgaggagagcagcggcaccaagagagatgagaagaccccccgggccggggctgatggccccccagcccctcctggggccccccaggcccccagccccccccagggcagcccccaggaccagcaccacttcctgcggagctctgtgcggccccagagcaagaggcccaggaaggacccccccagcgctgtgggcagcggaaatgccggcggcagcggcccccggggcaaggacagacacctgcccaaggcccagctgtggctgagcatcagccgggtgccctttggaggcagccgcagcagcagcaggaacctgggcagcagcggcggggagaaggaggagggcaagaaggtgcggcggcagtgggagagctggagcacagaggacaagaacaccttctttgagggcctgtatgagcacggcaaggactttgaggccatccagaacaacatcgccctgaagtacaagaagaagggcaagccagcctccatggtgaagaacaaggagcaggtgcgccacttctactaccgcacctggcacaagatcaccaagtacatcgactttgaccacgtgttcagccggggcctgaagaagagcagccaggagctgtatggcctcatctgctatggagagctgaggaagaagattggaggctgcatggatgacaagaatgccaccaagctgaatgaactcatccaggtgggcgccaccaccgtgcgctacaagggcaggaacctgcgcatcaaggcccccatgtgccgggccctgaagaagctgtgtgaccctgatggcctgagtgatgaggaggaccagaagcctgtgcggctgcccctgaaggtgcccatcgagctgcagcccaggaacaaccacgcctgggcccgggtgcagagcctggcccagaacccccggctgaggatgattgtggagctgcacaggaaggtgagcagcctcatcgagttcctgaagcagaagtgggccctgcacgaggtgcgggtgaggaagaccctggaggagcggcagctgcaggacagctgcagcgcccccatgcaggagaaggtgaccctgcacctgtttcctggagagaactgcaccctgacccccctgcccggggtggcccgggtggtgcacagcaaggccttctgcaccgtgcactggcaggagggcggccgctgcaagcagagcgccaaggatgcccacgtgctgcccccagcccagatcctgggcatccagagcggccagggcacagcccggggccaggtgaagtgccccaggtctggagctgagggcaagggcgtgggccggcccccacctgctgctgatgccctgcagagcagtggagagagcagccctgagagcgcccctggagagggcgccgccctgagcctgagcagcccagatgccccagaccggcccccacccaggcaccaggacaccggcccctgcctggagaagaccccagctgagggccgggacagccccacccgggagcccggggccctgccctgtgcctgtggccagctgcctgacctggaggatgagctgagcctgctggaccccctgccccgctacctgaagagctgccaggacctgattgtgcctgagcagtgccgctgtgccgacaccaggcctggcagcgagcagccccccctgggcggggccgccagccctgaggtgctggcccctgtgtccaaggaggccgctgacctggcccccaccggccccagcccccggcccggccctggcctgctgctggatgtgtgcaccaaggacctggctgatgccccagctgaggagctgcaggagaagggcagccctgctggccccccacccagccagggccagcctgctgcccggccccccaaggaggtgcctgccagccggctggcccagcagctgcgggaggagggctggaacctgcagaccagcgagagcctgaccctggccgaggtgtacctgatgatgggcaagcccagcaagctgcagctggagtatgactggctgggccctggccggcaggacccccggcccggcagcctgcccacagccctgcacaagcagaggctgctgagctgcctgctgaagctgatcagcacagaggtgaaccccaagctggccctggaggccaacaccatcagcacagcctctgtgcggcctgcccaggaggagcagagcatgaccccacctgggaaggtggtgacagtgagcagccgcagcccccgctgccccaggaaccaggccagcctgcggagcagcaagaccttcccccccagcagcgccccctgcagcagcggcctgaggaaccccccccggcccctgctggtgcccggccccagcagcacaggcagcaatgacagtgatggcggcctgtttgctgtgcccaccaccctgccccccaacagccgccacggcaagctgttcagccccagcaaggaggccgagctgaccttccggcagcacctgaacagcatctccatgcagagcgacttcttcctgcccaagcccaggaagctgaggaacagacacctgaggaagcccctggtggtgcagaggaccctgctgccccggcccagcgagaaccagagccacaacgtgtgcagcttcagcatcctgagcaacagctctgtgacaggccggggcagcttccggcccatccagagcagcctgaccaaggccgccctgagccggcccatcgtgcccaaggtgctgcccccccaggccaccagccacctggccagcgccatcgacctggccgccaccagcgctggcatcctgagcggcaaccccctgcctgccctggacacagagggcctgagcggcatcagccccctgagcagtgatgaggtgactggagccatcagcggccaggacagcacaggcacccaccaggatggagacaccctgcccaccgtgggcggcagtgacccctttgtgtccatccccagcaggcctgagcaggagcctgtggccgacagcttccagggcagctctgtgctgagcctgtctgagctgcccaaggcccccctgcagaatggcctgagcatccccctgagcagcagcgagagcagcagcacccggctgagccccccagatgtgtctgccctgctggacatcagcctgcccggccccccagaagatgccctgagccagggcgagcccgccacccacatcagtgacagcatcattgaaattgccatcagcagcggccagtacggggagggcgtgcccctgagccctgccaagctgaatggaagtgacagcagcaagagcctgcccagccccagcagcagcccccagccccactggatcgccagccccacccatgacccccagtggtaccccagcgacagcacagacagcagcctgagcagcctgtttgccagcttcatcagccctgagaagagcaggaagatgctgcccacccccatcggcaccaacagcggcaccagcctgctgggccccagcctgctggatggcaacagccgggacagctttgtgagccgcagcctggctgatgtggccgaggtggtggacagccagctggtgtgcatgatgaatgaaaacagcattgactacatcagccgcttcaatgacctggcccaggagctgagcattgctgagcctggaagaagagaggccctgtttgatggcggcggcggcggccctgctgtgtctgacctgagccagtag

SEQ ID NO: 37746 - DNA, 528 bp, Artificial Sequence
  Description of Artificial Sequence: Synthetic coding sequence
atggacatcgccatccaccacccctggatcagaagacccttcttccccttccacagccccagccggctgtttgaccagttcttcggggagcacctgctggagagtgacctcttccccaccagcaccagcctgagccccttctacctgcggcccccatccttcctgcgggcccccagctggtttgacaccggcctgtctgagatgaggctggagaaggaccgcttctctgtgaacctggatgtgaagcacttcagccctgaggagctgaaggtgaaggtgctgggagatgtgattgaggtgcacggcaagcatgaggagcggcaggatgaacatggcttcatcagccgggagttccacaggaagtaccgcatcccagcagatgtggaccccctgaccatcaccagcagcctgagcagtgatggagtgctgactgtgaatggccccaggaagcaggtgtctggccctgagaggaccatccccatcacccgggaggagaagccagctgtgacagctgcccccaagaagtag

SEQ ID NO: 37747 - DNA, 528 bp, Artificial Sequence; identical to SEQ ID NO: 37746
  Description of Artificial Sequence: Synthetic coding sequence

SEQ ID NO: 37748 - DNA, 528 bp, Artificial Sequence; identical to SEQ ID NO: 37746
  Description of Artificial Sequence: Synthetic coding sequence

SEQ ID NO: 37749 - DNA, 549 bp, Artificial Sequence
  Description of Artificial Sequence: Synthetic coding sequence
atggcccagaggtctgggaagatcaccctgtatgagggcaagcacttcaccggccagaagctggaggtgtttggagactgtgacaacttccaggaccggggcttcatgaacagagtgaacagcatccacgtggagagcggggcctgggtgtgcttcaaccacccagacttccggggccagcagttcatcctggagcacggggactacccagacttcttccgctggaacagccacagcgaccacatgggcagctgcaggcctgtgggcatgcatggagagcacttccggctggagatctttgagggctgcaacttcaccggccagtgcctggagttcctggaggacagccccttcctgcagagccggggctgggtgaagaactgtgtgaacaccatcaaggtgtatggagatggagctgcctggagccccaggagctttggagctgaggacttccagctgagcagcagcctgcagagcgaccagggccctgaggaggccaccaccaagccagccaccacccagccccccttcctgacagccaacctgtag

SEQ ID NO: 37750 - DNA, 447 bp, Artificial Sequence
  Description of Artificial Sequence: Synthetic coding sequence
atgggccgggccggccccaggagcacagctgacacccggccccgggccaccgtcatcaccacccggcggccccggccctggcagaagcccaccagcccccggcggctgcacagaagaagaccccggggccagcctgcctctgaaaatgctgctgagcccagccaggtggccatcagcaagggcaagagcccagactatgccaacggcggcaaggccgccatggacagccgggccagtgatgccatcaacaagagcaaggtggacaccagcgccagcaaccccagccagaggcggcccagccggctgcggggcaagaggagcctggccctgcccccccggctggagtgcctcttccccagcagctgtggcagcagaagagccaccagcaggcctggcttcccccccctggagggcagccacctgggctgccagctgctgcccctgtag

SEQ ID NO: 37751 - DNA, 2415 bp, Artificial Sequence
  Description of Artificial Sequence: Synthetic coding sequence
atggaggagcccggggtgaccccccagccctacctgggcctgctgctggaggagctgcggcgggtggtggccgccctgcctgagggcatgaggccagacagcaacctgtatggcttcccctgggagctggtgatctgtgccgctgtggtgggcttctttgctgtgctcttcttcctgtggaggagcttccgctctgtgcgcagccggctgtatgtgggccgggagaagaagctggccctgatgctgagcggcctcatcgaggagaagagcaagctgctggagaagttcagcctggtgcagaaggagtatgagggctatgaggtggagagcagcctgaaggatgccagctttgagaaggaggccacagaggcccagagcctggaggccacctgtgagaagctgaacagaagcaacagcgagctggaggatgagatcctgtgcctggagaaggagctgaaggaggagaagagcaagcacagcgagcaggatgagctgatggctgacatcagcaagaggatccagagcctggaggatgagagcaagagcctgaagagccaggtggccgaggccaagatgaccttcaagatcttccagatgaatgaggagcggctgaagatcgccatcaaggatgccctgaatgaaaacagccagctgcaggagagccagaagcagctgctgcaggaggccgaggtgtggaaggagcaggtgtctgagctgaacaagcagaaggtgacctttgaggacagcaaggtgcatgctgagcaggtgctgaatgacaaggagagccacatcaagaccctgacagagcggctgctgaagatgaaggactgggccgccatgctgggggaggacatcacagatgatgacaacctggagctggagatgaacagcgagagtgaaaatggagcctacctggacaacccccccaagggggccctgaagaagctgattcatgctgccaagctgaatgccagcctgaagaccctggagggggagaggaaccagatctacatccagctgtctgaggtggacaagaccaaggaggagctgacagagcacatcaagaacctgcagacagagcaggccagcctgcagagcgagaacacccactttgaaaatgaaaaccagaagctgcagcagaagctgaaggtgatgacagagctgtaccaggagaatgagatgaagctgcacaggaagctgactgtggaggagaactaccgcctggagaaggaggagaagctgagcaaggtggatgagaagatcagccacgccacagaggagctggagacctacaggaagagggccaaggacctggaggaggagctggagaggaccatccacagctaccagggccagatcatcagccatgagaagaaggcccatgacaactggctggccgccagaaatgctgagaggaacctgaatgacctgaggaaagaaaatgcccacaaccggcagaagctgacagaaacagagctgaagtttgagctgctggagaaggacccctatgccctggatgtgcccaacacagccttcggccgggagcacagcccctacggccccagccccctgggctggcccagcagcgagacccgggccttcctgagcccccccaccctgctggagggccccctgcggctgagccccctgctgcccggcggcggcggccggggcagccggggccctggcaaccccctggaccaccagatcaccaatgaaagaggagagagcagctgtgaccggctgacagacccccaccgggcccccagcgacaccggcagcctgagccccccctgggaccaggacaggaggatgatgttccccccacctggccagagctacccagattctgccctgcccccccagaggcaggaccgcttctgcagcaacagcggccgcctgagcggccctgctgagctgcggagcttcaacatgcccagcctggacaagatggatggctccatgcccagcgagatggagagcagcagaaatgacaccaaggatgacctgggcaacctgaatgtgcctgacagcagcctgcctgcagaaaatgaggccactggacctggctttgtgcccccacccctggcccccatccggggccccctcttccctgtggatgcccggggccccttcctgcggcggggcccccccttccccccacctcctcctggggccatgtttggagccagccgggactacttccccccaggggacttccctggccccccaccagccccctttgccatgagaaatgtgtacccaccccggggcttccccccctacctgccccccaggcctggcttcttccccccaccaccccacagcgagggccgctctgagttccccagcggcctcatcccccccagcaatgaaccagccacagagcaccctgagccccagcaggagacctag

SEQ ID NO: 37752 - DNA, 2316 bp, Artificial Sequence
  Description of Artificial Sequence: Synthetic coding sequence
atggaggagcccggggtgaccccccagccctacctgggcctgctgctggaggagctgcggcgggtggtggccgccctgcctgagggcatgaggccagacagcaacctgtatggcttcccctgggagctggtgatctgtgccgctgtggtgggcttctttgctgtgctcttcttcctgtggaggagcttccgctctgtgcgcagccggctgtatgtgggccgggagaagaagctggccctgatgctgagcggcctcatcgaggagaagagcaagctgctggagaagttcagcctggtgcagaaggagtatgagggctatgaggtggagagcagcctgaaggatgccagctttgagaaggaggccacagaggcccagagcctggaggccacctgtgagaagctgaacagaagcaacagcgagctggaggatgagatcctgtgcctggagaaggagctgaaggaggagaagagcaagcacagcgagcaggatgagctgatggctgacatcagcaagaggatccagagcctggaggatgagagcaagagcctgaagagccaggtggccgaggccaagatgaccttcaagatcttccagatgaatgaggagcggctgaagatcgccatcaaggatgccctgaatgaaaacagccagctgcaggagagccagaagcagctgctgcaggaggccgaggtgtggaaggagcaggtgtctgagctgaacaagcagaaggtgacctttgaggacagcaaggtgcatgctgagcaggtgctgaatgacaaggagagccacatcaagaccctgacagagcggctgctgaagatgaaggactgggccgccatgctgggggaggacatcacagatgatgacaacctggagctggagatgaacagcgagagtgaaaatggagcctacctggacaacccccccaagggggccctgaagaagctgattcatgctgccaagctgaatgccagcctgaagaccctggagggggagaggaaccagatctacatccagctgtctgaggtggacaagaccaaggaggagctgacagagcacatcaagaacctgcagacagagcaggccagcctgcagagcgagaacacccactttgaaaatgaaaaccagaagctgcagcagaagctgaaggtgatgacagagctgtaccaggagaatgagatgaagctgcacaggaagctgactgtggaggagaactaccgcctggagaaggaggagaagctgagcaaggtggatgagaagatcagccacgccacagaggagctggagacctacaggaagagggccaaggacctggaggaggagctggagaggaccatccacagctaccagggccagatcatcagccatgagaagaaggcccatgacaactggctggccgccagaaatgctgagaggaacctgaatgacctgaggaaagaaaatgcccacaaccggcagaagctgacagaaacagagctgaagtttgagctgctggagaaggacccctatgccctggatgtgcccaacacagccttcggccgggagcacagcccctacggccccagccccctgggctggcccagcagcgagacccgggccttcctgagcccccccaccctgctggagggccccctgcggctgagccccctgctgcccggcggcggcggccggggcagccggggccctggcaaccccctggaccaccagatcaccaatgaaagaggagagagcagctgtgaccggctgacagacccccaccgggcccccagcgacaccggcagcctgagccccccctgggaccaggacaggaggatgatgttccccccacctggccagagctacccagattctgccctgcccccccagaggcaggaccgcttctgcagcaacagcggccgcctgagcggccctgctgagctgcggagcttcaacatgcccagcctggacaagatggatggctccatgcccagcgagatggagagcagcagaaatgacaccaaggatgacctgggcaacctgaatgtgcctgacagcagcctgcctgcagaaaatgaggccactggacctggctttgtgcccccacccctggcccccatccggggccccctcttccctgtggatgcccggggccccttcctgcggcggggcccccccttccccccacctcctcctggggccatgtttggagccagccgggactacttccccccaggggacttccctggccccccaccagccccctttgccagcgcccggagccccccaggagctggggccccagccagcggccggggcctgggcggcccccagaagtag

SEQ ID NO: 37753 - DNA, 2379 bp, Artificial Sequence
  Description of Artificial Sequence: Synthetic coding sequence
atggagctgaagagccctgaggaggaggtggtggccgccctgcctgagggcatgaggccagacagcaacctgtatggcttcccctgggagctggtgatctgtgccgctgtggtgggcttctttgctgtgctcttcttcctgtggaggagcttccgctctgtgcgcagccggctgtatgtgggccgggagaagaagctggccctgatgctgagcggcctcatcgaggagaagagcaagctgctggagaagttcagcctggtgcagaaggagtatgagggctatgaggtggagagcagcctgaaggatgccagctttgagaaggaggccacagaggcccagagcctggaggccacctgtgagaagctgaacagaagcaacagcgagctggaggatgagatcctgtgcctggagaaggagctgaaggaggagaagagcaagcacagcgagcaggatgagctgatggctgacatcagcaagaggatccagagcctggaggatgagagcaagagcctgaagagccaggtggccgaggccaagatgaccttcaagatcttccagatgaatgaggagcggctgaagatcgccatcaaggatgccctgaatgaaaacagccagctgcaggagagccagaagcagctgctgcaggaggccgaggtgtggaaggagcaggtgtctgagctgaacaagcagaaggtgacctttgaggacagcaaggtgcatgctgagcaggtgctgaatgacaaggagagccacatcaagaccctgacagagcggctgctgaagatgaaggactgggccgccatgctgggggaggacatcacagatgatgacaacctggagctggagatgaacagcgagagtgaaaatggagcctacctggacaacccccccaagggggccctgaagaagctgattcatgctgccaagctgaatgccagcctgaagaccctggagggggagaggaaccagatctacatccagctgtctgaggtggacaagaccaaggaggagctgacagagcacatcaagaacctgcagacagagcaggccagcctgcagagcgagaacacccactttgaaaatgaaaaccagaagctgcagcagaagctgaaggtgatgacagagctgtaccaggagaatgagatgaagctgcacaggaagctgactgtggaggagaactaccgcctggagaaggaggagaagctgagcaaggtggatgagaagatcagccacgccacagaggagctggagacctacaggaagagggccaaggacctggaggaggagctggagaggaccatccacagctaccagggccagatcatcagccatgagaagaaggcccatgacaactggctggccgccagaaatgctgagaggaacctgaatgacctgaggaaagaaaatgcccacaaccggcagaagctgacagaaacagagctgaagtttgagctgctggagaaggacccctatgccctggatgtgcccaacacagccttcggccgggagcacagcccctacggccccagccccctgggctggcccagcagcgagacccgggccttcctgagcccccccaccctgctggagggccccctgcggctgagccccctgctgcccggcggcggcggccggggcagccggggccctggcaaccccctggaccaccagatcaccaatgaaagaggagagagcagctgtgaccggctgacagacccccaccgggcccccagcgacaccggcagcctgagccccccctgggaccaggacaggaggatgatgttccccccacctggccagagctacccagattctgccctgcccccccagaggcaggaccgcttctgcagcaacagcggccgcctgagcggccctgctgagctgcggagcttcaacatgcccagcctggacaagatggatggctccatgcccagcgagatggagagcagcagaaatgacaccaaggatgacctgggcaacctgaatgtgcctgacagcagcctgcctgcagaaaatgaggccactggacctggctttgtgcccccacccctggcccccatccggggccccctcttccctgtggatgcccggggccccttcctgcggcggggcccccccttccccccacctcctcctggggccatgtttggagccagccgggactacttccccccaggggacttccctggccccccaccagccccctttgccatgagaaatgtgtacccaccccggggcttccccccctacctgccccccaggcctggcttcttccccccaccaccccacagcgagggccgctctgagttccccagcggcctcatcccccccagcaatgaaccagccacagagcaccctgagccccagcaggagacctag

SEQ ID NO: 37754 - DNA, 2286 bp, Artificial Sequence
  Description of Artificial Sequence: Synthetic coding sequence
atggaggagcccggggtgaccccccagccctacctgggcctgctgctggaggagctgcggcgggtggtggccgccctgcctgagggcatgaggccagacagcaacctgtatggcttcccctgggagctggtgatctgtgccgctgtggtgggcttctttgctgtgctcttcttcctgtggaggagcttccgctctgtgcgcagccggctgtatgtgggccgggagaagaagctggccctgatgctgagcggcctcatcgaggagaagagcaagctgctggagaagttcagcctggtgcagaaggagtatgagggctatgaggtggagagcagcctgaaggatgccagctttgagaaggaggccacagaggcccagagcctggaggccacctgtgagaagctgaacagaagcaacagcgagctggaggatgagatcctgtgcctggagaaggagctgaaggaggagaagagcaagcacagcgagcaggatgagctgatggctgacatcagcaagaggatccagagcctggaggatgagagcaagagcctgaagagccaggtggccgaggccaagatgaccttcaagatcttccagatgaatgaggagcggctgaagatcgccatcaaggatgccctgaatgaaaacagccagctgcaggagagccagaagcagctgctgcaggaggccgaggtgtggaaggagcaggtgtctgagctgaacaagcagaaggtgacctttgaggacagcaaggtgcatgctgagcaggtgctgaatgacaaggagagccacatcaagaccctgacagagcggctgctgaagatgaaggactgggccgccatgctgggggaggacatcacagatgatgacaacctggagctggagatgaacagcgagagtgaaaatggagcctacctggacaacccccccaagggggccctgaagaagctgattcatgctgccaagctgaatgccagcctgaagaccctggagggggagaggaaccagatctacatccagctgtctgaggtggacaagaccaaggaggagctgacagagcacatcaagaacctgcagacagagcaggccagcctgcagagcgagaacacccactttgaaaatgaaaaccagaagctgcagcagaagctgaaggtgatgacagagctgtaccaggagaatgagatgaagctgcacaggaagctgactgtggaggagaactaccgcctggagaaggaggagaagctgagcaaggtggatgagaagatcagccacgccacagaggagctggagacctacaggaagagggccaaggacctggaggaggagctggagaggaccatccacagctaccagggccagatcatcagccatgagaagaaggcccatgacaactggctggccgccagaaatgctgagaggaacctgaatgacctgaggaaagaaaatgcccacaaccggcagaagctgacagaaacagagctgaagtttgagctgctggagaaggacccctatgccctggatgtgcccaacacagccttcggccggggcagccggggccctggcaaccccctggaccaccagatcaccaatgaaagaggagagagcagctgtgaccggctgacagacccccaccgggcccccagcgacaccggcagcctgagccccccctgggaccaggacaggaggatgatgtttcctcctcctggccagagctacccagacagcgccctgcccccccagaggcaggaccgcttctgcagcaacagcggccgcctgagcggccctgctgagctgcgctccttcaacatgcccagcctggacaagatggatggctccatgcccagcgagatggagagcagcagaaatgacaccaaggatgacctgggcaacctgaatgtgcctgacagcagcctgcctgcagaaaatgaggccaccggccctggctttgtgcccccacccctggcccccatccggggccccctcttccctgtggatgcccggggccccttcctgcggcggggcccccccttccccccacctcctcctggggccatgtttggagccagccgggactacttccccccaggggacttccctggccccccaccagccccctttgccatgagaaatgtgtacccaccccggggcttccccccctacctgcccccccggcccggcttcttccccccaccaccccacagcgagggccgctctgagttccccagcggcctcatcccccccagcaatgagcccgccacagagcaccctgagccccagcaggagacctag

SEQ ID NO: 37755 - DNA, 2019 bp, Artificial Sequence
  Description of Artificial Sequence: Synthetic coding sequence
atggagctgaagagccctgaggaggaggtggtggccgccctgcctgagggcatgaggccagacagcaacctgtatggcttcccctgggagctggtgatctgtgccgctgtggtgggcttctttgctgtgctcttcttcctgtggaggagcttccgctctgtgcgcagccggctgtatgtgggccgggagaagaagctggccctgatgctgagcggcctcatcgaggagaagagcaagctgctggagaagttcagcctggtgcagaaggaggccacctgtgagaagctgaacagaagcaacagcgagctggaggatgagatcctgtgcctggagaaggagctgaaggaggagaagagcaagcacagcgagcaggatgagctgatggctgacatcagcaagaggatccagagcctggaggatgagagcaagagcctgaagagccaggtggccgaggccaagatgaccttcaagatcttccagatgaatgaggagcggctgaagatcgccatcaaggatgccctgaatgaaaacagccagctgcaggagagccagaagcagctgctgcaggaggccgaggtgtggaaggagcaggtgtctgagctgaacaagcagaaggtgacctttgaggacagcaaggtgcatgctgagcaggtgctgaatgacaaggagagccacatcaagaccctgacagagcggctgctgaagatgaaggactgggccgccatgctgggggaggacatcacagatgatgacaacctggagctggagatgaacagcgagagtgaaaatggagcctacctggacaacccccccaagggggccctgaagaagctgattcatgctgccaagctgaatgccagcctgaagaccctggagggggagaggaaccagatctacatccagctgtctgaggtggacaagaccaaggaggagctgacagagcacatcaagaacctgcagacagagcaggccagcctgcagagcgagaacacccactttgaaaatgaaaaccagaagctgcagcagaagctgaaggtgatgacagagctgtaccaggagaatgagatgaagctgcacaggaagctgactgtggaggagaactaccgcctggagaaggaggagaagctgagcaaggtggatgagaagatcagccacgccacagaggagctggagacctacaggaagagggccaaggacctggaggaggagctggagaggaccatccacagctaccagggccagatcatcagccatgagaagaaggcccatgacaactggctggccgccagaaatgctgagaggaacctgaatgacctgaggaaagaaaatgcccacaaccggcagaagctgacagaaacagagctgaagtttgagctgctggagaaggacccctatgccctggatgtgcccaacacagccttcggccgggagcacagcccctacggccccagccccctgggctggcccagcagcgagacccgggccttcctgagcccccccaccctgctggagggccccctgcggctgagccccctgctgcccggcggcggcggccggggcagccggggccctggcaaccccctggaccaccagatcaccaatgaaagaggagagagcagctgtgaccggctgacagacccccaccgggcccccagcgacaccggcagcctgagccccccctgggaccaggacaggaggatgatgttccccccacctggccagagctacccagattctgccctgcccccccagaggcaggaccgcttctgcagcaacagcggccgcctgagcggccctgctgagctgcggagcttcaacatgcctcctggccccccaccagccccctttgccatgagaaatgtgtacccaccccggggcttccccccctacctgccccccaggcctggcttcttccccccaccaccccacagcgagggccgctctgagttccccagcggcctcatcccccccagcaatgaaccagccacagagcaccctgagccccagcaggagacctag

SEQ ID NO: 37756 - DNA, 2430 bp, Artificial Sequence
  Description of Artificial Sequence: Synthetic coding sequence
atggaggagcccggggtgaccccccagccctacctgggcctgctgctggaggagctgcggcgggtggtggccgccctgcctgagggcatgaggccagacagcaacctgtatggcttcccctgggagctggtgatctgtgccgctgtggtgggcttctttgctgtgctcttcttcctgtggaggagcttccgctctgtgcgcagccggctgtatgtgggccgggagaagaagctggccctgatgctgagcggcctcatcgaggagaagagcaagctgctggagaagttcagcctggtgcagaaggagtatgagggctatgaggtggagagcagcctgaaggatgccagctttgagaaggaggccacagaggcccagagcctggaggtggagaaccagatggccacctgtgagaagctgaacagaagcaacagcgagctggaggatgagatcctgtgcctggagaaggagctgaaggaggagaagagcaagcacagcgagcaggatgagctgatggctgacatcagcaagaggatccagagcctggaggatgagagcaagagcctgaagagccaggtggccgaggccaagatgaccttcaagatcttccagatgaatgaggagcggctgaagatcgccatcaaggatgccctgaatgaaaacagccagctgcaggagagccagaagcagctgctgcaggaggccgaggtgtggaaggagcaggtgtctgagctgaacaagcagaaggtgacctttgaggacagcaaggtgcacgccgagcaggtgctgaatgacaaggagagccacatcaagaccctgacagagcggctgctgaagatgaaggactgggccgccatgctgggggaggacatcacagatgatgacaacctggagctggagatgaacagcgagagtgaaaatggagcctacctggacaacccccccaagggggccctgaagaagctgattcatgctgccaagctgaatgccagcctgaagaccctggagggggagaggaaccagatctacatccagctgtctgaggtggacaagaccaaggaggagctgacagagcacatcaagaacctgcagacagagcaggccagcctgcagagcgagaacacccactttgaaaatgaaaaccagaagctgcagcagaagctgaaggtgatgacagagctgtaccaggagaatgagatgaagctgcacaggaagctgactgtggaggagaactaccgcctggagaaggaggagaagctgagcaaggtggatgagaagatcagccacgccacagaggagctggagacctacaggaagagggccaaggacctggaggaggagctggagaggaccatccacagctaccagggccagatcatcagccatgagaagaaggcccatgacaactggctggccgccagaaatgctgagaggaacctgaatgacctgaggaaagaaaatgcccacaaccggcagaagctgacagaaacagagctgaagtttgagctgctggagaaggacccctatgccctggatgtgcccaacacagccttcggccgggagcacagcccctacggccccagccccctgggctggcccagcagcgagacccgggccttcctgagcccccccaccctgctggagggccccctgcggctgagccccctgctgcccggcggcggcggccggggcagccggggccctggcaaccccctggaccaccagatcaccaatgaaagaggagagagcagctgtgaccggctgacagacccccaccgggcccccagcgacaccggcagcctgagccccccctgggaccaggacaggaggatgatgtttcctcctcctggccagagctacccagacagcgccctgcccccccagaggcaggaccgcttctgcagcaacagcggccgcctgagcggccctgctgagctgcgctccttcaacatgcccagcctggacaagatggatggctccatgcccagcgagatggagagcagcagaaatgacaccaaggatgacctgggcaacctgaatgtgcctgacagcagcctgcctgcagaaaatgaggccaccggccctggctttgtgcccccacccctggcccccatccggggccccctcttccctgtggatgcccggggccccttcctgcggcggggcccccccttccccccacctcctcctggggccatgtttggagccagccgggactacttccccccaggggacttccctggccccccaccagccccctttgccatgagaaatgtgtacccaccccggggcttccccccctacctgcccccccggcccggcttcttccccccaccaccccacagcgagggccgctctgagttccccagcggcctcatcccccccagcaatgagcccgccacagagcaccctgagccccagcaggagacctag

SEQ ID NO: 37757 - DNA, 2328 bp, Artificial Sequence
  Description of Artificial Sequence: Synthetic coding sequence
atgaggccagacagcaacctgtatggcttcccctgggagctggtgatctgtgccgctgtggtgggcttctttgctgtgctcttcttcctgtggaggagcttccgctctgtgcgcagccggctgtatgtgggccgggagaagaagctggccctgatgctgagcggcctgattgaggagaagagcaagctgctggagaagttcagcctggtgcagaaggagtatgagggctatgaggtggagagcagcctgaaggatgccagctttgagaaggaggccacagaggcccagagcctggaggccacctgtgagaagctgaacagaagcaacagcgagctggaggatgagatcctgtgcctggagaaggagctgaaggaggagaagagcaagcacagcgagcaggatgagctgatggctgacatcagcaagaggatccagagcctggaggatgagagcaagagcctgaagagccaggtggccgaggccaagatgaccttcaagatcttccagatgaatgaggagcggctgaagatcgccatcaaggatgccctgaatgaaaacagccagctgcaggagagccagaagcagctgctgcaggaggccgaggtgtggaaggagcaggtgtctgagctgaacaagcagaaggtgacctttgaggacagcaaggtgcacgccgagcaggtgctgaatgacaaggagagccacatcaagaccctgacagagcggctgctgaagatgaaggactgggccgccatgctgggggaggacatcacagatgatgacaacctggagctggagatgaacagcgagagtgaaaatggagcctacctggacaacccccccaagggggccctgaagaagctgattcatgctgccaagctgaatgccagcctgaagaccctggagggggagaggaaccagatctacatccagctgtctgaggtggacaagaccaaggaggagctgacagagcacatcaagaacctgcagacagagcaggccagcctgcagagcgagaacacccactttgaaaatgaaaaccagaagctgcagcagaagctgaaggtgatgacagagctgtaccaggagaatgagatgaagctgcacaggaagctgactgtggaggagaactaccgcctggagaaggaggagaagctgagcaaggtggatgagaagatcagccacgccacagaggagctggagacctacaggaagagggccaaggacctggaggaggagctggagaggaccatccacagctaccagggccagatcatcagccatgagaagaaggcccatgacaactggctggccgccagaaatgctgagaggaacctgaatgacctgaggaaagaaaatgcccacaaccggcagaagctgacagaaacagagctgaagtttgagctgctggagaaggacccctatgccctggatgtgcccaacacagccttcggccgggagcacagcccctacggccccagccccctgggctggcccagcagcgagacccgggccttcctgagcccccccaccctgctggagggccccctgcggctgagccccctgctgcccggcggcggcggccggggcagccggggccctggcaaccccctggaccaccagatcaccaatgaaagaggagagagcagctgtgaccggctgacagacccccaccgggcccccagcgacaccggcagcctgagccccccctgggaccaggacaggaggatgatgtttcctcctcctggccagagctacccagacagcgccctgcccccccagaggcaggaccgcttctgcagcaacagcggccgcctgagcggccctgctgagctgcgctccttcaacatgcccagcctggacaagatggatggctccatgcccagcgagatggagagcagcagaaatgacaccaaggatgacctgggcaacctgaatgtgcctgacagcagcctgcctgcagaaaatgaggccaccggccctggctttgtgcccccacccctggcccccatccggggccccctcttccctgtggatgcccggggccccttcctgcggcggggcccccccttccccccacctcctcctggggccatgtttggagccagccgggactacttccccccaggggacttccctggccccccaccagccccctttgccatgagaaatgtgtacccaccccggggcttccccccctacctgcccccccggcccggcttcttccccccaccaccccacagcgagggccgctctgagttccccagcggcctcatcccccccagcaatgagcccgccacagagcaccctgagccccagcaggagacctag

SEQ ID NO: 37758 - DNA, 1401 bp, Artificial Sequence
  Description of Artificial Sequence: Synthetic coding sequence
atgaggctgcggaccaggaaggccagccagcagagcaaccagatccagacccagaggacagcccgggccaagaggaagtacagcgaggtggatgacagcctgcccagcggcggggagaagcccagcaagaatgagaccggcctgctgagcagcatcaagaagttcatcaagggcagcacccccaaggaggagcgggagaaccccagcaagaggagccgcatcgagcgggacatcgacaacaacctgatcaccagcacccccagggctggggagaagcccaacaagcagatcagccgggtgcggaggaagagccaggtgaatggagaggccggcagctatgagatgaccaaccagcacgtgaagcagaatggcaagctggaggacaaccccagcagcggcagcccccccaggaccaccctgctgggcaccatcttcagccctgtgttcaacttcttcagccctgccaacaagaatggcaccagcggcagtgacagccctggccaggccgtggaggccgaggagatcgtgaagcagctggacatggagcaggtggatgagatcaccaccagcaccaccaccagcaccaacggggccgcctacagcaaccaggccgtgcaggtgcggcccagcctgaacaacggcctggaggaggccgaggagaccgtgaacagagacatcccccccctgacagcccctgtgaccccagattctggctacagcagcgcccacgccgaggccacctatgaggaggactgggaggtgtttgacccctactacttcatcaagcacgtgccccccctgacagaggagcagctgaacaggaagccagccctgcccctgaagaccaggagcaccccagagttcagcctggtgctggacctggatgagaccctggtgcactgcagcctgaatgagctggaggatgctgccctgaccttccctgtgctcttccaggatgtgatctaccaggtgtatgtgcggctgcggcccttcttccgggagttcctggagaggatgagccagatgtatgagatcatcctcttcaccgccagcaagaaggtgtatgctgacaagctgctgaacatcctggaccccaagaagcagctggtgcgccacaggctcttccgggagcactgtgtgtgtgtgcagggcaactacatcaaggacctgaacatcctgggccgggacctgagcaagaccatcatcatcgacaacagcccccaggcctttgcctaccagctgagcaatggcatccccatcgagagctggttcatggacaagaatgacaatgagctgctgaagctgatccccttcctggagaagctggtggagctgaatgaagatgtgcggccccacatccgggaccgcttccggctgcatgacctgctgcccccagactag

SEQ ID NO: 37759 - DNA, 1185 bp, Artificial Sequence
  Description of Artificial Sequence: Synthetic coding sequence
atgaggctgcggaccaggaaggccagccagcagagcaaccagatccagacccagaggacagcccgggccaagaggaagtacagcgaggtggatgacagcctgcccagcggcggggagaagcccagcaagaatgagaccggcctgctgagcagcatcaagaagttcatcaagggcagcacccccaaggaggagcgggagaaccccagcaagaggagccgcatcgagcgggacatcgacaacaacctgatcaccagcacccccagggctggggagaagcccaacaagcagatcagccgggtgcggaggaagagccaggtgaatggagaggccggcagctatgagatgaccaaccagcacgtgaagcagaatggcaagctggaggacaaccccagcagcggcagcccccccaggaccaccctgctgggcaccatcttcagccctgtgttcaacttcttcagccctgccaacaagaatgcccctgtgaccccagattctggctacagcagcgcccacgccgaggccacctatgaggaggactgggaggtgtttgacccctactacttcatcaagcacgtgccccccctgacagaggagcagctgaacaggaagccagccctgcccctgaagaccaggagcaccccagagttcagcctggtgctggacctggatgagaccctggtgcactgcagcctgaatgagctggaggatgctgccctgaccttccctgtgctcttccaggatgtgatctaccaggtgtatgtgcggctgcggcccttcttccgggagttcctggagaggatgagccagatgtatgagatcatcctcttcaccgccagcaagaaggtgtatgctgacaagctgctgaacatcctggaccccaagaagcagctggtgcgccacaggctcttccgggagcactgtgtgtgtgtgcagggcaactacatcaaggacctgaacatcctgggccgggacctgagcaagaccatcatcatcgacaacagcccccaggcctttgcctaccagctgagcaatggcatccccatcgagagctggttcatggacaagaatgacaatgagctgctgaagctgatccccttcctggagaagctggtggagctgaatgaagatgtgcggccccacatccgggaccgcttccggctgcatgacctgctgcccccagactag

SEQ ID NO: 37760 - DNA, 1185 bp, Artificial Sequence; identical to SEQ ID NO: 37759
  Description of Artificial Sequence: Synthetic coding sequence

SEQ ID NO: 37761 - DNA, 498 bp, Artificial Sequence
  Description of Artificial Sequence: Synthetic coding sequence
atgaggctgcggaccaggaaggccagccagcagagcaaccagatccagacccagaggacagcccgggccaagaggaagtacagcgaggtggatgacagcctgcccagcggcggggagaagcccagcaagaatgagaccggcctgctgagcagcatcaagaagttcatcaagggcagcacccccaaggaggagcgggagaaccccagcaagaggagccgcatcgagcgggacatcgacaacaacctgatcaccagcacccccagggctggggagaagcccaacaagcagatcagccgggtgcggaggaagagccaggtgaatggagaggccggcagctatgagatgaccaaccagcacgtgaagcagaatggcaagctggaggacaaccccagcagcggcagcccccccaggaccaccctgctgggcaccatcttcagccctgtgttcaacttcttcagccctgccaacaagaatggcaccagcggcagtgacagctag

SEQ ID NO: 37762 - DNA, 1401 bp, Artificial Sequence; identical to SEQ ID NO: 37758
  Description of Artificial Sequence: Synthetic coding sequence

SEQ ID NO: 37763 - DNA, 279 bp, Artificial Sequence
  Description of Artificial Sequence: Synthetic coding sequence
atgaggctgcggaccaggaaggccagccagcagagcaaccagatccagacccagaggacagcccgggccaagaggaagtacagcgaggtggatgacagcctgcccagcggcggggagaagcccagcaagaatgagaccggcctgctgagcagcatcaagaagttcatcaagggcagcacccccaaggaggagcgggagaaccccagcaagaggagccgcatcgagcgggacatcgacaacaacctgatcaccagcacccccagggctggggagaagtag

SEQ ID NO: 37764 - DNA, 354 bp, Artificial Sequence
  Description of Artificial Sequence: Synthetic coding sequence
atgaggctgcggaccaggaaggccagccagcagagcaaccagatccagacccagaggacagcccgggccaagaggaagtacagcgaggtggatgacagcctgcccagcggcggggagaagcccagcaagaatgagaccggcctgctgagcagcatcaagaagttcatcaagggcagcacccccaaggaggagcgggagaaccccagcaagaggagccgcatcgagcgggacatcgacaacaacctgatcaccagcacccccagggctggggagaagcccaacaagcagatcagccgggtgcggaggaagagccaggtgaatggagaggccggcagctatgagatgaccaactag

SEQ ID NO: 37765 - DNA, 522 bp, Artificial Sequence
  Description of Artificial Sequence: Synthetic coding sequence
atgggagacctgccctgggcccctcctgaggcccaggcccccagcacagctggagctggagatgtggccgagcaccaggtggccccagcccgcttcctgcagggcgcctggaggcaggccgccggctggctgtgccgggagaccggggccgcccctggcagcgcccaggccggccccccagagacagcccatgctgctgacccccagccccggggcccccaggccccaccccggctgccccccagcctgagccctgagcgggtgcaccctggccagcctgctgccccagctgagcccgcccctggggccccagccctgcggagcggccccagccagccccggggcctgcggctgcctgtgcctgtgcctgcctgtgccggcagcagcgcccctggcagccctgctgccctgcctgacagctacccctggcccccaccagccaggaacagacctgccaccctgccccccaccagccgggtgagccccctggccgccttcctggccagcgccccccagaggtag

SEQ ID NO: 37766 - DNA, 252 bp, Artificial Sequence
  Description of Artificial Sequence: Synthetic coding sequence
atggccagcacccccatgggaaatgaaggagagaagaagagctcctggcccagccaggccgcccccagcctgcggggcggccctgccagcctgagccgctctgaggagtacctgagccagatctctgctgagctgatggaggaggccctgtgcacagcctgctgccacctgaaccctgtgcccatcaagaagaagcagagccaggaccaggccacccagatcagcaagagggccttcttcaccaagacctag

SEQ ID NO: 37767 - DNA, 606 bp, Artificial Sequence
  Description of Artificial Sequence: Synthetic coding sequence
atgttcctggtggtggccgtgaacagcctgaccctgtaccagcccagcttccggcccctgctgggagatgcctgctgcctgtgtgtggccgctgctgctggggccctgtgccgggacctgggcccccaccacacccacacccggggccccaatgatggcagctgtggcctgagccgctggaggcaccggcagcacggggacagccctgaggacttcttcctggcccggggggcccacctggccagcacccggggcagaaatgagcacagccccaagggcagcctgcagaagtgcctgctgagcatccgggtgcagaccacccggctgagccacctgcgggccggcgtgaccctgcgctgtgtgctgctgtgtgtgtctgagagccctgtgggcctgcggtctgtggcctgcagcggggacctgctgggggaccccctgaccggcttcctggccttcctggtgtcctgcctgacccccagcggcaccccaggcaacaccagcctgaccaagctgagccccaccagcagcagccagggcctggccctgggccccctgagccccagcagctgtgatgctgccagccccagcatcagcctgggcctgtag

SEQ ID NO: 37768 - DNA, 645 bp, Artificial Sequence
  Description of Artificial Sequence: Synthetic coding sequence
atggagcccgcccgggagccccccagccgggcccggcccccaccacccctggccgcccggcctgccccagccccagctgccccccggcccaggagccctgctgaggccgaggcccggggccctgagggcctgctgcggcgcagcggcagcggctatgagggcagcacctcctggaaggccgccctggaggacaccaccacccggctgctgctgggcgccatcgctgtgctgctgtttgccatcctggtggtgatgagcatcctggccagcaagggctgcatcaagtgtgaggccccctgcccagaggactggctgctgtatggcaggaagtgctacttcttcagcgaggagccccgggactggaacacaggccggcagtactgccacacccatgaagctgtgctggccgtcatccagagccagaaggagctggagttcatgttcaagttcacccggcgggagccctggattggcctgcggcgggtgggagatgagttccactgggtgaatggagacccctttgatcctgacaccttcaccatcgccggccctggagaatgtgtgtttgtggagcccacccggctggtgtccacagaatgtctgatgacccggccctgggtgtgcagcaagatggcctacacctag

SEQ ID NO: 37769 - DNA, 1824 bp, Artificial Sequence
  Description of Artificial Sequence: Synthetic coding sequence
atggagctggtgcggcggctgatgcccctgaccctgctgatcctgagctgcctggccgagctgaccatggccgaggccgagggcaatgccagctgcaccgtgtccctgggcggggccaacatggccgagacccacaaggccatgatcctgcagctgaaccccagcgagaactgcacctggaccatcgagaggcctgagaacaagagcatccgcatcatcttctcctatgtgcagctggaccctgatggcagctgtgagagcgagaacatcaaggtgtttgatggcaccagcagcaatggccccctgctgggccaggtgtgcagcaagaatgactatgtgcctgtgtttgagagcagcagcagcaccctgaccttccagatcgtgacagattctgcccgcatccagaggacagtgtttgtgttctactacttcttcagccccaacatcagcatccccaactgtggcggctacctggacaccctggagggcagcttcaccagccccaactaccccaagccccaccctgagctggcctactgtgtgtggcacatccaggtggagaaggactacaagatcaagctgaacttcaaggagatcttcctggagattgacaagcagtgcaagtttgacttcctggccatctatgatggccccagcaccaacagcggcctgattggccaggtgtgtggccgggtgacccccacctttgagagcagcagcaacagcctgactgtggtgctgagcacagattatgccaacagctaccggggcttcagcgccagctacaccagcatctatgcagagaacatcaacaccaccagcctgacctgcagcagtgacaggatgagggtcatcatcagcaagagctacctggaggccttcaacagcaatggaaacaacctgcagctgaaggaccccacctgccggcccaagctgagcaatgtggtggagttctctgtgcccctgaatggctgcggcaccatcaggaaggtggaggaccagagcatcacctacaccaacatcatcaccttcagcgccagcagcaccagcgaggtgatcacccggcagaagcagctgcagatcatcgtgaagtgtgagatgggccacaacagcacagtggagatcatctacatcacagaagatgatgtgatccagagccagaatgccctgggcaagtacaacacctccatggccctgtttgagagcaacagctttgagaagaccatcctggagagcccctactacgtggacctgaaccagaccctgtttgtgcaggtgtccctgcacaccagtgaccccaacctggtggtgttcctggacacctgccgggccagccccaccagtgactttgccagccccacctatgacctgatcaagagcggctgcagcagagatgagacctgcaaggtgtaccccctgtttggccactacggccgcttccagttcaatgccttcaagttcctgcgctccatgagctctgtgtacctgcagtgcaaggtgctgatctgtgacagcagtgaccaccagagccgctgcaaccagggctgtgtgagccgcagcaagagggacatcagcagctacaagtggaagacagacagcatcatcggccccatccggctgaagagggacagaagtgccagcggcaacagcggcttccagcacgagacccacgccgaggagacccccaaccagcccttcaacagcgtgcacctgttctccttcatggtgctggccctgaatgtggtgacagtggccaccatcaccgtgcgccactttgtgaaccagagagctgactacaagtaccagaagctgcagaactactag

SEQ ID NO: 37770 - DNA, 1824 bp, Artificial Sequence; identical to SEQ ID NO: 37769
  Description of Artificial Sequence: Synthetic coding sequence

SEQ ID NO: 37771 - DNA, 1161 bp, Artificial Sequence
  Description of Artificial Sequence: Synthetic coding sequence
atgaccagcctcttccgccgcagcagcagcggcagcggcggcggcggcacagctggggcccggggcggcggcggcggcacagctgccccccaggagctgaacaacagcaggcctgcccggcaggtgcggcggctggagttcaaccaggccatggatgacttcaagaccatgttccccaacatggactatgacatcattgaatgtgtgctgcgggccaacagcggggctgtggatgccaccatcgaccagctgctgcagatgaacctggagggcggcggcagcagtggaggagtgtatgaggacagcagtgacagcgaggacagcatccccccagagatcctggagaggaccctggagccagacagcagtgatgaggagcccccacctgtgtacagccccccagcctaccacatgcacgtgtttgaccggccctaccccctggccccacccaccccacctccaagaattgatgccctgggcagcggggcccccaccagccagaggcgctacagaaactggaacccccccctgctgggcaacctgcctgatgacttcctgcgcatcctgccccagcagctggacagcatccagggcaatgctgggggccccaagccaggcagcggggagggctgccccccagccatggccggccctggccctggggaccaggagagccgctggaagcagtacctggaggatgagcgcatcgccctcttcctgcagaatgaggagttcatgaaggagctgcagaggaacagagacttcctgctggccctggagcgggaccggctgaagtatgagagccagaagagcaagagcagctctgtggccgtgggcaatgactttggcttcagcagccctgtgcccggcactggagatgccaacccagctgtgtctgaagatgccctcttccgggacaagctgaagcacatgggcaagagcaccaggaggaagctgtttgagctggcccgggccttcagcgagaagaccaagatgaggaagagcaagaggaagcacctgctgaagcaccagagcctgggcgctgctgccagcacagccaacctgctggatgatgtggagggccacgcctgtgatgaggacttccggggccggcggcaggaggcccccaaggtggaggagggcctgcgggagggccagtag

SEQ ID NO: 37772 - DNA, 1161 bp, Artificial Sequence; identical to SEQ ID NO: 37771
  Description of Artificial Sequence: Synthetic coding sequence

SEQ ID NO: 37773 - DNA, 471 bp, Artificial Sequence
  Description of Artificial Sequence: Synthetic coding sequence
atgcctgccctgctgcctgtggccagccggctgctgctgctgccccgggtgctgctgaccatggccagcggcagcccccccacccagcccagccctgccagtgacagcggcagcggctacgtgcccggctctgtgtctgctgcctttgtgacctgccccaatgagaaggtggccaaggagatcgcccgggctgtggtggagaagaggctggccgcctgtgtgaacctgatcccccagatcaccagcatctatgagtggaagggcaagattgaggaggacagcgaggtgctgatgatgatcaagacccagagcagcctggtgcctgccctgacagactttgtgcgctctgtgcacccctatgaggtggccgaggtgattgccctgcctgtggagcagggcaacttcccctacctgcagtgggtgcggcaggtgacagaatctgtgtctgacagcatcaccgtgctgccctag

SEQ ID NO: 37774 - DNA, 597 bp, Artificial Sequence
  Description of Artificial Sequence: Synthetic coding sequence
atgattggcagcggcctggccggcagcggcggggccggcggccccagcagcacagtgacctggtgtgccctcttcagcaaccacgtggccgccacccaggccagcctgctgctgagctttgtgtggatgcctgccctgctgcctgtggccagccggctgctgctgctgccccgggtgctgctgaccatggccagcggcagcccccccacccagcccagccctgccagtgacagcggcagcggctacgtgcccggctctgtgtctgctgcctttgtgacctgccccaatgagaaggtggccaaggagatcgcccgggctgtggtggagaagaggctggccgcctgtgtgaacctgatcccccagatcaccagcatctatgagtggaagggcaagattgaggaggacagcgaggtgctgatgatgatcaagacccagagcagcctggtgcctgccctgacagactttgtgcgctctgtgcacccctatgaggtggccgaggtgattgccctgcctgtggagcagggcaacttcccctacctgcagtgggtgcggcaggtgacagaatctgtgtctgacagcatcaccgtgctgccctag

SEQ ID NO: 37775 - DNA, 471 bp, Artificial Sequence; identical to SEQ ID NO: 37773
  Description of Artificial Sequence: Synthetic coding sequence

SEQ ID NO: 37776 - DNA, 540 bp, Artificial Sequence
  Description of Artificial Sequence: Synthetic coding sequence
atgtctgggggccgggccccagctgtgctgctgggcggcgtggccagcctgctgctgagctttgtgtggatgcctgccctgctgcctgtggccagccggctgctgctgctgccccgggtgctgctgaccatggccagcggcagcccccccacccagcccagccctgccagtgacagcggcagcggctacgtgcccggctctgtgtctgctgcctttgtgacctgccccaatgagaaggtggccaaggagatcgcccgggctgtggtggagaagaggctggccgcctgtgtgaacctgatcccccagatcaccagcatctatgagtggaagggcaagattgaagaagattctgaggtgctgatgatgatcaagacccagagcagcctggtgcctgccctgacagactttgtgcgctctgtgcacccctatgaggtggccgaggtgattgccctgcctgtggagcagggcaacttcccctacctgcagtgggtgcggcaggtgacagagagcgtgtctgacagcatcaccgtgctgccctag

SEQ ID NO: 37777 - DNA, 540 bp, Artificial Sequence; identical to SEQ ID NO: 37776
  Description of Artificial Sequence: Synthetic coding sequence

SEQ ID NO: 37778 - DNA, 129 bp, Artificial Sequence
  Description of Artificial Sequence: Synthetic coding sequence
atgtctgggggccgggccccagctgtgctgctgggcggcgtggtgtctgaccggcccaggcctgcccccagcggccccaggagcctggaccgctacccccaccccaagagccagaggctggccccctag

SEQ ID NO: 37779 - DNA, 690 bp, Artificial Sequence
  Description of Artificial Sequence: Synthetic coding sequence
atgaccacagctgcccggcccacctttgagcccgcccggggcggccggggcaagggggagggggacctgagccagctgagcaagcagtacagcagccgggacctgcccagccacaccaagatcaagtaccggcagaccacccaggatgcccctgaggaggtgaggaacagagacttccggcgggagctggaggagcgggagagagctgctgcccgggagaagaacagagaccggcccacccgggagcacaccaccagcagctctgtgtccaagaagccccggctggaccagatcccagctgccaacctggatgctgatgaccccctgacagatgaagaagatgaagattttgaggaggagagtgatgatgatgacacagctgccctgctggccgagctggagaagatcaagaaggagagagctgaggagcaggccaggaaggagcaggagcagaaggccgaggaggagcgcatccgcatggagaacatcctgagcggcaaccccctgctgaacctgaccggccccagccagccccaggccaacttcaaggtgaagaggcgctgggatgatgatgtggtgttcaagaactgtgccaagggcgtggatgaccagaagaaggacaagagatttgtgaatgacaccctgcggtctgagttccacaagaagttcatggagaagtacatcaagtag

SEQ ID NO: 37780 - DNA, 618 bp, Artificial Sequence
  Description of Artificial Sequence: Synthetic coding sequence
atgagcatcatgagctacaatggaggagctgtgatggccatgaagggcaagaactgtgtggccatcgctgctgaccggcgcttcggcatccaggcccagatggtgaccacagacttccagaagatcttccccatgggagaccggctgtacatcggcctggccggcctggccacagatgtgcagacagtggcccagaggctgaagttccggctgaacctgtatgagctgaaggagggccggcagatcaagccctacaccctgatgtccatggtggccaacctgctgtatgagaagcgcttcggcccctactacacagagcctgtgattgctggcctggaccccaagaccttcaagcccttcatctgcagcctggacctgattggctgccccatggtgacagatgactttgtggtgtctggcacctgtgccgagcagatgtatggcatgtgtgagagcctgtgggagcccaacatggaccctgaccacctgtttgagaccatcagccaggccatgctgaatgctgtggacagagatgctgtgtctggcatgggcgtcatcgtgcacatcatcgagaaggacaagatcaccaccaggaccctgaaggccaggatggactag

SEQ ID NO: 37781 - DNA, 1089 bp, Artificial Sequence
  Description of Artificial Sequence: Synthetic coding sequence
atgaagaaggaggagaagctggactggatgtaccagggccctgggggcatggtgaacagagatgagtacctgctgggccggcccatcgacaagtatgtgtttgagaagatggaggagaaggaggccggctgcagcagcgagaccggcctgctgcccggcagcatctttgcccccagcggggccaacagcctgctggacatggccagcaagatccgggaggaccccctcttcatcatcaggaagaaggaggaggagaagaagcgggaggtgctgaacaaccctgtgaagatgaagaagatcaaggagctgctgcagatgagcctggagaagaaggagaagaagaagaagaaggagaagaagaagaagcacaagaagcacaagcacaggagcagcagcagtgacaggagcagcagtgaagatgagcacagcgctggccgcagccagaagaagatggccaacagcagccctgtgctgagcaaggtgcccggctacggcctgcaggtgaggaacagcgacaggaaccagggcctgcagggccccctgacagctgagcagaagaggggccacggcatgaagaaccacagccgcagccgcagcagcagccacagcccccccaggcatgccagcaagaagagcacccgggaggccggcagccgggacagaagaagccgcagcctgggccgccgcagccgcagcccccggcccagcaagctgcacaacagcaaggtgaacagaagagagaccggccagaccaggagccccagccccaagaaggaggtgtaccagaggagacatgcccctggctacaccaggaagctgtctgctgaggagctggagaggaagaggcaggagatgatggagaatgccaagtggagggaggaggagcggctgaacatcctgaagagacatgccaaggatgaggagcgggagcagaggctggagaagctggacagcagagatggcaagttcatccacaggatgaagctggagagcgccagcaccagcagcctggaggacagagtgaagaggaacatctacagcctgcagaggacctctgtggccctggagaagaacttcatgaagaggtag

SEQ ID NO: 37782 - DNA, 1617 bp, Artificial Sequence
  Description of Artificial Sequence: Synthetic coding sequence
atggcccagaagcccctgcggctgctggcctgtggagatgtggagggcaagtttgacatcctcttcaacagagtgcaggccatccagaagaagagcggcaactttgacctgctgctgtgtgtgggcaacttcttcggcagcacccaggatgctgagtgggaggagtacaagacaggcatcaagaaggcccccatccagacctacgtgctgggcgccaacaaccaggagaccgtgaagtacttccaggatgctgatggctgtgagctggccgagaacatcacctacctgggcaggaagggcatcttcaccggcagcagcggcctgcagatcgtgtacctgagcggcacagagagcctgaatgaacctgtgcccggctacagcttcagccccaaggatgtgagcagcctgaggatgatgctgtgcaccaccagccagttcaagggcgtggacatcctgctgaccagcccctggcccaagtgtgtgggcaactttggaaacagcagcggggaggtggacaccaagaagtgtggcagcgccctggtgagcagcctggccaccggcctgaagccccgctaccactttgctgccctggagaagacctactatgaaaggctgccctacagaaaccacatcatcctgcaggagaatgcccagcacgccacccgcttcatcgccctggccaacgtgggcaaccctgagaagaagaagtacctgtatgccttcagcatcgtgcccatgaagctgatggatgctgctgagctggtgaagcagcccccagatgtgacagagaacccctacaggaagagcggccaggaggccagcatcggcaagcagatcctggcccctgtggaggagagcgcctgccagttcttctttgacctgaatgagaagcagggcaggaagaggagcagcacaggccgggacagcaagagcagcccccaccccaagcagcccaggaagccaccccagcccccaggcccctgctggttctgcctggccagccctgaggtggagaagcacctggtggtgaacatcggcacccactgctacctggccctggccaagggcggcctgagtgatgaccacgtgctgatcctgcccatcggccactaccagagcgtggtggagctgtctgctgaggtggtggaggaggtggagaagtacaaggccaccctgcggcgcttcttcaagagccggggcaagtggtgtgtggtgtttgagaggaactacaagagccaccacctgcagctgcaggtgattcctgtgcccatcagctgcagcaccacagatgacatcaaggatgccttcatcacccaggcccaggagcagcagatcgagctgctggagatccctgagcacagcgacatcaagcagatcgcccagcccggggccgcctacttctacgtggagctggacacaggagagaagctgttccaccgcatcaagaagaacttccccctgcagtttggccgggaggtgctggccagcgaggccatcctgaatgtgcctgacaagagtgactggaggcagtgccagatcagcaaggaggatgaggagaccctggcccggcgcttcaggaaggactttgagccctatgacttcaccctggatgactag

SEQ ID NO: 37783 - DNA, 762 bp, Artificial Sequence
  Description of Artificial Sequence: Synthetic coding sequence
atgaagctgatggatgctgctgagctggtgaagcagcccccagatgtgacagagaacccctacaggaagagcggccaggaggccagcatcggcaagcagatcctggcccctgtggaggagagcgcctgccagttcttctttgacctgaatgagaagcagggcaggaagaggagcagcacaggccgggacagcaagagcagcccccaccccaagcagcccaggaagccaccccagcccccaggcccctgctggttctgcctggccagccctgaggtggagaagcacctggtggtgaacatcggcacccactgctacctggccctggccaagggcggcctgagtgatgaccacgtgctgatcctgcccatcggccactaccagagcgtggtggagctgtctgctgaggtggtggaggaggtggagaagtacaaggccaccctgcggcgcttcttcaagagccggggcaagtggtgtgtggtgtttgaaagaaactacaagagccaccacctgcagctgcagatcgcccagcctggagctgcctacttctacgtggagctggacaccggggagaagctgttccaccgcatcaagaagaacttccccctgcagtttggccgggaggtgctggccagcgaggccatcctgaatgtgcctgacaagagtgactggaggcagtgccagatcagcaaagaagatgaggagaccctggcccggcgcttcaggaaggactttgagccctatgacttcaccctggatgactag

SEQ ID NO: 37784 - DNA, 1617 bp, Artificial Sequence; identical to SEQ ID NO: 37782
  Description of Artificial Sequence: Synthetic coding sequence

SEQ ID NO: 37785 - DNA, 2685 bp, Artificial Sequence
  Description of Artificial Sequence: Synthetic coding sequence
atggccacctccatggctgctgccagcggccgctttgagagcgccaagagcattgaggagaggaaggagcagaccagaaatgcccgggcagaggtgctgcggcaggccaaggccaactttgagaaggaggagaggaggaaggagctgaagaggctgcggggggaggacacctggatgctgcctgatgtgaatgaaagaattgagcagttcagccaggagcacagcgtgaagaagaagaagaagaaggacaagcacagcaagaaggccaagaaggagaagaagaagaagagcaagaagcagaagtatgagaagaacaatgaaagcagtgacagcagcagcagcagtgaagatgagtgggtggaggccgtgcccagccagaccccagacaaggagaaggcctggaaggtgaaggatgagaagagcggcaaggatgacacccagatcatcaagagagatgagtggatgacagtggacttcatgtctgtgaagacagtgagcagcagcagcctgaaggccgagaaggagaccatgaggaagattgagcaggagaagaaccaggccctggagcagagcaagctgatggagcgggagctgaacccctactggaaggatggcggcaccggcctgcccccagaggactgcagcgtgagcagcatcaccaaggtgtctgtggtggaggatggcggcctgtcctggctgaggaagagctacctgaggatgaaggagcaggccgagaagcagagcaggaactttgaggacatcgtggccgagagatatggctccatggagatcttccagagcaagctggaggatgctgagaaggccgccagcaccaaggaggactacagaagagagcgctggaggaagcccacctacagcgacaaggcccagaactgccaggagagccgggagagtgacctggtgaagtatggcaacagcagccgggacagatatgccaccacagacacagccaagaacagcaacaatgagaagttcatcggagatgagaaggacaagaggcctggcagcctggagacctgccggcgggagagcaacccccggcagaaccaggagttctcctttggaaacctgcgggccaagttcctgcggcccagtgatgatgaggagctgtccttccacagcaagggcaggaagtttgagcccctgagcagcagcagcgccctggtggcccagggcagcctgtgcagcggcttcaggaagcccaccaagaacagcgaggagcggctgacctcctggagcagaagtgatggccgcggggacaagaagcacagcaaccagaagcccagcgagaccagcacagatgagcaccagcacgtgcctgaggacccccgggagaagagccaggatgaggtgctgagagatgatcctcccaagaaggagcacctgcgggacaccaagagcacctttgctggcagccctgagcgggagagcatccacatcctgtctgtggatgagaagaacaagctgggcgccaagatcatcaaggccgagatgatgggcaacatggagctggccgagcagctgaaggtgcagctggagaaggccaacaagttcaaggagaccatcacccagatccccaagaagagcggcgtggagaatgaagaccagcaggaggtgatcctggtgaggacagaccagagcggccgggtgtggcctgtgaacaccccaggcaagagcctggagagccagggcggccgcaggaagaggcagatggtgtccacccatgaggagcgggagcgggtgcgctacttccatgatgatgacaacctgagcctgaatgacctggtgaagaatgagaagatgggcacagctgagaaccagaacaagctgttcatgaggatggccagcaagttcatgggcaagacagatggagactactacaccctggatgacatgtttgtgtccaaggctgctgagcgggagcggctgggggaggaggaggagaaccagaggaagaaggccatcgccgagcacaggagcctggccgcccagatggagaagtgcctgtactgctttgacagcagccagttccccaagcacctgattgtggccatcggcgtgaaggtgtacctgtgcctgcccaacgtgcgcagcctgacagagggccactgcctgattgtgcccctgcagcaccacagagctgccaccctgctggatgaggacatctgggaggagatccagatgttcaggaagagcctggtgaagatgtttgaagataaaggcctggactgcatcttcctggagaccaacatgtccatgaagaagcagtaccacatggtgtatgagtgcatccccctgcccaaggaggtgggggacatggcccccatctacttcaagaaggccatcatggagagtgatgaggagtggagcatgaacaagaagctgattgacctgagcagcaaggacatcaggaagtctgtgccccggggcctgccctacttctctgtggactttggcctgcacggcggctttgcccacgtgattgaggaccagcacaagttcccccactactttgggaaggagatcatcggcggcatgctggacatcgagccccggctgtggaggaagggcatccgggagagctttgaggaccagaggaagaaggccctgcagtttgcccagtggtggaagccctatgacttcaccaagagcaagaactactag

SEQ ID NO: 37786 - DNA, 291 bp, Artificial Sequence
  Description of Artificial Sequence: Synthetic coding sequence
atgtttgaagataaaggcctggactgcatcttcctggagaccaacatgtccatgaagaagcagtaccacatggtgtatgagtgcatccccctgcccaaggaggtgggggacatggcccccatctacttcaagaaggccatcatggagagtgatgaggagtggagcatgaacaagaagctgattgacctgagcagcaaggacatcaggaagtctgtgccccggggcctgccctacttctctgtggactttggcctgcacggcggctttgcccacgtgattgaggaccagtag

SEQ ID NO: 37787 - DNA, 2229 bp, Artificial Sequence
  Description of Artificial Sequence: Synthetic coding sequence
atggccacctccatggctgctgccagcggccgctttgagagcgccaagagcattgaggagaggaaggagcagaccagaaatgcccgggcagaggtgctgcggcaggccaaggccaactttgagaaggaggagaggaggaaggagctgaagaggctgcggggggaggacacctggatgctgcctgatgtgaatgaaagaattgagcagttcagccaggagcacagcgtgaagaagaagaagaagaaggacaagcacagcaagaaggccaagaaggagaagaagaagaagagcaagaagcagaagtatgagaagaacaatgaaagcagtgacagcagcagcagcagtgaagatgagtgggtggaggccgtgcccagccagaccccagacaaggagaaggcctggaaggtgaaggatgagaagagcggcaaggatgacacccagatcatcaagagagatgagtggatgacagtggacttcatgtctgtgaagacagtgagcagcagcagcctgaaggccgagaaggagaccatgaggaagattgagcaggagaagaaccaggccctggagcagagcaagctgatggagcgggagctgaacccctactggaaggatggcggcaccggcctgcccccagaggactgcagcgtgagcagcatcaccaaggtgtctgtggtggaggatggcggcctgtcctggctgaggaagagctacctgaggatgaaggagcaggccgagaagcagagcaggaactttgaggacatcgtggccgagagatatggctccatggagatcttccagagcaagctggaggatgctgagaaggccgccagcaccaaggaggactacagaagagagcgctggaggaagcccacctacagcgacaaggcccagaactgccaggagagccgggagagtgacctggtgaagtatggcaacagcagccgggacagatatgccaccacagacacagccaagaacagcaacaatgagaagttcatcggagatgagaaggacaagaggcctggcagcctggagacctgccggcgggagagcaacccccggcagaaccaggagttctcctttggaaacctgcgggccaagttcctgcggcccagtgatgatgaggagctgtccttccacagcaagggcaggaagtttgagcccctgagcagcagcagcgccctggtggcccagggcagcctgtgcagcggcttcaggaagcccaccaagaacagcgaggagcggctgacctcctggagcagaagtgatggccgcggggacaagaagcacagcaaccagaagcccagcgagaccagcacagatgagcaccagcacgtgcctgaggacccccgggagaagagccaggatgaggtgctgagagatgatcctcccaagaaggagcacctgcgggacaccaagagcacctttgctggcagccctgagcgggagagcatccacatcctgtctgtggatgagaagaacaagctgggcgccaagatcatcaaggccgagatgatgggcaacatggagctggccgagcagctgaaggtgcagctggagaaggccaacaagttcaaggagaccatcacccagatccccaagaagagcggcgtggagaatgaagaccagcaggaggtgatcctggtgaggacagaccagagcggccgggtgtggcctgtgaacaccccaggcaagagcctggagagccagggcggccgcaggaagaggcagatggtgtccacccatgaggagcgggagcgggtgcgctacttccatgatgatgacaacctgagcctgaatgacctggtgaagaatgagaagatgggcacagctgagaaccagaacaagctgttcatgaggatggccagcaagttcatgggcaagacagatggagactactacaccctggatgacatgtttgtgtccaaggctgctgagcgggagcggctgggggaggaggaggagaaccagaggaagaaggccatcgccgagcacaggagcctggccgcccagatggagaagtgcctgtactgctttgacagcagccagttccccaagcacctgattgtggccatcggcgtgaaggtgtacctgtgcctgcccaacgtgcgcagcctgacagagggccactgcctgattgtgcccctgcagcaccacagagctgccaccctgctggatgaggacatctgggaggagatccagatcaagagcaggacagtcatccagtag

SEQ ID NO: 37788 - DNA, 207 bp, Artificial Sequence
  Description of Artificial Sequence: Synthetic coding sequence
atgccccagaaggacccctgccagaagcaggcctgtgagatccagaagtgcctgcaggccaacagctacatggagagcaagtgccaggccgtcatccaggagctgaggaagtgctgtgcccagtaccccaagggccgctctgtggtgtgcagcggctttgagaaggaggaggaggagaacctgaccaggaagagcgccagcaagtag

SEQ ID NO: 37789 - DNA, 1311 bp, Artificial Sequence
  Description of Artificial Sequence: Synthetic coding sequence
atgcccatgagcagcctgcctgctgccatcctgagccacatgacagccatcaacaacgtgcccccaccacccctgcacagcatccccaacctgaagaagagcaagcacatcaactacggccagctgaatgccctgtgccacatccggggccagcacagccgctccatgagcaacatcctgagcgcccatgacaccttcatgaagcagtaccccaaggtgttcctgcaccagaagccccggctgcccaagctgttcaagcaggaggagcagcgggagctgaatgaaggcaaggaggagagccagcaccagcagccagatgacagcaacaacattgctgtgcacgtgcagagggcccatggaggccacatcctgtaccggcccaagagggccacagagaagtttgaggagttcctggccatcctgaagaagctgcccatccacaggaccccctatgagcacaagacagtgtggaagttcctgaagaccatcccagacctgaccttccagctgaatgacaagcacctgaagaccctgagcaagacagtgttcagcgagacctggctgaagggcagcacagtggtggccaatgatggcttctacgtgatcctgaagggcctggcccggccccagaccaacgtgtacaagaacctgattgagggcagtgacagcccagacagcttcatcagccagagcttccacagcttcatctggagcgaggagttcaagaacagcaccctggccgagatgtacctgcccagctatgacagcatgctgagcaagtggagcaccttcggcaccctggaggtgatgccccagaatgaaagtgagacccagatgttttctgtggtgacagaagatgactgtgagatcctgaagatcccagccaagggctacgccaagatcaaggaggagaagatcaagctggagaacatgcagaagctgaagctgatccgcatgtgcccctactatgaggagtggcccaccctgagcatctatgagctgattgccctgctgaagtggaagaagttccccccaggccacgtgattgtggagagcggcaacatcatcagctttgtgggctacatcaacagcggctgctgcaacatctaccgcagcatcatcggctttgtgaagctgcggagcaacaaggtgaagaggagccagaagctggtgtacatgggcaagctgaaggagaaggagagctttggagagatctctgtgctgctgcaggtgcccttcacctgcaccatcatcaccaagaaggaggtggagatggccatcatcgaggacaaggacctgtttgtggcctag

SEQ ID NO: 37790 - DNA, 876 bp, Artificial Sequence
  Description of Artificial Sequence: Synthetic coding sequence
atgctgctgcccctgcccccccagagcagcaagcctgtgcccaagaagagccagagcagcaagatcgtgcccagccaccacgaccccagcgagaagacaggagagaactgccagaccaagatcagccccagcagcctgcaggagagccccagcagcctgcagggcgccctgaagaagaggtctgcctttgaggacctgaccaacgtgtcctttgagatgacccatgagaccctgtacctggccgtgaagctggtggacctgtacctgatgaaggctgtgtgcaagaaggacaagctgcagctgctgggcgccacagccttcatgattgctgccaagtttgaggagcacaacagcccccgggtggatgactttgtgtacatctgtgatgacaactaccagaggtctgaggtgctgtccatggagatcaacatcctgaatgtgctgaagtgtgacatcaacatccccatcgcctaccacttcctgcggcgctatgcccgctgcatccacaccaacatgaagaccctgaccctgagccgctacatctgtgagatgaccctgcaggagtaccactacgtgcaggagaaggccagcaagctggccgccgccagcctgctgctggccctgtacatgaagaagctgggctactgggtgcccttcctggagcactacagcggctacagcatcagcgagctgcaccccctggtgcggcagctgaacaagctgctgaccttcagcagctatgacagcctgaaggctgtgtactacaagtacagccaccctgtgttctttgaggtggccaagatcccagccctggacatgctgaagctggaggagatcctgaactgtgactgtgaggcccagggcctggtgctgtag

SEQ ID NO: 37791 - DNA, 4188 bp, Artificial Sequence
  Description of Artificial Sequence: Synthetic coding sequence
atgctgctgcccctgcccccccagagcagcaagcctgtgcccaagaagagccagagcagcaagatcgtgcccagccaccacgaccccagcgagaagacaggagagaactgccagaccaagatcagccccagcagcctgcaggagagccccagcagcctgcagggcgccctgaagaagaggtctgcctttgaggacctgaccaatgccagccagtgccagcctgtgcagcccaagaaggaggccaacaaggagtttgtgaaggtggtgtccaagaagatcaacagaaacacccacgccctgggcctggccaagaagaacaagaggaacctgaagtggcacaagctggaggtgacccctgtggtggccagcaccaccgtggtgcccaacatcatggagaagcccctcatcctggacatcagcaccaccagcaagacccccaacacagaggaggccagcctcttcaggaagcccctggtgctgaaggaggagcccaccattgaagatgagaccctcatcaacaagagcctgagcctgaagaagtgcagcaaccacgaggaggtgtccctgctggagaagctgcagcccctgcaggaggagagtgacagtgatgatgccttcgtcatcgagcccatgaccttcaagaagacccacaagacagaggaggccgccatcaccaagaagaccctgagcctgaagaagaagatgtgtgccagccagaggaagcagagctgccaggaggagagcctggccgtgcaggatgtgaacatggaggaggacagcttcttcatggagagcatgtccttcaagaagaagcccaagacagaggagagcatccccacccacaagctgagcagcctgaagaagaagtgcaccatctacggcaagatctgccacttcaggaagccccctgtgctgcagaccaccatctgtggggccatgagcagcatcaagaagcccaccacagagaaggagaccctcttccaggagctgtctgtgctgcaggagaagcacaccacagaacatgagatgagcatcctgaagaagagcctggccctgcagaagaccaacttcaaggaggacagcctggtgaaggagagcctggccttcaagaagaagcccagcacagaggaggccatcatgatgcctgtgatcctgaaggagcagtgcatgacagagggcaagaggagccggctgaagcccctggtgctgcaggagatcaccagcggggagaagagcctcatcatgaagcccctgagcatcaaggagaagcccagcacagagaaggagagcttcagccaggagcccagcgccctgcagaagaagcacaccacccaggaggaggtgtccatcctgaaggagcccagcagcctgctgaagagccccacagaggagagcccctttgatgaggccctggccttcaccaagaagtgcaccatcgaggaggccccacccaccaagaagcccctcatcctgaagaggaagcacgccacccagggcaccatgagccacctgaagaagcccctcatcctgcagaccaccagcggggagaagagcctcatcaaggagcccctgcccttcaaggaggagaaggtgtccctgaagaagaagtgcaccacccaggagatgatgagcatctgcccagagctgctggacttccaggacatgattggagaggacaagaacagcttcttcatggagcccatgtccttcaggaagaaccccaccacagaggagaccgtgctgaccaagaccagcctgagcctgcaggagaagaagatcacccagggcaagatgagccacctgaagaagcccctggtgctgcagaagatcaccagcgaggaggagagcttctacaagaagctgctgcccttcaagatgaagagcaccacagaggagaagttcctgagccaggagcccagcgccctgaaggagaagcacaccaccctgcaggaggtgtccctgagcaaggagagcctggccatccaggagaaggccaccacagaggaggagttcagccaggagctgttcagcctgcacgtgaagcacaccaacaagagcggcagcctcttccaggaggccctggtgctgcaggagaagacagatgctgaggaggacagcctgaagaacctgctggccctgcaggagaagagcaccatggaggaggagagcctcatcaacaagctgctggccctgaaggaggagctgtctgctgaggccgccaccaacatccagacccagctgagcctgaagaagaagagcaccagccacggcaaggtgttcttcctgaagaagcagctggccctgaatgagaccatcaatgaggaggagttcctgaacaagcagcccctggccctggagggctaccccagcattgctgagggggagaccctcttcaagaagctgctggccatgcaggaggagcccagcattgagaaggaggccgtgctgaaggagcccaccatcgacacagaggcccacttcaaggagcccctggccctgcaggaggagcccagcacagagaaggaggccgtgctgaaggagcccagcgtggacacagaggcccacttcaaggagaccctggccctgcaggagaagcccagcattgagcaggaggccctcttcaagaggcacagcgccctgtgggagaagcccagcacagagaaggagaccatcttcaaggagagcctggacctgcaggagaagcccagcatcaagaaggagaccctgctgaagaagcccctggccctgaagatgagcaccatcaatgaggccgtgctgtttgaggacatgattgccctgaatgagaagcccaccaccgggaaggagctgtccttcaaggagcccctggccctgcaggagagccccacctacaaggaggacaccttcctgaagaccctgctggtgccccaggtgggcaccagccccaacgtgagcagcacagcccctgagagcatcaccagcaagagcagcatcgccaccatgacctctgtgggcaagagcggcaccatcaatgaggccttcctgtttgaggacatgatcaccctgaatgagaagcccaccaccgggaaggagctgtccttcaaggagcccctggccctgcaggagagccccacctgcaaggaggacaccttcctggagaccttcctgatcccccagatcggcaccagcccctacgtgttcagcaccaccccagagagcatcacagagaagagcagcatcgccaccatgacctctgtgggcaagagcaggaccaccacagagagcagcgcctgtgagagcgccagtgacaagcctgtgagcccccaggccaagggcacccccaaggagatcaccccccgggaggacattgatgaggacagcagtgaccccagcttcaaccccatgtatgccaaggagatcttctcctacatgaaggagcgggaggagcagttcatcctgacagactacatgaaccggcagatcgagatcaccagtgacatgagggccatcctggtggactggctggtggaggtgcaggtgtcctttgagatgacccatgagaccctgtacctggccgtgaagctggtggacctgtacctgatgaaggctgtgtgcaagaaggacaagctgcagctgctgggcgccacagccttcatgattgctgccaagtttgaggagcacaacagcccccgggtggatgactttgtgtacatctgtgatgacaactaccagaggtctgaggtgctgtccatggagatcaacatcctgaatgtgctgaagtgtgacatcaacatccccatcgcctaccacttcctgcggcgctatgcccgctgcatccacaccaacatgaagaccctgaccctgagccgctacatctgtgagatgaccctgcaggagtaccactacgtgcaggagaaggccagcaagctggccgccgccagcctgctgctggccctgtacatgaagaagctgggctactgggtgcccttcctggagcactacagcggctacagcatcagcgagctgcaccccctggtgcggcagctgaacaagctgctgaccttcagcagctatgacagcctgaaggctgtgtactacaagtacagccaccctgtgttctttgaggtggccaagatcccagccctggacatgctgaagctggaggagatcctgaactgtgactgtgaggcccagggcctggtgctgtag

SEQ ID NO: 37792 - DNA, 4188 bp, Artificial Sequence; identical to SEQ ID NO: 37791
  Description of Artificial Sequence: Synthetic coding sequence

SEQ ID NO: 37793 - DNA, 4188 bp, Artificial Sequence; identical to SEQ ID NO: 37791
  Description of Artificial Sequence: Synthetic coding sequence

SEQ ID NO: 37794 - DNA, 876 bp, Artificial Sequence; identical to SEQ ID NO: 37790
  Description of Artificial Sequence: Synthetic coding sequence

SEQ ID NO: 37795 - DNA, 4188 bp, Artificial Sequence; identical to SEQ ID NO: 37791
  Description of Artificial Sequence: Synthetic coding sequence

SEQ ID NO: 37796 - DNA, 876 bp, Artificial Sequence; identical to SEQ ID NO: 37790
  Description of Artificial Sequence: Synthetic coding sequence

SEQ ID NO: 37797 - DNA, 876 bp, Artificial Sequence; identical to SEQ ID NO: 37790
  Description of Artificial Sequence: Synthetic coding sequence

SEQ ID NO: 37798 - DNA, 1215 bp, Artificial Sequence
  Description of Artificial Sequence: Synthetic coding sequence
atgagcagaagaagcagccggctgcaggccaagcagcagccccagcccagccagacagagagcccccaggaggcccagatcatccaggccaagaagaggaagaccacccaggatgtgaagaagaggcgggaggaggtgaccaagaagcaccagtatgagatccggaactgctggccccctgtgctgagcggcggcatcagcccctgcatcatcatcgagaccccccacaaggagatcggcaccagtgacttcagccgcttcaccaactaccgcttcaagaacctcttcatcaaccccagccccctgcctgacctgtcctggggctgcagcaaggaggtgtggctgaacatgctgaagaaggagagccgctacgtgcatgacaagcactttgaggtgctgcacagcgacctggagccccagatgaggagcatcctgctggactggctgctggaggtgtgtgaggtgtacaccctgcaccgggagaccttctacctggcccaggacttctttgaccgcttcatgctgacccagaaggacatcaacaagaacatgctgcagctgattggcatcaccagcctcttcatcgccagcaagctggaggagatctatgcccccaagctgcaggagtttgcctacgtgacagatggagcctgcagcgaggaggacatcctgaggatggagctgatcatcctgaaggccctgaagtgggagctgtgccctgtgaccatcatctcctggctgaacctcttcctgcaggtggatgccctgaaggatgcccccaaggtgctgctgccccagtacagccaggagaccttcatccagatcgcccagctgctggacctgtgcatcctggccatcgacagcctggagttccagtaccgcatcctgacagctgctgccctgtgccacttcaccagcattgaggtggtgaagaaggccagcggcctggagtgggacagcatcagtgaatgtgtggactggatggtgccctttgtgaatgtggtgaagagcaccagccctgtgaagctgaagaccttcaagaagatccccatggaggacagacacaacatccagacccacaccaactacctggccatgctggaggaggtgaactacatcaacaccttcaggaagggcggccagctgagccctgtgtgcaatggaggcatcatgaccccacccaagagcacagagaagcccccaggcaagcactag

SEQ ID NO: 37799 - DNA, 1125 bp, Artificial Sequence
  Description of Artificial Sequence: Synthetic coding sequence
atgagcagaagaagcagccggctgcaggccaagcagcagccccagcccagccagacagagagcccccaggaggcccagatcatccaggccaagaagaggaagaccacccaggatgtgaagaagaggcgggaggaggtgaccaagaagcaccagtatgagatccggaactgctggccccctgtgctgagcggcggcatcagcccctgcatcatcatcgagaccccccacaaggagatcggcaccagtgacttcagccgcttcaccaactaccgcttcaagaacctcttcatcaaccccagccccctgcctgacctgtcctggggctgcagcaaggaggtgtggctgaacatgctgaagaaggagagccgctacgtgcatgacaagcactttgaggtgctgcacagcgacctggagccccagatgaggagcatcctgctggactggctgctggaggtgtgtgaggtgtacaccctgcaccgggagaccttctacctggcccaggacttctttgaccgcttcatgctgacccagaaggacatcaacaagaacatgctgcagctgattggcatcaccagcctcttcatcgccagcaagctggaggagatctatgcccccaagctgcaggagtttgcctacgtgacagatggagcctgcagcgaggaggacatcctgaggatggagctgatcatcctgaaggccctgaagtgggagctgtgccctgtgaccatcatctcctggctgaacctcttcctgcaggtggatgccctgaaggatgcccccaaggtgctgctgccccagtacagccaggagaccttcatccagatcgcccagctgctggacctgtgcatcctggccatcgacagcctggagttccagtaccgcatcctgacagctgctgccctgtgccacttcaccagcattgaggtggtgaagaaggccagcggcctggagtgggacagcatcagtgaatgtgtggactggatggtgccctttgtgaatgtggtgaagagcaccagccctgtgaagctgaagaccttcaagaagatccccatggaggacagacacaacatccagacccacaccaactacctggccatgctgtgcatgatcagcagccacgtgtag

SEQ ID NO: 37800 - DNA, 1215 bp, Artificial Sequence; identical to SEQ ID NO: 37798
  Description of Artificial Sequence: Synthetic coding sequence

SEQ ID NO: 37801 - DNA, 891 bp, Artificial Sequence
  Description of Artificial Sequence: Synthetic coding sequence
atgagcaaggaggtgtggctgaacatgctgaagaaggagagccgctacgtgcatgacaagcactttgaggtgctgcacagcgacctggagccccagatgaggagcatcctgctggactggctgctggaggtgtgtgaggtgtacaccctgcaccgggagaccttctacctggcccaggacttctttgaccgcttcatgctgacccagaaggacatcaacaagaacatgctgcagctgattggcatcaccagcctcttcatcgccagcaagctggaggagatctatgcccccaagctgcaggagtttgcctacgtgacagatggagcctgcagcgaggaggacatcctgaggatggagctgatcatcctgaaggccctgaagtgggagctgtgccctgtgaccatcatctcctggctgaacctcttcctgcaggtggatgccctgaaggatgcccccaaggtgctgctgccccagtacagccaggagaccttcatccagatcgcccagctgctggacctgtgcatcctggccatcgacagcctggagttccagtaccgcatcctgacagctgctgccctgtgccacttcaccagcattgaggtggtgaagaaggccagcggcctggagtgggacagcatcagtgaatgtgtggactggatggtgccctttgtgaatgtggtgaagagcaccagccctgtgaagctgaagaccttcaagaagatccccatggaggacagacacaacatccagacccacaccaactacctggccatgctggaggaggtgaactacatcaacaccttcaggaagggcggccagctgagccctgtgtgcaatggaggcatcatgaccccacccaagagcacagagaagcccccaggcaagcactag

SEQ ID NO: 37802 - DNA, 1134 bp, Artificial Sequence
  Description of Artificial Sequence: Synthetic coding sequence
atgaagtttcctggccccctggagaaccagaggctgtccttcctgctggagaaggccatcacccgggaggcccagatgtggaaggtgaatgtgaggaagatgcccagcaaccagaatgtgagccccagccagagagatgaggtgatccagtggctggccaagctgaagtaccagttcaacctgtacccagagacctttgccctggccagcagcctgctggaccgcttcctggccaccgtgaaggcccaccccaagtacctgagctgcatcgccatcagctgcttcttcctggccgccaagacagtggaggaggatgagcgcatccctgtgctgaaggtgctggcccgggacagcttctgtggctgcagcagcagcgagatcctgaggatggagcgcatcatcctggacaagctgaactgggacctgcacacagccacccccctggacttcctgcacatcttccacgccatcgctgtgtccacccggccccagctgctcttcagcctgcccaagctgagccccagccagcacctggccgtgctgaccaagcagctgctgcactgcatggcctgcaaccagctgctgcagttccggggctccatgctggccctggccatggtgtccctggagatggagaagctgatcccagactggctgagcctgaccatcgagctgctgcagaaggcccagatggacagcagccagctgatccactgccgggagctggtggcccaccacctgagcaccctgcagagcagcctgcccctgaacagcgtgtatgtgtaccggcccctgaagcacaccctggtgacctgtgacaagggcgtcttccggctgcaccccagctctgtgcccggccctgacttcagcaaggacaacagcaagccagaggtgcctgtgcggggcacagctgccttctaccaccacctgcctgctgccagcggctgcaagcagaccagcaccaagaggaaggtggaggagatggaggtggatgacttctatgatggcatcaagaggctgtacaatgaagataatgtgtctgaaaatgtgggctctgtgtgtggcacagacctgagccggcaggagggccacgccagcccctgcccccccctgcagcctgtgtctgtgatgtag

SEQ ID NO: 37803 - DNA, 378 bp, Artificial Sequence
  Description of Artificial Sequence: Synthetic coding sequence
atgaagtttcctggccccctggagaaccagaggctgtccttcctgctggagaaggccatcacccgggaggcccagatgtggaaggtgaatgtgaggaagatgcccagcaaccagaatgtgagccccagccagagagatgaggtgatccagtggctggccaagctgaagtaccagttcaacctgtacccagagacctttgccctggccagcagcctgctggaccgcttcctggccaccgtgaaggcccaccccaagtacctgagctgcatcgccatcagctgcttcttcctggccgccaagacagtggaggaggatgagcgcatccctgtgctgaaggtgctggcccgggacagcttctgtggctgcagcagcagctag

SEQ ID NO: 37804 - DNA, 243 bp, Artificial Sequence
  Description of Artificial Sequence: Synthetic coding sequence
atgaagtttcctggccccctggagaaccagaggctgtccttcctgctggagaaggccatcacccgggaggcccagatgtggaaggtgaatgtgaggaagatgcccagcaaccagaatgtgagccccagccagagagatgaggtgatccagtggctggccaagctgaagtaccagttcaacctgtacccagagacctttgccctggccagcagcctgctggaccgcttcctggccaccgtgtag

SEQ ID NO: 37805 - DNA, 1092 bp, Artificial Sequence
  Description of Artificial Sequence: Synthetic coding sequence
atgacccccaggcaccactgtgaggcctacagcagcgctggggaggaggaggaggaggaggaggaggagaagaatgtgagccccagccagagagatgaggtgatccagtggctggccaagctgaagtaccagttcaacctgtacccagagacctttgccctggccagcagcctgctggaccgcttcctggccaccgtgaaggcccaccccaagtacctgagctgcatcgccatcagctgcttcttcctggccgccaagacagtggaggaggatgagcgcatccctgtgctgaaggtgctggcccgggacagcttctgtggctgcagcagcagcgagatcctgaggatggagcgcatcatcctggacaagctgaactgggacctgcacacagccacccccctggacttcctgcacatcttccacgccatcgctgtgtccacccggccccagctgctcttcagcctgcccaagctgagccccagccagcacctggccgtgctgaccaagcagctgctgcactgcatggcctgcaaccagctgctgcagttccggggctccatgctggccctggccatggtgtccctggagatggagaagctgatcccagactggctgagcctgaccatcgagctgctgcagaaggcccagatggacagcagccagctgatccactgccgggagctggtggcccaccacctgagcaccctgcagagcagcctgcccctgaacagcgtgtatgtgtaccggcccctgaagcacaccctggtgacctgtgacaagggcgtcttccggctgcaccccagctctgtgcccggccctgacttcagcaaggacaacagcaagccagaggtgcctgtgcggggcacagctgccttctaccaccacctgcctgctgccagcggctgcaagcagaccagcaccaagaggaaggtggaggagatggaggtggatgacttctatgatggcatcaagaggctgtacaatgaagataatgtgtctgaaaatgtgggctctgtgtgtggcacagacctgagccggcaggagggccacgccagcccctgcccccccctgcagcctgtgtctgtgatgtag

SEQ ID NO: 37806 - DNA, 1110 bp, Artificial Sequence
  Description of Artificial Sequence: Synthetic coding sequence
atggccagcggggcccagctgcccccccagcccagcagcagcgaggtgtctgctgtgcagagccctgggggccggcctggggccggcctggaggagacagccctgggcgtgcccctgccccccagccctggagaggcccccctgcccaggagcaacagaagccgctgccccggcacccggcagcccggggccgccagcctgcatgctgccagcgctgctgtgcctgtgcggccccggcggggcacagccccagctgggaagacagcagatgctgtgcctgctgctgcccctgagcaggcccccaggcctgccccccagagcaggaagcccaggaacctggagggggacctggatgagcggcggctgctgtgccacctgcagctggcccaggaccgggaggcccggctgtggaggggcggcaagccccaggatgagatctgtgatgcctttgaggaggtggtgctgtggctgctgcggctgcagaacaccttctacttcagccagagcaccttcaacctggccctgaccatcttcggccgcctgctgatctctgtgaaggtgaaggagaagtacctgcactgtgccaccatcaccagcctgcggctggccgccaaggtgaatgaggaggaggagttcatcccccaggtgaaggacttcaccaagcactacggcagtgactacagccccaatgagctgctgaggatggagctggccatcctggaccggctgcactgggacctgtacatcggcacccccctggacttcctgaccatcttccacgccctggtggtgctgtcctggccccacgtgctggagctgctgccccagaggaaccccagcctgcacgtggccagcctgacccggcagctgcagcactgcatggccggccaccagctgctgcagttcaagggcagcaccctggccctggtgatcatcaccctggagctggagcggctgatgcctggctggtgtgcccccatcagtgacctgctgaagaaggcccaggtgggggacatgcagtacagctgctgcaaggagctggtgatgcagcagctgcggagcctgcagagcagcagctgcacagacaactttgtgtccccagccaactag

SEQ ID NO: 37807 - DNA, 993 bp, Artificial Sequence
  Description of Artificial Sequence: Synthetic coding sequence
atggatggccccatgaggcccaggtctgccagcctggtggacttccagtttggagtggtggccacagagaccattgaagatgccctgctgcacctggcccagcagaatgagcaggccgtgcgggaggccagcggccgcctgggccgcttccgggagccccagatcgtggagtttgtgttcctgctgtctgagcagtggtgcctggagaagtctgtgtcctaccaggccgtggagatcctggagcgcttcatggtgaagcaggccgagaacatctgccggcaggccaccatccagccccgggacaacaagcgggagagccagaactggagggccctgaagcagcagctggtgaacaagttcaccctgcggctggtgtcctgtgtgcagctggccagcaagctgtccttcaggaacaagatcatcagcaacatcaccgtgctgaacttcctgcaggccctgggctacctgcacaccaaggaggagctgctggagagcgagctggatgtgctgaagagcctgaacttccgcatcaacctgcccacccccctggcctacgtggagaccctgctggaggtgctgggctacaacggctgcctggtgcctgccatgaggctgcacgccacctgcctgaccctgctggacctggtgtacctgctgcacgagcccatctatgagagcctgctgcgggccagcattgagaacagcacccccagccagctgcagggcgagaagttcacctctgtgaaggaggacttcatgctgctggccgtgggcatcatcgccgccagcgccttcatccagaaccacgagtgctggagccaggtggtgggccacctgcagagcatcactggaattgccctggccagcattgctgagttctcctatgccatcctgacccacggcgtgggcgccaacaccccaggccggcagcagagcatccccccccacctggccgcccgggccctgaagacagtggccagcagcaacacctag

SEQ ID NO: 37808 - DNA, 993 bp, Artificial Sequence; identical to SEQ ID NO: 37807
  Description of Artificial Sequence: Synthetic coding sequence

SEQ ID NO: 37809 - DNA, 924 bp, Artificial Sequence
  Description of Artificial Sequence: Synthetic coding sequence
atgctggtgcggggccgggaccagggcagcggcagccggctgggccccatcgtgcggcgctgggccccccggcccagccccctgcagagcctggccgccagcctggatgctgagcccagcagcgctgctgtgcctgatggcttccctgctggccccaccgtgagcccccggcggctggcccggcccccaggcctggaggaggccctgagcgccctgggcctgcagggcgagcgggagtatgctggggacatctttgctgaggtgatggtgtgccgggtgctgcccctgcgggccctgcccagggctgtgaccccagagatgagggccctggtggtggactggctggtgcaggtgcatgagtacctgggcctggccggggacaccctgtacctggccgtgcacctgctggacagctacctgtctgctggccgggtgcggctgcaccggctgcagctgctgggcgtggcctgcctgtttgtggcctgcaagatggaggagtgtgtgctgcctgagcccgccttcctgtgcctgctgtctgctgacagcttcagcagagctgagctgctgcgggcagagcggcgcatcctgagccggctggacttccggctgcaccaccctggccccctgctgtgcctgggcctgctggccgccctggccggcagcagcccccaggtgatgctgctggccacctacttcctggagctgagcctgctggaggccgaggccgccggctgggagcctggaagaagagctgctgctgccctgagcctggcccaccggctgctggatggagctggcagccggctgcagcctgagctgtaccgctgcagcctgggcggcggctctgtgtggggccacaggagcttccgggacctgcccagctggagcttcctgcggagcaggaggatgagggacaactactag

SEQ ID NO: 37810 - DNA, 468 bp, Artificial Sequence
  Description of Artificial Sequence: Synthetic coding sequence
atgctggtgcggggccgggaccagggcagcggcagccggctgggccccatcgtgcggcgctgggccccccggcccagccccctgcagagcctggccgccagcctggatgctgagcccagcagcgctgctgtgcctgatggcttccctgctggccccaccgtgagcccccggcggctggcccggcccccaggcctggaggaggccctgagcgccctgggcctgcagggcgagcgggagtatgctggggacatctttgctgaggtgatggagtacctgggcctggccggggacaccctgtacctggccgtgcacctgctggacagctacctgtctgctggccgggtgcggctgcaccggctgcagctgctgggcgtggcctgcctgtttgtggcctgcaagatggaggagtgtgtgctgcctgaggagacagaggtgaggaacctgggccccttccagggccgggagtag

SEQ ID NO: 37811 - DNA, 1080 bp, Artificial Sequence
  Description of Artificial Sequence: Synthetic coding sequence
atgggcaacaccctgacctgctgcgtgagccccaatgccagccccaagctgggcagaagagctggcagcgctgagctgtactgtgccagtgacatctatgaagctgtgtctggagatgctgtggccgtggccccagctgtggtggagcctgctgagctggactttggagagggggagggccaccacctgcagcacatcagtgaccgggagatgcctgaggacctggccctggagagcaaccccagcgaccacccccgggccagcaccatcttcctgagcaagagccagacagatgtgcgggagaagaggaagagcaaccacctgaaccacgtgtccccaggccagctgaccaagaagtacagcagctgcagcaccatcttcctggatgacagcacagtgtcccagcccaacctgcggaccaccgtgaagtgtgtgaccctggccatctactaccacatcaagaacagagatgccaacagaagcctggacatctttgatgagaggagccaccccctgacccgggagaaggtgcctgaggagtacttcaagcatgaccctgagcacaagttcatctacagatttgtgaggaccctcttctctgctgcccagctgacagcagaatgtgccatcgtgaccctggtgtacctggagcggctgctgacctatgcagaaattgacatctgccccaccaactggaagagaattgtgctgggcgccatcctgctggccagcaaggtgtgggatgaccaggccgtgtggaatgtggactactgccagatcctgaaggacatcaccgtggaggacatgaatgagatggagcggcacttcctggagctgctgcagttcaacatcaacgtgcctgcctctgtgtatgccaagtactactttgacctgcggagcctggctgatgacaacaacctgaacttcctgtttgcccccctgagcaaggagcgggcccagaacctggaggccatcagccggctgtgtgaggacaaggacctgtgcagagctgccatgaggaggagcttctctgctgacaacttcatcggcatccagaggagcaaggccatcctgtcctag

SEQ ID NO: 37812 - DNA, 927 bp, Artificial Sequence
  Description of Artificial Sequence: Synthetic coding sequence
atgggcaacaccctgacctgctgcgtgagccccaatgccagccccaagctgggcagaagagctggcagcgctgagctgtactgtgccagtgacatctatgaagctgtgtctggagatgctgtggccgtggccccagctgtggtggagcctgctgagctggactttggagagggggagggccaccacctgcagcacatcagtgaccgggagatgcctgaggacctggccctggagagcaaccccagcgaccacccccgggccagcaccatcttcctgagcaagagccagacagatgtgcgggagaagaggaagagcaaccacctgaaccactgtgacctgagcaacatcctgccccacaaggagcagcgggagaaggtgcctgaggagtacttcaagcatgaccctgagcacaagttcatctacagatttgtgaggaccctcttctctgctgcccagctgacagcagaatgtgccatcgtgaccctggtgtacctggagcggctgctgacctacgccgagattgacatctgccccaccaactggaagagaattgtgctgggcgccatcctgctggccagcaaggtgtgggatgaccaggccgtgtggaatgtggactactgccagatcctgaaggacatcaccgtggaggacatgaatgagatggagcggcacttcctggagctgctgcagttcaacatcaacgtgcctgcctctgtgtatgccaagtactactttgacctgcggagcctggctgatgacaacaacctgaacttcctgtttgcccccctgagcaaggagcgggcccagaacctggaggccatcagccggctgtgtgaggacaaggacctgtgccgggccgccatgagaagaagcttctctgctgacaacttcatcggcatccagaggagcaaggccatcctgtcctag

SEQ ID NO: 37813 - DNA, 870 bp, Artificial Sequence
  Description of Artificial Sequence: Synthetic coding sequence
atgcctgaggacctggccctggagagcaaccccagcgaccacccccgggccagcaccatcttcctgagcaagagccagacagatgtgcgggagaagaggaagagcaaccacctgaaccacgtgtccccaggccagctgaccaagaagtacagcagctgcagcaccatcttcctggatgacagcacagtgtcccagcccaacctgcggaccaccgtgaagtgtgtgaccctggccatctactaccacatcaagaacagagatgccaacagaagcctggacatctttgatgagaggagccaccccctgacccgggagaaggtgcctgaggagtacttcaagcatgaccctgagcacaagttcatctacagatttgtgaggaccctcttctctgctgcccagctgacagcagaatgtgccatcgtgaccctggtgtacctggagcggctgctgacctatgcagaaattgacatctgccccaccaactggaagagaattgtgctgggcgccatcctgctggccagcaaggtgtgggatgaccaggccgtgtggaatgtggactactgccagatcctgaaggacatcaccgtggaggacatgaatgagatggagcggcacttcctggagctgctgcagttcaacatcaacgtgcctgcctctgtgtatgccaagtactactttgacctgcggagcctggctgatgacaacaacctgaacttcctgtttgcccccctgagcaaggagcgggcccagaacctggaggccatcagccggctgtgtgaggacaaggacctgtgcagagctgccatgaggaggagcttctctgctgacaacttcatcggcatccagaggagcaaggccatcctgtcctag

SEQ ID NO: 37814 - DNA, 1086 bp, Artificial Sequence
  Description of Artificial Sequence: Synthetic coding sequence
atgggcaacatcctgacctgctgcgtgtgcccccgggccagccctggcctgcaccagcaccagggcctggtgtgccactgtgagagcgagatctatgaggccgccgccggggacctgattgctggggtgcctgtggccgctgctgtggagcctggagaggtgacctttgtggccggggagggcctgcacatgcaccacatctgtgagcgggagatgcctgaggacatccccctggagcccaaccccagcgaccaccccaaggccagcaccatcttcctgaggaagagccagacagatgtgcaggagaagaagaagaagcagctgtgcaaggtgtccacagagcacttcacccagcagtacagcagctgcagcaccatcttcctggatgacagcatcgccagccagccccacctgaccatgaccctgaagagctgtgacctgggcaccatcctgagctaccaggccaagagagatgcccacaggagcctgggcatctttgatgagcagctgcaccccctgactgtgaggaaggaggtgctggaggagtacttcaagtatgaccctgagcacaagctgatcttccgctttgtgaggaccctcttcaaggccatgaggctgacagctgagtttgccatcgtgtccctcatctacatcgagcggctggtgtcctatgctgacatcgacatctgccccaccaactggaagagaattgtgctgggcgccatcctgctggccagcaaggtgtggagcgacatggctgtgtggaatgaagactactgcaagctgttcaagaacatcaccgtggaggagatgaatgagctggagcggcagttcctgaagctgatcaactacaacaacagcatcaccaacagcgtgtacagccgcttctactttgacctgcggaccctggcccacaacaacggcctgtacagccctgtgtacctgctggaccgggagcgggcctggaagctggaggccttcagcaggatggagcaggacaaggtgttctacagcgctgccaagaatggcagcctgtctgcagatgacctgatccacctgcagagggccaaggccatcctcttctag

SEQ ID NO: 37815 - DNA, 864 bp, Artificial Sequence
  Description of Artificial Sequence: Synthetic coding sequence
tgaatccccctggagcccaaccccagcgaccaccccaaggccagcaccatcttcctgaggaagagccagacagatgtgcaggagaagaagaagaagcagctgtgcaaggtgtccacagagcacttcacccagcagtacagcagctgcagcaccatcttcctggatgacagcatcgccagccagccccacctgaccatgaccctgaagagctgtgacctgggcaccatcctgagctaccaggccaagagagatgcccacaggagcctgggcatctttgatgagcagctgcaccccctgactgtgaggaaggaggtgctggaggagtacttcaagtatgaccctgagcacaagctgatcttccgctttgtgaggaccctcttcaaggccatgaggctgacagctgagtttgccatcgtgtccctcatctacatcgagcggctggtgtcctatgctgacatcgacatctgccccaccaactggaagagaattgtgctgggcgccatcctgctggccagcaaggtgtggagcgacatggctgtgtggaatgaagactactgcaagctgttcaagaacatcaccgtggaggagatgaatgagctggagcggcagttcctgaagctgatcaactacaacaacagcatcaccaacagcgtgtacagccgcttctactttgacctgcggaccctggcccacaacaacggcctgtacagccctgtgtacctgctggaccgggagcgggcctggaagctggaggccttcagcaggatggagcaggacaaggtgttctacagcgctgccaagaatggcagcctgtctgcagatgacctgatccacctgcagagggccaaggccatcctcttctag

SEQ ID NO: 37816 - DNA, 1032 bp, Artificial Sequence
  Description of Artificial Sequence: Synthetic coding sequence
agctgtgtggtgatccagatccccccctggcacctggacagaaaatatggcagctgcagcaccatcctgctggacaacagcacagccagccagcctgacctgcggcacaccctggagagatatgccaacagaagcctggccatctttgaggagcctgtgcaccccctgccccaggagaagctgcccgggaagagcttcaagcatgaccccaagaggaactgcatcttccgccacttctgcaccctcttccaggtgatcaagctgacagccccctgtgccatcgtggccctggtgtacatcaagaggctgctgaccagcgccaacatcgacctgtgccccaccaactggaagaagatcgtgctgggcaccatgctgctggccagcaaggtgtggaggaaccacggcctgtggagcgtggatgacagccagaacagcaaggacacagctgtggagaacatgagcaagatggagaagtgcttcctggagctgctggagttcaacatccacgtgtctgcctctgtgtatgccaagtactactttgacctgtgtgccctggccaatgaccatgacctgtacttcctgttctccttcctgcacaaggacaaggcccagaagctggagggccacaccagccagcacagcctgagcctgggcccctgccgggtgggcatggagaactatgccacctacagccccctgagcagccagcctgtgctgggcgccctgagcctggccgaggtgctgccccaggagatcaagcaggagatccaccaggtgctgatggaccatggagtgccctgccactacacctgcttcctgctgcaccctgaggacagcaccctggagcgcttcctggtgctgcacagcatccagggcctgcaggaggacagcgtgctgtgcaaggtggagatccacggcctgagcccccagccccagacctaccagagccacttccgcagccccagcctggccgagctgctgaaccgcatcagcggcacctgcaggaaccactttgctggcatgcagaagtag

SEQ ID NO: 37817 - DNA, 1155 bp, Artificial Sequence
  Description of Artificial Sequence: Synthetic coding sequence
atgaccagcttccacccccggggcctgcaggccgcccgggcccagaagttcaagagcaagaggcccaggagcaacagcgactgcttccaggaggaggacctgcggcagggcttccagtggaggaagagcctgccctttggagctgccagcagctacctgaacctggagaagctgggggagggcagctatgccaccgtgtacaagggcatcagccgcatcaatggccagctggtggccctgaaggtgatctccatgaatgctgaggagggcgtgcccttcaccgccatccgggaggccagcctgctgaagggcctgaagcacgccaacatcgtgctgctgcatgacatcatccacaccaaggagaccctgacctttgtgtttgagtacatgcacacagacctggcccagtacatgagccagcaccctgggggcctgcacccccacaacgtgcggctcttcatgttccagctgctgcggggcctggcctacatccaccaccagcacgtgctgcaccgggacctgaagccccagaacctgctgatcagccacctgggggagctgaagctggccgactttggcctggcccgggccaagagcatccccagccagacctacagcagcgaggtggtgaccctgtggtaccggcccccagatgccctgctgggcgccacagagtacagcagcgagctggacatctggggcgccggctgcatcttcatcgagatgttccagggccagcccctcttccctggggtgagcaacatcctggagcagctggagaagatctgggaggtgctgggcgtgcccacagaggacacctggccaggagtgtccaagctgcccaactacaaccctgagtggttccccctgcccacccccaggagcctgcacgtggtgtggaaccggctgggccgggtgcctgaggccgaggacctggccagccagatgctgaagggcttcccccgggacagagtgtctgcccaggaggccctggtgcatgactacttcagcgccctgcccagccagctgtaccagctgcctgatgaggagagcctcttcaccgtgtctggagtgcggctgaagccagagatgtgtgacctgctggccagctaccagaagggccaccacccagcccagttcagcaagtgctggtag

SEQ ID NO: 37818 - DNA, 1308 bp, Artificial Sequence
  Description of Artificial Sequence: Synthetic coding sequence
atgggccaggagctgtgtgccaagacagtgcagcccggctgcagctgctaccactgcagcgagggcggggaggcccacagctgcagaagaagccagcctgagaccacagaggccgccttcaagctgacagacctgaaggaggccagctgcagcatgaccagcttccacccccggggcctgcaggccgcccgggcccagaagttcaagagcaagaggcccaggagcaacagcgactgcttccaggaggaggacctgcggcagggcttccagtggaggaagagcctgccctttggagctgccagcagctacctgaacctggagaagctgggggagggcagctatgccaccgtgtacaagggcatcagccgcatcaatggccagctggtggccctgaaggtgatctccatgaatgctgaggagggcgtgcccttcaccgccatccgggaggccagcctgctgaagggcctgaagcacgccaacatcgtgctgctgcatgacatcatccacaccaaggagaccctgacctttgtgtttgagtacatgcacacagacctggcccagtacatgagccagcaccctgggggcctgcacccccacaacgtgcggctcttcatgttccagctgctgcggggcctggcctacatccaccaccagcacgtgctgcaccgggacctgaagccccagaacctgctgatcagccacctgggggagctgaagctggccgactttggcctggcccgggccaagagcatccccagccagacctacagcagcgaggtggtgaccctgtggtacagacctccagatgccctgctgggcgccacagagtacagcagcgagctggacatctggggcgccggctgcatcttcatcgagatgttccagggccagcccctcttccctggggtgagcaacatcctggagcagctggagaagatctgggaggtgctgggcgtgcccacagaggacacctggccaggagtgtccaagctgcccaactacaaccctgagtggttccccctgcccacccccaggagcctgcacgtggtgtggaaccggctgggccgggtgcctgaggccgaggacctggccagccagatgctgaagggcttcccccgggacagagtgtctgcccaggaggccctggtgcatgactacttcagcgccctgcccagccagctgtaccagctgcctgatgaggagagcctcttcaccgtgtctggagtgcggctgaagccagagatgtgtgacctgctggccagctaccagaagggccaccacccagcccagttcagcaagtgctggtag

SEQ ID NO: 37819 - DNA, 1155 bp, Artificial Sequence; identical to SEQ ID NO: 37817
  Description of Artificial Sequence: Synthetic coding sequence

SEQ ID NO: 37820 - DNA, 1203 bp, Artificial Sequence
  Description of Artificial Sequence: Synthetic coding sequence
atgggccaggagctgtgtgccaagacagtgcagcccggctgcagctgctaccactgcagcgagggcggggaggcccacagctgcagaagaagccagcctgagaccacagaggccgccttcaagctgacagacctgaaggaggccagctgcagcatgaccagcttccacccccggggcctgcaggccgcccgggcccagaagttcaagagcaagaggcccaggagcaacagcgactgcttccaggaggaggacctgcggcagggcttccagtggaggaagagcctgccctttggagctgccagcagctacctgaacctggagaagctgggggagggcagctatgccaccgtgtacaagggcatcagccgcatcaatggccagctggtggccctgaaggtgatctccatgaatgctgaggagggcgtgcccttcaccgccatccgggaggccagcctgctgaagggcctgaagcacgccaacatcgtgctgctgcatgacatcatccacaccaaggagaccctgacctttgtgtttgagtacatgcacacagacctggcccagtacatgagccagcaccctgggggcctgcacccccacaacgtgcggctcttcatgttccagctgctgcggggcctggcctacatccaccaccagcacgtgctgcaccgggacctgaagccccagaacctgctgatcagccacctgggggagctgaagctggccgactttggcctggcccgggccaagagcatccccagccagacctacagcagcgaggtggtgaccctgtggtacagacctccagatgccctgctgggcgccacagagtacagcagcgagctggacatctggggcgccggctgcatcttcatcgagatgttccagggccagcccctcttccctggggtgagcaacatcctggagcagctggagaagatctgggaggtgctgggcgtgcccacagaggacacctggccaggagtgtccaagctgcccaactacaaccctgagtggttccccctgcccacccccaggagcctgcacgtggtgtggaaccggctgggccgggtgcctgaggccgaggacctggccagccagatgctgaagggcttcccccgggacagagtgtctgcccaggaggccctggtgcatgactacttcagcgccctgcccagccagctgtaccagctgcctgatgaatag

SEQ ID NO: 37821 - DNA, 1290 bp, Artificial Sequence
  Description of Artificial Sequence: Synthetic coding sequence
atgggccaggagctgtgtgccaagacagtgcagcccggctgcagctgctaccactgcagcgagggcggggaggcccacagctgcagaagaagccagcctgagaccacagaggccgccttcaagctgacagacctgaaggaggccagctgcagcatgaccagcttccacccccggggcctgcaggccgcccgggcccagaagttcaagagcaagaggcccaggagcaacagcgactgcttccaggaggaggacctgcggcagggcttccagtggaggaagagcctgccctttggagctgccagcagctacctgaacctggagaagctgggggagggcagctatgccaccgtgtacaagggcatcagccgcatcaatggccagctggtggccctgaaggtgatctccatgaatgctgaggagggcgtgcccttcaccgccatccgggaggccagcctgctgaagggcctgaagcacgccaacatcgtgctgctgcatgacatcatccacaccaaggagaccctgacctttgtgtttgagtacatgcacacagacctggcccagtacatgagccagcaccctgggggcctgcacccccacaacgtgcggctcttcatgttccagctgctgcggggcctggcctacatccaccaccagcacgtgctgcaccgggacctgaagccccagaacctgctgatcagccacctgggggagctgaagctggccgactttggcctggcccgggccaagagcatccccagccagacctacagcagcgaggtggtgaccctgtggtacagacctccagatgccctgctgggcgccacagagtacagcagcgagctggacatctggggcgccggctgcatcttcatcgagatgttccagggccagcccctcttccctggggtgagcaacatcctggagcagctggagaagatctgggaggtgctgggcgtgcccacagaggacacctggccaggagtgtccaagctgcccaactacaaccctgagtggttccccctgcccacccccaggagcctgcacgtggtgtggaaccggctgggccgggtgcctgaggccgaggacctggccagccagatgctgaagggcttcccccgggacagagtgtctgcccaggaggccctggtgcatgactacttcagcgccctgcccagccagctgtaccagctgcctgatgtgtctggagtgcggctgaagccagagatgtgtgacctgctggccagctaccagaagggccaccacccagcccagttcagcaagtgctggtag

SEQ ID NO: 37822 - DNA, 1713 bp, Artificial Sequence
  Description of Artificial Sequence: Synthetic coding sequence
atgcccctgtatggccgggcccgggaccacgtgacccaccccagcatcctgggcaccaggcctggccggcccatggccggccccatcacagctgctgtgcctgagaagatctgcaatggagccttctgcagctgcagcggggccttccccctggaccccaacaaccccagcctgggccccctgcccagcatcagccacctgaacctgcggacccagatcgccatggacaggatgaagaagatcaagaggcagctgtccatgaccctgcggggcggccggggcatcgacaagaccaatggagcccctgagcagatcggcctggatgagagcggcggcggcggcggcagtgaccccggggaggcccccaccagggctgcccctggagagctgcggagcgcccggggccccctgagcagcgcccctgagatcgtgcatgaggacctgaagatgggcagtgatggagagagtgaccaggccagcgccaccagcagtgatgaggtgcagagccctgtgcgggtgaggatgaggaaccacccccccaggaagatcagcacagaggacatcaacaagaggctgagcctgcctgctgacatccggctgcctgagggctacctggagaagctgaccctgaacagccccatctttgacaagcccctgagccggcggctgcggcgggtgtccctgtctgaaattggatttgggaagctggagacctacatcaagctggacaagctgggggagggcacctacgccaccgtgtacaagggcaagagcaagctgacagacaacctggtggccctgaaggagatccggctggagcacgaggagggcgccccctgcacagccatccgggaggtgtccctgctgaaggacctgaagcacgccaacatcgtgaccctgcatgacatcatccacacagagaagagcctgaccctggtgtttgagtacctggacaaggacctgaagcagtacctggatgactgtggcaacatcatcaacatgcacaacgtgaagctgttcctgttccagctgctgcggggcctggcctactgccaccggcagaaggtgctgcaccgggacctgaagccccagaacctgctgatcaatgaaagaggagagctgaagctggccgactttggcctggcccgggccaagagcatccccaccaagacctacagcaatgaggtggtgaccctgtggtacagacctccagacatcctgctgggcagcacagactacagcacccagattgacatgtggggcgtgggctgcatcttctatgagatggccaccggccggcccctcttccctggcagcacagtggaggagcagctgcacttcatcttccgcatcctgggcacccccacagaggagacctggccaggcatcctgagcaatgaggagttcaagacctacaactaccccaagtacagagctgaggccctgctgagccacgccccccggctggacagtgatggagctgacctgctgaccaagctgctgcagtttgagggcaggaaccgcatctctgcagaagatgccatgaagcaccccttcttcctgagcctgggggagcgcatccacaagctgcctgacaccaccagcatctttgccctgaaggagatccagctgcagaaggaggccagcctgcggagcagctccatgccagacagcggccgcccagccttccgggtggtggacacagagttctag

SEQ ID NO: 37823 - DNA, 1491 bp, Artificial Sequence
  Description of Artificial Sequence: Synthetic coding sequence
atggacaggatgaagaagatcaagaggcagctgtccatgaccctgcggggcggccggggcatcgacaagaccaatggagcccctgagcagatcggcctggatgagagcggcggcggcggcggcagtgaccccggggaggcccccaccagggctgcccctggagagctgcggagcgcccggggccccctgagcagcgcccctgagatcgtgcatgaggacctgaagatgggcagtgatggagagagtgaccaggccagcgccaccagcagtgatgaggtgcagagccctgtgcgggtgaggatgaggaaccacccccccaggaagatcagcacagaggacatcaacaagaggctgagcctgcctgctgacatccggctgcctgagggctacctggagaagctgaccctgaacagccccatctttgacaagcccctgagccggcggctgcggcgggtgtccctgtctgaaattggatttgggaagctggagacctacatcaagctggacaagctgggggagggcacctacgccaccgtgtacaagggcaagagcaagctgacagacaacctggtggccctgaaggagatccggctggagcacgaggagggcgccccctgcacagccatccgggaggtgtccctgctgaaggacctgaagcacgccaacatcgtgaccctgcatgacatcatccacacagagaagagcctgaccctggtgtttgagtacctggacaaggacctgaagcagtacctggatgactgtggcaacatcatcaacatgcacaacgtgaagctgttcctgttccagctgctgcggggcctggcctactgccaccggcagaaggtgctgcaccgggacctgaagccccagaacctgctgatcaatgaaagaggagagctgaagctggccgactttggcctggcccgggccaagagcatccccaccaagacctacagcaatgaggtggtgaccctgtggtacagacctccagacatcctgctgggcagcacagactacagcacccagattgacatgtggggcgtgggctgcatcttctatgagatggccaccggccggcccctcttccctggcagcacagtggaggagcagctgcacttcatcttccgcatcctgggcacccccacagaggagacctggccaggcatcctgagcaatgaggagttcaagacctacaactaccccaagtacagagctgaggccctgctgagccacgccccccggctggacagtgatggagctgacctgctgaccaagctgctgcagtttgagggcaggaaccgcatctctgcagaagatgccatgaagcaccccttcttcctgagcctgggggagcgcatccacaagctgcctgacaccaccagcatctttgccctgaaggagatccagctgcagaaggaggccagcctgcggagcagctccatgccagacagcggccgcccagccttccgggtggtggacacagagttctag

SEQ ID NO: 37824 - DNA, 1509 bp, Artificial Sequence
  Description of Artificial Sequence: Synthetic coding sequence
atgcagagcgagatcgccatggacaggatgaagaagatcaagaggcagctgtccatgaccctgcggggcggccggggcatcgacaagaccaatggagcccctgagcagatcggcctggatgagagcggcggcggcggcggcagtgaccccggggaggcccccaccagggctgcccctggagagctgcggagcgcccggggccccctgagcagcgcccctgagatcgtgcatgaggacctgaagatgggcagtgatggagagagtgaccaggccagcgccaccagcagtgatgaggtgcagagccctgtgcgggtgaggatgaggaaccacccccccaggaagatcagcacagaggacatcaacaagaggctgagcctgcctgctgacatccggctgcctgagggctacctggagaagctgaccctgaacagccccatctttgacaagcccctgagccggcggctgcggcgggtgtccctgtctgaaattggatttgggaagctggagacctacatcaagctggacaagctgggggagggcacctacgccaccgtgtacaagggcaagagcaagctgacagacaacctggtggccctgaaggagatccggctggagcacgaggagggcgccccctgcacagccatccgggaggtgtccctgctgaaggacctgaagcacgccaacatcgtgaccctgcatgacatcatccacacagagaagagcctgaccctggtgtttgagtacctggacaaggacctgaagcagtacctggatgactgtggcaacatcatcaacatgcacaacgtgaagctgttcctgttccagctgctgcggggcctggcctactgccaccggcagaaggtgctgcaccgggacctgaagccccagaacctgctgatcaatgaaagaggagagctgaagctggccgactttggcctggcccgggccaagagcatccccaccaagacctacagcaatgaggtggtgaccctgtggtacagacctccagacatcctgctgggcagcacagactacagcacccagattgacatgtggggcgtgggctgcatcttctatgagatggccaccggccggcccctcttccctggcagcacagtggaggagcagctgcacttcatcttccgcatcctgggcacccccacagaggagacctggccaggcatcctgagcaatgaggagttcaagacctacaactaccccaagtacagagctgaggccctgctgagccacgccccccggctggacagtgatggagctgacctgctgaccaagctgctgcagtttgagggcaggaaccgcatctctgcagaagatgccatgaagcaccccttcttcctgagcctgggggagcgcatccacaagctgcctgacaccaccagcatctttgccctgaaggagatccagctgcagaaggaggccagcctgcggagcagctccatgccagacagcggccgcccagccttccgggtggtggacacagagttctag

SEQ ID NO: 37825 - DNA, 1491 bp, Artificial Sequence; identical to SEQ ID NO: 37823
  Description of Artificial Sequence: Synthetic coding sequence

SEQ ID NO: 37826 - DNA, 570 bp, Artificial Sequence
  Description of Artificial Sequence: Synthetic coding sequence
atggacaggatgaagaagatcaagaggcagctgtccatgaccctgcggggcggccggggcatcgacaagaccaatggagcccctgagcagatcggcctggatgagagcggcggcggcggcggcagtgaccccggggaggcccccaccagggctgcccctggagagctgcggagcgcccggggccccctgagcagcgcccctgagatcgtgcatgaggacctgaagatgggcagtgatggagagagtgaccaggccagcgccaccagcagtgatgaggtgcagagccctgtgcgggtgaggatgaggaaccacccccccaggaagatcagcacagaggacatcaacaagaggctgagcctgcctgctgacatccggctgcctgagggctacctggagaagctgaccctgaacagccccatctttgacaagcccctgagccggcggctgcggcgggtgtccctgtctgaaattggatttgggaagctggagacctacatcaagctggacaagctgggggagggcacctacgccaccgtgtacaagggcaagagcaagctgacagacaactag

SEQ ID NO: 37827 - DNA, 453 bp, Artificial Sequence
  Description of Artificial Sequence: Synthetic coding sequence
atggacaggatgaagaagatcaagaggcagctgtccatgaccctgcggggcggccggggcatcgacaagaccaatggagcccctgagcagatcggcctggatgagagcggcggcggcggcggcagtgaccccggggaggcccccaccagggctgcccctggagagctgcggagcgcccggggccccctgagcagcgcccctgagatcgtgcatgaggacctgaagatgggcagtgatggagagagtgaccaggccagcgccaccagcagtgatgaggtgcagagccctgtgcgggtgaggatgaggaaccacccccccaggaagatcagcacagaggacatcaacaagaggctgagcctgcctgctgacatccggctgcctgagggctacctggagaagctgaccctgaacagccccatctttgacaagcccctgagccggcggctgaggtag

SEQ ID NO: 37828 - DNA, 462 bp, Artificial Sequence
  Description of Artificial Sequence: Synthetic coding sequence
atggacaggatgaagaagatcaagaggcagctgtccatgaccctgcggggcggccggggcatcgacaagaccaatggagcccctgagcagatcggcctggatgagagcggcggcggcggcggcagtgaccccggggaggcccccaccagggctgcccctggagagctgcggagcgcccggggccccctgagcagcgcccctgagatcgtgcatgaggacctgaagatgggcagtgatggagagagtgaccaggccagcgccaccagcagtgatgaggtgcagagccctgtgcgggtgaggatgaggaaccacccccccaggaagatcagcacagaggacatcaacaagaggctgagcctgcctgctgacatccggctgcctgagggctacctggagaagctgaccctgaacagccccatctttgacaagcccctgagccggcggctgcggcgggtgtcctag

SEQ ID NO: 37829 - DNA, 174 bp, Artificial Sequence
  Description of Artificial Sequence: Synthetic coding sequence
atggacaggatgaagaagatcaagaggcagctgtccatgaccctgcggggcggccggggcatcgacaagaccaatggagcccctgagcagatcggcctggatgagagcggcggcggcggcggcagtgaccccggggaggcccccaccagggctgcccctggagagctgaggtag

SEQ ID NO: 37830 - DNA, 1347 bp, Artificial Sequence
  Description of Artificial Sequence: Synthetic coding sequence
atggacaggatgaagaagatcaagaggcagctgtccatgaccctgcggagcgcccctgagatcgtgcatgaggacctgaagatgggcagtgatggagagagtgaccaggccagcgccaccagcagtgatgaggtgcagagccctgtgcgggtgaggatgaggaaccacccccccaggaagatcagcacagaggacatcaacaagaggctgagcctgcctgctgacatccggctgcctgagggctacctggagaagctgaccctgaacagccccatctttgacaagcccctgagccggcggctgcggcgggtgtccctgtctgaaattggatttgggaagctggagacctacatcaagctggacaagctgggggagggcacctacgccaccgtgtacaagggcaagagcaagctgacagacaacctggtggccctgaaggagatccggctggagcacgaggagggcgccccctgcacagccatccgggaggtgtccctgctgaaggacctgaagcacgccaacatcgtgaccctgcatgacatcatccacacagagaagagcctgaccctggtgtttgagtacctggacaaggacctgaagcagtacctggatgactgtggcaacatcatcaacatgcacaacgtgaagctgttcctgttccagctgctgcggggcctggcctactgccaccggcagaaggtgctgcaccgggacctgaagccccagaacctgctgatcaatgaaagaggagagctgaagctggccgactttggcctggcccgggccaagagcatccccaccaagacctacagcaatgaggtggtgaccctgtggtacagacctccagacatcctgctgggcagcacagactacagcacccagattgacatgtggggcgtgggctgcatcttctatgagatggccaccggccggcccctcttccctggcagcacagtggaggagcagctgcacttcatcttccgcatcctgggcacccccacagaggagacctggccaggcatcctgagcaatgaggagttcaagacctacaactaccccaagtacagagctgaggccctgctgagccacgccccccggctggacagtgatggagctgacctgctgaccaagctgctgcagtttgagggcaggaaccgcatctctgcagaagatgccatgaagcaccccttcttcctgagcctgggggagcgcatccacaagctgcctgacaccaccagcatctttgccctgaaggagatccagctgcagaaggaggccagcctgcggagcagctccatgccagacagcggccgcccagccttccgggtggtggacacagagttctag

SEQ ID NO: 37831 - DNA, 1806 bp, Artificial Sequence
  Description of Artificial Sequence: Synthetic coding sequence
atgagaggagcccggcgggcccggcggctgggccgctggctgtttggacctggcatccgccgccacagcgccatccggcccctgtgtgccgccagcagaagagagcacagcgacagcagccggcggcagagggtgcggggccaccggccccagaggcccagctcctggccagctgagagagatgctgccagcgccagcgccacagctgctgctgctgccagcagcagcagcgctgggggcggccctggccctgccaccatggccgaggtggcccgggcccccccacccatcgccatggacaggatgaagaagatcaagaggcagctgtccatgaccctgcggggcggccggggcatcgacaagaccaatggagcccctgagcagatcggcctggatgagagcggcggcggcggcggcagtgaccccggggaggcccccaccagggctgcccctggagagctgcggagcgcccggggccccctgagcagcgcccctgagatcgtgcatgaggacctgaagatgggcagtgatggagagagtgaccaggccagcgccaccagcagtgatgaggtgcagagccctgtgcgggtgaggatgaggaaccacccccccaggaagatcagcacagaggacatcaacaagaggctgagcctgcctgctgacatccggctgcctgagggctacctggagaagctgaccctgaacagccccatctttgacaagcccctgagccggcggctgcggcgggtgtccctgtctgaaattggatttgggaagctggagacctacatcaagctggacaagctgggggagggcacctacgccaccgtgtacaagggcaagagcaagctgacagacaacctggtggccctgaaggagatccggctggagcacgaggagggcgccccctgcacagccatccgggaggtgtccctgctgaaggacctgaagcacgccaacatcgtgaccctgcatgacatcatccacacagagaagagcctgaccctggtgtttgagtacctggacaaggacctgaagcagtacctggatgactgtggcaacatcatcaacatgcacaacgtgaagctgttcctgttccagctgctgcggggcctggcctactgccaccggcagaaggtgctgcaccgggacctgaagccccagaacctgctgatcaatgaaagaggagagctgaagctggccgactttggcctggcccgggccaagagcatccccaccaagacctacagcaatgaggtggtgaccctgtggtacagacctccagacatcctgctgggcagcacagactacagcacccagattgacatgtggggcgtgggctgcatcttctatgagatggccaccggccggcccctcttccctggcagcacagtggaggagcagctgcacttcatcttccgcatcctgggcacccccacagaggagacctggccaggcatcctgagcaatgaggagttcaagacctacaactaccccaagtacagagctgaggccctgctgagccacgcccccaggagcctgtgcccctgtggccgcctggacagtgatggagctgacctgctgaccaagctgctgcagtttgagggcaggaaccgcatctctgcagaagatgccatgaagcaccccttcttcctgagcctgggggagcgcatccacaagctgcctgacaccaccagcatctttgccctgaaggagatccagctgcagaaggaggccagcctgcggagcagctccatgccagattctggccggcctgccttccgggtggtggacacagagttctag

SEQ ID NO: 37832 - DNA, 1572 bp, Artificial Sequence
  Description of Artificial Sequence: Synthetic coding sequence
atgaagaagttcaagaggcggctgagcctgaccctgcggggcagccagaccattgatgagagcctgtctgagctggccgagcagatgaccatcgaggagaacagcagcaaggacaatgagcccatcgtgaagaatggccggccccccaccagccacagcatgcacagcttcctgcaccagtacacaggcagcttcaagaagccacccctgcggcggccccacagcgtgattggaggcagcctgggcagcttcatggccatgcccagaaatggcagccggctggacatcgtgcatgagaacctgaagatgggcagtgatggagagagtgaccaggccagcggcaccagcagtgatgaggtgcagagccccaccggggtgtgcctgaggaaccgcatccaccggcgcatctccatggaggacctgaacaagaggctgagcctgcctgctgacatccgcatcccagatggctacctggagaagctgcagatcaacagccccccatttgaccagcccatgagccgccgcagcagaagagccagcctgtctgagatcggctttgggaagatggagacctacatcaagctggagaagctgggggagggcacctacgccaccgtgtacaagggccgcagcaagctgacagagaacctggtggccctgaaggagatccggctggagcacgaggagggcgccccctgcacagccatccgggaggtgtccctgctgaaggacctgaagcacgccaacatcgtgaccctgcatgacatcgtgcacacagacaagagcctgaccctggtgtttgagtacctggacaaggacctgaagcagtacatggatgactgtggcaacatcatgtccatgcacaacgtgaagctgttcctgtaccagatcctgcggggcctggcctactgccacaggaggaaggtgctgcaccgggacctgaagccccagaacctgctgatcaatgagaagggggagctgaagctggccgactttggcctggcccgggccaagtctgtgcccaccaagacctacagcaatgaggtggtgaccctgtggtaccggcccccagatgtgctgctgggcagcagcgagtacagcacccagattgacatgtggggcgtgggctgcatcttctttgagatggccagcggccggcccctcttccctggcagcacagtggaggatgagctgcacctgatcttccggctgctgggcacccccagccaggagacctggccaggcatcagcagcaatgaggagttcaagaactacaacttccccaagtacaagccccagcccctcatcaaccacgccccccggctggacagcgagggcatcgagctgatcaccaagttcctgcagtatgagagcaagaagagggtgtctgctgaggaggccatgaagcacgtgtacttccgcagcctgggcccccgcatccacgccctgcctgagagcgtgtccatcttcagcctgaaggagatccagctgcagaaggaccccggcttcaggaacagcagctacccagagactggacatggcaagaacagacggcagagcatgctgttctag

SEQ ID NO: 37833 - DNA, 1572 bp, Artificial Sequence
  Description of Artificial Sequence: Synthetic coding sequence
atgaagaagttcaagaggcggctgagcctgaccctgcggggcagccagaccattgatgagagcctgtctgagctggccgagcagatgaccatcgaggagaacagcagcaaggacaatgagcccatcgtgaagaatggccggccccccaccagccacagcatgcacagcttcctgcaccagtacacaggcagcttcaagaagccacccctgcggcggccccacagcgtgattggaggcagcctgggcagcttcatggccatgcccagaaatggcagccggctggacatcgtgcatgagaacctgaagatgggcagtgatggagagagtgaccaggccagcggcaccagcagtgatgaggtgcagagccccaccggggtgtgcctgaggaaccgcatccaccggcgcatctccatggaggacctgaacaagaggctgagcctgcctgctgacatccgcatcccagatggctacctggagaagctgcagatcaacagccccccatttgaccagcccatgagccgccgcagcagaagagccagcctgtctgagatcggctttgggaagatggagacctacatcaagctggagaagctgggggagggcacctacgccaccgtgtacaagggccgcagcaagctgacagagaacctggtggccctgaaggagatccggctggagcacgaggagggcgccccctgcacagccatccgggaggtgtccctgctgaaggacctgaagcacgccaacatcgtgaccctgcatgacatcgtgcacacagacaagagcctgaccctggtgtttgagtacctggacaaggacctgaagcagtacatggatgactgtggcaacatcatgtccatgcacaacgtgaagctgttcctgtaccagatcctgcggggcctggcctactgccacaggaggaaggtgctgcaccgggacctgaagccccagaacctgctgatcaatgagaagggggagctgaagctggccgactttggcctggcccgggccaagtctgtgcccaccaagacctacagcaatgaggtggtgaccctgtggtaccggcccccagatgtgctgctgggcagcagcgagtacagcacccagattgacatgtggggcgtgggctgcatcttctttgagatggccagcggccggcccctcttccctggcagcacagtggaggatgagctgcacctgatcttccggctgctgggcacccccagccaggagacctggccaggcatcagcagcaatgaggagttcaagaactacaacttccccaagtacaagccccagcccctcatcaaccacgccccccggctggacagcgagggcatcgagctgatcaccaagttcctgcagtatgagagcaagaagagggtgtctgctgaggaggccatgaagcacgtgtacttccgcagcctgggcccccgcatccacgccctgcctgagagcgtgtccatcttcagcctgaaggagatccagctgcagaaggaccccggcttcaggaacagcagctacccagagactggagtgtttgtgatcaaccacttcacctgccgctcctag

SEQ ID NO: 37834 - DNA, 540 bp, Artificial Sequence
  Description of Artificial Sequence: Synthetic coding sequence
atgaagaagttcaagaggcggctgagcctgaccctgcggggcagccagaccattgatgagagcctgtctgagctggccgagcagatgaccatcgaggagaacagcagcaaggacaatgagcccatcgtgaagaatggccggccccccaccagccacagcatgcacagcttcctgcaccagtacacaggcagcttcaagaagccacccctgcggcggccccacagcgtgattggaggcagcctgggcagcttcatggccatgcccagaaatggcagccggctggacatcgtgcatgagaacctgaagatgggcagtgatggagagagtgaccaggccagcggcaccagcagtgatgaggtgcagagccccaccggggtgtgcctgaggaaccgcatccaccggcgcatctccatggaggacctgaacaagaggctgagcctgcctgctgacatccgcatcccagatggctacctggagaagctgcagatcaacagccccccatttgaccagcccatgagccgccgcagcagaagagcctag

SEQ ID NO: 37835 - DNA, 267 bp, Artificial Sequence
  Description of Artificial Sequence: Synthetic coding sequence
atgaagaagttcaagaggcggctgagcctgaccctgcggggcagccagaccattgatgagagcctgtctgagctggccgagcagatgaccatcgaggagaacagcagcaaggacaatgagcccatcgtgaagaatggccggccccccaccagccacagcatgcacagcttcctgcaccagtacacaggcagcttcaagaagccacccctgcggcggccccacagcgtgattggaggcagcctgggcagcttcatggccatgccctag

SEQ ID NO: 37836 - DNA, 486 bp, Artificial Sequence
  Description of Artificial Sequence: Synthetic coding sequence
atgaagaagttcaagaggcggctgagcctgaccctgcggggcagccagaccattgatgagagcctgtctgagctggccgagcagatgaccatcgaggagaacagcagcaaggacaatgagcccatcgtgaagaatggccggccccccaccagccacagcatgcacagcttcctgcaccagtacacaggcagcttcaagaagccacccctgcggcggccccacagcgtgattggaggcagcctgggcagcttcatggccatgcccagaaatggcagccggctggacatcgtgcatgagaacctgaagatgggcagtgatggagagagtgaccaggccagcggcaccagcagtgatgaggtgcagagccccaccggggtgtgcctgaggaaccgcatccaccggcgcatctccatggaggacctgaacaagaggctgagcctgcctgctgacatccgcatcccagatggctacctggagaagctgtag

SEQ ID NO: 37837 - DNA, 1425 bp, Artificial Sequence
  Description of Artificial Sequence: Synthetic coding sequence
atgatcatgaacaagatgaagaacttcaagaggcgcttcagcctgtctgtgcccaggacagagaccatcgaggagagcctggccgagttcacagagcagttcaaccagctgcacaacagaagaaatgaaaacctgcagctgggccccctgggccgggaccccccccaggagtgcagcaccttcagccccacagacagcggggaggagcccggccagctgagccctggggtgcagttccagaggcggcagaaccagaggcgcttctccatggaggatgtgtccaagaggctgagcctgcccatggacatccggctgccccaggagttcctgcagaagctgcagatggagagcccagacctgcccaagcccctgagcaggatgagcagaagagccagcctgagtgacatcggctttgggaagctggagacctacgtgaagctggacaagctgggggagggcacctacgccaccgtcttcaagggccgcagcaagctgacagagaacctggtggccctgaaggagatccggctggagcacgaggagggcgccccctgcacagccatccgggaggtgtccctgctgaagaacctgaagcacgccaacatcgtgaccctgcatgacctgatccacacagacaggagcctgaccctggtgtttgagtacctggacagcgacctgaagcagtacctggaccactgcggcaacctgatgtccatgcacaacgtgaagatcttcatgttccagctgctgcggggcctggcctactgccaccacaggaagatcctgcaccgggacctgaagccccagaacctgctgatcaatgaaagaggagagctgaagctggccgactttggcctggcccgggccaagtctgtgcccaccaagacctacagcaatgaggtggtgaccctgtggtaccggcccccagatgtgctgctgggcagcacagagtacagcacccccatcgacatgtggggcgtgggctgcatccactatgagatggccaccggccggcccctcttccctggcagcacagtgaaggaggagctgcacctgatcttccggctgctgggcacccccacagaggagacctggccaggagtgacagccttcagcgagttccgcacctacagcttcccctgctacctgccccagcccctcatcaaccacgccccccggctggacacagatggcatccacctgctgagcagcctgctgctgtatgagagcaagagcaggatgtctgctgaggccgccctgagccacagctacttccgcagcctgggggagcgggtgcaccagctggaggacacagccagcatcttcagcctgaaggagatccagctgcagaaggaccccggctaccggggcctggccttccagcagcccggccggggcaagaacagacggcagagcatcttctag

SEQ ID NO: 37838 - DNA, 855 bp, Artificial Sequence
  Description of Artificial Sequence: Synthetic coding sequence
atgatcatgaacaagatgaagaacttcaagaggcgcttcagcctgtctgtgcccaggacagagaccatcgaggagagcctggccgagttcacagagcagttcaaccagctgcacaacagaagaaatgaaaacctgcagctgggccccctgggccgggaccccccccaggagtgcagcaccttcagccccacagacagcggggaggagcccggccagctgagccctggggtgcagttccagaggcggcagaaccagaggcgcttctccatggaggtgcgggccagcggggccctgccccggcaggtggccggctgcacccacaagggcgtgcaccggcgggctgctgccctgcagcctgactttgatgtgtccaagaggctgagcctgcccatggacatccggctgccccaggagttcctgcagaagctgcagatggagagcccagacctgcccaagcccctgagcaggatgagcagaagagccagcctgagtgacatcggctttgggaagctggagacctacgtgaagctggacaagctgggggagggcacctacgccaccgtcttcaagggccgcagcaagctgacagagaacctggtggccctgaaggagatccggctggagcacgaggagggcgccccctgcacagccatccgggaggtgtccctgctgaagaacctgaagcacgccaacatcgtgaccctgcatgacctgatccacacagacaggagcctgaccctggtgtttgagtacctggacagcgacctgaagcagtacctggaccactgcggcaacctgatgtccatgcacaacgtgaagatcttcatgttccagctgctgcggggcctggcctag

SEQ ID NO: 37839 - DNA, 1425 bp, Artificial Sequence; identical to SEQ ID NO: 37837
  Description of Artificial Sequence: Synthetic coding sequence

SEQ ID NO: 37840 - DNA, 474 bp, Artificial Sequence
  Description of Artificial Sequence: Synthetic coding sequence
atgtccatgcacaacgtgaagatcttcatgttccagctgctgcggggcctggcctactgccaccacaggaagatcctgcaccgggacctgaagccccagaacctgctgatcaatgaaagaggagagctgaagctggccgactttggcctggcccgggccaagtctgtgcccaccaagacctacagcaatgaggtggtgaccctgtggtaccggcccccagatgtgctgctgggcagcacagagtacagcacccccatcgacatgtggggcgtgggctgcatccactatgagatggccaccggccggcccctcttccctggcagcacagtgaaggaggagctgcacctgatcttccggctgctgggcacccccacagaggagacctggccaggagtgacagccttcagcgagttccgcacctacagcttcccctgctacctgccccagcccctcatcaaccacgcccccaggtag

SEQ ID NO: 37841 - DNA, 1515 bp, Artificial Sequence
  Description of Artificial Sequence: Synthetic coding sequence
atgatcatgaacaagatgaagaacttcaagaggcgcttcagcctgtctgtgcccaggacagagaccatcgaggagagcctggccgagttcacagagcagttcaaccagctgcacaacagaagaaatgaaaacctgcagctgggccccctgggccgggaccccccccaggagtgcagcaccttcagccccacagacagcggggaggagcccggccagctgagccctggggtgcagttccagaggcggcagaaccagaggcgcttctccatggaggtgcgggccagcggggccctgccccggcaggtggccggctgcacccacaagggcgtgcaccggcgggctgctgccctgcagcctgactttgatgtgtccaagaggctgagcctgcccatggacatccggctgccccaggagttcctgcagaagctgcagatggagagcccagacctgcccaagcccctgagcaggatgagcagaagagccagcctgagtgacatcggctttgggaagctggagacctacgtgaagctggacaagctgggggagggcacctacgccaccgtcttcaagggccgcagcaagctgacagagaacctggtggccctgaaggagatccggctggagcacgaggagggcgccccctgcacagccatccgggaggtgtccctgctgaagaacctgaagcacgccaacatcgtgaccctgcatgacctgatccacacagacaggagcctgaccctggtgtttgagtacctggacagcgacctgaagcagtacctggaccactgcggcaacctgatgtccatgcacaacgtgaagatcttcatgttccagctgctgcggggcctggcctactgccaccacaggaagatcctgcaccgggacctgaagccccagaacctgctgatcaatgaaagaggagagctgaagctggccgactttggcctggcccgggccaagtctgtgcccaccaagacctacagcaatgaggtggtgaccctgtggtaccggcccccagatgtgctgctgggcagcacagagtacagcacccccatcgacatgtggggcgtgggctgcatccactatgagatggccaccggccggcccctcttccctggcagcacagtgaaggaggagctgcacctgatcttccggctgctgggcacccccacagaggagacctggccaggagtgacagccttcagcgagttccgcacctacagcttcccctgctacctgccccagcccctcatcaaccacgccccccggctggacacagatggcatccacctgctgagcagcctgctgctgtatgagagcaagagcaggatgtctgctgaggccgccctgagccacagctacttccgcagcctgggggagcgggtgcaccagctggaggacacagccagcatcttcagcctgaaggagatccagctgcagaaggaccccggctaccggggcctggccttccagcagcccggccggggcaagaacagacggcagagcatcttctag

SEQ ID NO: 37842 - DNA, 1329 bp, Artificial Sequence
  Description of Artificial Sequence: Synthetic coding sequence
atgtctgcctgccgggagatcgccctgctgcgggagctgaagcaccccaacgtgattgccctgcagaaggtgttcctgagccacagcgacaggaaggtgtggctgctgtttgattatgcagagcatgacctgtggcacatcatcaagttccaccgggccagcaaggccaacaagaagcccatgcagctgcccaggtccatggtgaagagcctgctgtaccagatcctggatggcatccactacctgcacgccaactgggtgctgcaccgggacctgaagccagccaacatcctggtgatgggagagggccctgagcggggccgggtgaagattgctgacatgggctttgcccggctcttcaacagccccctgaagcccctggccgacctggaccctgtggtggtgaccttctggtaccgggcccctgagctgctgctgggcgcccggcactacaccaaggccatcgacatctgggccatcggctgcatctttgctgagctgctgaccagcgagcccatcttccactgccggcaggaggacatcaagaccagcaaccccttccaccacgaccagctggaccgcatcttctctgtgatgggcttccctgctgacaaggactgggaggacatcaggaagatgcctgagtaccccaccctgcagaaggacttccggaggaccacctacgccaacagcagcctcatcaagtacatggagaagcacaaggtgaagccagacagcaaggtgttcctgctgctgcagaagctgctgaccatggaccccaccaagaggatcaccagcgagcaggccctgcaggacccctacttccaggaggaccccctgcccaccctggatgtgtttgctggctgccagatcccctaccccaagcgggagttcctgaatgaagatgatcctgaggagaagggggacaagaaccagcagcagcagcagaaccagcaccagcagcccacagccccaccccagcaggccgccgccccaccccaggcccccccaccccagcagaacagcacccagaccaacggcacagctggaggagctggggccggcgtgggcggcactggagctggcctgcagcacagccaggacagcagcctgaaccaggtgccccccaacaagaagccccggctgggccccagcggggccaacagcggcggccctgtgatgcccagcgactaccagcacagcagcagccggctgaactaccagagctctgtgcagggcagcagccagagccagagcaccctgggctacagcagcagcagccagcagagcagccagtaccaccccagccaccaggcccaccgctactag

SEQ ID NO: 37843 - DNA, 1509 bp, Artificial Sequence
  Description of Artificial Sequence: Synthetic coding sequence
atggactatgacttcaaggccaagctggccgctgagcgggagcgggtggaggacctgtttgaatatgagggctgcaaggtgggccggggcacctacggccacgtgtacaaggcccggaggaaggatggcaaggatgagaaggagtatgccctgaagcagatcgagggcaccggcatctccatgtctgcctgccgggagatcgccctgctgcgggagctgaagcaccccaacgtgattgccctgcagaaggtgttcctgagccacagcgacaggaaggtgtggctgctgtttgattatgcagagcatgacctgtggcacatcatcaagttccaccgggccagcaaggccaacaagaagcccatgcagctgcccaggtccatggtgaagagcctgctgtaccagatcctggatggcatccactacctgcacgccaactgggtgctgcaccgggacctgaagccagccaacatcctggtgatgggagagggccctgagcggggccgggtgaagattgctgacatgggctttgcccggctcttcaacagccccctgaagcccctggccgacctggaccctgtggtggtgaccttctggtaccgggcccctgagctgctgctgggcgcccggcactacaccaaggccatcgacatctgggccatcggctgcatctttgctgagctgctgaccagcgagcccatcttccactgccggcaggaggacatcaagaccagcaaccccttccaccacgaccagctggaccgcatcttctctgtgatgggcttccctgctgacaaggactgggaggacatcaggaagatgcctgagtaccccaccctgcagaaggacttccggaggaccacctacgccaacagcagcctcatcaagtacatggagaagcacaaggtgaagccagacagcaaggtgttcctgctgctgcagaagctgctgaccatggaccccaccaagaggatcaccagcgagcaggccctgcaggacccctacttccaggaggaccccctgcccaccctggatgtgtttgctggctgccagatcccctaccccaagcgggagttcctgaatgaagatgatcctgaggagaagggggacaagaaccagcagcagcagcagaaccagcaccagcagcccacagccccaccccagcaggccgccgccccaccccaggcccccccaccccagcagaacagcacccagaccaacggcacagctggaggagctggggccggcgtgggcggcactggagctggcctgcagcacagccaggacagcagcctgaaccaggtgccccccaacaagaagccccggctgggccccagcggggccaacagcggcggccctgtgatgcccagcgactaccagcacagcagcagccggctgaactaccagagctctgtgcagggcagcagccagagccagagcaccctgggctacagcagcagcagccagcagagcagccagtaccaccccagccaccaggcccaccgctactag

SEQ ID NO: 37844 - DNA, 1326 bp, Artificial Sequence
  Description of Artificial Sequence: Synthetic coding sequence
agcctgaccaggaacatccagctgctgcgggagctgaagcaccccaacgtcatcgccctgcagaaggtgttcctgagccacagcgacaggaaggtgtggctgctgtttgattatgcagagcatgacctgtggcacatcatcaagttccaccgggccagcaaggccaacaagaagcccatgcagctgcccaggtccatggtgaagagcctgctgtaccagatcctggatggcatccactacctgcacgccaactgggtgctgcaccgggacctgaagccagccaacatcctggtgatgggagagggccctgagcggggccgggtgaagattgctgacatgggctttgcccggctcttcaacagccccctgaagcccctggccgacctggaccctgtggtggtgaccttctggtaccgggcccctgagctgctgctgggcgcccggcactacaccaaggccatcgacatctgggccatcggctgcatctttgctgagctgctgaccagcgagcccatcttccactgccggcaggaggacatcaagaccagcaaccccttccaccacgaccagctggaccgcatcttctctgtgatgggcttccctgctgacaaggactgggaggacatcaggaagatgcctgagtaccccaccctgcagaaggacttccggaggaccacctacgccaacagcagcctcatcaagtacatggagaagcacaaggtgaagccagacagcaaggtgttcctgctgctgcagaagctgctgaccatggaccccaccaagaggatcaccagcgagcaggccctgcaggacccctacttccaggaggaccccctgcccaccctggatgtgtttgctggctgccagatcccctaccccaagcgggagttcctgaatgaagatgatcctgaggagaagggggacaagaaccagcagcagcagcagaaccagcaccagcagcccacagccccaccccagcaggccgccgccccaccccaggcccccccaccccagcagaacagcacccagaccaatggaacagctgggggcgctggggccggcgtgggcggcaccggggccggcctgcagcacagccaggacagcagcctgaaccaggtgccccccaacaagaagccccggctgggccccagcggggccaacagcggcggccctgtgatgcccagcgactaccagcacagcagcagccggctgaactaccagagctctgtgcagggcagcagccagagccagagcaccctgggctacagcagcagcagccagcagagcagccagtaccaccccagccaccaggcccaccgctactag

SEQ ID NO: 37845 - DNA, 1137 bp, Artificial Sequence
  Description of Artificial Sequence: Synthetic coding sequence
atggactttgtgttcaaccccctgtggaagtacctgtgcctgctggccggcaagtgcatcgtgctgctggtgcggcccaagctgaagccagccaacatcctggtgatgggagagggccctgagcggggccgggtgaagattgctgacatgggctttgcccggctcttcaacagccccctgaagcccctggccgacctggaccctgtggtggtgaccttctggtaccgggcccctgagctgctgctgggcgcccggcactacaccaaggccatcgacatctgggccatcggctgcatctttgctgagctgctgaccagcgagcccatcttccactgccggcaggaggacatcaagaccagcaaccccttccaccacgaccagctggaccgcatcttctctgtgatgggcttccctgctgacaaggactgggaggacatcaggaagatgcctgagtaccccaccctgcagaaggacttccggaggaccacctacgccaacagcagcctcatcaagtacatggagaagcacaaggtgaagccagacagcaaggtgttcctgctgctgcagaagctgctgaccatggaccccaccaagaggatcaccagcgagcaggccctgcaggacccctacttccaggaggaccccctgcccaccctggatgtgtttgctggctgccagatcccctaccccaagcgggagttcctgaatgaagatgatcctgaggagaagggggacaagaaccagcagcagcagcagaaccagcaccagcagcccacagccccaccccagcaggccgccgccccaccccaggcccccccaccccagcagaacagcacccagaccaacggcacagctggaggagctggggccggcgtgggcggcactggagctggcctgcagcacagccaggacagcagcctgaaccaggtgccccccaacaagaagccccggctgggccccagcggggccaacagcggcggccctgtgatgcccagcgactaccagcacagcagcagccggctgaactaccagagctctgtgcagggcagcagccagagccagagcaccctgggctacagcagcagcagccagcagagcagccagtaccaccccagccaccaggcccaccgctactag

SEQ ID NO: 37846 - DNA, 756 bp, Artificial Sequence
  Description of Artificial Sequence: Synthetic coding sequence
atgtctgcctgccgggagatcgccctgctgcgggagctgaagcaccccaacgtgattgccctgcagaaggtgttcctgagccacagcgacaggaaggtgtggctgctgtttgattatgcagagcatgacctgtggcacatcatcaagttccaccgggccagcaaggccaacaagaagcccatgcagctgcccaggtccatggtgaagagcctgctgtaccagatcctggatggcatccactacctgcacgccaactgggtgctgcaccgggacctgaagccagccaacatcctggtgatgggagagggccctgagcggggccgggtgaagattgctgacatgggctttgcccggctcttcaacagccccctgaagcccctggccgacctggaccctgtggtggtgaccttctggtaccgggcccctgagctgctgctgggcgcccggcactacaccaaggccatcgacatctgggccatcggctgcatctttgctgagctgctgaccagcgagcccatcttccactgccggcaggaggacatcaagaccagcaaccccttccaccacgaccagctggaccgcatcttctctgtgatgggcttccctgctgacaaggactgggaggacatcaggaagatgcctgagtaccccaccctgcagaaggacttccggaggaccacctacgccaacagcagcctcatcaagtacatggagaagcacaaggtgaagccagacagcaaggtgttcctgctgtag

SEQ ID NO: 37847 - DNA, 381 bp, Artificial Sequence
  Description of Artificial Sequence: Synthetic coding sequence
atgagctacaagcccatcgccccagcccccagcagcaccccaggcagcagcaccccaggccctggcacccctgtgcccactggatctgtgcccagccccagcggctctgtgcctggggccggggcccccttccggcccctcttcaatgactttggacctccttccatgggctacgtgcaggccatgaagcccccaggggcccagggcagccagagcacctacacagacctgctgtctgtgattgaggagatgggcaaggagatccggcccacctacgccggcagcaagagcgccatggagcggctgaagaggggcatcatccacgcccgggccctggtgagagaatgtctggccgagacagaaagaaatgcccggacctag

SEQ ID NO: 37848 - DNA, 1077 bp, Artificial Sequence
  Description of Artificial Sequence: Synthetic coding sequence
atgatggagaagtatgagaagattggcaagattggagagggcagctatggagtggtgttcaagtgcaggaacagagacaccggccagatcgtggccatcaagaagttcctggagagtgaagatgatcctgtgatcaagaagatcgccctgcgggagatccgcatgctgaagcagctgaagcaccccaacctggtgaacctgctggaggtgttccggaggaagaggcggctgcacctggtgtttgagtactgtgaccacacagtgctgcacgagctggaccgctaccagaggggcgtgcctgagcacctggtgaagagcatcacctggcagaccctgcaggccgtgaacttctgccacaagcacaactgcatccacagagatgtgaagccagagaacatcctgatcaccaagcacagcgtcatcaagctgtgtgactttggatttgcccggctgctgaccggccccagcgactactacacagattatgtggccacccgctggtaccgcagccctgagctgctggtgggggacacccagtatggcccccctgtggatgtgtgggccatcggctgtgtgtttgctgagctgctgagcggcgtgcccctgtggccaggcaagagtgatgtggaccagctgtacctgatcaggaagaccctgggggacctgatccccaggcaccagcaggtgttcagcaccaaccagtacttctctggagtgaagatcccagaccctgaggacatggagcccctggagctgaagttccccaacatctcctacccagccctgggcctgctgaagggctgcctgcacatggaccccacccagaggctgacctgtgagcagctgctgcaccacccctactttgagaacatccgggagattgaggacctggccaaggagcacaacaagcccaccaggaagaccctgaggaagagcaggaagcaccactgcttcacagagaccagcaagctgcagtacctgccccagctgaccggcagcagcatcctgcctgccctggacaacaagaagtactactgtgacaccaagaagctgaactaccgcttccccaacatctag

SEQ ID NO: 37849 - DNA, 747 bp, Artificial Sequence
  Description of Artificial Sequence: Synthetic coding sequence
atggaggcccctgagggcggcggcggcggccctgctgcccggggccctgagggccagcctgcccctgaggcccgggtgcacttccgggtggcccgcttcatcatggaggccggcgtgaagctgggcatgaggagcatccccatcgccacagcctgcaccatctaccacaagttcttctgtgagaccaacctggatgcctatgacccctacctgattgccatgagcagcatctacctggccggcaaggtggaggagcagcacctgcggacccgggacatcatcaacgtgagcaaccgctacttcaaccccagcggggagcccctggagctggacagccgcttctgggagctgcgggacagcatcgtgcagtgtgagctgctgatgctgcgggtgctgcgcttccaggtgtccttccagcacccccacaagtacctgctgcactacctggtgtccctgcagaactggctgaacagacacagctggcagaggacccctgtggccgtgacagcctgggccctgctgcgggacagctaccatggagccctgtgcctgcgcttccaggcccagcacatcgctgtggccgtgctgtacctggccctgcaggtgtatggagtggaggtgcctgctgaggtggaggccgagaagccctggtggcaggtgttcaatgatgacctgaccaagcccatcatcgacaacatcgtgtctgacctgatccagatctacaccatggacacagagatcccctag

SEQ ID NO: 37850 - DNA, 1134 bp, Artificial Sequence
  Description of Artificial Sequence: Synthetic coding sequence
atggagctgtctgtgctgctcttcctggccctgctgaccggcctgctgctgctgctggtgcagaggcaccccaacagccacggcaccctgcccccaggcccccggcccctgcccctgctgggcaacctgctgcagatggaccggcggggcctgctgaagagcttcctgcgcttccgggagaagtatggagatgtgttcaccgtgcacctgggccccaggcctgtggtgatgctgtgtggggtggaggccatccgggaggccctggtggacaatgctgaggccttcagcggccggggcaagatcgtcatcatggaccctgtgtaccagggctacggcatgctgtttgccaatggaaaccgctggaaggtgctgcggcgcttctctgtgaccaccatgagggactttggcatgggcaagaggtctgtggaggagcgcatccaggatgaggcccagtgcctgattgaggagctgaggaagagcaaaggagccctggtggaccccaccttcctgttccacagcatcacagccaacatcatctgcagcatcatctttgggaagcgcttccactaccaggaccaggagttcctgaagaccctgaacctcttctgccagagcttcctgctgatcagcagcatcagcagccagctgtttgagctgttcagcggcttcctgaagtacttccctggggcccaccggcaggtgtacaagaacctgcaggagatcaatgcctacatcggccacagcgtggagaagcaccgggagaccctggaccccagcgccccccgggacctgattgacacctacctgctgcacatggagaaggagaagagcaacccccacagcgagttcagccaccagaacctgatcatcaacaccctgagcctcttctttgctggaacagagaccaccagcaccaccctgcgctatggcttcctgctgatgctgaagtacccccacgtggccgagcgggtgtacaaggagattgagcaggtggtgggcccccaccggcccccagccctggatgaccgggccaagatgccctacacagaagctgtgatccgggagatccagagatttgctgacctgctgcccatgggcgtgccccacatcgtgacccagcacaccagcttctag

SEQ ID NO: 37851 - DNA, 999 bp, Artificial Sequence
  Description of Artificial Sequence: Synthetic coding sequence
atggccctgctgtgctacaacagaggctgcggccagagatttgatcctgagaccaacagtgatgatgcctgcacctaccaccctggggtgcctgtgttccatgatgccctgaagggctggagctgctgcaagaggaggaccacagacttcagtgacttcctgagcatcgtgggctgcaccaagggccgccacaacagcgagaagcccccagagcctgtgaagccagaggtgaagaccacagagaagaaggagctgtgtgagctgaagcccaagttccaggagcacatcatccaggcccccaagcctgtggaggccatcaagaggcccagcccagatgagcccatgaccaacctggagctgaagatcagcgccagcctgaagcaggccctggacaagctgaagctgagcagtggaaatgaggagaacaagaaggaggaggacaatgatgagatcaagattggcaccagctgcaagaatggaggctgcagcaagacctaccagggcctggagagcctggaggaggtgtgtgtgtaccacagcggcgtgcccatcttccacgagggcatgaagtactggagctgctgcaggaggaagaccagtgacttcaacaccttcctggcccaggagggctgcaccaagggcaagcacatgtggaccaagaaggatgctgggaagaaggtggtgccctgcagacatgactggcaccagacaggaggagaggtgaccatctctgtgtatgccaagaacagcctgcctgagctgagccgggtggaggccaacagcaccctgctgaatgtgcacatcgtgtttgaaggagagaaggagtttgaccagaatgtgaagctgtggggcgtgattgatgtgaagaggagctatgtgaccatgacagccaccaagattgagatcaccatgaggaaggccgagcccatgcagtgggccagcctggagctgcctgctgccaagaagcaggagaagcagaaggatgccaccacagactag

SEQ ID NO: 37852 - DNA, 942 bp, Artificial Sequence
  Description of Artificial Sequence: Synthetic coding sequence
atggccctgctgtgctacaacagaggctgcggccagagatttgatcctgagaccaacagtgatgatgcctgcacctaccaccctggggtgcctgtgttccatgatgccctgaagggctgcaccaagggccgccacaacagcgagaagcccccagagcctgtgaagccagaggtgaagaccacagagaagaaggagctgtgtgagctgaagcccaagttccaggagcacatcatccaggcccccaagcctgtggaggccatcaagaggcccagcccagatgagcccatgaccaacctggagctgaagatcagcgccagcctgaagcaggccctggacaagctgaagctgagcagtggaaatgaggagaacaagaaggaggaggacaatgatgagatcaagattggcaccagctgcaagaatggaggctgcagcaagacctaccagggcctggagagcctggaggaggtgtgtgtgtaccacagcggcgtgcccatcttccacgagggcatgaagtactggagctgctgcaggaggaagaccagtgacttcaacaccttcctggcccaggagggctgcaccaagggcaagcacatgtggaccaagaaggatgctgggaagaaggtggtgccctgcagacatgactggcaccagacaggaggagaggtgaccatctctgtgtatgccaagaacagcctgcctgagctgagccgggtggaggccaacagcaccctgctgaatgtgcacatcgtgtttgaaggagagaaggagtttgaccagaatgtgaagctgtggggcgtgattgatgtgaagaggagctatgtgaccatgacagccaccaagattgagatcaccatgaggaaggccgagcccatgcagtgggccagcctggagctgcctgctgccaagaagcaggagaagcagaaggatgccaccacagactag

SEQ ID NO: 37853 - DNA, 1563 bp, Artificial Sequence
  Description of Artificial Sequence: Synthetic coding sequence
atgagcatccccctgaagagcagcttcctgctgagctacctgtgcaccctgcccccagccctgctgagccgggagatcctgatggctgacagcgaggccctgcccagcctggccggggaccctgtggccgtggaggccctgctgcgggctgtgtttggagtggtggtggatgaggccatccagaagggcacctctgtgtcccagaaggtgtgtgagtggaaggagcctgaggagctgaagcagctgctggacctggagctgcggagccagggcgagagccagaagcagatcctggagcgctgcagagctgtgatccgctacagcgtgaagacaggccacccccgcttcttcaaccagctgttcagcggcctggacccccacgccctggccggccgcatcatcacagagagcctgaacaccagccagtacacctatgaaattgcccctgtgtttgtgctgatggaggaggaggtgctgaggaagctgcgggccctggtgggctggagcagtggagatggcatcttctgccctgggggcagcatcagcaacatgtatgctgtgaacctggcccgctaccagcgctacccagactgcaagcagaggggcctgcggaccctgccccccctggccctcttcaccagcaaggagtgccactacagcatccagaagggagctgccttcctgggcctgggcacagacagcgtgcgggtggtgaaggcagatgagcggggcaagatggtgcctgaggacctggagcggcagatcggcatggccgaggccgagggcgctgtgcccttcctggtgtctgccaccagcggcaccaccgtgctgggcgcctttgaccccctggaggccatcgcagatgtgtgccagagacatggcctgtggctgcacgtggatgctgcctggggcggctctgtgctgctgagccagacccaccgccacctgctggatggcatccagagagctgacagcgtggcctggaacccccacaagctgctggccgccggcctgcagtgcagcgccctgctgctgcaggacaccagcaacctgctgaagcgctgccacggcagccaggccagctacctgttccagcaggacaagttctatgatgtggccctggacaccggggacaaggtggtgcagtgtggcagaagagtggactgcctgaagctgtggctgatgtggaaggcccagggcgaccagggcctggagaggagaattgaccaggcctttgtgctggcccgctacctggtggaggagatgaagaagcgggagggctttgagctggtgatggagcctgagtttgtgaatgtgtgcttctggtttgtgccccccagcctgcggggcaagcaggagagcccagactaccacgagcggctgagcaaggtggcccctgtgctgaaggagaggatggtgaaggagggctccatgatgattggctaccagccccacggcacccggggcaacttcttccgggtggtggtggccaacagcgccctgacctgtgccgacatggacttcctgctgaatgagctggagcggctgggccaggacctgtag

SEQ ID NO: 37854 - DNA, 1749 bp, Artificial Sequence
  Description of Artificial Sequence: Synthetic coding sequence
catggcctgcgggccacagaggccctgcccagcgtgaggaccaccctgcggagcctgggcctggcccccacctgccaggcccggcccccagctggcagcctggccgcccggcggctgctgcaggccccagcccacccagccaaccccacagctgctgctgcccccaccggcacagaggccaccagccagatgtgggccacccacagcggccggcccaggagctacctgtgcaccctgcccccagccctgctgagccgggagatcctgatggctgacagcgaggccctgcccagcctggccggggaccctgtggccgtggaggccctgctgcgggctgtgtttggagtggtggtggatgaggccatccagaagggcacctctgtgtcccagaaggtgtgtgagtggaaggagcctgaggagctgaagcagctgctggacctggagctgcggagccagggcgagagccagaagcagatcctggagcgctgcagagctgtgatccgctacagcgtgaagacaggccacccccgcttcttcaaccagctgttcagcggcctggacccccacgccctggccggccgcatcatcacagagagcctgaacaccagccagtacacctatgaaattgcccctgtgtttgtgctgatggaggaggaggtgctgaggaagctgcgggccctggtgggctggagcagtggagatggcatcttctgccctgggggcagcatcagcaacatgtatgctgtgaacctggcccgctaccagcgctacccagactgcaagcagaggggcctgcggaccctgccccccctggccctcttcaccagcaaggagtgccactacagcatccagaagggagctgccttcctgggcctgggcacagacagcgtgcgggtggtgaaggcagatgagcggggcaagatggtgcctgaggacctggagcggcagatcggcatggccgaggccgagggcgctgtgcccttcctggtgtctgccaccagcggcaccaccgtgctgggcgcctttgaccccctggaggccatcgcagatgtgtgccagagacatggcctgtggctgcacgtggatgctgcctggggcggctctgtgctgctgagccagacccaccgccacctgctggatggcatccagagagctgacagcgtggcctggaacccccacaagctgctggccgccggcctgcagtgcagcgccctgctgctgcaggacaccagcaacctgctgaagcgctgccacggcagccaggccagctacctgttccagcaggacaagttctatgatgtggccctggacaccggggacaaggtggtgcagtgtggcagaagagtggactgcctgaagctgtggctgatgtggaaggcccagggcgaccagggcctggagaggagaattgaccaggcctttgtgctggcccgctacctggtggaggagatgaagaagcgggagggctttgagctggtgatggagcctgagtttgtgaatgtgtgcttctggtttgtgccccccagcctgcggggcaagcaggagagcccagactaccacgagcggctgagcaaggtggcccctgtgctgaaggagaggatggtgaaggagggctccatgatgattggctaccagccccacggcacccggggcaacttcttccgggtggtggtggccaacagcgccctgacctgtgccgacatggacttcctgctgaatgagctggagcggctgggccaggacctgtag

SEQ ID NO: 37855 - DNA, 1041 bp, Artificial Sequence
  Description of Artificial Sequence: Synthetic coding sequence
atggctgacagcgaggccctgcccagcctggccggggaccctgtggccgtggaggccctgctgcgggctgtgtttggagtggtggtggatgaggccatccagaagggcacctctgtgtcccagaagtgccactacagcatccagaagggagctgccttcctgggcctgggcacagacagcgtgcgggtggtgaaggcagatgagcggggcaagatggtgcctgaggacctggagcggcagatcggcatggccgaggccgagggcgctgtgcccttcctggtgtctgccaccagcggcaccaccgtgctgggcgcctttgaccccctggaggccatcgcagatgtgtgccagagacatggcctgtggctgcacgtggatgctgcctggggcggctctgtgctgctgagccagacccaccgccacctgctggatggcatccagagagctgacagcgtggcctggaacccccacaagctgctggccgccggcctgcagtgcagcgccctgctgctgcaggacaccagcaacctgctgaagcgctgccacggcagccaggccagctacctgttccagcaggacaagttctatgatgtggccctggacaccggggacaaggtggtgcagtgtggcagaagagtggactgcctgaagctgtggctgatgtggaaggcccagggcgaccagggcctggagaggagaattgaccaggcctttgtgctggcccgctacctggtggaggagatgaagaagcgggagggctttgagctggtgatggagcctgagtttgtgaatgtgtgcttctggtttgtgccccccagcctgcggggcaagcaggagagcccagactaccacgagcggctgagcaaggtggcccctgtgctgaaggagaggatggtgaaggagggctccatgatgattggctaccagccccacggcacccggggcaacttcttccgggtggtggtggccaacagcgccctgacctgtgccgacatggacttcctgctgaatgagctggagcggctgggccaggacctgtag

SEQ ID NO: 37856 - DNA, 1041 bp, Artificial Sequence; identical to SEQ ID NO: 37855
  Description of Artificial Sequence: Synthetic coding sequence

SEQ ID NO: 37857 - DNA, 1365 bp, Artificial Sequence
  Description of Artificial Sequence: Synthetic coding sequence
atggctgacagcgaggccctgcccagcctggccggggaccctgtggccgtggaggccctgctgcgggctgtgtttggagtggtggtggatgaggccatccagaagggcacctctgtgtcccagaaggtgtgtgagtggaaggagcctgaggagctgaagcagctgctggacctggagctgcggagccagggcgagagccagaagcagatcctggagcgctgccgggccgtcatccgctacagcgtgaagacaggccacccccgcttcttcaaccagctgttcagcggcctggacccccacgccctggccggccgcatcatcacagagagcctgaacaccagccagtacacctatgagatcgcccctgtgtttgtgctgatggaggaggaggtgctgaggaagctgcgggccctggtgggctggagcagtggagatggcatcagcgccctgtgccactacagcatccagaagggagctgccttcctgggcctgggcacagacagcgtgcgggtggtgaaggcagatgagcggggcaagatggtgcctgaggacctggagcggcagatcggcatggccgaggccgagggcgctgtgcccttcctggtgtctgccaccagcggcaccaccgtgctgggcgcctttgaccccctggaggccatcgcagatgtgtgccagagacatggcctgtggctgcacgtggatgctgcctggggcggctctgtgctgctgagccagacccaccgccacctgctggatggcatccagagagctgacagcgtggcctggaacccccacaagctgctggccgccggcctgcagtgcagcgccctgctgctgcaggacaccagcaacctgctgaagcgctgccacggcagccaggccagctacctgttccagcaggacaagttctatgatgtggccctggacaccggggacaaggtggtgcagtgtggcagaagagtggactgcctgaagctgtggctgatgtggaaggcccagggcgaccagggcctggagaggagaattgaccaggcctttgtgctggcccgctacctggtggaggagatgaagaagcgggagggctttgagctggtgatggagcctgagtttgtgaatgtgtgcttctggtttgtgccccccagcctgcggggcaagcaggagagcccagactaccacgagcggctgagcaaggtggcccctgtgctgaaggagaggatggtgaaggagggctccatgatgattggctaccagccccacggcacccggggcaacttcttccgggtggtggtggccaacagcgccctgacctgtgccgacatggacttcctgctgaatgagctggagcggctgggccaggacctgtag

SEQ ID NO: 37858 - DNA, 1482 bp, Artificial Sequence
  Description of Artificial Sequence: Synthetic coding sequence
atggctgacagcgaggccctgcccagcctggccggggaccctgtggccgtggaggccctgctgcgggctgtgtttggagtggtggtggatgaggccatccagaagggcacctctgtgtcccagaaggtgtgtgagtggaaggagcctgaggagctgaagcagctgctggacctggagctgcggagccagggcgagagccagaagcagatcctggagcgctgccgggccgtcatccgctacagcgtgaagacaggccacccccgcttcttcaaccagctgttcagcggcctggacccccacgccctggccggccgcatcatcacagagagcctgaacaccagccagtacacctatgagatcgcccctgtgtttgtgctgatggaggaggaggtgctgaggaagctgcgggccctggtgggctggagcagtggagatggcatcttctgccctgggggcagcatcagcaacatgtatgctgtgaacctggcccgctaccagcgctacccagactgcaagcagaggggcctgcggaccctgccccccctggccctcttcaccagcaaagaatgccactacagcatccagaagggggccgccttcctgggcctgggcacagattctgtgcgggtggtgaaggcagatgagcggggcaagatggtgcctgaggacctggagcggcagatcggcatggccgaggccgagggcgctgtgcccttcctggtgtctgccaccagcggcaccaccgtgctgggcgcctttgaccccctggaggccatcgcagatgtgtgccagagacatggcctgtggctgcacgtggatgctgcctggggcggctctgtgctgctgagccagacccaccgccacctgctggatggcatccagagagctgacagcgtggcctggaacccccacaagctgctggccgccggcctgcagtgcagcgccctgctgctgcaggacaccagcaacctgctgaagcgctgccacggcagccaggccagctacctgttccagcaggacaagttctatgatgtggccctggacacaggagacaaggtggtgcagtgtggccggcgggtggactgcctgaagctgtggctgatgtggaaggcccagggcgaccagggcctggagaggagaattgaccaggcctttgtgctggcccgctacctggtggaggagatgaagaagcgggagggctttgagctggtgatggagcctgagtttgtgaatgtgtgcttctggtttgtgccccccagcctgcggggcaagcaggagagcccagactaccacgagcggctgagcaaggtggcccctgtgctgaaggagaggatggtgaaggagggctccatgatgattggctaccagccccacggcacccggggcaacttcttccgggtggtggtggccaacagcgccctgacctgtgccgacatggacttcctgctgaatgagctggagcggctgggccaggacctgtag

SEQ ID NO: 37859 - DNA, 459 bp, Artificial Sequence
  Description of Artificial Sequence: Synthetic coding sequence
atggctgacagcgaggccctgcccagcctggccggggaccctgtggccgtggaggccctgctgcgggctgtgtttggagtggtggtggatgaggccatccagaagggcacctctgtgtcccagaaggtgtgtgagtggaaggagcctgaggagctgaagcagctgctggacctggagctgcggagccagggcgagagccagaagcagatcctggagcgctgccgggccgtcatccgctacagcgtgaagacaggccacccccgcttcttcaaccagctgttcagcggcctggacccccacgccctggccggccgcatcatcacagagagcctgaacaccagccagtacacctatgagatcgcccctgtgtttgtgctgatggaggaggaggtgctgaggaagctgcgggccctggtgggctggagcagtggagatggcatcttctgccccggcctgtag

SEQ ID NO: 37860 - DNA, 804 bp, Artificial Sequence
  Description of Artificial Sequence: Synthetic coding sequence
atggctgacagcgaggccctgcccagcctggccggggaccctgtggccgtggaggccctgctgcgggctgtgtttggagtggtggtggatgaggccatccagaagggcacctctgtgtcccagaaggtgtgtgagtggaaggagcctgaggagctgaagcagctgctggacctggagctgcggagccagggcgagagccagaagcagatcctggagcgctgccgggccgtcatccgctacagcgtgaagacaggccacccccgcttcttcaaccagctgttcagcggcctggacccccacgccctggccggccgcatcatcacagagagcctgaacaccagccagtacacctatgagatcgcccctgtgtttgtgctgatggaggaggaggtgctgaggaagctgcgggccctggtgggctggagcagtggagatggcatcttctgccctgggggcagcatcagcaacatgtatgctgtgaacctggcccgctaccagcgctacccagactgcaagcagaggggcctgcggaccctgccccccctggccctcttcaccagcaaggaggtgggcaagaggcaccggcccaaccctggcctgctgatcctgatcagcagccacgtgaccacccccagcagaagagagctgcgcttctgggacctggcccccaccgtgtctgagtggagccggctgatgagggagggcaagtggagcccccgcatctggaggggccgcctggtgtggccccggctgcgggtgctgtgccgctcctggagcgtgccccccctggcccccctgtgctag

SEQ ID NO: 37861 - DNA, 300 bp, Artificial Sequence
  Description of Artificial Sequence: Synthetic coding sequence
atgagcagccagcagagcgctgtgtctgccaagggcttcagcaagggcagcagccagggccctgccccctgcccagccccagcccccaccccagccccagccagcagcagcagctgctgcggcagcggccggggctgctgcggggacagcggctgctgcggcagcagcagcaccagctgctgctgcttccccaggagaagaagacggcagaggagcagcggctgctgctgctgcggcggcggcagccagaggagccagaggagcaacaacagaagcagcggctgctgcagcggctgctag

SEQ ID NO: 37862 - DNA, 372 bp, Artificial Sequence
  Description of Artificial Sequence: Synthetic coding sequence
atggccagccacgtggagtgccggcccctgggcgtgtttgaatgtgagctgtgcaccctgacagccccctacagctatgtgggccagaagccacccaacacccagagcatggtgctgctggaggagagctatgtgatgaaggaccccttcaccagtgacaaggaccgcttcctggtgctgggcagctgctgcagcctgtgcagccggctggtgtgtgtgggccctgagtgcagcctcttctacagcaagcgcttctgcctgccctgtgtgcgggagaacatcaatgccttcccccaggagatccggcaggacctggagaagaggaaggcccccagcaagaggacccccagccagcccggcagcaggacatag

SEQ ID NO: 37863 - DNA, 1545 bp, Artificial Sequence
  Description of Artificial Sequence: Synthetic coding sequence
atgaaggaggccggccagatgcagaacctggagagcgcccgggccggccgctctgtgtccacccagacaggctccatgacaggccagatcccccggctgagcaaggtgaacctcttcaccctgctgagcctgtggatggagctgtttcctgctgaggcccagaggcagaagagccagaagaatgaggagggcaagcacggccccctgggggacaatgaggagaggaccagggtgtccacagacaagaggcaggtgaagaggacaggcctggtggtggtgaagaacatgaagatcgtgggcctgcactgcagcagcgaggacctgcacgccggccagatcgccctgatcaagcacggcagccggctgaagaactgtgacctgtacttcagcaggaagccctgcagcgcctgcctgaagatgattgtgaatgctggggtgaaccgcatctcctactggccagctgaccctgagatcagcctgctgacagaggccagcagcagtgaagatgccaagctggatgccaaggctgtggagcggctgaagagcaacagccgggcccacgtgtgtgtgctgctgcagcccctggtgtgctacatggtgcagtttgtggaggagaccagctacaagtgtgacttcatccagaagatcaccaagaccctgcctgatgccaacacagacttctactatgagtgcaagcaggagcgcatcaaggagtatgagatgctgttcctggtgtccaatgaggagatgcacaagcagatcctgatgaccatcggcctggagaacctgtgtgagaacccctacttcagcaacctgcggcagaacatgaaggacctgatcctgctgctggccaccgtggccagctctgtgcccaacttcaagcacttcggcttctaccgcagcaaccctgagcagatcaatgagatccacaaccagagcctgccccaggagatcgcccggcactgcatggtgcaggcccggctgctggcctacagaacagaggaccacaagacaggagtgggcgccgtcatctgggccgagggcaagagccgcagctgtgatggcaccggggccatgtactttgtgggctgcggctacaatgccttccctgtgggctctgaatatgctgacttcccccacatggatgacaagcagaaggaccgggagatcaggaagttccgctacatcatccatgctgagcagaatgccctgaccttccgctgccaggagatcaagccagaggagaggtccatgatctttgtgaccaagtgcccctgtgatgaatgtgtgcccctcatcaagggggccggcatcaagcagatctatgctggagatgtggatgtgggcaagaagaaggctgacatctcctacatgagatttggagagctggagggcgtgtccaagttcacctggcagctgaaccccagcggggcctacggcctggagcagaatgaacctgagcggcgggagaatggagtgctgcggcctgtgccccagaaggaggagcagcaccaggacaagaagctgcggctgggcatccactag

SEQ ID NO: 37864 - DNA, 951 bp, Artificial Sequence
  Description of Artificial Sequence: Synthetic coding sequence
atggtgcagtttgtggaggagaccagctacaagtgtgacttcatccagaagatcaccaagaccctgcctgatgccaacacagacttctactatgagtgcaagcaggagcgcatcaaggagtatgagatgctgttcctggtgtccaatgaggagatgcacaagcagatcctgatgaccatcggcctggagaacctgtgtgagaacccctacttcagcaacctgcggcagaacatgaaggacctgatcctgctgctggccaccgtggccagctctgtgcccaacttcaagcacttcggcttctaccgcagcaaccctgagcagatcaatgagatccacaaccagagcctgccccaggagatcgcccggcactgcatggtgcaggcccggctgctggcctacagaacagaggaccacaagacaggagtgggcgccgtcatctgggccgagggcaagagccgcagctgtgatggcaccggggccatgtactttgtgggctgcggctacaatgccttccctgtgggctctgaatatgctgacttcccccacatggatgacaagcagaaggaccgggagatcaggaagttccgctacatcatccatgctgagcagaatgccctgaccttccgctgccaggagatcaagccagaggagaggtccatgatctttgtgaccaagtgcccctgtgatgaatgtgtgcccctcatcaagggggccggcatcaagcagatctatgctggagatgtggatgtgggcaagaagaaggctgacatctcctacatgagatttggagagctggagggcgtgtccaagttcacctggcagctgaaccccagcggggcctacggcctggagcagaatgaacctgagcggcgggagaatggagtgctgcggcctgtgccccagaaggaggagcagcaccaggacaagaagctgcggctgggcatccactag

SEQ ID NO: 37865 - DNA, 462 bp, Artificial Sequence
  Description of Artificial Sequence: Synthetic coding sequence
atgaaggaggccggccagatgcagaacctggagagcgcccgggccggccgctctgtgtccacccagacaggctccatgacaggccagatcccccggctgagcaaggtgaacctcttcaccctgctgagcctgtggatggagctgtttcctgctgaggcccagaggcagaagagccagaagaatgaggagggcaagcacggccccctgggggacaatgaggagaggaccagggtgtccacagacaagaggcaggtgaagaggacaggcctggtggtggtgaagaacatgaagatcgtgggcctgcactgcagcagcgaggacctgcacgccggccagatcgccctgatcaagcacggcagccggctgaagaactgtgacctgtacttcagcaggaagccctgcagcgcctgcctgaagatgattgtgaatggcctgctggaggccgccaagatgcccaggtag

SEQ ID NO: 37866 - DNA, 1506 bp, Artificial Sequence
  Description of Artificial Sequence: Synthetic coding sequence
atggatgaaaataatggcctgctgctgctggagctgaacccccccaacccctgggacctgcagcccaggagccctgaggagctggccttcggggaggtgcagatcacctacctgacccacgcctgcatggacctgaagctgggggacaagaggatggtgtttgacccctggctgattggccctgcctttgcccggggctggtggctgctgcacgagcccccaagtgactggctggagcggctgtgccaggccgacctgatctacatcagccacctgcacagcgaccacctgagctaccccaccctgaagaagctggccggccggcggccagacatccccatctacgtgggcaacacagagaggcctgtgttctggaacctgaaccagagcggcgtgcagctgaccaacatcaacgtggtgcccttcggcatctggcagcaggtggacaagaacctgcgcttcatgatcctgatggatggagtgcaccctgagatggacacctgcatcatcgtggagtacaagggccacaagatcctgaacatcgtggactgcacccggcccaacggcggccgcctgcccatgaaggtggccctgatgatgtctgactttgctgggggcgccagcggcttccccatgaccttcagcggcggcaagttcacagaggagtggaaggcccagttcatcaagacagagaggaagaagctgctgaactacaaggcccggctggtgaagaacctgcagccccgcatctactgcccctttgctggctactttgtggagagccaccccagcgacaagtacatcaaggagaccaacaccaagaatgaccccaatgagctgaacaacctgatcaagaagaacagtgatgtgatcacctggacccccaggcctggggccaccctggacctgggccgcatgctgaaggacagaacagacagcaagggcatcatcgagcccccagagggcaccaagatctacaaggacagctgggactttgagccctacctggagatcctgaatgctgccctgggagatgagatcttcctgcacagctcctggatcaaggagtacttcacctgggccggcttcaaggactacaacctggtggtgaggatgattgaaacagatgaggacttcaaccccttccctgggggctatgactacctggtggacttcctggacctgtccttccccaaggagcggccccagcgggagcacccctatgaggagatccacagccgggtggatgtgatccgccacgtggtgaagaatggcctgctgtgggatgagctgtacatcggcttccagacccggctgcagagggaccctgacatctaccaccacctgttctggaaccacttccagatcaagctgcccctgaccccacccaactggaagagcttcctgatgtgctgtgagcagaatggacctgtgatcctgcagttcagcacagagaggaccaatgagcccaacagaaacaagttctctgtggagaacaaggcctag

SEQ ID NO: 37867 - DNA, 1461 bp, Artificial Sequence
  Description of Artificial Sequence: Synthetic coding sequence
atggatgaaaataatggcctgctgctgctggagctgaacccccccaacccctgggacctgcagcccaggagccctgaggagctggccttcggggaggtgcagatcacctacctgacccacgcctgcatggacctgaagctgggggacaagaggatggtgtttgacccctggctgattggccctgcctttgcccggggctggtggctgctgcacgagcccccaagtgactggctggagcggctgtgccaggccgacctgatctacatcagccacctgcacagcgaccacctgagctaccccaccctgaagaagctggccggccggcggccagacatccccatctacgtgggcaacacagagaggcctgtgttctggaacctgaaccagagcggcgtgcagctgaccaacatcaacgtggtgcccttcggcatctggcagcaggtggacaagaacctgcgcttcatgatcctgatggatggagtgcaccctgagatggacacctgcatcatcgtggagtacaagggccacaagatcctgaacatcgtggactgcacccggcccaacggcggccgcctgcccatgaaggtggccctgatgatgtctgactttgctgggggcgccagcggcttccccatgaccttcagcggcggcaagttcacagaggagtggaaggcccagttcatcaagacagagaggaagaagctgctgaactacaaggcccggctggtgaagaacctgcagccccgcatctactgcccctttgctggctactttgtggagagccaccccagcgacaagtacatcaaggagaccaacaccaagaatgaccccaatgagctgaacaacctgatcaagaagaacagtgatgtgatcacctggacccccaggcctggggccaccctggacctgggccgcatgctgaaggacagaacagacagcaagggcatcatcgagcccccagagggcaccaagatctacaaggacagctgggactttgagccctacctggagatcctgaatgctgccctgggagatgagatcttcctgcacagctcctggatcaaggagtacttcacctgggccggcttcaaggactacaacctggtggtgaggatgattgaaacagatgaggacttcaaccccttccctgggggctatgactacctggtggacttcctggacctgtccttccccaaggagcggccccagcgggagcacccctatgaggagatccacagccgggtggatgtgatccgccacgtggtgaagaatggcctgctgtgggatgagctgtacatcggcttccagacccggctgcagagggaccctgacatctaccaccacctgttctggaaccacttccagatcaagctgcccctgaccccacccaactggaagagcttcctgatgtgctgtgagcagaatggacctgtgatcctgcaggagtgcaagaccacctag

SEQ ID NO: 37868 - DNA, 663 bp, Artificial Sequence
  Description of Artificial Sequence: Synthetic coding sequence
atggatgaaaataatggcctgctgctgctggagctgaacccccccaacccctgggacctgcagcccaggagccctgaggagctggccttcggggaggtgcagatcacctacctgacccacgcctgcatggacctgaagctgggggacaagaggatggtgtttgacccctggctgattggccctgcctttgcccggggctggtggctgctgcacgagcccccaagtgactggctggagcggctgtgccaggccgacctgatctacatcagccacctgcacagcgaccacctgagctaccccaccctgaagaagctggccggccggcggccagacatccccatctacgtgggcaacacagagaggcctgtgttctggaacctgaaccagagcggcgtgcagctgaccaacatcaacgtggtgcccttcggcatctggcagcaggtggacaagaacctgcgcttcatgatcctgatggatggagtgcaccctgagatggacacctgcatcatcgtggagtacaagggccacaagatcctgaacatcgtggactgcacccggcccaacggcggccgcctgcccatgaaggtggccctgatgatgtctgactttgctgggggcgccagcggcttccccatgaccttcagcggcggcaagttcacctag

SEQ ID NO: 37869 - DNA, 681 bp, Artificial Sequence
  Description of Artificial Sequence: Synthetic coding sequence
atggatgaaaataatggcctgctgctgctggagctgaacccccccaacccctgggacctgcagcccaggagccctgaggagctggccttcggggaggtgcagatcacctacctgacccacgcctgcatggacctgaagctgggggacaagaggatggtgtttgacccctggctgattggccctgcctttgcccggggctggtggctgctgcacgagcccccaagtgactggctggagcggctgtgccaggccgacctgatctacatcagccacctgcacagcgaccacctgagctaccccaccctgaagaagctggccggccggcggccagacatccccatctacgtgggcaacacagagaggcctgtgttctggaacctgaaccagagcggcgtgcagctgaccaacatcaacgtggtgcccttcggcatctggcagcaggtggacaagaacctgcgcttcatgatcctgatggatggagtgcaccctgagatggacacctgcatcatcgtggagtacaagggccacaagatcctgaacatcgtggactgcacccggcccaacggcggccgcctgcccatgaaggtggccctgatgatgtctgactttgctgggggcgccagcggcttccccatgaccttcagcggcggcaagttcaccgctgaggagaccctcatctag

SEQ ID NO: 37870 - DNA, 1506 bp, Artificial Sequence; identical to SEQ ID NO: 37866
  Description of Artificial Sequence: Synthetic coding sequence

SEQ ID NO: 37871 - DNA, 522 bp, Artificial Sequence
  Description of Artificial Sequence: Synthetic coding sequence
atggatgaaaataatggcctgctgctgctggagctgaacccccccaacccctgggacctgcagcccaggagccctgaggagctggccttcggggaggtgcagatcacctacctgacccacgcctgcatggacctgaagctgggggacaagaggatggtgtttgacccctggctgattggccctgcctttgcccggggctggtggctgctgcacgagcccccaagtgactggctggagcggctgtgccaggccgacctgatctacatcagccacctgcacagcgaccacctgagctaccccaccctgaagaagctggccggccggcggccagacatccccatctacgtgggcaacacagagaggcctgtgttctggaacctgaaccagagcggcgtgcagctgaccaacatcaacgtggtgcccttcggcatctggcagcaggtggacaagaacctgcgcttcatgatcctgatggatggagtgcaccctgagatggacacctgcatcatcgtggagtactag

SEQ ID NO: 37872 - DNA, 687 bp, Artificial Sequence
  Description of Artificial Sequence: Synthetic coding sequence
atgccccggcggggcctggtggccggccctgacctggagtacttccagaggcgctacttcaccccagctgaggtggcccagcacaacagacctgaggacctgtgggtgtcctacctgggccgggtgtatgacctgaccagcctggcccaggagtacaagggcaacctgctgctgaagcccatcgtggaggtggccggccaggacatcagccactggtttgaccccaagacccgggacatcaggaagcacatcgaccccctgaccggctgcctgcgctactgcaccccccggggccgctttgtgcacgtgcccccccagctgccctgcagcgactgggccaatgactttgggaagccctggtggcagggcagctactatgaggtgggccgcctgagcgccaagaccaggagcatccgcatcatcaacaccctgaccagccaggagcacaccctggaggtgggcgtgctggagagcatctgggagatcctgcaccgctacctgccctacaacagccatgctgccagctacacctggaagtatgagggcaagaacctgaacatggacttcaccctggaggagaatggcatcagagatgaggaggaggagtttgactacctgtccatggatggcaccctgcacaccccagccatcctgctgtacttcaatgatgacctgacagagctgtag

SEQ ID NO: 37873 - DNA, 474 bp, Artificial Sequence
  Description of Artificial Sequence: Synthetic coding sequence
atgccccggcggggcctggtggccggccctgacctggagtacttccagaggcgctacttcaccccagctgaggtggcccagcacaacagacctgaggacctgtgggtgtcctacctgggccgggtgtatgacctgaccagcctggcccaggagtacaagggcaacctgctgctgaagcccatcgtggaggtggccggccaggacatcagccactggtttgaccccaagacccgggacatcaggaagcacatcgaccccctgaccggctgcctgcgctactgcaccccccggggccgctttgtgcacgtgcccccccagctgccctgcagcgactgggccaatgactttgggaagccctggtggcagggcagctactatgaggtgggccgcctgagcgccaagaccaggagcatccgcatcatcaacaccctgaccagccaggagcacaccctggagatccacgaggagctgtag

SEQ ID NO: 37874 - DNA, 744 bp, Artificial Sequence
  Description of Artificial Sequence: Synthetic coding sequence
atgatggccgagcgggaggaggatgatgacacagaggaggcctggatgcagctgcggcccacagagcccctgcccagccagtgctgcggcagcggctgcagcccctgtgtgtttgacctgtaccaccgggacctggcccgctgggaggccgcccaggccagcaaggacaggagcctgctgcggggccctgagagccagagctgccccagcaagctgaaccctgagacctttgtggccttctgcatcatcgccatggaccggctgaccaaggacacctacagagtgcgctttgccctgcccggcaacagccagctgggcctgcggcccggccagcacctgatcctgcggggcatcgtggatgacctggagatccagagggcctacacccccatcagccctgccaatgctgagggctactttgaggtgctgatcaagtgctaccagatgggcctgatgagccgctacgtggagagctggagggtgggggacacagccttctggaggggcccctttggagacttcttctacaagcccaaccaggagagcagcagcgagcagctgccctggagctaccaggagaagacccacttcggccacctgggccaggacctgatcaaggagctggtgtcctgctgcaggaggaagccctttgccctggtgtgtggcagcgctgagttcaccaaggacatcgcccgctgcctgctgtgtgccggcctgacagaagattcctacttcctgttctag

SEQ ID NO: 37875 - DNA, 504 bp, Artificial Sequence
  Description of Artificial Sequence: Synthetic coding sequence
atgggcctgatgagccgctacgtggagagctggagggtgggggacacagccttctggaggggcccctttggagacttcttctacaagcccaaccagtatggagagctgctgctgctggccgccggcaccggcctggcccccatggtgcccatcctgcagagcatcacagacaatgaaaatgatgagacctttgtgaccctggtgggctgcttcaagacctttgagagcatctacctgaagaccttcctgcaggagcaggcccgcttctggaatgtgaggaccttctttgtgctgagccaggagagcagcagcgagcagctgccctggagctaccaggagaagacccacttcggccacctgggccaggacctgatcaaggagctggtgtcctgctgcaggaggaagccctttgccctggtgtgtggcagcgctgagttcaccaaggacatcgcccgctgcctgctgtgtgccggcctgacagaagattcctacttcctgttctag

SEQ ID NO: 37876 - DNA, 948 bp, Artificial Sequence
  Description of Artificial Sequence: Synthetic coding sequence
atgatggccgagcgggaggaggatgatgacacagaggaggcctggatgcagctgcggcccacagagcccctgcccagccagtgctgcggcagcggctgcagcccctgtgtgtttgacctgtaccaccgggacctggcccgctgggaggccgcccaggccagcaaggacaggagcctgctgcggggccctgagagccagagctgccccagcaagctgaaccctgagacctttgtggccttctgcatcatcgccatggaccggctgaccaaggacacctacagagtgcgctttgccctgcccggcaacagccagctgggcctgcggcccggccagcacctgatcctgcggggcatcgtggatgacctggagatccagagggcctacacccccatcagccctgccaatgctgagggctactttgaggtgctgatcaagtgctaccagatgggcctgatgagccgctacgtggagagctggagggtgggggacacagccttctggaggggcccctttggagacttcttctacaagcccaaccagtatggagagctgctgctgctggccgccggcaccggcctggcccccatggtgcccatcctgcagagcatcacagacaatgaaaatgatgagacctttgtgaccctggtgggctgcttcaagacctttgagagcatctacctgaagaccttcctgcaggagcaggcccgcttctggaatgtgaggaccttctttgtgctgagccaggagagcagcagcgagcagctgccctggagctaccaggagaagacccacttcggccacctgggccaggacctgatcaaggagctggtgtcctgctgcaggaggaagccctttgccctggtgtgtggcagcgctgagttcaccaaggacatcgcccgctgcctgctgtgtgccggcctgacagaagattcctacttcctgttctag

SEQ ID NO: 37877 - DNA, 417 bp, Artificial Sequence
  Description of Artificial Sequence: Synthetic coding sequence
atgatggccgagcgggaggaggatgatgacacagaggaggcctggatgcagctgcggcccacagagcccctgcccagccagtgctgcggcagcggctgcagcccctgtgtgtttgacctgtaccaccgggacctggcccgctgggaggccgcccaggccagcaaggacaggagcctgctgcggggccctgagagccagagctgccccagcaagctgaaccctgagacctttgtggccttctgcatcatcgccatggaccggctgaccaaggacacctacagagtgcgctttgccctgcccggcaacagccagctgggcctgcggcccggccagcacctgatcctgcgctacacccaggtggccggcggccccaagctgcacagccctgccctgctgtttgccagctgctggccctag

SEQ ID NO: 37878 - DNA, 948 bp, Artificial Sequence; identical to SEQ ID NO: 37876
  Description of Artificial Sequence: Synthetic coding sequence

SEQ ID NO: 37879 - DNA, 744 bp, Artificial Sequence; identical to SEQ ID NO: 37874
  Description of Artificial Sequence: Synthetic coding sequence

SEQ ID NO: 37880 - DNA, 948 bp, Artificial Sequence; identical to SEQ ID NO: 37876
  Description of Artificial Sequence: Synthetic coding sequence

SEQ ID NO: 37881 - DNA, 246 bp, Artificial Sequence
  Description of Artificial Sequence: Synthetic coding sequence
atgagccgcagcagcaaggtggtgctgggcctgtctgtgctgctgacagctgccaccgtggccggcgtgcacgtgaagcagcagtgggaccagcagaggctgagagatggagtcatccgggacatcgagcggcagatcaggaagaaggagaacatccggctgctgggggagcagatcatcctgacagagcagctggaggccgagcgggagaagatgctgctggccaagggcagccagaagagctag

SEQ ID NO: 37882 - DNA, 810 bp, Artificial Sequence
  Description of Artificial Sequence: Synthetic coding sequence
ggcctgctgctggtggccctgctggccagcctgactgtgatggtgctgatgtctgtgtggcagcagaggaagagccggggcaagctgcccctgggccccacccccctgctcttcatcggcaactacctgcagctgaacacagagcacatctgtgacagcatcatgaagatcagcgagagatatggccctgtgttcaccatccacctgggcccccggcgggtggtggtgctgtgtggccatgatgctgtgaaggaggccctggtggaccaggccgaggagttcagcggccgcggggagcaggccacctttgactggctgttcaagggctacggcgtgacctgcaggacctgggagaggaccaagcccctgcggcgcttcagcatcgccaccctgcgggactttggagtgggcaagaggggcatcaaggagatccaggagaaggccggcttcctgatcaaggcccaccagagcagtgacagcagcatctaccccaccttcttcctgagcaggaccaccagcaatgtcatcagcagcatcgtgtttggagacagatttgattatgaggacaagttcctgagcctgctgtgcatgatgctggagagcttccagttcaccgcccccagcacaggccagctgtatgagatgttcagctctgtgatgaagcacctgcccggcccccagcagcaggccttcaaggagctgcagggcctggaggacttcatcgccaagaaggtggagcacaaccagtgcaccctggaccccaacagcccccgggacttcatcgacagcttcctgatccgcatgcagtag

SEQ ID NO: 37883 - DNA, 1338 bp, Artificial Sequence
  Description of Artificial Sequence: Synthetic coding sequence
atgggcctggaggccctggtgcccctggccatgattgtggccatcttcctgctgctggtggacctgatgcaccgccaccagcgctgggccgcccgctacccacctggccccctgcccctgcccggcctgggcaacctgcacgtggacttccagaacaccccctactgctttgaccagctgcggaggagatttggagatgtgttcagcctgcagctggcctggacccctgtggtggtgctgaatggcctggccgctgtgcgggaggccatggtgaccagaggagaggacacagctgaccggcccccagcccccatctaccaggtgctgggcttcggccccaggagccagggccggcccttccggcccaacggcctgctggacaaggctgtgtccaatgtcatcgccagcctgacctgtggcagaagatttgaatatgatgacccccgcttcctgcggctgctggacctggcccaggagggcctgaaggaggagagcggcttcctgcgggaggtgctgaatgctgtgcctgtgctgctgcacatcccagccctggccggcaaggtgctgcgcttccagaaggccttcctgacccagctggatgagctgctgacagagcacaggatgacctgggaccctgcccagcccccccgggacctgacagaggccttcctggccaagaaggagaaggccaagggcagccctgagagcagcttcaatgatgagaacctgagaattgtggtgggcaacctcttcctggccggcatggtgaccaccctgaccaccctggcctggggcctgctgctgatgatcctgcacctggatgtgcagctgcgggtgcagcaggagattgatgatgtgattggccaggtgagaagacctgagatgggagaccaggcccacatgccctacaccacagctgtgattcatgaggtgcagagatttggagacatcatccccctgtctgtgacccacatgaccagccatgacatcgaggtgcagggcttccgcatccccaagggcaccaccctcatcaccaacctgagctctgtgctgaaggatgaagctgtgtggaagaagcccttccgcttccaccctgagcacttcctggatgcccagggccactttgtgaagccagaggccttcctgcccttctctgctggccggcgggcctgcctgggggagcccctggccaggatggagctgttcctgttcttcaccagcctgctgcagcacttctccttctctgtggccgccggccagccccggcccagccacagccgggtggtgtccttcctggtgacccccagcccctatgagctgtgtgctgtgcccaggtag

SEQ ID NO: 37884 - DNA, 1332 bp, Artificial Sequence
  Description of Artificial Sequence: Synthetic coding sequence
caggaggccctgaccctgcccctgcagctgcggaggagatttggagatgtgttcagcctgcagctggcctggacccctgtggtggtgctgaatggcctggccgctgtgcgggaggccatggtgaccagaggagaggacacagctgaccggcccccagcccccatctaccaggtgctgggcttcggcccccgggagcagtgggtgttcctgagccgctatggccctgcctggagggagcagaggcgcttctctgtgtccaccctgaggaacctgggcctgggcaagaagagcctggagcagtgggtgacagaggaggccgcctgcctgtgtgccgcctttgctgaccaggatgccccctttgcccccaccgtgtcctggaccaagcccaacgtcatcgccagcctgacctgtggcagaagatttgaatatgatgacccccgcttcctgcggctgctggacctggcccaggagggcctgaaggaggagagcggcttcctgcgggaggtgctgaatgctgtgcctgtgctgctgcacatcccagccctggccggcaaggtgctgcgcttccagaaggccttcctgacccagctggatgagctgctgacagagcacaggatgacctgggaccctgcccagcccccccgggacctgacagaggccttcctggccaagaaggagaaggccaagggcagccctgagagcagcttcaatgatgagaacctgagaattgtggtgggcaacctcttcctggccggcatggtgaccaccctgaccaccctggcctggggcctgctgctgatgatcctgcacctggatgtgcagctgcgggtgcagcaggagattgatgatgtgattggccaggtgagaagacctgagatgggagaccaggcccacatgccctacaccacagctgtgattcatgaggtgcagagatttggagacatcatccccctgtctgtgacccacatgaccagccatgacatcgaggtgcagggcttccgcatccccaagggcaccaccctcatcaccaacctgagctctgtgctgaaggatgaagctgtgtggaagaagcccttccgcttccaccctgagcacttcctggatgcccagggccactttgtgaagccagaggccttcctgcccttctctgctggccggcgggcctgcctgggggagcccctggccaggatggagctgttcctgttcttcaccagcctgctgcagcacttctccttctctgtggccgccggccagccccggcccagccacagccgggtggtgtccttcctggtgacccccagcccctatgagctgtgtgctgtgcccaggtag

SEQ ID NO: 37885 - DNA, 1491 bp, Artificial Sequence
  Description of Artificial Sequence: Synthetic coding sequence
atgggcctggaggccctggtgcccctggccatgattgtggccatcttcctgctgctggtggacctgatgcaccgccaccagcgctgggccgcccgctacccacctggccccctgcccctgcccggcctgggcaacctgcacgtggacttccagaacaccccctactgctttgaccagctgcggaggagatttggagatgtgttcagcctgcagctggcctggacccctgtggtggtgctgaatggcctggccgctgtgcgggaggccatggtgaccagaggagaggacacagctgaccggcccccagcccccatctaccaggtgctgggcttcggcccccgggagcagtgggtgttcctgagccgctatggccctgcctggagggagcagaggcgcttctctgtgtccaccctgaggaacctgggcctgggcaagaagagcctggagcagtgggtgacagaggaggccgcctgcctgtgtgccgcctttgctgaccaggccggccggcccttccggcccaacggcctgctggacaaggctgtgtccaatgtgattgccagcctgacctgtggccgccgctttgaatatgatgacccccgcttcctgcggctgctggacctggcccaggagggcctgaaggaggagagcggcttcctgcgggaggtgctgaatgctgtgcctgtgctgctgcacatcccagccctggccggcaaggtgctgcgcttccagaaggccttcctgacccagctggatgagctgctgacagagcacaggatgacctgggaccctgcccagcccccccgggacctgacagaggccttcctggccaagaaggagaaggccaagggcagccctgagagcagcttcaatgatgagaacctgcgcatcgtggtgggcaacctcttcctggccggcatggtgaccaccctgaccaccctggcctggggcctgctgctgatgatcctgcacctggatgtgcagctgcgggtgcagcaggagattgatgatgtgattggccaggtgcggcggcctgagatgggagaccaggcccacatgccctacaccacagctgtgatccacgaggtgcagagatttggagacatcatccccctgtctgtgacccacatgaccagccatgacatcgaggtgcagggcttccgcatccccaagggcaccaccctcatcaccaacctgagctctgtgctgaaggatgaggccgtgtggaagaagcccttccgcttccaccctgagcacttcctggatgcccagggccactttgtgaagccagaggccttcctgcccttctctgctggaagaagagcctgcctgggggagcccctggccaggatggagctgttcctgttcttcaccagcctgctgcagcacttctccttctctgtggccgccggccagccccggcccagccacagccgggtggtgtccttcctggtgacccccagcccctatgagctgtgtgctgtgcccaggtag

SEQ ID NO: 37886 - DNA, 1224 bp, Artificial Sequence
  Description of Artificial Sequence: Synthetic coding sequence
atggtgaccagaggagaggacacagctgaccggcccccagcccccatctaccaggtgctgggcttcggccccaggagccagggcgtcttcctgagccgctatggccctgcctggagggagcagaggcgcttctctgtgtccaccctgaggaacctgggcctgggcaagaagagcctggagcagtgggtgacagaggaggccgcctgcctgtgtgccgcctttgctgaccaggccggccggcccttccggcccaacggcctgctggacaaggctgtgtccaatgtcatcgccagcctgacctgtggcagaagatttgaatatgatgacccccgcttcctgcggctgctggacctggcccaggagggcctgaaggaggagagcggcttcctgcgggaggtgctgaatgctgtgcctgtgctgctgcacatcccagccctggccggcaaggtgctgcgcttccagaaggccttcctgacccagctggatgagctgctgacagagcacaggatgacctgggaccctgcccagcccccccgggacctgacagaggccttcctggccaagaaggagaaggccaagggcagccctgagagcagcttcaatgatgagaacctgagaattgtggtgggcaacctcttcctggccggcatggtgaccaccctgaccaccctggcctggggcctgctgctgatgatcctgcacctggatgtgcagctgcgggtgcagcaggagattgatgatgtgattggccaggtgagaagacctgagatgggagaccaggcccacatgccctacaccacagctgtgattcatgaggtgcagagatttggagacatcatccccctgtctgtgacccacatgaccagccatgacatcgaggtgcagggcttccgcatccccaagggcaccaccctcatcaccaacctgagctctgtgctgaaggatgaagctgtgtggaagaagcccttccgcttccaccctgagcacttcctggatgcccagggccactttgtgaagccagaggccttcctgcccttctctgctggccggcgggcctgcctgggggagcccctggccaggatggagctgttcctgttcttcaccagcctgctgcagcacttctccttctctgtggccgccggccagccccggcccagccacagccgggtggtgtccttcctggtgacccccagcccctatgagctgtgtgctgtgcccaggtag

SEQ ID NO: 37887 - DNA, 429 bp, Artificial Sequence
  Description of Artificial Sequence: Synthetic coding sequence
cagctgcggaggagatttggagatgtgttcagcctgcagctggcctggacccctgtggtggtgcagtgggccggcggccgggcccggggagatggagacccccggcggggccacggccggcccccagcctgtgcccacctgcccggggaccccctgcctgccagccccacccccaggacccccctgagcccccagaggagcctgggccagagccgggagcagagggaccggctgccccacctgcgggcccccctgcgggtgcggcggcccagcctgccccaggccgccggccccagcagcggcggcacagaaggaggagtgggcctgcctgcccggggagctgagtgctgcccccggcccccagcccaccccagcgctggctggcagggccccaccctgcccaagggcttcccagaccctgctggatag

SEQ ID NO: 37888 - DNA, 510 bp, Artificial Sequence
  Description of Artificial Sequence: Synthetic coding sequence
aagatccacgaggagatcaaccaggtgattggcccccaccggctgccccgggtggatgacagagtgaagatgccctacacagatgtggtgatccacgagatccagaggctggtggacatcgtgcccatgggcgtgccccacaacatcatccaggacacccagttccggggctacctgctgcccaagggcacagatgtgttccccctgctgggctctgtgctgaaggaccccaagtacttccgctacccagatgccttctacccccagcacttcctggatgagcagggccgcttcaagaagaatgaggcctttgtgcccttcagcagcggcaagaggatctgcctgggggaggccatggccaggatggagctgttcctgtacttcaccagcaccctgcagaacttcagcctgtgcagcctggtgcccctggtggacatcgacatcacccccaagctgagcggctttggaaacatcacccccacctatgagctgtgcctggtggccaggtag

SEQ ID NO: 37889 - DNA, 1119 bp, Artificial Sequence
  Description of Artificial Sequence: Synthetic coding sequence
atgaggtctgtgctgcggcagaggatcctgaagcccaaggatgtggccatctacagcggggaggtgaaccaggtgattgctgacctgatcaagaggatctacctgctgcggagccaggctgaagatggagaaacagtgaccaacgtgaatgacctcttcttcaagtacagcatggagggcgtggccaccatcctgtatgagagccggctgggctgcctggagaacagcatcccccagctgactgtggagtacatcgaggccctggagctgatgttctccatgttcaagacctccatgtatgctggggccatcccccgctggctgcggcccttcatccccaagccctggagggagttctgccgctcctgggatggcctcttcaagttcagccagatccacgtggacaacaagctgcgggacatccagtaccagatggaccggggcagaagagtgtctgggggcctgctgacctacctgttcctgagccaggccctgaccctgcaggagatctatgccaacgtgacagagatgctgctggccggcgtggacaccaccagcttcaccctgtcctggacagtgtacctgctggcccggcaccctgaggtgcagcagacagtgtaccgggagatcgtgaagaacctgggggagcggcacgtgcccacagctgctgatgtgcccaaggtgcccctggtgcgggccctgctgaaggagaccctgcggctcttccctgtgctgcctggaaatggccgggtgacccaggaggacctggtgattggaggctacctgatccccaagggcacccagctggccctgtgccactacgccaccagctaccaggatgagaacttcccccgggccaaggagttccggcctgagcgctggctgaggaaaggagacctggacagagtggacaactttggcagcatcccctttggacatggagtgcgcagctgcattggaagaagaattgctgagctggagatccacctggtggtgatccagctgctgcagcactttgagatcaagaccagcagccagaccaatgctgtgcacgccaagacccacggcctgctgacccctgggggccccatccacgtgcgctttgtgaacaggaagtag

SEQ ID NO: 37890 - DNA, 1119 bp, Artificial Sequence; identical to SEQ ID NO: 37889
  Description of Artificial Sequence: Synthetic coding sequence

SEQ ID NO: 37891 - DNA, 357 bp, Artificial Sequence
  Description of Artificial Sequence: Synthetic coding sequence
atggtgaccccagctggctgcctgggcggcaggaaccagggcccccgggagatccctggaacagccttccccaggagcagcagagctggccagacaggccaggccgtgtctggggcccaggtgtcctcctggagggagcggcagccctgcagcggcagccggggccccctgcacatcctgggcacagatggaaatgtggacaccaccgggaagctgggcctggtgcccaccccaccccgcatccagaaggagaccaagcagggcgccctgtgtggcatgaagccacccttcctgcctgaggccctgctgattgtgtggtggctgccctttgtggccgtgagcccctgcctcttctag

SEQ ID NO: 37892 - DNA, 1194 bp, Artificial Sequence
  Description of Artificial Sequence: Synthetic coding sequence
atggaggaggatgacagctatgtgcccagcgacctgacagctgaggagcggcaggagctggagaacatcagaagaaggaagcaggagctgctggccgacatccagaggctgaaggatgaaattgctgaggtggccaatgaaattgagaacctgggcagcacagaggagaggaagaacatgcagaggaacaagcaggtggccatgggcaggaagaagttcaacatggaccccaagaagggcatccagttcctgattgaaaatgacctgctgaagaacacctgtgaagatattgcccagttcctgtacaagggggagggcctgaacaagacagccatcggggactacctgggggagagagatgagttcaacatccaggtgctgcacgcctttgtggagctgcacgagttcacagacctgaacctggtgcaggccctgcggcagttcctgtggagcttccggctgcctggagaggcccagaagattgacaggatgatggaggcctttgcccagcgctactgccagtgcaacaatggagtcttccagagcacagacacctgctacgtgctgagctttgccatcatcatgctgaacaccagcctgcacaaccccaacgtgaaggacaagcccaccgtggagcgcttcatcgccatgaacagaggcatcaatgatggaggagacctgcctgaggagctgctgaggaacctgtatgagagcatcaagaatgagcccttcaagatcccagaagatgatggaaatgacctgacccacaccttcttcaacccagaccgggagggctggctgctgaagctgggcggccgggtgaagacctggaagaggcgctggttcatcctgacagacaactgcctgtactactttgagtacaccacagacaaggagccccggggcatcatccccctggagaacctgagcatccgggaggtggaggacagcaagaagcccaactgctttgagctgtacatcccagacaacaaggaccaggtgatcaaggcctgcaagacagaagcagatggccgggtggtggagggcaaccacacagtgtaccgcatcagcgcccccaccccagaggagaaggaggagtggatcaagtgcatcaaggccgccatcagccgggaccccttctatgagatgctggccgccaggaagaagaaggtgagcagcaccaagaggcactag

SEQ ID NO: 37893 - DNA, 465 bp, Artificial Sequence
  Description of Artificial Sequence: Synthetic coding sequence
atggacctgtgccaccctgagcctgctgagctgagcagtggagaaacagaggagctgcagaggatcaagtggcacaggaagcagctgctggaggacatccagaagctgaaggatgaaattgctgatgtgtttgcccagattgactgctttgagagcgctgaggagagcaggatggcccagaaggagaaggagctgtgcattggaaggaagaagttcaacatggaccctgccaagggcatccagtacttcatcgagcacaagctgctgaccccagatgtgcaggacatcgcccgcttcctgtacaagggggagggcctgaacaagacagccatcggcacctacctgggggagcgggaccccatcaacctgcaggtgctgcaggcctttgtggactgccatgaatttgccaacctgaacctggtgcaggccctgcgggtggtgaagaccaagtgggagagcgtgtag

SEQ ID NO: 37894 - DNA, 777 bp, Artificial Sequence
  Description of Artificial Sequence: Synthetic coding sequence
atggccgagtacagctatgtgaagagcaccaagctggtgctgaagggcaccaagaccaagagcaagaagaagaagagcaaggacaagaagaggaagcgggaggaggatgaggagacccagctggacatcgtgggcatctggtggacagtgaccaactttggagagatcagcggcaccatcgccatcgagatggacaagggcacctacatccacgccctggacaatggcctcttcaccctgggcgccccccacaaggaggtggatgagggccccagccccccagagcagttcaccgctgtgaagctgagtgacagcagaattgccctgaagagcggctacggcaagtacctgggcatcaacagtgatggcctggtggtgggccgcagtgatgccatcggcccccgggagcagtgggagcccgtcttccagaatggcaagatggccctgctggccagcaacagctgcttcatccgctgcaatgaggccggggacatcgaggccaagagcaagacagctggggaggaggagatgatcaagatccgcagctgtgccgagcgggagaccaagaagaaggatgacatcccagaagaagataaaggaaatgtgaagcagtgtgagatcaactacgtgaagaagttccagagcttccaggaccacaagctgaagatcagcaaggaggacagcaagatcctgaagaaggccaggaaggatggcttcctgcacgagaccctgctggacagaagagccaagctgaaggctgaccgctactgcaagtag

SEQ ID NO: 37895 - DNA, 1179 bp, Artificial Sequence
  Description of Artificial Sequence: Synthetic coding sequence
atgaacccccggggcaacaggaagaccaccaaggagggcagcaatgacctgaagttccagaacttcagcctgcccaagaacagatcctggccccgcatcaacagcgccaccggccagtaccagaggatgaacaagcccctgctggactgggagaggaactttgctgctgtgctggatggagccaagggccacagtgatgatgattatgatgatcctgagctgaggatggaggagacctggcagagcatcaagatcctgcctgcccggcccatcaaggagagtgaatatgctgacacccactacttcaaggtggccatggacacccccctgcccctggacaccaggaccagcatcagcatcggccagcccacctggaacacccagacccggctggagcgggtggacaagcccatcagcaaggatgtgcgcagccagaacatccggccccccctgagccagaggcacaccttccctgaggtgcagaggatgcccagccagatcagcctgcgggacctgtctgagagcctggaggccaagaaggtgccccacaaccagaggaagccagagagcacccacctgctggagaaccagaacacccaggagatccccctggccatcagcagcagcagcttcaccaccagcaaccacagcgtgcagaacagagaccacagaggaggcatgcagccctgcagcccccagcgctgccagcccccagccagctgcagcccccatgagaacatcctgccctacaagtacacctcctggaggcctcccttccccaagagaagtgacaggaaggatgtgcagcacaatgagtggtacatcggggagtacagccggcaggccgtggaggaggccttcatgaaggagaacaaggatggcagcttcctggtgcgggactgcagcaccaagagcaaggaggagccctacgtgctggccgtgttctatgagaacaaggtgtacaacgtgaagatccgcttcctggagaggaaccagcagtttgccctgggcaccggcctgcggggagatgagaagtttgacagcgtggaggacatcatcgagcactacaagaacttccccatcatcctgattgatggcaaggacaagacaggagtgcacaggaagcagtgccacctgacccagcccctgcccctgaccaggcacctgctgcccctgtag

SEQ ID NO: 37896 - DNA, 510 bp, Artificial Sequence
  Description of Artificial Sequence: Synthetic coding sequence
atgaacaagcccctgctggactgggagaggaactttgctgctgtgctggatggagccaagggccacagtgatgatgattatgatgatcctgagctgaggatggaggagacctggcagagcatcaagatcctgcctgcccggcccatcaaggagagtgaatatgctgacacccactacttcaaggtggccatggacacccccctgcccctggacaccaggaccagcatcagcatcggccagcccacctggaacacccagacccggctggagcgggtggacaagcccatcagcaaggatgtgcgcagccagaacatcaagggagatgcctctgtgaggaagaacaagatccccctgcccccaccccggcccctcatcaccctgcccaagaagtaccagcccctgcccccagagcctgagagcagcaggcctcccctgagccagaggcacaccttccctgaggtgcagaggatgcccagccagatcagcctgcgggacctgtctgagccctag

SEQ ID NO: 37897 - DNA, 510 bp, Artificial Sequence; identical to SEQ ID NO: 37896
  Description of Artificial Sequence: Synthetic coding sequence

SEQ ID NO: 37898 - DNA, 1695 bp, Artificial Sequence
  Description of Artificial Sequence: Synthetic coding sequence
atgccagaatgtctgtggacccagggcgtgctgcaggaggtgctgaacagctacttctgtggcagcatcatcctgagcaccctgccctgggaggtgcctgggggccacgccagccgcatctgcctgctgctgctggccactggagagaacaagcaggtggagtgctaccagctgagccctggcctgagcagcctgcctgacttccaggacagcgaggagaccgtgaccagcaggatgctgttccccaccagcgcccaggagagcagccggggcctgcctgatgccaatgacctgtgcctgggcctgcagagcctgagcctgaccggctgggaccggccctggagcacccaggacagcgacagcagcgcccagagcagcacccacagcgtgctgtccatgctgcacaaccccctgggcaatgtgctgggcaagccacccctgtccttcctgcccctggaccccctgggcagtgacctggtggacaagtttcctgcccccagcgtgcggggcagccggctggacacccggcccatcctggacagccgcagcagcagccccagcgacagcgacaccagcggcttcagcagcggcagtgaccacctgagtgacctgatcagcagcctgcgcatcagcccccccctgcccttcctgagcctgagcggcggcggcccccgggaccccctgaagatgggcgtgggcagcaggatggaccaggagcaggccgccctggccgctgtgacccccagccccaccagcgccagcaagcgctggccaggggcctctgtgtggcccagctgggacctgctggaggcccccaaggaccccttcagcattgaaagagaggcccggctgcaccggcaggccgctgctgtgaatgaggccacctgcacctggagcggccagctgcccccaagaaactacaagaaccccatctacagctgcaaggtgttcctgggcggcgtgccctgggacatcacagaggccggcctggtgaacaccttccgggtgtttggcagcctgtctgtggagtggccaggcaaggatggcaagcacccccgctgcccccccaagggctacgtgtacctggtgtttgagctggagaagtctgtgcgcagcctgctgcaggcctgcagccatgaccccctgagcccagatggcctgtctgagtactacttcaagatgagcagcaggaggatgcgctgcaaggaggtgcaggtgatcccctgggtgctggccgacagcaactttgtgcgcagccccagccagaggctggaccccagcaggacagtgtttgtgggcgccctgcacggcatgctgaatgctgaggccctggccgccatcctgaatgacctgtttggaggagtggtgtatgccggcatcgacacagacaagcacaagtaccccatcggcagcggccgggtgaccttcaacaaccagaggagctacctgaaggctgtgtctgctgcctttgtggagatcaagaccaccaagttcaccaagaaggtgcagattgacccctacctggaggacagcctgtgccacatctgcagcagccagcccggccccttcttctgccgggaccaggtgtgcttcaagtacttctgccgcagctgctggcactggaggcacagcatggagggcctgcggcaccacagccccctgatgaggaaccagaagaacagagacagcagctag

SEQ ID NO: 37899 - DNA, 1476 bp, Artificial Sequence
  Description of Artificial Sequence: Synthetic coding sequence
atgctgttccccaccagcgcccaggagagcagccggggcctgcctgatgccaatgacctgtgcctgggcctgcagagcctgagcctgaccggctgggaccggccctggagcacccaggacagcgacagcagcgcccagagcagcacccacagcgtgctgtccatgctgcacaaccccctgggcaatgtgctgggcaagccacccctgtccttcctgcccctggaccccctgggcagtgacctggtggacaagtttcctgcccccagcgtgcggggcagccggctggacacccggcccatcctggacagccgcagcagcagccccagcgacagcgacaccagcggcttcagcagcggcagtgaccacctgagtgacctgatcagcagcctgcgcatcagcccccccctgcccttcctgagcctgagcggcggcggcccccgggaccccctgaagatgggcgtgggcagcaggatggaccaggagcaggccgccctggccgctgtgacccccagccccaccagcgccagcaagcgctggccaggggcctctgtgtggcccagctgggacctgctggaggcccccaaggaccccttcagcattgaaagagaggcccggctgcaccggcaggccgctgctgtgaatgaggccacctgcacctggagcggccagctgcccccaagaaactacaagaaccccatctacagctgcaaggtgttcctgggcggcgtgccctgggacatcacagaggccggcctggtgaacaccttccgggtgtttggcagcctgtctgtggagtggccaggcaaggatggcaagcacccccgctgcccccccaagggcaacatgcccaagggctacgtgtacctggtgtttgagctggagaagtctgtgcgcagcctgctgcaggcctgcagccatgaccccctgagcccagatggcctgtctgagtactacttcaagatgagcagcaggaggatgcgctgcaaggaggtgcaggtgatcccctgggtgctggccgacagcaactttgtgcgcagccccagccagaggctggaccccagcaggacagtgtttgtgggcgccctgcacggcatgctgaatgctgaggccctggccgccatcctgaatgacctgtttggaggagtggtgtatgccggcatcgacacagacaagcacaagtaccccatcggcagcggccgggtgaccttcaacaaccagaggagctacctgaaggctgtgtctgctgcctttgtggagatcaagaccaccaagttcaccaagaaggtgcagattgacccctacctggaggacagcctgtgccacatctgcagcagccagcccggccccttcttctgccgggaccaggtgtgcttcaagtacttctgccgcagctgctggcactggaggcacagcatggagggcctgcggcaccacagccccctgatgaggaaccagaagaacagagacagcagctag

SEQ ID NO: 37900 - DNA, 1008 bp, Artificial Sequence
  Description of Artificial Sequence: Synthetic coding sequence
atgggcgtgggcagcaggatggaccaggagcaggccgccctggccgctgtgacccccagccccaccagcgccagcaagcgctggccaggggcctctgtgtggcccagctgggacctgctggaggcccccaaggaccccttcagcattgagcgggaggcccggctgcaccggcaggccgctgctgtgaatgaggccacctgcacctggagcggccagctgccccccaggaactacaagaaccccatctacagctgcaaggtgttcctgggcggcgtgccctgggacatcacagaagctggcctggtgaacaccttccgggtgtttggcagcctgtctgtggagtggccaggcaaggatggcaagcacccccgctgcccccccaagggctacgtgtacctggtgtttgagctggagaagtctgtgcgcagcctgctgcaggcctgcagccatgaccccctgagcccagatggcctgtctgagtactacttcaagatgagcagcaggaggatgcgctgcaaggaggtgcaggtgatcccctgggtgctggccgacagcaactttgtgcgcagccccagccagaggctggaccccagcaggacagtgtttgtgggcgccctgcacggcatgctgaatgctgaggccctggccgccatcctgaatgacctgtttggaggagtggtgtatgccggcatcgacacagacaagcacaagtaccccatcggcagcggccgggtgaccttcaacaaccagaggagctacctgaaggctgtgtctgctgcctttgtggagatcaagaccaccaagttcaccaagaaggtgcagattgacccctacctggaggacagcctgtgccacatctgcagcagccagcccggccccttcttctgccgggaccaggtgtgcttcaagtacttctgccgcagctgctggcactggaggcacagcatggagggcctgcggcaccacagccccctgatgaggaaccagaagaacagagacagcagctag

SEQ ID NO: 37901 - DNA, 1686 bp, Artificial Sequence
  Description of Artificial Sequence: Synthetic coding sequence
atgtccatgcccctggaggaggaggccggccgcatcaaggactgctgggacaaccaggaggccccagccctgagcacctgcagcaatgccaacatcttccgccgcatcaatgccatcctggacaacagcctggacttcagccgggtgtgcaccacccccatcaacagaggcatccatgaccacctgcctgacttccaggacagcgaggagaccgtgaccagcaggatgctgttccccaccagcgcccaggagagcagccggggcctgcctgatgccaatgacctgtgcctgggcctgcagagcctgagcctgaccggctgggaccggccctggagcacccaggacagcgacagcagcgcccagagcagcacccacagcgtgctgtccatgctgcacaaccccctgggcaatgtgctgggcaagccacccctgtccttcctgcccctggaccccctgggcagtgacctggtggacaagtttcctgcccccagcgtgcggggcagccggctggacacccggcccatcctggacagccgcagcagcagccccagcgacagcgacaccagcggcttcagcagcggcagtgaccacctgagtgacctgatcagcagcctgcgcatcagcccccccctgcccttcctgagcctgagcggcggcggcccccgggaccccctgaagatgggcgtgggcagcaggatggaccaggagcaggccgccctggccgctgtgacccccagccccaccagcgccagcaagcgctggccaggggcctctgtgtggcccagctgggacctgctggaggcccccaaggaccccttcagcattgagcgggaggcccggctgcaccggcaggccgctgctgtgaatgaggccacctgcacctggagcggccagctgccccccaggaactacaagaaccccatctacagctgcaaggtgttcctgggcggcgtgccctgggacatcacagaagctggcctggtgaacaccttccgggtgtttggcagcctgtctgtggagtggccaggcaaggatggcaagcacccccgctgcccccccaagggctacgtgtacctggtgtttgagctggagaagtctgtgcgcagcctgctgcaggcctgcagccatgaccccctgagcccagatggcctgtctgagtactacttcaagatgagcagcaggaggatgcgctgcaaggaggtgcaggtgatcccctgggtgctggccgacagcaactttgtgcgcagccccagccagaggctggaccccagcaggacagtgtttgtgggcgccctgcacggcatgctgaatgctgaggccctggccgccatcctgaatgacctgtttggaggagtggtgtatgccggcatcgacacagacaagcacaagtaccccatcggcagcggccgggtgaccttcaacaaccagaggagctacctgaaggctgtgtctgctgcctttgtggagatcaagaccaccaagttcaccaagaaggtgcagattgacccctacctggaggacagcctgtgccacatctgcagcagccagcccggccccttcttctgccgggaccaggtgtgcttcaagtacttctgccgcagctgctggcactggaggcacagcatggagggcctgcggcaccacagccccctgatgaggaaccagaagaacagagacagcagctag

SEQ ID NO: 37902 - DNA, 1461 bp, Artificial Sequence
  Description of Artificial Sequence: Synthetic coding sequence
atgctgttccccaccagcgcccaggagagcagccggggcctgcctgatgccaatgacctgtgcctgggcctgcagagcctgagcctgaccggctgggaccggccctggagcacccaggacagcgacagcagcgcccagagcagcacccacagcgtgctgtccatgctgcacaaccccctgggcaatgtgctgggcaagccacccctgtccttcctgcccctggaccccctgggcagtgacctggtggacaagtttcctgcccccagcgtgcggggcagccggctggacacccggcccatcctggacagccgcagcagcagccccagcgacagcgacaccagcggcttcagcagcggcagtgaccacctgagtgacctgatcagcagcctgcgcatcagcccccccctgcccttcctgagcctgagcggcggcggcccccgggaccccctgaagatgggcgtgggcagcaggatggaccaggagcaggccgccctggccgctgtgacccccagccccaccagcgccagcaagcgctggccaggggcctctgtgtggcccagctgggacctgctggaggcccccaaggaccccttcagcattgaaagagaggcccggctgcaccggcaggccgctgctgtgaatgaggccacctgcacctggagcggccagctgcccccaagaaactacaagaaccccatctacagctgcaaggtgttcctgggcggcgtgccctgggacatcacagaggccggcctggtgaacaccttccgggtgtttggcagcctgtctgtggagtggccaggcaaggatggcaagcacccccgctgcccccccaagggctacgtgtacctggtgtttgagctggagaagtctgtgcgcagcctgctgcaggcctgcagccatgaccccctgagcccagatggcctgtctgagtactacttcaagatgagcagcaggaggatgcgctgcaaggaggtgcaggtgatcccctgggtgctggccgacagcaactttgtgcgcagccccagccagaggctggaccccagcaggacagtgtttgtgggcgccctgcacggcatgctgaatgctgaggccctggccgccatcctgaatgacctgtttggaggagtggtgtatgccggcatcgacacagacaagcacaagtaccccatcggcagcggccgggtgaccttcaacaaccagaggagctacctgaaggctgtgtctgctgcctttgtggagatcaagaccaccaagttcaccaagaaggtgcagattgacccctacctggaggacagcctgtgccacatctgcagcagccagcccggccccttcttctgccgggaccaggtgtgcttcaagtacttctgccgcagctgctggcactggaggcacagcatggagggcctgcggcaccacagccccctgatgaggaaccagaagaacagagacagcagctag

SEQ ID NO: 37903 - DNA, 1686 bp, Artificial Sequence
  Description of Artificial Sequence: Synthetic coding sequence
atggccttccccctggaggaggaggccggccgcatcaaggactgctgggacaaccaggaggccccagccctgagcacctgcagcaatgccaacatcttccgccgcatcaatgccatcctggacaacagcctggacttcagccgggtgtgcaccacccccatcaacagaggcatccatgaccacctgcctgacttccaggacagcgaggagaccgtgaccagcaggatgctgttccccaccagcgcccaggagagcagccggggcctgcctgatgccaatgacctgtgcctgggcctgcagagcctgagcctgaccggctgggaccggccctggagcacccaggacagcgacagcagcgcccagagcagcacccacagcgtgctgtccatgctgcacaaccccctgggcaatgtgctgggcaagccacccctgtccttcctgcccctggaccccctgggcagtgacctggtggacaagtttcctgcccccagcgtgcggggcagccggctggacacccggcccatcctggacagccgcagcagcagccccagcgacagcgacaccagcggcttcagcagcggcagtgaccacctgagtgacctgatcagcagcctgcgcatcagcccccccctgcccttcctgagcctgagcggcggcggcccccgggaccccctgaagatgggcgtgggcagcaggatggaccaggagcaggccgccctggccgctgtgacccccagccccaccagcgccagcaagcgctggccaggggcctctgtgtggcccagctgggacctgctggaggcccccaaggaccccttcagcattgagcgggaggcccggctgcaccggcaggccgctgctgtgaatgaggccacctgcacctggagcggccagctgccccccaggaactacaagaaccccatctacagctgcaaggtgttcctgggcggcgtgccctgggacatcacagaagctggcctggtgaacaccttccgggtgtttggcagcctgtctgtggagtggccaggcaaggatggcaagcacccccgctgcccccccaagggctacgtgtacctggtgtttgagctggagaagtctgtgcgcagcctgctgcaggcctgcagccatgaccccctgagcccagatggcctgtctgagtactacttcaagatgagcagcaggaggatgcgctgcaaggaggtgcaggtgatcccctgggtgctggccgacagcaactttgtgcgcagccccagccagaggctggaccccagcaggacagtgtttgtgggcgccctgcacggcatgctgaatgctgaggccctggccgccatcctgaatgacctgtttggaggagtggtgtatgccggcatcgacacagacaagcacaagtaccccatcggcagcggccgggtgaccttcaacaaccagaggagctacctgaaggctgtgtctgctgcctttgtggagatcaagaccaccaagttcaccaagaaggtgcagattgacccctacctggaggacagcctgtgccacatctgcagcagccagcccggccccttcttctgccgggaccaggtgtgcttcaagtacttctgccgcagctgctggcactggaggcacagcatggagggcctgcggcaccacagccccctgatgaggaaccagaagaacagagacagcagctag

SEQ ID NO: 37904 - DNA, 1686 bp, Artificial Sequence; identical to SEQ ID NO: 37903
  Description of Artificial Sequence: Synthetic coding sequence

SEQ ID NO: 37905 - DNA, 1131 bp, Artificial Sequence
  Description of Artificial Sequence: Synthetic coding sequence
atgctgaccttcctgcagcagctgcgggtggactggccagctgccagcgagcgggccagcagccacaccctgcggagccacgccctggaggagctgaccagcgccaatgatggccgcaccctgagccctggcatcctgggccgcctgtgcctgaaggagctggtggaggagcagggccgcacagctggctatgaccccaacctggacaactgcctggtgacagaggacctgctgtctgtgctggccgagctgcaggaggccctgtggcactggccagaggacagccaccctggcctggccggggccagtgacacaggaactggaggctgcctggtggtgcacgtggtgtcctgtgaggaggagttccagcagcagaagctggacctgctgtggcagaagctggtggacaaggcccccctgcggcagaagcacctgatctgtggccctgtgaaggtggccggggcccctggcaccctgatgacagcccctgagtactatgagttccgccacacccaggtgtgcaaggccagcgccctgaagcatggaggagacctggcccaggaccctgcctggacagagatctttggagtgctgtctgtggccaccatcaagtttgagatgctgagcacagccccccagagccagctgttcctggccctggccgacagcagcatcagcaccaagggcaccaagagcggcacctttgtgatgtacaactgtgcccggctggccaccctgtttgagagctacaagtgcagcatggagcagggcctgtaccccaccttcccccctgtgagcagcctggacttcagcctgctgcatgatgaaggagagtggctgctgctcttcaacagcatcctgcccttcccagacctgctgagcaggacagctgtgctggactgcacagcccctggcctgcacatcgctgtgaggacagagatgatctgcaagttcctggtgcagctgtccatggacttcagcagctactacaacagagtgcacatcctgggggagccccggccccacctgtttggccagatgtttgtgcggctgcagctgctgcgggctgtgcgggaggtgctgcacacaggcctggccatgctgggcctgccccccctgagccacatctag

SEQ ID NO: 37906 - DNA, 1551 bp, Artificial Sequence
  Description of Artificial Sequence: Synthetic coding sequence
atggccacccggcggctgggcgtgggggagaccctgggcgccctgaatgctgccctgggccctgggggccctgtgtggatcaaggagaccaggaccaggcacctgcggagccgggacttcctggccccccaccgggccctgcaggccaggtttgatgatggccaggtgcctgagcacctgctgcacgccctggcctgcctgcagggccctggggtggcccctgtgctgcgctgtgcccccaccccagctggcctgagcctgcagctgcagaggtctgctgtgtttgagcgggtgctgtctgctgtggccgcctatgccaccccagccagccctgccagcctgggccagagggtgctgctgcactgcccagccctgcggagcagcccctgtgccctgcggctgagccagctgaggacagtgctggtggccgaccacctggcccgggccctgcgggcccatggagtgtgtgtgcggctggtgcctgctgtgcgggacccccacatgctgaccttcctgcagcagctgcgggtggactggccagctgccagcgagcgggccagcagccacaccctgcggagccacgccctggaggagctgaccagcgccaatgatggccgcaccctgagccctggcatcctgggccgcctgtgcctgaaggagctggtggaggagcagggccgcacagctggctatgaccccaacctggacaactgcctggtgacagaggacctgctgtctgtgctggccgagctgcaggaggccctgtggcactggccagaggacagccaccctggcctggccggggccagtgacaccggcaccggcggctgcctggtggtgcacgtggtgtcctgtgaggaggagttccagcagcagaagctggacctgctgtggcagaagctggtggacaaggcccccctgcggcagaagcacctgatctgtggccctgtgaaggtggccggggcccctggcaccctgatgacagcccctgagtactatgagttccgccacacccaggtgtgcaaggccagcgccctgaagcacggcggggacctggcccaggaccctgcctggacagagatcttcggcgtgctgtctgtggccaccatcaagtttgagatgctgagcacagccccccagagccagctgttcctggccctggccgacagcagcatcagcaccaagggcaccaagagcggcacctttgtgatgtacaactgtgcccggctggccaccctgtttgagagctacaagtgcagcatggagcagggcctgtaccccaccttcccccctgtgagcagcctggacttcagcctgctgcatgatgagtacccacccctgagcggcagcgctgagccagacagcagcgctggcctgcacagccctggggccccccactgctgcacccacagagatgacatgcaggtgcctggaacagcccagcacggcttccagctgctgctgcagcccggcacccaccctgggggcgccagcaccacccccctgtggagcgatgtgcggcccccagctgccagcgagagctgtgcctag

SEQ ID NO: 37907 - DNA, 507 bp, Artificial Sequence
  Description of Artificial Sequence: Synthetic coding sequence
atgaacagcaagggccagtaccccacccagcccacctaccctgtgcagcccccaggcaaccctgtgtacccccagaccctgcacctgccccaggccccaccctacacagatgcccccccagcctacagcgagctgtaccggcccagctttgtgcaccctggagctgccaccgtgcccaccatgtctgctgccttccctggggccagcctgtacctgcccatggcccagagcgtggccgtgggccccctgggcagcaccatccccatggcctactaccctgtgggccccatctacccacctggcagcacagtgctggtggagggcggctatgatgctggggccaggtttggagctggggccacagctggcaacatccccccacctcctcctggctgccccccaaatgctgcccagctggccgtgatgcagggcgccaacgtgctggtgacccagaggaaaggaaacttcttcatgggcggcagtgatggcggctacaccatctggtag

SEQ ID NO: 37908 - DNA, 462 bp, Artificial Sequence
  Description of Artificial Sequence: Synthetic coding sequence
atgaacagcaagggccagtaccccacccagcccacctaccctgtgcagcccccaggcaaccctgtgtacccccagaccctgcacctgccccaggccccaccctacacagatgcccccccagcctacagcgagctgtaccggcccagctttgtgcaccctggagctgccaccgtgcccaccatgtctgctgccttccctggggccagcctgtacctgcccatggcccagagcgtggccgtgggccccctgggcagcaccatccccatggcctactaccctgtgggccccatctacccacctggcagcacagtgctggtggagggcggctatgatgctggggccaggtttggagctggggccacagctggcaacatccctgtgaaggaggaccaggaccatgaccgggagcagggcgaggaggacaacggggacaacaacctggagcggcggggcaagatgtag

SEQ ID NO: 37909 - DNA, 261 bp, Artificial Sequence
  Description of Artificial Sequence: Synthetic coding sequence
atgaacagcaagggccagtaccccacccagcccacctaccctgtgcagcccccaggcaaccctgtgtacccccagaccctgcacctgccccaggccccaccctacacagatgcccccccagcctacagcgagcccccacctcctggctgccccccaaatgctgcccagctggccgtgatgcagggcgccaacgtgctggtgacccagaggaaaggaaacttcttcatgggcggcagtgatggcggctacaccatctggtag

SEQ ID NO: 37910 - DNA, 441 bp, Artificial Sequence
  Description of Artificial Sequence: Synthetic coding sequence
atgaacagcaagggccagtaccccacccagcccacctaccctgtgcagcccccaggcaaccctgtgtacccccagaccctgcacctgccccaggccccaccctacacagatgcccccccagcctacagcgagctgtaccggcccagctttgtgcaccctggagctgccaccgtgcccaccatgtctgctgccatccccatggcctactaccctgtgggccccatctacccacctggcagcacagtgctggtggagggcggctatgatgctggggccaggtttggagctggggccacagctggcaacatccccccacctcctcctggctgccccccaaatgctgcccagctggccgtgatgcagggcgccaacgtgctggtgacccagaggaaaggaaacttcttcatgggcggcagtgatggcggctacaccatctggtag

SEQ ID NO: 37911 - DNA, 624 bp, Artificial Sequence
  Description of Artificial Sequence: Synthetic coding sequence
atgaacagcaagggccagtaccccacccagcccacctaccctgtgcagcccccaggcaaccctgtgtacccccagaccctgcacctgccccaggccccaccctacacagatgcccccccagcctacagcgagctgtaccggcccagctttgtgcaccctggagctgccaccgtgcccaccatgtctgctgccttccctggggccagcctgtacctgcccatggcccagagcgtggccgtgggccccctgggcagcaccatccccatggcctactaccctgtgggccccatctaccccccagccagcacctcctggatgcccagccagtgctgcagcgcctgcagccatgctggcagccagaggcccagaaattctgctgagggggagctgctgcacggctggttccgctggtggctgcaccacctggtgaggaaccagggccacctgtgtgccggcaaggacatcacctacctgcagcacttcagccagtgcaactgcttcagccacatcaacctgaagctgcagttccgccacatgctgctgggctgcctgagcggggcccagaccttccgccacttcagcaacctgatccggaaccacgtgatggtggccgtgcccccatag

SEQ ID NO: 37912 - DNA, 411 bp, Artificial Sequence
  Description of Artificial Sequence: Synthetic coding sequence
atgaacagcaagggccagtaccccacccagcccacctaccctgtgcagcccccaggcaaccctgtgtacccccagaccctgcacctgccccaggccccaccctacacagatgcccccccagcctacagcgagagcgtggccgtgggccccctgggcagcaccatccccatggcctactaccctgtgggccccatctacccacctggcagcacagtgctggtggagggcggctatgatgctggggccaggtttggagctggggccacagctggcaacatccccccacctcctcctggctgccccccaaatgctgcccagctggccgtgatgcagggcgccaacgtgctggtgacccagaggaaaggaaacttcttcatgggcggcagtgatggcggctacaccatctggtag

SEQ ID NO: 37913 - DNA, 2304 bp, Artificial Sequence
  Description of Artificial Sequence: Synthetic coding sequence
atgcagagccctgctgccacagctgagggcctgagcggccccctgtttggagcctacaccttccccaccttcaagttccagcccaggcatgacagcatggactggaggcgcatcagcaccctggatgtggacagagtggcccgggagctggatgtggccaccctgcaggagaacattgctggcatcaccttctgcaacctggaccgggaggtgtgcagccgctgtggccagcctgtggaccctgccctgctgaaggtgctgcggctggcccagctgatcatcgagtacctgctgcactgccaggactgcctgagcgcctctgtggcccagctggaggcccggctgcagaccagcctgggccagcagcagaggggccagcaggagctgggccggcaggctgatgagctgaagggcgtgcgggaggagagcagaagaagaaggaagatgatcagcaccctgcagcagctgctgatgcagacaggcacccacagctaccacacctgccacctgtgtgacaagaccttcatgaatgccaccttcctgcggggccacatccagaggagacatgctggggtggccgagggcggcaagcagaagaagcaggagcagcctgtggaggaggtgctggaggagctgcgggccaagctgaagtggacccagggcgagctggaggcccagcgggaggccgagcggcagaggcagctgcaggaggccgagctgatccaccagcgggagattgaggccaagaaggagtttgacaagtggaaggagcaggagtggaccaagctgtatggagaaattgacaagctgaagaagctgttctgggatgagttcaagaatgtggccaagcagaacagcaccctggaggagaagctgcgggccctgcagagccacagcgtgatggagagcaagctgggcagcctgagagatgaggagagcgaggagtggctgcggcaggcccgggagctgcaggccctgcgggagaagacagagatccagaagacagagtggaagaggaaggtgaaggagctgcacgaggagcacatggccgagaagaaggagctgcaggaggagaaccagaggctgcaggccagcctgagccaggaccagaagaaggccgccgcccagagccagtgccagatcagcaccctgcgggcccagctgcaggagcaggcccgcatcatcgccagccaggaggagatgatccagagcctgagcctgaggaaggtggagggcatccacaaggtgcccaaggctgtggacacagaggaggacagccctgaggaggagatggaggacagccaggatgagcagcacaaggtgctggccgccctgcggaggaaccccaccctgctgaagcacttccggcccatcctggaggacaccctggaggagaagctggagagcatgggcatcaggaaggatgccaagggcatcagcatccagaccctgcggcacctggagagcctgctgcgggtgcagcgggagcagaaggccaggaagttcagcgagttcctgagcctgcggggcaagctggtgaaggaggtgaccagccgggccaaggagcggcaggagaatggagctgtggtgtcccagccagatggccagcccagcgtgaagagccagcagagcaccctggtgacccgggaggcccagcccaagaccaggaccctgcaggtggccctgcccagcaccccagctgagcccccaccacccacccggcagagccacggcagccacggcagcagcctgacccaggtgtctgccccagccccccggcccggcctgcacggccccagcagcaccccacccagcagcggccctggcatgagcaccccacccttcagcagtgaagaagattctgagggggacagagtgcagagggtgtccctgcagccccccaaggtgcccagcaggatggtgccccggcccaaggatgactgggactggagcgacacagagaccagcgaggagaatgcccagcccccaggccagggcagcggcaccctggtgcagagcatggtgaagaacctggagaagcagctggaggccccagccaagaagccagctgggggcgtgtccctcttcttcatgcccaatgccggcccccagagagctgccaccccaggcaggaagccccagctgtctgaagatgaaagtgacctggagatcagcagcctggaggacctgcccctggacctggaccagcgggagaagcccaagcccctgagccgcagcaagctgcctgagaagtttggcaccggcccccagagcagcggccagccccgggtgcctgcctggtag

SEQ ID NO: 37914 - DNA, 204 bp, Artificial Sequence
  Description of Artificial Sequence: Synthetic coding sequence
atgcagagccctgctgccacagctgagggcctgagcggccccctgtttggagcctacaccttccccaccttcaagttccagcccaggcatgacagcatggactggaggcgcatcagcaccctggatgtggacagagtggcccgggagctggatgtggccaccctgcaggagaacattgctggcatcaccttctgcaacctgtag

SEQ ID NO: 37915 - DNA, 1620 bp, Artificial Sequence
  Description of Artificial Sequence: Synthetic coding sequence
atgcagagccctgctgccacagctgagggcctgagcggccccctgtttggagcctacaccttccccaccttcaagttccagcccaggcatgacagcatggactggaggcgcatcagcaccctggatgtggacagagtggcccgggagctggatgtggccaccctgcaggagaacattgctggcatcaccttctgcaacctggaccgggaggtgtgcagccgctgtggccagcctgtggaccctgccctgctgaaggtgctgcggctggcccagctgatcatcgagtacctgctgcactgccaggactgcctgagcgcctctgtggcccagctggaggcccggctgcagaccagcctgggccagcagcagaggggccagcaggagctgggccggcaggctgatgagctgaagggcgtgcgggaggagagcagaagaagaaggaagatgatcagcaccctgcagcagctgctgatgcagacaggcacccacagctaccacacctgccacctgtgtgacaagaccttcatgaatgccaccttcctgcggggccacatccagaggagacatgctggggtggccgagggcggcaagcagaagaagcaggagcagcctgtggaggaggtgctggaggagctgcgggccaagctgaagtggacccagggcgagctggaggcccagcgggaggccgagcggcagaggcagctgcaggaggccgagctgatccaccagcgggagattgaggccaagaaggagtttgacaagtggaaggagcaggagtggaccaagctgtatggagaaattgacaagctgaagaagctgttctgggatgagttcaagaatgtggccaagcagaacagcaccctggaggagaagctgcgggccctgcagagccacagcgtgatggagagcaagctgggcagcctgagagatgaggagagcgaggagtggctgcggcaggcccgggagctgcaggccctgcgggagaagacagagatccagaagacagagtggaagaggaaggtgaaggagctgcacgaggagcacatggccgagaagaaggagctgcaggaggagaaccagaggctgcaggccagcctgagccaggaccagaagaaggccgccgcccagagccagtgccagatcagcaccctgcgggcccagctgcaggagcaggcccgcatcatcgccagccaggaggagatgatccagagcctgagcctgaggaaggtggagggcatccacaaggtgcccaaggctgtggacacagaggaggacagccctgaggaggagatggaggacagccaggatgagcagcacaaggtgctggccgccctgcggaggaaccccaccctgctgaagcacttccggcccatcctggaggacaccctggaggagaagctggagagcatgggcatcaggaaggatgccaagggcatcagcatccagaccctgcggcacctggagagcctgctgcgggtgcagcgggagcagaaggccaggaagttcagcgagttcctgagcctgcggggcaagctggtgaaggaggtgaccagccgggccaaggagcggcaggagaatggagctgtggtgtcccagccagatggccagcccagcggctag

SEQ ID NO: 37916 - DNA, 120 bp, Artificial Sequence
  Description of Artificial Sequence: Synthetic coding sequence
atgcagagccctgctgccacagctgagggcctgagcggccccctgtttggagcctacaccttccccaccttcaagttccagcccaggcatgacagcatggactggaggcgcatctcctag

SEQ ID NO: 37917 - DNA, 1620 bp, Artificial Sequence; identical to SEQ ID NO: 37915
  Description of Artificial Sequence: Synthetic coding sequence

SEQ ID NO: 37918 - DNA, 561 bp, Artificial Sequence
  Description of Artificial Sequence: Synthetic coding sequence
atgcacaagctgaagagcagccagaaggacaaggtgcggcagttcatggcctgcacccaggccggggagaggacagccatctactgcctgacccagaatgagtggaggctggatgaggccacagacagcttcttccagaacccagacagcctgcaccgggagagcatgagaaatgctgtggacaagaagaagctggagcggctgtatggccgctacaaggacccccaggatgagaacaagattggagtggatggcatccagcagttctgtgatgacctgagcctggaccctgccagcatctctgtgctggtgattgcctggaagttccgggccgccacccagtgtgagttcagcaggaaggagttcctggatggcatgacagagctgggctgtgacagcatggagaagctgaaggccctgctgccccggctggagcaggagctgaaggacacagccaagttcaaggacttctaccagttcaccttcacctttgccaagaaccctggccagaagggcctgggcagcccccccttcctgaatgtgaaggccctgcaccactag

SEQ ID NO: 37919 - DNA, 780 bp, Artificial Sequence
  Description of Artificial Sequence: Synthetic coding sequence
atgcacaagctgaagagcagccagaaggacaaggtgcggcagttcatggcctgcacccaggccggggagaggacagccatctactgcctgacccagaatgagtggaggctggatgaggccacagacagcttcttccagaacccagacagcctgcaccgggagagcatgagaaatgctgtggacaagaagaagctggagcggctgtatggccgctacaaggacccccaggatgagaacaagattggagtggatggcatccagcagttctgtgatgacctgagcctggaccctgccagcatctctgtgctggtgattgcctggaagttccgggccgccacccagtgtgagttcagcaggaaggagttcctggatggcatgacagagctgggctgtgacagcatggagaagctgaaggccctgctgccccggctggagcaggagctgaaggacacagccaagttcaaggacttctaccagttcaccttcacctttgccaagaaccctggccagaagggcctggacctggagatggctgtggcctactggaagctggtgctgagcggccgcttcaagttcctggacctgtggaacaccttcctgatggagcaccacaagaggagcatcccccgggacacctggaacctgctgctggactttggaaacatgattgctgatgacatgagcaactatgatgaggagggcgcctggcctgtgctgattgatgactttgtggagtatgcccggcctgtggtgactggaggcaagaggagcctcttctag

SEQ ID NO: 37920 - DNA, 714 bp, Artificial Sequence
  Description of Artificial Sequence: Synthetic coding sequence
atgcctgtgaagaagaagaggaagagccctggggtggccgctgctgtggccgaggatggcggcctgaagaagtgcaagatcagcagctactgccgcagccagcccccagcccggctcatctctggagaggagcacttcagcagcaagaagtgcctggcctggttctatgaatatgccggcccagatgaggtggtgggccctgagggcatggagaagttctgtgaagatattggagtggagcctgagaacatcatcatgctggtgctggcctggaagctggaggccgagagcatgggcttcttcaccaaggaggagtggctgaagggcatgaccagcctgcagtgtgactgcacagagaagctgcagaacaagtttgacttcctgcggagccagctgaatgacatcagcagcttcaagaacatctaccgctatgcctttgattttgcccgggacaaggaccagaggagcctggacatcgacacagccaagtccatgctggccctgctgctgggccgcacctggcccctcttcagcgtcttctaccagtacctggagcagagcaagtacagagtgatgaacaaggaccagtggtacaacgtgctggagttcagcaggacagtgcatgctgacctgagcaactatgatgaagatggagcctggcctgtgctgctggatgaatttgtggagtggcagaaggtgcggcagaccagctag

SEQ ID NO: 37921 - DNA, 1749 bp, Artificial Sequence
  Description of Artificial Sequence: Synthetic coding sequence
atggaggccctgagcagagctggccaggagatgagcctggccgccctgaagcagcacgacccctacatcaccagcattgctgacctgaccggccaggtggccctgtacaccttctgccccaaggccaaccagtgggagaagacagacatcgagggcaccctgtttgtgtaccgccgcagcgccagcccctaccacggcttcaccatcgtgaaccggctgaacatgcacaacctggtggagcctgtgaacaaggacctggagttccagctgcacgagcccttcctgctgtacagaaatgccagcctgagcatctacagcatctggttctatgacaagaatgactgccaccgcatcgccaagctgatggctgatgtggtggaggaggagaccaggaggagccagcaggccgcccgggacaagcagagccccagccaggccaacggctgcagcgaccaccggcccatcgacatcctggagatgctgagccgggccaaggatgaatatgaaagaaaccagatgggagacagcaacatcagcagccctggcctgcagcccagcacccagctgagcaacctgggcagcacagagaccctggaggagatgcccagcggcagccaggacaagagcgcccccagcggccacaagcacctgactgtggaggagctgtttggcaccagcctgcccaaggagcagcctgctgtggtgggcctggacagcgaggagatggagcggctgcctggagatgccagccagaaggagcccaacagcttcctgcccttcccctttgagcagctgggcggggccccccagagcgagaccctgggcgtgcccagcgctgcccaccacagcgtgcagcctgagatcaccacccctgtgctgatcaccccagccagcatcacccagagcaatgagaagcacgcccccacctacaccatccccctgagccctgtgctgagccccaccctgcctgctgaggcccccacagcccaggtgccccccagcctgcccaggaacagcaccatgatgcaggccgtgaagaccaccccccggcagaggagccccctgctgaaccagcctgtgcctgagctgagccacgccagcctgattgccaaccagagccccttccgggcccccctgaatgtgaccaacacagctggcaccagcctgcccagcgtggacctgctgcagaagctgcggctgaccccccagcacgaccagatccagacccagcccctgggcaagggggccatggtggccagcttctccccagctgctggccagctggccaccccagagagcttcatcgagccccccagcaagacagctgctgcccgggtggccgccagcgccagcctgagcaacatggtgctggcccccctgcagagcatgcagcagaaccaggaccctgaggtgtttgtgcagcccaaggtgctgagcagcgccaagagggtggccggggcccccctggtgacagccaccaccacagctgtgtcctctgtgctgctggcccccagcgtcttccagcagacagtgaccaggagcagtgacctggagaggaaggccagcagccccagccccctgaccatcggcaccccagagagccagaggaagcccagcatcatcctgagcaagagccagctgcaggacaccctcatccacctgatcaagaatgacagcagcttcctgagcaccctgcacgaggtgtacctgcaggtgctgaccaagaacaaggacaaccacaacctgtag

SEQ ID NO: 37922 - DNA, 1569 bp, Artificial Sequence
  Description of Artificial Sequence: Synthetic coding sequence
atgttccccttcggcccccacagccctggaggagatggcagcgctggagctggagctgaggagcccacccctcatgagggccaggccgccgccaccggcccccccagccccctgcaccctggagcagatgccacccaccccccacctccagcccggagccccaggaggcctggggcccccagcctgagccctgcccccaggtctggagagctgggcctgcccggggcccctgagagcagcacagccagcgcccctggagagcccagcccccccagccccccctgccggcggcccggccctgactgccgggccaagagccggggccgccacggcctgggcgccggcctgggcggccctggggcccggctgtttggctggctgaaggagaggagcctgggccggggcctgtttgtggaccctgcccgggacaacttccgcaccatgaccagcctgtatggcagcatccaccctgctgacagcgtgtacctgagcaccaggacccacggggctgtgttcaacctggagtacagcccagatggctctgtgctgactgtggcctgtgagcagacagaggtgctgctgtttgaccccatcagcagcaagcacatcaagaccctgtctgaggcccacgaggactgtgtgaacaacatccgcttcctggacaaccggctgtttgccacctgcagtgatgacaccaccatcgccctgtgggacctgaggaagctgaacaccaaggtgtgcaccctgcacggccacacctcctgggtgaagaacattgaatatgacaccaacacccggctgctggtgaccagcggctttgatggaaatgtcatcatctgggacaccaaccgctacacagaagatggctgcccccacaagaagttcttccacacccgcttcctgatgaggatgaggctgaccccagactgcagcaagatgctgatcagcaccagcagcggctacctgctgatcctgcatgacctggacctgaccaagagcctggaggtgggcagctaccccatcctgcgggcccggaggaccaccagcagcagtggagtgagccccaggaacagcctggaggtggtgaccccagaggtgctgggggagagtgaccacggcaactgcatcaccagcctgcagctgcaccccaagggctgggccaccctgctgcgctgcagcagcaacagtgatgatgaggagtgcacctgtgtgtatgagttccaggagggcgcccctgtgcggcctgtgagcccccgctgcagcctgcggctgacccactacatcgaggaggccaacgtgggccggggctacatcaaggagctgtgcttctccccagatggccgcatgatcagcagcccccacggctacggcatccggctgctgggctttgacaagcagtgcagcgagctggtggactgcctgcccaaggaggccagccccctgcgggtcatccgcagcctgtacagccacaatgatgtggtgctgaccaccaagttcagccccacccactgccagatcgccagcggctgcctgagcggccgggtgtccctgtaccagcccaagttctag

SEQ ID NO: 37923 - DNA, 1680 bp, Artificial Sequence
  Description of Artificial Sequence: Synthetic coding sequence
atgttccccttcggcccccacagccctggaggagatggcagcgctggagctggagctgaggagcccacccctcatgagggccaggccgccgccaccggcccccccagccccctgcaccctggagcagatgccacccaccccccacctccagcccggagccccaggaggcctggggcccccagcctgagccctgcccccaggtctggagagctgggcctgcccggggcccctgagagcagcacagccagcgcccctggagagcccagcccccccagccccccctgccggcggcccggccctgactgccgggccaagagccggggccgccacggcctgggcgccggcctgggcggccctggggcccggctgtttggctggctgaaggagaggagcctgggccggggcctgtttgtggaccctgcccgggacaacttccgcaccatgaccagcctgtatggcagcatccaccctgctgacagcgtgtacctgagcaccaggacccacggggctgtgttcaacctggagtacagcccagatggctctgtgctgactgtggcctgtgagcagacagaggtgctgctgtttgaccccatcagcagcaagcacatcaagaccctgtctgaggcccacgaggactgtgtgaacaacatccgcttcctggacaaccggctgtttgccacctgcagtgatgacaccaccatcgccctgtgggacctgaggaagctgaacaccaaggtgtgcaccctgcacggccacacctcctgggtgaagaacattgaatatgacaccaacacccggctgctggtgaccagcggctttgatggaaatgtcatcatctgggacaccaaccgctacacagaagatggctgcccccacaagaagttcttccacacccgcttcctgatgaggatgaggctgaccccagactgcagcaagatgctgatcagcaccagcagcggctacctgctgatcctgcatgacctggacctgaccaagagcctggaggtgggcagctaccccatcctgcgggcccggaggaccaccagcagcagtgacctgaccaccagcagcagcagcagcggcccccgggtgtctggcagcccctgccaccacagcgacagcaacagcagcgagaagcacatgagccgggccagccagcgggagggcgtgagccccaggaacagcctggaggtggtgaccccagaggtgctgggggagagtgaccacggcaactgcatcaccagcctgcagctgcaccccaagggctgggccaccctgctgcgctgcagcagcaacagtgatgatgaagaatgtacctgtgtgtatgagttccaggagggcgcccctgtgcggcctgtgagcccccgctgcagcctgcggctgacccactacatcgaggaggccaacgtgggccggggctacatcaaggagctgtgcttctccccagatggccgcatgatcagcagcccccacggctacggcatccggctgctgggctttgacaagcagtgcagcgagctggtggactgcctgcccaaggaggccagccccctgcgggtcatccgcagcctgtacagccacaatgatgtggtgctgaccaccaagttcagccccacccactgccagatcgccagcggctgcctgagcggccgggtgtccctgtaccagcccaagttctag

SEQ ID NO: 37924 - DNA, 1392 bp, Artificial Sequence
  Description of Artificial Sequence: Synthetic coding sequence
atggcccagcagcagacaggcagcaggaagaggaaggccccagctgtggaggctgatgctgagagcagccccagccagggcctggccgctgctgatggagagggccccctgctgctgaagaggcagaggaggcctgccacctaccgctccatggcccactacctgaaggtgcgggaggtgggcggctggggccctgcccggctgcagggctttgatggagagctgcggggctatgctgtgcagaggctgcctgagctgctgacagagcggcagctggagctgggcaccgtgaacaaggtgtttgccagccagtggctgaacagccggcaggtggtgtgtggcaccaagtgcaacaccctgtttgtggtggatgtggagagcggccacatcgcccgcatccccctgctgcgggacagcgaggcccggctggcccaggaccagcagggctgcggcatccacgccatcgagctgaaccccagcaagaccctgctggccactggaggagagaaccccaacagcctggccatctaccagctgcccagcctggaccccctgtgcctgggggacagacatggccacaaggactggatctttgctgtggcctggctgagtgacacagtggccgtgtctggcagcagagatggcaccgtggccctgtggaggatggaccctgacaagtttgatgacacagtggcctggcacagcgaggtgggcctgcctgtgtatgcccacatccggcccagagatgtggaggccatcccccgggccatcatcaaccccagcaacaggaaggtgcgggccctggcctgtggcggcaagaaccaggagctgggcgctgtgtccctggatggctacttccacctgtggaaggccggcagcgccctgagccggctgctgagcatccggctgccctacttccgggacaacgtgtgcctgacctactgtgatgacatgtctgtgtatgctgtgggcagccacagccacgtgtccttcctggacctgcggcaggaccagcagaacatccggcccctgtgcagccgggagggcggcactggagtgcgcagcctgtccttctaccgccacatcatcaccgtgggcaccggccagggcagcctgctcttctatgatgtgcgggcccagaagttcctggaggagcgggccagcgccaccctggagagcagcagcggccctgcccggaggaagctgcggctggcctgtggccggggctggctgaaccacaatgacttctgggtgaactactttggaggcatggaggtgttccccaatgccctgtacacccactgctacaactggccagagatgaagctgtttgtggccggcggccccctgcctgctggcctgcacggcaactatgccggcctgtggagctag

SEQ ID NO: 37925 - DNA, 1392 bp, Artificial Sequence
  Description of Artificial Sequence: Synthetic coding sequence
atggcccagcagcagacaggcagcaggaagaggaaggccccagctgtggaggccggggccggcagcagcagcagccagggcctggccgctgctgatggagagggccccctgctgcccaagaagcagaagaggcctgccacccggcggcggctggtgcactacctgaagggccgggaggtgggcgcccggggccctgctggcctgcagggctttgaaggagagctgcggggctatgctgtgcagaggctgcctgagctgctgacagagcggcagctggacctgggcaccctgaacaaggtgtttgccagccagtggctgaatgcccggcaggtggtgtgtggcaccaagtgcaacaccctgtttgtggtggatgtgcagagcggccacatcacccgcatccccctgatgagggacaaggaggccggcctggcccaggcccaccagggctgcggcatccacgccatcgagctgaaccccagcaagaccctgctggccactggaggagagaaccccaacagcctggccatctaccagctgcccaccctggaccccctgtgcctgggggacagacatggccacaaggactggatctttgctgtggcctggctgagtgacacagtggccgtgtctggcagcagagatggcaccgtggccctgtggaggatggaccctgacatgttcaacggcagcatcgcctggcacagcgaggtgggcctgcctgtgtatgcccacatccggcccagagatgtggaggccatcccccgggccagcaccaaccccagcaacaggaaggtgcgggccctggccttcagcggcaagaaccaggagctgggcgctgtgtccctggatggctacttccacctgtggaaggcccggagcaccctgagccggctgctgagcatccggctgccctactgccgggagaatgtgtgcctgacctactgtgatgagctgagcctgtatgctgtgggcagccagagccacgtgtccttcctggacccccggcagaggcagcagaacatccggcccctgtgcagccgggagggcggcactggagtgcgcagcctgtccttctaccagcacatcatcaccgtgggcactggacatggcagcctgctcttctatgacatccgggcccagaagttcctggaggagcgggccagcagcagcctggacagcatgcctggccctgctggcaggaagctgaagctggcctgtggccggggctggctgaaccaggatgatgtgtgggtgaactactttggaggcatgggagagttccccaatgccctgtacacccactgctacaactggccagagatgaagctgtttgtggccggcggccccctgcccagcggcctgcacggcaactatgccggcctgtggagctag

SEQ ID NO: 37926 - DNA, 1392 bp, Artificial Sequence; identical to SEQ ID NO: 37925
  Description of Artificial Sequence: Synthetic coding sequence

SEQ ID NO: 37927 - DNA, 1803 bp, Artificial Sequence
  Description of Artificial Sequence: Synthetic coding sequence
atggcccccagcagcaagtcagaaagaaattctggagctggcagcggcggcggcggccctgggggcgccggcggcaagagagctgctggaagaagaagagaacatgtgctgaagcagctggagcgggtgaagatcagcggccagctgagccccaggctcttcaggaagctgcccccccgggtgtgtgtgtccctgaagaacatcgtggatgaggacttcctgtatgccggccacatcttcctgggcttcagcaaatgtggccgctacgtgctgagctacaccagcagcagtggagatgatgacttctccttctacatctaccacctgtactggtgggagttcaacgtgcacagcaagctgaagctggtgcggcaggtgcggctcttccaggatgaggagatctacagcgacctgtacctgactgtgtgtgagtggcccagtgatgccagcaaggtgattgtgtttggcttcaacaccaggtctgccaacggcatgctgatgaacatgatgatgatgtctgatgagaaccaccgggacatctacgtgtccacagtggccgtgcccccacctggccgctgtgccgcctgccaggatgccagccgggcccaccctggggaccccaatgcccagtgcctgcggcacggcttcatgctgcacaccaagtaccaggtggtgtaccccttccccaccttccagcctgccttccagctgaagaaggaccaggtggtgctgctgaacaccagctacagcctggtggcctgtgctgtgtctgtgcacagcgctggggaccgctccttctgccagatcctgtatgaccacagcacctgccccctggccccagccagccccccagagccccagagccctgagctgcccccagccctgcccagcttctgcccagaggccgccccagcccggagcagcggcagccctgagcccagccctgccatcgccaaggccaaggagtttgtggccgacatcttcagaagagccaaggaggccaagggcggcgtgcctgaggaggcccggcctgccctgtgccccggccccagcggcagccgctgccgggcccacagcgagcccctggccctgtgtggggagacagccccccgggacagccccccagccagcgaggccccagccagcgagcccggctacgtgaactacaccaagctgtactacgtgctggagagcggggagggcacagagccagaagatgagctggaggatgacaagatcagcctgccctttgtggtgacagacctgcggggcaggaacctgcggcccatgagggagaggacagctgtgcagggccagtacctgactgtggagcagctgaccctggactttgaatatgtgatcaatgaagtcatcagacatgatgccacctggggccaccagttctgcagcttcagtgactatgacatcgtcatcctggaggtgtgcccagagaccaaccaggtgctgatcaacatcggcctgctgctgctggccttccccagccccacagaggagggccagctgcggcccaagacctaccacaccagcctgaaggtggcctgggacctgaacacaggcatctttgagaccgtgtctgtgggggacctgacagaggtgaagggccagaccagcggctctgtgtggagcagctacaggaagagctgtgtggacatggtgatgaagtggctggtgcctgagagcagcggccgctacgtgaacaggatgaccaatgaggccctgcacaagggctgcagcctgaaggtgctggccgacagcgagcgctacacctggatcgtgctgtag

SEQ ID NO: 37928 - DNA, 651 bp, Artificial Sequence
  Description of Artificial Sequence: Synthetic coding sequence
atgggccccaggaaccccagcccagaccacctgtctgagagcgagagcgaggaggaggagaacatctcctacctgaatgaatcttctggagaggagtgggacagcagcgaggaggaggacagcatggtgcccaacctgagccccctggagagcctggcctggcaggtgaagtgcctgctgaagtacagcaccacctggaagcccctgaaccccaacagctggctgtaccacgccaagctgctggaccccagcacccctgtgcacatcctgcgggagatcggcctgcggctgagccactgcagccactgtgtgcccaagctggagcccatccctgagtggccacccctggccagctgtggggtgccccccttccagaagcccctgaccagccccagccggctgagccgggaccacgccaccctgaatggagccctgcagtttgccaccaagcagctgagcaggaccctgagccgggccacccccatccctgagtacctgaagcagatccccaacagctgtgtgtctggctgctgctgcggctggctgaccaagacagtgaaggagaccaccaggacagagcccatcaacaccacctacagctacacagacttccagaaggctgtgaacaagctgctgacagccagcctgtag

SEQ ID NO: 37929 - DNA, 651 bp, Artificial Sequence; identical to SEQ ID NO: 37928
  Description of Artificial Sequence: Synthetic coding sequence

SEQ ID NO: 37930 - DNA, 1488 bp, Artificial Sequence
  Description of Artificial Sequence: Synthetic coding sequence
atgaacaagagccgctggcagagcagaagaagacatggccgccgcagccaccagcagaacccctggttccggctgcgggacagtgaagatagaagtgacagccgggccgcccagcctgcccatgattctggccatggagatgatgagagccccagcaccagcagcggcacagctggcaccagctctgtgcctgagctgcccggcttctactttgatcctgagaagaagcgctacttccggctgctgcccggccacaacaactgcaaccccctgaccaaggagagcatccggcagaaggagatggagagcaagaggctgcggctgctgcaggaggaggacaggaggaagaagatcgccaggatgggcttcaatgccagctccatgctgaggaagagccagctgggcttcctgaatgtgaccaactactgccacctggcccacgagctgcggctgagctgcatggagaggaagaaggtgcagatccgctccatggaccccagcgccctggccagtgaccgcttcaacctgatcctggccgacaccaacagcgacaggctcttcaccgtgaatgatgtgaaggtgggcggcagcaaatatggcatcatcaacctgcagagcctgaagacccccaccctgaaggtgttcatgcatgagaacctgtacttcaccaacaggaaggtgaacagcgtgtgctgggccagcctgaaccacctggacagccacatcctgctgtgcctgatgggcctggccgagaccccaggctgtgccaccctgctgcctgccagcctgtttgtgaacagccaccctggcatcgaccggcccggcatgctgtgcagcttccgcatccctggggcctggagctgtgcctggagcctgaacatccaggccaacaactgcttcagcacaggcctgagccggcgggtgctgctgaccaacgtggtgacaggccaccggcagagctttggcaccaacagtgatgtgctggcccagcagtttgccctgatggcccccctgctcttcaacggctgccgctctggagagatctttgccatcgacctgcgctgtggcaaccagggcaagggctggaaggccaccaggctcttccatgattctgctgtgacctctgtgcgcatcctgcaggatgagcagtacctgatggccagtgacatggccggcaagatcaagctgtgggacctgcggaccaccaagtgtgtgcggcagtatgagggccacgtgaatgaatatgcctacctgcccctgcacgtgcatgaggaggagggcatcctggtggccgtgggccaggactgctacacccgcatctggagcctgcatgatgcccggctgctgcggaccatccccagcccctacccagccagcaaggctgacatccccagcgtggccttcagcagccggctgggcggcagcagaggagcccctggcctgctgatggctgtgggccaggacctgtactgctacagctacagctag

SEQ ID NO: 37931 - DNA, 1188 bp, Artificial Sequence
  Description of Artificial Sequence: Synthetic coding sequence
atggagagcaagaggctgcggctgctgcaggaggaggacaggaggaagaagatcgccaggatgggcttcaatgccagctccatgctgaggaagagccagctgggcttcctgaatgtgaccaactactgccacctggcccacgagctgcggctgagctgcatggagaggaagaaggtgcagatccgctccatggaccccagcgccctggccagtgaccgcttcaacctgatcctggccgacaccaacagcgacaggctcttcaccgtgaatgatgtgaaggtgggcggcagcaaatatggcatcatcaacctgcagagcctgaagacccccaccctgaaggtgttcatgcatgagaacctgtacttcaccaacaggaaggtgaacagcgtgtgctgggccagcctgaaccacctggacagccacatcctgctgtgcctgatgggcctggccgagaccccaggctgtgccaccctgctgcctgccagcctgtttgtgaacagccaccctggcatcgaccggcccggcatgctgtgcagcttccgcatccctggggcctggagctgtgcctggagcctgaacatccaggccaacaactgcttcagcacaggcctgagccggcgggtgctgctgaccaacgtggtgacaggccaccggcagagctttggcaccaacagtgatgtgctggcccagcagtttgccctgatggcccccctgctcttcaacggctgccgctctggagagatctttgccatcgacctgcgctgtggcaaccagggcaagggctggaaggccaccaggctcttccatgattctgctgtgacctctgtgcgcatcctgcaggatgagcagtacctgatggccagtgacatggccggcaagatcaagctgtgggacctgcggaccaccaagtgtgtgcggcagtatgagggccacgtgaatgaatatgcctacctgcccctgcacgtgcatgaggaggagggcatcctggtggccgtgggccaggactgctacacccgcatctggagcctgcatgatgcccggctgctgcggaccatccccagcccctacccagccagcaaggctgacatccccagcgtggccttcagcagccggctgggcggcagcagaggagcccctggcctgctgatggctgtgggccaggacctgtactgctacagctacagctag

SEQ ID NO: 37932 - DNA, 1308 bp, Artificial Sequence
  Description of Artificial Sequence: Synthetic coding sequence
atgaacaagagccgctggcagagcagaagaagacatggccgccgcagccaccagcagaacccctggttccggctgcgggacagtgaagatagaagtgacagccgggccgcccagcctgcccatgattctggccatggagatgatgagagccccagcaccagcagcggcacagctggcaccagctctgtgcctgagctgcccggcttctactttgatcctgagaagaagcgctacttccggctgctgcccggccacaacaactgcaaccccctgaccaaggagagcatccggcagaaggagatggagagcaagaggctgcggctgctgcaggaggaggacaggaggaagaaggctgacaccaacagcgacaggctcttcaccgtgaatgatgtgaaggtgggcggcagcaaatatggcatcatcaacctgcagagcctgaagacccccaccctgaaggtgttcatgcatgaaaatctctacttcaccaacaggaaggtgaacagcgtgtgctgggccagcctgaaccacctggacagccacatcctgctgtgcctgatgggcctggccgagaccccaggctgtgccaccctgctgcctgccagcctgtttgtgaacagccaccctgctggcatcgaccggcccggcatgctgtgcagcttccgcatccctggggcctggagctgtgcctggagcctgaacatccaggccaacaactgcttcagcacaggcctgagccggcgggtgctgctgaccaacgtggtgacaggccaccggcagagctttggcaccaacagtgatgtgctggcccagcagtttgccctgatggcccccctgctcttcaacggctgccgctctggagagatctttgccatcgacctgcgctgtggcaaccagggcaagggctggaaggccaccaggctcttccatgattctgctgtgacctctgtgcgcatcctgcaggatgagcagtacctgatggccagtgacatggccggcaagatcaagctgtgggacctgcggaccaccaagtgtgtgcggcagtatgagggccacgtgaatgaatatgcctacctgcccctgcacgtgcatgaggaggagggcatcctggtggccgtgggccaggactgctacacccgcatctggagcctgcatgatgcccggctgctgcggaccatccccagcccctacccagccagcaaggctgacatccccagcgtggccttcagcagccggctgggcggcagcagaggagcccctggcctgctgatggctgtgggccaggacctgtactgctacagctacagctag

SEQ ID NO: 37933 - DNA, 1470 bp, Artificial Sequence
  Description of Artificial Sequence: Synthetic coding sequence
atgaacaagagccgctggcagagcagaagaagacatggccgccgcagccaccagcagaacccctggttccggctgcgggacagtgaagatagaagtgacagccgggccgcccagcctgcccatgattctggccatggagatgatgagagccccagcaccagcagcggcacagctggcaccagctctgtgcctgagctgcccggcttctactttgatcctgagaagaagcgctacttccggctgctgcccggccacaacaactgcaaccccctgaccaaggagagcatccggcagaaggagatggagagcaagaggctgcggctgctgcaggaggaggacaggaggaagaagatcgccaggatgggcttcaatgccagctccatgctgaggaagagccagctgggcttcctgaatgtgaccaactactgccacctggcccacgagctgcggctgagctgcatggagaggaagaaggtgcagatccgctccatggaccccagcgccctggccagtgaccgcttcaacctgatcctggccgacaccaacagcgacaggctcttcaccgtgaatgatgtgaaggtgggcggcagcaaatatggcatcatcaacctgcagagcctgaagacccccaccctgaaggtgttcatgcatgagaacctgtacttcaccaacaggaaggtgaacagcgtgtgctgggccagcctgaaccacctggacagccacatcctgctgtgcctgatgggcctggccgagaccccaggctgtgccaccctgctgcctgccagcctgtttgtgaacagccaccctgctggcatcgacaggcctggcatgctgtgcagcttccgcatccctggggcctggagctgtgcctggagcctgaacatccaggccaacaactgcttcagcacaggcctgagcagaagagtgctgctgaccaacgtggtgacaggccaccggcagagctttggcaccaacagtgatgtgctggcccccctgctcttcaacggctgccgctctggagagatctttgccatcgacctgcgctgtggcaaccagggcaagggctggaaggccaccaggctcttccatgattctgctgtgacctctgtgcgcatcctgcaggatgagcagtacctgatggccagtgacatggccggcaagatcaagctgtgggacctgcggaccaccaagtgtgtgcggcagtatgagggccacgtgaatgaatatgcctacctgcccctgcacgtgcatgaggaggagggcatcctggtggccgtgggccaggactgctacacccgcatctggagcctgcatgatgcccggctgctgcggaccatccccagcccctacccagccagcaaggctgacatccccagcgtggccttcagcagccggctgggcggcagcagaggagcccctggcctgctgatggctgtgggccaggacctgtactgctacagctacagctag

SEQ ID NO: 37934 - DNA, 1191 bp, Artificial Sequence
  Description of Artificial Sequence: Synthetic coding sequence
atggaggccgagcggctgcggctgctggaggaggaggccaagctgaagaaggtggccaggatgggcttcaatgccagctccatgctgaggaagagccagctgggcttcctgaatgtgaccagctacagccggctggccaatgagctgcgggtgtcctgcatggagaggaagaaggtgcagatccgcagcctggaccccagcagcctggccagtgaccgcttcaacttcatcctggccagcaccaacagcgaccagctgtttgtggtgaaccaggtggaggtggagggcagcaaatatggcatcatcagcctgcggaccctgaagatccccagcttccacgtgtatgtgctgaggaacctgtatgtgcccaacaggaaggtgaagagcctgtgctgggccagcctgaaccagctggacagccacgtgctgctgtgctttgagggcatcacagatgcccccagctgtgctgtgctgctgcctgccagccgcttcctgtctgtgcacaccagggtgaaccagcccggcatgctgtgcagcttccagatccctgaggcctggagctgtgcctggagcctgaacacccgggcctaccactgcttctctgctggcctgagccagcaggtgctgctgacctctgtggccaccggccaccagcagagctttgacaccagcagtgatgtgctggcccagcagtttgccagcacagcccccctgctcttcaacggctgccgctctggagagatctttgccatcgacctgcgctgcaggaacagaggcaagggctggagggccaccaggctcttccatgattctgctgtgacctctgtgcagatcctgcaggaggagcagtgcctgatggccagtgacatgaccgggaagatcaagctgtgggacctgcgggccaccaagtgtgtgcggcagtatgagggccacgtgaatgaaagtgcctacctgcccctgcacgtgcatgaggaggagggcatcgtggtggccgtgggccaggactgctacacccgcatctggagcctgcatgatgcccacctgctgcggaccatccccagcccctacagcgcctctgaagatgacatccccagcgtggcctttgccagccggctgggcggcatccggggggccgcccctggcctgctgatggctgtgcggcaggacctgtactgcttccccttctcctag

SEQ ID NO: 37935 - DNA, 1188 bp, Artificial Sequence
  Description of Artificial Sequence: Synthetic coding sequence
atggagagcaagaggccccggctgctggaggaggccgacaagcagaagaagacagtgcgggtgggcctgaatgcccccagcatgctgaggaagaaccagctgggcttcctgcgctttgccaactactgcagaattgcccgggagctgcgggtgtcctgcatgcagaggaagaaggtgcagatccacagctgggaccccagcagcctggccagtgaccgcttcaaccgcatcctggccaacaccaacacagaccagctgttcaccgtgaaccaggtggaggccggcggcagcaaatatggcatcatcaccatgaggggcctgaccaccccagagctgcgggtgtacccccacaagaccctgtatgtgcccaacaggaaggtgaacagcatgtgctgggccagcctgaaccacctggacagccacctgctgctgtgctttgtgggcctggccgacacccccagctgtgctgtgctgctgcctgccagcctcttcatcggcagcttccctggcatgaggcggcccggcatgctgtgcagcttccagatcccagatgcctggagctgtgcctggagcctgagcatccacgcctaccacagcttcagcacaggcctgagccagcaggtgctgctgaccaacgtggtgacaggccaccagcagagctttggcaccagcagtgatgtgctggcccagcagtttgccatcatgacccccctgctcttcaacggctgccgctctggagagatctttggaattgacctgcgctgtggcaaccagggcagcggctggaaggccatctgcctgagccatgattctgctgtgaccagcctgcagatcctgcaggacggccagttcctggtgtccagtgacatgacaggcaccatcaagctgtgggacctgcgggccaccaagtgtgtgacccagtatgagggccacgtgaacaacagcgcctacctgcctgtgcacgtgaatgaggaggagggcgtggtggccgctgtgggccaggactgctacacccgcatctggagcctgcggcacggccacctgctgaccaccatccccagcccctacccagcctctgaaaatgacatccccagcgtggccttcagcagccggctgggcggcttccggggggcccctggcctgctgatggctgtgagagaagatctctactgcttctcctatggatag

SEQ ID NO: 37936 - DNA, 1803 bp, Artificial Sequence
  Description of Artificial Sequence: Synthetic coding sequence
atgagccaccaggagggcagcactggaggcctgcctgacctggtgacagagagcctcttcagcagccctgaggagcagagcggcgtggccgctgtgacagctgccagcagtgacatcgagatggccgccacagagcccagcactggagatggaggagacaccagagatggcggcttcctgaatgatgccagcacagagaaccagaacacagacagcgagagcagcagtgaagatgtggagctggagagcatgggagagggcctgtttggctaccccctggtgggggaggagacagagcgggaggaggaggaggaggagatggaggaggagggggaggaggaggagcagcccaggatgtgcccccgctgtggcggcaccaaccacgaccagtgcctgctggatgaggaccaggccctggaggagtggatcagcagcgagaccagcgccctgcccaggagccgctggcaggtgctgacagccctgcggcagaggcagctgggcagcagcgccaggtttgtgtatgaggcctgtggggcccggacctttgtgcagcgcttccggctgcagtacctgctgggcagccacgccggctctgtgtccaccatccacttcaaccagaggggcacccggctggccagcagtggagatgacctgcgggtgattgtgtgggactgggtgcggcagaagcctgtgctgaactttgagagcggccatgacatcaacgtcatccaggccaagttcttccccaactgtggggacagcaccctggccatgtgtggccatgatggccaggtgcgggtggccgagctgatcaatgccagctactgtgagaacaccaagagggtggccaagcaccggggccctgcccacgagctggccctggagccagacagcccctacaagttcctgaccagcggagaagatgctgtggtgttcaccatcgacctgcggcaggacaggcctgccagcaaggtggtggtgacccgggagaatgacaagaaggtgggcctgtacaccatctccatgaacccagccaacatctaccagtttgctgtgggcggccatgaccagtttgtgcgcatctatgaccagaggagaattgacaagaaggaaaataatggagtgctgaagaagttcaccccccaccacctggtgtactgtgacttccccaccaacatcacctgtgtggtgtacagccatgatggaacagagctgctggccagctacaatgatgaggacatctacctgttcaacagcagcctgagtgatggagcccagtatgtgaagcgctacaagggccacagaaataatgacaccatcaagtgtgtgaacttctacggccccaggagtgaatttgtggtgtctggcagtgactgtggccacgtgttcttctgggagaagagcagcagccagatcatccagttcatggagggggacagaggagacatcgtgaactgcctggagccccacccctacctgcctgtgctggccaccagcggcctggaccagcacgtgcgcatctggacccccacagccaagacagccacagagctgaccggcctgaaggatgtgatcaagaagaacaagcaggagagagatgaggacaacctgaactacacagacagctttgacaacaggatgctgcgcttctttgtgcgccacctgctgcagagggcccaccagcccggctggagggaccatggagctgagttcccagatgaggaggagctggatgagagcagcagcaccagtgacaccagcgaggaggagggccaggacagagtgcagtgcatccccagctag

SEQ ID NO: 37937 - DNA, 1896 bp, Artificial Sequence
  Description of Artificial Sequence: Synthetic coding sequence
atgagccaccaggagggcagcacagatggcctgcctgacctgggcacagagagcctcttcagcagccctgaggagcagagcggggctgtggccgccacagaggccagcagtgacattgatattgccaccagcgagctgtctgtgacagtgactggagatggcagtgacagcagagatggcggcttccccaatgatgccagcacagaaaatagaagcagtgaccaggagagcgccagcgaggacatcgagctggagagcctggaggactttgagcacttcctgatgtctggagagagcctcttccactaccccctggtgggggaggaggagacagagcgggaggaggaggatgaggagatccaggaggagggcggggaggaggaggaggaggaggaggaggaggaggaggaggaggaggaggaggaggaggaggaggaggagcagcccagggctggcccccagggcagcggcggcaaccacgagcagtacagcctggaggaggaccaggccctggaggagtgggtgtcctctgagaccagcgccctgccccggccccgctggcaggtggtgacagccctgcaccagaggcagctgggcagccggcccaggtttgtgtatgaggcctgtggggcccgggcctttgtgcagcgcttccggctgcagtaccgcctggccgaccacgtgggctgtgtgaacacagtgcacttcaaccagaggggcacccggctggccagcagtggagatgacctgaaggtgattgtgtgggactgggtgcggcagaggcctgtgctgaactttgagagcggccacaccaacaacgtgttccaggccaagttcctgcccaactgtggggacagcaccctggccatgtgtgccagagatggccaggtgcgggtggccgagctgatcaatgccagctacttcaacaacaccaagtgtgtggcccagcaccggggccctgcccacaagctggccctggagccagacagcccctacaagttcctgaccagcggagaagatgctgtggtgttcaccatcgacctgcggcaggacaggcctgccagcaaggtggtggtgacccgggagaatgacaagaaggtgggcctgtacaccatcaccgtgaacccagccaacacctaccagtttgctgtgggcggccaggaccagtttgtgcgcatctatgaccagaggaagattgacaagaaggaaaataatggagtgctgaagaagttcaccccccaccacctggtgaactgtgacttccccaccaacatcacctgtgtggtgtacagccatgatggaacagagctgctggccagctacaatgatgatgacatctacctgttcaacagcagccacagtgatggagcccagtacagcaagcgcttcaagggccacaggaacaacaccaccgtgaagggcgtgaacttctacggccccaggagtgaatttgtggtgtctggcagtgactgtggccacatcttcttctgggagaagagcagctgccagatcatccagttcctgaagggcagccgggagggcaccatcaactgcctggagccccacccctacctgcctgtgctggcctgcagcggcctggaccatgatgtgaagatctggacccccacagccaaggccgccacagagctgaccggcctgaagaaggtgatcaagaagaacaagtgggagagagatgaggacagcctgcaccacggcagcctgtttgaccagtacatgctgtggttcctgctgcggcacgtgacccagaggggccgccaccaggactggaggtctggagaggccgagttcccagatgaggagagtgatgagagcagcagcaccagcgagaccagcgaggaggaggtgcaggacagagtgcagtgcatgcccagctag

SEQ ID NO: 37938 - DNA, 1452 bp, Artificial Sequence
  Description of Artificial Sequence: Synthetic coding sequence
atgagcacagccaggacagaaaatcctgtgatcatgggcctgagcagccagaatggccagctgcggggccctgtgaagcccaccggcggccctgggggcggcggcacccagacccagcagcagatgaaccagctgaagaacaccaacaccatcaacaacggcacccagcagcaggcccagagcatgaccaccaccatcaagccaggagatgactggaagaagaccctgaagctgccccccaaggacctgcgcatcaagaccagtgatgtgaccagcaccaagggaaatgaatttgaggactactgcctgaagcgggagctgctgatgggcatctttgagatgggctgggagaagcccagccccatccaggaggagagcatccccatcgccctgagcggccgggacatcctggcccgggccaagaatggcaccgggaagagcggggcctacctgatccccctgctggagcggctggacctgaagaaggacaacatccaggccatggtgattgtgcccacccgggagctggccctgcaggtgtcccagatctgcatccaggtgtccaagcacatgggcggggccaaggtgatggccaccaccggcggcaccaacctgagagatgacatcatgaggctggatgacacagtgcacgtggtgattgccaccccaggccgcatcctggacctgatcaagaagggcgtggccaaggtggaccacgtgcagatgattgtgctggatgaggccgacaagctgctgagccaggactttgtgcagatcatggaggacatcatcctgaccctgcccaagaaccggcagatcctgctgtacagcgccaccttccccctgtctgtgcagaagttcatgaacagccacctgcagaagccctatgagatcaacctgatggaggagctgaccctgaagggcgtgacccagtactatgcctacgtgacagagcggcagaaggtgcactgcctgaacaccctcttcagccggctgcagatcaaccagagcatcatcttctgcaacagcagccagagggtggagctgctggccaagaagatcagccagctgggctacagctgcttctacatccacgccaagatgaggcaggagcacaggaacagagtcttccatgacttcagaaatggcctgtgcaggaacctggtgtgcacagacctcttcacccggggcatcgacatccaggccgtgaatgtggtgatcaactttgacttccccaagctggccgagacctacctgcaccgcatcggccgcagcggccgcttcggccacctgggcctggccatcaacctgatcacctatgatgaccgcttcaacctgaagagcattgaggagcagctgggcacagagatcaagcccatccccagcaacatcgacaagagcctgtatgtggccgagtaccacagcgagcctgtggaggatgagaagccctag

SEQ ID NO: 37939 - DNA, 1452 bp, Artificial Sequence
  Description of Artificial Sequence: Synthetic coding sequence
atggccggctttgctgagctgggcctgagctcctggctggtggagcagtgccggcagctgggcctgaagcagcccacccctgtgcagctgggctgcatcccagccatcctggagggccgggactgcctgggctgtgccaagacaggcagcggcaagacagctgcctttgtgctgcccatcctgcagaagctgtctgaggacccctacggcatcttctgcctggtgctgacccccacccgggagctggcctaccagattgctgagcagttccgggtgctgggcaagcccctgggcctgaaggactgcatcatcgtgggcggcatggacatggtggcccaggccctggagctgagcaggaagccccacgtggtgattgccaccccaggccgcctggccgaccacctgcggagcagcaacaccttcagcatcaagaagatccgcttcctggtgatggatgaggccgaccggctgctggagcagggctgcacagacttcaccgtggacctggaggccatcctggccgctgtgcctgcccggcggcagaccctgctcttcagcgccaccctgacagacaccctgcgggagctgcagggcctggccaccaaccagcccttcttctgggaggcccaggcccctgtgtccacagtggagcagctggaccagcgctacctgctggtgcctgagaaggtgaaggatgcctacctggtgcacctgatccagcgcttccaggatgaacatgaggactggagcatcatcatcttcaccaacacctgcaagacctgccagatcctgtgcatgatgctgaggaagttctccttccccaccgtggccctgcacagcatgatgaagcagaaggagagatttgctgccctggccaagttcaagagcagcatctaccgcatcctgattgccacagatgtggccagccggggcctggacatccccaccgtgcaggtggtgatcaaccacaacaccccaggcctgcccaagatctacatccaccgggtgggccgcacagcccgggccggccggcagggccaggccatcaccctggtgacccagtatgacatccacctggtgcacgccatcgaggagcagatcaagaagaagctggaggagttctctgtggaggaggccgaggtgctgcagatcctgacccaggtgaatgtggtgcggcgggagtgtgagatcaagctggaggccgcccactttgatgagaagaaggagatcaacaagaggaagcagctgatcctggagggcaaggaccctgacctggaggccaagaggaaggccgagctggccaagatcaagcagaagaacagacgcttcaaggagaaggtggaggagaccctgaagaggcagaaggccggccgggccggccacaagggccggccccccaggacccccagcggcagccacagcggccctgtgcccagccagggcctggtgtag

SEQ ID NO: 37940 - DNA, 765 bp, Artificial Sequence
  Description of Artificial Sequence: Synthetic coding sequence
atggacatggtggcccaggccctggagctgagcaggaagccccacgtggtgattgccaccccaggccgcctggccgaccacctgcggagcagcaacaccttcagcatcaagaagatccgcttcctggtgatggatgaagctgaccggctgctggagcagggctgcacagacttcaccgtggacctggaggccatcctggccgctgtgcctgcccggcggcagaccctgctcttcagcgccaccctgacagacaccctgcgggagctgcagggcctggccaccaaccagcccttcttctgggaggcccaggcccctgtgtccacagtggagcagctggaccagcgctacctgctggtgcctgagaaggtgaaggatgcctacctggtgcacctgatccagcgcttccaggatgaacatgaggactggagcatcatcatcttcaccaacacctgcaagacctgccagatcctgtgcatgatgctgaggaagttctccttccccaccgtggccctgcacagcatgatgaagcagaaggagagatttgctgccctggccaagttcaagagcagcatctaccgcatcctgattgccacagatgtggccagcagaggagctgaccagccccccctgcccccaggggcctggaccagcctgcgctaccgctggagcagcaccaccaccccacctggcagccccaggagcaccagcacagaatctgctggccggcctgtgcagggcggccgggtgcggcccagccgctggtag

SEQ ID NO: 37941 - DNA, 1803 bp, Artificial Sequence
  Description of Artificial Sequence: Synthetic coding sequence
atggagcacgtgacagagggctcctgggagagcctgcctgtgcccctgcacccccaggtgctgggcgccctgcgggagctgggcttcccctacatgacccctgtgcagagcgccaccatccccctcttcatgaggaacaaggatgtggccgctgaggccgtgactggaagtggcaagaccctggcctttgtgatccccatcctggagatcctgctgcggcgggaggagaagctgaagaagagccaggtgggcgccatcatcatcacccccacccgggagctggccatccagattgatgaggtgctgagccacttcaccaagcacttccctgagttcagccagatcctgtggattggaggaagaaatcctggagaagatgtggagcgcttcaagcagcagggcggcaacatcatcgtggccaccccaggccgcctggaggacatgttccggaggaaggccgagggcctggacctggccagctgtgtgcgcagcctggatgtgctggtgctggatgaagctgaccggctgctggacatgggctttgaggccagcatcaacaccatcctggagttcctgcccaagcagaggagaacaggcctcttcagcgccacccagacccaggaggtggagaacctggtgcgggccggcctgaggaaccctgtgcgggtgtctgtgaaggagaagggcgtggccgccagcagcgcccagaagacccccagccggctggagaactactacatggtgtgcaaggcagatgagaagttcaaccagctggtgcacttcctgaggaaccacaagcaggagaagcacctggtgttcttcagcacctgtgcctgtgtggagtactacggcaaggccctggaggtgctggtgaagggcgtgaagatcatgtgcatccacggcaagatgaagtacaagaggaacaagatcttcatggagttcaggaagctgcagagcggcatcctggtgtgcacagatgtgatggcccggggcatcgacatccctgaggtgaactgggtgctgcagtatgacccccccagcaatgccagcgcctttgtgcaccgctgtggccgcacagcccgcatcggccacggcggcagcgccctggtgttcctgctgcccatggaggagagctacatcaacttcctggccatcaaccagaagtgccccctgcaggagatgaagccccagaggaacacagctgacctgctgcccaagctgaagtccatggccctggccgacagagctgtgtttgagaagggcatgaaggcctttgtgtcctatgtgcaggcctatgccaagcatgagtgcaacctgatcttccggctgaaggacctggactttgccagcctggcccggggctttgccctgctgaggatgcccaagatgcctgagctgcggggcaagcagttcccagactttgtgcctgtggatgtgaacacagacaccatccccttcaaggacaagatccgggagaagcagaggcagaagctgctggagcagcagaggcgggagaagacagaaaatgaaggccgcaggaagttcatcaagaacaaggcctggagcaagcagaaggccaagaaggagaagaagaagaagatgaatgagaagaggaagcgggaggagggcagtgacattgaagatgaggacatggaggagctgctgaatgacacccggctgctgaagaagctgaagaagggcaagatcacagaggaggagtttgagaagggcctgctgaccaccgggaagaggaccatcaagacagtggacctgggcatcagtgacctggaggatgactgctag

SEQ ID NO: 37942 - DNA, 1062 bp, Artificial Sequence
  Description of Artificial Sequence: Synthetic coding sequence
atggagcacgtgacagagggctcctgggagagcctgcctgtgcccctgcacccccaggtgctgggcgccctgcgggagctgggcttcccctacatgacccctgtgcagagcgccaccatccccctcttcatgaggaacaaggatgtggccgctgaggccgtgactggaagtggcaagaccctggcctttgtgatccccatcctggagatcctgctgcggcgggaggagaagctgaagaagagccaggtgggcgccatcatcatcacccccacccgggagctggccatccagattgatgaggtgctgagccacttcaccaagcacttccctgagttcagccagatcctgtggattggaggaagaaatcctggagaagatgtggagcgcttcaagcagcagggcggcaacatcatcgtggccaccccaggccgcctggaggacatgttccggaggaaggccgagggcctggacctggccagctgtgtgcgcagcctggatgtgctggtgctggatgaagctgaccggctgctggacatgggctttgaggccagcatcaacaccatcctggagttcctgcccaagcagaggagaacaggcctcttcagcgccacccagacccaggaggtggagaacctggtgcgggccggcctgaggaaccctgtgcgggtgtctgtgaaggagaagggcgtggccgccagcagcgcccagaagacccccagccggctggagaactactacatggtgtgcaaggcagatgagaagttcaaccagctggtgcacttcctgaggaaccacaagcaggagaagcacctggtgttcttcagcacctgtgcctgtgtggagtactacggcaaggccctggaggtgctggtgaagggcgtgaagatcatgtgcatccacggcaagatgaagtacaagaggaacaagatcttcatggagttcaggaagctgcagagcggcatcctggtgtgcacagatgtgatggcccggggcatcgacatccctgaggtgaactgggtgctgcagtatgacccccccagcaatgctgtgctgccctgctag

SEQ ID NO: 37943 - DNA, 1860 bp, Artificial Sequence
  Description of Artificial Sequence: Synthetic coding sequence
atgtttgtgcccaggagcctgaagatcaagagaaatgccaatgatgatggcaagagctgtgtggccaagatcatcaagccagaccctgaggacctgcagctggacaagagcagagatgtgcctgtggatgctgtggccacagaagctgccaccatcgacagacacatcagcgagagctgccccttccccagccctgggggccagctggccgaggtgcacagcgtgtccccagagcagggcgccaaggacagccaccccagcgaggagcctgtgaagagcttcagcaagacccagcgctgggccgagcctggagagcccatctgtgtggtgtgtggccgctacggggagtacatctgtgacaagacagatgaagatgtgtgcagcctggagtgcaaggccaagcacctgctgcaggtgaaggagaaggaggagaagagcaagctgagcaacccccagaaggctgacagcgagcctgagagccccctgaatgccagctatgtgtacaaggagcaccccttcatcctgaacctgcaggaggaccagatcgagaacctgaagcagcagctgggcatcctggtgcagggccaggaggtgacccggcccatcatcgactttgagcactgcagcctgcctgaggtgctgaaccacaacctgaagaagagcggctatgaggtgcccacccccatccagatgcagatgatccctgtgggcctgctgggccgggacatcctggccagcgctgacaccggcagcggcaagacagctgccttcctgctgcccgtcatcatgagggccctgtttgagagcaagaccccatctgccctgatcctgacccccacccgggagctggccatccagatcgagcggcaggccaaggagctgatgagcggcctgcccaggatgaagacagtgctgctggtgggcggcctgcccctgcccccccagctgtaccgcctgcagcagcacgtgaaggtgatcatcgccaccccaggccgcctgctggacatcatcaagcagagctctgtggagctgtgtggggtgaagatcgtggtggtggatgaagctgacaccatgctgaagatgggcttccagcagcaggtgctggacatcctggagaacatccccaatgactgccagaccatcctggtgtctgccaccatccccaccagcattgagcagctggccagccagctgctgcacaaccctgtgcgcatcatcactggagagaagaacctgccctgtgccaacgtgcggcagatcatcctgtgggtggaggaccctgccaagaagaagaagctgtttgagatcctgaatgacaagaagctgttcaagccccctgtgctggtgtttgtggactgcaagctgggcgctgacctgctgtctgaggccgtgcagaagatcaccggcctgaagagcatcagcatccacagcgagaagagccagatcgagaggaagaacatcctgaagggcctgctggagggggactatgaggtggtggtgtccactggagtgctgggccggggcctggacctgatctctgtgcggctggtggtgaactttgacatgcccagctccatggatgaatatgtgcaccagatcggccgggtgggccgcctgggccagaatggaacagccatcaccttcatcaacaacaacagcaagaggctcttctgggacatcgccaagagggtgaagcccaccggcagcatcctgcccccccagctgctgaacagcccctacctgcatgaccagaagaggaaggagcagcagaaggacaagcagacccagaatgacctggtgactggagccaacctgatggacatcatcaggaagcatgacaagagcaacagccagaagtag

SEQ ID NO: 37944 - DNA, 618 bp, Artificial Sequence
  Description of Artificial Sequence: Synthetic coding sequence
atgaagacagtgctgctggtgggcggcctgcccctgcccccccagctgtaccgcctgcagcagcacgtgaaggacaagaagctgttcaagccccctgtgctggtgtttgtggactgcaagctgggcgctgacctgctgtctgaggccgtgcagaagatcaccggcctgaagagcatcagcatccacagcgagaagagccagatcgagaggaagaacatcctgaagggcctgctggagggggactatgaggtggtggtgtccactggagtgctgggccggggcctggacctgatctctgtgcggctggtggtgaactttgacatgcccagctccatggatgaatatgtgcaccagatcggccgggtgggccgcctgggccagaatggaacagccatcaccttcatcaacaacaacagcaagaggctcttctgggacatcgccaagagggtgaagcccaccggcagcatcctgcccccccagctgctgaacagcccctacctgcatgaccagaagaggaaggagcagcagaaggacaagcagacccagaatgacctggtgactggagccaacctgatggacatcatcaggaagcatgacaagagcaacagccagaagtag

SEQ ID NO: 37945 - DNA, 1704 bp, Artificial Sequence
  Description of Artificial Sequence: Synthetic coding sequence
atgtttgtgcccaggagcctgaagatcaagagaaatgccaatgatgatggcaagagctgtgtggccaagatcatcaagccagaccctgaggacctgcagctggacaagagcagagatgtgcctgtggatgctgtggccacagaagctgccaccatcgacagacacatcagcgagagctgccccttccccagccctgggggccagctggccgaggtgcacagcgtgtccccagagcagggcgccaaggacagccaccccagcgaggagcctgtgaagagcttcagcaagacccagcgctgggccgagcctggagagcccatctgtgtggtgtgtggccgctacggggagtacatctgtgacaagacagatgaagatgtgtgcagcctggagtgcaaggccaagcacctgctgcaggtgaaggagaaggaggagaagagcaagctgagcaacccccagaaggctgacagcgagcctgagagccccctgaatgccagctatgtgtacaaggagcaccccttcatcctgaacctgcaggaggaccagatcgagaacctgaagcagcagctgggcatcctggtgcagggccaggaggtgacccggcccatcatcgactttgagcactgcagcctgcctgaggtgctgaaccacaacctgaagaagagcggctatgaggtgcccacccccatccagatgcagatgatccctgtgggcctgctgggccgggacatcctggccagcgctgacaccggcagcggcaagacagctgccttcctgctgcccgtcatcatgagggccctgtttgagagcaagaccccatctgccctgatcctgacccccacccgggagctggccatccagatcgagcggcaggccaaggagctgatgagcggcctgcccaggatgaagacagtgctgctggtgggcggcctgcccctgcccccccagctgtaccgcctgcagcagcacgtgaaggtgatcatcgccaccccaggccgcctgctggacatcatcaagcagagctctgtggagctgtgtggggtgaagatcgtggtggtggatgaagctgacaccatgctgaagatgggcttccagcagcaggtgctggacatcctggagaacatccccaatgactgccagaccatcctggtgtctgccaccatccccaccagcattgagcagctggccagccagctgctgcacaaccctgtgcgcatcatcactggagagaagaacctgccctgtgccaacgtgcggcagatcatcctgtgggtggaggaccctgccaagaagaagaagctgtttgagatcctgaatgacaagaagctgttcaagccccctgtgctggtgtttgtggactgcaagctgggcgctgacctgctgtctgaggccgtgcagaagatcaccggcctgaagagcatcagcatccacagcgagaagagccagatcgagaggaagaacatcctgaagggcctgctggagggggactatgaggtggtggtgtccactggagtgctgggccggggcctggacctgatctctgtgcggctggtggtgaactttgacatgcccagctccatggatgaatatgtgcaccagctgaacatcatctgggtggtgcccttcagcggcatcaacatcaatgccagcctgattgccctgctgtacagcctgctgaccaccatcaacatgaagttcaccccctag

SEQ ID NO: 37946 - DNA, 486 bp, Artificial Sequence
  Description of Artificial Sequence: Synthetic coding sequence
atgtttgtgcccaggagcctgaagatcaagagaaatgccaatgatgatggcaagagctgtgtggccaagatcatcaagccagaccctgaggacctgcagctggacaagagcagagatgtgcctgtggatgctgtggccacagaagctgccaccatcgacagacacatcagcgagagctgccccttccccagccctgggggccagctggccgaggtgcacagcgtgtccccagagcagggcgccaaggacagccaccccagcgaggagcctgtgaagagcttcagcaagacccagcgctgggccgagcctggagagcccatctgtgtggtgtgtggccgctacggggagtacatctgtgacaagacagatgaagatgtgtgcagcctggagtgcaaggccaagcacctgctgcaggtgaaggagaaggaggagaagagcaagctgagcaacccccagaaggctgacagcgagcctgagagcccctag

SEQ ID NO: 37947 - DNA, 1743 bp, Artificial Sequence
  Description of Artificial Sequence: Synthetic coding sequence
atgtttgtgcccaggagcctgaagatcaagagaaatgccaatgatgatggcaagagctgtgtggccaagatcatcaagccagaccctgaggacctgcagctggacaagagcagagatgtgcctgtggatgctgtggccacagaagctgccaccatcgacagacacatcagcgagagctgccccttccccagccctgggggccagctggccgaggtgcacagcgtgtccccagagcagggcgccaaggacagccaccccagcgaggagcctgtgaagagcttcagcaagacccagcgctgggccgagcctggagagcccatctgtgtggtgtgtggccgctacggggagtacatctgtgacaagacagatgaagatgtgtgcagcctggagtgcaaggccaagcacctgctgcaggtgaaggagaaggaggagaagagcaagctgagcaacccccagaaggctgacagcgagcctgagagccccctgaatgccagctatgtgtacaaggagcaccccttcatcctgaacctgcaggaggaccagatcgagaacctgaagcagcagctgggcatcctggtgcagggccaggaggtgacccggcccatcatcgactttgagcactgcagcctgcctgaggtgctgaaccacaacctgaagaagagcggctatgaggtgcccacccccatccagatgcagatgatccctgtgggcctgctgggccgggacatcctggccagcgctgacaccggcagcggcaagacagctgccttcctgctgcccgtcatcatgagggccctgtttgagagcaagaccccatctgccctgatcctgacccccacccgggagctggccatccagatcgagcggcaggccaaggagctgatgagcggcctgcccaggatgaagacagtgctgctggtgggcggcctgcccctgcccccccagctgtaccgcctgcagcagcacgtgaaggtgatcatcgccaccccaggccgcctgctggacatcatcaagcagagctctgtggagctgtgtggggtgaagatcgtggtggtggatgaagctgacaccatgctgaagatgggcttccagcagcaggtgctggacatcctggagaacatccccaatgactgccagaccatcctggtgtctgccaccatccccaccagcattgagcagctggccagccagctgctgcacaaccctgtgcgcatcatcactggagagaagaacctgccctgtgccaacgtgcggcagatcatcctgtgggtggaggaccctgccaagaagaagaagctgtttgagatcctgaatgacaagaagctgttcaagccccctgtgctggtgtttgtggactgcaagctgggcgctgacctgctgtctgaggccgtgcagaagatcaccggcctgaagagcatcagcatccacagcgagaagagccagatcgagaggaagaacatcctgaagggcctgctggagggggactatgaggtggtggtgtccactggagtgctgggccggggcctggacctgatctctgtgcggctggtggtgaactttgacatgcccagctccatggatgaatatgtgcaccaggagaacacctacaagagcacctggaggaacccccagcacttccagcaggatgtgaggatgaccctgggctacgtgggcaaggcccagtgggaggaggacaaccagctgaaggtgaagctgggcctgaagaagaactgcagcagctag

SEQ ID NO: 37948 - DNA, 5121 bp, Artificial Sequence
  Description of Artificial Sequence: Synthetic coding sequence
atgggcagcaaggaccatgctgtgttcttccgggagatgacccagctgatcctgaatgagatgcccaaggccggctacagcagcatcctgaatgactttgtggagagcaacttctttgtgattgatggagacagcctgctggtgacctgcctgggcgtgaagagcttcaagtggggccagaacctgcacttcttctacctggtggagtgctacctggtggacctgctgagcaatggaggccagttcaccatcgtgttcttcaaggatgctgaatatgcctactttgacttccctgagctgctgagcctgaggacagccctgatcctgcacctgcagcacaacaccaacattgatgtgcagacagagttcagcggctgcctgagccaggactggaagctgttcctggagcagcactacccctacttcctgattgtgtctgaggagggcctgagtgacctgcagacctacctgttcaacttcctgatcatccacagctggggcatgaaggtgaatgtggtgctgagcagcggccacgagagtgacaccctgcgcttctacgcctacaccatggagagcacagacaggaaccagaccttcagcaaagaaaatgaaacagtcatccagagcgcctacaagagcctcatccagcacctggaggagatccgggtgctggtgctggccacccactttgagcacctgaagtggaatgacatgatggaggaggcctaccagaccctcttcctgctgcagcacctgtggagcgagggcagtgacatccagagggtgctgtgtgtgaccagctgcagcctgagcctgaggatgtaccaccgggtgctggtgcacagcaactgcctgagcctgcaggaggtggaggacttctgccgcctgcgctgcctgtgtgtggccttccagctgcacctgcccctgagccagagggcctgcagcagggtcatcacctgctcctggatccggaacagcgacagcttcctgaagatgaacaagtggtgtgagtacttcatcctgagcaacctgaatgtgtttggctgctggaacctgaacctgaaccacgtgtctgacctgtatgatgagcagctgctgaagaacatcgccttctactatgaatttgagagcacccaggagccccacctgaacctgggggacagcatccggcgggactatgaggacctgtggaatgtggtgagccacctggtgaaggagttcaacgtgggcaagagcttccccctgcggaccaccaggaggcacttcctgcggcaggagaagagcgtcatccaggagatcagcctggagaagatgcccagcgtgggcttcatccccatgaccagcgctgtgattgatgaatttgtgggggacatgatgaaggacctgcccatcctgaagagtgatgatcctgtggtgcccagcctcttcaagcagaagaccagtgatgagctgctgcactggcacgcccagaggctgctgagtgatgattatgaccgcatcaagtgccacgtggatgagcagagccgggacccccacgtgctggacttcctgaagaagatccaggactaccagcagttctacggcaagagcctggagagcatcagcaccaaggtgattgtgacccagaccacccggcccaaggaggacagcagcggggccagcggggagatcctgcagaacaccaagccccaccagatcaccaagaagagcaagaagaagagcttcctgaaggaggaccagaacaaggcccagcagaatgatgacctgctcttcagcattgaggaggagatgaagaacaacctgcacagcggcatcaggaagctggaggactacctgaccagctgtgccagcaacagcgtgaagtttggagtggagatgctgggcctcatcgcctgcttcaaggcctggaagaagcactgccgcggggagggcaagatcagcaaggacctgagcattgctgtgcagatgatgaagaggatccacagcctgctggagcgctacccagagatcctggaggccgagcaccaccagtacatcgccaagtgcctgaagtacctgggcttcaatgacctggccaacagcctggaccccaccctgattggagatgacaagaacaagaagaagtacagcattgatattggccctgcccgcttccagctgcagtacatgggccactacctgatcagagatgagaggaaggaccgggacccccgggtgcaggacttcatccccaatgcctggcagcaggagctgctggatgtggtggacaagaatgaatctgctgtgattgtggcccccaccagcagcggcaagacctacgccagctactactgcatggagaaggtgctgcgggagagtgatgtgggcgtggtggtgtatgtggccccagccaagagcctggtgggccaggtggccgccaccgtggagaaccgcttcaccaagaccctgcctgctggccgcaccctgtgtggggccttcacccgggactactgccacaacgtgctgaactgccaggtgctgatcaccgtgcctgaatgttttgagatcctgctgctggccccccaccggcagaagtgggtggagcgcatccgctacgtgatctttgatgaggtgcactacctgggccgggaggtgggcgccaagttctgggagctgctgctggtgatcatccgctgccccttcctggtgctgagcgccaccatcaacaaccccaacctgctgaccaagtggctgcagagcgtgaagcagtactggaagcaggccgacaagatcatggaggagaagtgcatcagcgagaagcaggccgacaagtgcctgaacttcctgcaggaccacagctacaagaaccagagctatgaggtgcggctggtgctgtatggagagcgctacaatgacctggagaagcacatctgcagcgtgaagcatgatgatgtgtactttgaccacttccacccctgtgccgccctgaccacagacatcatcgagaagtatggcttccccccagacctgaccctgaccccccaggagagcatccagctgtatgacaccatggcccaggtgtgggagacctggccccgggcccaggagctgtgcccagaggagttcatcctcttcaagaacaagatcgtcatcaagaagctggatgccaggaaatatgaggagaacctgaaggccgagctgaccaactggatcaagaatggccaggtgaagaaggtgaagagggtgctgaagaacctgagcccagacagcctgagcagcagcaaggacatggtgaagatgttccccctgctggtggagaagctgcggcagatggacaagctgcctgccatcttcttcctgttcaagaatgatgatgtgggcaagagagctggctctgtgtgcaccttcctggagaagacagagaccaagagccacccccacacagagtgccacagctatgtgtttgccattgatgaggtgctggagaaggtgaggaagacccagaagaggatcaccaagaagaaccccaagaaggccgagaagctggagaggaagaaggtgtacagagctgagtacatcaacttcctggagaacctgaagatcctggagatcagcgaggactgcacctatgcagatgtgaaggccctgcacacagagatcaccaggaacaaggacagcaccctggagcgggtgctgccccgggtgcgcttcaccaggcatggcaaggagctgaaggccctggcccagaggggcatcggctaccaccacagctccatgtacttcaaggagaaggagtttgtggagatcctgtttgtgaagggcctcatccgggtggtgacagccacagagaccctggccctgggcatccacatgccctgcaagtctgtggtgtttgcccaggacagcgtgtacctggatgccctgaactaccggcagatgagcggccgggccggccggcggggccaggacctgctgggcaatgtgtacttctttgacatccccctgcccaagatcaagaggctgctggccagctctgtgcctgagctgcggggccagttccccctgagcatcaccctggtgctgcggctgatgctgctggccagcaaaggagatgatcctgaagatgccaaggccaaggtgctgtctgtgctgaagcacagcctgctgtccttcaagagaagaagagccatggagaccctgaagctgtacttcctgttcagcctgcagctgctgatcaaggaggactacctgaacaagaagggcaaccccaagaagtttgctggcctggccagctacctgcacggccacgagcccagcaacctggtgtttgtgaacttcctgaagaggggcctcttccacaacctgtgcaagccagcctggaagggcagccagcagttcagccaggatgtgatggagaagctggtgctggtgctggccaacctgtttggaaggaagtacatcccagccaagttccagaatgccaacctgtccttcagccagagcaaggtgatcctggccgagctgcctgaggacttcaaggccgccctgtatgagtacaacctggccgtgatgaaggactttgccagcttcctgctgattgccagcaagtctgtgaacatgaagaaggagcaccagctgcccctgagccgcatcaagttcaccgggaaggaatgtgaggacagccagctggtgagccacctgatgagctgcaagaagggccgggtggccatcagcccctttgtgtgcctgagcggcaacacagacaatgacctgctgcggcctgagaccatcaaccaggtgatcctgaggacagtgggcgtgtctggcacccaggcccccctgctgtggccctggaagctggacaacagaggccgcaggatgcccctgaatgcctacgtgctgaacttctacaagcacaactgcctgacccggctggaccagaagaatggcatgaggatgggccagctgctgaagtgcctgaaggactttgccttcaacatccaggccatcagtgacagcctgtctgagctgtgtgagaacaagagggacaacgtggtgctggccttcaagcagctgagccagaccttctatgagaagctgcaggagatgcagatccagatgagccagaaccacctggagtag

SEQ ID NO: 37949 - DNA, 378 bp, Artificial Sequence
  Description of Artificial Sequence: Synthetic coding sequence
atgggcagcaaggaccatgctgtgttcttccgggagatgacccagctgatcctgaatgagatgcccaaggccggctacagcagcatcctgaatgactttgtggagagcaacttctttgtgattgatggagacagcctgctggtgacctgcctgggcgtgaagagcttcaagtggggccagaacctgcacttcttctacctggtggagtgctacctggtggacctgctgagcaatggaggccagttcaccatcgtgttcttcaaggatgctgaatatgcctactttgacttccctgagctgctgagcctgaggacagccctgatcctgcacctgcagcacaacaccaacattgatgtgcagacagagttcagcggctag

SEQ ID NO: 37950 - DNA, 3927 bp, Artificial Sequence
  Description of Artificial Sequence: Synthetic coding sequence
atgggcagcaaggaccatgctgtgttcttccgggagatgacccagctgatcctgaatgagatgcccaaggccggctacagcagcatcctgaatgactttgtggagagcaacttctttgtgattgatggagacagcctgctggtgacctgcctgggcgtgaagagcttcaagtggggccagaacctgcacttcttctacctggtggagtgctacctggtggacctgctgagcaatggaggccagttcaccatcgtgttcttcaaggatgctgaatatgcctactttgacttccctgagctgctgagcctgaggacagccctgatcctgcacctgcagcacaacaccaacattgatgtgcagacagagttcagcggctgcctgagccaggactggaagctgttcctggagcagcactacccctacttcctgattgtgtctgaggagggcctgagtgacctgcagacctacctgttcaacttcctgatcatccacagctggggcatgaaggtgaatgtggtgctgagcagcggccacgagagtgacaccctgcgcttctacgcctacaccatggagagcacagacaggaaccagaccttcagcaaagaaaatgaaacagtcatccagagcgcctacaagagcctcatccagcacctggaggagatccgggtgctggtgctggccacccactttgagcacctgaagtggaatgacatgatggaggaggcctaccagaccctcttcctgctgcagcacctgtggagcgagggcagtgacatccagagggtgctgtgtgtgaccagctgcagcctgagcctgaggatgtaccaccgggtgctggtgcacagcaactgcctgagcctgcaggaggtggaggacttctgccgcctgcgctgcctgtgtgtggccttccagctgcacctgcccctgagccagagggcctgcagcagggtcatcacctgctcctggatccggaacagcgacagcttcctgaagatgaacaagtggtgtgagtacttcatcctgagcaacctgaatgtgtttggctgctggaacctgaacctgaaccacgtgtctgacctgtatgatgagcagctgctgaagaacatcgccttctactatgaatttgagagcacccaggagccccacctgaacctgggggacagcatccggcgggactatgaggacctgtggaatgtggtgagccacctggtgaaggagttcaacgtgggcaagagcttccccctgcggaccaccaggaggcacttcctgcggcaggagaagagcgtcatccaggagatcagcctggagaagatgcccagcgtgggcttcatccccatgaccagcgctgtgattgatgaatttgtgggggacatgatgaaggacctgcccatcctgaagagtgatgatcctgtggtgcccagcctcttcaagcagaagaccagtgatgagctgctgcactggcacgcccagaggctgctgagtgatgattatgaccgcatcaagtgccacgtggatgagcagagccgggacccccacgtgctggacttcctgaagaagatccaggactaccagcagttctacggcaagagcctggagagcatcagcaccaaggtgattgtgacccagaccacccggcccaaggaggacagcagcggggccagcggggagatcctgcagaacaccaagccccaccagatcaccaagaagagcaagaagaagagcttcctgaaggaggaccagaacaaggcccagcagaatgatgacctgctcttcagcattgaggaggagatgaagaacaacctgcacagcggcatcaggaagctggaggactacctgaccagctgtgccagcaacagcgtgaagtttggagtggagatgctgggcctcatcgcctgcttcaaggcctggaagaagcactgccgcggggagggcaagatcagcaaggacctgagcattgctgtgcagatgatgaagaggatccacagcctgctggagcgctacccagagatcctggaggccgagcaccaccagtacatcgccaagtgcctgaagtacctgggcttcaatgacctggccaacagcctggaccccaccctgattggagatgacaagaacaagaagaagtacagcattgatattggccctgcccgcttccagctgcagtacatgggccactacctgatcagagatgagaggaaggaccgggacccccgggtgcaggacttcatccccaatgcctggcagcaggagctgctggatgtggtggacaagaatgaatctgctgtgattgtggcccccaccagcagcggcaagacctacgccagctactactgcatggagaaggtgctgcgggagagtgatgtgggcgtggtggtgtatgtggccccagccaagagcctggtgggccaggtggccgccaccgtggagaaccgcttcaccaagaccctgcctgctggccgcaccctgtgtggggccttcacccgggactactgccacaacgtgctgaactgccaggtgctgatcaccgtgcctgaatgttttgagatcctgctgctggccccccaccggcagaagtgggtggagcgcatccgctacgtgatctttgatgaggtgcactacctgggccgggaggtgggcgccaagttctgggagctgctgctggtgatcatccgctgccccttcctggtgctgagcgccaccatcaacaaccccaacctgctgaccaagtggctgcagagcgtgaagcagtactggaagcaggccgacaagatcatggaggagaagtgcatcagcgagaagcaggccgacaagtgcctgaacttcctgcaggaccacagctacaagaaccagagctatgaggtgcggctggtgctgtatggagagcgctacaatgacctggagaagcacatctgcagcgtgaagcatgatgatgtgtactttgaccacttccacccctgtgccgccctgaccacagacatcatcgagaagtatggcttccccccagacctgaccctgaccccccaggagagcatccagctgtatgacaccatggcccaggtgtgggagacctggccccgggcccaggagctgtgcccagaggagttcatcctcttcaagaacaagatcgtcatcaagaagctggatgccaggaaatatgaggagaacctgaaggccgagctgaccaactggatcaagaatggccaggtgaagaaggtgaagagggtgctgaagaacctgagcccagacagcctgagcagcagcaaggacatggtgaagatgttccccctgctggtggagaagctgcggcagatggacaagctgcctgccatcttcttcctgttcaagaatgatgatgtgggcaagagagctggctctgtgtgcaccttcctggagaagacagagaccaagagccacccccacacagagtgccacagctatgtgtttgccattgatgaggtgctggagaaggtgaggaagacccagaagaggatcagcaccaagaagaaccccaagaaggccgagaagctggagaggaagaaggtgtacagagctgagtacatcaacttcctggagaacctgaagatcctggagatcagcgaggactgcacctatgcagatgtgaaggccctgcacacagagatcaccaggaacaaggacagcaccctggagcgggtgctgccccgggtgcgcttcaccaggcatggcaaggagctgaaggccctggcccagaggggcatcggctaccaccacagctccatgtacttcaaggagaaggagtttgtggagatcctgtttgtgaagggcctcatccgggtggtgacagccacagagaccctggccctgggcatccacatgccctgcaagtctgtggtgtttgcccaggacagcgtgtacctggatgccctgaactaccggcagatcatgtag

SEQ ID NO: 37951 - DNA, 5121 bp, Artificial Sequence; identical to SEQ ID NO: 37948
  Description of Artificial Sequence: Synthetic coding sequence

SEQ ID NO: 37952 - DNA, 234 bp, Artificial Sequence
  Description of Artificial Sequence: Synthetic coding sequence
atgggcagcaaggaccatgctgtgttcttccgggagatgacccagctgatcctgaatgagatgcccaaggccggctacagcagcatcctgaatgactttgtggagagcaacttctttgtgattgatggagacagcctgctggtgacctgcctgggcgtgaagagcttcaagtggggccagaacctgcacttcttctacctggtggagtgctacctggtggacctgctgtcctag

SEQ ID NO: 37953 - DNA, 297 bp, Artificial Sequence
  Description of Artificial Sequence: Synthetic coding sequence
atgggcagcaaggaccatgctgtgttcttccgggagatgacccagctgatcctgaatgagatgcccaaggccggctacagcagcatcctgaatgactttgtggagagcaacttctttgtgattgatggagacagcctgctggtgacctgcctgggcgtgaagagcttcaagtggggccagaacctgcacttcttctacctggtggagtgctacctggtggacctgctgagcaatggaggccagttcaccatcgtgttcttcaaggatgctgaatatgcctactttgacttcccctag

SEQ ID NO: 37954 - DNA, 2586 bp, Artificial Sequence
  Description of Artificial Sequence: Synthetic coding sequence
atgcccatcctgctcttcctgattgacaccagcgcctccatgaaccagaggacagacctgggcaccagctacctggacatcgccaagggagctgtggagctgttcctgaagctgcgggcccgggaccctgccagcagaggagaccgctacatgctggtgacctatgatgagcccccctactgcatcaaggccggctggaaggagaaccacgccaccttcatgtctgagctgaagaacctgcaggccagcggcctgaccaccctgggccaggccctgcggagcagctttgacctgctgaacctgaacagactcatcagcggcatcgacaactacggccagggcaggaaccccttcttcctggagcccagcatcctgatcaccatcacagatggcaacaagctgaccagcacagctggggtgcaggaggagctgcacctgcccctgaacagccccctgcccggcagcgagctgaccaaggagcccttccgctgggaccagaggctgtttgccctggtgctgcggctgcccggggtggccagcacagagcctgagcagctgggctctgtgcccacagatgagagcgccatcacccagatgtgtgaggtgactggaggccgcagctactgtgtgaggacccagaggatgctgaaccagtgcctggagagcctggtgcagaaggtgcagagcggcgtggtgatcaactttgagaagacaggccctgaccccctgcccatcggagaagatggcctgatggacagcagccggcccagcaacagctttgctgcccagccctggcacagctgccacaagctgatctacgtgcggcccaacagcaagacaggagtgcctgtgggccactggcccatccctgagagcttctggccagaccagaacctgcccagcctgccccccaggaccagccaccctgtggtgcgcttcagctgtgtggactgtgagcccatggtgattgacaagctgccctttgacaagtatgagctggagcccagccccctgacccagtacatcctggagaggaagagcccccacacctgctggcaggtgtttgtgaccagcagcggcaagtacaatgagctgggctaccccttcggctacctgaaggccagcaccaccctgacctgtgtgaacctgtttgtgatgccctacaactaccctgtgctgctgcccctgctggatgacctcttcaaggtgcacaagctgaagcccaacctgaagtggaggcaggcctttgacagctacctgaagaccctgcccccctactacctgctgaccaagctggagagcgagcgcatcctggcctctgtgggcaagaagccaccccaggagatcggcatcaaggtgaagaaccacagcggcggcggcatgagcctgacccacaacaagaacttcaggaagctgctgaaggagatcactggagaaacagccctgcggctgacagagctgaacaccaaggagtttgctggcttccagatcggcctgctgaacaaggacctgaagccccagacctacagaaatgcctatgacatcccccggcggggcctgctggaccagctgaccaggatgaggagcaacctgctgaagacccacaagttcatcgtgggccaggatgaggacagcctgcacagcgtgcctgtggcccagatgggcaactaccaggagtacctgaagaccctggccagccccctgcgggagattgatcctgaccagcccaagaggctgcacaccttcggcaaccccttcaagcaggacaagaagggcatgatgattgatgaagcagatgaatttgtggccggcccccagaacaaggtgaagaggcctggagagcccaacagccccatgagcagcaagagaagaagatccatgagcctgctgctgaggaagccccagaccccacccaccgtgaccaaccacgtgggcggcaaaggacctccttctgcctcctggttccccagctaccccaacctgatcaagcccaccctggtgcacacagatgccaccatcatccatgatggccacgaggagaagatggagaatggccagatcaccccagatggcttcctgagcaagagcgcccccagcgagctgatcaacatgactggagacctgatgccacccaaccaggtggacagcctgagtgatgacttcaccagcctgagcaaggatggcctcatccagaagccaggcagcaatgcctttgtgggcggggccaagaactgcagcctgtctgtggatgaccagaaggaccctgtggccagcaccctgggcgccatgcccaacaccctgcagatcaccccagccatggcccagggcatcaatgctgacatcaagcaccagctgatgaaggaggtgaggaagtttggaagaaaatatgaaagaatcttcatcctgctggaggaggtgcagggccccctggagatgaagaagcagtttgtggagttcaccatcaaggaggccgcccgcttcaagagaagagtgctgatccagtacctggagaaggtgctggagaagatcaacagccaccacctgcacaacaacatcagccacatcaacagccgcagcagctgctag

SEQ ID NO: 37955 - DNA, 4161 bp, Artificial Sequence
  Description of Artificial Sequence: Synthetic coding sequence
atgagcagctctgtgcggaggaagggcaagccaggaaaaggaggcggcaagggcagcagccggggcggccggggcggccgcagccacgccagcaagagccacggcagcggcggcggcggcggcggcggcggcggcggcggcggcggcaacaggaaggccagcagccgcatctgggatgatggagatgacttctgcatcttcagcgagagcagaagacccagccggcccagcaacagcaacatcagcaaaggagagagccggcccaagtggaagcccaaggccaaggtgcccctgcagaccctgcacatgaccagcgagaaccaggagaaggtgaaggccctgctgcgggacctgcaggagcaggatgctgatgctggcagcgagcggggcctgagcggggaggaggaggatgatgagccagactgctgcaatgatgagcgctactggccagctggccaggagcccagcctggtgcctgacctggaccccctggagtatgccggcctggcctctgtggagccctacgtgcctgagttcaccgtgagcccctttgctgtgcagaagctgagccgctatggcttcaacacagagcgctgccaggccgtgctgaggatgtgtgatggagatgtgggcgccagcctggagcacctgctgacccagtgcttcagcgagaccttcggggagaggatgaagatcagcgaggccgtgaaccagatcagcctggatgagtgcatggagcagaggcaggaggaggcctttgccctgaagagcatctgtggggagaagttcatcgagcgcatccagaacagagtgtggaccatcggcctggagctggagtacctgaccagccgcttcaggaagagcaagcccaaggagagcaccaagaatgtgcaggagaacagcctggagatctgcaagttctacctgaagggcaactgcaagtttggcagcaagtgccgcttcaagcatgaggtgccccccaaccagatcgtgggccgcatcgagaggtctgtggatgacagccacctgaatgccattgaagatgccagcttcctgtatgagctggagatccgcttcagcaaggaccacaagtacccctaccaggcccccctggtggccttctacagcaccaatgaaaacctgcccctggcctgccgcctgcacatcagcgagttcctgtatgacaaggccctgacctttgctgagaccagcgagcctgtggtgtacagcctcatcaccctgctggaggaggagagcgagatcgtgaagctgctgaccaacacccaccacaagtacagcgacccccctgtgaacttcctgcctgtgcccagcaggacccgcatcaacaacccagcctgccacaagacagtcatccccaacaacagctttgtgagcaaccagatccctgaggtggagaaggccagcgagagcgaggagagtgatgaagatgatggccctgcccctgtgattgtggagaatgaaagctatgtgaacctgaagaagaagatcagcaagagatatgactggcaggccaagtctgtgcatgctgaaaatggcaagatctgcaagcagttcaggatgaagcaggccagccggcagttccagagcatcctgcaggagcggcagagcctgcctgcctgggaggagcgggagaccatcctgaacctgctgaggaagcaccaggtggtggtgatcagcggcatgacaggctgcggcaagaccacccagatcccccagttcatcctggatgacagcctgaatggacctcctgagaaggtggccaacatcatctgcacccagccccggcgcatcagcgccatctctgtggccgagcgggtggccaaggagcgggcagagcgggtgggcctgactgtgggctaccagatccggctggagagcgtgaagagcagcgccacccggctgctgtactgcaccaccggggtgctgctgcggcggctggagggggacacagccctgcagggcgtgagccacatcatcgtggatgaggtgcatgagaggacagaggagagtgacttcctgctgctggtgctgaaggacatcgtgtcccagaggcctggcctgcaggtgatcctgatgtctgccaccctgaatgctgagctgttcagtgactacttcaacagctgccctgtgatcaccatccctggccgcaccttccctgtggaccagttcttcctggaggatgccatcgctgtgaccaggtatgtgctgcaggacggcagcccctacatgaggtccatgaagcagatcagcaaggagaagctgaaggcccggaggaacagaacagcctttgaggaggtggaggaggacctgcggctgagcctgcacctgcaggaccaggacagcgtgaaggatgctgtgcctgaccagcagctggacttcaagcagctgctggcccgctacaagggcgtgtccaagagcgtcatcaagaccatgagcatcatggactttgagaaggtgaacctggagctgattgaggccctgctggagtggatcgtggatggcaagcacagctacccacctggggccatcctggtgttcctgcccggcctggccgagatcaagatgctgtatgagcagctgcagagcaacagcctcttcaacaacagaagaagcaacagatgtgtgatccaccccctgcacagcagcctgagcagcgaggagcagcaggccgtgtttgtgaagcccccagctggggtgaccaagatcatcatcagcaccaacattgctgagaccagcatcaccattgatgatgtggtgtatgtgattgattctgggaagatgaaggagaagagatatgatgccagcaagggcatggagagcctggaggacacctttgtgtcccaggccaatgccctgcagaggaagggccgggccggccgggtggccagcggcgtgtgcttccacctgttcaccagccaccactacaaccaccagctgctgaagcagcagctgcctgagatccagagggtgcccctggagcagctgtgcctgcgcatcaagatcctggagatgttttctgcccacaacctgcagagcgtcttcagccggctgattgagcccccccacacagacagcctgcgggccagcaagatccggctgcgggacctgggcgccctgaccccagatgagcggctgacccccctgggctaccacctggccagcctgcctgtggatgtgcgcatcggcaagctgatgctgtttggcagcatcttccgctgcctggaccctgccctgaccatcgccgccagcctggccttcaagagcccctttgtgagcccctgggacaagaaggaggaggccaaccagaagaagctggagtttgcctttgccaacagcgactacctggccctgctgcaggcctacaagggctggcagctgagcaccaaggagggcgtgcgggccagctacaactactgccggcagaacttcctgagcggccgggtgctgcaggagatggccagcctgaagaggcagttcacagagctgctgagtgacattggatttgcccgggagggcctgcgggcccgggagattgagaagagggcccagggcggagatggagtgctggatgccactggagaggaggccaacagcaatgctgagaaccccaagctgatcagcgccatgctgtgtgccgccctgtaccccaacgtggtgcaggtgaagagccctgagggcaagttccagaagaccagcactggagctgtgaggatgcagcccaagtctgctgagctgaagtttgtgaccaagaatgatggctacgtgcacatccaccccagctctgtgaactaccaggtgcgccactttgacagcccctacctgctgtaccacgagaagatcaagaccagcagggtcttcatccgggactgcagcatggtgtctgtgtaccccctggtgctgtttggaggcggccaggtgaatgtgcagctgcagagaggagaatttgtggtgtccctggatgatggctggatccgctttgtggccgccagccaccaggtggccgagctggtgaaggagctgcgctgtgagctggaccagctgctgcaggacaagatcaagaaccccagcattgacctgtgcacctgcccccggggcagccgcatcatcagcaccatcgtgaagctggtgaccacccagtag

SEQ ID NO: 37956 - DNA, 1302 bp, Artificial Sequence
  Description of Artificial Sequence: Synthetic coding sequence
atgaccagcgagaaccaggagaaggtgaaggccctgctgcgggacctgcaggagcaggatgctgatgctggcagcgagcggggcctgagcggggaggaggaggatgatgagccagactgctgcaatgatgagcgctactggccagctggccaggagcccagcctggtgcctgacctggaccccctggagtatgccggcctggcctctgtggagccctacgtgcctgagttcaccgtgagcccctttgctgtgcagaagctgagccgctatggcttcaacacagagcgctgccaggccgtgctgaggatgtgtgatggagatgtgggcgccagcctggagcacctgctgacccagtgcttcagcgagaccttcggggagaggatgaagatcagcgaggccgtgaaccagatcagcctggatgagtgcatggagcagaggcaggaggaggcctttgccctgaagagcatctgtggggagaagttcatcgagcgcatccagaacagagtgtggaccatcggcctggagctggagtacctgaccagccgcttcaggaagagcaagcccaaggagagcaccaagaatgtgcaggagaacagcctggagatctgcaagttctacctgaagggcaactgcaagtttggcagcaagtgccgcttcaagcatgaggtgccccccaaccagatcgtgggccgcatcgagaggtctgtggatgacagccacctgaatgccattgaagatgccagcttcctgtatgagctggagatccgcttcagcaaggaccacaagtacccctaccaggcccccctggtggccttctacagcaccaatgaaaacctgcccctggcctgccgcctgcacatcagcgagttcctgtatgacaaggccctgacctttgctgagaccagcgagcctgtggtgtacagcctcatcaccctgctggaggaggagagcgagatcgtgaagctgctgaccaacacccaccacaagtacagcgacccccctgtgaacttcctgcctgtgcccagcaggacccgcatcaacaacccagcctgccacaagacagtcatccccaacaacagctttgtgagcaaccagatccctgaggtggagaaggccagcgagagcgaggagagtgatgaagatgatggccctgcccctgtgattgtggagaatgaaagctatgtgaacctgaagaagaagatcagcaagagatatgactggcaggccaagtctgtgcatgctgaaaatggcaagatctgcaagcagttcaggatgaagcagatcctgcagagccacctgtag

SEQ ID NO: 37957 - DNA, 1731 bp, Artificial Sequence
  Description of Artificial Sequence: Synthetic coding sequence
atgcccccacccaggacccgggagggccgggaccggcgggaccaccaccgggcccccagcgaggaggaggccctggagaagtgggactggaactgcccagagacccggcggctgctggaggatgccttcttccgggaggaggactacatccggcagggcagcgaggagtgccagaagttctggaccttctttgagcggctgcagcgcttccagaacctgaagaccagcaggaaggaggagaaggaccccggccagcccaagcacagcatcccagccctggccgacctgcccaggacctatgacccccgctaccgcatcaacctgtctgtgctgggccctgccacccggggcagccagggcctgggccgccacctgcctgctgagcgggtggccgagttccggcgggccctgctgcactacctggactttggccagaagcaggccttcggccgcctggccaagctgcagcgggagcgggccgccctgcccatcgcccagtatggcaaccgcatcctgcagaccctgaaggagcaccaggtggtggtggtggccggggacaccggctgcggcaagagcacccaggtgccccagtacctgctggccgccggcttcagccacgtggcctgcacccagcccaggagaattgcctgcatcagcctggccaagagggtgggctttgagagcctgagccagtatggcagccaggtgggctaccagatccgctttgagagcaccaggtctgctgccaccaagatcgtgttcctgactgtgggcctgctgctgcggcagatccagcgggagcccagcctgccccagtatgaggtgctgattgtggatgaggtgcatgagcggcacctgcacaatgacttcctgctgggcgtgctgcagaggctgctgcccaccaggccagacctgaaggtgatcctgatgtctgccaccatcaacatcagcctcttcagcagctacttcagcaatgcccctgtggtgcaggtgcccggccgcctcttccccatcaccgtgtttgatgtggcccctcctggggtgaggaagtgcatcctgagcaccaacattgctgagacctctgtgaccattgatggcatccgctttgtggtggacagcggcaaggtgaaggagatgtcctatgacccccaggccaagctgcagaggctgcaggagttctggatcagccaggccagcgctgagcagaggaagggccgggccggccgcacaggccctggggtgtgcttccggctgtatgcagagagtgactatgatgcctttgccccctaccctgtgcctgagatccggcgggtggccctggacagcctggtgctgcagatgaagtccatgtctgtgggggaccccaggaccttccccttcatcgagcccccacctccagccagcctggagacagccatcctgtacctgcgggaccagggcgccctggacagcagcgaggccctgacccccatcggcagcctgctggcccagctgcctgtggatgtggtgattggcaagatgctgatcctgggctccatgttcagcctggtggagcctgtgctgaccatcgctgctgccctgtctgtgcagagccccttcaccaggtctgcccagagcagccctgagtgctgcaccccaccagccagcagcctggccgccccccgctgctgcacccaccgctcctggaggcctgccacagccacagaggccgagaccaccaggaccaggtag

SEQ ID NO: 37958 - DNA, 3432 bp, Artificial Sequence
  Description of Artificial Sequence: Synthetic coding sequence
atgcccccacccaggacccgggagggccgggaccggcgggaccaccaccgggcccccagcgaggaggaggccctggagaagtgggactggaactgcccagagacccggcggctgctggaggatgccttcttccgggaggaggactacatccggcagggcagcgaggagtgccagaagttctggaccttctttgagcggctgcagcgcttccagaacctgaagaccagcaggaaggaggagaaggaccccggccagcccaagcacagcatcccagccctggccgacctgcccaggacctatgacccccgctaccgcatcaacctgtctgtgctgggccctgccacccggggcagccagggcctgggccgccacctgcctgctgagcgggtggccgagttccggcgggccctgctgcactacctggactttggccagaagcaggccttcggccgcctggccaagctgcagcgggagcgggccgccctgcccatcgcccagtatggcaaccgcatcctgcagaccctgaaggagcaccaggtggtggtggtggccggggacaccggctgcggcaagagcacccaggtgccccagtacctgctggccgccggcttcagccacgtggcctgcacccagcccaggagaattgcctgcatcagcctggccaagagggtgggctttgagagcctgagccagtatggcagccaggtgggctaccagatccgctttgagagcaccaggtctgctgccaccaagatcgtgttcctgactgtgggcctgctgctgcggcagatccagcgggagcccagcctgccccagtatgaggtgctgattgtggatgaggtgcatgagcggcacctgcacaatgacttcctgctgggcgtgctgcagaggctgctgcccaccaggccagacctgaaggtgatcctgatgtctgccaccatcaacatcagcctcttcagcagctacttcagcaatgcccctgtggtgcaggtgcccggccgcctcttccccatcaccgtggtgtaccagccccaggaggccgagcccaccaccagcaagtctgagaagctggacccccggcccttcctgcgggtgctggagagcattgaccacaagtacccacctgaggagcggggggacctgctggtgttcctgagcggcatggccgagatctctgctgtgctggaggccgcccagacctacgccagccacacccagcgctgggtggtgctgcccctgcacagcgccctgtctgtggccgaccaggacaaggtgtttgatgtggcccctcctggggtgaggaagtgcatcctgagcaccaacattgctgagacctctgtgaccattgatggcatccgctttgtggtggacagcggcaaggtgaaggagatgtcctatgacccccaggccaagctgcagaggctgcaggagttctggatcagccaggccagcgctgagcagaggaagggccgggccggccgcactggacctggggtgtgcttccggctgtatgcagagagtgactatgatgcctttgccccctaccctgtgcctgagatcagaagagtggccctggacagcctggtgctgcagatgaagtccatgtctgtgggggaccccaggaccttccccttcatcgagcccccacctccagccagcctggagacagccatcctgtacctgcgggaccagggcgccctggacagcagcgaggccctgacccccatcggcagcctgctggcccagctgcctgtggatgtggtgattggcaagatgctgatcctgggctccatgttcagcctggtggagcctgtgctgaccatcgccgccgccctgtctgtgcagagccccttcaccaggtctgcccagagcagcccagaatgtgccgccgcccggcggcccctggagagtgaccagggcgaccccttcaccctcttcaacgtgttcaatgcctgggtgcaggtgaagtctgagaggagcaggaacagcaggaagtggtgcagaagaagaggcatcgaggagcaccggctgtatgagatggccaacctgcggcggcagttcaaggagctgctggaggaccacggcctgctggccggggcccaggccgcccaggtgggggacagctacagccggctgcagcagaggcgggagcggcgggccctgcaccagctgaagaggcagcacgaggagggcgccggcagaagaaggaaggtgctgcggctgcaggaggagcaggacggcggcagcagtgatgaggacagagctggccctgcccctcctggggccagtgatggagtggacatccaggatgtgaagttcaagctgcggcatgacctggcccagctgcaggccgccgccagcagcgcccaggacctgagccgggagcagctggccctgctgaagctggtgctgggccggggcctgtacccccagctggccgtgcctgatgccttcaacagcagcaggaaggacagcgaccagatcttccacacccaggccaagcagggcgctgtgctgcaccccacctgtgtgtttgctggcagccctgaggtgctgcacgcccaggagctggaggccagcaactgtgatggcagcagagatgacaaggacaagatgagcagcaagcaccagctgctgagctttgtgtccctgctggagaccaacaagccctacctggtgaactgtgtgcgcatcccagccctgcagagcctgctgctcttcagccgcagcctggacaccaacggggactgcagccggctggtggctgatggctggctggagctgcagctggccgacagcgagagcgccatccggctgctggccgccagcctgcggctgcgggcccgctgggagagcgccctggaccggcagctggcccaccaggcccagcagcagctggaggaggaggaggaggacacccctgtgagccccaaggaggtggccaccctgagcaaggagctgctgcagttcaccgccagcaagatcccctacagcctgcggcggctgaccggcctggaggtgcagaacatgtatgtgggcccccagaccatcccagccaccccccacctgcccggcctgtttggcagcagcaccctgagcccccaccccaccaagggcggctatgctgtgacagacttcctgacctacaactgcctgaccaatgacacagacctgtacagcgactgcctgcggaccttctggacctgcccccactgcggcctgcacgcccccctgacccccctggagcgcatcgcccacgagaacacctgcccccaggccccccaggacggccccccaggagctgaggaggccgccctggagaccctgcagaagacctctgtgctgcagaggccctaccactgtgaggcctgtgggaaggacttcctgttcacccccacagaggtgctgcggcacaggaagcagcacgtgtag

SEQ ID NO: 37959 - DNA, 3474 bp, Artificial Sequence
  Description of Artificial Sequence: Synthetic coding sequence
atgggcaagctgcggcggcgctacaacatcaagggccggcagcaggccggccctggccccagcaagggccccccagagcccccacctgtgcagctggagctggaggacaaggacaccctgaagggcgtggatgccagcaatgccctggtgctgcccgggaagaagaagaagaagaccaaggccccacccctgagcaagaaggagaagaagcccctgaccaagaaggagaagaaggtgctgcagaagatcctggagcagaaggagaagaagagccagagagctgagatgctgcagaagctgtctgaggtgcaggccagcgaggccgagatgaggctcttctacaccaccagcaagctgggcactggaaacaggatgtaccacaccaaggagaaggcagatgaggtggtggcccctggccaggagaagatcagcagcctgagcggggcccacaggaagagaagacgctggcccagcgctgaggaggaggaggaggaggaggaggagagcgagagcgagctggaggaggagagcgagctggatgaagatcctgctgctgagcctgctgaggccggcgtgggcaccaccgtggcccccctgcccccagccccagcccccagcagccagcctgtgcctgctggcatgacagtgcccccacctcctgctgctgccccacccctgccccgggccctggccaagccagctgtgttcatccctgtgaacagaagccctgagatgcaggaggagcggctgaagctgcccatcctgtctgaggagcaggtgatcatggaggccgtggccgagcaccccatcgtcatcgtgtgtggggagactggaagtggcaagaccacccaggtgccccagttcctgtatgaggccggcttcagcagtgaagattccatcattggagtgacagagcccaggagagtggccgctgtggccatgagccagagggtggccaaggagatgaacctgagccagagggtggtgtcctaccagatccgctatgagggcaatgtgacagaggagacccgcatcaagttcatgacagatggagtgctgctgaaggagatccagaaggacttcctgctgctgcgctacaaggtggtgatcattgatgaggcccacgagaggtctgtgtacacagacatcctgattggcctgctgagcagaattgtgaccctgcgggccaagaggaacctgcccctgaagctgctgatcatgtctgccaccctgcgggtggaggacttcacccagaacccccggctgtttgccaagcccccacctgtgatcaaggtggagagccggcagtttcctgtgacagtgcacttcaacaagaggacccccctggaggactacagcggggagtgcttcaggaaggtgtgcaagatccacaggatgctgcctgctgggggcatcctggtgttcctgaccggccaggccgaggtgcacgccctgtgccggcggctgaggaaggccttcccccccagccgggcccggccccaggagaaggatgatgaccagaaggacagcgtggaggagatgaggaagttcaagaagagccgggcccgggccaagaaggcccgggcagaggtgctgccccagatcaacctggaccactacagcgtgctgcctgctggggagggagatgaggaccgggaggccgaggtggatgaggaggagggcgccctggacagcgacctggacctggacctgggagatggcggccaggatggaggagagcagccagatgccagcctgcccctgcacgtgctgcccctgtacagcctgctggcccctgagaagcaggcccaggtgttcaagcccccacctgagggcacccggctgtgtgtggtggccaccaacgtggccgagaccagcctgaccatccctggcatcaagtatgtggtggactgtgggaaggtgaagaagcgctactatgacagagtgactggagtgagcagcttccgggtgacctgggtgtcccaggccagcgctgaccagagagctggccgggccggccgcacagagcccggccactgctaccgcctgtacagcagcgctgtgtttggagactttgagcagttccccccacctgagatcacccggcggcctgtggaggacctgatcctgcagatgaaggccctgaatgtggagaaggtgatcaacttccccttccccaccccacccagcgtggaggccctgctggccgctgaggagctgctgattgccctgggcgccctgcagcccccccagaaggccgagcgggtgaagcagctgcaggagaaccggctgagctgccccatcacagccctgggccgcaccatggccaccttccctgtggcccccaggtatgccaagatgctggccctgagccggcagcacggctgcctgccctatgccatcaccatcgtggcctccatgacagtgcgggagctgtttgaggagctggacaggcctgctgccagtgatgaggagctgacccggctgaagagcaagagggcccgggtggcccagatgaagaggacctgggccggccagggcgccagcctgaagctgggggacctgatggtgctgctgggcgctgtgggcgcctgtgaatatgccagctgcaccccccagttctgtgaggccaacggcctgcgctacaaggccatgatggagatccggcggctgcggggccagctgaccacagctgtgaatgctgtgtgcccagaggccgagctgtttgtggaccccaagatgcagcccccaacagagagccaggtgacctacctgcggcagatcgtgacagctggcctgggggaccacctggccaggagagtgcagagcgaggagatgctggaggacaagtggagaaatgcctacaagacccccctgctggatgatcctgtgttcatccaccccagctctgtgctcttcaaggagctgcctgagtttgtggtgtaccaggagatcgtggagaccaccaagatgtacatgaagggcgtgtcctctgtggaggtgcagtggatcccagccctgctgcccagctactgccagtttgacaagcccctggaggagcccgcccccacctactgcccagagcggggccgggtgctgtgccaccgggccagcgtcttctacagagtgggctggcccctgcctgccatcgaggtggacttccctgagggcatcgaccgctacaagcactttgcccgcttcctgctggagggccaggtgttcaggaagctggccagctaccgcagctgcctgctgagcagccctggcaccatgctgaagacctgggcccggctgcagcccaggacagagagcctgctgcgggccctggtggccgagaaggctgactgccacgaggccctgctggccgcctggaagaagaaccccaagtacctgctggccgagtactgtgagtggctgccccaggccatgcacccagacatcgagaaggcctggccacccaccaccgtgcactag

SEQ ID NO: 37960 - DNA, 1851 bp, Artificial Sequence
  Description of Artificial Sequence: Synthetic coding sequence
atgtgcctggagaagcgctacctggatgtgctgagtgatgtgacaggcccccaggtgtcctgctacatcacagcccccagctatgtgctgcagcagctggagtgccgcatcatcaaccacatgagcagcctgattgtgggggacaatgaggagctggtgtccaatgtcatcaccatcgagtgcagcgacaaggagaagagggtgcccttccccatcggcatcgccatccccttcaccgcccgctaccggggcaactacagagacatcatggtgaaggtgtgtgacatcaacctgcagagcagctacctgaaccccaacagcctggagggcatgaagggcggctacaagggcacctgtgcctctgtgaaggtgtacaagctgggcatcttctctgtggtgtcctgcctgaagaaggagagcttcaccgtgaccaagaagggcctggccctgaagagctccatggacagccgcatcagcctgaactacccacctggggtcttcaccagccctgtgctggtgcagctgaagatccagcctgtggaccctgccctggtggcccacctgaaggcccagcaggacaccttctacagcgtgcagagcaccagccccctcatccacatccagcaccccagcacctaccccttccagaagcctgtgaccctcttcctgccctgcagcccctacctggacaagaacaacctgggcagcgagattgaccacaagaggcgggccagcgccaccatcaaccgcatcacccccagctacttcaacagaaccaagatcgccagcatcaggaagcccaggaagaatgcctctgaatgtctgaagctgctgggcttccgcagccaggacagcggctggtgtggcctggatgatgtggtgaagaccatccagagcggcctggtgtctgtggagctgtatgagcacctggagcgcttcatcgtgctgcacctgagcagcaccatggacaacagccacctggtgacctttgtgaagagcctggaggaggccatgctgagcaccacagcctgcatcgtgctgagccaccagaaggacaacccccacagaattgctgtgctggtggtgcccagcaaggacctgagccaggtgctgaaggacctgcacctggagggctttggaggccccccagagcccagccgccacttccaggtgcgggagggggagcagctgctgctgcgcttcaccggcaacatctttgccagcagcaatggcaaggactatggcaaggactacaccctcatcttccacctgcagaggaagccccggctggagctgcagatcaaggaggtggatgaatttggaaactacagctgcccccactacaagggcaccatcgtggtgtacaaggtgcccaagggcaagatcgtgcccaacctgaaccagagcctggtgatcaatgaaaaccacagccagctgcccatctgcaagctgcccctgaagctgcccaagcacaagaagctgatcaaccggccccagagcaccaagagggtgtccaaggaccctgtggaggccctgtgggacaacctgctgcactggctggccgaggagctgtctgaagaaaatgctgagagcctgagcagcaccctgcccctgcggcgcagcaccatccagctgatcaagctgaagaacccagatgacctgacagagcagatccacgagttcctgtgcttctggaagaagagcctgcccaccttcacagacaagctgcggctgctggcccggcacctgaggaagattggccgcagtgacctggccgaggagctgaagttcaagtgggagaacaaggtgttcacagagccccagcagtgctttgatgtggcccctgagtag

SEQ ID NO: 37961 - DNA, 2346 bp, Artificial Sequence
  Description of Artificial Sequence: Synthetic coding sequence
atgcatgatgagtgcaccccccagcagaccatgagcagcatccaggacaccaaggctgctgacattgctgcccggggggagctgaatgtgattgaaacagccaccgtgagccccaccaacggggaggagagccactacaccaaccaggtgcagctggagaagaacaagacccacatgagcagcgccctggtggagaaggagaacaacaccagcctgaatggccgggtgctgggccaggaggagagccagaacaagatgtttcctgacaatgcagaaaatgaagatgacaagcagatcgagcacatgacagtggagaacatcaatggaaaccgggaggagacccacggcatcatccagaccacagaaacagagatccaggagaccagcgagagcccccgggaggagatgaccaccagcagcatcatctgtgacatcagcaagaagtacatcaacagcaccctgcccaatgacagcgagaacatcaagcacaagaacaacatcatggagaaggagtacctggatgtgctgagtgatgtgacaggcccccaggtgtcctgctacatcacagcccccagctatgtgctgcagcagctggagtgccgcatcatcaaccacatgagcagcctcatcgtgggggacaatgaggagctggtgtccaatgtcatcaccattgaatgtagtgacaaggagaagagggtgcccttccccatcggcatcgccatccccttcaccgcccgctaccggggcaactacagagacatcatggtgaaggtgtgtgacatcaacctgcagagcagctacctgaaccccaacagcctggagggcatgaagggcggctacaagggcacctgtgcctctgtgaaggtgtacaagctgggcatcttctctgtggtgtcctgcctgaagaaggagagcttcaccgtgaccaagaagggcctggccctgaagagctccatggacagccgcatcagcctgaactacccacctggggtcttcaccagccctgtgctggtgcagctgaagatccagcctgtggaccctgccctggtggcccacctgaaggcccagcaggacaccttctacagcgtgcagagcaccagccccctcatccacatccagcaccccagcacctaccccttccagaagcctgtgaccctcttcctgccctgcagcccctacctggacaagaacaacctgggcagcgagattgaccacaagagaagagccagcgccaccatcaaccgcatcacccccagctacttcaacagaaccaagatcgccagcatcaggaagcccaggaagaatgccagcgagtgcctgaagctgctgggcttccgcagccaggacagcggctggtgtggcctggatgatgtggtgaagaccatccagagcggcctggtgtctgtggagctgtatgagcacctggagcgcttcatcgtgctgcacctgagcagcaccatggacaacagccacctggtgacctttgtgaagagcctggaggaggccatgctgagcaccacagcctgcatcgtgctgagccaccagaaggacaacccccacagaattgctgtgctggtggtgcccagcaaggacctgagccaggtgctgaaggacctgcacctggagggctttggaggccccccagagcccagccgccacttccaggtgcgggagggggagcagctgctgctgcgcttcaccggcaacatctttgccagcagcaatggcaaggactatggcaaggactacaccctcatcttccacctgcagaggaagccccggctggagctgcagatcaaggaggtggatgaatttggaaactacagctgcccccactacaagggcaccatcgtggtgtacaaggtgcccaagggcaagatcgtgcccaacctgaaccagagcctggtgatcaatgaaaaccacagccagctgcccatctgcaagctgcccctgaagctgcccaagcacaagaagctgatcaaccggccccagagcaccaagagggtgtccaaggaccctgtggaggccctgtgggacaacctgctgcactggctggccgaggagctgtctgaggagaatgctgagagcctgagcagcaccctgcccctgcggcgcagcaccatccagctgatcaagctgaagaacccagatgacctgacagagcagatccacgagttcctgtgcttctggaagaagagcctgcccaccttcacagacaagctgcggctgctggcccggcacctgaggaagattggccgcagtgacctggccgaggagctgaagttcaagtgggagaacaaggtgttcacagagccccagcagtgctttgatgtggcccctgagtag

SEQ ID NO: 37962 - DNA, 6390 bp, Artificial Sequence
  Description of Artificial Sequence: Synthetic coding sequence
atggccgagcggcgggcctttgcccagaagatcagcaggacagtggccgctgaggtgaggaagcagatcagcggccagtacagcggcagcccccagctgctgaagaacctgaacatcgtgggcaacatcagccaccacaccaccgtgcccctgacagaggccgtggaccctgtggacctggaggactacctgatcacccaccccctggccgtggacagcggccccctgcgggacctgattgagttccccccagatgacatcgaggtggtgtacagcccccgggactgcaggaccctggtgtctgctgtgcctgaggagagcgagatggacccccacgtgcgggactgcatccgcagctacacagaggactgggccatcgtcatcaggaagtaccacaagctgggcaccggcttcaaccccaacaccctggacaagcagaaggagcggcagaagggcctgcccaagcaggtgtttgaaagtgatgaggccccagatggcaacagctaccaggatgaccaggatgacctgaagaggaggtccatgagcattgatgacaccccccggggctcctgggcctgcagcatctttgacctgaagaacagcctgcctgatgccctgctgcccaacctgctggacaggaccccaaatgaggagattgaccggcagaatgatgaccagaggaagagcaacagacacaaggagctgtttgccctgcaccccagcccagatgaggaggagcccatcgagcggctgtctgtgcctgacatccccaaggagcacttcggccagaggctgctggtgaagtgcctgagcctgaagtttgaaattgaaattgagcccatctttgccagcctggccctgtatgatgtgaaggagaagaagaagatcagcgagaacttctactttgacctgaacagcgagcagatgaagggcctgctgcggccccacgtgcccccagctgccatcaccaccctggcccggagcgccatcttcagcatcacctaccccagccaggatgtgttcctggtgatcaagctggagaaggtgctgcagcagggcgacattggagaatgtgccgagccctacatgatcttcaaggaggctgatgccaccaagaacaaggagaagctggagaagctgaagagccaggccgaccagttctgccagaggctgggcaagtacaggatgccctttgcctggacagccatccacctgatgaacatcgtgtcctctgctggcagcctggagcgggacagcacagaggtggagatcagcactggagagaggaagggctcctggagcgagaggaggaacagcagcatcgtgggccgccgcagcctggagaggaccaccagcggagatgatgcctgcaacctgaccagcttccggcctgccaccctgactgtgaccaacttcttcaagcaggagggggaccggctgagtgatgaagatctctacaagttcctggccgacatgagaagacccagctctgtgctgcggcggctgcggcccatcacagcccagctgaagattgacatcagccctgcccctgagaacccccactactgcctgaccccagagctgctgcaggtgaagctgtacccagacagccgggtgcggcccacccgggagatcctggagttccctgccagagatgtgtatgtgcccaacaccacctacagaaacctgctgtacatctacccccagagcctgaactttgccaaccggcagggcagcgccaggaacatcaccgtgaaggtgcagttcatgtatggagaggaccccagcaatgccatgcctgtgatctttgggaagagcagctgcagcgagttcagcaaggaggcctacacagctgtggtgtaccacaacagaagcccagacttccacgaggagatcaaggtgaagctgcctgccaccctgacagaccaccaccacctgctcttcaccttctaccacgtgtcctgccagcagaagcagaacacccccctggagacccctgtgggctacacctggatccccatgctgcagaatggccgcctgaagacaggccagttctgcctgcctgtgtccctggagaagccaccccaggcctacagcgtgctgagccctgaggtgcccctgcccggcatgaagtgggtggacaaccacaagggcgtcttcaacgtggaggtggtggccgtgagcagcatccacacccaggacccctacctggacaagttctttgccctggtgaatgccctggatgagcacctgtttcctgtgcgcatcggggacatgaggatcatggagaacaacctggagaatgagctgaagagcagcatcagcgccctgaacagcagccagctggagcctgtggtgcgcttcctgcacctgctgctggacaagctgatcctgctggtgatccggccccctgtgattgctggccagatcgtgaacctgggccaggccagctttgaggccatggccagcatcatcaaccggctgcacaagaacctggagggcaaccacgaccagcacggcaggaacagcctgctggccagctacatccactacgtgttccggctgcccaacacctaccccaacagcagcagccctggccctgggggcctgggcggctctgtgcactacgccaccatggcccggtctgctgtgcggcctgccagcctgaacctgaacagaagccgcagcctgagcaacagcaacccagacatcagcggcacccccaccagcccagatgatgaggtgcgcagcatcatcggcagcaagggcctggacaggagcaacagctgggtgaacacaggaggccccaaggccgccccctggggcagcaaccccagccccagcgctgagagcacccaggccatggacaggagctgcaacaggatgagcagccacacagagaccagcagcttcctgcagaccctgaccggccgcctgcccaccaagaagctgttccacgaggagctggccctgcagtgggtggtgtgcagcggctctgtgcgggagagcgccctgcagcaggcctggttcttctttgagctgatggtgaagtccatggtgcaccacctgtacttcaatgacaagctggaggcccccaggaagagccgcttccctgagcgcttcatggatgacattgctgccctggtgtccaccatcgccagtgacatcgtgagccgcttccagaaggacacagagatggtggagcggctgaacaccagcctggccttcttcctgaatgacctgctgtctgtgatggaccggggctttgtgttcagcctcatcaagagctgctacaagcaggtgagcagcaagctgtacagcctgcccaaccccagcgtgctggtgtccctgcggctggacttcctgcgcatcatctgcagccatgagcactacgtgaccctgaacctgccctgcagcctgctgaccccaccagccagccccagccccagcgtgtcctctgccaccagccagagcagcggcttcagcaccaacgtgcaggaccagaagatcgccaacatgtttgagctgtctgtgcccttccggcagcagcactacctggccggcctggtgctgacagagctggccgtcatcctggaccctgatgctgagggcctgtttggcctgcacaagaaggtgatcaacatggtgcacaacctgctgagcagccatgacagcgacccccgctacagcgacccccagatcaaggcccgggtggccatgctgtacctgcccctcatcggcatcatcatggagaccgtgccccagctgtatgacttcacagagacccacaaccagaggggccggcccatctgcatcgccacagatgattatgaaagtgaaagtggctccatgatcagccagacagtggccatggccatcgccggcacctctgtgccccagctgacccggcccggcagcttcctgctgaccagcaccagcggccggcagcacaccaccttctctgctgagagcagccgcagcctgctgatctgcctgctgtgggtgctgaagaatgctgatgagaccgtgctgcagaagtggttcacagacctgtctgtgctgcagctgaaccggctgctggacctgctgtacctgtgtgtgtcctgctttgagtacaagggcaagaaggtgtttgagaggatgaacagcctgaccttcaagaagagcaaggacatgagggccaagctggaggaggccatcctgggcagcatcggggcccggcaggagatggtgcggcgcagccggggccagctggagaggagccccagcggcagcgccttcggcagccaggagaacctgcgctggaggaaggacatgacccactggaggcagaacacagagaagctggacaagagcagagctgagattgagcacgaggccctgattgatggcaacctggccacagaggccaacctgatcatcctggacaccctggagatcgtggtgcagacagtgtctgtgacagagagcaaggagagcatcctgggcggcgtgctgaaggtgctgctgcacagcatggcctgcaaccagagcgctgtgtacctgcagcactgctttgccacccagagggccctggtgtccaagtttcctgagctgctgtttgaggaggagacagagcagtgtgccgacctgtgcctgcggctgctgcggcactgcagcagcagcatcggcaccatccgcagccacgccagcgccagcctgtacctgctgatgaggcagaactttgaaattggcaacaactttgcccgggtgaagatgcaggtgaccatgagcctgagcagcctggtgggcaccagccagaacttcaatgaggagttcctgcggcgcagcctgaagaccatcctgacctacgccgaggaggacctggagctgcgggagaccaccttcccagaccaggtgcaggacctggtgttcaacctgcacatgatcctgagtgacacagtgaagatgaaggagcaccaggaggaccctgagatgctgattgacctgatgtacagaattgccaagggctaccagaccagcccagacctgcggctgacctggctgcagaacatggccggcaagcacagcgagaggagcaaccacgccgaggccgcccagtgcctggtgcacagcgctgccctggtggccgagtacctgtccatgctggaggacaggaagtacctgcctgtgggctgtgtgaccttccagaacatcagcagcaatgtgctggaggagagcgctgtgtctgatgatgtggtgtccccagatgaggagggcatctgcagcggcaagtacttcacagaaagtggcctggtgggcctgctggagcaggccgccgccagcttctccatggccggcatgtatgaggccgtgaatgaggtgtacaaggtgctgatccccatccacgaggccaacagagatgccaagaagctgagcaccatccacggcaagctgcaggaggccttcagcaagatcgtgcaccaggacggcaagaggatgtttggcacctacttccgggtgggcttctacggcaccaagtttggagacctggatgagcaggagtttgtgtacaaggagcccgccatcaccaagctggccgagatcagccaccggctggagggcttctacggggagagatttggagaagatgtggtggaggtgatcaaggacagcaaccctgtggacaagtgcaagctggaccccaacaaggcctacatccagatcacctacgtggagccctactttgacacctatgagatgaaggaccgcatcacctactttgacaagaactacaacctgcggcgcttcatgtactgcacccccttcaccctggatggccgggcccatggagagctgcacgagcagttcaagaggaagaccatcctgaccaccagccacgccttcccctacatcaagaccagggtgaatgtgacccacaaggaggagatcatcctgacccccatcgaggtggccatcgaggacatgcagaagaagacccaggagctggcctttgccacccaccaggaccctgctgaccccaagatgctgcagatggtgctgcagggctctgtgggcaccaccgtgaaccagggccccctggaggtggcccaggtgttcctgtctgagatccccagcgaccccaagctgttccgccaccacaacaagctgcggctgtgcttcaaggacttcaccaagagatgtgaagatgccctgaggaagaacaagagcctcatcggccctgaccagaaggagtaccagcgggagctggagaggaactaccaccggctgaaggaggccctgcagcccctcatcaacaggaagatcccccagctgtacaaggctgtgctgcctgtgacctgccaccgggacagcttcagcaggatgagcctgaggaagatggacctgtag

SEQ ID NO: 37963 - DNA, 6330 bp, Artificial Sequence
  Description of Artificial Sequence: Synthetic coding sequence
atggccgagcggcgggcctttgcccagaagatcagcaggacagtggccgctgaggtgaggaagcagatcagcggccagtacagcggcagcccccagctgctgaagaacctgaacatcgtgggcaacatcagccaccacaccaccgtgcccctgacagaggccgtggaccctgtggacctggaggactacctgatcacccaccccctggccgtggacagcggccccctgcgggacctgattgagttccccccagatgacatcgaggtggtgtacagcccccgggactgcaggaccctggtgtctgctgtgcctgaggagagcgagatggacccccacgtgcgggactgcatccgcagctacacagaggactgggccatcgtcatcaggaagtaccacaagctgggcaccggcttcaaccccaacaccctggacaagcagaaggagcggcagaagggcctgcccaagcaggtgtttgaaagtgatgaggccccagatggcaacagctaccaggatgaccaggatgacctgaagaggaggtccatgagcattgatgacaccccccggggctcctgggcctgcagcatctttgacctgaagaacagcctgcctgatgccctgctgcccaacctgctggacaggaccccaaatgaggagattgaccggcagaatgatgaccagaggaagagcaacagacacaaggagctgtttgccctgcaccccagcccagatgaggaggagcccatcgagcggctgtctgtgcctgacatccccaaggagcacttcggccagaggctgctggtgaagtgcctgagcctgaagtttgaaattgaaattgagcccatctttgccagcctggccctgtatgatgtgaaggagaagaagaagatcagcgagaacttctactttgacctgaacagcgagcagatgaagggcctgctgcggccccacgtgcccccagctgccatcaccaccctggcccggagcgccatcttcagcatcacctaccccagccaggatgtgttcctggtgatcaagctggagaaggtgctgcagcagggcgacattggagaatgtgccgagccctacatgatcttcaaggaggctgatgccaccaagaacaaggagaagctggagaagctgaagagccaggccgaccagttctgccagaggctgggcaagtacaggatgccctttgcctggacagccatccacctgatgaacatcgtgtcctctgctggcagcctggagcgggacagcacagaggtggagatcagcactggagagaggaagggctcctggagcgagaggaggaacagcagcatcgtgggccgccgcagcctggagaggaccaccagcggagatgatgcctgcaacctgaccagcttccggcctgccaccctgactgtgaccaacttcttcaagcaggagggggaccggctgagtgatgaagatctctacaagttcctggccgacatgagaagacccagctctgtgctgcggcggctgcggcccatcacagcccagctgaagattgacatcagccctgcccctgagaacccccactactgcctgaccccagagctgctgcaggtgaagctgtacccagacagccgggtgcggcccacccgggagatcctggagttccctgccagagatgtgtatgtgcccaacaccacctacagaaacctgctgtacatctacccccagagcctgaactttgccaaccggcagggcagcgccaggaacatcaccgtgaaggtgcagttcatgtatggagaggaccccagcaatgccatgcctgtgatctttgggaagagcagctgcagcgagttcagcaaggaggcctacacagctgtggtgtaccacaacagaagcccagacttccacgaggagatcaaggtgaagctgcctgccaccctgacagaccaccaccacctgctcttcaccttctaccacgtgtcctgccagcagaagcagaacacccccctggagacccctgtgggctacacctggatccccatgctgcagaatggccgcctgaagacaggccagttctgcctgcctgtgtccctggagaagccaccccaggcctacagcgtgctgagccctgaggtgcccctgcccggcatgaagtgggtggacaaccacaagggcgtcttcaacgtggaggtggtggccgtgagcagcatccacacccaggacccctacctggacaagttctttgccctggtgaatgccctggatgagcacctgtttcctgtgcgcatcggggacatgaggatcatggagaacaacctggagaatgagctgaagagcagcatcagcgccctgaacagcagccagctggagcctgtggtgcgcttcctgcacctgctgctggacaagctgatcctgctggtgatccggccccctgtgattgctggccagatcgtgaacctgggccaggccagctttgaggccatggccagcatcatcaaccggctgcacaagaacctggagggcaaccacgaccagcacggcaggaacagcctgctggccagctacatccactacgtgttccggctgcccaacacctaccccaacagcagcagccctggccctgggggcctgggcggctctgtgcactacgccaccatggcccggtctgctgtgcggcctgccagcctgaacctgaacagaagccgcagcctgagcaacagcaacccagacatcagcggcacccccaccagcccagatgatgaggtgcgcagcatcatcggcagcaaggccatggacaggagctgcaacaggatgagcagccacacagagaccagcagcttcctgcagaccctgaccggccgcctgcccaccaagaagctgttccacgaggagctggccctgcagtgggtggtgtgcagcggctctgtgcgggagagcgccctgcagcaggcctggttcttctttgagctgatggtgaagtccatggtgcaccacctgtacttcaatgacaagctggaggcccccaggaagagccgcttccctgagcgcttcatggatgacattgctgccctggtgtccaccatcgccagtgacatcgtgagccgcttccagaaggacacagagatggtggagcggctgaacaccagcctggccttcttcctgaatgacctgctgtctgtgatggaccggggctttgtgttcagcctcatcaagagctgctacaagcaggtgagcagcaagctgtacagcctgcccaaccccagcgtgctggtgtccctgcggctggacttcctgcgcatcatctgcagccatgagcactacgtgaccctgaacctgccctgcagcctgctgaccccaccagccagccccagccccagcgtgagcagcgccaccagccagagcagcggcttcagcaccaacgtgcaggaccagaagatcgccaacatgtttgagctgtctgtgcccttccggcagcagcactacctggccggcctggtgctgacagagctggccgtcatcctggaccctgatgctgagggcctgtttggcctgcacaagaaggtgatcaacatggtgcacaacctgctgagcagccatgacagcgacccccgctacagcgacccccagatcaaggcccgggtggccatgctgtacctgcccctgattggcatcatcatggagaccgtgccccagctgtatgacttcacagagacccacaaccagaggggccggcccatctgcatcgccacagatgattatgagagcgagagcggctccatgatcagccagacagtggccatggccatcgccggcacctctgtgccccagctgaccaggcctggcagcttcctgctgaccagcaccagcggccggcagcacaccaccttctctgctgagagcagccgcagcctgctgatctgcctgctgtgggtgctgaagaatgctgatgaaacagtgctgcagaagtggttcacagacctgtctgtgctgcagctgaaccggctgctggacctgctgtacctgtgtgtgtcctgctttgagtacaagggcaagaaggtgtttgagaggatgaacagcctgaccttcaagaagagcaaggacatgagggccaagctggaggaggccatcctgggcagcattggagcccggcaggagatggtgagaagaagccggggccagctgggcacctacaccatcgccagccccccagagaggagccccagcggcagcgccttcggcagccaggagaacctgcgctggaggaaggacatgacccactggaggcagaacacagagaagctggacaagagcagagctgagattgagcacgaggccctgattgatggcaacctggccacagaggccaacctgatcatcctggacaccctggagatcgtggtgcagacagtgtctgtgacagagagcaaggagagcatcctgggcggcgtgctgaaggtgctgctgcacagcatggcctgcaaccagagcgctgtgtacctgcagcactgctttgccacccagagggccctggtgtccaagtttcctgagctgctgtttgaggaggagacagagcagtgtgccgacctgtgcctgcggctgctgcggcactgcagcagcagcatcggcaccatccgcagccacgccagcgccagcctgtacctgctgatgaggcagaactttgaaattggcaacaactttgcccgggtgaagatgcaggtgaccatgagcctgagcagcctggtgggcaccagccagaacttcaatgaggagttcctgcggcgcagcctgaagaccatcctgacctacgccgaggaggacctggagctgcgggagaccaccttcccagaccaggtgcaggacctggtgttcaacctgcacatgatcctgagtgacacagtgaagatgaaggagcaccaggaggaccctgagatgctgattgacctgatgtacagaattgccaagggctaccagaccagcccagacctgcggctgacctggctgcagaacatggccggcaagcacagcgagaggagcaaccacgccgaggccgcccagtgcctggtgcacagcgctgccctggtggccgagtacctgtccatgctggaggacaggaagtacctgcctgtgggctgtgtgaccttccagaacatcagcagcaatgtgctggaggagagcgctgtgtctgatgatgtggtgtccccagatgaggagggcatctgcagcggcaagtacttcacagaaagtggcctggtgggcctgctggagcaggccgccgccagcttctccatggccggcatgtatgaggccgtgaatgaggtgtacaaggtgctgatccccatccacgaggccaacagagatgccaagaagctgagcaccatccacggcaagctgcaggaggccttcagcaagatcgtgcaccagagcacaggctgggagaggatgtttggcacctacttccgggtgggcttctacggcaccaagtttggagacctggatgagcaggagtttgtgtacaaggagcccgccatcaccaagctggccgagatcagccaccggctggagggcttctacggggagagatttggagaagatgtggtggaggtgatcaaggacagcaaccctgtggacaagtgcaagctggaccccaacaaggcctacatccagatcacctacgtggagccctactttgacacctatgagatgaaggaccgcatcacctactttgacaagaactacaacctgcggcgcttcatgtactgcacccccttcaccctggatggccgggcccatggagagctgcacgagcagttcaagaggaagaccatcctgaccaccagccacgccttcccctacatcaagaccagggtgaatgtgacccacaaggaggagatcatcctgacccccatcgaggtggccatcgaggacatgcagaagaagacccaggagctggcctttgccacccaccaggaccctgctgaccccaagatgctgcagatggtgctgcagggctctgtgggcaccaccgtgaaccagggccccctggaggtggcccaggtgttcctgtctgagatccccagcgaccccaagctgttccgccaccacaacaagctgcggctgtgcttcaaggacttcaccaagagatgtgaagatgccctgaggaagaacaagagcctcatcggccctgaccagaaggagtaccagcgggagctggagaggaactaccaccggctgaaggaggccctgcagcccctcatcaacaggaagatcccccagctgtacaaggctgtgctgcctgtgacctgccaccgggacagcttcagcaggatgagcctgaggaagatggacctgtag

SEQ ID NO: 37964 - DNA, 6423 bp, Artificial Sequence
  Description of Artificial Sequence: Synthetic coding sequence
atggccgagcggcgggcctttgcccagaagatcagcaggacagtggccgctgaggtgaggaagcagatcagcggccagtacagcggcagcccccagctgctgaagaacctgaacatcgtgggcaacatcagccaccacaccaccgtgcccctgacagaggccgtggaccctgtggacctggaggactacctgatcacccaccccctggccgtggacagcggccccctgcgggacctgattgagttccccccagatgacatcgaggtggtgtacagcccccgggactgcaggaccctggtgtctgctgtgcctgaggagagcgagatggacccccacgtgcgggactgcatccgcagctacacagaggactgggccatcgtcatcaggaagtaccacaagctgggcaccggcttcaaccccaacaccctggacaagcagaaggagcggcagaagggcctgcccaagcaggtgtttgaaagtgatgaggccccagatggcaacagctaccaggatgaccaggatgacctgaagaggaggtccatgagcattgatgacaccccccggggctcctgggcctgcagcatctttgacctgaagaacagcctgcctgatgccctgctgcccaacctgctggacaggaccccaaatgaggagattgaccggcagaatgatgaccagaggaagagcaacagacacaaggagctgtttgccctgcaccccagcccagatgaggaggagcccatcgagcggctgtctgtgcctgacatccccaaggagcacttcggccagaggctgctggtgaagtgcctgagcctgaagtttgaaattgaaattgagcccatctttgccagcctggccctgtatgatgtgaaggagaagaagaagatcagcgagaacttctactttgacctgaacagcgagcagatgaagggcctgctgcggccccacgtgcccccagctgccatcaccaccctggcccggagcgccatcttcagcatcacctaccccagccaggatgtgttcctggtgatcaagctggagaaggtgctgcagcagggcgacattggagaatgtgccgagccctacatgatcttcaaggaggctgatgccaccaagaacaaggagaagctggagaagctgaagagccaggccgaccagttctgccagaggctgggcaagtacaggatgccctttgcctggacagccatccacctgatgaacatcgtgtcctctgctggcagcctggagcgggacagcacagaggtggagatcagcactggagagaggaagggctcctggagcgagaggaggaacagcagcatcgtgggccgccgcagcctggagaggaccaccagcggagatgatgcctgcaacctgaccagcttccggcctgccaccctgactgtgaccaacttcttcaagcaggagggggaccggctgagtgatgaagatctctacaagttcctggccgacatgagaagacccagctctgtgctgcggcggctgcggcccatcacagcccagctgaagattgacatcagccctgcccctgagaacccccactactgcctgaccccagagctgctgcaggtgaagctgtacccagacagccgggtgcggcccacccgggagatcctggagttccctgccagagatgtgtatgtgcccaacaccacctacagaaacctgctgtacatctacccccagagcctgaactttgccaaccggcagggcagcgccaggaacatcaccgtgaaggtgcagttcatgtatggagaggaccccagcaatgccatgcctgtgatctttgggaagagcagctgcagcgagttcagcaaggaggcctacacagctgtggtgtaccacaacagaagcccagacttccacgaggagatcaaggtgaagctgcctgccaccctgacagaccaccaccacctgctcttcaccttctaccacgtgtcctgccagcagaagcagaacacccccctggagacccctgtgggctacacctggatccccatgctgcagaatggccgcctgaagacaggccagttctgcctgcctgtgtccctggagaagccaccccaggcctacagcgtgctgagccctgaggtgcccctgcccggcatgaagtgggtggacaaccacaagggcgtcttcaacgtggaggtggtggccgtgagcagcatccacacccaggacccctacctggacaagttctttgccctggtgaatgccctggatgagcacctgtttcctgtgcgcatcggggacatgaggatcatggagaacaacctggagaatgagctgaagagcagcatcagcgccctgaacagcagccagctggagcctgtggtgcgcttcctgcacctgctgctggacaagctgatcctgctggtgatccggccccctgtgattgctggccagatcgtgaacctgggccaggccagctttgaggccatggccagcatcatcaaccggctgcacaagaacctggagggcaaccacgaccagcacggcaggaacagcctgctggccagctacatccactacgtgttccggctgcccaacacctaccccaacagcagcagccctggccctgggggcctgggcggctctgtgcactacgccaccatggcccggtctgctgtgcggcctgccagcctgaacctgaacagaagccgcagcctgagcaacagcaacccagacatcagcggcacccccaccagcccagatgatgaggtgcgcagcatcatcggcagcaagggcctggacaggagcaacagctgggtgaacacaggaggccccaaggccgccccctggggcagcaaccccagccccagcgctgagagcacccaggccatggacaggagctgcaacaggatgagcagccacacagagaccagcagcttcctgcagaccctgaccggccgcctgcccaccaagaagctgttccacgaggagctggccctgcagtgggtggtgtgcagcggctctgtgcgggagagcgccctgcagcaggcctggttcttctttgagctgatggtgaagtccatggtgcaccacctgtacttcaatgacaagctggaggcccccaggaagagccgcttccctgagcgcttcatggatgacattgctgccctggtgtccaccatcgccagtgacatcgtgagccgcttccagaaggacacagagatggtggagcggctgaacaccagcctggccttcttcctgaatgacctgctgtctgtgatggaccggggctttgtgttcagcctcatcaagagctgctacaagcaggtgagcagcaagctgtacagcctgcccaaccccagcgtgctggtgtccctgcggctggacttcctgcgcatcatctgcagccatgagcactacgtgaccctgaacctgccctgcagcctgctgaccccaccagccagccccagccccagcgtgtcctctgccaccagccagagcagcggcttcagcaccaacgtgcaggaccagaagatcgccaacatgtttgagctgtctgtgcccttccggcagcagcactacctggccggcctggtgctgacagagctggccgtcatcctggaccctgatgctgagggcctgtttggcctgcacaagaaggtgatcaacatggtgcacaacctgctgagcagccatgacagcgacccccgctacagcgacccccagatcaaggcccgggtggccatgctgtacctgcccctcatcggcatcatcatggagaccgtgccccagctgtatgacttcacagagacccacaaccagaggggccggcccatctgcatcgccacagatgattatgaaagtgaaagtggctccatgatcagccagacagtggccatggccatcgccggcacctctgtgccccagctgacccggcccggcagcttcctgctgaccagcaccagcggccggcagcacaccaccttctctgctgagagcagccgcagcctgctgatctgcctgctgtgggtgctgaagaatgctgatgagaccgtgctgcagaagtggttcacagacctgtctgtgctgcagctgaaccggctgctggacctgctgtacctgtgtgtgtcctgctttgagtacaagggcaagaaggtgtttgagaggatgaacagcctgaccttcaagaagagcaaggacatgagggccaagctggaggaggccatcctgggcagcatcggggcccggcaggagatggtgcggcgcagccggggccagctgggcacctacaccatcgccagccccccagagaggagccccagcggcagcgccttcggcagccaggagaacctgcgctggaggaaggacatgacccactggaggcagaacacagagaagctggacaagagcagagctgagattgaacatgaggccctgattgatggcaacctggccacagaggccaacctgatcatcctggacaccctggagatcgtggtgcagacagtgtctgtgacagagagcaaggagagcatcctgggcggcgtgctgaaggtgctgctgcacagcatggcctgcaaccagagcgctgtgtacctgcagcactgctttgccacccagagggccctggtgtccaagtttcctgagctgctgtttgaggaggagacagagcagtgtgccgacctgtgcctgcggctgctgcggcactgcagcagcagcatcggcaccatccgcagccacgccagcgccagcctgtacctgctgatgaggcagaactttgagatcggcaacaactttgcccgggtgaagatgcaggtgaccatgagcctgagcagcctggtgggcaccagccagaacttcaatgaggagttcctgcggcgcagcctgaagaccatcctgacctatgcagaggaggacctggagctgcgggagaccaccttcccagaccaggtgcaggacctggtgttcaacctgcacatgatcctgagtgacacagtgaagatgaaggagcaccaggaggaccctgagatgctgattgacctgatgtaccgcatcgccaagggctaccagaccagcccagacctgcggctgacctggctgcagaacatggccggcaagcacagcgagaggagcaaccacgccgaggccgcccagtgcctggtgcacagcgctgccctggtggccgagtacctgtccatgctggaggacaggaagtacctgcctgtgggctgtgtgaccttccagaacatcagcagcaatgtgctggaggagagcgctgtgtctgatgatgtggtgtccccagatgaggagggcatctgcagcggcaagtacttcacagagagcggcctggtgggcctgctggagcaggccgccgccagcttctccatggccggcatgtatgaagctgtgaatgaggtgtacaaggtgctgatccccatccacgaggccaacagagatgccaagaagctgagcaccatccacggcaagctgcaggaggccttcagcaagatcgtgcaccagaccaccatctggaagaggatgtttggcacctacttccgggtgggcttctacggcaccaagtttggagacctggatgagcaggagtttgtgtacaaggagcccgccatcaccaagctggccgagatcagccaccggctggagggcttctatggagagagatttggagaagatgtggtggaggtgatcaaggacagcaaccctgtggacaagtgcaagctggaccccaacaaggcctacatccagatcacctacgtggagccctactttgacacctatgagatgaaggaccgcatcacctactttgacaagaactacaacctgcggcgcttcatgtactgcacccccttcaccctggatggccgggcccacggggagctgcacgagcagttcaagaggaagaccatcctgaccaccagccacgccttcccctacatcaagaccagggtgaatgtgacccacaaggaggagatcatcctgacccccatcgaggtggccatcgaggacatgcagaagaagacccaggagctggcctttgccacccaccaggaccctgctgaccccaagatgctgcagatggtgctgcagggctctgtgggcaccaccgtgaaccagggccccctggaggtggcccaggtgttcctgtctgagatccccagcgaccccaagctgttccgccaccacaacaagctgcggctgtgcttcaaggacttcaccaagagatgtgaagatgccctgaggaagaacaagagcctgattggaccagaccagaaggagtaccagcgggagctggagaggaactaccaccggctgaaggaggccctgcagcccctcatcaacaggaagatcccccagctgtacaaggctgtgctgcctgtgacctgccaccgggacagcttcagcaggatgagcctgaggaagatggacctgtag

SEQ ID NO: 37965 - DNA, 2799 bp, Artificial Sequence
  Description of Artificial Sequence: Synthetic coding sequence
atgtttgagctgtctgtgcccttccggcagcagcactacctggccggcctggtgctgacagagctggccgtcatcctggaccctgatgctgagggcctgtttggcctgcacaagaaggtgatcaacatggtgcacaacctgctgagcagccatgacagcgacccccgctacagcgacccccagatcaaggcccgggtggccatgctgtacctgcccctcatcggcatcatcatggagaccgtgccccagctgtatgacttcacagacctgtctgtgctgcagctgaaccggctgctggacctgctgtacctgtgtgtgtcctgctttgagtacaagggcaagaaggtgtttgagaggatgaacagcctgaccttcaagaagagcaaggacatgagggccaagctggaggaggccatcctgggcagcattggagcccggcaggagatggtgagaagaagccggggccagctggagaggagccccagcggcagcgccttcggcagccaggagaacctgcgctggaggaaggacatgacccactggaggcagaacacagagaagctggacaagagcagagctgagattgaacatgaggccctgattgatggcaacctggccacagaggccaacctgatcatcctggacaccctggagatcgtggtgcagacagtgtctgtgacagagagcaaggagagcatcctgggcggcgtgctgaaggtgctgctgcacagcatggcctgcaaccagagcgctgtgtacctgcagcactgctttgccacccagagggccctggtgtccaagtttcctgagctgctgtttgaggaggagacagagcagtgtgccgacctgtgcctgcggctgctgcggcactgcagcagcagcatcggcaccatccgcagccacgccagcgccagcctgtacctgctgatgaggcagaactttgagatcggcaacaactttgcccgggtgaagatgcaggtgaccatgagcctgagcagcctggtgggcaccagccagaacttcaatgaggagttcctgcggcgcagcctgaagaccatcctgacctatgcagaggaggacctggagctgcgggagaccaccttcccagaccaggtgcaggacctggtgttcaacctgcacatgatcctgagtgacacagtgaagatgaaggagcaccaggaggaccctgagatgctgattgacctgatgtaccgcatcgccaagggctaccagaccagcccagacctgcggctgacctggctgcagaacatggccggcaagcacagcgagaggagcaaccacgccgaggccgcccagtgcctggtgcacagcgctgccctggtggccgagtacctgtccatgctggaggacaggaagtacctgcctgtgggctgtgtgaccttccagaacatcagcagcaatgtgctggaggagagcgctgtgtctgatgatgtggtgtccccagatgaggagggcatctgcagcggcaagtacttcacagagagcggcctggtgggcctgctggagcaggccgccgccagcttctccatggccggcatgtatgaagctgtgaatgaggtgtacaaggtgctgatccccatccacgaggccaacagagatgccaagaagctgagcaccatccacggcaagctgcaggaggccttcagcaagatcgtgcaccagagcacaggctgggagaggatgtttggcacctacttccgggtgggcttctacggcaccaagtttggagacctggatgagcaggagtttgtgtacaaggagcccgccatcaccaagctggccgagatcagccaccggctggagggcttctatggagagagatttggagaagatgtggtggaggtgatcaaggacagcaaccctgtggacaagtgcaagctggaccccaacaaggcctacatccagatcacctacgtggagccctactttgacacctatgagatgaaggaccgcatcacctactttgacaagaactacaacctgcggcgcttcatgtactgcacccccttcaccctggatggccgggcccacggggagctgcacgagcagttcaagaggaagaccatcctgaccaccagccacgccttcccctacatcaagaccagggtgaatgtgacccacaaggaggagatcatcctgacccccatcgaggtggccatcgaggacatgcagaagaagacccaggagctggcctttgccacccaccaggaccctgctgaccccaagatgctgcagatggtgctgcagggctctgtgggcaccaccgtgaaccagggccccctggaggtggcccaggtgttcctgtctgagatccccagcgaccccaagctgttccgccaccacaacaagctgcggctgtgcttcaaggacttcaccaagagatgtgaagatgccctgaggaagaacaagagcctgattggaccagaccagaaggagtaccagcgggagctggagaggaactaccaccggctgaaggaggccctgcagcccctcatcaacaggaagatcccccagctgtacaaggccaccaactacgtgctgtccttcttcagccagcgcttcctgcagagcaatgagcccagccagaatggcagcctggagtgcacctgcttcatccacctgcagagggccatgtacagcaccagctctgtgaagaggagcatcggcaagcagcacggcatggagttctggaagctgctcttcattgaagaatgttctggccaggagaacatcaagtgccgcctgctgaccctggagaaccacggctacggcttctag

SEQ ID NO: 37966 - DNA, 1899 bp, Artificial Sequence
  Description of Artificial Sequence: Synthetic coding sequence
atggccgagcggcgggcctttgcccagaagatcagcaggacagtggccgctgaggtgaggaagcagatcagcggccagtacagcggcagcccccagctgctgaagaacctgaacatcgtgggcaacatcagccaccacaccaccgtgcccctgacagaggccgtggaccctgtggacctggaggactacctgatcacccaccccctggccgtggacagcggccccctgcgggacctgattgagttccccccagatgacatcgaggtggtgtacagcccccgggactgcaggaccctggtgtctgctgtgcctgaggagagcgagatggacccccacgtgcgggactgcatccgcagctacacagaggactgggccatcgtcatcaggaagtaccacaagctgggcaccggcttcaaccccaacaccctggacaagcagaaggagcggcagaagggcctgcccaagcaggtgtttgaaagtgatgaggccccagatggcaacagctaccaggatgaccaggatgacctgaagaggaggtccatgagcattgatgacaccccccggggctcctgggcctgcagcatctttgacctgaagaacagcctgcctgatgccctgctgcccaacctgctggacaggaccccaaatgaggagattgaccggcagaatgatgaccagaggaagagcaacagacacaaggagctgtttgccctgcaccccagcccagatgaggaggagcccatcgagcggctgtctgtgcctgacatccccaaggagcacttcggccagaggctgctggtgaagtgcctgagcctgaagtttgaaattgaaattgagcccatctttgccagcctggccctgtatgatgtgaaggagaagaagaagatcagcgagaacttctactttgacctgaacagcgagcagatgaagggcctgctgcggccccacgtgcccccagctgccatcaccaccctggcccggagcgccatcttcagcatcacctaccccagccaggatgtgttcctggtgatcaagctggagaaggtgctgcagcagggcgacattggagaatgtgccgagccctacatgatcttcaaggaggctgatgccaccaagaacaaggagaagctggagaagctgaagagccaggccgaccagttctgccagaggctgggcaagtacaggatgccctttgcctggacagccatccacctgatgaacatcgtgtcctctgctggcagcctggagcgggacagcacagaggtggagatcagcactggagagaggaagggctcctggagcgagaggaggaacagcagcatcgtgggccgccgcagcctggagaggaccaccagcggagatgatgcctgcaacctgaccagcttccggcctgccaccctgactgtgaccaacttcttcaagcaggagggggaccggctgagtgatgaagatctctacaagttcctggccgacatgagaagacccagctctgtgctgcggcggctgcggcccatcacagcccagctgaagattgacatcagccctgcccctgagaacccccactactgcctgaccccagagctgctgcaggtgaagctgtacccagacagccgggtgcggcccacccgggagatcctggagttccctgccagagatgtgtatgtgcccaacaccacctacagaaacctgctgtacatctacccccagagcctgaactttgccaaccggcagggcagcgccaggaacatcaccgtgaaggtgcagttcatgtatggagaggaccccagcaatgccatgcccagccccagctgcacccaccccatccccaccgtgcggcccctgcccctgtggtgctaccacagcatcttcagcctgctgtcctgggacttcatcacctag

SEQ ID NO: 37967 - DNA, 3912 bp, Artificial Sequence
  Description of Artificial Sequence: Synthetic coding sequence
tgaaagaacctggagggcaaccacgaccagcacggcaggaacagcctgctggccagctacatccactacgtgttccggctgcccaacacctaccccaacagcagcagccctggccctgggggcctgggcggctctgtgcactacgccaccatggcccggtctgctgtgcggcctgccagcctgaacctgaacagaagccgcagcctgagcaacagcaacccagacatcagcggcacccccaccagcccagatgatgaggtgcgcagcatcatcggcagcaagggcctggacaggagcaacagctgggtgaacacaggaggccccaaggccgccccctggggcagcaaccccagccccagcgctgagagcacccaggccatggacaggagctgcaacaggatgagcagccacacagagaccagcagcttcctgcagaccctgaccggccgcctgcccaccaagaagctgttccacgaggagctggccctgcagtgggtggtgtgcagcggctctgtgcgggagagcgccctgcagcaggcctggttcttctttgagctgatggtgaagtccatggtgcaccacctgtacttcaatgacaagctggaggcccccaggaagagccgcttccctgagcgcttcatggatgacattgctgccctggtgtccaccatcgccagtgacatcgtgagccgcttccagaaggacacagagatggtggagcggctgaacaccagcctggccttcttcctgaatgacctgctgtctgtgatggaccggggctttgtgttcagcctcatcaagagctgctacaagcaggtgagcagcaagctgtacagcctgcccaaccccagcgtgctggtgtccctgcggctggacttcctgcgcatcatctgcagccatgagcactacgtgaccctgaacctgccctgcagcctgctgaccccaccagccagccccagccccagcgtgtcctctgccaccagccagagcagcggcttcagcaccaacgtgcaggaccagaagatcgccaacatgtttgagctgtctgtgcccttccggcagcagcactacctggccggcctggtgctgacagagctggccgtcatcctggaccctgatgctgagggcctgtttggcctgcacaagaaggtgatcaacatggtgcacaacctgctgagcagccatgacagcgacccccgctacagcgacccccagatcaaggcccgggtggccatgctgtacctgcccctcatcggcatcatcatggagaccgtgccccagctgtatgacttcacagagacccacaaccagaggggccggcccatctgcatcgccacagatgattatgaaagtgaaagtggctccatgatcagccagacagtggccatggccatcgccggcacctctgtgccccagctgacccggcccggcagcttcctgctgaccagcaccagcggccggcagcacaccaccttctctgctgagagcagccgcagcctgctgatctgcctgctgtgggtgctgaagaatgctgatgagaccgtgctgcagaagtggttcacagacctgtctgtgctgcagctgaaccggctgctggacctgctgtacctgtgtgtgtcctgctttgagtacaagggcaagaaggtgtttgagaggatgaacagcctgaccttcaagaagagcaaggacatgagggccaagctggaggaggccatcctgggcagcatcggggcccggcaggagatggtgcggcgcagccggggccagctggagaggagccccagcggcagcgccttcggcagccaggagaacctgcgctggaggaaggacatgacccactggaggcagaacacagagaagctggacaagagcagagctgagattgagcacgaggccctgattgatggcaacctggccacagaggccaacctgatcatcctggacaccctggagatcgtggtgcagacagtgtctgtgacagagagcaaggagagcatcctgggcggcgtgctgaaggtgctgctgcacagcatggcctgcaaccagagcgctgtgtacctgcagcactgctttgccacccagagggccctggtgtccaagtttcctgagctgctgtttgaggaggagacagagcagtgtgccgacctgtgcctgcggctgctgcggcactgcagcagcagcatcggcaccatccgcagccacgccagcgccagcctgtacctgctgatgaggcagaactttgaaattggcaacaactttgcccgggtgaagatgcaggtgaccatgagcctgagcagcctggtgggcaccagccagaacttcaatgaggagttcctgcggcgcagcctgaagaccatcctgacctacgccgaggaggacctggagctgcgggagaccaccttcccagaccaggtgcaggacctggtgttcaacctgcacatgatcctgagtgacacagtgaagatgaaggagcaccaggaggaccctgagatgctgattgacctgatgtacagaattgccaagggctaccagaccagcccagacctgcggctgacctggctgcagaacatggccggcaagcacagcgagaggagcaaccacgccgaggccgcccagtgcctggtgcacagcgctgccctggtggccgagtacctgtccatgctggaggacaggaagtacctgcctgtgggctgtgtgaccttccagaacatcagcagcaatgtgctggaggagagcgctgtgtctgatgatgtggtgtccccagatgaggagggcatctgcagcggcaagtacttcacagaaagtggcctggtgggcctgctggagcaggccgccgccagcttctccatggccggcatgtatgaggccgtgaatgaggtgtacaaggtgctgatccccatccacgaggccaacagagatgccaagaagctgagcaccatccacggcaagctgcaggaggccttcagcaagatcgtgcaccagagcacaggctgggagaggatgtttggcacctacttccgggtgggcttctacggcaccaagtttggagacctggatgagcaggagtttgtgtacaaggagcccgccatcaccaagctggccgagatcagccaccggctggagggcttctacggggagagatttggagaagatgtggtggaggtgatcaaggacagcaaccctgtggacaagtgcaagctggaccccaacaaggcctacatccagatcacctacgtggagccctactttgacacctatgagatgaaggaccgcatcacctactttgacaagaactacaacctgcggcgcttcatgtactgcacccccttcaccctggatggccgggcccatggagagctgcacgagcagttcaagaggaagaccatcctgaccaccagccacgccttcccctacatcaagaccagggtgaatgtgacccacaaggaggagatcatcctgacccccatcgaggtggccatcgaggacatgcagaagaagacccaggagctggcctttgccacccaccaggaccctgctgaccccaagatgctgcagatggtgctgcagggctctgtgggcaccaccgtgaaccagggccccctggaggtggcccaggtgttcctgtctgagatccccagcgaccccaagctgttccgccaccacaacaagctgcggctgtgcttcaaggacttcaccaagagatgtgaagatgccctgaggaagaacaagagcctcatcggccctgaccagaaggagtaccagcgggagctggagaggaactaccaccggctgaaggaggccctgcagcccctcatcaacaggaagatcccccagctgtacaaggctgtgctgcctgtgacctgccaccgggacagcttcagcaggatgagcctgaggaagatggacctgtag

SEQ ID NO: 37968 - DNA, 6282 bp, Artificial Sequence
  Description of Artificial Sequence: Synthetic coding sequence
atgagccagccccccctgctgcctgccagcgctgagaccaggaagttcacccgggccctgagcaagccaggcacagctgctgagctgcggcagagcgtgtctgaggtggtgcggggctctgtgctgctggccaagcccaagctgattgagcccctggactatgaaaatgtcatcgtgcagaagaagacccagatcctgaatgactgcctgcgggagatgctgctcttcccctatgatgacttccagacagccatcctgcggcggcagggccgctacatctgcagcacagtgcctgccaaggccgaggaggaggcccagagcctgtttgtgacagagtgcatcaagacctacaacagcgactggcacctggtgaactacaagtatgaggactacagcggggagttccggcagctgcccaacaaggtggtgaagctggacaagctgcctgtgcacgtgtatgaggtggatgaggaggtggacaaggatgaagatgctgccagcctgggcagccagaagggcggcatcaccaagcacggctggctgtacaagggcaacatgaacagcgccatctctgtgaccatgaggagcttcaagaggcgcttcttccacctgatccagctgggagatggcagctacaacctgaacttctacaaggatgagaagatcagcaaggagcccaagggcagcatcttcctggacagctgcatgggcgtggtgcagaacaacaaggtgagaagatttgcctttgagctgaagatgcaggacaagagcagctacctgctggccgctgacagcgaggtggagatggaggagtggatcaccatcctgaacaagatcctgcagctgaactttgaggccgccatgcaggagaagagaaatggagacagccatgaagatgatgagcagagcaagctggagggcagcggcagcggcctggacagctacctgcctgagctggccaagagcgcccgggaggccgagatcaagctgaagtctgagagccgggtgaagctgttctacctggaccctgatgcccagaagctggacttcagcagcgctgagcctgaggtgaagagctttgaggagaagtttgggaagaggatcctggtgaagtgcaatgacctgtccttcaacctgcagtgctgcgtggctgaaaatgaggagggccccaccaccaacgtggagcccttctttgtgaccctgagcctgtttgacatcaagtacaacaggaagatctctgctgacttccacgtggacctgaaccacttctctgtgcggcagatgctggccaccaccagccctgccctgatgaatggcagcggccagagccccagcgtgctgaagggcatcctgcacgaggccgccatgcagtaccccaagcagggcatcttctctgtgacctgcccccacccagacatcttcctggtggccagaattgagaaggtgctgcagggcagcatcacccactgtgccgagccctacatgaagagcagtgacagcagcaaggtggcccagaaggtgctgaagaatgccaagcaggcctgccagaggctgggccagtacaggatgccctttgcctgggccgcccggaccctcttcaaggatgccagcggcaacctggacaagaatgcccgcttcagcgccatctaccggcaggacagcaacaagctgagcaatgatgacatgctgaagctgctggccgacttcaggaagccagagaagatggccaagctgcctgtgatcctgggcaacctggacatcaccatcgacaacgtgtccagtgacttccccaactacgtgaacagcagctacatccccaccaagcagtttgagacctgcagcaagacccccatcacctttgaggtggaggagtttgtgccctgcatccccaagcacacccagccctacaccatctacaccaaccacctgtatgtgtaccccaagtacctgaagtatgacagccagaagagctttgccaaggccaggaacatcgccatctgcatcgagttcaaggacagtgatgaggaggacagccagcccctgaagtgcatctacggccggcctgggggccctgtgttcaccaggtctgcctttgctgctgtgctgcaccaccaccagaaccctgagttctatgatgagatcaagattgagctgcccacccagctgcacgagaagcaccacctgctgctgaccttcttccacgtgtcctgtgacaacagcagcaagggcagcaccaagaagagagatgtggtggagacccaggtgggctacagctggctgcccctgctgaaggatggccgggtggtgaccagcgagcagcacatccctgtgtctgccaacctgcccagcggctacctgggctaccaggagctgggcatgggccgccactacggccctgagatcaagtgggtggatggcggcaagcccctgctgaagatcagcacccacctggtgtccacagtgtacacccaggaccagcacctgcacaacttcttccagtactgccagaagacagagagcggggcccaggccctgggcaatgagctggtgaagtacctgaagagcctgcacgccatggagggccacgtgatgattgccttcctgcccaccatcctgaaccagctgttccgggtgctgacccgggccacccaggaggaggtggccgtgaatgtgaccagggtcatcatccacgtggtggcccagtgccacgaggagggcctggagagccacctgcggagctatgtgaagtatgcctacaaggccgagccctacgtggccagcgagtacaagacagtgcatgaggagctgaccaagtccatgaccaccatcctgaagcccagcgctgacttcctgaccagcaacaagctgctgaagtacagctggttcttctttgatgtgctgatcaagtccatggcccagcacctgattgagaacagcaaggtgaagctgctgaggaaccagcgcttccctgccagctaccaccacgctgtggagaccgtggtgaacatgctgatgccccacatcacccagaagttccgggacaaccctgaggccagcaagaatgccaaccacagcctggccgtgttcatcaagcgctgcttcaccttcatggaccggggctttgtgttcaagcagatcaacaactacatcagctgctttgcccctggggaccccaagaccctgtttgagtacaagtttgagttcctgcgggtggtgtgcaaccacgagcactacatccccctgaacctgcccatgccctttgggaagggccgcatccagcgctaccaggacctgcagctggactacagcctgacagatgagttctgcaggaaccacttcctggtgggcctgctgctgcgggaggtgggcacagccctgcaggagttccgggaggtgcggctgattgccatctctgtgctgaagaacctgctgatcaagcacagctttgatgacagatatgccagccgcagccaccaggcccgcatcgccaccctgtacctgcccctgtttggcctgctgattgaaaatgtgcagaggatcaacgtgagagatgtgagccccttccctgtgaatgccggcatgacagtgaaggatgagagcctggccctgcctgctgtgaaccccctggtgaccccccagaagggcagcaccctggacaacagcctgcacaaggacctgctgggcgccatctctggaattgccagcccctacaccaccagcacccccaacatcaacagcgtgagaaatgctgacagccggggcagcctcatcagcacagattctggcaacagcctgcctgagaggaacagcgagaagagcaacagcctggacaagcaccagcagagcagcaccctgggcaacagcgtggtgcgctgtgacaagctggaccagagcgagatcaagagcctgctgatgtgcttcctgtacatcctgaagtccatgtctgatgatgccctcttcacctactggaacaaggccagcaccagcgagctgatggacttcttcaccatcagcgaggtgtgcctgcaccagttccagtacatgggcaagcgctacatcgccaggacaggcatgatgcacgcccggctgcagcagctgggcagcctggacaacagcctgaccttcaaccacagctatggccacagtgatgctgatgtgctgcaccagagcctgctggaggccaacatcgccacagaggtgtgcctgacagccctggacaccctgagcctcttcaccctggccttcaagaaccagctgctggccgaccacggccacaaccccctgatgaagaaggtgtttgatgtgtacctgtgcttcctgcagaagcaccagagcgagacagccctgaagaatgtgttcaccgccctgcggagcctcatctacaagttccccagcaccttctatgagggccgggctgacatgtgtgccgccctgtgctatgagatcctgaagtgctgcaacagcaagctgagcagcatcagaacagaggccagccagctgctgtacttcctgatgaggaacaactttgactacaccgggaagaagagctttgtgaggacccacctgcaggtgatcatctctgtgtcccagctgattgctgatgtggtgggcatcggcggcacccgcttccagcagagcctgagcatcatcaacaactgtgccaacagcgacaggctcatcaagcacaccagcttcagcagtgatgtgaaggacctgaccaagaggatcagaacagtgctgatggccacagcccagatgaaggagcatgaaaatgaccctgagatgctggtggacctgcagtacagcctggccaagagctatgccagcaccccagagctgaggaagacctggctggacagcatggcccgcatccacgtgaagaatggagacctgtctgaggccgccatgtgctacgtgcacgtgacagccctggtggccgagtacctgaccaggaaggaggccgtgcagtgggagccccccctgctgccccacagccacagcgcctgcctgcggcgcagcagaggaggagtcttccggcagggctgcacagccttccgggtcatcacccccaacattgatgaggaggcctccatgatggaggatgtgggcatgcaggatgtgcacttcaatgaagatgtgctgatggagctgctggagcagtgtgctgatggcctgtggaaggccgagagatatgagctgattgctgacatctacaagctgatcatccccatctatgagaagaggcgggactttgagcggctggcccacctgtatgacaccctgcaccgggcctacagcaaggtgacagaggtgatgcacagcggccggcggctgctgggcacctacttccgggtggccttcttcggccagggcttctttgaagatgaagatggcaaggagtacatctacaaggagcccaagctgacccccctgtctgagatcagccagaggctgctgaagctgtacagcgacaagtttggaagtgaaaatgtgaagatgatccaggacagcggcaaggtgaaccccaaggacctggacagcaaatatgcctacatccaggtgacccacgtgatccccttctttgatgagaaggagctgcaggagaggaagacagaatttgagaggagccacaacatccgccgcttcatgtttgagatgcccttcacccagacaggcaagaggcagggcggcgtggaggagcagtgcaagaggaggaccatcctgacagccatccactgcttcccctacgtgaagaagagaattcctgtgatgtaccagcaccacacagacctgaaccccatcgaggtggccattgatgagatgagcaagaaggtggccgagctgcggcagctgtgcagcagcgctgaggtggacatgatcaagctgcagctgaagctgcagggctctgtgtctgtgcaggtgaatgccggccccctggcctatgcccgggccttcctggatgacaccaacaccaagcgctacccagacaacaaggtgaagctgctgaaggaggtgttccggcagtttgtggaggcctgtggccaggccctggccgtgaatgaaagactcatcaaggaggaccagctggagtaccaggaggagatgaaggccaactaccgggagatggccaaggagctgtctgagatcatgcatgagcagatctgccccctggaggagaagacctctgtgctgcccaacagcctgcacatcttcaatgccatcagcggcacccccaccagcaccatggtgcacggcatgaccagcagcagctctgtggtgtag

SEQ ID NO: 37969 - DNA, 1275 bp, Artificial Sequence
  Description of Artificial Sequence: Synthetic coding sequence
atgatgcacgcccggctgcagcagctgggcagcctggacaacagcctgaccttcaaccacagctatggccacagtgatgctgatgtgctgcaccagagcctgctggaggccaacatcgccacagaggtgtgcctgacagccctggacaccctgagcctcttcaccctggccttcaagaaccagctgctggccgaccacggccacaaccccctgatgaagaaggtgtttgatgtgtacctgtgcttcctgcagaagcaccagagcgagacagccctgaagaatgtgttcaccgccctgcggagcctcatctacaagttccccagcaccttctatgagggccgggctgacatgtgtgccgccctgtgctatgagatcctgaagtgctgcaacagcaagctgagcagcatcagaacagaggccagccagctgctgtacttcctgatgaggaacaactttgactacacaggcaagaagagctttgtgaggacccacctgcaggtgatcatctctgtgtcccagctgattgctgatgtggtgggcattggaggcacccgcttccagcagagcctgagcatcatcaacaactgtgccaacagcgacaggctcatcaagcacaccagcttcagcagtgatgtgaaggacctgaccaagaggatcagaacagtgctgatggccacagcccagatgaaggagcatgaaaatgaccctgagatgctggtggacctgcagtacagcctggccaagagctatgccagcaccccagagctgaggaagacctggctggacagcatggcccgcatccacgtgaagaatggagacctgtctgaggccgccatgtgctacgtgcacgtgacagccctggtggccgagtacctgaccaggaaaggagtcttccggcagggctgcacagccttccgggtcatcacccccaacattgatgaggaggcctccatgatggaggatgtgggcatgcaggatgtgcacttcaatgaagatgtgctgatggagctgctggagcagtgtgctgatggcctgtggaaggccgagagatatgagctgattgctgacatctacaagctgatcatccccatctatgagaagaggcgggactttgagcggctggcccacctgtatgacaccctgcaccgggcctacagcaaggtgacagaggtgatgcacagcggccggcggctgctgggcacctacttccgggtggccttcttcggccaggtgtccctgctgagcatcctgcagacagtgctgagccccctgtag

SEQ ID NO: 37970 - DNA, 6309 bp, Artificial Sequence
  Description of Artificial Sequence: Synthetic coding sequence
atgagccagccccccctgctgcctgccagcgctgagaccaggaagttcacccgggccctgagcaagccaggcacagctgctgagctgcggcagagcgtgtctgaggtggtgcggggctctgtgctgctggccaagcccaagctgattgagcccctggactatgaaaatgtcatcgtgcagaagaagacccagatcctgaatgactgcctgcgggagatgctgctcttcccctatgatgacttccagacagccatcctgcggcggcagggccgctacatctgcagcacagtgcctgccaaggccgaggaggaggcccagagcctgtttgtgacagagtgcatcaagacctacaacagcgactggcacctggtgaactacaagtatgaggactacagcggggagttccggcagctgcccaacaaggtggtgaagctggacaagctgcctgtgcacgtgtatgaggtggatgaggaggtggacaaggatgaagatgctgccagcctgggcagccagaagggcggcatcaccaagcacggctggctgtacaagggcaacatgaacagcgccatctctgtgaccatgaggagcttcaagaggcgcttcttccacctgatccagctgggagatggcagctacaacctgaacttctacaaggatgagaagatcagcaaggagcccaagggcagcatcttcctggacagctgcatgggcgtggtgcagaacaacaaggtgagaagatttgcctttgagctgaagatgcaggacaagagcagctacctgctggccgctgacagcgaggtggagatggaggagtggatcaccatcctgaacaagatcctgcagctgaactttgaggccgccatgcaggagaagagaaatggagacagccatgaagatgatgagcagagcaagctggagggcagcggcagcggcctggacagctacctgcctgagctggccaagagcgcccgggaggccgagatcaagctgaagtctgagagccgggtgaagctgttctacctggaccctgatgcccagaagctggacttcagcagcgctgagcctgaggtgaagagctttgaggagaagtttgggaagaggatcctggtgaagtgcaatgacctgtccttcaacctgcagtgctgcgtggctgaaaatgaggagggccccaccaccaacgtggagcccttctttgtgaccctgagcctgtttgacatcaagtacaacaggaagatctctgctgacttccacgtggacctgaaccacttctctgtgcggcagatgctggccaccaccagccctgccctgatgaatggcagcggccagagccccagcgtgctgaagggcatcctgcacgaggccgccatgcagtaccccaagcagggcatcttctctgtgacctgcccccacccagacatcttcctggtggccagaattgagaaggtgctgcagggcagcatcacccactgtgccgagccctacatgaagagcagtgacagcagcaaggtggcccagaaggtgctgaagaatgccaagcaggcctgccagaggctgggccagtacaggatgccctttgcctgggccgcccggaccctcttcaaggatgccagcggcaacctggacaagaatgcccgcttcagcgccatctaccggcaggacagcaacaagctgagcaatgatgacatgctgaagctgctggccgacttcaggaagccagagaagatggccaagctgcctgtgatcctgggcaacctggacatcaccatcgacaacgtgtccagtgacttccccaactacgtgaacagcagctacatccccaccaagcagtttgagacctgcagcaagacccccatcacctttgaggtggaggagtttgtgccctgcatccccaagcacacccagccctacaccatctacaccaaccacctgtatgtgtaccccaagtacctgaagtatgacagccagaagagctttgccaaggccaggaacatcgccatctgcatcgagttcaaggacagtgatgaggaggacagccagcccctgaagtgcatctacggccggcctgggggccctgtgttcaccaggtctgcctttgctgctgtgctgcaccaccaccagaaccctgagttctatgatgagatcaagattgagctgcccacccagctgcacgagaagcaccacctgctgctgaccttcttccacgtgtcctgtgacaacagcagcaagggcagcaccaagaagagagatgtggtggagacccaggtgggctacagctggctgcccctgctgaaggatggccgggtggtgaccagcgagcagcacatccctgtgtctgccaacctgcccagcggctacctgggctaccaggagctgggcatgggccgccactacggccctgagatcaagtgggtggatggcggcaagcccctgctgaagatcagcacccacctggtgtccacagtgtacacccaggaccagcacctgcacaacttcttccagtactgccagaagacagagagcggggcccaggccctgggcaatgagctggtgaagtacctgaagagcctgcacgccatggagggccacgtgatgattgccttcctgcccaccatcctgaaccagctgttccgggtgctgacccgggccacccaggaggaggtggccgtgaatgtgaccagggtcatcatccacgtggtggcccagtgccacgaggagggcctggagagccacctgcggagctatgtgaagtatgcctacaaggccgagccctacgtggccagcgagtacaagacagtgcatgaggagctgaccaagtccatgaccaccatcctgaagcccagcgctgacttcctgaccagcaacaagctgctgaagtacagctggttcttctttgatgtgctgatcaagtccatggcccagcacctgattgagaacagcaaggtgaagctgctgaggaaccagcgcttccctgccagctaccaccacgctgtggagaccgtggtgaacatgctgatgccccacatcacccagaagttccgggacaaccctgaggccagcaagaatgccaaccacagcctggccgtgttcatcaagcgctgcttcaccttcatggaccggggctttgtgttcaagcagatcaacaactacatcagctgctttgcccctggggaccccaagaccctgtttgagtacaagtttgagttcctgcgggtggtgtgcaaccacgagcactacatccccctgaacctgcccatgccctttgggaagggccgcatccagcgctaccaggacctgcagctggactacagcctgacagatgagttctgcaggaaccacttcctggtgggcctgctgctgcgggaggtgggcacagccctgcaggagttccgggaggtgcggctgattgccatctctgtgctgaagaacctgctgatcaagcacagctttgatgacagatatgccagccgcagccaccaggcccgcatcgccaccctgtacctgcccctgtttggcctgctgattgaaaatgtgcagaggatcaacgtgagagatgtgagccccttccctgtgaatgccggcatgacagtgaaggatgagagcctggccctgcctgctgtgaaccccctggtgaccccccagaagggcagcaccctggacaacagcctgcacaaggacctgctgggcgccatctctggaattgccagcccctacaccaccagcacccccaacatcaacagcgtgagaaatgctgacagccggggcagcctcatcagcacagattctggcaacagcctgcctgagaggaacagcgagaagagcaacagcctggacaagcaccagcagagcagcaccctgggcaacagcgtggtgcgctgtgacaagctggaccagagcgagatcaagagcctgctgatgtgcttcctgtacatcctgaagtccatgtctgatgatgccctcttcacctactggaacaaggccagcaccagcgagctgatggacttcttcaccatcagcgaggtgtgcctgcaccagttccagtacatgggcaagcgctacatcgccaggacaggcatgatgcacgcccggctgcagcagctgggcagcctggacaacagcctgaccttcaaccacagctatggccacagtgatgctgatgtgctgcaccagagcctgctggaggccaacatcgccacagaggtgtgcctgacagccctggacaccctgagcctcttcaccctggccttcaagaaccagctgctggccgaccacggccacaaccccctgatgaagaaggtgtttgatgtgtacctgtgcttcctgcagaagcaccagagcgagacagccctgaagaatgtgttcaccgccctgcggagcctcatctacaagttccccagcaccttctatgagggccgggctgacatgtgtgccgccctgtgctatgagatcctgaagtgctgcaacagcaagctgagcagcatcagaacagaggccagccagctgctgtacttcctgatgaggaacaactttgactacaccgggaagaagagctttgtgaggacccacctgcaggtgatcatctctgtgtcccagctgattgctgatgtggtgggcatcggcggcacccgcttccagcagagcctgagcatcatcaacaactgtgccaacagcgacaggctcatcaagcacaccagcttcagcagtgatgtgaaggacctgaccaagaggatcagaacagtgctgatggccacagcccagatgaaggagcatgaaaatgaccctgagatgctggtggacctgcagtacagcctggccaagagctatgccagcaccccagagctgaggaagacctggctggacagcatggcccgcatccacgtgaagaatggagacctgtctgaggccgccatgtgctacgtgcacgtgacagccctggtggccgagtacctgaccaggaaggaggccgtgcagtgggagccccccctgctgccccacagccacagcgcctgcctgcggcgcagcagaggaggagtcttccggcagggctgcacagccttccgggtcatcacccccaacattgatgaggaggcctccatgatggaggatgtgggcatgcaggatgtgcacttcaatgaagatgtgctgatggagctgctggagcagtgtgctgatggcctgtggaaggccgagagatatgagctgattgctgacatctacaagctgatcatccccatctatgagaagaggcgggactttgagcggctggcccacctgtatgacaccctgcaccgggcctacagcaaggtgacagaggtgatgcacagcggccggcggctgctgggcacctacttccgggtggccttcttcggccaggccgcccagtaccagttcacagattctgaaacagatgtggagggcttctttgaagatgaagatggcaaggagtacatctacaaggagcccaagctgacccccctgtctgagatcagccagaggctgctgaagctgtacagcgacaagtttggaagtgaaaatgtgaagatgatccaggacagcggcaaggtgaaccccaaggacctggacagcaaatatgcctacatccaggtgacccacgtgatccccttctttgatgagaaggagctgcaggagaggaagacagaatttgagaggagccacaacatccgccgcttcatgtttgagatgcccttcacccagacaggcaagaggcagggcggcgtggaggagcagtgcaagaggaggaccatcctgacagccatccactgcttcccctacgtgaagaagagaattcctgtgatgtaccagcaccacacagacctgaaccccatcgaggtggccattgatgagatgagcaagaaggtggccgagctgcggcagctgtgcagcagcgctgaggtggacatgatcaagctgcagctgaagctgcagggctctgtgtctgtgcaggtgaatgccggccccctggcctatgcccgggccttcctggatgacaccaacaccaagcgctacccagacaacaaggtgaagctgctgaaggaggtgttccggcagtttgtggaggcctgtggccaggccctggccgtgaatgaaagactcatcaaggaggaccagctggagtaccaggaggagatgaaggccaactaccgggagatggccaaggagctgtctgagatcatgcatgagcaggtgagaagaagtgccccctggaggagaagaagagccagctaccgcatccccttcaccagcagcaccccatctgtgggcctgcagcaggcccagtggttcaccggctag

SEQ ID NO: 37971 - DNA, 2175 bp, Artificial Sequence
  Description of Artificial Sequence: Synthetic coding sequence
atgcacgcccggctgcagcagctgggcagcctggacaacagcctgaccttcaaccacagctatggccacagtgatgctgatgtgctgcaccagagcctgctggaggccaacatcgccacagaggtgtgcctgacagccctggacaccctgagcctcttcaccctggccttcaagaaccagctgctggccgaccacggccacaaccccctgatgaagaaggtgtttgatgtgtacctgtgcttcctgcagaagcaccagagcgagacagccctgaagaatgtgttcaccgccctgcggagcctcatctacaagttccccagcaccttctatgagggccgggctgacatgtgtgccgccctgtgctatgagatcctgaagtgctgcaacagcaagctgagcagcatcagaacagaggccagccagctgctgtacttcctgatgaggaacaactttgactacaccgggaagaagagctttgtgaggacccacctgcaggtgatcatctctgtgtcccagctgattgctgatgtggtgggcatcggcggcacccgcttccagcagagcctgagcatcatcaacaactgtgccaacagcgacaggctcatcaagcacaccagcttcagcagtgatgtgaaggacctgaccaagaggatcagaacagtgctgatggccacagcccagatgaaggagcatgaaaatgaccctgagatgctggtggacctgcagtacagcctggccaagagctatgccagcaccccagagctgaggaagacctggctggacagcatggcccgcatccacgtgaagaatggagacctgtctgaggccgccatgtgctacgtgcacgtgacagccctggtggccgagtacctgaccaggaagggcgtcttccggcagggctgcacagccttccgggtcatcacccccaacattgatgaggaggcctccatgatggaggatgtgggcatgcaggatgtgcacttcaatgaagatgtgctgatggagctgctggagcagtgtgctgatggcctgtggaaggccgagagatatgagctgattgctgacatctacaagctgatcatccccatctatgagaagagaagagactttgagcggctggcccacctgtatgacaccctgcaccgggcctacagcaaggtgacagaggtgatgcacagcggccgccgcctgctgggcacctacttccgggtggccttcttcggccagcagtaccagttcacagacagcgagacagatgtggagggcttctttgaagatgaagatggcaaggagtacatctacaaggagcccaagctgacccccctgtctgagatcagccagaggctgctgaagctgtacagcgacaagtttggaagtgaaaatgtgaagatgatccaggacagcggcaaggtgaaccccaaggacctggacagcaaatatgcctacatccaggtgacccacgtgatccccttctttgatgagaaggagctgcaggagaggaagacagaatttgagaggagccacaacatccgccgcttcatgtttgagatgcccttcacccagacaggcaagaggcagggcggcgtggaggagcagtgcaagaggaggaccatcctgacagccatccactgcttcccctacgtgaagaagagaattcctgtgatgtaccagcaccacacagacctgaaccccatcgaggtggccattgatgagatgagcaagaaggtggccgagctgcggcagctgtgcagcagcgctgaggtggacatgatcaagctgcagctgaagctgcagggctctgtgtctgtgcaggtgaatgccggccccctggcctatgcccgggccttcctggatgacaccaacaccaagcgctacccagacaacaaggtgaagctgctgaaggaggtgttccggcagtttgtggaggcctgtggccaggccctggccgtgaatgaaagactcatcaaggaggaccagctggagtaccaggaggagatgaaggccaactaccgggagatggccaaggagctgtctgagatcatgcatgagcagatctgccccctggaggagaagacctctgtgctgcccaacagcctgcacatcttcaatgccatcagcggcacccccaccagcaccatggtgcacggcatgaccagcagcagctctgtggtgtag

SEQ ID NO: 37972 - DNA, 6285 bp, Artificial Sequence
  Description of Artificial Sequence: Synthetic coding sequence
atgagccagccccccctgctgcctgccagcgctgagaccaggaagttcacccgggccctgagcaagccaggcacagctgctgagctgcggcagagcgtgtctgaggtggtgcggggctctgtgctgctggccaagcccaagctgattgagcccctggactatgaaaatgtcatcgtgcagaagaagacccagatcctgaatgactgcctgcgggagatgctgctcttcccctatgatgacttccagacagccatcctgcggcggcagggccgctacatctgcagcacagtgcctgccaaggccgaggaggaggcccagagcctgtttgtgacagagtgcatcaagacctacaacagcgactggcacctggtgaactacaagtatgaggactacagcggggagttccggcagctgcccaacaaggtggtgaagctggacaagctgcctgtgcacgtgtatgaggtggatgaggaggtggacaaggatgaagatgctgccagcctgggcagccagaagggcggcatcaccaagcacggctggctgtacaagggcaacatgaacagcgccatctctgtgaccatgaggagcttcaagaggcgcttcttccacctgatccagctgggagatggcagctacaacctgaacttctacaaggatgagaagatcagcaaggagcccaagggcagcatcttcctggacagctgcatgggcgtggtgcagaacaacaaggtgagaagatttgcctttgagctgaagatgcaggacaagagcagctacctgctggccgctgacagcgaggtggagatggaggagtggatcaccatcctgaacaagatcctgcagctgaactttgaggccgccatgcaggagaagagaaatggagacagccatgaagatgatgagcagagcaagctggagggcagcggcagcggcctggacagctacctgcctgagctggccaagagcgcccgggaggccgagatcaagctgaagtctgagagccgggtgaagctgttctacctggaccctgatgcccagaagctggacttcagcagcgctgagcctgaggtgaagagctttgaggagaagtttgggaagaggatcctggtgaagtgcaatgacctgtccttcaacctgcagtgctgcgtggctgaaaatgaggagggccccaccaccaacgtggagcccttctttgtgaccctgagcctgtttgacatcaagtacaacaggaagatctctgctgacttccacgtggacctgaaccacttctctgtgcggcagatgctggccaccaccagccctgccctgatgaatggcagcggccagagccccagcgtgctgaagggcatcctgcacgaggccgccatgcagtaccccaagcagggcatcttctctgtgacctgcccccacccagacatcttcctggtggccagaattgagaaggtgctgcagggcagcatcacccactgtgccgagccctacatgaagagcagtgacagcagcaaggtggcccagaaggtgctgaagaatgccaagcaggcctgccagaggctgggccagtacaggatgccctttgcctgggccgcccggaccctcttcaaggatgccagcggcaacctggacaagaatgcccgcttcagcgccatctaccggcaggacagcaacaagctgagcaatgatgacatgctgaagctgctggccgacttcaggaagccagagaagatggccaagctgcctgtgatcctgggcaacctggacatcaccatcgacaacgtgtccagtgacttccccaactacgtgaacagcagctacatccccaccaagcagtttgagacctgcagcaagacccccatcacctttgaggtggaggagtttgtgccctgcatccccaagcacacccagccctacaccatctacaccaaccacctgtatgtgtaccccaagtacctgaagtatgacagccagaagagctttgccaaggccaggaacatcgccatctgcatcgagttcaaggacagtgatgaggaggacagccagcccctgaagtgcatctacggccggcctgggggccctgtgttcaccaggtctgcctttgctgctgtgctgcaccaccaccagaaccctgagttctatgatgagatcaagattgagctgcccacccagctgcacgagaagcaccacctgctgctgaccttcttccacgtgtcctgtgacaacagcagcaagggcagcaccaagaagagagatgtggtggagacccaggtgggctacagctggctgcccctgctgaaggatggccgggtggtgaccagcgagcagcacatccctgtgtctgccaacctgcccagcggctacctgggctaccaggagctgggcatgggccgccactacggccctgagatcaagtgggtggatggcggcaagcccctgctgaagatcagcacccacctggtgtccacagtgtacacccaggaccagcacctgcacaacttcttccagtactgccagaagacagagagcggggcccaggccctgggcaatgagctggtgaagtacctgaagagcctgcacgccatggagggccacgtgatgattgccttcctgcccaccatcctgaaccagctgttccgggtgctgacccgggccacccaggaggaggtggccgtgaatgtgaccagggtcatcatccacgtggtggcccagtgccacgaggagggcctggagagccacctgcggagctatgtgaagtatgcctacaaggccgagccctacgtggccagcgagtacaagacagtgcatgaggagctgaccaagtccatgaccaccatcctgaagcccagcgctgacttcctgaccagcaacaagctgctgaagtacagctggttcttctttgatgtgctgatcaagtccatggcccagcacctgattgagaacagcaaggtgaagctgctgaggaaccagcgcttccctgccagctaccaccacgctgtggagaccgtggtgaacatgctgatgccccacatcacccagaagttccgggacaaccctgaggccagcaagaatgccaaccacagcctggccgtgttcatcaagcgctgcttcaccttcatggaccggggctttgtgttcaagcagatcaacaactacatcagctgctttgcccctggggaccccaagaccctgtttgagtacaagtttgagttcctgcgggtggtgtgcaaccacgagcactacatccccctgaacctgcccatgccctttgggaagggccgcatccagcgctaccaggacctgcagctggactacagcctgacagatgagttctgcaggaaccacttcctggtgggcctgctgctgcgggaggtgggcacagccctgcaggagttccgggaggtgcggctgattgccatctctgtgctgaagaacctgctgatcaagcacagctttgatgacagatatgccagccgcagccaccaggcccgcatcgccaccctgtacctgcccctgtttggcctgctgattgaaaatgtgcagaggatcaacgtgagagatgtgagccccttccctgtgaatgccggcatgacagtgaaggatgagagcctggccctgcctgctgtgaaccccctggtgaccccccagaagggcagcaccctggacaacagcctgcacaaggacctgctgggcgccatctctggaattgccagcccctacaccaccagcacccccaacatcaacagcgtgagaaatgctgacagccggggcagcctcatcagcacagattctggcaacagcctgcctgagaggaacagcgagaagagcaacagcctggacaagcaccagcagagcagcaccctgggcaacagcgtggtgcgctgtgacaagctggaccagagcgagatcaagagcctgctgatgtgcttcctgtacatcctgaagtccatgtctgatgatgccctcttcacctactggaacaaggccagcaccagcgagctgatggacttcttcaccatcagcgaggtgtgcctgcaccagttccagtacatgggcaagcgctacatcgcctctgtgaggaagatcagctctgtgctgggcatctctgtggacaatggctacggccacagtgatgctgatgtgctgcaccagagcctgctggaggccaacatcgccacagaggtgtgcctgacagccctggacaccctgagcctcttcaccctggccttcaagaaccagctgctggccgaccacggccacaaccccctgatgaagaaggtgtttgatgtgtacctgtgcttcctgcagaagcaccagagcgagacagccctgaagaatgtgttcaccgccctgcggagcctcatctacaagttccccagcaccttctatgagggccgggctgacatgtgtgccgccctgtgctatgagatcctgaagtgctgcaacagcaagctgagcagcatcagaacagaggccagccagctgctgtacttcctgatgaggaacaactttgactacaccgggaagaagagctttgtgaggacccacctgcaggtgatcatctctgtgtcccagctgattgctgatgtggtgggcatcggcggcacccgcttccagcagagcctgagcatcatcaacaactgtgccaacagcgacaggctcatcaagcacaccagcttcagcagtgatgtgaaggacctgaccaagaggatcagaacagtgctgatggccacagcccagatgaaggagcatgaaaatgaccctgagatgctggtggacctgcagtacagcctggccaagagctatgccagcaccccagagctgaggaagacctggctggacagcatggcccgcatccacgtgaagaatggagacctgtctgaggccgccatgtgctacgtgcacgtgacagccctggtggccgagtacctgaccaggaaggaggccgtgcagtgggagccccccctgctgccccacagccacagcgcctgcctgcggcgcagcagaggaggagtcttccggcagggctgcacagccttccgggtcatcacccccaacattgatgaggaggcctccatgatggaggatgtgggcatgcaggatgtgcacttcaatgaagatgtgctgatggagctgctggagcagtgtgctgatggcctgtggaaggccgagagatatgagctgattgctgacatctacaagctgatcatccccatctatgagaagaggcgggactttgagcggctggcccacctgtatgacaccctgcaccgggcctacagcaaggtgacagaggtgatgcacagcggccggcggctgctgggcacctacttccgggtggccttcttcggccaggccgcccagtaccagttcacagattctgaaacagatgtggagggcttctttgaagatgaagatggcaaggagtacatctacaaggagcccaagctgacccccctgtctgagatcagccagaggctgctgaagctgtacagcgacaagtttggaagtgaaaatgtgaagatgatccaggacagcggcaaggtgaaccccaaggacctggacagcaaatatgcctacatccaggtgacccacgtgatccccttctttgatgagaaggagctgcaggagaggaagacagaatttgagaggagccacaacatccgccgcttcatgtttgagatgcccttcacccagacaggcaagaggcagggcggcgtggaggagcagtgcaagaggaggaccatcctgacagccatccactgcttcccctacgtgaagaagagaattcctgtgatgtaccagcaccacacagacctgaaccccatcgaggtggccattgatgagatgagcaagaaggtggccgagctgcggcagctgtgcagcagcgctgaggtggacatgatcaagctgcagctgaagctgcagggctctgtgtctgtgcaggtgaatgccggccccctggcctatgcccgggccttcctggatgacaccaacaccaagcgctacccagacaacaaggtgaagctgctgaaggaggtgttccggcagtttgtggaggcctgtggccaggccctggccgtgaatgaaagactcatcaaggaggaccagctggagtaccaggaggagatgaaggccaactaccgggagatggccaaggagctgtctgagatcatgcatgagcaggtgagaagaagtgccccctggaggagaagaagagccagctaccgcatccccttcaccagcagcaccccatctgtgggcctgcagcaggcccagtggttcaccggctag

SEQ ID NO: 37973 - DNA, 6207 bp, Artificial Sequence
  Description of Artificial Sequence: Synthetic coding sequence
atgcaggccgacaagtgcaggaccagcagccgctctgtgaagaaggagctggtgattgagagccccctgcagtacaaggatgctgcccagggcgaggtggaggccgagagccctggccctgtgcctgccaagcccaagctgattgagcccctggactatgaaaatgtgattgtgcagaagaagacccagatcctgaatgactgcctgcgggagatgctgctcttcccctatgatgacttccagacagccatcctgcggcggcagggccgctacatctgcagcacagtgcctgccaaggccgaggaggaggcccagagcctgtttgtgacagagtgcatcaagacctacaacagcgactggcacctggtgaactacaagtatgaggactacagcggggagttccggcagctgcccaacaaggtggtgaagctggacaagctgcctgtgcacgtgtatgaggtggatgaggaggtggacaaggatgaagatgctgccagcctgggcagccagaagggcggcatcaccaagcacggctggctgtacaagggcaacatgaacagcgccatctctgtgaccatgaggagcttcaagaggcgcttcttccacctgatccagctgggagatggcagctacaacctgaacttctacaaggatgagaagatcagcaaggagcccaagggcagcatcttcctggacagctgcatgggcgtggtgcagaacaacaaggtgagaagatttgcctttgagctgaagatgcaggacaagagcagctacctgctggccgctgacagcgaggtggagatggaggagtggatcaccatcctgaacaagatcctgcagctgaactttgaagctgccatgcaggagaagagaaatggagacagccatgaagatgatgagcagagcaagctggagggcagcggcagcggcctggacagctacctgcctgagctggccaagagcgcccgggaggccgagatcaagctgaagtctgagagccgggtgaagctgttctacctggaccctgatgcccagaagctggacttcagcagcgctgagcctgaggtgaagagctttgaggagaagtttgggaagaggatcctggtgaagtgcaatgacctgtccttcaacctgcagtgctgcgtggccgagaatgaggagggccccaccaccaacgtggagcccttctttgtgaccctgagcctgtttgacatcaagtacaacaggaagatctctgctgacttccacgtggacctgaaccacttctctgtgcggcagatgctggccaccaccagccctgccctgatgaatggaagtggccagagccccagcgtgctgaagggcatcctgcatgaagctgccatgcagtaccccaagcagggcatcttctctgtgacctgcccccacccagacatcttcctggtggcccgcatcgagaaggtgctgcagggcagcatcacccactgtgccgagccctacatgaagagcagtgacagcagcaaggtggcccagaaggtgctgaagaatgccaagcaggcctgccagaggctgggccagtacaggatgccctttgcctgggccgcccggaccctcttcaaggatgccagcggcaacctggacaagaatgcccgcttcagcgccatctaccggcaggacagcaacaagctgagcaatgatgacatgctgaagctgctggccgacttcaggaagccagagaagatggccaagctgcccgtcatcctgggcaacctggacatcaccatcgacaacgtgtccagtgacttccccaactacgtgaacagcagctacatccccaccaagcagtttgagacctgcagcaagacccccatcacctttgaggtggaggagtttgtgccctgcatccccaagcacacccagccctacaccatctacaccaaccacctgtatgtgtaccccaagtacctgaagtatgacagccagaagagctttgccaaggccagaaatattgccatctgcatcgagttcaaggacagtgatgaggaggacagccagcccctgaagtgcatctacggccggcctgggggccctgtgttcaccaggtctgcctttgctgctgtgctgcaccaccaccagaaccctgagttctatgatgagatcaagattgagctgcccacccagctgcacgagaagcaccacctgctgctgaccttcttccacgtgtcctgtgacaacagcagcaagggcagcaccaagaagagagatgtggtggagacccaggtgggctacagctggctgcccctgctgaaggatggccgggtggtgaccagcgagcagcacatccctgtgtctgccaacctgcccagcggctacctgggctaccaggagctgggcatgggccgccactacggccctgagatcaagtgggtggatggcggcaagcccctgctgaagatcagcacccacctggtgtccacagtgtacacccaggaccagcacctgcacaacttcttccagtactgccagaagacagaaagtggggcccaggccctgggcaatgagctggtgaagtacctgaagagcctgcacgccatggagggccacgtgatgattgccttcctgcccaccatcctgaaccagctgttccgggtgctgacccgggccacccaggaggaggtggccgtgaatgtgaccagggtcatcatccacgtggtggcccagtgccacgaggagggcctggagagccacctgcggagctatgtgaagtatgcctacaaggccgagccctacgtggccagcgagtacaagacagtgcatgaggagctgaccaagtccatgaccaccatcctgaagcccagcgctgacttcctgaccagcaacaagctgctgaagtacagctggttcttctttgatgtgctgatcaagtccatggcccagcacctgattgagaacagcaaggtgaagctgctgaggaaccagcgcttccctgccagctaccaccacgctgtggagaccgtggtgaacatgctgatgccccacatcacccagaagttccgggacaaccctgaggccagcaagaatgccaaccacagcctggccgtgttcatcaagcgctgcttcaccttcatggaccggggctttgtgttcaagcagatcaacaactacatcagctgctttgcccctggggaccccaagaccctgtttgagtacaagtttgagttcctgcgggtggtgtgcaaccacgagcactacatccccctgaacctgcccatgccctttgggaagggccgcatccagcgctaccaggacctgcagctggactacagcctgacagatgagttctgcaggaaccacttcctggtgggcctgctgctgcgggaggtgggcacagccctgcaggagttccgggaggtgcggctcatcgccatctctgtgctgaagaacctgctgatcaagcacagctttgatgacagatatgccagccgcagccaccaggccagaattgccaccctgtacctgcccctgtttggcctgctgattgaaaatgtgcagaggatcaacgtgagagatgtgagccccttccctgtgaatgccggcatgacagtgaaggatgagagcctggccctgcctgctgtgaaccccctggtgaccccccagaagggcagcaccctggacaacagcctgcacaaggacctgctgggcgccatcagcggcatcgccagcccctacaccaccagcacccccaacatcaacagcgtgagaaatgctgacagccggggcagcctcatcagcacagacagcggcaacagcctgcctgagagaaattctgagaagagcaacagcctggacaagcaccagcagagcagcaccctgggcaacagcgtggtgcgctgtgacaagctggaccagagcgagatcaagagcctgctgatgtgcttcctgtacatcctgaagtccatgtctgatgatgccctcttcacctactggaacaaggccagcaccagcgagctgatggacttcttcaccatcagcgaggtgtgcctgcaccagttccagtacatgggcaagcgctacatcgccaggacaggcatgatgcacgcccggctgcagcagctgggcagcctggacaacagcctgaccttcaaccacagctatggccacagtgatgctgatgtgctgcaccagagcctgctggaggccaacatcgccacagaggtgtgcctgacagccctggacaccctgagcctcttcaccctggccttcaagaaccagctgctggccgaccacggccacaaccccctgatgaagaaggtgtttgatgtgtacctgtgcttcctgcagaagcaccagagcgagacagccctgaagaatgtgttcaccgccctgcggagcctcatctacaagttccccagcaccttctatgagggccgggctgacatgtgtgccgccctgtgctatgagatcctgaagtgctgcaacagcaagctgagcagcatcagaacagaggccagccagctgctgtacttcctgatgaggaacaactttgactacacaggcaagaagagctttgtgaggacccacctgcaggtgatcatctctgtgtcccagctgattgctgatgtggtgggcattggaggcacccgcttccagcagagcctgagcatcatcaacaactgtgccaacagcgacaggctcatcaagcacaccagcttcagcagtgatgtgaaggacctgaccaagaggatcagaacagtgctgatggccacagcccagatgaaggagcatgaaaatgaccctgagatgctggtggacctgcagtacagcctggccaagagctatgccagcaccccagagctgaggaagacctggctggacagcatggcccgcatccacgtgaagaatggagacctgtctgaggccgccatgtgctacgtgcacgtgacagccctggtggccgagtacctgaccaggaaggaggccgtgcagtgggagccccccctgctgccccacagccacagcgcctgcctgcggcgcagccggggcggcgtcttccggcagggctgcacagccttccgggtcatcacccccaacattgatgaggaggcctccatgatggaggatgtgggcatgcaggatgtgcacttcaatgaagatgtgctgatggagctgctggagcagtgtgctgatggcctgtggaaggccgagagatatgagctgattgctgacatctacaagctgatcatccccatctatgagaagagaagagactttgagcggctggcccacctgtatgacaccctgcaccgggcctacagcaaggtgacagaggtgatgcacagcggccgccgcctgctgggcacctacttccgggtggccttcttcggccaggccgcccagtaccagttcacagacagcgagacagatgtggagggcttctttgaagatgaagatggcaaggagtacatctacaaggagcccaagctgacccccctgtctgagatcagccagaggctgctgaagctgtacagcgacaagtttggaagtgaaaatgtgaagatgatccaggacagcggcaaggtgaaccccaaggacctggacagcaaatatgcctacatccaggtgacccacgtgatccccttctttgatgagaaggagctgcaggagaggaagacagaatttgagaggagccacaacatccgccgcttcatgtttgagatgcccttcacccagacaggcaagaggcagggcggcgtggaggagcagtgcaagaggaggaccatcctgacagccatccactgcttcccctacgtgaagaagagaattcctgtgatgtaccagcaccacacagacctgaaccccatcgaggtggccattgatgagatgagcaagaaggtggccgagctgcggcagctgtgcagcagcgctgaggtggacatgatcaagctgcagctgaagctgcagggctctgtgtctgtgcaggtgaatgccggccccctggcctatgcccgggccttcctggatgacaccaacaccaagcgctacccagacaacaaggtgaagctgctgaaggaggtgttccggcagtttgtggaggcctgtggccaggccctggccgtgaatgaaagactcatcaaggaggaccagctggagtaccaggaggagatgaaggccaactaccgggagatggccaaggagctgtctgagatcatgcatgagcagctgggctag

SEQ ID NO: 37974 - DNA, 3030 bp, Artificial Sequence
  Description of Artificial Sequence: Synthetic coding sequence
atgccctttgggaagggccgcatccagcgctaccaggccttcctgagccccaccgtggagagcaatgacacccctgtggacctgcagctggactacagcctgacagatgagttctgcaggaaccacttcctggtgggcctgctgctgcgggaggtgggcacagccctgcaggagttccgggaggtgcggctgattgccatctctgtgctgaagaacctgctgatcaagcacagctttgatgacagatatgccagccgcagccaccaggcccgcatcgccaccctgtacctgcccctgtttggcctgctgattgaaaatgtgcagaggatcaacgtgagagatgtgagccccttccctgtgaatgccggcatgacagtgaaggatgagagcctggccctgcctgctgtgaaccccctggtgaccccccagaagggcagcaccctggacaacagcctgcacaaggacctgctgggcgccatctctggaattgccagcccctacaccaccagcacccccaacatcaacagcgtgagaaatgctgacagccggggcagcctcatcagcacagattctggcaacagcctgcctgagaggaacagcgagaagagcaacagcctggacaagcaccagcagagcagcaccctgggcaacagcgtggtgcgctgtgacaagctggaccagagcgagatcaagagcctgctgatgtgcttcctgtacatcctgaagtccatgtctgatgatgccctcttcacctactggaacaaggccagcaccagcgagctgatggacttcttcaccatcagcgaggtgtgcctgcaccagttccagtacatgggcaagcgctacatcgccaggacaggcatgatgcacgcccggctgcagcagctgggcagcctggacaacagcctgaccttcaaccacagctatggccacagtgatgctgatgtgctgcaccagagcctgctggaggccaacatcgccacagaggtgtgcctgacagccctggacaccctgagcctcttcaccctggccttcaagaaccagctgctggccgaccacggccacaaccccctgatgaagaaggtgtttgatgtgtacctgtgcttcctgcagaagcaccagagcgagacagccctgaagaatgtgttcaccgccctgcggagcctcatctacaagttccccagcaccttctatgagggccgggctgacatgtgtgccgccctgtgctatgagatcctgaagtgctgcaacagcaagctgagcagcatcagaacagaggccagccagctgctgtacttcctgatgaggaacaactttgactacaccgggaagaagagctttgtgaggacccacctgcaggtgatcatctctgtgtcccagctgattgctgatgtggtgggcatcggcggcacccgcttccagcagagcctgagcatcatcaacaactgtgccaacagcgacaggctcatcaagcacaccagcttcagcagtgatgtgaaggacctgaccaagaggatcagaacagtgctgatggccacagcccagatgaaggagcatgaaaatgaccctgagatgctggtggacctgcagtacagcctggccaagagctatgccagcaccccagagctgaggaagacctggctggacagcatggcccgcatccacgtgaagaatggagacctgtctgaggccgccatgtgctacgtgcacgtgacagccctggtggccgagtacctgaccaggaagggcgtcttccggcagggctgcacagccttccgggtcatcacccccaacattgatgaggaggcctccatgatggaggatgtgggcatgcaggatgtgcacttcaatgaagatgtgctgatggagctgctggagcagtgtgctgatggcctgtggaaggccgagagatatgagctgattgctgacatctacaagctgatcatccccatctatgagaagagaagagactttgagcggctggcccacctgtatgacaccctgcaccgggcctacagcaaggtgacagaggtgatgcacagcggccgccgcctgctgggcacctacttccgggtggccttcttcggccaggccgcccagtaccagttcacagacagcgagacagatgtggagggcttctttgaagatgaagatggcaaggagtacatctacaaggagcccaagctgacccccctgtctgagatcagccagaggctgctgaagctgtacagcgacaagtttggaagtgaaaatgtgaagatgatccaggacagcggcaaggtgaaccccaaggacctggacagcaaatatgcctacatccaggtgacccacgtgatccccttctttgatgagaaggagctgcaggagaggaagacagaatttgagaggagccacaacatccgccgcttcatgtttgagatgcccttcacccagacaggcaagaggcagggcggcgtggaggagcagtgcaagaggaggaccatcctgacagccatccactgcttcccctacgtgaagaagagaattcctgtgatgtaccagcaccacacagacctgaaccccatcgaggtggccattgatgagatgagcaagaaggtggccgagctgcggcagctgtgcagcagcgctgaggtggacatgatcaagctgcagctgaagctgcagggctctgtgtctgtgcaggtgaatgccggccccctggcctatgcccgggccttcctggatgacaccaacaccaagcgctacccagacaacaaggtgaagctgctgaaggaggtgttccggcagtttgtggaggcctgtggccaggccctggccgtgaatgaaagactcatcaaggaggaccagctggagtaccaggaggagatgaaggccaactaccgggagatggccaaggagctgtctgagatcatgcatgagcaggtgcggcgcagcgccccctggaggagaagaagagccagctaccgcatccccttcaccagcagcacccccagcgtgggcctgcagcaggcccagtggttcaccggctag

SEQ ID NO: 37975 - DNA, 2010 bp, Artificial Sequence
  Description of Artificial Sequence: Synthetic coding sequence
tgattcaagaaccagctgctggccgaccacggccacaaccccctgatgaagaaggtgtttgatgtgtacctgtgcttcctgcagaagcaccagagcgagacagccctgaagaatgtgttcaccgccctgcggagcctcatctacaagttccccagcaccttctatgagggccgggctgacatgtgtgccgccctgtgctatgagatcctgaagtgctgcaacagcaagctgagcagcatcagaacagaggccagccagctgctgtacttcctgatgaggaacaactttgactacacaggcaagaagagctttgtgaggacccacctgcaggtgatcatctctgtgtcccagctgattgctgatgtggtgggcattggaggcacccgcttccagcagagcctgagcatcatcaacaactgtgccaacagcgacaggctcatcaagcacaccagcttcagcagtgatgtgaaggacctgaccaagaggatcagaacagtgctgatggccacagcccagatgaaggagcatgaaaatgaccctgagatgctggtggacctgcagtacagcctggccaagagctatgccagcaccccagagctgaggaagacctggctggacagcatggcccgcatccacgtgaagaatggagacctgtctgaggccgccatgtgctacgtgcacgtgacagccctggtggccgagtacctgaccaggaaaggagtcttccggcagggctgcacagccttccgggtcatcacccccaacattgatgaggaggcctccatgatggaggatgtgggcatgcaggatgtgcacttcaatgaagatgtgctgatggagctgctggagcagtgtgctgatggcctgtggaaggccgagagatatgagctgattgctgacatctacaagctgatcatccccatctatgagaagaggcgggactttgagcggctggcccacctgtatgacaccctgcaccgggcctacagcaaggtgacagaggtgatgcacagcggccggcggctgctgggcacctacttccgggtggccttcttcggccagcagtaccagttcacagattctgaaacagatgtggagggcttctttgaagatgaagatggcaaggagtacatctacaaggagcccaagctgacccccctgtctgagatcagccagaggctgctgaagctgtacagcgacaagtttggaagtgaaaatgtgaagatgatccaggacagcggcaaggtgaaccccaaggacctggacagcaaatatgcctacatccaggtgacccacgtgatccccttctttgatgagaaggagctgcaggagaggaagacagaatttgagaggagccacaacatccgccgcttcatgtttgagatgcccttcacccagacaggcaagaggcagggcggcgtggaggagcagtgcaagaggaggaccatcctgacagccatccactgcttcccctacgtgaagaagagaattcctgtgatgtaccagcaccacacagacctgaaccccatcgaggtggccattgatgagatgagcaagaaggtggccgagctgcggcagctgtgcagcagcgctgaggtggacatgatcaagctgcagctgaagctgcagggctctgtgtctgtgcaggtgaatgccggccccctggcctatgcccgggccttcctggatgacaccaacaccaagcgctacccagacaacaaggtgaagctgctgaaggaggtgttccggcagtttgtggaggcctgtggccaggccctggccgtgaatgaaagactcatcaaggaggaccagctggagtaccaggaggagatgaaggccaactaccgggagatggccaaggagctgtctgagatcatgcatgagcagatctgccccctggaggagaagacctctgtgctgcccaacagcctgcacatcttcaatgccatcagcggcacccccaccagcaccatggtgcacggcatgaccagcagcagctctgtggtgtag

SEQ ID NO: 37976 - DNA, 6240 bp, Artificial Sequence
  Description of Artificial Sequence: Synthetic coding sequence
atgagccagccccccctgctgcctgccagcgctgagaccaggaagttcacccgggccctgagcaagccaggcacagctgctgagctgcggcagagcgtgtctgaggtggtgcggggctctgtgctgctggccaagcccaagctgattgagcccctggactatgaaaatgtcatcgtgcagaagaagacccagatcctgaatgactgcctgcgggagatgctgctcttcccctatgatgacttccagacagccatcctgcggcggcagggccgctacatctgcagcacagtgcctgccaaggccgaggaggaggcccagagcctgtttgtgacagagtgcatcaagacctacaacagcgactggcacctggtgaactacaagtatgaggactacagcggggagttccggcagctgcccaacaaggtggtgaagctggacaagctgcctgtgcacgtgtatgaggtggatgaggaggtggacaaggatgaagatgctgccagcctgggcagccagaagggcggcatcaccaagcacggctggctgtacaagggcaacatgaacagcgccatctctgtgaccatgaggagcttcaagaggcgcttcttccacctgatccagctgggagatggcagctacaacctgaacttctacaaggatgagaagatcagcaaggagcccaagggcagcatcttcctggacagctgcatgggcgtggtgcagaacaacaaggtgagaagatttgcctttgagctgaagatgcaggacaagagcagctacctgctggccgctgacagcgaggtggagatggaggagtggatcaccatcctgaacaagatcctgcagctgaactttgaggccgccatgcaggagaagagaaatggagacagccatgaagatgatgagcagagcaagctggagggcagcggcagcggcctggacagctacctgcctgagctggccaagagcgcccgggaggccgagatcaagctgaagtctgagagccgggtgaagctgttctacctggaccctgatgcccagaagctggacttcagcagcgctgagcctgaggtgaagagctttgaggagaagtttgggaagaggatcctggtgaagtgcaatgacctgtccttcaacctgcagtgctgcgtggctgaaaatgaggagggccccaccaccaacgtggagcccttctttgtgaccctgagcctgtttgacatcaagtacaacaggaagatctctgctgacttccacgtggacctgaaccacttctctgtgcggcagatgctggccaccaccagccctgccctgatgaatggcagcggccagagccccagcgtgctgaagggcatcctgcacgaggccgccatgcagtaccccaagcagggcatcttctctgtgacctgcccccacccagacatcttcctggtggccagaattgagaaggtgctgcagggcagcatcacccactgtgccgagccctacatgaagagcagtgacagcagcaaggtggcccagaaggtgctgaagaatgccaagcaggcctgccagaggctgggccagtacaggatgccctttgcctgggccgcccggaccctcttcaaggatgccagcggcaacctggacaagaatgcccgcttcagcgccatctaccggcaggacagcaacaagctgagcaatgatgacatgctgaagctgctggccgacttcaggaagccagagaagatggccaagctgcctgtgatcctgggcaacctggacatcaccatcgacaacgtgtccagtgacttccccaactacgtgaacagcagctacatccccaccaagcagtttgagacctgcagcaagacccccatcacctttgaggtggaggagtttgtgccctgcatccccaagcacacccagccctacaccatctacaccaaccacctgtatgtgtaccccaagtacctgaagtatgacagccagaagagctttgccaaggccaggaacatcgccatctgcatcgagttcaaggacagtgatgaggaggacagccagcccctgaagtgcatctacggccggcctgggggccctgtgttcaccaggtctgcctttgctgctgtgctgcaccaccaccagaaccctgagttctatgatgagatcaagattgagctgcccacccagctgcacgagaagcaccacctgctgctgaccttcttccacgtgtcctgtgacaacagcagcaagggcagcaccaagaagagagatgtggtggagacccaggtgggctacagctggctgcccctgctgaaggatggccgggtggtgaccagcgagcagcacatccctgtgtctgccaacctgcccagcggctacctgggctaccaggagctgggcatgggccgccactacggccctgagatcaagtgggtggatggcggcaagcccctgctgaagatcagcacccacctggtgtccacagtgtacacccaggaccagcacctgcacaacttcttccagtactgccagaagacagagagcggggcccaggccctgggcaatgagctggtgaagtacctgaagagcctgcacgccatggagggccacgtgatgattgccttcctgcccaccatcctgaaccagctgttccgggtgctgacccgggccacccaggaggaggtggccgtgaatgtgaccagggtcatcatccacgtggtggcccagtgccacgaggagggcctggagagccacctgcggagctatgtgaagtatgcctacaaggccgagccctacgtggccagcgagtacaagacagtgcatgaggagctgaccaagtccatgaccaccatcctgaagcccagcgctgacttcctgaccagcaacaagctgctgaagtacagctggttcttctttgatgtgctgatcaagtccatggcccagcacctgattgagaacagcaaggtgaagctgctgaggaaccagcgcttccctgccagctaccaccacgctgtggagaccgtggtgaacatgctgatgccccacatcacccagaagttccgggacaaccctgaggccagcaagaatgccaaccacagcctggccgtgttcatcaagcgctgcttcaccttcatggaccggggctttgtgttcaagcagatcaacaactacatcagctgctttgcccctggggaccccaagaccctgtttgagtacaagtttgagttcctgcgggtggtgtgcaaccacgagcactacatccccctgaacctgcccatgccctttgggaagggccgcatccagcgctaccaggacctgcagctggactacagcctgacagatgagttctgcaggaaccacttcctggtgggcctgctgctgcgggaggtgggcacagccctgcaggagttccgggaggtgcggctgattgccatctctgtgctgaagaacctgctgatcaagcacagctttgatgacagatatgccagccgcagccaccaggcccgcatcgccaccctgtacctgcccctgtttggcctgctgattgaaaatgtgcagaggatcaacgtgagagatgtgagccccttccctgtgaatgccggcatgacagtgaaggatgagagcctggccctgcctgctgtgaaccccctggtgaccccccagaagggcagcaccctggacaacagcctgcacaaggacctgctgggcgccatctctggaattgccagcccctacaccaccagcacccccaacatcaacagcgtgagaaatgctgacagccggggcagcctcatcagcacagattctggcaacagcctgcctgagaggaacagcgagaagagcaacagcctggacaagcaccagcagagcagcaccctgggcaacagcgtggtgcgctgtgacaagctggaccagagcgagatcaagagcctgctgatgtgcttcctgtacatcctgaagtccatgtctgatgatgccctcttcacctactggaacaaggccagcaccagcgagctgatggacttcttcaccatcagcgaggtgtgcctgcaccagttccagtacatgggcaagcgctacatcgccaggacaggcatgatgcacgcccggctgcagcagctgggcagcctggacaacagcctgaccttcaaccacagctatggccacagtgatgctgatgtgctgcaccagagcctgctggaggccaacatcgccacagaggtgtgcctgacagccctggacaccctgagcctcttcaccctggccttcaagaaccagctgctggccgaccacggccacaaccccctgatgaagaaggtgtttgatgtgtacctgtgcttcctgcagaagcaccagagcgagacagccctgaagaatgtgttcaccgccctgcggagcctcatctacaagttccccagcaccttctatgagggccgggctgacatgtgtgccgccctgtgctatgagatcctgaagtgctgcaacagcaagctgagcagcatcagaacagaggccagccagctgctgtacttcctgatgaggaacaactttgactacaccgggaagaagagctttgtgaggacccacctgcaggtgatcatctctgtgtcccagctgattgctgatgtggtgggcatcggcggcacccgcttccagcagagcctgagcatcatcaacaactgtgccaacagcgacaggctcatcaagcacaccagcttcagcagtgatgtgaaggacctgaccaagaggatcagaacagtgctgatggccacagcccagatgaaggagcatgaaaatgaccctgagatgctggtggacctgcagtacagcctggccaagagctatgccagcaccccagagctgaggaagacctggctggacagcatggcccgcatccacgtgaagaatggagacctgtctgaggccgccatgtgctacgtgcacgtgacagccctggtggccgagtacctgaccaggaagggcgtcttccggcagggctgcacagccttccgggtcatcacccccaacattgatgaggaggcctccatgatggaggatgtgggcatgcaggatgtgcacttcaatgaagatgtgctgatggagctgctggagcagtgtgctgatggcctgtggaaggccgagagatatgagctgattgctgacatctacaagctgatcatccccatctatgagaagagaagagactttgagcggctggcccacctgtatgacaccctgcaccgggcctacagcaaggtgacagaggtgatgcacagcggccgccgcctgctgggcacctacttccgggtggccttcttcggccaggccgcccagtaccagttcacagacagcgagacagatgtggagggcttctttgaagatgaagatggcaaggagtacatctacaaggagcccaagctgacccccctgtctgagatcagccagaggctgctgaagctgtacagcgacaagtttggaagtgaaaatgtgaagatgatccaggacagcggcaaggtgaaccccaaggacctggacagcaaatatgcctacatccaggtgacccacgtgatccccttctttgatgagaaggagctgcaggagaggaagacagaatttgagaggagccacaacatccgccgcttcatgtttgagatgcccttcacccagacaggcaagaggcagggcggcgtggaggagcagtgcaagaggaggaccatcctgacagccatccactgcttcccctacgtgaagaagagaattcctgtgatgtaccagcaccacacagacctgaaccccatcgaggtggccattgatgagatgagcaagaaggtggccgagctgcggcagctgtgcagcagcgctgaggtggacatgatcaagctgcagctgaagctgcagggctctgtgtctgtgcaggtgaatgccggccccctggcctatgcccgggccttcctggatgacaccaacaccaagcgctacccagacaacaaggtgaagctgctgaaggaggtgttccggcagtttgtggaggcctgtggccaggccctggccgtgaatgaaagactcatcaaggaggaccagctggagtaccaggaggagatgaaggccaactaccgggagatggccaaggagctgtctgagatcatgcatgagcaggtgcggcgcagcgccccctggaggagaagaagagccagctaccgcatccccttcaccagcagcacccccagcgtgggcctgcagcaggcccagtggttcaccggctag

SEQ ID NO: 37977 - DNA, 1173 bp, Artificial Sequence
  Description of Artificial Sequence: Synthetic coding sequence
tgacagatgaaggagcatgaaaatgaccctgagatgctggtggacctgcagtacagcctggccaagagctatgccagcaccccagagctgaggaagacctggctggacagcatggcccgcatccacgtgaagaatggagacctgtctgaggccgccatgtgctacgtgcacgtgacagccctggtggccgagtacctgaccaggaaggaggccgtgcagtgggagccccccctgctgccccacagccacagcgcctgcctgcggcgcagccggggcggcgtcttccggcagggctgcacagccttccgggtcatcacccccaacattgatgaggaggcctccatgatggaggatgtgggcatgcaggatgtgcacttcaatgaagatgtgctgatggagctgctggagcagtgtgctgatggcctgtggaaggccgagagatatgagctgattgctgacatctacaagctgatcatccccatctatgagaagagaagagactttgagcggctggcccacctgtatgacaccctgcaccgggcctacagcaaggtgacagaggtgatgcacagcggccgccgcctgctgggcacctacttccgggtggccttcttcggccagggcttctttgaagatgaagatggcaaggagtacatctacaaggagcccaagctgacccccctgtctgagatcagccagaggctgctgaagctgtacagcgacaagtttggaagtgaaaatgtgaagatgatccaggacagcggcaaggtgaaccccaaggacctggacagcaaatatgcctacatccaggtgacccacgtgatccccttctttgatgagaaggagctgcaggagaggaagacagaatttgagaggagccacaacatccgccgcttcatgtttgagatgcccttcacccagacaggcaagaggcagggcggcgtggaggagcagtgcaagaggaggaccatcctgacagccatccactgcttcccctacgtgaagaagagaattcctgtgatgtaccagcaccacacagacctgaaccccatcgaggtggccattgatgagatgagcaagaaggtggccgagctgcggcagctgtgcagcagcgctgaggtggacatgatcaagctgcagctgaagctgcagggctctgtgtctgtgcagtag

SEQ ID NO: 37978 - DNA, 588 bp, Artificial Sequence
  Description of Artificial Sequence: Synthetic coding sequence
atgagccagccccccctgctgcctgccagcgctgagaccaggaagttcacccgggccctgagcaagccaggcacagctgctgagctgcggcagagcgtgtctgaggtggtgcggggctctgtgctgctggccaagcccaagctgattgagcccctggactatgaaaatgtcatcgtgcagaagaagacccagatcctgaatgactgcctgcgggagatgctgctcttcccctatgatgacttccagacagccatcctgcggcggcagggccgctacatctgcagcacagtgcctgccaaggccgaggaggaggcccagagcctgtttgtgacagagtgcatcaagacctacaacagcgactggcacctggtgaactacaagtatgaggactacagcggggagttccggcagctgcccaacaaggtggtgaagctggacaagctgcctgtgcacgtgtatgaggtggatgaggaggtggacaaggatgaagatgctgccagcctgggcagccagaagggcggcatcaccaagcacggctggctgtacaagggcaacatgaacagcgccatctctgtgaccatgaggtag

SEQ ID NO: 37979 - DNA, 6306 bp, Artificial Sequence
  Description of Artificial Sequence: Synthetic coding sequence
atgcaggccgacaagtgcaggaccagcagccgctctgtgaagaaggagctggtgattgagagccccctgcagtacaaggatgctgcccagggcgaggtggaggccgagagccctggccctgtgcctgccaagcccaagctgattgagcccctggactatgaaaatgtgattgtgcagaagaagacccagatcctgaatgactgcctgcgggagatgctgctcttcccctatgatgacttccagacagccatcctgcggcggcagggccgctacatctgcagcacagtgcctgccaaggccgaggaggaggcccagagcctgtttgtgacagagtgcatcaagacctacaacagcgactggcacctggtgaactacaagtatgaggactacagcggggagttccggcagctgcccaacaaggtggtgaagctggacaagctgcctgtgcacgtgtatgaggtggatgaggaggtggacaaggatgaagatgctgccagcctgggcagccagaagggcggcatcaccaagcacggctggctgtacaagggcaacatgaacagcgccatctctgtgaccatgaggagcttcaagaggcgcttcttccacctgatccagctgggagatggcagctacaacctgaacttctacaaggatgagaagatcagcaaggagcccaagggcagcatcttcctggacagctgcatgggcgtggtgcagaacaacaaggtgagaagatttgcctttgagctgaagatgcaggacaagagcagctacctgctggccgctgacagcgaggtggagatggaggagtggatcaccatcctgaacaagatcctgcagctgaactttgaagctgccatgcaggagaagagaaatggagacagccatgaagatgatgagcagagcaagctggagggcagcggcagcggcctggacagctacctgcctgagctggccaagagcgcccgggaggccgagatcaagctgaagtctgagagccgggtgaagctgttctacctggaccctgatgcccagaagctggacttcagcagcgctgagcctgaggtgaagagctttgaggagaagtttgggaagaggatcctggtgaagtgcaatgacctgtccttcaacctgcagtgctgcgtggccgagaatgaggagggccccaccaccaacgtggagcccttctttgtgaccctgagcctgtttgacatcaagtacaacaggaagatctctgctgacttccacgtggacctgaaccacttctctgtgcggcagatgctggccaccaccagccctgccctgatgaatggaagtggccagagccccagcgtgctgaagggcatcctgcatgaagctgccatgcagtaccccaagcagggcatcttctctgtgacctgcccccacccagacatcttcctggtggcccgcatcgagaaggtgctgcagggcagcatcacccactgtgccgagccctacatgaagagcagtgacagcagcaaggtggcccagaaggtgctgaagaatgccaagcaggcctgccagaggctgggccagtacaggatgccctttgcctgggccgcccggaccctcttcaaggatgccagcggcaacctggacaagaatgcccgcttcagcgccatctaccggcaggacagcaacaagctgagcaatgatgacatgctgaagctgctggccgacttcaggaagccagagaagatggccaagctgcccgtcatcctgggcaacctggacatcaccatcgacaacgtgtccagtgacttccccaactacgtgaacagcagctacatccccaccaagcagtttgagacctgcagcaagacccccatcacctttgaggtggaggagtttgtgccctgcatccccaagcacacccagccctacaccatctacaccaaccacctgtatgtgtaccccaagtacctgaagtatgacagccagaagagctttgccaaggccagaaatattgccatctgcatcgagttcaaggacagtgatgaggaggacagccagcccctgaagtgcatctacggccggcctgggggccctgtgttcaccaggtctgcctttgctgctgtgctgcaccaccaccagaaccctgagttctatgatgagatcaagattgagctgcccacccagctgcacgagaagcaccacctgctgctgaccttcttccacgtgtcctgtgacaacagcagcaagggcagcaccaagaagagagatgtggtggagacccaggtgggctacagctggctgcccctgctgaaggatggccgggtggtgaccagcgagcagcacatccctgtgtctgccaacctgcccagcggctacctgggctaccaggagctgggcatgggccgccactacggccctgagatcaagtgggtggatggcggcaagcccctgctgaagatcagcacccacctggtgtccacagtgtacacccaggaccagcacctgcacaacttcttccagtactgccagaagacagaaagtggggcccaggccctgggcaatgagctggtgaagtacctgaagagcctgcacgccatggagggccacgtgatgattgccttcctgcccaccatcctgaaccagctgttccgggtgctgacccgggccacccaggaggaggtggccgtgaatgtgaccagggtcatcatccacgtggtggcccagtgccacgaggagggcctggagagccacctgcggagctatgtgaagtatgcctacaaggccgagccctacgtggccagcgagtacaagacagtgcatgaggagctgaccaagtccatgaccaccatcctgaagcccagcgctgacttcctgaccagcaacaagctgctgaagtacagctggttcttctttgatgtgctgatcaagtccatggcccagcacctgattgagaacagcaaggtgaagctgctgaggaaccagcgcttccctgccagctaccaccacgctgtggagaccgtggtgaacatgctgatgccccacatcacccagaagttccgggacaaccctgaggccagcaagaatgccaaccacagcctggccgtgttcatcaagcgctgcttcaccttcatggaccggggctttgtgttcaagcagatcaacaactacatcagctgctttgcccctggggaccccaagaccctgtttgagtacaagtttgagttcctgcgggtggtgtgcaaccacgagcactacatccccctgaacctgcccatgccctttgggaagggccgcatccagcgctaccaggacctgcagctggactacagcctgacagatgagttctgcaggaaccacttcctggtgggcctgctgctgcgggaggtgggcacagccctgcaggagttccgggaggtgcggctcatcgccatctctgtgctgaagaacctgctgatcaagcacagctttgatgacagatatgccagccgcagccaccaggccagaattgccaccctgtacctgcccctgtttggcctgctgattgaaaatgtgcagaggatcaacgtgagagatgtgagccccttccctgtgaatgccggcatgacagtgaaggatgagagcctggccctgcctgctgtgaaccccctggtgaccccccagaagggcagcaccctggacaacagcctgcacaaggacctgctgggcgccatcagcggcatcgccagcccctacaccaccagcacccccaacatcaacagcgtgagaaatgctgacagccggggcagcctcatcagcacagacagcggcaacagcctgcctgagagaaattctgagaagagcaacagcctggacaagcaccagcagagcagcaccctgggcaacagcgtggtgcgctgtgacaagctggaccagagcgagatcaagagcctgctgatgtgcttcctgtacatcctgaagtccatgtctgatgatgccctcttcacctactggaacaaggccagcaccagcgagctgatggacttcttcaccatcagcgaggtgtgcctgcaccagttccagtacatgggcaagcgctacatcgccaggacaggcatgatgcacgcccggctgcagcagctgggcagcctggacaacagcctgaccttcaaccacagctatggccacagtgatgctgatgtgctgcaccagagcctgctggaggccaacatcgccacagaggtgtgcctgacagccctggacaccctgagcctcttcaccctggccttcaagaaccagctgctggccgaccacggccacaaccccctgatgaagaaggtgtttgatgtgtacctgtgcttcctgcagaagcaccagagcgagacagccctgaagaatgtgttcaccgccctgcggagcctcatctacaagttccccagcaccttctatgagggccgggctgacatgtgtgccgccctgtgctatgagatcctgaagtgctgcaacagcaagctgagcagcatcagaacagaggccagccagctgctgtacttcctgatgaggaacaactttgactacacaggcaagaagagctttgtgaggacccacctgcaggtgatcatctctgtgtcccagctgattgctgatgtggtgggcattggaggcacccgcttccagcagagcctgagcatcatcaacaactgtgccaacagcgacaggctcatcaagcacaccagcttcagcagtgatgtgaaggacctgaccaagaggatcagaacagtgctgatggccacagcccagatgaaggagcatgaaaatgaccctgagatgctggtggacctgcagtacagcctggccaagagctatgccagcaccccagagctgaggaagacctggctggacagcatggcccgcatccacgtgaagaatggagacctgtctgaggccgccatgtgctacgtgcacgtgacagccctggtggccgagtacctgaccaggaaggaggccgtgcagtgggagccccccctgctgccccacagccacagcgcctgcctgcggcgcagccggggcggcgtcttccggcagggctgcacagccttccgggtcatcacccccaacattgatgaggaggcctccatgatggaggatgtgggcatgcaggatgtgcacttcaatgaagatgtgctgatggagctgctggagcagtgtgctgatggcctgtggaaggccgagagatatgagctgattgctgacatctacaagctgatcatccccatctatgagaagagaagagactttgagcggctggcccacctgtatgacaccctgcaccgggcctacagcaaggtgacagaggtgatgcacagcggccgccgcctgctgggcacctacttccgggtggccttcttcggccaggccgcccagtaccagttcacagacagcgagacagatgtggagggcttctttgaagatgaagatggcaaggagtacatctacaaggagcccaagctgacccccctgtctgagatcagccagaggctgctgaagctgtacagcgacaagtttggaagtgaaaatgtgaagatgatccaggacagcggcaaggtgaaccccaaggacctggacagcaaatatgcctacatccaggtgacccacgtgatccccttctttgatgagaaggagctgcaggagaggaagacagaatttgagaggagccacaacatccgccgcttcatgtttgagatgcccttcacccagacaggcaagaggcagggcggcgtggaggagcagtgcaagaggaggaccatcctgacagccatccactgcttcccctacgtgaagaagagaattcctgtgatgtaccagcaccacacagacctgaaccccatcgaggtggccattgatgagatgagcaagaaggtggccgagctgcggcagctgtgcagcagcgctgaggtggacatgatcaagctgcagctgaagctgcagggctctgtgtctgtgcaggtgaatgccggccccctggcctatgcccgggccttcctggatgacaccaacaccaagcgctacccagacaacaaggtgaagctgctgaaggaggtgttccggcagtttgtggaggcctgtggccaggccctggccgtgaatgaaagactcatcaaggaggaccagctggagtaccaggaggagatgaaggccaactaccgggagatggccaaggagctgtctgagatcatgcatgagcaggtgcggcgcagcgccccctggaggagaagaagagccagctaccgcatccccttcaccagcagcacccccagcgtgggcctgcagcaggcccagtggttcaccggctag

SEQ ID NO: 37980 - DNA, 3762 bp, Artificial Sequence
  Description of Artificial Sequence: Synthetic coding sequence
atgcaggccgacaagtgcaggaccagcagccgctctgtgaagaaggagctggtgattgagagccccctgcagtacaaggatgctgcccagggcgaggtggaggccgagagccctggccctgtgcctgccaagcccaagctgattgagcccctggactatgaaaatgtgattgtgcagaagaagacccagatcctgaatgactgcctgcgggagatgctgctcttcccctatgatgacttccagacagccatcctgcggcggcagggccgctacatctgcagcacagtgcctgccaaggccgaggaggaggcccagagcctgtttgtgacagagtgcatcaagacctacaacagcgactggcacctggtgaactacaagtatgaggactacagcggggagttccggcagctgcccaacaaggtggtgaagctggacaagctgcctgtgcacgtgtatgaggtggatgaggaggtggacaaggatgaagatgctgccagcctgggcagccagaagggcggcatcaccaagcacggctggctgtacaagggcaacatgaacagcgccatctctgtgaccatgaggagcttcaagaggcgcttcttccacctgatccagctgggagatggcagctacaacctgaacttctacaaggatgagaagatcagcaaggagcccaagggcagcatcttcctggacagctgcatgggcgtggtgcagaacaacaaggtgagaagatttgcctttgagctgaagatgcaggacaagagcagctacctgctggccgctgacagcgaggtggagatggaggagtggatcaccatcctgaacaagatcctgcagctgaactttgaagctgccatgcaggagaagagaaatggagacagccatgaagatgatgagcagagcaagctggagggcagcggcagcggcctggacagctacctgcctgagctggccaagagcgcccgggaggccgagatcaagctgaagtctgagagccgggtgaagctgttctacctggaccctgatgcccagaagctggacttcagcagcgctgagcctgaggtgaagagctttgaggagaagtttgggaagaggatcctggtgaagtgcaatgacctgtccttcaacctgcagtgctgcgtggccgagaatgaggagggccccaccaccaacgtggagcccttctttgtgaccctgagcctgtttgacatcaagtacaacaggaagatctctgctgacttccacgtggacctgaaccacttctctgtgcggcagatgctggccaccaccagccctgccctgatgaatggaagtggccagagccccagcgtgctgaagggcatcctgcatgaagctgccatgcagtaccccaagcagggcatcttctctgtgacctgcccccacccagacatcttcctggtggcccgcatcgagaaggtgctgcagggcagcatcacccactgtgccgagccctacatgaagagcagtgacagcagcaaggtggcccagaaggtgctgaagaatgccaagcaggcctgccagaggctgggccagtacaggatgccctttgcctgggccgcccggaccctcttcaaggatgccagcggcaacctggacaagaatgcccgcttcagcgccatctaccggcaggacagcaacaagctgagcaatgatgacatgctgaagctgctggccgacttcaggaagccagagaagatggccaagctgcccgtcatcctgggcaacctggacatcaccatcgacaacgtgtccagtgacttccccaactacgtgaacagcagctacatccccaccaagcagtttgagacctgcagcaagacccccatcacctttgaggtggaggagtttgtgccctgcatccccaagcacacccagccctacaccatctacaccaaccacctgtatgtgtaccccaagtacctgaagtatgacagccagaagagctttgccaaggccagaaatattgccatctgcatcgagttcaaggacagtgatgaggaggacagccagcccctgaagtgcatctacggccggcctgggggccctgtgttcaccaggtctgcctttgctgctgtgctgcaccaccaccagaaccctgagttctatgatgagatcaagattgagctgcccacccagctgcacgagaagcaccacctgctgctgaccttcttccacgtgtcctgtgacaacagcagcaagggcagcaccaagaagagagatgtggtggagacccaggtgggctacagctggctgcccctgctgaaggatggccgggtggtgaccagcgagcagcacatccctgtgtctgccaacctgcccagcggctacctgggctaccaggagctgggcatgggccgccactacggccctgagatcaagtgggtggatggcggcaagcccctgctgaagatcagcacccacctggtgtccacagtgtacacccaggaccagcacctgcacaacttcttccagtactgccagaagacagaaagtggggcccaggccctgggcaatgagctggtgaagtacctgaagagcctgcacgccatggagggccacgtgatgattgccttcctgcccaccatcctgaaccagctgttccgggtgctgacccgggccacccaggaggaggtggccgtgaatgtgaccagggtcatcatccacgtggtggcccagtgccacgaggagggcctggagagccacctgcggagctatgtgaagtatgcctacaaggccgagccctacgtggccagcgagtacaagacagtgcatgaggagctgaccaagtccatgaccaccatcctgaagcccagcgctgacttcctgaccagcaacaagctgctgaagtacagctggttcttctttgatgtgctgatcaagtccatggcccagcacctgattgagaacagcaaggtgaagctgctgaggaaccagcgcttccctgccagctaccaccacgctgtggagaccgtggtgaacatgctgatgccccacatcacccagaagttccgggacaaccctgaggccagcaagaatgccaaccacagcctggccgtgttcatcaagcgctgcttcaccttcatggaccggggctttgtgttcaagcagatcaacaactacatcagctgctttgcccctggggaccccaagaccctgtttgagtacaagtttgagttcctgcgggtggtgtgcaaccacgagcactacatccccctgaacctgcccatgccctttgggaagggccgcatccagcgctaccaggacctgcagctggactacagcctgacagatgagttctgcaggaaccacttcctggtgggcctgctgctgcgggaggtgggcacagccctgcaggagttccgggaggtgcggctcatcgccatctctgtgctgaagaacctgctgatcaagcacagctttgatgacagatatgccagccgcagccaccaggccagaattgccaccctgtacctgcccctgtttggcctgctgattgaaaatgtgcagaggatcaacgtgagagatgtgagccccttccctgtgaatgccggcatgacagtgaaggatgagagcctggccctgcctgctgtgaaccccctggtgaccccccagaagggcagcaccctggacaacagcctgcacaaggacctgctgggcgccatcagcggcattggaaatgccccctgcagctgtggcctgctgagcaccatcaccctgaaggtgtcctggagccagtag

SEQ ID NO: 37981 - DNA, 4182 bp, Artificial Sequence
  Description of Artificial Sequence: Synthetic coding sequence
atgggctgcaccaccagcgtcatcctcttcaagggcatcagaacagtgtttgaaagaaactgtgcctacatgtgcaagcagcagggcgagaacaatgccctggagtacacagcctacaactggaccaaggaggacagcgagctgctgatcagctcctggctggccaagcccaagctgattgagcccctggactatgaaaatgtgattgtgcagaagaagacccagatcctgaatgactgcctgcgggagatgctgctcttcccctatgatgacttccagacagccatcctgcggcggcagggccgctacatctgcagcacagtgcctgccaaggccgaggaggaggcccagagcctgtttgtgacagagtgcatcaagacctacaacagcgactggcacctggtgaactacaagtatgaggactacagcggggagttccggcagctgcccaacaaggtggtgaagctggacaagctgcctgtgcacgtgtatgaggtggatgaggaggtggacaaggatgaagatgctgccagcctgggcagccagaagggcggcatcaccaagcacggctggctgtacaagggcaacatgaacagcgccatctctgtgaccatgaggagcttcaagaggcgcttcttccacctgatccagctgggagatggcagctacaacctgaacttctacaaggatgagaagatcagcaaggagcccaagggcagcatcttcctggacagctgcatgggcgtggtgcagaacaacaaggtgagaagatttgcctttgagctgaagatgcaggacaagagcagctacctgctggccgctgacagcgaggtggagatggaggagtggatcaccatcctgaacaagatcctgcagctgaactttgaagctgccatgcaggagaagagaaatggagacagccatgaagatgatgagcagagcaagctggagggcagcggcagcggcctggacagctacctgcctgagctggccaagagcgcccgggaggccgagatcaagctgaagtctgagagccgggtgaagctgttctacctggaccctgatgcccagaagctggacttcagcagcgctgagcctgaggtgaagagctttgaggagaagtttgggaagaggatcctggtgaagtgcaatgacctgtccttcaacctgcagtgctgcgtggccgagaatgaggagggccccaccaccaacgtggagcccttctttgtgaccctgagcctgtttgacatcaagtacaacaggaagatctctgctgacttccacgtggacctgaaccacttctctgtgcggcagatgctggccaccaccagccctgccctgatgaatggaagtggccagagccccagcgtgctgaagggcatcctgcatgaagctgccatgcagtaccccaagcagggcatcttctctgtgacctgcccccacccagacatcttcctggtggcccgcatcgagaaggtgctgcagggcagcatcacccactgtgccgagccctacatgaagagcagtgacagcagcaaggtggcccagaaggtgctgaagaatgccaagcaggcctgccagaggctgggccagtacaggatgccctttgcctgggccgcccggaccctcttcaaggatgccagcggcaacctggacaagaatgcccgcttcagcgccatctaccggcaggacagcaacaagctgagcaatgatgacatgctgaagctgctggccgacttcaggaagccagagaagatggccaagctgcccgtcatcctgggcaacctggacatcaccatcgacaacgtgtccagtgacttccccaactacgtgaacagcagctacatccccaccaagcagtttgagacctgcagcaagacccccatcacctttgaggtggaggagtttgtgccctgcatccccaagcacacccagccctacaccatctacaccaaccacctgtatgtgtaccccaagtacctgaagtatgacagccagaagagctttgccaaggccagaaatattgccatctgcatcgagttcaaggacagtgatgaggaggacagccagcccctgaagtgcatctacggccggcctgggggccctgtgttcaccaggtctgcctttgctgctgtgctgcaccaccaccagaaccctgagttctatgatgagatcaagattgagctgcccacccagctgcacgagaagcaccacctgctgctgaccttcttccacgtgtcctgtgacaacagcagcaagggcagcaccaagaagagagatgtggtggagacccaggtgggctacagctggctgcccctgctgaaggatggccgggtggtgaccagcgagcagcacatccctgtgtctgccaacctgcccagcggctacctgggctaccaggagctgggcatgggccgccactacggccctgagatcaagtgggtggatggcggcaagcccctgctgaagatcagcacccacctggtgtccacagtgtacacccaggaccagcacctgcacaacttcttccagtactgccagaagacagaaagtggggcccaggccctgggcaatgagctggtgaagtacctgaagagcctgcacgccatggagggccacgtgatgattgccttcctgcccaccatcctgaaccagctgttccgggtgctgacccgggccacccaggaggaggtggccgtgaatgtgaccagggtcatcatccacgtggtggcccagtgccacgaggagggcctggagagccacctgcggagctatgtgaagtatgcctacaaggccgagccctacgtggccagcgagtacaagacagtgcatgaggagctgaccaagtccatgaccaccatcctgaagcccagcgctgacttcctgaccagcaacaagctgctgaagtacagctggttcttctttgatgtgctgatcaagtccatggcccagcacctgattgagaacagcaaggtgaagctgctgaggaaccagcgcttccctgccagctaccaccacgctgtggagaccgtggtgaacatgctgatgccccacatcacccagaagttccgggacaaccctgaggccagcaagaatgccaaccacagcctggccgtgttcatcaagcgctgcttcaccttcatggaccggggctttgtgttcaagcagatcaacaactacatcagctgctttgcccctggggaccccaagaccctgtttgagtacaagtttgagttcctgcgggtggtgtgcaaccacgagcactacatccccctgaacctgcccatgccctttgggaagggccgcatccagcgctaccaggacctgcagctggactacagcctgacagatgagttctgcaggaaccacttcctggtgggcctgctgctgcgggaggtgggcacagccctgcaggagttccgggaggtgcggctcatcgccatctctgtgctgaagaacctgctgatcaagcacagctttgatgacagatatgccagccgcagccaccaggccagaattgccaccctgtacctgcccctgtttggcctgctgattgaaaatgtgcagaggatcaacgtgagagatgtgagccccttccctgtgaatgccggcatgacagtgaaggatgagagcctggccctgcctgctgtgaaccccctggtgaccccccagaagggcagcaccctggacaacagcctgcacaaggacctgctgggcgccatcagcggcatcgccagcccctacaccaccagcacccccaacatcaacagcgtgagaaatgctgacagccggggcagcctcatcagcacagacagcggcaacagcctgcctgagagaaattctgagaagagcaacagcctggacaagcaccagcagagcagcaccctgggcaacagcgtggtgcgctgtgacaagctggaccagagcgagatcaagagcctgctgatgtgcttcctgtacatcctgaagtccatgtctgatgatgccctcttcacctactggaacaaggccagcaccagcgagctgatggacttcttcaccatcagcgaggtgtgcctgcaccagttccagtacatgggcaagcgctacatcgccagcctgaccaagtgtgtggccctgctgctgcctgcctggaacagaaatgatgcctgccagattgctgctgctggccagcccggctag

SEQ ID NO: 37982 - DNA, 753 bp, Artificial Sequence
  Description of Artificial Sequence: Synthetic coding sequence
gctgacagccggggcagcctcatcagcacagacagcggcaacagcctgcctgagagaaattctgagaagagcaacagcctggacaagcaccagcagagcagcaccctgggcaacagcgtggtgcgctgtgacaagctggaccagagcgagatcaagagcctgctgatgtgcttcctgtacatcctgaagtccatgtctgatgatgccctcttcacctactggaacaaggccagcaccagcgagctgatggacttcttcaccatcagcgaggtgtgcctgcaccagttccagtacatgggcaagcgctacatcgcctctgtgaggaagatcagctctgtgctgggcatctctgtggacaatggctacggccacagtgatgctgatgtgctgcaccagagcctgctggaggccaacatcgccacagaggtgtgcctgacagccctggacaccctgagcctcttcaccctggccttcaagaaccagctgctggccgaccacggccacaaccccctgatgaagaaggtgtttgatgtgtacctgtgcttcctgcagaagcaccagagcgagacagccctgaagaatgtgttcaccgccctgcggagcctcatctacaagttccccagcaccttctatgagggccgggctgacatgtgtgccgccctgtgctatgagatcctgaagtgctgcaacagcaagctgagcagcatcagaacagaggccagccagctgctgtacttcctgatgagaaattag

SEQ ID NO: 37983 - DNA, 351 bp, Artificial Sequence
  Description of Artificial Sequence: Synthetic coding sequence
tgaagtgagctgatggacttcttcaccatcagcgaggtgtgcctgcaccagttccagtacatgggcaagcgctacatcgccaggaaccaggagggcctgggccccatcgtgcatgacaggaagagccagaccctgcctgtgtccaggaacagaacaggcatgatgcacgcccggctgcagcagctgggcagcctggacaacagcctgaccttcaaccacagctatggccacagtgatgctgatgtgctgcaccagagcctgctggaggccaacatcgccacagaggtgtgcctgacagccctggacaccctgagcctcttcaccctggccttcaagaaccagctgctgtag

SEQ ID NO: 37984 - DNA, 612 bp, Artificial Sequence
  Description of Artificial Sequence: Synthetic coding sequence
aggaagacctggctggacagcatggcccgcatccacgtgaagaatggagacctgtctgaggccgccatgtgctacgtgcacgtgacagccctggtggccgagtacctgaccaggaaaggagtcttccggcagggctgcacagccttccgggtcatcacccccaacattgatgaggaggcctccatgatggaggatgtgggcatgcaggatgtgcacttcaatgaagatgtgctgatggagctgctggagcagtgtgctgatggcctgtggaaggccgagagatatgagctgattgctgacatctacaagctgatcatccccatctatgagaagaggcgggactttgagcggctggcccacctgtatgacaccctgcaccgggcctacagcaaggtgacagaggtgatgcacagcggccggcggctgctgggcacctacttccgggtggccttcttcggccagggcttctttgaagatgaagatggcaaggagtacatctacaaggagcccaagctgacccccctgtctgagatcagccagaggctgctgaagctgtacagcgacaagtttggaagtgaaaatgtgaagatgatccaggacagcggcaagtag

SEQ ID NO: 37985 - DNA, 1122 bp, Artificial Sequence
  Description of Artificial Sequence: Synthetic coding sequence
atggccgagacccgggaggaggagaccgtgtctgctgaggccagcggcttcagtgacctgagtgacagcgagttcctggagttcctggacctggaggatgcccaggagagcaaggccctggtgaacatgcctggccccagcagcgagagcctgggcaaggatgacaagcccatcagcctgcagaactggaagaggggcctggacatcctgagccccatggagcgcttccacctgaagtacctgtatgtgacagacctggccacccagaactggtgtgagctgcagacagcctacggcaaggagctgcccggcttcctggcccctgagaaggctgctgtgctggacaccggggccagcatccacctggcccgggagctggagctgcatgacctggtgacagtgcctgtgaccaccaaggaggatgcctgggccatcaagttcctgaacatcctgctgctgatccccaccctgcagagcgagggccacatccgggagttccctgtgtttggagagggggagggcgtgctgctggtgggcgtgattgatgagctgcactacacagccaagggggagctggagctggccgagctgaagaccaggagaagacccatgctgcccctggaggcccagaagaagaaggactgcttccaggtgtccctgtacaagtacatctttgatgccatggtgcagggcaaggtgaccccagccagcctcatccaccacaccaagctgtgcctggagaagcccctgggccccagcgtgctgcggcatgcccagcagggcggcttctctgtgaagagcctgggggacctgatggagctggtgttcctgagcctgaccctgagtgacctgcctgtgattgacatcctgaagattgagtacatccaccaggagacagccaccgtgctgggcacagaaattgtggccttcaaggagaaggaggtgcgggccaaggtgcagcactacatggcctactggatgggccaccgggagccccagggcgtggatgtggaggaggcctggaagtgcaggacctgcacctatgctgacatctgtgagtggaggaagggcagcggcgtgctgagcagcaccctggccccccaggtgaagaaggccaagtag

SEQ ID NO: 37986 - DNA, 1122 bp, Artificial Sequence; identical to SEQ ID NO: 37985
  Description of Artificial Sequence: Synthetic coding sequence

SEQ ID NO: 37987 - DNA, 1122 bp, Artificial Sequence; identical to SEQ ID NO: 37985
  Description of Artificial Sequence: Synthetic coding sequence

SEQ ID NO: 37988 - DNA, 486 bp, Artificial Sequence
  Description of Artificial Sequence: Synthetic coding sequence
atggccgagacccgggaggaggagaccgtgtctgctgaggccagcggcttcagtgacctgagtgacagcgagttcctggagttcctggacctggaggatgcccaggagagcaaggccctggtgaacatgcctggccccagcagcgagagcctgggcaaggatgacaagcccatcagcctgcagaactggaagaggggcctggacatcctgagccccatggagcgcttccacctgaagtacctgtatgtgacagacctggccacccagaactggtgtgagctgcagacagcctacggcaaggagctgcccggcttcctggcccctgagaaggctgctgtgctggacaccggggccagcatccacctggcccgggagctggagctgcatgacctggtgacagtgcctgtgaccaccaaggaggatgcctgggccatcaagttcctgaacatcctgctgctgatccccaccctgcagagcgagggctag

SEQ ID NO: 37989 - DNA, 675 bp, Artificial Sequence
  Description of Artificial Sequence: Synthetic coding sequence
atggccgagacccgggaggaggagaccgtgtctgctgaggccagcggcttcagtgacctgagtgacagcgagttcctggagttcctggacctggaggatgcccaggagagcaaggccctggtgaacatgcctggccccagcagcgagagcctgggcaaggatgacaagcccatcagcctgcagaactggaagaggggcctggacatcctgagccccatggagcgcttccacctgaagtacctgtatgtgacagacctggccacccagaactggtgtgagctgcagacagcctacggcaaggagctgcccggcttcctggcccctgagaaggctgctgtgctggacaccggggccagcatccacctggcccgggagctggagctgcatgacctggtgacagtgcctgtgaccaccaaggaggatgcctgggccatcaagttcctgaacatcctgctgctgatccccaccctgcagagcgagggccacatccgggagttccctgtgtttggagagggggagggcgtgctgctggtgggcgtgattgatgagctgcactacacagccaagggggagctggagctggccgagctgaagaccaggagaagacccatgctgcccctggaggcccagaagaagaaggactgcttccaggtgtccctgtacaagtacatctag

SEQ ID NO: 37990 - DNA, 744 bp, Artificial Sequence
  Description of Artificial Sequence: Synthetic coding sequence
atggccgagacccgggaggaggagaccgtgtctgctgaggccagcggcttcagtgacctgagtgacagcgagttcctggagttcctggacctggaggatgcccaggagagcaaggccctggtgaacatgcctggccccagcagcgagagcctgggcaaggatgacaagcccatcagcctgcagaactggaagaggggcctggacatcctgagccccatggagcgcttccacctgaagtacctgtatgtgacagacctggccacccagaactggtgtgagctgcagacagcctacggcaaggagctgcccggcttcctggcccctgagaaggctgctgtgctggacaccggggccagcatccacctggcccgggagctggagctgcatgacctggtgacagtgcctgtgaccaccaaggaggatgcctgggccatcaagttcctgaacatcctgctgctgatccccaccctgcagagcgagggccacatccgggagttccctgtgtttggagagggggagggcgtgctgctggtgggcgtgattgatgagctgcactacacagccaagggggagctggagctggccgagctgaagaccaggagaagacccatgctgcccctggaggcccagaagaagaaggactgcttccaggtgtccctgtacaagtacatctttgatgccatggtgcagggcaaggtgaccccagccagcctcatccaccacaccaagctgtgcctggagtag

SEQ ID NO: 37991 - DNA, 681 bp, Artificial Sequence
  Description of Artificial Sequence: Synthetic coding sequence
atggccgagacccgggaggaggagaccgtgtctgctgaggccagcggcttcagtgacctgagtgacagcgagttcctggagttcctggacctggaggatgcccaggagagcaaggccctggtgaacatgcctggccccagcagcgagagcctgggcaaggatgacaagcccatcagcctgcagaactggaagaggggcctggacatcctgagccccatggagcgcttccacctgaagtacctgtatgtgacagacctggccacccagaactggtgtgagctgcagacagcctacggcaaggagctgcccggcttcctggcccctgagaaggctgctgtgctggacaccggggccagcatccacctggcccgggagctggagctgcatgacctggtgacagtgcctgtgaccaccaaggaggatgcctgggccatcaagttcctgaacatcctgctgctgatccccaccctgcagagcgagggccacatccgggagttccctgtgtttggagagggggagggcgtgctgctggtgggcgtgattgatgagctgcactacacagccaagggggagctggagctggccgagctgaagaccaggagaagacccatgctgcccctggaggcccagaagaagaaggactgcttccaggtgtccctgtacaagtacatctttgattag

SEQ ID NO: 37992 - DNA, 303 bp, Artificial Sequence
  Description of Artificial Sequence: Synthetic coding sequence
atggccgagacccgggaggaggagaccgtgtctgctgaggccagcggcttcagtgacctgagtgacagcgagttcctggagttcctggacctggaggatgcccaggagagcaaggccctggtgaacatgcctggccccagcagcgagagcctgggcaaggatgacaagcccatcagcctgcagaactggaagaggggcctggacatcctgagccccatggagcgcttccacctgaagtacctgtatgtgacagacctggccacccagaactggtgtgagctgcagacagcctacggcaagtag

SEQ ID NO: 37993 - DNA, 744 bp, Artificial Sequence; identical to SEQ ID NO: 37990
  Description of Artificial Sequence: Synthetic coding sequence

SEQ ID NO: 37994 - DNA, 129 bp, Artificial Sequence
  Description of Artificial Sequence: Synthetic coding sequence
tgccgcagccagaagagctgctggatcatcaagggccactgcaggaagaactgcaagccaggagagcaggtgaagaagccctgcaagaatggagactactgctgcatccccagcaacacagacagctag

SEQ ID NO: 37995 - DNA, 876 bp, Artificial Sequence
  Description of Artificial Sequence: Synthetic coding sequence
atggtgcgggagcagtacaccacagccacagagggcatctgcatcgagaggcctgagaaccagtatgtgtacaagattggcatctacggctggaggaagcgctgcctgtacctgtttgtgctgctgctgctgatcatcctggtggtgaacctggccctgaccatctggatcctgaaggtgatgtggttctccccagctggcatgggccacctgtgtgtgaccaaggatggcctgcggctggagggggagagcgagttcctgttccccctgtatgccaaggagatccacagccgggtggacagcagcctgctgctgcagagcacccagaatgtgacagtgaatgccaggaacagcgagggggaggtgacaggccgcctgaaggtgggccccaagatggtggaggtgcagaaccagcagttccagatcaacagcaatgatggcaagcccctcttcaccgtggatgagaaggaggtggtggtgggcacagacaagctgcgggtgacaggccctgagggcgccctgtttgagcacagcgtggagacccccctggtgcgggctgaccccttccaggacctgcggctggagagccccaccaggagcctgtccatggatgccccccggggcgtgcacatccaggcccatgctgggaagattgaggccctgagccagatggacatcctcttccacagcagtgatggcatgctggtgctggatgctgagaccgtgtgcctgcccaagctggtgcagggcacctggggccccagcggcagcagccagagcctgtatgagatctgtgtgtgcccagatggcaagctgtacctgtctgtggccggcgtgtccaccacctgccaggagcacaaccacatctgcctgtag

SEQ ID NO: 37996 - DNA, 816 bp, Artificial Sequence
  Description of Artificial Sequence: Synthetic coding sequence
atgaacctgcacgtgaagaccctgagcctgatgacctggaggagccgcttcctggaggagagcttctggagcctggaggagacagctgccctggccaagcagctgcccctgaagagccccagcgagaacatcttcctgcacatcgtggacctgagtgaccccaagcagatctggaagtttgtggagaacttcaagcaggagcacaagctgcacgtgctgatcaacaatgccggctgcatggtgaacaagcgggagctgacagaagatggcctggagaagaactttgctgccaacaccctgggcgtgtacatcctgaccaccggcctcatccctgtgctggagaaggagcatgaccccagggtcatcaccgtgagcagcggcggcatgctggtgcagaagctgaacaccaatgacctgcagagcgagaggaccccatttgatggcaccatggtgtatgcccagaacaagaggcagcaggtggtgctgacagagcgctgggcccagggccacccagccatccacttcagctccatgcaccctggctgggccgacaccccagacagaaatgagcaggagctgaggaaggtggtgggggaggcccagacagccagccccctgccccgcttcctggagatcatgatgcatgagggcaagtgccagccccagggccacagcagcaatgacctggaggcctgctggagcagcggcggcggggagcagaacagcctgcctgactggccccaccagctgcatgacctgcggcagctgacctgggccctgtgcagcagcttcctgctgtacaagcagggcaactag

SEQ ID NO: 37997 - DNA, 954 bp, Artificial Sequence
  Description of Artificial Sequence: Synthetic coding sequence
atgagcctgtacagatctgtggtgtggtttgccaagggcctgcgggagtacaccaagagcggctatgagagcgcctgcaaggactttgtgccccatgacctggaggtgcagatccctggccgggtcttcctggtgactggaggcaacagcggcatcggcaaggccacagccctggagatcgccaagaggggcggcaccgtgcacctggtgtgccgggaccaggccccagcagaagatgcccggggggagatcatccgggagagcggcaaccagaacatcttcctgcacatcgtggacctgagtgaccccaagcagatctggaagtttgtggagaacttcaagcaggagcacaagctgcacgtgctgatcaacaatgccggctgcatggtgaacaagcgggagctgacagaagatggcctggagaagaactttgctgccaacaccctgggcgtgtacatcctgaccaccggcctcatccctgtgctggagaaggagcatgaccccagggtcatcaccgtgtcctctgggggcatgctggtgcagaagctgaacaccaatgacctgcagagcgagaggaccccatttgatggcaccatggtgtatgcccagaacaagaggcagcaggtggtgctgacagagcgctgggcccagggccacccagccatccacttcagctccatgcaccctggctgggccgacaccccaggagtgcggcaggccatgcctggcttccacgccaggtttggagaccggctgcggtctgaggcccagggcgctgacaccatgctgtggctggccctgagcagcgctgctgctgcccagcccagcggccgcttcttccaggacaggaagcctgtgtccacccacctgcccctggccacagccagcagcagccctgctgaggaggagaagctgattgagatcctggagcagctggcccagaccttcaagtag

SEQ ID NO: 37998 - DNA, 699 bp, Artificial Sequence
  Description of Artificial Sequence: Synthetic coding sequence
atgcagatggcccggctgctgggcctgtgtgcctgggccaggaagtctgtgaggatggccagcagcaggatgacccggcgggaccccctgaccaacaaggtggccctggtgacagccagcacagatggcatcggctttgccatcgcccggcggctggcccaggaccgggcccacgtggtggtgagcagcaggaagcagcagaatgtggaccaggccgtggccaccctgcagggcgagggcctgtctgtgacaggcaccgtgtgccacgtgggcaaggccgaggaccgggagcggctggtggccatggctgtgaagctgcatggaggcatcgacatcctggtgtccaatgctgctgtgaaccccttcttcggcagcctgatggatgtgacagaggaggtgtgggacaagaccctggacatcaacgtgaaggccccagccctgatgaccaaggctgtggtgcctgagatggagaagaggggcggcggctctgtggtgattgtgagcagcattgctgccttcagccccagccctggcttcagcccctacaacgtgtccaagacagccctgctgggcctgaacaacaccctggccatcgagctggcccccaggaacatccgggtgaactgcctgcacctggacctgagccggctggccagcgctggctgcagcggctggaccaggaagaagaggaaggcctag

SEQ ID NO: 37999 - DNA, 648 bp, Artificial Sequence
  Description of Artificial Sequence: Synthetic coding sequence
atgcccttcccctgcctgagcctgcccagctcctgggactaccgcatcggctttgccatcgcccggcggctggcccaggaccgggcccacgtggtggtgagcagcaggaagcagcagaatgtggaccaggccgtggccaccctgcagggcgagggcctgtctgtgacaggcaccgtgtgccacgtgggcaaggccgaggaccgggagcggctggtggccatgaccctggacatcaacgtgaaggccccagccctgatgaccaaggctgtggtgcctgagatggagaagaggggcggcggctctgtggtgattgtgagcagcattgctgccttcagccccagccctggcttcagcccctacaacgtgtccaagacagccctgctgggcctgaacaacaccctggccatcgagctggcccccaggaacatccgggtgaactgcctgcccggcctcatcaagaccagcttcagcaggatgctgtggatggacaaggagaaggaggagagcatgaaggagaccctgcgcatccggcggctgggggagcctgaggactgtgccggcatcgtgtccttcctgtgcagtgaagatgccagctacatcactggagagaccgtggtggtgggcggcggcacccccagccggctgtag

SEQ ID NO: 38000 - DNA, 774 bp, Artificial Sequence
  Description of Artificial Sequence: Synthetic coding sequence
atggcccggctgctgggcctgtgtgcctgggccaggaagtctgtgaggatggccagcagcaggatgacccggcgggaccccctgaccaacaaggtggccctggtgacagccagcacagatggcatcggctttgccatcgcccggcggctggcccaggaccgggcccacgtggtggtgagcagcaggaagcagcagaatgtggaccaggccgtggccaccctgcagggcgagggcctgtctgtgacaggcaccgtgtgccacgtgggcaaggccgaggaccgggagcggctggtggccatggctgtgaagctgcatggaggcatcgacatcctggtgtccaatgctgctgtgaaccccttcttcggcagcctgatggatgtgacagaggaggtgtgggacaagaccctggacatcaacgtgaaggccccagccctgatgaccaaggctgtggtgcctgagatggagaagaggggcggcggctctgtggtgattgtgagcagcattgctgccttcagccccagccctggcttcagcccctacaacgtgtccaagacagccctgctgggcctgaacaacaccctggccatcgagctggcccccaggaacatccgggtgaactgcctgcacctggacctgagccggctggccagcgctggctggctgggggagcctgaggactgtgccggcatcgtgtccttcctgtgcagtgaagatgccagctacatcactggagagaccgtggtggtgggcggcggcacccccagccggctgtag

SEQ ID NO: 38001 - DNA, 276 bp, Artificial Sequence
  Description of Artificial Sequence: Synthetic coding sequence
atggctgtgaagctgcacggcggcatcgacatcctggtgtccaatgctgctgtgaaccccttcttcggcagcctgatggatgtgacagaggaggtgtgggacaagctgtggatggacaaggagaaggaggagagcatgaaggagaccctgcgcatccggcggctgggggagcctgaggactgtgccggcatcgtgtccttcctgtgcagtgaagatgccagctacatcactggagagaccgtggtggtgggcggcggcacccccagccggctgtag

SEQ ID NO: 38002 - DNA, 174 bp, Artificial Sequence
  Description of Artificial Sequence: Synthetic coding sequence
atgctgtggatggacaaggagaaggaggagagcatgaaggagaccctgcgcatccggcggctgggggagcctgaggactgtgccggcatcgtgtccttcctgtgcagtgaagatgccagctacatcactggagagaccgtggtggtgggcggcggcacccccagccggctgtag

SEQ ID NO: 38003 - DNA, 468 bp, Artificial Sequence
  Description of Artificial Sequence: Synthetic coding sequence
atgcagatggcccggctgctgggcctgtgtgcctgggccaggaagtctgtgaggatggccagcagcaggatgacccggcgggaccccctgaccaacaaggtggccctggtgacagccagcacagatggcatcggctttgccatcgcccggcggctggcccaggaccgggcccacgtggtggtgagcagcaggaagcagcagaatgtggaccaggccgtggccaccctgcagggcgagggcctgtctgtgacaggcaccgtgtgccacgtgggcaaggccgaggaccgggagcggctggtggccatggctgtgaagctgcatggaggcatcgacatcctggtgtccaatgctgctgtgaaccccttcttcggcagcctgatggatgtgacagaggaggtgtgggacaagctgtggatggacaaggagaaggaggagagcatgaaggagaccctgcgcatcagaagatag

SEQ ID NO: 38004 - DNA, 993 bp, Artificial Sequence
  Description of Artificial Sequence: Synthetic coding sequence
atgagccccctgtctgctgcccgggccgccctgcgggtgtatgctgtgggcgctgctgtgatcctggcccagctgctgcggcgctgccggggcggcttcctggagcccgtcttcccccccaggccagacagagtggccatcgtgactggaggaacagatggcatcggctacagcacagccaagcacctggcccggctgggcatgcacgtgatcatcgccggcaacaatgacagcaaggccaagcaggtggtgtccaagatcaaggaggagaccctgaatgacaaggtggagttcctgtactgtgacctggcctccatgaccagcatccggcagtttgtgcagaagttcaagatgaagaagatccccctgcacgtgctgatcaacaatgctggggtgatgatggtgccccagaggaagaccagagatggctttgaggagcacttcggcctgaactacctgggccacttcctgctgaccaacctgctgctggacaccctgaaggagagcggcagccctggccacagcgcccgggtggtgacagtgtcctctgccacccactacgtggccgagctgaacatggatgacctgcagagcagcgcctgctacagcccccacgccgcctatgcccagagcaagctggccctggtgctcttcacctaccacctgcagaggctgctggccgctgagggcagccacgtgacagccaacgtggtggaccccggggtggtgaacacagatgtgtacaagcacgtgttctgggccacccggctggccaagaagctgctgggctggctgctcttcaagaccccagatgaaggagcctggaccagcatctatgctgctgtgaccccagagctggagggcgtgggcggccactacctgtacaatgagaaggagaccaagagcctgcacgtgacctacaaccagaagctgcagcagcagctgtggagcaagagctgtgagatgactggagtgctggatgtgaccctgtag

SEQ ID NO: 38005 - DNA, 168 bp, Artificial Sequence
  Description of Artificial Sequence: Synthetic coding sequence
atgaagatgagctttgagcgctgcacagccaggaacaagatgtttgtgaacagcgccttcaccaaggtggacaactactgcaccttcctgatggagaaggtgctcttcaaggtgctcttcctggtggagtactaccagaagggcaagaagaatgacctgaacttctag

SEQ ID NO: 38006 - DNA, 168 bp, Artificial Sequence; identical to SEQ ID NO: 38005
  Description of Artificial Sequence: Synthetic coding sequence

SEQ ID NO: 38007 - DNA, 483 bp, Artificial Sequence
  Description of Artificial Sequence: Synthetic coding sequence
atggccagccctgcccccctggtggccagcatcagccaccagatggtggccctgcagaccctgcagctgctgcagcaggagtggggctggggagatggccctgtggcccctggcaacccccgggaccctgaccacgtgtccacagccccagcccggcgcagcggccccccccgggcccggcccggccctggccgggaggagcggggcggcggcgtgggcaccaggagcagaagaacagctgcccgggccaacagccctgaggaggaggtggtgagaggagctgagggcggcgctgagctgctgcccttcccccgggaccggggcccctgcaccctggcccagatggccatgaggtctgccctggcccgggtggtggacagcaccagcgagctggtgtctgtggagcagaccctgctgggccccctgcagcaggagaggagcttccccatccacctgaagctgcagctgctggccaatgaatag

SEQ ID NO: 38008 - DNA, 525 bp, Artificial Sequence
  Description of Artificial Sequence: Synthetic coding sequence
atggccagccctgcccccctggtggccagcatcagccaccagatggtggccctgcagaccctgcagctgctgcagcaggagtggggctggggagatgctgcccgggccaacagccctgaggaggaggtggtgagaggagctgagggcggcgctgagctgctgcccttcccccgggaccggggcccctgcaccctggcccagatggccatgaggtctgccctggcccgggtggtggacagcaccagcgagctggtgtctgtggagcagaccctgctgggccccctgcagcaggagaggagcttccccatccacctgaaggacagcgtggagttcaggaacatctgcagccacctggccctgcagatcgagggccagcagtttgaccgggacctgaatgctgcccaccagtgcctgaagaccatcgtgaagaagctgatccagagcctggccaacttccccagtgatgcccacatggtggcctgtgccagcctgcggcagatcctgcagaacctgcctgacatctag

SEQ ID NO: 38009 - DNA, 666 bp, Artificial Sequence
  Description of Artificial Sequence: Synthetic coding sequence
atggccagccctgcccccctggtggccagcatcagccaccagatggtggccctgcagaccctgcagctgctgcagcaggagtggggctggggagatggccctgtggcccctggcaacccccgggaccctgaccacgtgtccacagccccagcccggcgcagcggccccccccgggcccggcccggccctggccgggaggagcggggcggcggcgtgggcaccaggagcagaagaacagctgcccgggccaacagccctgaggaggaggtggtgagaggagctgagggcggcgctgagctgctgcccttcccccgggaccggggcccctgcaccctggcccagatggccatgaggtctgccctggcccgggtggtggacagcaccagcgagctggtgtctgtggagcagaccctgctgggccccctgcagcaggagaggagcttccccatccacctgaaggacagcgtggagttcaggaacatctgcagccacctggccctgcagatcgagggccagcagtttgaccgggacctgaatgctgcccaccagtgcctgaagaccatcgtgaagaagctgatccagagcctggccaacttccccagtgatgcccacatggtggcctgtgccagcctgcggcagatcctgcagaacctgcctgacatctag

SEQ ID NO: 38010 - DNA, 513 bp, Artificial Sequence
  Description of Artificial Sequence: Synthetic coding sequence
atggctgtgacaggctggctggagagcctgaggacagcccagaagacagccctgctgcaggatggaagaaggaaggtgcactacctgttcccagatggcaaggagatggccgaggagtatgatgagaagaccagcgagctgctggtgaggaagtggagggtgaagagcgccctgggcgccatgggccagtggcagctggaggtgggggaccctgcccccctgggcgccggcaacctgggccctgagctgatcaaggagagcaatgccaaccccatcttcatgaggaaggacaccaagatgtccttccagtggaggatccggaacctgccctaccccaaggatgtgtacagcgtgtctgtggaccagaaggagcgctgcatcatcgtgaggaccaccaacaagaagaggacaggctggaggctgctgtggacccccctggccatgagatgtgccggcgtgcacggcacccccagcgagattgacaccagctacctgtggatgaccccctgctag

SEQ ID NO: 38011 - DNA, 513 bp, Artificial Sequence; identical to SEQ ID NO: 38010
  Description of Artificial Sequence: Synthetic coding sequence

SEQ ID NO: 38012 - DNA, 354 bp, Artificial Sequence
  Description of Artificial Sequence: Synthetic coding sequence
atggccgaggagtatgatgagaagaccagcgagctgctggtgaggaagtggagggtgaagagcgccctgggcgccatgggccagtggcagctggaggtgggggaccctgcccccctgggcgccggcaacctgggccctgagctgatcaaggagagcaatgccaaccccatcttcatgaggaaggacaccaagatgtccttccagtggaggatccggaacctgccctaccccaaggatgtgtacagcgtgtctgtggaccagaaggagcgctgcatcatcgtgaggaccaccaacaagaacaccaggagccagaggcggctgtggtggcccagcctgagctacagaagaaattag

SEQ ID NO: 38013 - DNA, 612 bp, Artificial Sequence
  Description of Artificial Sequence: Synthetic coding sequence
atggctgtgacaggctggctggagagcctgaggacagcccagaagacagccctgctgcaggatggaagaaggaaggtgcactacctgttcccagatggcaaggagatggccgaggagtatgatgagaagaccagcgagctgctggtgaggaagtggagggtgaagagcgccctgggcgccatgggccagtggcagctggaggtgggggaccctgcccccctgggcgccggcaacctgggccctgagctgatcaaggagagcaatgccaaccccatcttcatgaggaaggacaccaagatgtccttccagtggaggatccggaacctgccctaccccaaggatgtgtacagcgtgtctgtggaccagaaggagcgctgcatcatcgtgaggaccaccaacaagaagtactacaagaagttcagcatcccagacctggacagacaccagctgcccctggatgatgccctgctgagctttgcccacgccaactgcaccctcatcatctcctaccagaagcccaaggaggtggtggtggccgagagcgagctgcagaaggagctgaagaaggtgaagacagcccacagcaatgatggagactgcaagacccagtag

SEQ ID NO: 38014 - DNA, 741 bp, Artificial Sequence
  Description of Artificial Sequence: Synthetic coding sequence
atggagacccggcggggcagaagaaggacctttggaggagagtgggagaggcctgcccctgtgctggtgtctgccagccgccacggcggggcccagaggaggagctgtggggagatgggccacggccgcagccgctgtggggagcccagcggaaatggaggagtgtcccagctgcgggtgaagagccgggccggggctgtgtacagcccctgcacccagctggcccaggcccgggagagccagctgggcgcccggaggaagctggagtgccccaccccagccccccgggtgagccccaccccccgggtgggcccccgggtgggcagcaccaccggccaggccagccaccctggggtgggcaggaaccggcccctgaccagccgggccaatgaaagtggccggcggggggagggcggccagatggcccgcatcgccagcgagagcgctggcagtgaccccctggagcggctgccctggcagaggctgggcgtgctgctgagccggggcaagatggctgtgacaggctggctggagagcctgaggacagcccagaagacagccctgctgcaggacggcaacagccgggtgcccaccggcagctttgtgttcttcccccagggccctgccctgcgggagggcccccagggcctgggccggcagagctggaagggcctgggcggccagcccggccaggtgctgcacctgcagatgaggcggctgcgcttcacagagatgacctag

SEQ ID NO: 38015 - DNA, 351 bp, Artificial Sequence
  Description of Artificial Sequence: Synthetic coding sequence
gctgaggagtatgatgagaagaccagcgagctgctggtgaggaagtggagggtgaagagcgccctgggcgccatgggccagtggcagctggaggtgggggaccctgcccccctgggcgccggcaacctgggccctgagctgatcaaggagagcaatgccaaccccatcttcatgaggaaggacaccaagatgtccttccagtggaggatccggaacctgccctaccccaaggatgtgtacagcgtgtctgtggaccagaaggagcgctgcatcatcgtgaggaccaccaacaagaacaccaggagccagaggcggctgtggtggcccagcctgagctacagaagaaattag

SEQ ID NO: 38016 - DNA, 3030 bp, Artificial Sequence
  Description of Artificial Sequence: Synthetic coding sequence
atggacatgttcagcctggacatgatcatcagtgaccctgctgctgaggccagccgggccggcaagaagcagctgcggggcgtgcagaacccctgccccagcgcccgggcccggcccaggcacaagagcctgaacatcaaggacaagatcagcgagtgggagggcaagaaggaggtgcccaccccagcccccagccggcgggcagatggccaggaggactacctgcccagcagcacagtggagcggcgcagcagtgatggagtgaggacccaggtgacagaggccaagaatggcatgaggcctggaacagagagcacagagaaggagaggaacaagggagctgtgaatgtgggcggccaggaccctgagcccggccaggacctgagccagcctgagcgggaggtggaccccagctggggccggggccgggagccccggctgggcaagctgcgcttccagaatgaccccctgtctgtgctgaagcaggtgaagaagctggagcaggccctgaaggatggcagcgctggcctggacccccagctgcccggcacctgctacagcccccactgccccccagacaaggccgaggccggcagcaccctgcctgagaacctgggcggcggcagcggcagcgaggtgtcccagagggtgcaccccagcgacctggagggccgggagcccaccccagagctggtggaggacaggaagggcagctgccggcggccctgggacaggagcctggagaatgtgtaccggggcagcgagggcagccccaccaagcccttcatcaaccccctgcccaagcccaggaggaccttcaagcacgccggggagggggacaaggatggcaagccaggcatcggcttcaggaaggagaagaggaacctgccccccctgcccagcctgcccccaccacccctgcccagcagccccccacccagctctgtgaacagaaggctgtggacaggccggcagaagagcagcgctgaccacaggaagagctatgaatttgaggacctgctgcagagcagcagcgagagcagccgggtggactggtacgcccagaccaagctgggcctgaccaggaccctgtctgaagaaaatgtgtatgaggacatcctggacccccccatgaaggagaacccctatgaggacatcgagctgcacggccgctgcctgggcaagaagtgtgtgctgaacttccctgccagccccaccagcagcatcccagacaccctgaccaagcagagcctgagcaagccagccttcttccggcagaacagcgagaggaggaacttcaagctgctggacaccaggaagctgagcagagatggcaccggcagccccagcaagatcagcccccccagcacccccagcagcccagatgacatcttcttcaacctgggggacccccagaatggaaggaagaagaggaagatccccaagctggtgctgcgcatcaatgccatctatgaggtgcggcggggcaagaagagggtgaagaggctgagccagagcatggagagcaacagcggcaaggtgacagatgaaaattctgagagtgacagcgacacagaggagaagctgaaggcccacagccagaggctggtgaatgtgaagagccggctgaagcaggccccccgctaccccagcctggcccgggagctgattgagtaccaggagcggcagctgtttgagtactttgtggtggtgtccctgcacaagaagcaggccggggccgcctacgtgcctgagctgacccagcagttccccctgaagctggagaggagcttcaagttcatgagggaggccgaggaccagctgaaggccatcccccagttctgcttcccagatgccaaggactgggtgcctgtgcagcagttcaccagcgagaccttctcctttgtgctgaccggggaggatggcagccgccgcttcggctactgccggcggctgctgcccggcggcaagggcaagaggctgcctgaggtgtactgcatcgtgtcccggctgggctgcttcagcctcttcagccgcatcctggatgaggtggagaagagaagaggcatcagccctgccctggtgcagcccctgatgaggtctgtgatggaggcccccttccctgccctgggcaagaccatcctggtgaagaacttcctgcccggcagcggcacagaggtgattgagctgtgccggcccctggacagccggctggagcacgtggactttgagagcctcttcagcagcctgtctgtgcgccacctggtgtgtgtgtttgccagcctgctgctggagcggcgggtcatcttcatcgctgacaagctgagcatcctgagcaagtgctgccacgccatggtggccctgatctacccctttgcctggcagcacacctacatccctgtgctgcccccagccatggtggacatcgtgtgcagccccacccccttcctgattggcctgctgagcagcagcctgcccctgctgcgggagctgcccctggaggaggtgctggtggtggacctggtgaacagccgcttcctgcggcagatggatgatgaagattccatcctgcccaggaagctgcaggtggccctggagcacatcctggagcagagaaatgagctggcctgtgagcaggatgagggccccctggatggccgccacggccctgagagcagccccctgaatgaggtggtgtctgaggcctttgtgcgcttctttgtggagatcgtgggccactacagcctcttcctgaccagcggggagcgggaggagaggaccctgcagcgggaggccttcaggaaggctgtgagcagcaagagcctgcggcacttcctggaggtgttcatggagacccagatgttccggggcttcatccaggagcgggagctgcggcggcaggatgccaagggcctgtttgaggtgcgggcccaggagtacctggagaccctgcccagcggggagcacagcggcgtgaacaagttcctgaagggcctgggcaacaagatgaagttcctgcacaagaagtag

SEQ ID NO: 38017 - DNA, 240 bp, Artificial Sequence
  Description of Artificial Sequence: Synthetic coding sequence
atggacatgttcagcctggacatgatcatcagtgaccctgctgctgaggccagccgggccggcaagaagcagctgcggggcgtgcagaacccctgccccagcgcccgggcccggcccaggcacaagagcctgaacatcaaggacaagatcagcgagtgggagggcaagaaggaggtgcccaccccagcccccagccggcgggcagatggccaggaggactacctgcccagcagcacctag

SEQ ID NO: 38018 - DNA, 273 bp, Artificial Sequence
  Description of Artificial Sequence: Synthetic coding sequence
atggacatgttcagcctggacatgatcatcagtgaccctgctgctgaggccagccgggccggcaagaagcagctgcggggcgtgcagaacccctgccccagcgcccgggcccggcccaggcacaagagcctgaacatcaaggacaagatcagcgagtgggagggcaagaaggaggtgcccaccccagcccccagccggcgggcagatggccaggaggactacctgcccagcagcacagtggagcggcgcagcagtgatggagtgaggacatag

SEQ ID NO: 38019 - DNA, 477 bp, Artificial Sequence
  Description of Artificial Sequence: Synthetic coding sequence
atggacatgttcagcctggacatgatcatcagtgaccctgctgctgaggccagccgggccggcaagaagcagctgcggggcgtgcagaacccctgccccagcgcccgggcccggcccaggcacaagagcctgaacatcaaggacaagatcagcgagtgggagggcaagaaggaggtgcccaccccagcccccagccggcgggcagatggccaggaggactacctgcccagcagcacagtggagcggcgcagcagtgatggagtgaggacccaggtgacagaggccaagaatggcatgaggcctggaacagagagcacagagaaggagaggaacaagggagctgtgaatgtgggcggccaggaccctgagcccggccaggacctgagccagcctgagcgggaggtggaccccagctggggccggggccgggagccccggctgggcaagctgcgcttccagaatgaccccctgtcctag

SEQ ID NO: 38020 - DNA, 2388 bp, Artificial Sequence
  Description of Artificial Sequence: Synthetic coding sequence
atggacatgttcagcctggacatgatcatcagtgaccctgctgctgaggccagccgggccggcaagaagcagctgcggggcgtgcagaacccctgccccagcgcccgggcccggcccaggcacaagagcctgaacatcaaggacaagatcagcgagtgggagggcaagaaggaggtgcccaccccagcccccagccggcgggcagatggccaggaggactacctgcccagcagcacagtggagcggcgcagcagtgatggagtgaggacccaggtgacagaggccaagaatggcatgaggcctggaacagagagcacagagaaggagaggaacaagggagctgtgaatgtgggcggccaggaccctgagcccggccaggacctgagccagcctgagcgggaggtggaccccagctggggccggggccgggagccccggctgggcaagctgcgcttccagaatgaccccctgtctgtgctgaagcaggtgaagaagctggagcaggccctgaaggatggcagcgctggcctggacccccagctgcccggcacctgctacagcccccactgccccccagacaaggccgaggccggcagcaccctgcctgagaacctgggcggcggcagcggcagcgaggtgtcccagagggtgcaccccagcgacctggagggccgggagcccaccccagagctggtggaggacaggaagggcagctgccggcggccctgggacaggagcctggagaatgtgtaccggggcagcgagggcagccccaccaagcccttcatcaaccccctgcccaagcccaggaggaccttcaagcacgccggggagggggacaaggatggcaagccaggcatcggcttcaggaaggagaagaggaacctgccccccctgcccagcctgcccccaccacccctgcccagcagccccccacccagctctgtgaacagaaggctgtggacaggccggcagaagagcagcgctgaccacaggaagagctatgaatttgaggacctgctgcagagcagcagcgagagcagccgggtggactggtacgcccagaccaagctgggcctgaccaggaccctgtctgaagaaaatgtgtatgaggacatcctggacccccccatgaaggagaacccctatgaggacatcgagctgcacggccgctgcctgggcaagaagtgtgtgctgaacttccctgccagccccaccagcagcatcccagacaccctgaccaagcagagcctgagcaagccagccttcttccggcagaacagcgagaggaggaacttcaagctgctggacaccaggaagctgagcagagatggcaccggcagccccagcaagatcagcccccccagcacccccagcagcccagatgacatcttcttcaacctgggggacccccagaatggaaggaagaagaggaagatccccaagctggtgctgcgcatcaatgccatctatgaggtgcggcggggcaagaagagggtgaagaggctgagccagagcatggagagcaacagcggcaaggtgacagatgaaaattctgagagtgacagcgacacagaggagaagctgaaggcccacagccagaggctggtgaatgtgaagagccggctgaagcaggccccccgctaccccagcctggcccgggagctgattgagtaccaggagcggcagctgtttgagtactttgtggtggtgtccctgcacaagaagcaggccggggccgcctacgtgcctgagctgacccagcagttccccctgaagctggagaggagcttcaagttcatgagggaggccgaggaccagctgaaggccatcccccagttctgcttcccagatgccaaggactgggtgcctgtgcagcagttcaccagcgagaccttctcctttgtgctgaccggggaggatggcagccgccgcttcggctactgccggcggctgctgcccggcggcaagggcaagaggctgcctgaggtgtactgcatcgtgtcccggctgggctgcttcagcctcttcagccgcatcctggatgaggtggagaagagaagaggcatcagccctgccctggtgcagcccctgatgaggtctgtgatggaggcccccttccctgccctgggcaagaccatcctggtgaagaacttcctgcccggcagcggcacagaggtgattgagctgtgccggcccctggacagccggctggagcacgtggactttgagagcctcttcagcagcctgtctgtgcgccacctggtgtgtgtgtttgccagcctgctgctggagcggcgggtcatcttcatcgctgacaagctgcgctacccaccctggctgctgctgctgaagaggctgaatgacagccgctcctggaccctgtag

SEQ ID NO: 38021 - DNA, 3030 bp, Artificial Sequence; identical to SEQ ID NO: 38016
  Description of Artificial Sequence: Synthetic coding sequence

SEQ ID NO: 38022 - DNA, 3030 bp, Artificial Sequence; identical to SEQ ID NO: 38016
  Description of Artificial Sequence: Synthetic coding sequence

SEQ ID NO: 38023 - DNA, 2787 bp, Artificial Sequence
  Description of Artificial Sequence: Synthetic coding sequence
atggatgtgggcttcagcaggaccaccgtgcagaccctgagccgcagccactgcaagaacatcaagcagaagatcagccagtgggagggccgggccaacggcatcagcaaccctgagaagtggtgccccaaggactttggagtgcgctacaactgccaccaggagatccggctgaagaagaaccccatcgccgagaggaagagcaagaacctggatgtgaccagcagagaaaatgtgggcctggacatcaatgaaaacaccaagagccatgaccagagtgaaaatgaaaacaagaagcatgaatatgatgacacccacttcttcaagaatgaaagtgagagcaactgggtgtgcagccgggtgaaggagattgagagctgcaaggaggatgtgctggaccctgagaccagcctgcccccaggcaacttctacaccagccagatcctgtggaagaagattgaggccctgcccccagacaagctgctgaacctggccctggagcactgtgacagcagcgagaaggagctgaacttccgggtgctggacagcagctatggcatcaccaagagcctggagaacatctacagcgagcctgagggccaggagtgtggccccagcatcaaccccctgcccaagcccaggaggaccttccgctacctgtctgagagcggcgtgaccccctacaaggagaggaactgtgacaagaagtactgtgagaacaacagctgtgcccagagcagcctggccagcagccaggagcctgagcccaagaagtatggaggcaagatccggggccgcagcaagaggaagagctttgaatttgaggacatccagcacttcaggaacagaaacagccagaccatccgggaggagctgggcaggaacagcggcagcgccctgtactacacccagagcgaggacaacatctatgaggacatcatctaccccaccaaggagaacccctatgaggacatccctgtgcagcccctgcccatgtggaggagccccagcgcctggaagctgcccccagccaagagcgccttcaaggcccccaagctgccccccaagccccagttcctgcacaggaagaccatggaggtgaagaacagccaggcctacctgcggagcaagctgaccaaggacaccaccctgcctgtgaccctgacagagtggaagctgttccgggccggggaggtggccaacaccaagaggaagaacctgccccggctggtgctgaagattgatgacatctttgagagcaagaggggcaagaagaaggtgaagctgcacagctacacaggcaaggagctgccccccaccaagggggagaccagcggaaatgaaagtgatgctgagtacctgcccaagaacagacacaagaggctggcccagctgcagcccagcagcaagaggaacccccactaccagaccctggagcgggacctgattgagctgcaggagcagcagctgtttgagctgtttgtggtggtgtccctgcagaagaagcccagcggcatctcctacatcccccaggtgatccagcagtttcctgggaaggatgaccacggctacaagcagagcaaggacatggaggagcggctgaaggtgatccccaagttctgcttcccagacagcaaggactggatgcccaccagcgagctgaagtctgagaccttctcctttgtgctgaccggggaggatggcagccgctggtttggctactgcaagaagctgctgcctgtgggcaagggcaagaggctgcctgaggtgtactgcatggtgtcccggctgggctgcttcaacctcttcagcaagatcctggatgaggtggagaagagaagagagatgagccctgccctggtgtaccccttcatgaggtctgtgatggaggcccccttccctgcccctggccgcaccatcaccgtgaagagctacctgcctggagctggagatgagagcattgagctgtgccggcccctggacagccggctggagcacgtggacttcaagtgcctcttcaagtgcctgtctgtgtgccacctgatccgggtgtgtgccagcctgctgctggagcggcgggtcatctttgtggccaacagcctgagcaccctgagcaaatgtggccatgctgtggtggccaccctgtaccccttcacctggcagcacacctacatccctgtgctgcctgcctccatgattgatattgtgtgcagccccacccccttcctgattggcatcctgagctgcagcctgccccagctgcaggacctgcccatcgaggaggtgctgattgtggacctgtgtgccgacaagttcctgcaggaggtgtctgatgaagatgagatcctgccccccaagctgcaggccgccctgatgcagatcctggaggagagaaatgagatcctgacccaggagcagaacttcagccaggatgtgaccctgaacagcctggtgtctgaggcctttgtgcgcttctttgtggagctggtgggccactacagcctgaacatgacagtgacagagcggggggagagggtcttccagcgggagcccttcaggaagagccacaccagccgctctgtgcgccacttcctggacctcttcatggagacccagatgtttgctggcttcatccaggaccgggagctgaggaagagcggcgtgaagggcctgtttgagatccgggccatccagtacctggagaccatccctgagagcgagcccagcggcatgaaccgcatcctgcggagcctgggcagcaagatgaagttcctgcagaagaagtag

SEQ ID NO: 38024 - DNA, 2787 bp, Artificial Sequence; identical to SEQ ID NO: 38023
  Description of Artificial Sequence: Synthetic coding sequence

SEQ ID NO: 38025 - DNA, 2616 bp, Artificial Sequence
  Description of Artificial Sequence: Synthetic coding sequence
atggatgtgggcttcagcaggaccaccgtgcagaccctgagccgcagccactgcaagaacatcaagcagaagatcagccagtgggagggccgggccaacggcatcagcaaccctgagaagtggtgccccaaggactttggagtgcgctacaactgccaccaggagatccggctgaagaagaaccccatcgccgagaggaagagcaagaacctggatgtgaccagcagagaaaatgtgggcctggacatcaatgaaaacaccaagagccatgaccagagtgaaaatgaaaacaagaagcatgaatatgatgacacccacttcttcaagaatgaaagtgagagcaactgggtgtgcagccgggtgaaggagattgagagctgcaaggaggatgtgctggaccctgagaccagcctgcccccaggcaacttctacaccagccagatcctgtggaagaagattgaggccctgcccccagacaagctgctgaacctggccctggagcactgtgacagcagcgagaaggagctgaacttccgggtgctggacagcagctatggcatcaccaagagcctggagaacatctacagcgagcctgagggccaggagtgtggccccagcatcaaccccctgcccaagcccaggaggaccttccgctacctgtctgagagcggcgtgaccccctacaaggagaggaactgtgacaagaagtactgtgagaacaacagctgtgcccagagcagcctggccagcagccaggagcctgagcccaagaagtatggaggcaagatccggggccgcagcaagaggaagagctttgaatttgaggacatccagcacttcaggaacagaaacagccagaccatccgggaggagctgggcaggaacagcggcagcgccctgtactacacccagagcgaggacaacatctatgaggacatcatctaccccaccaaggagaacccctatgaggacatccctgtgcagcccctgcccatgtggaggagccccagcgcctggaagctgcccccagccaagagcgccttcaaggcccccaagctggtgctgaagattgatgacatctttgagagcaagaggggcaagaagaaggtgaagctgcacagctacaccgggaaggagctgccccccaccaagggggagaccagcggaaatgaaagtgatgctgagtacctgcccaagaacagacacaagaggctggcccagctgcagcccagcagcaagaggaacccccactaccagaccctggagcgggacctgattgagctgcaggagcagcagctgtttgagctgtttgtggtggtgtccctgcagaagaagcccagcggcatctcctacatcccccaggtgatccagcagtttcctgggaaggatgaccacggctacaagcagagcaaggacatggaggagcggctgaaggtgatccccaagttctgcttcccagacagcaaggactggatgcccaccagcgagctgaagtctgagaccttctcctttgtgctgactggagaagatggcagccgctggtttggctactgcaagaagctgctgcctgtgggcaagggcaagaggctgcctgaggtgtactgcatggtgtcccggctgggctgcttcaacctcttcagcaagatcctggatgaggtggagaagaggcgggagatgagccctgccctggtgtaccccttcatgaggtctgtgatggaggcccccttccctgcccctggccgcaccatcaccgtgaagagctacctgcccggggctggagatgagagcattgagctgtgccggcccctggacagccggctggagcacgtggacttcaagtgcctcttcaagtgcctgtctgtgtgccacctgatccgggtgtgtgccagcctgctgctggagaggagggtcatctttgtggccaacagcctgagcaccctgagcaaatgtggccatgctgtggtggccaccctgtaccccttcacctggcagcacacctacatccctgtgctgcctgcctccatgattgacatcgtgtgcagccccacccccttcctgattggcatcctgagctgcagcctgccccagctgcaggacctgcccatcgaggaggtgctgattgtggacctgtgtgccgacaagttcctgcaggaggtgtctgatgaagatgagatcctgccccccaagctgcaggccgccctgatgcagatcctggaggagagaaatgagatcctgacccaggagcagaacttcagccaggatgtgaccctgaacagcctggtgtctgaggcctttgtgcgcttctttgtggagctggtgggccactacagcctgaacatgacagtgacagagcggggggagagggtcttccagcgggagcccttcaggaagagccacaccagccgctctgtgcgccacttcctggacctcttcatggagacccagatgtttgctggcttcatccaggaccgggagctgaggaagtctggagtgaagggcctgtttgagatccgggccatccagtacctggagaccatccctgagagcgagcccagcggcatgaaccgcatcctgcggagcctgggcagcaagatgaagttcctgcagaagaagtag

SEQ ID NO: 38026 - DNA, 2451 bp, Artificial Sequence
  Description of Artificial Sequence: Synthetic coding sequence
atggatgtgggcttcagcaggaccaccgtgcagaccctgagccgcagccactgcaagaacatcaagcagaagatcagccagtgggagggccgggccaacggcatcagcaaccctgagaagtggtgccccaaggactttggagtgcgctacaactgccaccaggagatccggctgaagaagaaccccatcgccgagaggaagagcaagaacctggatgtgaccagcagagaaaatgtgggcctggacatcaatgaaaacaccaagagccatgaccagagtgaaaatgaaaacaagaagcatgaatatgatgacacccacttcttcaagaatgaaagtgagagcaactgggtgtgcagccgggtgaaggagattgagagctgcaaggaggatgtgctggaccctgagaccagcctgcccccaggcaacttctacaccagccagatcctgtggaagaagattgaggccctgcccccagacaagctgctgaacctggccctggagcactgtgacagcagcgagaaggagctgaacttccgggtgctggacagcagctatggcatcaccaagagcctggagaacatctacagcgagcctgagggccaggagtgtggccccagcatcaaccccctgcccaagcccaggaggaccttccgctacctgtctgagagcggcgtgaccccctacaaggagaggaactgtgacaagaagtactgtgagaacaacagctgtgcccagagcagcctggccagcagccaggagcctgagcccaagaagtatggaggcaagatccggggccgcagcaagaggaagagctttgaatttgaggacatccagcacttcaggaacagaaacagccagaccatccgggaggagctgggcaggaacagcggcagcgccctgtactacacccagagcgaggacaacatctatgaggacatcatctaccccaccaaggagaacccctatgaggacatccctgtgcagcccctgcccatgtggaggagccccagcgcctggaagctgcccccagccaagagcgccttcaaggcccccaagctgccccccaagccccagttcctgcacaggaagaccatggaggtgaagaacagccaggcctacctgcggagcaagctgaccaaggacaccaccctgcctgtgaccctgacagagtggaagctgttccgggccggggaggtggccaacaccaagaggaagaacctgccccggctggtgctgaagattgatgacatctttgagagcaagaggggcaagaagaaggtgaagctgcacagctacacaggcaaggagctgccccccaccaagggggagaccagcggaaatgaaagtgatgctgagtacctgcccaagaacagacacaagaggctggcccagctgcagcccagcagcaagaggaacccccactaccagaccctggagcgggacctgattgagctgcaggagcagcagctgtttgagctgtttgtggtggtgtccctgcagaagaagcccagcggcatctcctacatcccccaggtgatccagcagtttcctgggaaggatgaccacggctacaagcagagcaaggacatggaggagcggctgaaggtgatccccaagttctgcttcccagacagcaaggactggatgcccaccagcgagctgaagtctgagaccttctcctttgtgctgaccggggaggatggcagccgctggtttggctactgcaagaagctgctgcctgtgggcaagggcaagaggctgcctgaggtgtactgcatggtgtcccggctgggctgcttcaacctcttcagcaagatcctggatgaggtggagaagagaagagagatgagccctgccctggtgtaccccttcatgaggtctgtgatggaggcccccttccctgcccctggccgcaccatcaccctgcaggacctgcccatcgaggaggtgctgattgtggacctgtgtgccgacaagttcctgcaggaggtgtctgatgaagatgagatcctgccccccaagctgcaggccgccctgatgcagatcctggaggagagaaatgagatcctgacccaggagcagaacttcagccaggatgtgaccctgaacagcctggtgtctgaggcctttgtgcgcttctttgtggagctggtgggccactacagcctgaacatgacagtgacagagcggggggagagggtcttccagcgggagcccttcaggaagagccacaccagccgctctgtgcgccacttcctggacctcttcatggagacccagatgtttgctggcttcatccaggaccgggagctgaggaagagcggcgtgaagggcctgtttgagatccgggccatccagtacctggagaccatccctgagagcgagcccagcggcatgaaccgcatcctgcggagcctgggctacaagatgaagttcctgcagaagaagtag

SEQ ID NO: 38027 - DNA, 1416 bp, Artificial Sequence
  Description of Artificial Sequence: Synthetic coding sequence
atggagggccaggtggtgggccgggtcttccgcctcttccagaggcggctgctgcagctgcgggccggccccccccaggacaacagcggggaggccctgaaggagcctgagcgggcccaggagcacagcctgcccaactttgctgggggccagcacttctttgagtacctgctggtggtgtccctgaagaagaagagaagtgaagatgattatgagcccatcatcacctaccagttccccaagcgggagaacctgctgcggggccagcaggaggaggaggagcggctgctgaaggccatccccctcttctgcttcccagatggaaatgagtgggccagcctgacagagtacccccgggagaccttctcctttgtgctgaccaacgtggatggcagcaggaagattggctactgccggcggctgctgcctgctggccctggcccccggctgcccaaggtgtactgcatcatcagctgcatcggctgcttcggcctcttcagcaagatcctggatgaggtggagaagaggcaccagatctccatggccgtcatctaccccttcatgcagggcctgcgggaggccgccttccctgcccctgggaagacagtgaccctgaagagcttcatcccagacagcggcacagagttcatcagcctgacccggcccctggacagccacctggagcacgtggacttcagcagcctgctgcactgcctgagctttgagcagatcctgcagatctttgccagcgctgtgctggagaggaagatcatcttcctggccgagggcctgagcaccctgagccagtgcatccatgctgctgctgccctgctgtaccccttctcctgggcccacacctacatccctgtggtgcctgagagcctgctggccaccgtgtgctgccccacccccttcatggtgggcgtgcagatgaggttccagcaggaggtgatggacagccccatggaggaggtgctgctggtgaacctgtgtgagggcaccttcctgatgtctgtgggagatgagaaggacatcctgccccccaagctgcaggatgacatcctggacagcctgggccagggcatcaatgagctgaagacagctgagcagatcaatgagcacgtgtctggcccctttgtgcagttctttgtgaagatcgtgggccactacgccagctacatcaagcgggaggccaacggccagggccacttccaggagaggagcttctgcaaggccctgaccagcaagaccaacagaagatttgtgaagaagtttgtgaagacccagctgttcagcctcttcatccaggaggccgagaagagcaagaaccccccagctggctacttccagcagaagatcctggagtatgaggagcagaagaagcagaagaagccccgggagaagacagtgaagtag

SEQ ID NO: 38028 - DNA, 1407 bp, Artificial Sequence
  Description of Artificial Sequence: Synthetic coding sequence
atggatggcctgggccggcggctgcgggccagcctgcggctgaagaggggccacggcggccccccccaggacaacagcggggaggccctgaaggagcctgagcgggcccaggagcacagcctgcccaactttgctgggggccagcacttctttgagtacctgctggtggtgtccctgaagaagaagagaagtgaagatgattatgagcccatcatcacctaccagttccccaagcgggagaacctgctgcggggccagcaggaggaggaggagcggctgctgaaggccatccccctcttctgcttcccagatggaaatgagtgggccagcctgacagagtacccccgggagaccttctcctttgtgctgaccaacgtggatggcagcaggaagattggctactgccggcggctgctgcctgctggccctggcccccggctgcccaaggtgtactgcatcatcagctgcatcggctgcttcggcctcttcagcaagatcctggatgaggtggagaagaggcaccagatctccatggctgtgatctaccccttcatgcagggcctgcgggaggccgccttccctgcccctgggaagacagtgaccctgaagagcttcatcccagattctggaacagagttcatcagcctgacccggcccctggacagccacctggagcacgtggacttcagcagcctgctgcactgcctgagctttgagcagatcctgcagatctttgccagcgctgtgctggagaggaagatcatcttcctggccgagggcctgagcaccctgagccagtgcatccacgccgccgccgccctgctgtaccccttctcctgggcccacacctacatccctgtggtgcctgagagcctgctggccaccgtgtgctgccccacccccttcatggtgggcgtgcagatgaggttccagcaggaggtgatggacagccccatggaggaggtgctgctggtgaacctgtgtgagggcaccttcctgatgtctgtgggagatgagaaggacatcctgccccccaagctgcaggatgacatcctggacagcctgggccagggcatcaatgagctgaagacagctgagcagatcaatgaacatgtgtctggcccctttgtgcagttctttgtgaagatcgtgggccactacgccagctacatcaagcgggaggccaacggccagggccacttccaggagaggagcttctgcaaggccctgaccagcaagaccaacagaagatttgtgaagaagtttgtgaagacccagctgttcagcctcttcatccaggaggccgagaagagcaagaaccccccagctggctacttccagcagaagatcctggagtatgaggagcagaagaagcagaagaagccccgggagaagacagtgaagtag

SEQ ID NO: 38029 - DNA, 3597 bp, Artificial Sequence
  Description of Artificial Sequence: Synthetic coding sequence
atgaggagcctgaggaagaagcgggagaagcccaggcctgagcagtggaagggcctgcccggccccccccgggcccctgagccagaagatgtggccgtgcctgggggcgtggacctgctgaccctgccccagctgtgcttccctgggggcgtgtgtgtggccacagagcccaaggaggactgtgtgcacttcctggtgctgacagatgtgtgtggcaacagaacctacggcgtggtggcccagtactaccggcccctgcatgatgagtactgcttctacaacgggaagacccaccgggagtgccccggctgctttgtgccctttgctgtgtgtgtggtgagccgcttcccctactacaacagcctgaaggactgcctgagctgcctgctggccctgctgaagccctgcaaggactttgaggtggacagccacatcaaggactttgctgccaagctgagcctcatccccagccccccacctggccccctgcacctggtgttcaacatgaagagcctgcagatcgtgctgcctgcccgggctgaccctgagagccccatcctggacctggacctgcacctgcccctgctgtgcttccggcctgagaaggtgctgcagatcctgacctgcatcctgacagagcagagaattgtgttcttcagcagtgactgggccctgctgaccctggtgacagagtgcttcatggcctacctgtaccccctgcagtggcagcacccctttgtgcccatcctgagtgaccagatgctggactttgtgatggcccccaccagcttcctgatgggctgccacctggaccactttgaggaggtgtccaaggaggctgatggcctggtgctgatcaacatcgaccacggcagcatcacctacagcaagagcacagatgacaacgtggacatcccagatgtgcccctgctggccgcccagaccttcatccagagggtgcagagcctgcagctgcaccacgagctgcatgctgcccacctgctgagcagcacagacctgaaggagggccgggcccacagaagatcctggcagcagaagctgaactgccagatccagcagaccaccctgcagctgctggtgtccatcttcagagatgtgaagaaccacctgaactatgagcacagggtcttcaacagcgaggagttcctgaagacccgggcccctggggaccaccagttctacaagcaggtgctggacacctacatgttccacagcttcctgaaggcccggctgaacagaaggatggatgcctttgcccagatggacctggacacccagagcgaggaggaccgcatcaatggcatgctgctgagcccccggcggcccaccgtggagaagagggccagcaggaagagcagccacctgcacgtgacccacaggaggatggtggtgtccatgcccaacctgcaggacatcgccatgcctgagctggcccccaggaacagcagcctgcggctgacagacacagctggctgccggggcagcagcgctgtgctgaatgtgacccccaagagcccctacaccttcaagatccctgagatccacttccccctggagagcaaatgtgtgcaggcctaccacgcccactttgtgtccatgctgtctgaggccatgtgcttcctggccccagacaacagcctgctgctggcccgctacctgtacctgcggggcctggtgtacctgatgcagggccagctgctgaatgccctgctggacttccagaacctgtacaagacagacatccgcatcttccccacagacctggtgaagaggacagtggagagcatgtctgcccctgagtgggagggcgctgagcaggcccctgagctgatgaggctcatcagcgagatcctggacaagccccatgaggccagcaagctggatgaccacgtgaagaagttcaagctgcccaagaagcacatgcagctgggggacttcatgaagagggtgcaggagagcggcatcgtgaaggatgccagcatcatccaccggctgtttgaggccctgactgtgggccaggagaagcagattgatcctgagaccttcaaggacttctacaactgctggaaggagacagaagctgaggcccaggaggtgtccctgccctggctggtgatggagcacctggacaagaatgaatgtgtgtgcaagctgagcagctctgtgaagaccaacctgggcgtgggcaagatcgccatgacccagaagaggctcttcctgctgacagagggccggcccggctacctggagatcagcaccttcaggaacatcgaggaggtgcggaggaccaccaccaccttcctgctgcggcgcatccccaccctgaagatccgggtggccagcaagaaggaggtgtttgaggccaacctgaagacagaatgtgacctgtggcacctgatggtgaaggagatgtgggccggcaagaagctggctgatgaccacaaggacccccactacgtgcagcaggccctgaccaacgtgctgctgatggatgctgtggtgggcaccctgcagagccctggggccatctatgctgccagcaagctgagctactttgacaagatgagcaatgagatgcccatgaccctgcctgagaccaccctggagaccctgaagcacaagatcaaccccagcgctggggaggccttcccccaggccgtggatgtgctgctgtacaccccaggccacctggaccctgctgagaaggtggaggatgcccaccccaagctgtggtgtgccctgtctgagggcaaggtgacagtgttcaatgccagctcctggaccatccaccagcacagcttcaaggtgggcacagccaaggtgaactgcatggtgatggctgaccagaaccaggtgtgggtgggcagcgaggacagcgtcatctacatcatcaacgtgcacagcatgagctgcaacaagcagctgacagcccactgcagctctgtgacagacctgattgtgcaggacggccaggaggcccccagcaatgtgtacagctgcagcatggatggcatggtgctggtgtggaatgtgtccaccctgcaggtgaccagccgcttccagctgccccggggcggcctgaccagcatccggctgcacggcggccgcctgtggtgctgcaccggcaacagcatcatggtgatgaagatgaatggcagcctgcaccaggagctgaagattgaggagaacttcaaggacaccagcaccagcttcctggccttccagctgctgcctgaggaggagcagctgtgggccgcctgtgccggccgctctgaggtgtacatctggagcctgaaggacctggcccagcccccccagagggtgcccctggaggactgcagcgagatcaactgcatgatccgggtgaagaagcaggtgtgggtgggcagccggggcctgggccagggcacccccaagggcaagatctacgtgattgatgctgagaggaagacagtggagaaggagctggtggcccacatggacacagtgaggaccctgtgcagcgcagaagatcgctacgtgctgagcggcagcggccgggaggagggcaaggtggccatctggaagggggagtag

SEQ ID NO: 38030 - DNA, 3441 bp, Artificial Sequence
  Description of Artificial Sequence: Synthetic coding sequence
atgaggagcctgaggaagaagcgggagaagcccaggcctgagcagtggaagggcctgcccggccccccccgggcccctgagccagaagatgtggccgtgcctgggggcgtggacctgctgaccctgccccagctgtgcttccctgggggcgtgtgtgtggccacagagcccaaggaggactgtgtgcacttcctggtgctgacagatgtgtgtggcaacagaacctacggcgtggtggcccagtactaccggcccctgcatgatgagtactgcttctacaacgggaagacccaccgggagtgccccggctgctttgtgccctttgctgtgtgtgtggtgagccgcttcccctactacaacagcctgaaggactgcctgagctgcctgctggccctgctgaagccctgcaaggactttgaggtggacagccacatcaaggactttgctgccaagctgagcctcatccccagccccccacctggccccctgcacctggtgttcaacatgaagagcctgcagatcgtgctgcctgcccgggctgaccctgagagccccatcctggacctggacctgcacctgcccctgctgtgcttccggcctgagaaggtgctgcagatcctgacctgcatcctgacagagcagagaattgtgttcttcagcagtgactgggccctgctgaccctggtgacagagtgcttcatggcctacctgtaccccctgcagtggcagcacccctttgtgcccatcctgagtgaccagatgctggactttgtgatggcccccaccagcttcctgatgggctgccacctggaccactttgaggaggtgtccaaggaggctgatggcctggtgctgatcaacatcgaccacggcagcatcacctacagcaagagcacagatgacaacgtggacatcccagatgtgcccctgctggccgcccagaccttcatccagagagatgtgaagaaccacctgaactatgagcacagggtcttcaacagcgaggagttcctgaagacccgggcccctggggaccaccagttctacaagcaggtgctggacacctacatgttccacagcttcctgaaggcccggctgaacagaaggatggatgcctttgcccagatggacctggacacccagagcgaggaggaccgcatcaatggcatgctgctgagcccccggcggcccaccgtggagaagagggccagcaggaagagcagccacctgcacgtgacccacaggaggatggtggtgtccatgcccaacctgcaggacatcgccatgcctgagctggcccccaggaacagcagcctgcggctgacagacacagctggctgccggggcagcagcgctgtgctgaatgtgacccccaagagcccctacaccttcaagatccctgagatccacttccccctggagagcaaatgtgtgcaggcctaccacgcccactttgtgtccatgctgtctgaggccatgtgcttcctggccccagacaacagcctgctgctggcccgctacctgtacctgcggggcctggtgtacctgatgcagggccagctgctgaatgccctgctggacttccagaacctgtacaagacagacatccgcatcttccccacagacctggtgaagaggacagtggagagcatgtctgcccctgagtgggagggcgctgagcaggcccctgagctgatgaggctcatcagcgagatcctggacaagccccatgaggccagcaagctggatgaccacgtgaagaagttcaagctgcccaagaagcacatgcagctgggggacttcatgaagagggtgcaggagagcggcatcgtgaaggatgccagcatcatccaccggctgtttgaggccctgactgtgggccaggagaagcagattgatcctgagaccttcaaggacttctacaactgctggaaggagacagaagctgaggcccaggaggtgtccctgccctggctggtgatggagcacctggacaagaatgaatgtgtgtgcaagctgagcagctctgtgaagaccaacctgggcgtgggcaagatcgccatgacccagaagaggctcttcctgctgacagagggccggcccggctacctggagatcagcaccttcaggaacatcgaggaggtgcggaggaccaccaccaccttcctgctgcggcgcatccccaccctgaagatccgggtggccagcaagaaggaggtgtttgaggccaacctgaagacagaatgtgacctgtggcacctgatggtgaaggagatgtgggccggcaagaagctggctgatgaccacaaggacccccactacgtgcagcaggccctgaccaacgtgctgctgatggatgctgtggtgggcaccctgcagagccctggggccatctatgctgccagcaagctgagctactttgacaagatgagcaatgagatgcccatgaccctgcctgagaccaccctggagaccctgaagcacaagatcaaccccagcgctggggaggccttcccccaggccgtggatgtgctgctgtacaccccaggccacctggaccctgctgagaaggtggaggatgcccaccccaagctgtggtgtgccctgtctgagggcaaggtgacagtgttcaatgccagctcctggaccatccaccagcacagcttcaaggtgggcacagccaaggtgaactgcatggtgatggctgaccagaaccaggtgtgggtgggcagcgaggacagcgtcatctacatcatcaacgtgcacagcatgagctgcaacaagcagctgacagcccactgcagctctgtgacagacctgattgtgcaggacggccaggaggcccccagcaatgtgtacagctgcagcatggatggcatggtgctggtgtggaatgtgtccaccctgcaggtgaccagccgcttccagctgccccggggcggcctgaccagcatccggctgcacggcggccgcctgtggtgctgcaccggcaacagcatcatggtgatgaagatgaatggcagcctgcaccaggagctgaagattgaggagaacttcaaggacaccagcaccagcttcctggccttccagctgctgcctgaggaggagcagctgtgggccgcctgtgccggccgctctgaggtgtacatctggagcctgaaggacctggcccagcccccccagagggtgcccctggaggactgcagcgagatcaactgcatgatccgggtgaagaagcaggtgtgggtgggcagccggggcctgggccagggcacccccaagggcaagatctacgtgattgatgctgagaggaagacagtggagaaggagctggtggcccacatggacacagtgaggaccctgtgcagcgcagaagatcgctacgtgctgagcggcagcggccgggaggagggcaaggtggccatctggaagggggagtag

SEQ ID NO: 38031 - DNA, 4491 bp, Artificial Sequence
  Description of Artificial Sequence: Synthetic coding sequence
atggccgaggagcggcccccccggctggtggactactttgtggtggccggcctggccggaaatggagcccccatccctgaggagacctgggtgcctgagcccagcggccccctgcggccccccaggcctgctgagcccatcacagatgtggccgtgattgcccgggccctgggggaggaggtgccccagggctacacctgcatccaggccagcgctgggggccaccccctggagctgtctgctggcctgctgggcggcacccagcctgtgatctgctaccgccggggccgggacaagccacccctggtggagctgggcgtgctgtatgagggcaaggagcggcccaagccaggcttccaggtgctggacaccaccccctacagccacagcgccaacctggcccctcctggccctggccaccccaggacctacctgacctaccgccgggctgctgagggcgccggcctgcacgccctgggcatcacagacctgtgcctggtgctgcccagcaaaggagagggcaccccccacacctactgccgcctgcccaggaacctgaaccctggcatgtggggccctgctgtgtacctgtgctacaaggtgggcctggccaaggccaacaccctggtgtatgaagctgagctgctgggccgctacccagaggaggacaatgaggccttccccctgcctgagagcgtgcctgtgttctgcctgcccatgggcgccaccatcgagtgctggccagcccagaccaagtaccctgtgcctgtgttcagcacctttgtgctgaccggggctgctggggacaaggtgtatggagctgccctgcagttctatgaggccttcccccgggcccggctgtctgagcggcaggcccgggccctgggcctgctgtctgctgtggagcggggccgggccctgggcggccgggctgtgcgcagcagaagagccatcgctgtgctgagccgctggccagccttccctgccttccgggccttcctgaccttcctgtaccgctacagcgtgtctggcccccaccggctgcccctggaggcccacatcagccacttcatccacaacgtgcccttccccagcccccagaggccccgcatcctggtgcagatgagcccctatgacaacctgctgctgtgccagcctgtgagcagccccctgcccctgagcggggccagcttcctgcagctgctgcagagcctgggccctgagctggccatcaccctgctgctggccgtgctgacagagcacaagctgctggtgcacagcctgcggccagacctgctgacctctgtgtgtgaggccctggtgtccatgatcttccccctgcactggcagtgcccctacatccccctgtgccccctggtgctggctgatgtgctgagcgcccctgtgcccttcatcgtgggcatccacagcagctactttgacctgcatgaccccccagcagatgtgatctgtgtggacctggacaccaacaccctcttccagacagaggagaagaagctgctgagccccaggaccctgccccggcggccctacaaggtgctgctggccaccctgaccaacctgtaccagcagctggaccagacctacacaggccctgaggaggaggccagcctggagttcctgctgacagattatgaggccgtgtgtggccggcgggcccggctggagcgggaggtgcagggcgccttcctgcgcttcatggcctgcctgctgaagggctacagagtcttcctgcggcccctgacccaggcccccagcgagggcgccagagatgtggacaacctcttcttcctgcagggcttcctgaagagccgggagaggagcagccacaagctgtacagccagctgctgcacacccagatgttcagccagttcattgaagaatgttcctttggcagcgcccggcatgctgccctggagttctttgacagctgtgtggagaaggtgcaccctgagcaggagaagccagagcccacccccctggtggagctggaggagctgagcggcagcgagctgaccgtcttcatcaccccacctgaggagcccgccctgcctgagggcagcgagagcaccccccagtactgctatgatggcttccctgagctgcgggcagagctgtttgagagcctgcaggagcagcccggggccctgcctgtgcccggccccagccgcagcgcccccagcagccctgcccccaggaggaccaagcaggagatgaaggtggcccagaggatggcccagaagtctgctgctgtgcctgagctgtgggcccgctgcctgctgggccactgctacggcctgtggttcctgtgcctgcctgcctacgtgcgcagcgcccccagccgggtgcaggccctgcacacagcctaccacgtgctgcggcagatggagagcggcaaggtggtgctgcctgatgaggtgtgctacagagtgctgatgcagctgtgcagccactacggccagcctgtgctgtctgtgcgggtgatgctggagatgaggcaggccggcatcgtgcccaacaccatcacctacggctactacaacaaggctgtgctggagagcaagtggcccagcggcacccctgggggccgcctgcgctgggccaagctgagaaatgtggtgctgggcgccgcccagttccggcagcccctgcgggagcggcagcagcagcagcagcagcagcagcagcagcagcagcagcagcagcaggagcaggtgtctgcccaccaggaggccggcagcagccaggccgagccctacctggagcggcccagccccacccggcccctgcagaggcagaccacctgggccggccgcagcctgcgggaccctgccagccccccaggccgcctggtgaagagcggcagcctgggcagcgcccggggggcccagcccaccgtggaggccggcgtggcccacatgattgaggccctgggcgtgctggagccccggggcagccctgtgccctggcatgatggcagcctgagtgacctgagcctgaccggggaggagcccctgcccggcggcagccctgggggcagcggcagcgccctgagcgcccagagcacagaggccctggagggcctgagcggccggggccccaaggccggcggccggcaggatgaggccggcaccccccggcggggcctgggcgcccggctgcagcagctgctgacccccagccgccacagccctgccagccgcatccccccacctgagctgcccccagacctgcccccaccagcccggcgcagccccatggacagcctgctgcacccccgggagcggcccggcagcacagccagcgagagcagcgccagcctgggcagcgagtgggacctgtctgagagcagcctgagcaacctgagcctgcggcgcagcagcgagcggctgagtgacaccccaggcagcttccagagccccagcctggagatcctgctgagcagctgcagcctgtgccgggcctgtgacagcctggtgtatgatgaggagatcatggccggctgggccccagatgacagcaacctgaacaccacctgccccttctgtgcctgcccctttgtgcccctgctgtctgtgcagaccctggacagccggcccagcgtgcccagccccaagtctgctggggccagcggcagcaaggatgcccctgtgcctgggggccctggccctgtgctgagtgaccggcggctgtgcctggccctggatgagccccagctgtgcaatggccacatgggcggggccagcagaagagtggagagcggggcctgggcctacctgagccccctggtgctgaggaaggagctggagagcctggtggagaatgaaggcagcgaggtgctggccctgcctgagctgcccagcgcccaccccatcatcttctggaacctgctgtggtacttccagaggctgcggctgcccagcatcctgcccggcctggtgctggccagctgtgatggccccagccacagccaggcccccagcccctggctgaccccagaccctgcctctgtgcaggtgcggctgctgtgggatgtgctgaccccagaccccaacagctgcccccccctgtatgtgctgtggagggtgcacagccagatcccccagagggtggtgtggccaggccctgtgcctgccagcctgagcctggccctgctggagagcgtgctgcggcacgtgggcctgaatgaggtgcacaaggctgtgggcctgctgctggagaccctgggccccccacccaccggcctgcacctgcagaggggcatctaccgggagatcctcttcctgaccatggccgccctgggcaaggaccacgtggacatcgtggcctttgacaagaagtacaagagcgccttcaacaagctggccagctccatgggcaaggaggagctgcggcaccggcgggcccagatgcccacccccaaggccatcgactgcaggaagtgcttcggggcccccccagaatgttag

SEQ ID NO: 38032 - DNA, 1002 bp, Artificial Sequence
  Description of Artificial Sequence: Synthetic coding sequence
atggtgcctggagaggagcccgcccgggagctgatggctgtgctgctgaccccccgcttccggcggctggtgtcccagaatgagctgcccggccctggcctgaatggccccagcagcaggaacagaagagatggcttctgcaggaagagaagaactggagtgcacctgtgccaggtgctgatgaaccacaaggtgtttgagcctgtgggcatgaagaagctgttcaagaaggagaaggagctggagtttgaggacagcaacatcagcctgtaccgcttcctgggcaacaagagcagctatgactgctgcaagaggcagaaggatgctgaaaatgagttcaatgagaccctgcggcccggctatgagatgatcagcaaccccctggcccaggagatcggggaggagagaattgaggagctgatccacaccatcaatggaaatcctgccctgtgccccaacatcaccgtgcagaagcccttcctgcggctgagcaaggagggcgtgtccttctacacagccatcaccagtgacaagacagatgtgtggaaggagcagaccctgctgtgcctgctgcagctgatccacctgcccttcctggacaacatcctggagccccctgtgaagacccagaacctgcagctgaacaaggaggaggacctggtgatcaccaacacctgcctggaccgggagctgatccccagcctgtgcctgcctgagattgacaactggctgaatgctgccattgaatgtctggagtacttcccagaccagctgattgtgacagtgtcccagcagctgatgcagaacagaaatgaggagacccggctgaacagccagaagaagatcctgtttgatgtgattgccaagtactatgcccaggagcgggactgcctgctgacagatgagtactttgacatccacagcggcatcatcgagctgctggagaatgagaagagagctgaggccctggaggccacccagctgtacctgcggctgctgtag

SEQ ID NO: 38033 - DNA, 885 bp, Artificial Sequence
  Description of Artificial Sequence: Synthetic coding sequence
atggtgcctggagaggagcccgcccgggagctgatggctgtgctgctgaccccccgcttccggcggctggtgtcccagaatgagctgcccggccctggcctgaatggccccagcagcaggaacagaagagatggcttctgcaggaagagaagaacaggctgcagcggccccttccaggccacccagctgtgggatggcatcatccacagcctgcaggcccaggtggagatcaagagaagaagacaccacctgcagacctacaaggactgcttcaccggcagtgatgctgtggatgtggtgctgagccacctgatgcagaacacctgcctgagcagcaatgacatcagctgcctgaagggcgtgcacctgtgccaggtgctgatgaaccacaaggtgtttgagcctgtgggcatgaagaagctgttcaagaaggagaaggagctggagtttgaggacagcaacatcagcctgtaccgcttcctgggcaacaagagcagctatgactgctgcaagaggcagaaggatgctgaaaatgagttcaatgagaccctgcggcccggctatgagatgatcagcaaccccctggcccaggagattggagaggagcgcatcgaggagctgatccacaccatcaatggaaatcctgccctgtgccccaacatcaccgtgcagaagcccttcctgcggctgagcaaagaagatgtgtggaaggagcagaccctgctgtgcctgctgcagctgatccacctgcccttcctggacaacatcctggagccccctgtgaagacccagaacctgcagctgaacaaggaggaggacctggtgatcaccaacacctgcctggaccgggagctgatccccagcctgtgcctgcctgagaagtag

SEQ ID NO: 38034 - DNA, 1164 bp, Artificial Sequence
  Description of Artificial Sequence: Synthetic coding sequence
atggtgcctggagaggagcccgcccgggagctgatggctgtgctgctgaccccccgcttccggcggctggtgtcccagaatgagctgcccggccctggcctgaatggccccagcagcaggaacagaagagatggcttctgcaggaagagaagaacaggctgcagcggccccttccaggccacccagctgtgggatggcatcatccacagcctgcaggcccaggtggagatcaagagaagaagacaccacctgcagacctacaaggactgcttcaccggcagtgatgctgtggatgtggtgctgagccacctgatgcagaacacctgcctgagcagcaatgacatcagctgcctgaagggcgtgcacctgtgccaggtgctgatgaaccacaaggtgtttgagcctgtgggcatgaagaagctgttcaagaaggagaaggagctggagtttgaggacagcaacatcagcctgtaccgcttcctgggcaacaagagcagctatgactgctgcaagaggcagaaggatgctgaaaatgagttcaatgagaccctgcggcccggctatgagatgatcagcaaccccctggcccaggagattggagaggagcgcatcgaggagctgatccacaccatcaatggaaatcctgccctgtgccccaacatcaccgtgcagaagcccttcctgcggctgagcaaagaagatgtgtggaaggagcagaccctgctgtgcctgctgcagctgatccacctgcccttcctggacaacatcctggagccccctgtgaagacccagaacctgcagctgaacaaggaggaggacctggtgatcaccaacacctgcctggaccgggagctgatccccagcctgtgcctgcctgagattgacaactggctgaatgctgccattgaatgtctggagtacttcccagaccagctgattgtgacagtgtcccagcagctgatgcagaacagaaatgaggagacccggctgaacagccagaagaagatcctgtttgatgtgattgccaagtactatgcccaggagcgggactgcctgctgacagatgagtactttgacatccacagcggcatcatcgagctgctggagaatgagaagagagctgaggccctggaggccacccagctgtacctgcggctgctgtag

SEQ ID NO: 38035 - DNA, 309 bp, Artificial Sequence
  Description of Artificial Sequence: Synthetic coding sequence
atggctgacttcctgaagggcctgcctgtgtacaacaagagcaacttcagccgcttccacgccgacagcgtgtgcaaggccagcaacagaagaccttctgtgtacctgcccacccgggagtaccccagcgagcagatcatcgtgacagagaagaccaacatcctgctgcgctacctgcaccagcagtgggacaagaagaatgctgccaagaagagggaccaggagcaggtggagctggagggggagagcagcgccccacccaggaaggtggccaggacagacagcccagacatgcatgaggacacctag

SEQ ID NO: 38036 - DNA, 528 bp, Artificial Sequence; identical to SEQ ID NO: 37746
  Description of Artificial Sequence: Synthetic coding sequence

SEQ ID NO: 38037 - DNA, 1032 bp, Artificial Sequence
  Description of Artificial Sequence: Synthetic coding sequence
atgatgtttcctggcctgctggcccctcctgctggctaccccagcctgctgcggcccacccccaccctgaccctgccccagagcctgcagagcgccttcagcggccacagcagcttcctggtggaggacctgatccgcatcagccggcccccagcctacctgcccaggtctgtgcccacagcctccatgagccccccccggcagggcgcccccacagccctgacagacacaggagccagtgacctgggcagccctggccctggcagccggcggggcggcagccccccaacagccttctccccagccagcgagaccaccttcctgaagtttggagtgaatgccatcctgagcagcggccccaggacagagaccagccctgccctgctgcagagcgtgccccccaagacctttgccttcccctactttgagggcagcttccagcccttcatccgcagcagctacttccctgccagcagctctgtggtgcccatccctggcaccttctcctggcccctggccgcccggggcaagccccggcggggcatgctgcggcgggctgtgttcagtgatgtgcagaggaaggccctggagaagatgttccagaagcagaagtacatcagcaagccagacaggaagaagctggccgccaagctgggcctgaaggacagccaggtgaagatctggttccagaacagaaggatgaagtggaggaacagcaaggagcgggagctgctgagcagcggcggctgccgggagcagaccctgcccaccaagctgaacccccacccagacctgagtgatgtgggccagaagggccctggaaatgaggaggaggaggagggccctggcagccccagccaccggctggcctaccacgccagcagtgacccccagcacctgcgggacccccggctgcccggccccctgccccccagccctgcccacagcagcagccctgggaagcccagcgacttcagtgacagcgaggaggaggaggagggggaggagcaggaggagatcaccgtgtcctag

SEQ ID NO: 38038 - DNA, 288 bp, Artificial Sequence
  Description of Artificial Sequence: Synthetic coding sequence
atgctgggcgcccgggtggccgcccacctggatgccctgggccccctggtgccctacgtgcccccacccctgctgcccagcatgttctacgtgggcctcttctttgtgaatgtgctgatcctgtactatgccttcctgatggagtacatcgtgctgaatgtgggcctggtgttcctgcctgaggacatggaccaggccctggtggacctgggcgtgctgagtgaccccggcagcggcctgtatgatgctgacagcgagctggatgtgtttgatgcctacctggagtag

SEQ ID NO: 38039 - DNA, 3816 bp, Artificial Sequence
  Description of Artificial Sequence: Synthetic coding sequence
atggacagaggagctgctgctgcccagggcacagccccaccccaggatggagagcagcctgctgagagccctgagcccccaccaccctggcccccacctcctcctcctccagcccctcctccagccccacccctgctgtctgaggccagccctgagcccatccctgagccctgcccagagctggcccctggcccctgcccagaggccaccagcgagagcgccacagagctgtacacagagcccaccccagagcccgccacagagcccgccagcgagcccgcccctgagcccgccacagagcccgcccctgagcccgccacagagcccgcccctgagcccgcccctgagcccgccacagaaagtgcccctgagcccaccccagagcccgccctggagagcgtgcctgagcccgcccctgagctgaccccagaggtggcccctgagctggcccctgagcccaccccagagcctgtgacagagctggcccctgagttctgcccagaggccgcccctgagttccggcccagccctgccccctgcctgctgcagtgccctgtggacacccgggagcggggcctgaagaccagccccagccccagccccagccccagccccaggacccccatgtcctggagccgcatcaagaagatcctgaaggagggccccatgctgaagaactgcaacagcttcaagcgctggaagctgcgctacttcctggtgcagggccagaagctgtactttgcccaccacccagcctttgcccactttgagaccatcgacctgagccaggccaccgtggccgagagcagctgcaggaacctgtgccacagcttctgtgtgatcaccccccagaggaagatcaccctggccgcccccaacaggaaggacatggaggagtggatcaacatcatcaagaccatccagcagggcgagatctacaagatcccagctgctgagaacaaccccttcctggtgggcatgcactgctggtacagcagctacagccacaggacccagcactgcaatgtgtgccgggagagcatcccagccctgagcagagatgccatcatctgtgaggtgtgcaaggtgaagagccaccggctgtgtgccctgcgggccagcaaggactgcaagtggaacaccctgagcatcacagatgacctgctgctgcctgcagatgaggtgaacatgccccaccagtgggtggagggcaacatgcctgtgagcagccagtgtgctgtgtgccacgagagctgtggcagctaccagaggctgcaggacttccgctgcctgtggtgcaacagcacagtgcatgatgactgcagaagacgcttcagcaaggagtgctgcttccgcagccacaggagcagcgtcatccccccaacagccctgagtgaccccaagggagatggccagctggtggtgtccagtgacttctggaacctggactggagcagcgcctgcagctgccccctgctgatcttcatcaacagcaagagcggggaccaccagggcatcgtgttcctgaggaagttcaagcagtacctgaaccccagccaggtgtttgacctgctgaagggcggccctgaggccggcctgtccatgttcaagaactttgcccgcttccgcatcctggtgtgtggaggagatggctctgtgtcctgggtgctgagcctgattgatgccttcggcctgcacgagaagtgccagctggccgtcatccccctgggcactggaaatgacctggcccgggtgctgggctggggcgccttctggaacaagagcaagagccccctggacatcctgaacagagtggagcaggcctctgtgcgcatcctggaccgctggagcgtgatgatccgggagaccccccggcagacccccctgctgaagggccaggtggagatggatgtgcccaggtttgaagctgctgccatccagcacctggagagcgctgccacagagctgaacaagatcctgaaggccaagtaccccacagagatgatcatcgccacccgcttcctgtgcagcgctgtggaggactttgtggtggacatcgtgaaggcctggggccagatcaagcagaacaacacagccatcgtgtctgtcatcctgaagagtgacctgatgtatgaccggctgtctgtgctgattgatgtgctggccgaggaggccgccgccaccagcgctgagaagagcgccacagaatatgctgacagcagcaaggctgacaggaagcccttcatcccccagattgaccacatcgccaagtgcaagctggagctggccaccaaggcccagagcctgcagaagagcctgaagctgatcatcttccaggtggagcaggccctggatgaggagagccggcagaccatctctgtgaagaacttcagcagcaccttcttcctggaggatgatcctgaggacatcaaccagaccagccccaggagaagaagccggcggggcaccctgagcagcatcagcagcctgaagtctgaggacctggacaacctgaacctggaccacctgcacttcaccccagagagcatccgcttcaaggagaagtgtgtgatgaacaactacttcggcatcggcctggatgccaagatcagcctggacttcaacaccaggagagatgagcaccctggccagtacaacagccggctgaagaacaagatgtggtacggcctgctgggcaccaaggagctgctgcagaggagctacaggaagctggaggagcgggtgcacctggagtgtgatggagagaccatcagcctgcccaacctgcagggcatcgtggtgctgaacatcaccagctatgccggcggcatcaacttctggggcagcaacacagccaccacagaatatgaggccccagccattgatgatggcaagctggaggtggtggccatcttcggctctgtgcagatggccatgagccgcatcatcaacctgcaccaccaccgcatcgcccagtgccacgaggtgatgatcaccattgatggagaggagggcatccctgtgcaggtggatggagaggcctggatccagaggcctggcctcatcaagatccgctacaagaatgctgcccagatgctgacccgggaccgggactttgagaacagcatgaagatgtgggagtacaagcacacagagatccaggccgccccccagccccagctggacttccaggacagccaggagagcctgagtgatgaggagtatgcccagatgcagcacctggcccggctggccgagaacctgatcagcaagctgaatgacctgagcaagatccaccagcacgtgtctgtgctgatgggctctgtgaatgccagcgccaacatcctgaatgacatcttctacggccaggacagcggaaatgagatgggcgccgccagctgcatccccatcgagaccctgagcagaaatgatgctgtggatgtgaccttcagcctgaagggcctgtatgatgacaccacagccttcctggatgagaagctgctgcggtctgcagaagatgaaacagccctgcagagcgccctggatgccatgaacaaggagttcaagaagctgtctgaaattgactggatgaaccccatctttgtgcctgaggagaagagcagtgacacagacagccgcagcctgcggctgaagatcaagttccccaagctgggcaagaagaaggtggaggaggagaggaagcccaagagcggccagagcgtgcagagcttcatcggcaacctgtggcacagaagacacagagaagatgaggccgagggagatgaccccctgacccccagccgcagccagctgtag

SEQ ID NO: 38040 - DNA, 2550 bp, Artificial Sequence
  Description of Artificial Sequence: Synthetic coding sequence
atgtctgaggagaggagcctgagcctgctggccaaggctgtggaccccaggcaccccaacatgatgacagatgtggtgaagctgctgtctgctgtgtgcatcgtgggggaggagagcatcctggaggaggtgctggaggccctgaccagcgctggggaggagaagaagattgaccgcttcttctgcatcgtggagggcctgcggcacaacagcgtgcagctgcaggtggcctgcatgcagctgatcaatgccctggtgaccagcccagatgacctggacttccggctgcacatcagaaatgagttcatgagatgtggcctgaaggagatcctgcccaacctgaagtgcatcaagaatgatggcctggacatccagctgaaggtgtttgatgagcacaaggaggaggacctgtttgagctgagccaccggctggaggacatccgggcagagctggatgaggcctatgatgtgtacaacatggtgtggagcacagtgaaggagaccagggctgagggctacttcatcagcatcctgcagcacctgctgctgatcagaaatgactacttcatccggcagcagtacttcaagctgattgatgaatgtgtgtcccagatcgtgctgcacagagatggcatggaccctgacttcacctacaggaagaggctggacctggacctgacccagtttgtggacatctgcatcgaccaggccaagctggaggagtttgaggagaaggccagcgagctgtacaagaagtttgagaaggagttcacagaccaccaggagacccaggccgagctgcagaagaaggaggccaagatcaatgagctgcaggccgagctgcaggccttcaagagccagtttggagccctgcctgctgactgcaacatccccctgccccccagcaaggagggcggcaccggccacagcgccctgcccccacctccacccctgcccagcggcggcggcgtgcccccacctcctcctcctcctcctcctccacccctgcccggcatgaggatgcccttcagcggccctgtgcccccacctccacccctgggcttcctgggcggccagaacagcccccccctgcccatcctgcccttcggcctgaagcccaagaaggagttcaagccagagatctccatgaggcggctgaactggctgaagatccggccccatgagatgacagagaactgcttctggatcaaggtgaatgaaaacaagtatgaaaatgtggacctgctgtgcaagctggagaacaccttctgctgccagcagaaggagcggcgggaggaggaggacatcgaggagaagaagagcatcaagaagaagatcaaggagctgaagttcctggacagcaagatcgcccagaacctgagcatcttcctgagcagcttccgggtgccctatgaggagatccgcatgatgatcctggaggtggatgagacccggctggccgagagcatgatccagaacctgatcaagcacctgcctgaccaggagcagctgaacagcctgagccagttcaagtctgagtacagcaacctgtgtgagcctgagcagtttgtggtggtgatgagcaatgtgaagaggctgcggccccggctgagcgccatcctcttcaagctgcagtttgaggagcaggtgaacaacatcaagccagacatcatggctgtgtccacagcctgtgaggagatcaagaagagcaagagcttcagcaagctgctggagctggtgctgctgatgggcaactacatgaatgccggcagcagaaatgcccagaccttcggcttcaacctgagcagcctgtgcaagctgaaggacaccaagtctgctgaccagaagaccaccctgctgcacttcctggtggagatctgtgaggagaagtacccagacatcctgaactttgtggatgacctggagcccctggacaaggccagcaaggtgtctgtggagaccctggagaagaacctgcggcagatgggccggcagctgcagcagctggagaaggagctggagaccttccccccacctgaggacctgcatgacaagtttgtgaccaagatgagcatctttgtgatcagcgccaaggagcagtatgagaccctgagcaagctgcacgagaacatggagaagctgtaccagagcatcatcggctactatgccattgatgtgaagaaggtgtctgtggaggacttcctgacagacctgaacaacttccgcaccaccttcatgcaggccatcaaggagaacatcaagaagcgggaggccgaggagaaggagaagagggtgagaattgccaaggagctggccgagcgggagcggctggagcggcagcagaagaagaagaggctgctggagatgaagacagaaggagatgagaccggggtgatggacaacctgctggaggccctgcagagcggggccgccttccgggacaggaggaagaggacccccatgcccaaggatgtgcggcagagcctgagccccatgagccagaggcctgtgctgaaggtgtgcaaccacggcaacaagccctacctgtag

SEQ ID NO: 38041 - DNA, 3582 bp, Artificial Sequence
  Description of Artificial Sequence: Synthetic coding sequence
atggagcggcaccagccccggctgcaccacccagcccagggcagcgctgctggcaccccctaccccagcagcgccagcctgcggggctgccgggagagcaagatgcccaggaggaagggcccccagcaccccccaccacccagcggccctgaggagcctggagagaagaggcccaagttccacctgaacatccgcaccctgacagatgacatgctggacaagtttgccagcatccgcatccctggcagcaagaaggagcggccccccctgcccaacctgaagacagcctttgccagcagtgactgcagcgctgcccccctggagatgatggagaacttccccaagcccctgtctgaaaatgagctgctggagctgtttgagaagatgatggaggacatgaacctgaatgaagacaagaaggcccccctgcgggagaaggacttcagcatcaagaaggagatggtgatgcagtacatcaacacagccagcaagacaggcagcctgaagaggagccggcagatcagcccccaggagttcatccacgagctgaagatgggcagcgcagatgagcggctggtgacctgcctggagagcctgcgggtgtccctgaccagcaaccctgtgtcctgggtggagagctttggccacgagggcctgggcctgctgctggacatcctggagaagctgatcagcggcaagatccaggagaaggtggtgaagaagaaccagcacaaggtgatccagtgcctgaaggccctgatgaacacccagtatggcctggagcgcatcatgtctgaggagaggagcctgagcctgctggccaaggctgtggaccccaggcaccccaacatgatgacagatgtggtgaagctgctgtctgctgtgtgcatcgtgggggaggagagcatcctggaggaggtgctggaggccctgaccagcgctggggaggagaagaagattgaccgcttcttctgcatcgtggagggcctgcggcacaacagcgtgcagctgcaggtggcctgcatgcagctgatcaatgccctggtgaccagcccagatgacctggacttccggctgcacatcagaaatgagttcatgagatgtggcctgaaggagatcctgcccaacctgaagtgcatcaagaatgatggcctggacatccagctgaaggtgtttgatgagcacaaggaggaggacctgtttgagctgagccaccggctggaggacatccgggcagagctggatgaggcctatgatgtgtacaacatggtgtggagcacagtgaaggagaccagggctgagggctacttcatcagcatcctgcagcacctgctgctgatcagaaatgactacttcatccggcagcagtacttcaagctgattgatgaatgtgtgtcccagatcgtgctgcacagagatggcatggaccctgacttcacctacaggaagaggctggacctggacctgacccagtttgtggacatctgcatcgaccaggccaagctggaggagtttgaggagaaggccagcgagctgtacaagaagtttgagaaggagttcacagaccaccaggagacccaggccgagctgcagaagaaggaggccaagatcaatgagctgcaggccgagctgcaggccttcaagagccagtttggagccctgcctgctgactgcaacatccccctgccccccagcaaggagggcggcaccggccacagcgccctgcccccacctccacccctgcccagcggcggcggcgtgcccccacctcctcctcctcctcctcctccacccctgcccggcatgaggatgcccttcagcggccctgtgcccccacctccacccctgggcttcctgggcggccagaacagcccccccctgcccatcctgcccttcggcctgaagcccaagaaggagttcaagccagagatctccatgaggcggctgaactggctgaagatccggccccatgagatgacagagaactgcttctggatcaaggtgaatgaaaacaagtatgaaaatgtggacctgctgtgcaagctggagaacaccttctgctgccagcagaaggagcggcgggaggaggaggacatcgaggagaagaagagcatcaagaagaagatcaaggagctgaagttcctggacagcaagatcgcccagaacctgagcatcttcctgagcagcttccgggtgccctatgaggagatccgcatgatgatcctggaggtggatgagacccggctggccgagagcatgatccagaacctgatcaagcacctgcctgaccaggagcagctgaacagcctgagccagttcaagtctgagtacagcaacctgtgtgagcctgagcagtttgtggtggtgatgagcaatgtgaagaggctgcggccccggctgagcgccatcctcttcaagctgcagtttgaggagcaggtgaacaacatcaagccagacatcatggctgtgtccacagcctgtgaggagatcaagaagagcaagagcttcagcaagctgctggagctggtgctgctgatgggcaactacatgaatgccggcagcagaaatgcccagaccttcggcttcaacctgagcagcctgtgcaagctgaaggacaccaagtctgctgaccagaagaccaccctgctgcacttcctggtggagatctgtgaggagaagtacccagacatcctgaactttgtggatgacctggagcccctggacaaggccagcaaggtgtctgtggagaccctggagaagaacctgcggcagatgggccggcagctgcagcagctggagaaggagctggagaccttccccccacctgaggacctgcatgacaagtttgtgaccaagatgagccgcttcgtcatcagcgccaaggagcagtatgagaccctgagcaagctgcacgagaacatggagaagctgtaccagagcatcatcggctactatgccattgatgtgaagaaggtgtctgtggaggacttcctgacagacctgaacaacttccgcaccaccttcatgcaggccatcaaggagaacatcaagaagcgggaggccgaggagaaggagaagagggtgcgcatcgccaaggagctggccgagcgggagcggctggagcggcagcagaagaagaagaggctgctggagatgaagacagaaggagatgaaacaggagtgatggacaacctgctggaggccctgcagagcggggccgccttccgggacaggaggaagaggacccccatgcccaaggatgtgcggcagagcctgagccccatgagccagaggcctgtgctgaaggtgtgcaaccacgagaaccagaaggtgcagctgacagagggcagccgcagccactacaacatcaactgcaacagcaccaggacccctgtggccaaggagctgaactacaacctggacacccacaccagcacaggccgcatcaaggctgctgagaagaaggaggcctgcaatgtggagagcaacaggaagaaggagacagagctgctgggcagcttcagcaagaatgaatctgtgcctgaggtggaggccctgctggcccggctgcgggccctgtag

SEQ ID NO: 38042 - DNA, 3549 bp, Artificial Sequence
  Description of Artificial Sequence: Synthetic coding sequence
atggagcggcaccagccccggctgcaccacccagcccagggcagcgctgctggcaccccctaccccagcagcgccagcctgcggggctgccgggagagcaagatgcccaggaggaagggcccccagcaccccccaccacccagcggccctgaggagcctggagagaagaggcccaagttcctggacaagtttgccagcatccgcatccctggcagcaagaaggagaggcctcccctgcccaacctgaagacagcctttgccagcagtgactgcagcgctgcccccctggagatgatggagaacttccccaagcccctgtctgaaaatgagctgctggagctgtttgagaagatgatggaggacatgaacctgaatgaagacaagaaggcccccctgcgggagaaggacttcagcatcaagaaggagatggtgatgcagtacatcaacacagccagcaagacaggcagcctgaagaggagccggcagatcagcccccaggagttcatccacgagctgaagatgggcagcgcagatgagcggctggtgacctgcctggagagcctgcgggtgtccctgaccagcaaccctgtgtcctgggtggagagctttggacatgagggcctgggcctgctgctggacatcctggagaagctgatcagcggcaagatccaggagaaggtggtgaagaagaaccagcacaaggtgatccagtgcctgaaggccctgatgaacacccagtatggcctggagcgcatcatgtctgaggagaggagcctgagcctgctggccaaggctgtggaccccaggcaccccaacatgatgacagatgtggtgaagctgctgtctgctgtgtgcatcgtgggggaggagagcatcctggaggaggtgctggaggccctgaccagcgctggggaggagaagaagattgaccgcttcttctgcatcgtggagggcctgcggcacaacagcgtgcagctgcaggtggcctgcatgcagctgatcaatgccctggtgaccagcccagatgacctggacttccggctgcacatcagaaatgagttcatgagatgtggcctgaaggagatcctgcccaacctgaagtgcatcaagaatgatggcctggacatccagctgaaggtgtttgatgagcacaaggaggaggacctgtttgagctgagccaccggctggaggacatccgggcagagctggatgaggcctatgatgtgtacaacatggtgtggagcacagtgaaggagaccagggctgagggctacttcatcagcatcctgcagcacctgctgctgatcagaaatgactacttcatccggcagcagtacttcaagctgattgatgaatgtgtgtcccagatcgtgctgcacagagatggcatggaccctgacttcacctacaggaagaggctggacctggacctgacccagtttgtggacatctgcatcgaccaggccaagctggaggagtttgaggagaaggccagcgagctgtacaagaagtttgagaaggagttcacagaccaccaggagacccaggccgagctgcagaagaaggaggccaagatcaatgagctgcaggccgagctgcaggccttcaagagccagtttggagccctgcctgctgactgcaacatccccctgccccccagcaaggagggcggcaccggccacagcgccctgcccccacctccacccctgcccagcggcggcggcgtgcccccacctcctcctcctcctcctcctccacccctgcccggcatgaggatgcccttcagcggccctgtgcccccacctccacccctgggcttcctgggcggccagaacagcccccccctgcccatcctgcccttcggcctgaagcccaagaaggagttcaagccagagatctccatgaggcggctgaactggctgaagatccggccccatgagatgacagagaactgcttctggatcaaggtgaatgaaaacaagtatgaaaatgtggacctgctgtgcaagctggagaacaccttctgctgccagcagaaggagcggcgggaggaggaggacatcgaggagaagaagagcatcaagaagaagatcaaggagctgaagttcctggacagcaagatcgcccagaacctgagcatcttcctgagcagcttccgggtgccctatgaggagatccgcatgatgatcctggaggtggatgagacccggctggccgagagcatgatccagaacctgatcaagcacctgcctgaccaggagcagctgaacagcctgagccagttcaagtctgagtacagcaacctgtgtgagcctgagcagtttgtggtggtgatgagcaatgtgaagaggctgcggccccggctgagcgccatcctcttcaagctgcagtttgaggagcaggtgaacaacatcaagccagacatcatggctgtgtccacagcctgtgaggagatcaagaagagcaagagcttcagcaagctgctggagctggtgctgctgatgggcaactacatgaatgccggcagcagaaatgcccagaccttcggcttcaacctgagcagcctgtgcaagctgaaggacaccaagtctgctgaccagaagaccaccctgctgcacttcctggtggagatctgtgaggagaagtacccagacatcctgaactttgtggatgacctggagcccctggacaaggccagcaaggtgtctgtggagaccctggagaagaacctgcggcagatgggccggcagctgcagcagctggagaaggagctggagaccttccccccacctgaggacctgcatgacaagtttgtgaccaagatgagcatctttgtgatcagcgccaaggagcagtatgagaccctgagcaagctgcacgagaacatggagaagctgtaccagagcatcatcggctactatgccattgatgtgaagaaggtgtctgtggaggacttcctgacagacctgaacaacttccgcaccaccttcatgcaggccatcaaggagaacatcaagaagcgggaggccgaggagaaggagaagagggtgagaattgccaaggagctggccgagcgggagcggctggagcggcagcagaagaagaagaggctgctggagatgaagacagaaggagatgagaccggggtgatggacaacctgctggaggccctgcagagcggggccgccttccgggacaggaggaagaggacccccatgcccaaggatgtgcggcagagcctgagccccatgagccagaggcctgtgctgaaggtgtgcaaccacgagaaccagaaggtgcagctgacagagggcagccgcagccactacaacatcaactgcaacagcaccaggacccctgtggccaaggagctgaactacaacctggacacccacaccagcacaggccgcatcaaggctgctgagaagaaggaggcctgcaatgtggagagcaacaggaagaaggagacagagctgctgggcagcttcagcaagaatgaatctgtgcctgaggtggaggccctgctggcccggctgcgggccctgtag

SEQ ID NO: 38043 - DNA, 3372 bp, Artificial Sequence
  Description of Artificial Sequence: Synthetic coding sequence
atggagcggcaccagccccggctgcaccacccagcccagggcagcgctgctggcaccccctaccccagcagcgccagcctgcggggctgccgggagagcaagatgcccaggaggaagggcccccagcaccccccaccacccagcggccctgaggagcctggagagaagaggcccaagtttgaggacatgaacctgaatgaagacaagaaggcccccctgcgggagaaggacttcagcatcaagaaggagatggtgatgcagtacatcaacacagccagcaagacaggcagcctgaagaggagccggcagatcagcccccaggagttcatccacgagctgaagatgggcagcgcagatgagcggctggtgacctgcctggagagcctgcgggtgtccctgaccagcaaccctgtgtcctgggtggagagctttggccacgagggcctgggcctgctgctggacatcctggagaagctgatcagcggcaagatccaggagaaggtggtgaagaagaaccagcacaaggtgatccagtgcctgaaggccctgatgaacacccagtatggcctggagcgcatcatgtctgaggagaggagcctgagcctgctggccaaggctgtggaccccaggcaccccaacatgatgacagatgtggtgaagctgctgtctgctgtgtgcatcgtgggggaggagagcatcctggaggaggtgctggaggccctgaccagcgctggggaggagaagaagattgaccgcttcttctgcatcgtggagggcctgcggcacaacagcgtgcagctgcaggtggcctgcatgcagctgatcaatgccctggtgaccagcccagatgacctggacttccggctgcacatcagaaatgagttcatgagatgtggcctgaaggagatcctgcccaacctgaagtgcatcaagaatgatggcctggacatccagctgaaggtgtttgatgagcacaaggaggaggacctgtttgagctgagccaccggctggaggacatccgggcagagctggatgaggcctatgatgtgtacaacatggtgtggagcacagtgaaggagaccagggctgagggctacttcatcagcatcctgcagcacctgctgctgatcagaaatgactacttcatccggcagcagtacttcaagctgattgatgaatgtgtgtcccagatcgtgctgcacagagatggcatggaccctgacttcacctacaggaagaggctggacctggacctgacccagtttgtggacatctgcatcgaccaggccaagctggaggagtttgaggagaaggccagcgagctgtacaagaagtttgagaaggagttcacagaccaccaggagacccaggccgagctgcagaagaaggaggccaagatcaatgagctgcaggccgagctgcaggccttcaagagccagtttggagccctgcctgctgactgcaacatccccctgccccccagcaaggagggcggcaccggccacagcgccctgcccccacctccacccctgcccagcggcggcggcgtgcccccacctcctcctcctcctcctcctccacccctgcccggcatgaggatgcccttcagcggccctgtgcccccacctccacccctgggcttcctgggcggccagaacagcccccccctgcccatcctgcccttcggcctgaagcccaagaaggagttcaagccagagatctccatgaggcggctgaactggctgaagatccggccccatgagatgacagagaactgcttctggatcaaggtgaatgaaaacaagtatgaaaatgtggacctgctgtgcaagctggagaacaccttctgctgccagcagaaggagcggcgggaggaggaggacatcgaggagaagaagagcatcaagaagaagatcaaggagctgaagttcctggacagcaagatcgcccagaacctgagcatcttcctgagcagcttccgggtgccctatgaggagatccgcatgatgatcctggaggtggatgagacccggctggccgagagcatgatccagaacctgatcaagcacctgcctgaccaggagcagctgaacagcctgagccagttcaagtctgagtacagcaacctgtgtgagcctgagcagtttgtggtggtgatgagcaatgtgaagaggctgcggccccggctgagcgccatcctcttcaagctgcagtttgaggagcaggtgaacaacatcaagccagacatcatggctgtgtccacagcctgtgaggagatcaagaagagcaagagcttcagcaagctgctggagctggtgctgctgatgggcaactacatgaatgccggcagcagaaatgcccagaccttcggcttcaacctgagcagcctgtgcaagctgaaggacaccaagtctgctgaccagaagaccaccctgctgcacttcctggtggagatctgtgaggagaagtacccagacatcctgaactttgtggatgacctggagcccctggacaaggccagcaaggtgtctgtggagaccctggagaagaacctgcggcagatgggccggcagctgcagcagctggagaaggagctggagaccttccccccacctgaggacctgcatgacaagtttgtgaccaagatgagcatcttcgtcatcagcgccaaggagcagtatgagaccctgagcaagctgcacgagaacatggagaagctgtaccagagcatcatcggctactatgccattgatgtgaagaaggtgtctgtggaggacttcctgacagacctgaacaacttccgcaccaccttcatgcaggccatcaaggagaacatcaagaagcgggaggccgaggagaaggagaagagggtgcgcatcgccaaggagctggccgagcgggagcggctggagcggcagcagaagaagaagaggctgctggagatgaagacagaaggagatgaaacaggagtgatggacaacctgctggaggccctgcagagcggggccgccttccgggacaggaggaagaggacccccatgcccaaggatgtgcggcagagcctgagccccatgagccagaggcctgtgctgaaggtgtgcaaccacgagaaccagaaggtgcagctgacagagggcagccgcagccactacaacatcaactgcaacagcaccaggacccctgtggccaaggagctgaactacaacctggacacccacaccagcacaggccgcatcaaggctgctgagaagaaggaggcctgcaatgtggagagcaacaggaagaaggagacagagctgctgggcagcttcagcaagaatgaatctgtgcctgaggtggaggccctgctggcccggctgcgggccctgtag

SEQ ID NO: 38044 - DNA, 3582 bp, Artificial Sequence
  Description of Artificial Sequence: Synthetic coding sequence
atggagcggcaccagccccggctgcaccacccagcccagggcagcgctgctggcaccccctaccccagcagcgccagcctgcggggctgccgggagagcaagatgcccaggaggaagggcccccagcaccccccaccacccagcggccctgaggagcctggagagaagaggcccaagttccacctgaacatccgcaccctgacagatgacatgctggacaagtttgccagcatccgcatccctggcagcaagaaggagcggccccccctgcccaacctgaagacagcctttgccagcagtgactgcagcgctgcccccctggagatgatggagaacttccccaagcccctgtctgaaaatgagctgctggagctgtttgagaagatgatggaggacatgaacctgaatgaagacaagaaggcccccctgcgggagaaggacttcagcatcaagaaggagatggtgatgcagtacatcaacacagccagcaagacaggcagcctgaagaggagccggcagatcagcccccaggagttcatccacgagctgaagatgggcagcgcagatgagcggctggtgacctgcctggagagcctgcgggtgtccctgaccagcaaccctgtgtcctgggtggagagctttggccacgagggcctgggcctgctgctggacatcctggagaagctgatcagcggcaagatccaggagaaggtggtgaagaagaaccagcacaaggtgatccagtgcctgaaggccctgatgaacacccagtatggcctggagcgcatcatgtctgaggagaggagcctgagcctgctggccaaggctgtggaccccaggcaccccaacatgatgacagatgtggtgaagctgctgtctgctgtgtgcatcgtgggggaggagagcatcctggaggaggtgctggaggccctgaccagcgctggggaggagaagaagattgaccgcttcttctgcatcgtggagggcctgcggcacaacagcgtgcagctgcaggtggcctgcatgcagctgatcaatgccctggtgaccagcccagatgacctggacttccggctgcacatcagaaatgagttcatgagatgtggcctgaaggagatcctgcccaacctgaagtgcatcaagaatgatggcctggacatccagctgaaggtgtttgatgagcacaaggaggaggacctgtttgagctgagccaccggctggaggacatccgggcagagctggatgaggcctatgatgtgtacaacatggtgtggagcacagtgaaggagaccagggctgagggctacttcatcagcatcctgcagcacctgctgctgatcagaaatgactacttcatccggcagcagtacttcaagctgattgatgaatgtgtgtcccagatcgtgctgcacagagatggcatggaccctgacttcacctacaggaagaggctggacctggacctgacccagtttgtggacatctgcatcgaccaggccaagctggaggagtttgaggagaaggccagcgagctgtacaagaagtttgagaaggagttcacagaccaccaggagacccaggccgagctgcagaagaaggaggccaagatcaatgagctgcaggccgagctgcaggccttcaagagccagtttggagccctgcctgctgactgcaacatccccctgccccccagcaaggagggcggcaccggccacagcgccctgcccccacctccacccctgcccagcggcggcggcgtgcccccacctcctcctcctcctcctcctccacccctgcccggcatgaggatgcccttcagcggccctgtgcccccacctccacccctgggcttcctgggcggccagaacagcccccccctgcccatcctgcccttcggcctgaagcccaagaaggagttcaagccagagatctccatgaggcggctgaactggctgaagatccggccccatgagatgacagagaactgcttctggatcaaggtgaatgaaaacaagtatgaaaatgtggacctgctgtgcaagctggagaacaccttctgctgccagcagaaggagcggcgggaggaggaggacatcgaggagaagaagagcatcaagaagaagatcaaggagctgaagttcctggacagcaagatcgcccagaacctgagcatcttcctgagcagcttccgggtgccctatgaggagatccgcatgatgatcctggaggtggatgagacccggctggccgagagcatgatccagaacctgatcaagcacctgcctgaccaggagcagctgaacagcctgagccagttcaagtctgagtacagcaacctgtgtgagcctgagcagtttgtggtggtgatgagcaatgtgaagaggctgcggccccggctgagcgccatcctcttcaagctgcagtttgaggagcaggtgaacaacatcaagccagacatcatggctgtgtccacagcctgtgaggagatcaagaagagcaagagcttcagcaagctgctggagctggtgctgctgatgggcaactacatgaatgccggcagcagaaatgcccagaccttcggcttcaacctgagcagcctgtgcaagctgaaggacaccaagtctgctgaccagaagaccaccctgctgcacttcctggtggagatctgtgaggagaagtacccagacatcctgaactttgtggatgacctggagcccctggacaaggccagcaaggtgtctgtggagaccctggagaagaacctgcggcagatgggccggcagctgcagcagctggagaaggagctggagaccttccccccacctgaggacctgcatgacaagtttgtgaccaagatgagcatcttcgtcatcagcgccaaggagcagtatgagaccctgagcaagctgcacgagaacatggagaagctgtaccagagcatcatcggctactatgccattgatgtgaagaaggtgtctgtggaggacttcctgacagacctgaacaacttccgcaccaccttcatgcaggccatcaaggagaacatcaagaagcgggaggccgaggagaaggagaagagggtgcgcatcgccaaggagctggccgagcgggagcggctggagcggcagcagaagaagaagaggctgctggagatgaagacagaaggagatgaaacaggagtgatggacaacctgctggaggccctgcagagcggggccgccttccgggacaggaggaagaggacccccatgcccaaggatgtgcggcagagcctgagccccatgagccagaggcctgtgctgaaggtgtgcaaccacgagaaccagaaggtgcagctgacagagggcagccgcagccactacaacatcaactgcaacagcaccaggacccctgtggccaaggagctgaactacaacctggacacccacaccagcacaggccgcatcaaggctgctgagaagaaggaggcctgcaatgtggagagcaacaggaagaaggagacagagctgctgggcagcttcagcaagaatgaatctgtgcctgaggtggaggccctgctggcccggctgcgggccctgtag

SEQ ID NO: 38045 - DNA, 3444 bp, Artificial Sequence
  Description of Artificial Sequence: Synthetic coding sequence
atggagcggcaccagccccggctgcaccacccagcccagggcagcgctgctggcaccccctaccccagcagcgccagcctgcggggctgccgggagagcaagatgcccaggaggaagggcccccagcaccccccaccacccagcggccctgaggagcctggagagaagaggcccaagttcctggacaagtttgccagcatccgcatccctggcagcaagaaggagaggcctcccctgcccaacctgaagacagcctttgccagcagtgactgcagcgctgcccccctggagatgatggagaacttccccaagcccctgtctgaaaatgagctgctggagctgtttgagaagatgatgggcagcctgaagaggagccggcagatcagcccccaggagttcatccacgagctgaagatgggcagcgcagatgagcggctggtgacctgcctggagagcctgcgggtgtccctgaccagcaaccctgtgtcctgggtggagagctttggccacgagggcctgggcctgctgctggacatcctggagaagctgatcagcggcaagatccaggagaaggtggtgaagaagaaccagcacaaggtgatccagtgcctgaaggccctgatgaacacccagtatggcctggagcgcatcatgtctgaggagaggagcctgagcctgctggccaaggctgtggaccccaggcaccccaacatgatgacagatgtggtgaagctgctgtctgctgtgtgcatcgtgggggaggagagcatcctggaggaggtgctggaggccctgaccagcgctggggaggagaagaagattgaccgcttcttctgcatcgtggagggcctgcggcacaacagcgtgcagctgcaggtggcctgcatgcagctgatcaatgccctggtgaccagcccagatgacctggacttccggctgcacatcagaaatgagttcatgagatgtggcctgaaggagatcctgcccaacctgaagtgcatcaagaatgatggcctggacatccagctgaaggtgtttgatgagcacaaggaggaggacctgtttgagctgagccaccggctggaggacatccgggcagagctggatgaggcctatgatgtgtacaacatggtgtggagcacagtgaaggagaccagggctgagggctacttcatcagcatcctgcagcacctgctgctgatcagaaatgactacttcatccggcagcagtacttcaagctgattgatgaatgtgtgtcccagatcgtgctgcacagagatggcatggaccctgacttcacctacaggaagaggctggacctggacctgacccagtttgtggacatctgcatcgaccaggccaagctggaggagtttgaggagaaggccagcgagctgtacaagaagtttgagaaggagttcacagaccaccaggagacccaggccgagctgcagaagaaggaggccaagatcaatgagctgcaggccgagctgcaggccttcaagagccagtttggagccctgcctgctgactgcaacatccccctgccccccagcaaggagggcggcaccggccacagcgccctgcccccacctccacccctgcccagcggcggcggcgtgcccccacctcctcctcctcctcctcctccacccctgcccggcatgaggatgcccttcagcggccctgtgcccccacctccacccctgggcttcctgggcggccagaacagcccccccctgcccatcctgcccttcggcctgaagcccaagaaggagttcaagccagagatctccatgaggcggctgaactggctgaagatccggccccatgagatgacagagaactgcttctggatcaaggtgaatgaaaacaagtatgaaaatgtggacctgctgtgcaagctggagaacaccttctgctgccagcagaaggagcggcgggaggaggaggacatcgaggagaagaagagcatcaagaagaagatcaaggagctgaagttcctggacagcaagatcgcccagaacctgagcatcttcctgagcagcttccgggtgccctatgaggagatccgcatgatgatcctggaggtggatgagacccggctggccgagagcatgatccagaacctgatcaagcacctgcctgaccaggagcagctgaacagcctgagccagttcaagtctgagtacagcaacctgtgtgagcctgagcagtttgtggtggtgatgagcaatgtgaagaggctgcggccccggctgagcgccatcctcttcaagctgcagtttgaggagcaggtgaacaacatcaagccagacatcatggctgtgtccacagcctgtgaggagatcaagaagagcaagagcttcagcaagctgctggagctggtgctgctgatgggcaactacatgaatgccggcagcagaaatgcccagaccttcggcttcaacctgagcagcctgtgcaagctgaaggacaccaagtctgctgaccagaagaccaccctgctgcacttcctggtggagatctgtgaggagaagtacccagacatcctgaactttgtggatgacctggagcccctggacaaggccagcaaggtgtctgtggagaccctggagaagaacctgcggcagatgggccggcagctgcagcagctggagaaggagctggagaccttccccccacctgaggacctgcatgacaagtttgtgaccaagatgagcatcttcgtcatcagcgccaaggagcagtatgagaccctgagcaagctgcacgagaacatggagaagctgtaccagagcatcatcggctactatgccattgatgtgaagaaggtgtctgtggaggacttcctgacagacctgaacaacttccgcaccaccttcatgcaggccatcaaggagaacatcaagaagcgggaggccgaggagaaggagaagagggtgcgcatcgccaaggagctggccgagcgggagcggctggagcggcagcagaagaagaagaggctgctggagatgaagacagaaggagatgaaacaggagtgatggacaacctgctggaggccctgcagagcggggccgccttccgggacaggaggaagaggacccccatgcccaaggatgtgcggcagagcctgagccccatgagccagaggcctgtgctgaaggtgtgcaaccacgagaaccagaaggtgcagctgacagagggcagccgcagccactacaacatcaactgcaacagcaccaggacccctgtggccaaggagctgaactacaacctggacacccacaccagcacaggccgcatcaaggctgctgagaagaaggaggcctgcaatgtggagagcaacaggaagaaggagacagagctgctgggcagcttcagcaagaatgaatctgtgcctgaggtggaggccctgctggcccggctgcgggccctgtag

SEQ ID NO: 38046 - DNA, 3051 bp, Artificial Sequence
  Description of Artificial Sequence: Synthetic coding sequence
atggagcggcaccagccccggctgcaccacccagcccagggcagcgctgctggcaccccctaccccagcagcgccagcctgcggggctgccgggagagcaagatgcccaggaggaagggcccccagcaccccccaccacccagcggccctgaggagcctggagagaagaggcccaagttccacctgaacatccgcaccctgacagatgacatgctggacaagtttgccagcatccgcatccctggcagcaagaaggagcggccccccctgcccaacctgaagacagcctttgccagcagtgactgcagcgctgcccccctggagatgatggagaacttccccaagcccctgtctgaaaatgagctgctggagctgtttgagaagatgatggaggacatgaacctgaatgaagacaagaaggcccccctgcgggagaaggacttcagcatcaagaaggagatggtgatgcagtacatcaacacagccagcaagacaggcagcctgaagaggagccggcagatcagcccccaggagttcatccacgagctgaagatgggcagcgcagatgagcggctggtgacctgcctggagagcctgcgggtgtccctgaccagcaaccctgtgtcctgggtggagagctttggccacgagggcctgggcctgctgctggacatcctggagaagctgatcagcggcaagatccaggagaaggtggtgaagaagaaccagcacaaggtgatccagtgcctgaaggccctgatgaacacccagtatggcctggagcgcatcatgtctgaggagaggagcctgagcctgctggccaaggctgtggaccccaggcaccccaacatgatgacagatgtggtgaagctgctgtctgctgtgtgcatcgtgggggaggagagcatcctggaggaggtgctggaggccctgaccagcgctggggaggagaagaagattgaccgcttcttctgcatcgtggagggcctgcggcacaacagcgtgcagctgcaggtggcctgcatgcagctgatcaatgccctggtgaccagcccagatgacctggacttccggctgcacatcagaaatgagttcatgagatgtggcctgaaggagatcctgcccaacctgaagtgcatcaagaatgatggcctggacatccagctgaaggtgtttgatgagcacaaggaggaggacctgtttgagctgagccaccggctggaggacatccgggcagagctggatgaggcctatgatgtgtacaacatggtgtggagcacagtgaaggagaccagggctgagggctacttcatcagcatcctgcagcacctgctgctgatcagaaatgactacttcatccggcagcagtacttcaagctgattgatgaatgtgtgtcccagatcgtgctgcacagagatggcatggaccctgacttcacctacaggaagaggctggacctggacctgacccagtttgtggacatctgcatcgaccaggccaagctggaggagtttgaggagaaggccagcgagctgtacaagaagtttgagaaggagttcacagaccaccaggagacccaggccgagctgcagaagaaggaggccaagatcaatgagctgcaggccgagctgcaggccttcaagagccagtttggagccctgcctgctgactgcaacatccccctgccccccagcaaggagggcggcaccggccacagcgccctgcccccacctccacccctgcccagcggcggcggcgtgcccccacctcctcctcctcctcctcctccacccctgcccggcatgaggatgcccttcagcggccctgtgcccccacctccacccctgggcttcctgggcggccagaacagcccccccctgcccatcctgcccttcggcctgaagcccaagaaggagttcaagccagagatctccatgaggcggctgaactggctgaagatccggccccatgagatgacagagaactgcttctggatcaaggtgaatgaaaacaagtatgaaaatgtggacctgctgtgcaagctggagaacaccttctgctgccagcagaaggagcggcgggaggaggaggacatcgaggagaagaagagcatcaagaagaagatcaaggagctgaagttcctggacagcaagatcgcccagaacctgagcatcttcctgagcagcttccgggtgccctatgaggagatccgcatgatgatcctggaggtggatgagacccggctggccgagagcatgatccagaacctgatcaagcacctgcctgaccaggagcagctgaacagcctgagccagttcaagtctgagtacagcaacctgtgtgagcctgagcagtttgtggtggtgatgagcaatgtgaagaggctgcggccccggctgagcgccatcctcttcaagctgcagtttgaggagcaggtgaacaacatcaagccagacatcatggctgtgtccacagcctgtgaggagatcaagaagagcaagagcttcagcaagctgctggagctggtgctgctgatgggcaactacatgaatgccggcagcagaaatgcccagaccttcggcttcaacctgagcagcctgtgcaagctgaaggacaccaagtctgctgaccagaagaccaccctgctgcacttcctggtggagatctgtgaggagaagtacccagacatcctgaactttgtggatgacctggagcccctggacaaggccagcaaggtgtctgtggagaccctggagaagaacctgcggcagatgggccggcagctgcagcagctggagaaggagctggagaccttccccccacctgaggacctgcatgacaagtttgtgaccaagatgagcatcttcgtcatcagcgccaaggagcagtatgagaccctgagcaagctgcacgagaacatggagaagctgtaccagagcatcatcggctactatgccattgatgtgaagaaggtgtctgtggaggacttcctgacagacctgaacaacttccgcaccaccttcatgaaggccatcaagttccagatctag

SEQ ID NO: 38047 - DNA, 3339 bp, Artificial Sequence
  Description of Artificial Sequence: Synthetic coding sequence
atggagcggcaccagccccggctgcaccacccagcccagggcagcgctgctggcaccccctaccccagcagcgccagcctgcggggctgccgggagagcaagatgcccaggaggaagggcccccagcaccccccaccacccagcggccctgaggagcctggagagaagaggcccaagttccacctgaacatccgcaccctgacagatgacatgctggacaagtttgccagcatccgcatccctggcagcaagaaggagcggccccccctgcccaacctgaagacagcctttgccagcagtgactgcagcgctgcccccctggagatgatggagaacttccccaagcccctgtctgaaaatgagctgctggagctgtttgagaagatgatggaggacatgaacctgaatgaagacaagaaggcccccctgcgggagaaggacttcagcatcaagaaggagatggtgatgcagtacatcaacacagccagcaagacaggcagcctgaagaggagccggcagatcagcccccaggagttcatccacgagctgaagatgggcagcgcagatgagcggctggtgacctgcctggagagcctgcgggtgtccctgaccagcaaccctgtgtcctgggtggagagctttggccacgagggcctgggcctgctgctggacatcctggagaagctgatcagcggcaagatccaggagaaggtggtgaagaagaaccagcacaaggtgatccagtgcctgaaggccctgatgaacacccagtatggcctggagcgcatcatgtctgaggagaggagcctgagcctgctggccaaggctgtggaccccaggcaccccaacatgatgacagatgtggtgaagctgctgtctgctgtgtgcatcgtgggggaggagagcatcctggaggaggtgctggaggccctgaccagcgctggggaggagaagaagattgaccgcttcttctgcatcgtggagggcctgcggcacaacagcgtgcagctgcaggtggcctgcatgcagctgatcaatgccctggtgaccagcccagatgacctggacttccggctgcacatcagaaatgagttcatgagatgtggcctgaaggagatcctgcccaacctgaagtgcatcaagaatgatggcctggacatccagctgaaggtgtttgatgagcacaaggaggaggacctgtttgagctgagccaccggctggaggacatccgggcagagctggatgaggcctatgatgtgtacaacatggtgtggagcacagtgaaggagaccagggctgagggctacttcatcagcatcctgcagcacctgctgctgatcagaaatgactacttcatccggcagcagtacttcaagctgattgatgaatgtgtgtcccagatcgtgctgcacagagatggcatggaccctgacttcacctacaggaagaggctggacctggacctgacccagtttgtggacatctgcatcgaccaggccaagctggaggagtttgaggagaaggccagcgagctgtacaagaagtttgagaaggagttcacagaccaccaggagacccaggccgagctgcagaagaaggaggccaagatcaatgagctgcaggccgagctgcaggccttcaagagccagtttggagccctgcctgctgactgcaacatccccctgccccccagcaaggagggcggcaccggccacagcgccctgcccccacctccacccctgcccagcggcggcggcgtgcccccacctcctcctcctcctcctcctccacccctgcccggcatgaggatgcccttcagcggccctgtgcccccacctccacccctgggcttcctgggcggccagaacagcccccccctgcccatcctgcccttcggcctgaagcccaagaaggagttcaagccagagatctccatgaggcggctgaactggctgaagatccggccccatgagatgacagagaactgcttctggatcaaggtgaatgaaaacaagtatgaaaatgtggacctgctgtgcaagctggagaacaccttctgctgccagcagaaggagcggcgggaggaggaggacatcgaggagaagaagagcatcaagaagaagatcaaggagctgaagttcctggacagcaagatcgcccagaacctgagcatcttcctgagcagcttccgggtgccctatgaggagatccgcatgatgatcctggaggtggatgagacccggctggccgagagcatgatccagaacctgatcaagcacctgcctgaccaggagcagctgaacagcctgagccagttcaagtctgagtacagcaacctgtgtgagcctgagcagtttgtggtggtgatgagcaatgtgaagaggctgcggccccggctgagcgccatcctcttcaagctgcagtttgaggagcaggtgaacaacatcaagccagacatcatggctgtgtccacagcctgtgaggagatcaagaagagcaagagcttcagcaagctgctggagctggtgctgctgatgggcaactacatgaatgccggcagcagaaatgcccagaccttcggcttcaacctgagcagcctgtgcaagctgaaggacaccaagtctgctgaccagaagaccaccctgctgcacttcctggtggagatctgtgaggagaagtacccagacatcctgaactttgtggatgacctggagcccctggacaaggccagcaaggtgtctgtggagaccctggagaagaacctgcggcagatgggccggcagctgcagcagctggagaaggagctggagaccttccccccacctgaggacctgcatgacaagtttgtgaccaagatgagccgcttcgtcatcagcgccaaggagcagtatgagaccctgagcaagctgcacgagaacatggagaagctgtaccagagcatcatcggctactatgccattgatgtgaagaaggtgtctgtggaggacttcctgacagacctgaacaacttccgcaccaccttcatgcaggccatcaaggagaacatcaagaagcgggaggccgaggagaaggagaagagggtgcgcatcgccaaggagctggccgagcgggagcggctggagcggcagcagaagaagaagaggctgctggagatgaagacagaaggagatgaaacaggagtgatggacaacctgctggaggccctgcagagcggggccgccttccgggacaggaggaagaggacccccatgcccaaggatgtgcggcagagcctgagccccatgagccagaggcctgtgctgaaggtgtgcaaccacggcaacaagccctacctgtag

SEQ ID NO: 38048 - DNA, 1866 bp, Artificial Sequence
  Description of Artificial Sequence: Synthetic coding sequence
atgtgcagcggctggagcagcagcgtcatctggaggcacacccagtttgctgtggagcgctgtggcttctgtggcagcagcggccctggggcccccctggagcccagcaccctgggcagcaagcacctgccctgggaggccgtgtctgctggctttgctgacaggaacagaaacatggatggagccatgtggctgagcctgtgcccagacaatgaagacctgctgtggaggaagaagcacaagctgctgcaggcccggggcaagggggacctggccctgcagaggagagcagatgccaagctgtggaagaactaccagctgcagaggctggccgaggagctgcggcggggctaccaggaggcccagcacctgcacgtgggcggcctggaccggctgcagagcgcccggctgctgggctggggcggcggccgggccagagaaaatgaaccagacagccagggccccatccagaggagaagtgcccggcccccccgggccaaggagaagcaccgggccgccctgtctgaggagaggagctgccgggaggagctgggccagcagcaccccaggcacagccggcccaggaagacagctgccagccctgagaagccccagaccaccaaggccaccggccgcatgaacagccacctggcccctcctgagaagaggaagggccggcctgagcccagcaccaagagcggcggcggccgctgtgccatccaccccaggaggagcaaaggagctgacctggagaggagcaaccccctggtggccgctgtgggggagatcggcctggtggaggagaaggagaagggcacagcccgggccggccggcggcagctgggcaaaggagctgtgtgctttgtgcctgccctgaccagccgcagccagggccagagcctggagggcaagctgcgggacctgggccagctgtggccagctgacagcagctgcagaagagaggccgtgtccccagccagccagtgcaccctgcgggagaagaacaagtggcagaaggagctggagctggcctttgaggagctgttcaacatcaacaggaagctgaagaagcacctgtgcctgtacctggccctgaagcccaggatggaccagaggcctggagagggccacgccttcagcgagatgcaggagtgtggggccggcaccccccggggcaagaagatggctgaccctgagatgctgcctgctggggagcccaggagccctgctgaggaggaggcccagcaggccgccagcaagacagacctgaagaccttcatgggcaaggcccagaaccagaagtaccagggcaccgtgaagcccaccttcagaaatggcagccagaccctgagccctgaggccggcatcttcatcaacaaggaggacagcctgctgtacagcacagagagcggccaggagacccccaagctgggcaccctggccgagggcagcctgcagctgcacctgcaggaccaggccgacagagtgggcagcacagccagccggcagaggcagaaggccgagatggagcagaggcggcagaagcagctggagagcctggagcagatggagcacccagacatgagcctggagatccactacaaggccgagctggagaaggagcggcgggagcagaggcgggcccggctggcccacctgaagagcagcagcacccgggcccaggagcgggagcggggcagcgagctgagcaccaccagccccagcggcaccagcctggctgatgatgacagacacagccagatgatccgggaccagcagcagcagatcctgcagcagaaccggctgcacaagcagttcctggaggaggccaggaagtgcctgcgggagttccagaacatctgctag

SEQ ID NO: 38049 - DNA, 1539 bp, Artificial Sequence
  Description of Artificial Sequence: Synthetic coding sequence
atggccatcctgagcctgcgggcccctggcccctggcaggccatgcaggtgtgggccgacaggaccctgctgaccccccacactggagtgaccagccaggtgctgggcgtggccgctgctgtgatgacccccctgcccggcggccacgccgccggccgcacccgggaggcccgctgggatgccatggagtatgatgagaagctggcccgcttccggcaggcccacctgaaccccttcaacaagcagagcggcccccggcagcacgagcagggccctggagaggaggtgcctgatgtgaccccagaggaggccctgcctgagctgcccccaggagagcctgagttccgctgcccagagcgggtgatggacctgggcctgtctgaggaccacttcagcaggcctgtgggcctcttcctggccagtgatgtgcagcagctgcggcaggccatcgaggagtgcaagcaggtgatcctggagctgcctgagcagagcgagaagcagaaggatgctgtggtgcggctcatccacctgcggctgaagctgcaggagctgaaggaccccaatgaagatgagcccaacatccgggtgctgctggagcaccgcttctacaaggagaagagcaagtctgtgaagcagacctgtgacaagtgcaacaccatcatctggggcctcatccagacctggtacacctgcaccggctgctactaccgctgccacagcaagtgcctgaacctgatcagcaagccctgtgtgagcagcaaggtgagccaccaggccgagtatgagctgaacatctgcccagagaccggcctggacagccaggactaccgctgtgccgagtgccgggcccccatcagcctgcggggcgtgcccagcgaggcccggcagtgtgactacacaggccagtactactgcagccactgccactggaatgacctggccgtcatcccagcccgggtggtgcacaactgggactttgagcccaggaaggtgagccgctgcagcatgagatacctggccctgatggtgtccaggcctgtgctgcggctgcgggagatcaaccccctgctcttctcctatgtggaggagctggtggagatcaggaagctgcggcaggacatcctgctgatgaagccctacttcatcacctgccgggaggccatggaggcccggctgctgctgcagctgcaggaccggcagcactttgtggagaatgatgagatgtacagcgtgcaggacctgctggatgtgcatgctggccgcctgggctgcagcctgacagagatccacaccctgtttgccaagcacatcaagctggactgtgagcgctgccaggccaagggctttgtgtgtgagctgtgccgggagggagatgtgctcttcccctttgacagccacacctctgtgtgtgccgactgcagcgctgtgttccaccgggactgctactatgacaacagcaccacctgccccaagtgtgcccggctgagcctgaggaagcagagcctcttccaggagcccggcccagatgtggaggcctag

SEQ ID NO: 38050 - DNA, 594 bp, Artificial Sequence
  Description of Artificial Sequence: Synthetic coding sequence
atggagtatgatgagaagctggcccgcttccggcaggcccacctgaaccccttcaacaagcagagcggcccccggcagcacgagcagggccctggagaggaggtgcctgatgtgaccccagaggaggccctgcctgagctgcccccaggagagcctgagttccgctgcccagagcgggtgatggacctgggcctgtctgaggaccacttcagcaggcctgtgggcctcttcctggccagtgatgtgcagcagctgcggcaggccatcgaggagtgcaagcaggtgatcctggagctgcctgagcagagcgagaagcagaaggatgctgtggtgcggctcatccacctgcggctgaagctgcaggagctgaaggaccccaatgaagatgagcccaacatccgggtgctgctggagcaccgcttctacaaggagaagagcaagtctgtgaagcagacctgtgacaagtgcaacaccatcatctggggcctcatccagacctggtacacctgcacaggaggcccccggcccaggagaggagtgagaaatgaaagagaccagagcagctgcctgcgctgggcccacatccagatgtag

SEQ ID NO: 38051 - DNA, 1356 bp, Artificial Sequence
  Description of Artificial Sequence: Synthetic coding sequence
atggagtatgatgagaagctggcccgcttccggcaggcccacctgaaccccttcaacaagcagagcggcccccggcagcacgagcagggccctggagaggaggtgcctgatgtgaccccagaggaggccctgcctgagctgcccccaggagagcctgagttccgctgcccagagcgggtgatggacctgggcctgtctgaggaccacttcagcaggcctgtgggcctcttcctggccagtgatgtgcagcagctgcggcaggccatcgaggagtgcaagcaggtgatcctggagctgcctgagcagagcgagaagcagaaggatgctgtggtgcggctcatccacctgcggctgaagctgcaggagctgaaggaccccaatgaagatgagcccaacatccgggtgctgctggagcaccgcttctacaaggagaagagcaagtctgtgaagcagacctgtgacaagtgcaacaccatcatctggggcctcatccagacctggtacacctgcaccggctgctactaccgctgccacagcaagtgcctgaacctgatcagcaagccctgtgtgagcagcaaggtgagccaccaggccgagtatgagctgaacatctgcccagagaccggcctggacagccaggactaccgctgtgctgaatgtcgggcccccatcagcctgcggggcgtgcccagcgaggcccggcagtgtgactacacaggccagtactactgcagccactgccactggaatgacctggccgtcatcccagcccgggtggtgcacaactgggactttgagcccaggaaggtgagccgctgcagcatgagatacctggccctgatggtgtccaggcctgtgctgcggctgcgggagatcaaccccctgctcttctcctatgtggaggagctggtggagatcaggaagctgcggcaggacatcctgctgatgaagccctacttcatcacctgccgggaggccatggaggcccggctgctgctgcagctgcaggaccggcagcactttgtggagaatgatgagatgtacagcgtgcaggacctgctggatgtgcacgccggccgcctgggctgcagcctgacagagatccacaccctgtttgccaagcacatcaagctggactgtgagcgctgccaggccaagggctttgtgtgtgagctgtgccgggagggagatgtgctcttcccctttgacagccacacctctgtgtgtgccgactgcagcgctgtgttccaccgggactgctactatgacaacagcaccacctgccccaagtgtgcccggctgagcctgaggaagcagagcctcttccaggagcccggcccagatgtggaggcctag

SEQ ID NO: 38052 - DNA, 1326 bp, Artificial Sequence
  Description of Artificial Sequence: Synthetic coding sequence
atggagtatgatgagaagctggcccgcttccggcaggcccacctgaaccccttcaacaagcagagcggcccccggcagcacgagcagggccctggagaggaggtgcctgatgtgaccccagaggaggccctgcctgagctgcccccaggagagcctgagttccgctgcccagagcgggtgatggacctgggcctgtctgaggaccacttcagcaggcctgtgctgcggcaggccatcgaggagtgcaagcaggtgatcctggagctgcctgagcagagcgagaagcagaaggatgctgtggtgcggctcatccacctgcggctgaagctgcaggagctgaaggaccccaatgaagatgagcccaacatccgggtgctgctggagcaccgcttctacaaggagaagagcaagtctgtgaagcagacctgtgacaagtgcaacaccatcatctggggcctcatccagacctggtacacctgcaccggctgctactaccgctgccacagcaagtgcctgaacctgatcagcaagccctgtgtgagcagcaaggtgagccaccaggccgagtatgagctgaacatctgcccagagaccggcctggacagccaggactaccgctgtgctgaatgtcgggcccccatcagcctgcggggcgtgcccagcgaggcccggcagtgtgactacacaggccagtactactgcagccactgccactggaatgacctggccgtcatcccagcccgggtggtgcacaactgggactttgagcccaggaaggtgagccgctgcagcatgagatacctggccctgatggtgtccaggcctgtgctgcggctgcgggagatcaaccccctgctcttctcctatgtggaggagctggtggagatcaggaagctgcggcaggacatcctgctgatgaagccctacttcatcacctgccgggaggccatggaggcccggctgctgctgcagctgcaggaccggcagcactttgtggagaatgatgagatgtacagcgtgcaggacctgctggatgtgcacgccggccgcctgggctgcagcctgacagagatccacaccctgtttgccaagcacatcaagctggactgtgagcgctgccaggccaagggctttgtgtgtgagctgtgccgggagggagatgtgctcttcccctttgacagccacacctctgtgtgtgccgactgcagcgctgtgttccaccgggactgctactatgacaacagcaccacctgccccaagtgtgcccggctgagcctgaggaagcagagcctcttccaggagcccggcccagatgtggaggcctag

SEQ ID NO: 38053 - DNA, 1563 bp, Artificial Sequence
  Description of Artificial Sequence: Synthetic coding sequence
atgagccaggacaatgacaccctgatgagggacatcctgggccacgagctggccgccatgaggctgcagaagctggagcagcagaggcggctgtttgagaagaagcagaggcagaagaggcaggagctgctgatggtgcaggccaacccagatgccagcccctggctgtggaggagctgcctgcgggaggagcggctgctgggggaccggggcctgggcaaccccttcctgaggaagaaggtgtctgaggcccacctgcccagcggcatccacagcgccctgggcaccgtgtcctgtggaggagatggccgcggggagcggggcctgcccacccccaggacagaggccgtgttcaggaacctgggcctgcagagccccttcctgtcctggctgcctgacaacagtgatgctgagctggaggaggtgtctgtggagaatggatctgtgtccccaccacccttcaagcagagcccccgcatccggaggaagggctggcaggcccaccagaggcctggcaccagggctgagggggagagtgacagccaggacatgggagatgcccacaagagccccaacatgggccccaaccctggcatggatggagactgtgtgtatgagaacctggccttccagaaggaggaggacctggagaagaagcgggaggccagcgagagcacaggcaccaacagcagcgctgcccacaatgaggagctgagcaaggccctgaagggggagggcggcacagacagcgaccacatgagacatgaggccagcctggccatccgcagcccctgccccggcctggaggaggacatggaggcctacgtgctgcggcctgccctgcccggcaccatgatgcagtgctacctgacccgggacaagcatggagtggacaagggcctcttccccctgtactacctgtacctggagaccagtgacagcctgcagcgcttcctgctggccggcaggaagagaagaagaagcaagaccagcaactacctgatcagcctggaccccacccacctgagcagagatggagacaactttgtgggcaaggtgcgcagcaatgtgttcagcaccaagttcaccatctttgacaatggagtgaacccagaccgggagcacctgaccaggaacacagcccgcatccggcaggagctgggcgctgtgtgctatgagcccaacgtgctgggctacctgggccccaggaagatgaccgtcatcctgcccggcaccaacagccagaaccagaggatcaacgtgcagcccctgaatgagcaggagagcctgctgagccgctaccagagaggagacaagcagggcctgctgctgctgcacaacaagacccccagctgggacaaggaaaatggagtgtacaccctgaacttccacggccgggtgacccgggcctctgtgaagaacttccagatcgtggaccccaagcaccaggagcacctggtgctgcagtttggccgggtgggccctgacaccttcaccatggacttctgcttccccttcagccccctgcaggccttcagcatctgcctgagcagcttcaactag

SEQ ID NO: 38054 - DNA, 1422 bp, Artificial Sequence
  Description of Artificial Sequence: Synthetic coding sequence
atgcccaagctgcagggctttgagttctggagcaggaccctgcggggggcccggcacgtggtggcccccatggtggaccagagcgagctggcctggaggctgctgagcagaagacatggagcccagctgtgctacacccccatgctgcacgcccaggtgtttgtgagagatgccaactacagaaaagaaaatctctactgtgaggtgtgcccagaggaccggcccctgattgtgcagttctgtgccaatgaccctgaggtgtttgtgcaggccgccctgctggcccaggactactgtgatgccatcgacctgaacctgggctgcccccagatgattgccaagaggggccactacggggccttcctgcaggatgagtgggacctgctgcagaggatgatcctgctggcccacgagaagctgtctgtgcctgtgacctgcaagatccgggtcttccctgagattgacaagacagtgcgctatgcccagatgctggagaaggccggctgccagctgctgactgtgcacggccgcaccaaggagcagaagggccccctgagcggggccgcctcctgggagcacatcaaggctgtgaggaaggctgtggccatccctgtgtttgccaacggcaacatccagtgcctgcaggatgtggagcgctgcctgcgggacaccggggtgcagggcgtgatgtctgctgagggcaacctgcacaacccagccctgtttgagggccgcagccctgctgtgtgggagctggccgaggagtacctggacatcgtgcgggagcacccctgccccctgtcctatgtgcgggcccacctgttcaagctgtggcaccacaccctgcaggtgcaccaggagctgcgggaggagctggccaaggtgaagaccctggagggcattgctgctgtgtcccaggagctgaagctgcgctgccaggaggagatcagccggcaggagggcgccaagcccactggagacctgcccttccactggatctgccagccctacatccggcccggcccccgggagggcagcaaggagaaggccggggcccggagcaagagggccctggaggaggaggagggcggcacagaggtgctgagcaagaacaagcagaagaagcagctgaggaacccccacaagacctttgaccccagcctgaagcccaagtatgccaagtgtgaccagtgtggcaaccccaagggcaacagatgtgtgttcagcctgtgccggggctgctgcaagaagagggccagcaaggagacagctgactgccccggccacggcctgctcttcaagaccaagctggagaagagcctggcctggaaggaggcccagcctgagctgcaggagccccagcctgctgcccctggcaccccaggcggcttcagcgaggtgatgggcagcgccctggcctag

SEQ ID NO: 38055 - DNA, 1422 bp, Artificial Sequence; identical to SEQ ID NO: 38054
  Description of Artificial Sequence: Synthetic coding sequence

SEQ ID NO: 38056 - DNA, 894 bp, Artificial Sequence
  Description of Artificial Sequence: Synthetic coding sequence
cccagctttgctggcccccgggagaccctgcctgtgacctgcaagatccgggtcttccctgagattgacaagacagtgcgctatgcccagatgctggagaaggccggctgccagctgctgactgtgcacggccgcaccaaggagcagaagggccccctgagcggggccgcctcctgggagcacatcaaggctgtgaggaaggctgtggccatccctgtgtttgccaacggcaacatccagtgcctgcaggatgtggagcgctgcctgcgggacaccggggtgcagggcgtgatgtctgctgagggcaacctgcacaacccagccctgtttgagggccgcagccctgctgtgtgggagctggccgaggagtacctggacatcgtgcgggagcacccctgccccctgtcctatgtgcgggcccacctgttcaagctgtggcaccacaccctgcaggtgcaccaggagctgcgggaggagctggccaaggtgaagaccctggagggcattgctgctgtgtcccaggagctgaagctgcgctgccaggagatcagccggcaggagggcgccaagcccaccggggacctgcccttccactggatctgccagccctacatccggcccggcccccgggagggcagcaaggagaaggccggggcccggagcaagagggccctggaggaggaggagggcggcacagaggtgctgagcaagaacaagcagaagaagcagctgaggaacccccacaagacctttgaccccagcctgaagcccaagtatgccaagtgtgaccagtgtggcaaccccaagatgtgtgtgcagcctgtgccccggctgctgcaggaggccagcctgcagagggactgccgcctgcccaggagcagaattgccttctag

SEQ ID NO: 38057 - DNA, 1011 bp, Artificial Sequence
  Description of Artificial Sequence: Synthetic coding sequence
atgattgccaagagggtgctgctggcccacgagaagctgtctgtgcctgtgacctgcaagatccgggtcttccctgagattgacaagacagtgcgctatgcccagatgctggagaaggccggctgccagctgctgactgtgcacggccgcaccaaggagcagaagggccccctgtctggagctgcctcctgggagcacatcaaggctgtgaggaaggctgtggccatccctgtgtttgccaatggaaacatccagtgcctgcaggatgtggagcgctgcctgcgggacacaggagtgcagggcgtgatgtctgctgagggcaacctgcacaacccagccctgtttgagggccgcagccctgctgtgtgggagctggccgaggagtacctggacatcgtgcgggcccacctgttcaagctgtggcaccacaccctgcaggtgcaccaggagctgcgggaggagctggccaaggtgaagaccctggagggcattgctgctgtgtcccaggagctgaagctgcgctgccaggaggagatcagccggcaggagggcgccaagcccaccggggacctgcccttccactggatctgccagccctacatccggcccggcccccgggagggcagcaaggagaaggccggggcccggagcaagagggccctggaggaggaggagggcggcacagaggtgctgagcaagaacaagcagaagaagcagctgaggaacccccacaagacctttgaccccagcctgaagcccaagtatgccaagtgtgaccagtgtggcaaccccaagggcaacagatgtgtgttcagcctgtgccggggctgctgcaagaagagggccagcaaggagacagctgactgccccggccacggcctgctcttcaagaccaagctggagaagagcctggcctggaaggaggcccagcctgagctgcaggagccccagcctgctgcccctggcacccctgggggcttcagcgaggtgatgggcagcgccctggcctag

SEQ ID NO: 38058 - DNA, 1953 bp, Artificial Sequence
  Description of Artificial Sequence: Synthetic coding sequence
atggccgagggcacagctgaggcccccctggagaatggaggcggcggggacagcggggccggggccctggagcggggcgtggcccccatcaagaggcagtacctgaccaccaaggagcagttccaccagttcctggaggccaagggccaggagaagacctgccgggagacagaggtgggggaccctgctggaaatgagctggccgagcctgaggccaagaggatccggctggaggatggccagacagcagatggccagacagaggaggccgctgagcctggagagcagctgcagacccagaagagggcccggggccagaacaagggccggccccacgtgaagcccaccaactatgacaagaaccggctgtgccccagcctcatccaggagagcgctgccaagtgcttctttggagaccgctgccgcttcctgcatgatgtgggccgctacctggagaccaagccagctgacctgggcccccgctgtgtgctgtttgagaccttcggccgctgcccctatggagtgacctgccgctttgctggggcccacctgcggcctgagggccagaacctggtgcaggaggagctggccgcccggggcacccagcccccatccatcagaaatggcctggacaaggccctgcagcagcagctgaggaagcgggaggtgcgctttgagcgggcagagcaggccctgcggcgcttcagccagggccccaccccagctgctgctgtgcctgagggcacagctgctgagggcgccccccggcaggagaactgtggggcccagcaggtgcctgctggccctggcaccagcaccccacccagcagccctgtgaggacctgtggccccctgacagatgaagatgtggtgcggctgcggccctgtgagaagaagaggctggacatccggggcaagctgtacctggcccccctgaccacctgtggcaacctgcccttccgccgcatctgcaagagatttggagcagatgtgacctgtggggagatggctgtgtgcaccaacctgctgcagggccagatgtctgagtgggccctgctgaagaggcaccagtgtgaggacatcttcggcgtgcagctggagggcgccttcccagacaccatgaccaagtgtgccgagctgctgagcaggacagtggaggtggactttgtggacatcaacgtgggctgccccatcgacctggtgtacaagaagggcggcggctgtgccctgatgaacagaagcaccaagttccagcagatcgtgcggggcatgaaccaggtgctggatgtgcccctgactgtgaagatcagaactggagtgcaggagcgggtgaacctggcccaccggctgctgcctgagctgcgggactggggcgtggccctggtgaccctgcacggccgcagccgggagcagcgctacaccaagctggccgactggcagtacatcgaggagtgtgtgcaggccgccagccccatgcccctgtttggaaatggagacatcctgagctttgaagatgccaacagagccatgcagacaggagtgacaggcatcatgattgcccggggggccctgctgaagccctggctgttcacagagatcaaggagcagaggcactgggacatcagcagcagcgagcggctggacatcctgcgggacttcaccaactacggcctggagcactggggcagtgacacccagggcgtggagaagacccggcgcttcctgctggagtggctgtccttcctgtgccgctacgtgcctgtgggcctgctggagcggctgccccagaggatcaatgaaagaccaccctactacctgggccgggactacctggagaccctgatggccagccagaaggctgctgactggatccgcatcagcgagatgctgctgggccctgtgcccccatcctttgccttcctgcccaagcacaaggccaatgcctacaagtag

SEQ ID NO: 38059 - DNA, 1227 bp, Artificial Sequence
  Description of Artificial Sequence: Synthetic coding sequence
atggccgagggcacagctgaggcccccctggagaatggaggcggcggggacagcggggccggggccctggagcggggcgtggcccccatcaagaggcagtacctgaccaccaaggagcagttccaccagttcctggaggccaagggccaggagaagacctgccgggagacagagctggacatccggggcaagctgtacctggcccccctgaccacctgtggcaacctgcccttccgccgcatctgcaagagatttggagcagatgtgacctgtggggagatggctgtgtgcaccaacctgctgcagggccagatgtctgagtgggccctgctgaagaggcaccagtgtgaggacatcttcggcgtgcagctggagggcgccttcccagacaccatgaccaagtgtgccgagctgctgagcaggacagtggaggtggactttgtggacatcaacgtgggctgccccatcgacctggtgtacaagaagggcggcggctgtgccctgatgaacagaagcaccaagttccagcagatcgtgcggggcatgaaccaggtgctggatgtgcccctgactgtgaagatcagaactggagtgcaggagcgggtgaacctggcccaccggctgctgcctgagctgcgggactggggcgtggccctggtgaccctgcacggccgcagccgggagcagcgctacaccaagctggccgactggcagtacatcgaggagtgtgtgcaggccgccagccccatgcccctgtttggaaatggagacatcctgagctttgaagatgccaacagagccatgcagacaggagtgacaggcatcatgattgcccggggggccctgctgaagccctggctgttcacagagatcaaggagcagaggcactgggacatcagcagcagcgagcggctggacatcctgcgggacttcaccaactacggcctggagcactggggcagtgacacccagggcgtggagaagacccggcgcttcctgctggagtggctgtccttcctgtgccgctacgtgcctgtgggcctgctggagcggctgccccagaggatcaatgaaagaccaccctactacctgggccgggactacctggagaccctgatggccagccagaaggctgctgactggatccgcatcagcgagatgctgctgggccctgtgcccccatcctttgccttcctgcccaagcacaaggccaatgcctacaagtag

SEQ ID NO: 38060 - DNA, 954 bp, Artificial Sequence
  Description of Artificial Sequence: Synthetic coding sequence
atgaagagtgactgcatgcagaccaccatctgccaggagaggaagaaggaccccatcgagatgttccacagcggccagctggtgaaggtgtgtgcccccatggtgcgctacagcaagctggccttccgcaccctggtgaggaagtacagctgtgacctgtgctacacccccatgattgtggccgctgactttgtgaagagcatcaaggcccgggacagcgagttcaccaccaaccagggcgactgccccctgattgtgcagtttgctgccaatgatgcccggctgctgagtgatgctgcccgcatcgtgtgcccctatgccaacggcatcgacatcaactgtggctgcccccagcgctgggccatggccgagggctacggggcctgcctgatcaacaagccagagctggtgcaggacatggtgaagcaggtgaggaaccaggtggagaccccaggcttctctgtgtccatcaagatccgcatccatgatgacctgaagaggacagtggacctgtgccagaaggccgaggccaccggggtgtcctggatcaccgtgcacggccgcacagctgaggagcggcaccagcctgtgcactatgacagcatcaagatcatcaaggagaacatgagcatccctgtgattgccaacggggacatccgcagcctgaaggaggccgagaatgtgtggaggatcaccggcacagatggagtgatggtggcccggggcctgctggccaacccagccatgtttgctggctatgaggagacccccctgaagtgcatctgggactgggtggacatcgccctggagctgggcaccccctacatgtgcttccaccagcacctgatgtacatgatggagaagatcaccagccggcaggagaagagggtcttcaatgccctgagcagcaccagcgccatcatcgactacctgacagaccactacggcatctag

SEQ ID NO: 38061 - DNA, 591 bp, Artificial Sequence
  Description of Artificial Sequence: Synthetic coding sequence
atggccgagggctatggagcctgcctgatcaacaagccagagctggtgcaggacatggtgaagcaggtgaggaaccaggtggagaccccaggcttctctgtgtccatcaagatccgcatccatgatgacctgaagaggacagtggacctgtgccagaaggccgaggccactggagtgtcctggatcaccgtgcacggccgcacagctgaggagcggcaccagcctgtgcactatgacagcatcaagatcatcaaggagaacatgagcatccctgtgattgccaatggagacatccgcagcctgaaggaggctgaaaatgtgtggaggatcactggaacagatggagtgatggtggcccggggcctgctggccaacccagccatgtttgctggctatgaggagacccccctgaagtgcatctgggactgggtggacatcgccctggagctgggcaccccctacatgtgcttccaccagcacctgatgtacatgatggagaagatcaccagccggcaggagaagagggtcttcaatgccctgagcagcaccagcgccatcatcgactacctgacagaccactacggcatctag

SEQ ID NO: 38062 - DNA, 3669 bp, Artificial Sequence
  Description of Artificial Sequence: Synthetic coding sequence
atgtctgaggccccccgcttctttgtgggccctgaggacacagagatcaaccctggcaactaccgccacttcttccaccacgcagatgaagatgatgaggaggaggatgacagccccccagagcggcagatcgtggtgggcatctgcagcatggccaagaagagcaagagcaagcccatgaaggagatcctggagcgcatcagcctcttcaagtacatcaccgtggtggtgtttgaggaggaggtgatcctgaatgaacctgtggagaactggcccctgtgtgactgcctgatctccttccacagcaagggcttccccctggacaaggctgtggcctatgccaagctgaggaaccccttcgtcatcaatgacctgaacatgcagtacctgatccaggaccggcgggaggtgtacagcatcctgcaggccgagggcatcctgctgcccaggtatgccatcctgaacagagaccccaacaaccccaaggagtgcaacctgattgaaggagaggaccacgtggaggtgaatggagaggtgttccagaagccctttgtggagaagcctgtgtctgctgaggaccacaacgtgtacatctactaccccaccagcgctgggggcggcagccagaggctcttcaggaagattggcagccgcagctctgtgtacagccctgagagcaatgtgaggaagacaggcagctacatctatgaggagttcatgcccacagatggaacagatgtgaaggtgtacacagtgggccctgactatgcccatgctgaggccaggaagagccctgccctggatggcaaggtggagcgggacagcgagggcaaggaggtgcgctaccctgtgatcctgaatgcccgggagaagctgattgcctggaaggtgtgcctggccttcaagcagacagtgtgtggctttgacctgctgcgggccaacggccagagctatgtgtgtgatgtgaatggcttctcctttgtgaagaacagcatgaagtactatgatgactgtgccaagatcctgggcaacatcgtgatgagggagctggccccccagttccacatcccctggagcatccccctggaggccgaggacatccccatcgtgcccaccaccagcggcaccatgatggagctgcgctgtgtgattgctgtgatcagacatggagacaggacccccaagcagaagatgaagatggaggtgcgccaccagaagttctttgacctgtttgagaagtgtgatggctacaagagcggcaagctgaagctgaagaagcccaagcagctgcaggaggtgctggacatcgcccggcagctgctgatggagctgggccagaacaatgacagcgagattgaggagaacaagcccaagctggagcagctgaagacagtgctggagatgtatggccacttcagcggcatcaacaggaaggtgcagctgacctacctgccccacggctgccccaagaccagcagcgaggaggaggacagcagaagagaggagcccagcctgctgctggtgctgaagtggggcggggagctgaccccagctggccgggtgcaggccgaggagctgggccgggccttccgctgcatgtacccaggcggccagggcgactatgccggcttccctggctgcggcctgctgcggctgcacagcacctacagacatgacctgaagatctatgccagtgatgagggccgggtgcagatgacagctgctgcctttgccaagggcctgctggccctggagggggagctgacccccatcctggtgcagatggtgaagagcgccaacatgaatggcctgctggacagcgacagcgacagcctgagcagctgccagcagagggtgaaggcccggctgcacgagatcctgcagaaggaccgggacttcaccgctgaggactatgagaagctgacccccagcggcagcatcagcctcatcaagtccatgcacctgatcaagaaccctgtgaagacctgtgacaaggtgtacagcctcatccagagcctgaccagccagatccgccacaggatggaggaccccaagagcagtgacatccagctgtaccacagcgagaccctggagctgatgctgcggcgctggagcaagctggagaaggacttcaagaccaagaatggccgctatgacatcagcaagatcccagacatctatgactgcatcaagtatgatgtgcagcacaacggcagcctgaagctggagaacaccatggagctgtaccgcctgagcaaggccctggccgacatcgtcatcccccaggagtatggcatcaccaaggccgagaagctggagatcgccaagggctactgcacccccctggtgaggaagatccgcagtgacctgcagaggacccaggatgatgacacagtgaacaagctgcaccctgtgtacagcagaggagtgctgagccctgagcggcacgtgaggacccggctgtacttcaccagcgagagccacgtgcacagcctgctgagcatcctgcgctacggggccctgtgcaatgaaagcaaggatgagcagtggaagagggccatggactacctgaatgtggtgaatgagctgaactacatgacccagatcgtcatcatgctgtatgaggaccccaacaaggacctgagcagcgaggagcgcttccacgtggagctgcacttcagccctggggccaagggctgtgaggaggacaagaacctgcccagcggctacggctacagacctgccagccgggagaatgaaggccggcggcccttcaagattgacaatgatgatgagccccacaccagcaagagagatgaggtggaccgggccgtcatcctcttcaagcccatggtgtctgagcccatccacatccacaggaagagccccctgcccaggagcaggaagacagccaccaatgatgaggagagccccctgtctgtgagcagccctgagggcaccggcacctggctgcactacaccagcggcgtgggcactggaagaagaagaagaagaagtggagagcagatcaccagcagccctgtgagccccaagagcctggccttcaccagcagcatcttcggctcctggcagcaggtggtgtctgaaaatgccaactacctgcggacccccaggaccctggtggagcagaagcagaaccccaccgtgggcagccactgtgccggcctcttcagcacctctgtgctgggcggcagcagcagcgcccccaacctgcaggactatgcccggacccacaggaagaagctgaccagcagcggctgcattgatggctttgagctgtacagcatggtgcccagcatctgccccctggagaccctgcacaatgccctgagcctgaagcaggtggatgagttcctggccagcatcgccagccccagcagtgatgtgcccaggaagacagctgagatcagcagcacagccctgcggagcagccccatcatgaggaagaaggtgtccctgaacacctacaccccagccaagatcctgcccaccccaccagccaccctgaagagcaccaaggccagcagcaagccagccaccagcggccccagcagcgctgtggtgcccaacaccagcagcaggaagaagaacatcaccagcaagacagagacccatgagcacaagaagaacacaggcaagaagaagtag

SEQ ID NO: 38063 - DNA, 2970 bp, Artificial Sequence
  Description of Artificial Sequence: Synthetic coding sequence
atgaagggcctgggggacagccggcccaggcacctgagtgacagcctggacccccctcatgagcccctgtttgctggaacagacaggaacccctacctgctgagccccacagaggcctttgcccgggaggcccgcttccctggccagaacaccctgcctggagatggcctcttccccctgaacaaccagctgcccccacccagcagcaccttcccccgcatccactacaacagccactttgaggtgcctgaggagagccccttccccagccacgcccaggccaccaagatcaaccggctgcctgccaacctgctggaccagtttgagaagcagctgcccatccacagagatggcttcagcaccctgcagttccccagaggagaggccaaggcccggggggagagccctggccgcatccgccacctggtgcacagcgtgcagaggctcttcttcaccaaggcccccagcctggagggcacagctgggaaggtgggcggcaatggcagcaagaagggcggcatggaggatggcaagggccggcgggccaagagcaaggagcgggccaaggccggggagcccaagagaagaagccgcagcaacatcagcggctggtggagcagtgatgacaacctggatggagaggccggggccttccgcagcagcggccctgccagcggcctgatgaccctgggccggcaggccgagaggagccagccccgctacttcatgcacgcctacaacaccatcagcggccacatgctgaagaccaccaagaacaacaccacagagctgacagcccctcctcctcctccagcccccccagccacctgccccagcctgggcgtgggcacagacaccaactacgtgaagaggggctcctggagcaccctgaccctgagccacgcccacgaggtgtgccagaagaccagcgccaccctggacaagagcctgctgaagagcaagagctgccaccagggcctggcctaccactacctgcaggtgcctgggggcggcggggagtggagcaccaccctgctgagcccccgggagacagatgctgctgctgagggccccatcccctgcaggaggatgaggagcggcagctacatcaaggccatgggagatgaggacagtgatgaaagtggcggcagccccaagcccagccccaagacagctgcccggcggcagagctacctgcgggccacccagcagagcctgggggagcagagcaaccccaggaggagcctggaccggctggacagcgtggacatgctgctgcccagcaaatgtcccagctgggaggaggactacacccctgtgtctgacagcctgaatgacagcagctgcatcagccagatcttcggccaggccagcctcatcccccagctgtttggccacgagcagcaggtgcgggaggccgagctgagtgaccagtatgaagctgcctgtgagagcgcctgcagcgaggccgagagcacagctgctgagaccctggacctgcccctgcccagctacttccgcagccgcagccacagctacctgcgggccatccaggccggctgcagccaggaggaggacagcgtgtccctgcagagcctgagccccccacccagcacaggcagcctgagcaacagcaggaccctgcccagcagcagctgcctggtggcctacaagaagaccccacctcctgtgccccccaggaccaccagcaagcccttcatctctgtgacagtgcagagcagcacagagagcgcccaggacacctacctggacagccaggaccacaagtctgaggtgaccagccagagcggcctgagcaacagcagtgacagcctggacagcagcacccggccccccagcgtgacccggggcggcgtggccccagcccctgaggcccctgagcccccacccaagcacgccgccctgaagtctgagcagggcaccctgaccagcagcgagagccaccctgaggccgcccccaagaggaagctgagcagcatcggcatccaggagaggaccaggagaaatggcagccacctgtctgaggacaatggccccaaggccattgatgtgatggcccccagcagcgagagctctgtgcccagccacagcatgagcagccggcgggacacagacagcgacacccaggatgccaatgacagcagctgcaagagcagcgagaggagcctgcctgactgcaccccccaccccaacagcatcagcattgatgctggcccccggcaggcccccaagatcgcccagatcaagaggaacctgtcctatggagacaacagcgaccctgccctggaggccagcagcctgcccccaccagacccctggctggagaccagcagcagcagccctgctgagcccgcccagcccggggcctgcagaagagatggctactggttcctgaagctgctgcaggccgagacagagcggctggagggctggtgctgccagatggacaaggagaccaaggagaacaacctgtctgaggaggtgctgggcaaggtgctgtctgctgtgggcagcgcccagctgctgatgagccagaagttccagcagttccggggcctgtgtgagcagaacctgaacccagatgccaacccccggcccacagcccaggacctggccggcttctgggacctgctgcagctgagcattgaggacatctccatgaagtttgatgagctgtaccacctgaaggccaacagctggcagctggtggagaccccagagaagaggaaggaggagaagaagcccccacctcctgtgcccaagaagccagccaagagcaagccagctgtgtcccgggacaaggccagtgatgccagtgacaagcagaggcaggaggccaggaagaggctgctggccgccaagagagctgcctctgtgcggcagaacagcgccacagagagcgctgacagcattgagatctacgtgcctgaggcccagacccggctgtag

SEQ ID NO: 38064 - DNA, 2979 bp, Artificial Sequence
  Description of Artificial Sequence: Synthetic coding sequence
atgaagggcctgggggacagccggcccaggcacctgagtgacagcctggacccccctcatgagcccctgtttgctggaacagacaggaacccctacctgctgagccccacagaggcctttgcccgggaggcccgcttccctggccagaacaccctgcctggagatggcctcttccccctgaacaaccagctgcccccacccagcagcaccttcccccgcatccactacaacagccactttgaggtgcctgaggagagccccttccccagccacgcccaggccaccaagatcaaccggctgcctgccaacctgctggaccagtttgagaagcagctgcccatccacagagatggcttcagcaccctgcagttccccagaggagaggccaaggcccggggggagagccctggccgcatccgccacctggtgcacagcgtgcagaggctcttcttcaccaaggcccccagcctggagggcacagctgggaaggtgggcggcaatggcagcaagaagggcggcatggaggatggcaagggccggcgggccaagagcaaggagcgggccaaggccggggagcccaagagaagaagccgcagcaacatcagcggctggtggagcagtgatgacaacctggatggagaggccggggccttccgcagcagcggccctgccagcggcctgatgaccctgggccggcaggccgagaggagccagccccgctacttcatgcacgcctacaacaccatcagcggccacatgctgaagaccaccaagaacaacaccacagagctgacagcccctcctcctcctccagcccccccagccacctgccccagcctgggcgtgggcacagacaccaactacgtgaagaggggctcctggagcaccctgaccctgagccacgcccacgaggtgtgccagaagaccagcgccaccctggacaagagcctgctgaagagcaagagctgccaccagggcctggcctaccactacctgcaggtgcctgggggcggcggggagtggagcaccaccctgctgagcccccgggagacagatgctgctgctgagggccccatcccctgcaggaggatgaggagcggcagctacatcaaggccatgggagatgaggacagtgatgaaagtggcggcagccccaagcccagccccaagacagctgcccggcggcagagctacctgcgggccacccagcagagcctgggggagcagagcaaccccaggaggagcctggaccggctggacagcgtggacatgctgctgcccagcaaatgtcccagctgggaggaggactacacccctgtgtctgacagcctgaatgacagcagctgcatcagccagatcttcggccaggccagcctcatcccccagctgtttggccacgagcagcaggtgcgggaggccgagctgagtgaccagtatgaagctgcctgtgagagcgcctgcagcgaggccgagagcacagctgctgagaccctggacctgcccctgcccagctacttccgcagccgcagccacagctacctgcgggccatccaggccggctgcagccaggaggaggacagcgtgtccctgcagagcctgagccccccacccagcacaggcagcctgagcaacagcaggaccctgcccagcagcagctgcctggtggcctacaagaagaccccacctcctgtgccccccaggaccaccagcaagcccttcatctctgtgacagtgcagagcagcacagagagcgcccaggacacctacctggacagccaggaccacaagtctgaggtgaccagccagagcggcctgagcaacagcagtgacagcctggacagcagcacccggccccccagcgtgacccggggcggcgtggccccagcccctgaggcccctgagcccccacccaagcacgccgccctgaagtctgagcagggcaccctgaccagcagcgagagccaccctgaggccgcccccaagaggaagctgagcagcatcggcatccaggtggactgcatccagcctgtgcccaaggaggagcccagccctgccaccaagttccagagcattggagtgcaggtggaggatgactggaggagctctgtgcccagccacagcatgagcagcagaagagacacagacagcgacacccaggatgccaatgacagcagctgcaagagcagcgagaggagcctgcctgactgcaccccccaccccaacagcatcagcattgatgctggcccccggcaggcccccaagatcgcccagatcaagaggaacctgtcctatggagacaacagcgaccctgccctggaggccagcagcctgcccccaccagacccctggctggagaccagcagcagcagccctgctgagcccgcccagcccggggcctgcagaagagatggctactggttcctgaagctgctgcaggccgagacagagcggctggagggctggtgctgccagatggacaaggagaccaaggagaacaacctgtctgaggaggtgctgggcaaggtgctgtctgctgtgggcagcgcccagctgctgatgagccagaagttccagcagttccggggcctgtgtgagcagaacctgaacccagatgccaacccccggcccacagcccaggacctggccggcttctgggacctgctgcagctgagcattgaggacatctccatgaagtttgatgagctgtaccacctgaaggccaacagctggcagctggtggagaccccagagaagaggaaggaggagaagaagcccccacctcctgtgcccaagaagccagccaagagcaagccagctgtgtcccgggacaaggccagtgatgccagtgacaagcagaggcaggaggccaggaagaggctgctggccgccaagagagctgcctctgtgcggcagaacagcgccacagaatctgctgacagcattgagatctacgtgcctgaggcccagacccggctgtag

SEQ ID NO: 38065 - DNA, 2979 bp, Artificial Sequence; identical to SEQ ID NO: 38064
  Description of Artificial Sequence: Synthetic coding sequence

SEQ ID NO: 38066 - DNA, 1362 bp, Artificial Sequence
  Description of Artificial Sequence: Synthetic coding sequence
atggccctgtgcctggagctgctgaagcagtgcagcagctgcctggtggcctacaagaagaccccacctcctgtgccccccaggaccaccagcaagcccttcatctctgtgacagtgcagagcagcacagaaagtgcccaggacacctacctggacagccaggaccacaagtctgaggtgaccagccagagcggcctgagcaacagcagtgacagcctggacagcagcaccaggcctccttctgtgacccggggcggcgtggccccagcccctgaggcccctgagcccccacccaagcatgctgccctgaagtctgagcagggcaccctgaccagcagcgagagccaccctgaggccgcccccaagaggaagctgagcagcatcggcatccaggtggactgcatccagcctgtgcccaaggaggagcccagccctgccaccaagttccagagcattggagtgcaggtggaggatgactggaggagctctgtgcccagccacagcatgagcagccggcgggacacagacagcgacacccaggatgccaatgacagcagctgcaagagcagcgagaggagcctgcctgactgcaccccccaccccaacagcatcagcattgatgctggcccccggcaggcccccaagatcgcccagatcaagaggaacctgtcctatggagacaacagcgaccctgccctggaggccagcagcctgcccccaccagacccctggctggagaccagcagcagcagccctgctgagcccgcccagcccggggcctgcagaagagatggctactggttcctgaagctgctgcaggccgagacagagcggctggagggctggtgctgccagatggacaaggagaccaaggagaacaacctgtctgaggaggtgctgggcaaggtgctgtctgctgtgggcagcgcccagctgctgatgagccagaagttccagcagttccggggcctgtgtgagcagaacctgaacccagatgccaacccccggcccacagcccaggacctggccggcttctgggacctgctgcagctgagcattgaggacatctccatgaagtttgatgagctgtaccacctgaaggccaacagctggcagctggtggagaccccagagaagaggaaggaggagaagaagcccccacctcctgtgcccaagaagccagccaagagcaagccagctgtgtcccgggacaaggccagtgatgccagtgacaagcagaggcaggaggccaggaagaggctgctggccgccaagagagctgcctctgtgcggcagaacagcgccacagagagcgctgacagcattgagatctacgtgcctgaggcccagacccggctgtag

SEQ ID NO: 38067 - DNA, 2979 bp, Artificial Sequence; identical to SEQ ID NO: 38064
  Description of Artificial Sequence: Synthetic coding sequence

SEQ ID NO: 38068 - DNA, 2970 bp, Artificial Sequence; identical to SEQ ID NO: 38063
  Description of Artificial Sequence: Synthetic coding sequence

SEQ ID NO: 38069 - DNA, 2970 bp, Artificial Sequence; identical to SEQ ID NO: 38063
  Description of Artificial Sequence: Synthetic coding sequence

SEQ ID NO: 38070 - DNA, 576 bp, Artificial Sequence
  Description of Artificial Sequence: Synthetic coding sequence
atgcctggcagcgaggacctgaggaagggcaaggaccagatgcacagccacaggaagaggaccatgttcaccaagaagcagctggaggacctgaacatcctcttcaatgaaaacccctaccccaaccccagcctgcagaaggagatggccagcaagattgacatccaccccaccgtgctgcaggtgtggttcaagaaccaccgggccaagctgaagaaggccaagtgcaagcacatccaccagaagcaggagaccccccagccccccatccctgagggcggcgtgtccacctctgtgggcctgagaaatgctgacaccctgccccggctgcccaatgctgcccaccccatcggcctggtgtacacaggccaccgggtgcccagcttccagctgatcctgtaccccaacctgaaggtgcctgccaatgacttcatcggccacagaattgtgcacttcggctgctgccgggaccccaacatctactgcctgtaccccatcctggagagccaggtgtgtgcccccagcttccacagcggcagccctgcctgcagcagcaaccagagccgggagaggtag

SEQ ID NO: 38071 - DNA, 2052 bp, Artificial Sequence
  Description of Artificial Sequence: Synthetic coding sequence
atgctggcctgcctgacccggggcaacctgctggatgtgctgcaggagggcttcaatgagcagcagctgcaggcctacgtggcctgggtgaatgcccagctgaagaagaggcctgctgtgaagcctgtgcaggacctgcggcaggacctgagagatggagtcatcctggcctacctgattgagatcgtggccggggagaagctgtctggagtgcagctgagccctggcaaccagcaggagatgaagaacaacgtggagaaggtgctgcagtttgtggccagcaagaagatccgcatgcaccagaccagcgccaaggacatcgtggatggcaacctgaagagcatcatgaggctggtgctggccctggccgcccacttcaagccaggcagcagcaggacagtgaaccagggccgggacagccgggcccccctgcagagccaccggccccactgtgccacagctgtggcccagggcgctgctgctgccctggctgatgtgtgccacgacatgagccgcagcggcagagatgtgttccgctaccggcagaggaacagctccatggatgaggagattgagaacccctactggagcgtgcgggccctggtgcagcagtatgagggccagcagaggagccccagcgagagcagctgcagcagcctgaccagccccagccccatccacagcgccaagtctgagagcatcatcacccagagcgaggagaaggctgactttgtgatcatcccagctgagggcattgaaaatagaacagagggcacagacagccccctgagccgggactggaggcctggcagccctggcacctacctggagacctcctgggaggagcagctgctggagcagcaggagtacctggagaaggagatggaggaggccaagaagatgatcagcggcctgcaggccctgctgctgaatggcagcctgcctgaagatgagcaggagcggcccctggccctgtgtgagcccggggtgaaccctgaggagcagctgatcatcatccagagccggctggaccagagcatggaggagaaccaggacctgaagaaggagctgctgaagtgcaagcaggaggccaggaacctgcagggcatcaaggatgccctgcagcagaggctgacccagcaggacacctctgtgctgcagctgaagcaggagctgctgcgggccaacatggacaaggatgagctgcacaaccagaatgtggacctgcagaggaagctggatgagaggaaccggctgctgggggagtacaagaaggagctgggccagaaggaccggctgctgcagcagcaccaggccaagctggaggaggccctgaggaagctgagtgatgtgtcctaccaccaggtggacctggagcgggagctggagcacaaggatgtgctgctggcccactgcatgaagcgggaggctgatgaggccaccaactacaacagccacaacagccagagcaatggcttcctgctgcccacagctgggaagggggccacctctgtgagcaacagaggcaccagtgacctgcagctggtgagagatgccctgcggagcctgaggaacagcttcagcggccatgacccccagcaccacaccatcgacagcctggagcagggcatcagcagcctgatggagcggctgcacgtgatggagacccagaagaagcaggagaggaaggtgcgggtgaagagccccaggacccaggtgggcagcgagtaccgggagagctggccacccaacagcaagctgccccacagccagagcagccccaccgtgagcagcacctgcaccaaggtgctgtacttcacagacaggagcctgacccccttcatggtgaacatccccaagaggctggaggaggtgaccctgaaggacttcaaggccgccatcgaccgggagggcaaccaccgctaccacttcaaggccctggaccctgagtttggaacagtgaaggaggagatcttccatgatgatgatgccatccctggctgggagggcaagatcgtggcctgggtggaggaggaccacggggagaactag

SEQ ID NO: 38072 - DNA, 384 bp, Artificial Sequence
  Description of Artificial Sequence: Synthetic coding sequence
atggccgccccacccaaggcccccatccgggtgaggaacctgaccatccgggccggggccctgaccgggaaggagaacaacatgctgcagcctgagacccacatcttcaccgcccctgaggaggtgcccaaggtgtctgaccaggccctggtgtctgcccacagcgagtggcagaggaagctggaggccgctgaggccctgctgaccctgagaaattctgcccaggcccccccagacagcatcagcctgcaccagccctgcaaccccccagccccagctggggacaagggcttccagccccccagccccagcctgcggcccaggcctgccagcagcatcagcctgcccatcggccacctgggctgcatcagcctgctgtcctag

SEQ ID NO: 38073 - DNA, 579 bp, Artificial Sequence
  Description of Artificial Sequence: Synthetic coding sequence
atggccgccccacccaaggcccccatccgggtgaggaacctgaccatccgggccggggccctgaccgggaaggagaacaacatgctgcagcctgagacccacatcttcaccgcccctgaggagggcagcagccagggcgccctgctgctgggccaggcccctgagcccctgagcctgccctgcacccctgtgaccctggagcagcagctggtgagccccagcggggacccccaccgggccccagccctgcccagcatctgcagcaccctcatcctgcagccctgtgccaccctggaccccctgctgctgcagccccaggtgcccaaggtgtctgaccaggccctggtgtctgcccacagcgagtggcagaggaagctggaggccgctgaggccctgctgaccctgaggaacagcgcccaggcccccccagacagcatcagcctgcaccagccctgcaaccccccagccccagctggggacaagggcttccagccccccagccccagcctgcggcccaggcctgccagcagcatcagcctgcccatcggccacctgggctgcatcagcctgctgtcctag

SEQ ID NO: 38074 - DNA, 384 bp, Artificial Sequence; identical to SEQ ID NO: 38072
  Description of Artificial Sequence: Synthetic coding sequence

SEQ ID NO: 38075 - DNA, 579 bp, Artificial Sequence; identical to SEQ ID NO: 38073
  Description of Artificial Sequence: Synthetic coding sequence

SEQ ID NO: 38076 - DNA, 579 bp, Artificial Sequence; identical to SEQ ID NO: 38073
  Description of Artificial Sequence: Synthetic coding sequence

SEQ ID NO: 38077 - DNA, 384 bp, Artificial Sequence; identical to SEQ ID NO: 38072
  Description of Artificial Sequence: Synthetic coding sequence

SEQ ID NO: 38078 - DNA, 195 bp, Artificial Sequence
  Description of Artificial Sequence: Synthetic coding sequence
atggccgccccacccaaggcccccatccgggtgaggaacctgaccatccgggccggggccctgaccgggaaggagaacaacatgctgcagcctgagacccacatcttcaccgcccctgaggagggcagcagccagggcgccctgctgctgggccaggcccctgagcccctgagcctgccctgcacccctgtgtag

SEQ ID NO: 38079 - DNA, 306 bp, Artificial Sequence
  Description of Artificial Sequence: Synthetic coding sequence
atggccgccccacccaaggcccccatccgggtgaggaacctgaccatccgggccggggccctgaccgggaaggagaacaacatgctgcagcctgagacccacatcttcaccgcccctgaggagggcagcagccagggcgccctgctgctgggccaggcccctgagcccctgagcctgccctgcacccctgtgaccctggagcagcagctggtgagccccagcggggacccccaccgggccccagccctgcccagcatctgcagcaccctcatcctgcagccctgtgccaccctggaccccctgtag

SEQ ID NO: 38080 - DNA, 579 bp, Artificial Sequence; identical to SEQ ID NO: 38073
  Description of Artificial Sequence: Synthetic coding sequence

SEQ ID NO: 38081 - DNA, 1191 bp, Artificial Sequence
  Description of Artificial Sequence: Synthetic coding sequence
atgctgatcaccgtgtactgtgtgagaagagacctgtctgaggtgaccttcagcctgcaggtgtccccagactttgagctgaggaacttcaaggtgctgtgtgaggccgagagccgggtgcctgtggaggagatccagatcatccacatggagcggctgctgattgaggaccactgcagcctgggcagctatggcctgaaggatggagacatcgtggtgctgctgcagaaggacaacgtgggcccccgggcccctggccgggcccccaaccagccccgggtggacttctctggaattgctgtgcccggcaccagcagcagccggccccagcaccctggccagcagcagcagaggaccccagctgcccagaggagccagggcctggccagcggggagaaggtggccggcctgcagggcctgggcagccctgccctgatccgctccatgctgctgagcaacccccatgacctgagcctgctgaaggagagaaatccacccctggccgaggccctgctgagcggcagcctggagaccttcagccaggtgctgatggagcagcagcgggagaaggccctgcgggagcaggagcggctgcggctgtacacagctgaccccctggaccgggaggcccaggccaagattgaggaggagatccggcagcagaacatcgaggagaacatgaacatcgccatcgaggaggcccctgagagctttggccaggtgaccatgctgtacatcaactgcaaggtgaatggccaccccctgaaggcctttgtggacagcggggcccagatgaccatcatgagccaggcctgtgccgagcgctgcaacatcatgaggctggtggaccggcgctgggccggcgtggccaagggcgtgggcacccagaggatcatcggccgggtgcacctggcccagatccagattgaaggagacttcctgcagtgcagcttcagcatcctggaggaccagcccatggacatgctgctgggcctggacatgctgcggcggcaccagtgcagcattgacctgaagaagaatgtgctggtgattggcaccaccggcacccagacctacttcctgcctgagggggagctgcccctgtgcagcaggatggtgtctggccaggatgagagcagtgacaaggagatcacccacagcgtgatggattctggcaggaaggagcactag

SEQ ID NO: 38082 - DNA, 1200 bp, Artificial Sequence
  Description of Artificial Sequence: Synthetic coding sequence
atgctgctgactgtgtactgtgtgagaagagacctgtctgaggtgaccttcagcctgcaggtggatgctgactttgagctgcacaacttccgggccctgtgtgagctggagagcggcatcccagctgctgagagccagatcgtgtatgcagagcggcccctgacagacaaccacaggagcctggccagctatggcctgaaggatggagatgtggtgatcctgcggcagaaggaaaatgctgacccccggccccctgtgcagttccccaacctgcccagaattgacttcagcagcattgctgtgcccggcaccagcagcccccggcagaggcagcccccaggcacccagcagagccacagcagccctggagagatcaccagcagcccccagggcctggacaacccagccctgctgcgggacatgctgctggccaacccccatgagctgagcctgctgaaggagagaaatccacccctggccgaggccctgctgagcggggacctggagaagttcagccgggtgctggtggagcagcagcaggaccgggcccggcgggagcaggagcgcatccgcctcttctctgctgacccctttgacctggaggcccaggccaagattgaggaggacatccggcagcagaacatcgaggagaacatgaccatcgccatggaggaggcccctgagagctttggccaggtggtgatgctgtacatcaactgcaaggtgaatggccaccctgtgaaggcctttgtggacagcggggcccagatgaccatcatgagccaggcctgtgccgagcgctgcaacatcatgaggctggtggaccggcgctgggccggcatcgccaagggcgtgggcacccagaagatcatcggccgggtgcacctggcccaggtgcagattgaaggagacttcctgccctgcagcttcagcatcctggaggagcagcccatggacatgctgctgggcctggacatgctgaagaggcaccagtgcagcattgacctgaagaagaatgtgctggtgattggcaccaccggcagccagaccaccttcctgcctgagggggagctgcctgaatgtgcccggctggcctacggggccggcagagaagatgtgcggcctgaggagattgctgaccaggagctggccgaggccctgcagaagtctgcagaagatgctgagcggcagaagccctag

SEQ ID NO: 38083 - DNA, 1167 bp, Artificial Sequence
  Description of Artificial Sequence: Synthetic coding sequence
atgaacaccatgtatgtgatgatggcccagatcctgcggagccacctgatcaaggccaccgtcatccccaacagagtgaagatgctgccctacttcggcatcatccggaacaggatgatgagcacccacaagagcaagaagaagatccgggagtactaccgcctgctgaatgtggaggagggctgcagcgcagatgaggtgcgggagagcttccacaagctggccaagcagtaccacccagacagcggcagcaacacagctgacagcgccaccttcatcagaattgagaaggcctacaggaaggtgctgagccacgtgattgagcagaccaatgccagccagagcaagggggaggaggaggaggatgtggagaagttcaagtacaagaccccccagcaccgccactacctgagctttgagggcatcggcttcggcacccccacccagcgggagaagcactaccggcagttccgggctgacagagctgctgagcaggtgatggagtaccagaagcagaagctgcagagccagtacttcccagacagcgtcatcgtgaagaacatccggcagagcaagcagcagaagatcacccaggccatcgagcggctggtggaggacctgatccaggagagcatggccaagggggactttgacaacctgagcggcaagggcaagcccctgaagaagttcagtgactgcagctacatcgaccccatgacccacaacctgaaccgcatcctgattgacaatggctaccagcctgagtggatcctgaagcagaaggagatcagtgacaccatcgagcagctgcgggaggccatcctggtgtccaggaagaagctgggcaaccccatgacccccacagagaagaagcagtggaaccacgtgtgtgagcagttccaggagaacatcaggaagctgaacaagaggatcaatgacttcaacctgattgtgcccatcctgacccggcagaaggtgcactttgatgcccagaaggagatcgtgcgggcccagaagatctatgagaccctcatcaagaccaaggaggtgacagacaggaaccccaacaacctggaccagggcgagggggagaagaccccagagatcaagaagggcttcctgaactggatgaacctgtggaagttcatcaagatccgctccttctag

SEQ ID NO: 38084 - DNA, 1167 bp, Artificial Sequence; identical to SEQ ID NO: 38083
  Description of Artificial Sequence: Synthetic coding sequence

SEQ ID NO: 38085 - DNA, 1194 bp, Artificial Sequence
  Description of Artificial Sequence: Synthetic coding sequence
atggtgaaggagaccacctactatgatgtgctgggcgtgaagcccaatgccacccaggaggagctgaagaaggcctacaggaagctggccctgaagtaccacccagacaagaaccccaatgaaggagagaagttcaagcagatcagccaggcctatgaggtgctgagtgatgccaagaagcgggagctgtatgacaagggcggggagcaggccatcaaggagggcggggccggcggcggcttcggcagccccatggacatctttgacatgttcttcggcggcggcggccgcatgcagcgggagcggcggggcaagaatgtggtgcaccagctgtctgtgaccctggaggacctgtacaacggggccaccaggaagctggccctgcagaagaatgtcatctgtgacaagtgtgagggccggggcggcaagaagggagctgtggagtgctgccccaactgccggggcaccggcatgcagatccgcatccaccagatcggccctggcatggtgcagcagatccagagcgtgtgcatggagtgccagggccatggagagcgcatcagccccaaggaccgctgcaagagctgcaatggaaggaagatcgtgcgggagaagaagatcctggaggtgcacatcgacaagggcatgaaggatggccagaagatcaccttccatggagagggggaccaggagcccggcctggagcccggggacatcatcatcgtgctggaccagaaggaccatgctgtgttcaccaggagaggagaggacctcttcatgtgcatggacatccagctggtggaggccctgtgtggcttccagaagcccatcagcaccctggacaacagaaccatcgtcatcaccagccaccctggccagatcgtgaagcatggagacatcaagtgtgtgctgaatgaaggcatgcccatctaccgccggccctatgagaagggccgcctcatcatcgagttcaaggtgaacttcccagaaaatggcttcctgagcccagacaagctgagcctgctggagaagctgctgcctgagaggaaggaggtggaggagacagatgagatggaccaggtggagctggtggactttgaccccaaccaggagaggagaagacactacaatggagaggcctatgaagatgatgagcaccacccccggggcggcgtgcagtgccagaccagctag

SEQ ID NO: 38086 - DNA, 774 bp, Artificial Sequence
  Description of Artificial Sequence: Synthetic coding sequence
atgcagatccgcatccaccagatcggccctggcatggtgcagcagatccagagcgtgtgcatggagtgccagggccacggggagcgcatcagccccaaggaccgctgcaagagctgcaatggaaggaagatcgtgcgggagaagaagatcctggaggtgcacatcgacaagggcatgaaggatggccagaagatcaccttccacggggagggggaccaggagcccggcctggagcccggggacatcatcatcgtgctggaccagaaggaccatgctgtgttcaccaggagaggagaagatctcttcatgtgcatggacatccagctggtggaggccctgtgtggcttccagaagcccatcagcaccctggacaacagaaccatcgtcatcaccagccaccctggccagatcgtgaagcacggggacatcaagtgtgtgctgaatgaaggcatgcccatctacagaagaccctatgagaagggccgcctcatcatcgagttcaaggtgaacttcccagaaaatggcttcctgagcccagacaagctgagcctgctggagaagctgctgcctgagaggaaggaggtggaggagacagatgagatggaccaggtggagctggtggactttgaccccaaccaggagcggcggcggcactacaacggggaggcctatgaagatgatgagcaccacccccggggcggcgtgcagtgccagaccagcaatggacctgtgaacaacacccactgctggcacctgatgtgcagcagcgagtag

SEQ ID NO: 38087 - DNA, 723 bp, Artificial Sequence
  Description of Artificial Sequence: Synthetic coding sequence
atgcagatccgcatccaccagatcggccctggcatggtgcagcagatccagagcgtgtgcatggagtgccagggccacggggagcgcatcagccccaaggaccgctgcaagagctgcaatggaaggaagatcgtgcgggagaagaagatcctggaggtgcacatcgacaagggcatgaaggatggccagaagatcaccttccacggggagggggaccaggagcccggcctggagcccggggacatcatcatcgtgctggaccagaaggaccatgctgtgttcaccaggagaggagaagatctcttcatgtgcatggacatccagctggtggaggccctgtgtggcttccagaagcccatcagcaccctggacaacagaaccatcgtcatcaccagccaccctggccagatcgtgaagcacggggacatcaagtgtgtgctgaatgaaggcatgcccatctacagaagaccctatgagaagggccgcctcatcatcgagttcaaggtgaacttcccagaaaatggcttcctgagcccagacaagctgagcctgctggagaagctgctgcctgagaggaaggaggtggaggagacagatgagatggaccaggtggagctggtggactttgaccccaaccaggagcggcggcggcactacaacggggaggcctatgaagatgatgagcaccacccccggggcggcgtgcagtgccagaccagctag

SEQ ID NO: 38088 - DNA, 1194 bp, Artificial Sequence
  Description of Artificial Sequence: Synthetic coding sequence
atggtgaaggagacccagtactatgacatcctgggcgtgaagcccagcgccagccctgaggagatcaagaaggcctacaggaagctggccctgaagtaccacccagacaagaacccagatgaaggagagaagttcaagctgatcagccaggcctatgaggtgctgagtgaccccaagaagagagatgtgtatgaccagggcggggagcaggccatcaaggagggcggcagcggcagccccagcttcagcagccccatggacatctttgacatgttctttggaggcggcggccgcatggcccgggagcggcggggcaagaatgtggtgcaccagctgtctgtgaccctggaggacctgtacaatggagtgaccaagaagctggccctgcagaagaatgtcatctgtgagaagtgtgagggcgtgggcggcaagaagggctctgtggagaagtgccccctgtgcaagggccggggcatgcagatccacatccagcagatcggccctggcatggtgcagcagatccagacagtgtgcatcgagtgcaagggccagggcgagcgcatcaaccccaaggacagatgtgagagctgcagcggggccaaggtgatccgggagaagaagatcatcgaggtgcacgtggagaagggcatgaaggatggccagaagatcctcttccacggggagggggaccaggagcctgagctggagcctggagatgtgatcatcgtgctggaccagaaggaccacagcgtcttccagaggcggggccatgacctgatcatgaagatgaagatccagctgtctgaggccctgtgtggcttcaagaagaccatcaagaccctggacaaccgcatcctggtgatcaccagcaaggccggggaggtgatcaagcacggggacctgcgctgtgtgagagatgagggcatgcccatctacaaggcccccctggagaagggcatcctgatcatccagttcctggtgatcttccctgagaagcactggctgagcctggagaagctgccccagctggaggccctgctgcccccccggcagaaggtgcgcatcacagatgacatggaccaggtggagctgaaggagttctgccccaatgagcagaactggaggcagcaccgggaggcctatgaagaagatgaagatggcccccaggccggcgtgcagtgccagacagcctag

SEQ ID NO: 38089 - DNA, 1194 bp, Artificial Sequence; identical to SEQ ID NO: 38088
  Description of Artificial Sequence: Synthetic coding sequence

SEQ ID NO: 38090 - DNA, 1281 bp, Artificial Sequence
  Description of Artificial Sequence: Synthetic coding sequence
atggcccggggcggcagccagagctggagcagtggagagagtgatggccagcccaaggagcagaccccagagaagcccaggcacaagatggtgaaggagacccagtactatgacatcctgggcgtgaagcccagcgccagccctgaggagatcaagaaggcctacaggaagctggccctgaagtaccacccagacaagaacccagatgaaggagagaagttcaagctgatcagccaggcctatgaggtgctgagtgaccccaagaagagagatgtgtatgaccagggcggggagcaggccatcaaggagggcggcagcggcagccccagcttcagcagccccatggacatctttgacatgttcttcggcggcggcggccgcatggcccgggagcggcggggcaagaatgtggtgcaccagctgtctgtgaccctggaggacctgtacaacggggtgaccaagaagctggccctgcagaagaatgtcatctgtgagaagtgtgaaggagtgggcggcaagaagggctctgtggagaagtgccccctgtgcaagggccggggcatgcagatccacatccagcagatcggccctggcatggtgcagcagatccagacagtgtgcattgaatgtaaaggccagggcgagcgcatcaaccccaaggacagatgtgagagctgcagcggggccaaggtgatccgggagaagaagatcatcgaggtgcacgtggagaagggcatgaaggatggccagaagatcctcttccatggagagggggaccaggagcctgagctggagcctggagatgtgatcatcgtgctggaccagaaggaccacagcgtcttccagaggcggggccatgacctgatcatgaagatgaagatccagctgtctgaggccctgtgtggcttcaagaagaccatcaagaccctggacaaccgcatcctggtgatcaccagcaaggccggggaggtgatcaagcatggagacctgcgctgtgtgagagatgagggcatgcccatctacaaggcccccctggagaagggcatcctgatcatccagttcctggtgatcttccctgagaagcactggctgagcctggagaagctgccccagctggaggccctgctgcccccccggcagaaggtgcgcatcacagatgacatggaccaggtggagctgaaggagttctgccccaatgagcagaactggaggcagcaccgggaggcctatgaggaggatgaagatggcccccaggccggcgtgcagtgccagacagcctag

SEQ ID NO: 38091 - DNA, 1113 bp, Artificial Sequence
  Description of Artificial Sequence: Synthetic coding sequence
atgtgggagagcctgaccctggacagcggccagatcagcgccctgacccgcttcaagctgatcagccaggcctatgaggtgctgagtgaccccaagaagagagatgtgtatgaccagggcggggagcaggccatcaaggagggcggcagcggcagccccagcttcagcagccccatggacatctttgacatgttcttcggcggcggcggccgcatggcccgggagcggcggggcaagaatgtggtgcaccagctgtctgtgaccctggaggacctgtacaacggggtgaccaagaagctggccctgcagaagaatgtcatctgtgagaagtgtgaaggagtgggcggcaagaagggctctgtggagaagtgccccctgtgcaagggccggggcatgcagatccacatccagcagatcggccctggcatggtgcagcagatccagacagtgtgcattgaatgtaaaggccagggcgagcgcatcaaccccaaggacagatgtgagagctgcagcggggccaaggtgatccgggagaagaagatcatcgaggtgcacgtggagaagggcatgaaggatggccagaagatcctcttccatggagagggggaccaggagcctgagctggagcctggagatgtgatcatcgtgctggaccagaaggaccacagcgtcttccagaggcggggccatgacctgatcatgaagatgaagatccagctgtctgaggccctgtgtggcttcaagaagaccatcaagaccctggacaaccgcatcctggtgatcaccagcaaggccggggaggtgatcaagcatggagacctgcgctgtgtgagagatgagggcatgcccatctacaaggcccccctggagaagggcatcctgatcatccagttcctggtgatcttccctgagaagcactggctgagcctggagaagctgccccagctggaggccctgctgcccccccggcagaaggtgcgcatcacagatgacatggaccaggtggagctgaaggagttctgccccaatgagcagaactggaggcagcaccgggaggcctatgaggaggatgaagatggcccccaggccggcgtgcagtgccagacagcctag

SEQ ID NO: 38092 - DNA, 951 bp, Artificial Sequence
  Description of Artificial Sequence: Synthetic coding sequence
atgggccaggactactacagcgtgctgggcatcaccagaaattctgaagatgcccagatcaagcaggcctacagaaggctggccctgaagcaccaccccctgaagagcaatgagcccagcagcgctgagatcttccggcagattgctgaggcctatgatgtgctgagtgaccccatgaagaggggcatctatgacaagtttggagaggagggcctgaagggcggcatccccctggagtttggcagccagaccccctggaccaccggctacgtgttccacggcaagccagagaaggtgttccacgagttcttcggcggcaacaaccccttcagcgagttctttgatgctgagggcagcgaggtggacctgaactttggaggcctgcagggccggggcgtgaagaagcaggacccccaggtggagcgggacctgtacctgagcctggaggacctcttcttcggctgcaccaagaagatcaagatcagcagaagagtgctgaatgaagatggctacagcagcaccatcaaggacaagatcctgaccattgatgtgaagccaggctggaggcagggcacccgcatcacctttgagaaggagggggaccagggccccaacatcatcccagctgacatcatcttcatcgtgaaggagaagctgcacccccgcttccggcgggagaatgacaacctcttctttgtgaaccccatccccctgggcaaggccctgacctgctgcaccgtggaggtgaggaccctggatgaccggctgctgaacatccccatcaatgacatcatccaccccaagtacttcaagaaggtgcctggagagggcatgcccctgcctgaggaccccaccaagaagggggacctcttcatcttctttgacatccagttccccacccggctgaccccccagaagaagcagatgctgcggcaggccctgctgacctag

SEQ ID NO: 38093 - DNA, 426 bp, Artificial Sequence
  Description of Artificial Sequence: Synthetic coding sequence
atggagaccagccggggcaggaacctggccaaggtgacccggcccaccagcccctgccacctgctggccagccctgcccagggccccaacatcatcccagctgacatcatcttcatcgtgaaggagaagctgcacccccgcttcagaagagaaaatgacaacctcttctttgtgaaccccatccccctgggcaaggccctgacctgctgcaccgtggaggtgaggaccctggatgaccggctgctgaacatccccatcaatgacatcatccaccccaagtacttcaagaaggtgcctggagagggcatgcccctgcctgaggaccccaccaagaagggggacctcttcatcttctttgacatccagttccccacccggctgaccccccagaagaagcagatgctgcggcaggccctgctgacctag

SEQ ID NO: 38094 - DNA, 426 bp, Artificial Sequence; identical to SEQ ID NO: 38093
  Description of Artificial Sequence: Synthetic coding sequence

SEQ ID NO: 38095 - DNA, 930 bp, Artificial Sequence
  Description of Artificial Sequence: Synthetic coding sequence
atggtggactactatgaggtgctgggcctgcagagatatgccagccctgaggacatcaagaaggcctaccacaaggtggccctgaagtggcacccagacaagaaccctgagaacaaggaggaggccgagaggaagttcaaggaggtggccgaggcctatgaggtgctgagcaatgatgagaagagggacatctatgacaagtatggaacagagggcctgaatggaggcggcagccactttgatgatgaatgtgaatatggcttcaccttccacaagccagatgatgtgttcaaggagatcttccacgagcgggaccccttctccttccacttctttgaggacagcctggaggacctgctgaacagacctggcagcagctatggcaacagaaacagagatgctggctacttcttcagcacagccagcgagtaccccatctttgagaagttcagcagctatgacaccggctacaccagccagggcagcctgggccacgagggcctgaccagcttcagcagcctggcctttgacaacagcggcatggacaactacatctctgtgaccaccagtgacaagatcgtgaatggaagaaacatcaacaccaagaagatcattgaaagtgaccaggagcgggaggccgaggacaacggggagctgaccttcttcctggtgaacagcgtggccaatgaggagggctttgccaaggagtgctcctggaggacccagagcttcaacaactacagccccaacagccacagcagcaagcacgtgtcccagtacacctttgtggacaatgatgagggcggcatctcctgggtgaccagcaacagagatcctcccatcttctctgctggggtgaaggagggcggcaagaggaagaagaagaagaggaaggaggtgcagaagaagagcaccaagaggaactgctag

SEQ ID NO: 38096 - DNA, 699 bp, Artificial Sequence
  Description of Artificial Sequence: Synthetic coding sequence
atggccaactactatgaggtgctgggcgtgcaggccagcgccagccctgaggacatcaagaaggcctacaggaagctggccctgcgctggcacccagacaagaacccagacaacaaggaggaggccgagaagaagttcaagctggtgtctgaggcctatgaggtgctgagtgacagcaagaagaggagcctgtatgaccgggccggctgtgacagctggagggctgggggcggggccagcaccccctaccacagcccctttgacaccggctacaccttcaggaaccctgaggacatcttccgggagttcttcggcggcctggaccccttctcctttgagttctgggacagccccttcaacagcgaccggggcggccggggccacggcctgcggggggccttctctgctggctttggagagttccctgccttcatggaggccttcagcagcttcaacatgctgggctgcagcggcggcagccacaccaccttcagcagcaccagctttggaggcagcagcagcggcagcagcggcttcaagtctgtgatgagcagcacagagatgatcaatggccacaaggtgaccaccaagagaattgtggagaatggccaggagcgggtggaggtggaggaggatggccagctgaagtctgtgacagtgaatggcaaggagcagctgaagtggatggacagcaagtag

SEQ ID NO: 38097 - DNA, 699 bp, Artificial Sequence; identical to SEQ ID NO: 38096
  Description of Artificial Sequence: Synthetic coding sequence

SEQ ID NO: 38098 - DNA, 1107 bp, Artificial Sequence
  Description of Artificial Sequence: Synthetic coding sequence
atgcagcccggcagcagccgctgtgaggaggagacccccagcctgctgtggggcctggaccctgtgttcctggcctttgccaagctgtacatccgggacatcctggacatgaaggagagccggcaggtgcctggggtcttcctgtacaacggccaccccatcaagcaggtggatgtgctgggcaccgtcatcggcgtgcgggagagagatgccttctacagctatggagtggatgacagcactggagtcatcaactgcatctgctggaagaagctgaacacagagagcgtgtctgctgcccccagcgctgcccgggagctgagcctgaccagccagctgaagaagctgcaggagaccatcgagcagaagaccaagattgagatcggggacaccatccgggtgcggggcagcatccgcacctaccgggaggagcgggagatccacgccaccacctactacaaggtggatgatcctgtgtggaacatccagatcgccaggatgctggagctgcccaccatctacaggaaggtgtatgaccagcccttccacagcagcgccctggagaaggaggaggccctgagcaaccctggggccctggacctgcccagcctgaccagcctgctgtctgagaaggccaaggagttcctgatggagaacagagtgcagagcttctaccagcaggagctggagatggtggagagcctgctgagcctggccaaccagcccgtcatccacagcgccagcagtgaccaggtgaacttcaagaaggacaccaccagcaaggccatccacagcatcttcaagaatgccatccagctgctgcaggagaagggcctggtgttccagaaggatgatggctttgacaacctgtactacgtgacccgggaggacaaggacctgcacaggaagatccaccgcatcatccagcaggactgccagaagcccaaccacatggagaagggctgccacttcctgcacatcctggcctgtgcccggctgagcatccggcccggcctgtctgaggccgtgctgcagcaggtgctggagctgctggaggaccagagcgacatcgtgtccaccatggagcactactacacagccttctag

SEQ ID NO: 38099 - DNA, 324 bp, Artificial Sequence
  Description of Artificial Sequence: Synthetic coding sequence
atggatgccatcctgaactacagaagtgaggacacagaggactactacaccctgctgggctgtgatgagctgagctctgtggagcagatcctggccgagttcaaggtgcgggccctggagtgccacccagacaagcaccctgagaaccccaaggctgtggagaccttccagaagctgcagaaggccaaggagatcctgaccaatgaggagagccgggcccgctatgaccactggaggaggagccagatgtccatgcccttccagcagtgggaggccctgaatgacagcgtgaagacagtgggcttcagcctgggcgccacctag

SEQ ID NO: 38100 - DNA, 1407 bp, Artificial Sequence
  Description of Artificial Sequence: Synthetic coding sequence
atgggcttcctgggcaccggcacctggatcctggtgctggtgctgcccatccaggccttccccaagccaggcggcagccaggacaagagcctgcacaaccgggagctgtctgctgagcggcccctgaatgagcagattgctgaggccgaggaggacaagatcaagaagacctaccccccagagaacaagccaggccagagcaactacagctttgtggacaacctgaacctgctgaaggccatcacagagaaggagaagattgagaaggagcggcagagcatccgcagcagccccctggacaacaagctgaatgtggaggatgtggacagcaccaagaacaggaagctgattgatgattatgacagcaccaagagcggcctggaccacaagttccaggatgatcctgatggcctgcaccagctggatggcacccccctgacagcagaagatattgtgcacaagattgctgcccgcatctatgaggagaatgacagagctgtgtttgacaagatcgtgtccaagctgctgaacctgggcctcatcacagagagccaggcccacaccctggaggatgaggtggccgaggtgctgcagaagctgatcagcaaggaggccaacaactatgaggaggaccccaacaagcccacctcctggacagagaaccaggccggcaagatccctgagaaggtgacccccatggccgccatccaggacggcctggccaagggggagaatgatgagaccgtgagcaacaccctgaccctgaccaacggcctggagaggaggaccaagacctacagcgaggacaactttgaggagctgcagtacttccccaacttctacgccctgctgaagagcattgattctgagaaggaggccaaggagaaggagaccctcatcaccatcatgaagaccctgattgactttgtgaagatgatggtgaagtatggcaccatcagccctgaggagggcgtgtcctacctggagaacctggatgagatgattgccctgcagaccaagaacaagctggagaagaatgccacagacaacatcagcaagctgtttcctgcccccagcgagaagagccatgaggagacagacagcaccaaggaggaggccgccaagatggagaaggagtatggcagcctgaaggacagcaccaaggatgacaacagcaaccctgggggcaagacagatgagcccaagggcaagacagaggcctacctggaggccatcaggaagaacatcgagtggctgaagaagcatgacaagaagggcaacaaggaggactatgacctgagcaagatgagggacttcatcaacaagcaggctgatgcctacgtggagaagggcatcctggacaaggaggaggccgaggccatcaagaggatctacagcagcctgtag

SEQ ID NO: 38101 - DNA, 450 bp, Artificial Sequence
  Description of Artificial Sequence: Synthetic coding sequence
atgatggctgtggagcagatgcccaagaaggactggtacagcatcctgggcgctgaccccagcgccaacatcagtgacctgaagcagaagtaccagaagctgatcctgatgtaccacccagacaagcagagcacagatgtgcctgctggcaccgtggaggagtgtgtgcagaagttcatcgagattgaccaggcctggaagatcctgggcaatgaggagaccaagcgggagtatgacctgcagagatgtgaagatgacctgagaaatgtgggccctgtggatgcccaggtgtacctggaggagatgtcctggaatgaaggagaccacagcttctacctgagctgccgctgtggcggcaagtacagcgtgtccaaggatgaggccgaggaggtgtccctcatcagctgtgacacctgcagcctcatcatcgagctgctgcactacaactag

SEQ ID NO: 38102 - DNA, 255 bp, Artificial Sequence
  Description of Artificial Sequence: Synthetic coding sequence
atggctgtggagcagatgcccaagaaggactggtacagcatcctgggcgctgaccccagcgccaacatcagtgacctgaagcagaagtaccagaagctgatcctgatgtaccacccagacaagcagagcacagatgtgcctgctggcaccgtggaggagtgtgtgcagaagttcattgaaattgaccaggcctggaagatcctgggcaatgaggagaccaagcgggagtatgacctgcagagatgtggcagctag

SEQ ID NO: 38103 - DNA, 1167 bp, Artificial Sequence; identical to SEQ ID NO: 38083
  Description of Artificial Sequence: Synthetic coding sequence

SEQ ID NO: 38104 - DNA, 1167 bp, Artificial Sequence; identical to SEQ ID NO: 38083
  Description of Artificial Sequence: Synthetic coding sequence

SEQ ID NO: 38105 - DNA, 1167 bp, Artificial Sequence; identical to SEQ ID NO: 38083
  Description of Artificial Sequence: Synthetic coding sequence

SEQ ID NO: 38106 - DNA, 462 bp, Artificial Sequence
  Description of Artificial Sequence: Synthetic coding sequence
atgggcgcccccctgctgagccctggctggggcgctggagctgctggaagacgctggtggatgctgctggcccccctgctgcctgccctgctgctggtgcggcctgctggggccctggtggagggcctgtactgcggcacccgggactgctatgaggtgctgggcgtgagccgctctgctgggaaggccgagatcgcccgggcctaccggcagctggcccggcgctaccacccagaccgctaccggccccagcctggagatgagggccctggccgcaccccccagagcgctgaggaggccttcctgctggtggccacagcctatgagaccctgaaggtgtcccaggccgctgctgagctgcagcagtactgcatgcagaatgcctgcaaggatgccctgctggtgggcgtgcctgctggcagcaaccccttccgggagcccaggagctgtgccctgctgtag

SEQ ID NO: 38107 - DNA, 996 bp, Artificial Sequence
  Description of Artificial Sequence: Synthetic coding sequence
atggccagcaacttcaatgacatcgtgaagcagggctacgtgaagatccgcagcaggaagctgggcatcttccgccgctgctggctggtgttcaagaaggccagcagcaagggcccccggcggctggagaagttcccagatgagaaggccgcctacttcaggaacttccacaaggtgacagagctgcacaacatcaagaacatcacccggctgccccgggagaccaagaagcatgctgtggccatcatcttccatgatgagaccagcaagacctttgcctgtgagagcgagctggaggccgaggagtggtgcaagcacctgtgcatggagtgcctgggcacccggctgaatgacatcagcctgggggagccagacctgctggccgccggcgtgcagcgggagcagaatgaacgcttcaacgtgtacctgatgcccacccccaacctggacatctacggggagtgcaccatgcagatcacccatgagaacatctacctgtgggacatccacaatgccaaggtgaagctggtgatgtggcccctgagcagcctgcggcgctatggccgggacagcacctggttcacctttgagagcggccgcatgtgtgacaccggggagggcctcttcaccttccagacccgggagggggagatgatctaccagaaggtgcacagcgccaccctggccatcgccgagcagcacgagcggctgatgctggagatggagcagaaggcccggctgcagaccagcctgacagagcccatgaccctgagcaagagcatcagcctgcccaggtctgcctactggcaccacatcacccggcagaacagcgtgggggagatctacagcctgcagggccacggcttcggcagcagcaagatgagccgggcccagaccttccccagctatgcccctgagcagagcgaggaggcccagcagcccctgagccgcagcagcagctatggcttctcctacagcagcagcctcatccagtag

SEQ ID NO: 38108 - DNA, 615 bp, Artificial Sequence
  Description of Artificial Sequence: Synthetic coding sequence
atggccgaggacacctacagccacaagatggtgaagaccaaccaccggcgctgcaggaccaagttcacagaggagcagctgaagatcctgatcaacaccttcaaccagaagccctacccaggctacgccaccaagcagaagctggccctggagatcaacacagaggagagccgcatccagatctggttccagaacagaagagcccggcacggcttccagaagaggcctgaggccgagaccctggagagcagccagagccagggccaggaccagcccggggtggagttccagagccgggaggcccggcgctgcaggaccacctacagcgccagccagctgcacaccctcatcaaggccttcatgaagaacccctacccaggcatcgacagccgggaggagctggccaaggagattggagtgcctgagagccgggtgcagatctggttccagaacagaagaagccggctgctgctgcagaggaagcgggagcctgtggccagcctggagcaggaggagcagggcaagatccctgagggcctgcagggcgctgaggacacccagaatggcaccaacttcaccagtgacagccacttcagcggggcccggacctggtag

SEQ ID NO: 38109 - DNA, 2259 bp, Artificial Sequence
  Description of Artificial Sequence: Synthetic coding sequence
atgacagctggctctgtgtgtgtgccccagatcatccccctgcgggtgccccagcccgggaaggccaaccacgagattgacaacaacaccctgctggagatgaagagtgacaccccagatgtgaacatctactacaccctggatggcagcaagccagagttcctgaagagaattggctacggggagaacaacaccttcaagtacatcaagcccatcaccctgcctgatggcaagatccaggtgaaggccatcgctgtgtccaaggactgccggcagagcggcatcgtgaccaaggtgttccacgtggactatgagccccccaacatcgtgtccccagaagataatgtggagaatgtgctgaaggacagcagccggcaggagttcaagaatggatttgtgggcagcaagctgaagaagaagtacaagaacagcgagaaccagaggtcctggaatgtgaacctgaggaagtttcctgagagccccctggagatcccagcctatggaggcggcagcggcagcaggcctcccacccggcagagccagagccctggctttgcccacgtgtctggccagaagtgcctgaccagcacagagatcatgaggatccagcgggagacagacttcctgaagtgtgcccactgcctggccccccggcccagcgacccctttgcccgcttctgccaggagtgtggcagccctgtgccccccatcttcggctgccgcctgcccccacctgagggcgcccagatgggcctgtgtgctgaatgtcgcagcctggtgcccatgaacacccccatctgtgtggtgtgtgaggcccccctggccctgcagctgcagccccaggccagcctgcacctgaaggagaaggtgatctgccgggcctgtggcactggaaatcctgcccacctgcgctactgtgtgacctgtgagggcgccctgcccagcagccaggagagcatgtgcagcggggacaaggcccctcctccacccacccagaagggcggcaccatcagctgctaccgctgtggccgctggaacctgtgggaggccagcttctgtggctggtgtggggccatgctgggcatcccagctggctgcagcgtgtgccccaagtgtggggccagcaaccacctgagcgcccgcttctgtggcagctgtggcatctgtgtgaagagcctggtgaagctgagcctggacaggagcctggccctggccgctgaggagccccggcccttcagcgagagcctgaacatccccctgcccaggagtgatgtgggcaccaagagggacatcggcacccagacagtgggcctcttctaccccagcggcaagctgctggccaagaaggagcaggagctggccagccagaagcagaggcaggagaagatgtctgaccacaagcccctgctgacagccatcagccctggccggggctactggaggcggcagctggaccacatcagcgcccacctgcgctgctacgcccagaacaaccctgagttccgggccctgattgctgagcccaggatgggcaagctgatcagcgccaccgtgcatgaagatggctgtgaggtgtccatccggctgaactacagccaggtgagcaacaagaacctgtacctgaacaaggctgtgaacttcagtgaccacctgctgagcagcgctgctgaaggagatggcggcctgtgtggcagccgcagctcctgggtgtctgactacagccagagcaccagtgacaccatcgagaagatcaagaggatcaagaacttcaagaccaagaccttccaggagaagaaggagcagctgatcccagaaaatcggctgctgctgaaggaggtgggccccaccggggagggccgggtgtctgtcatcgagcagctgctggatgaaggagctgaccccaactgctgtgatgaggacaacagacctgtgatcaccgtggccgtgatgaacaagcaccacgaggccatccctgtgctggtgcagagaggagctgacatcgaccagcagtggggccccctgaggaacacagccctgcacgaggccaccctgctgggcctggccggccgggagagcacagccaccctgctgggctgcaatgccagcatccagaagaagaatgctgggggccagacagcctatgacctggccctgaacacaggagatgacctggtgaccagcctgtttgctgccaagtttggccagggcctggaggaccagctggcccagaccaggagcctgagcctggatgactgctag

SEQ ID NO: 38110 - DNA, 2193 bp, Artificial Sequence
  Description of Artificial Sequence: Synthetic coding sequence
atgacagctggctctgtgtgtgtgccccagatcatccccctgcgggtgccccagcccgggaaggccaaccacgagattgacaacaacaccctgctggagatgaagagtgacaccccagatgtgaacatctactacaccctggatggcagcaagccagagttcctgaagagaattggctacggggagaacaacaccttcaagtacatcaagcccatcaccctgcctgatggcaagatccaggtgaaggccatcgctgtgtccaaggactgccggcagagcggcatcgtgaccaaggtgttccacgtggactatgagccccccaacatcgtgtccccagaagataatgtggagaatgtgctgaaggacagcagccggcaggcccgggagttcaagaatggatttgtgggcagcaagctgaagaagaagtacaagaacagcgagaaccagaggtcctggaatgtgaacctgaggaagtttcctgagagccccctggagatcccagcctatggaggcggcagcggcagcaggcctcccacccggcagagccagagccctggctttgcccacgtgtctggccagaagtgcctgaccagcacagagatcatgaggatccagcgggagacagacttcctgaagtgtgcccactgcctggccccccggcccagcgacccctttgcccgcttctgccaggagtgtggcagccctgtgccccccatcttcggctgccgcctgcccccacctgagggcgcccagatgggcctgtgtgctgaatgtcgcagcctggtgcccatgaacacccccatctgtgtggtgtgtgaggcccccctggccctgcagctgcagccccaggccagcctgcacctgaaggagaaggtgatctgccgggcctgtggcactggaaatcctgcccacctgcgctactgtgtgacctgtgagggcgccctgcccagcagccaggagagcatgtgcagcggggacaaggcccctcctccacccacccagaagggcggcaccatcagctgctaccgctgtggccgctggaacctgtgggaggccagcttctgtggctggtgtggggccatgctgggcatcccagctggctgcagcgtgtgccccaagtgtggggccagcaaccacctgagcgcccgcttctgtggcagctgtggcatctgtgtgaagagcctggtgaagctgagcctggacaggagcctggccctggccgctgaggagccccggcccttcagcgagagcctgaacatccccctgcccaggagtgatgtgggcaccaagagggacatcggcacccagacagtgggcctcttctaccccagcggcaagctgctggccaagaaggagcaggagctggccagccagaagcagaggcaggagaagatgtctgaccacaagcccctgctgacagccatcagccctggccggggctactggaggcggcagctggaccacatcagcgcccacctgcgctgctacgcccagaacaaccctgagttccgggccctgattgctgagcccaggatgggcaagctgatcagcgccaccgtgcatgaagatggctgtgaggtgtccatccggctgaactacagccaggtgagcaacaaggtgaggaagctgcggctgcgggaggtgaagcagcctgccagcagcaagggcaccaagctggccggccggcccctcatcaagaacttcaagaccaagaccttccaggagaagaaggagcagctgatcccagaaaatcggctgctgctgaaggaggtgggccccaccggggagggccgggtgtctgtcatcgagcagctgctggatgaaggagctgaccccaactgctgtgatgaggacaacagacctgtgatcaccgtggccgtgatgaacaagcaccacgaggccatccctgtgctggtgcagagaggagctgacatcgaccagcagtggggccccctgaggaacacagccctgcacgaggccaccctgctgggcctggccggccgggagagcacagccaccctgctgggctgcaatgccagcatccagaagaagaatgctgggggccagacagcctatgacctggccctgaacacaggagatgacctggtgaccagcctgtttgctgccaagtttggccagggcctggaggaccagctggcccagaccaggagcctgagcctggatgactgctag

SEQ ID NO: 38111 - DNA, 1917 bp, Artificial Sequence
  Description of Artificial Sequence: Synthetic coding sequence
atgctgaccctggagagcttccagagggtgcactggaagagccagctgatggtggaggaccaggtgctggaccaccccccagccagcccccggcaggacacagtgcccttcaccttcaagagcttcctgtttggccacagcatggagatccggccctggaagaggaagggccgcaccctcttccggcggctgctcttccagagccctggctttgcccacgtgtctggccagaagtgcctgaccagcacagagatcatgaggatccagcgggagacagacttcctgaagtgtgcccactgcctggccccccggcccagcgacccctttgcccgcttctgccaggagtgtggcagccctgtgccccccatcttcggctgccgcctgcccccacctgagggcgcccagatgggcctgtgtgctgaatgtcgcagcctggtgcccatgaacacccccatctgtgtggtgtgtgaggcccccctggccctgcagctgcagccccaggccagcctgcacctgaaggagaaggtgatctgccgggcctgtggcactggaaatcctgcccacctgcgctactgtgtgacctgtgagggcgccctgcccagcagccaggagagcatgtgcagcggggacaaggcccctcctccacccacccagaagggcggcaccatcagctgctaccgctgtggccgctggaacctgtgggaggccagcttctgtggctggtgtggggccatgctgggcatcccagctggctgcagcgtgtgccccaagtgtggggccagcaaccacctgagcgcccgcttctgtggcagctgtggcatctgtgtgaagagcctggtgaagctgagcctggacaggagcctggccctggccgctgaggagccccggcccttcagcgagagcctgaacatccccctgcccaggagtgatgtgggcaccaagagggacatcggcacccagacagtgggcctcttctaccccagcggcaagctgctggccaagaaggagcaggagctggccagccagaagcagaggcaggagaagatgtctgaccacaagcccctgctgacagccatcagccctggccggggctactggaggcggcagctggaccacatcagcgcccacctgcgctgctacgcccagaacaaccctgagttccgggccctgattgctgagcccaggatgggcaagctgatcagcgccaccgtgcatgaagatggctgtgaggtgtccatccggctgaactacagccaggtgagcaacaagaacctgtacctgaacaaggctgtgaacttcagtgaccacctgctgagcagcgctgctgaaggagatggcggcctgtgtggcagccgcagctcctgggtgtctgactacagccagagcaccagtgacaccatcgagaagatcaagaggatcaagaacttcaagaccaagaccttccaggagaagaaggagcagctgatcccagaaaatcggctgctgctgaaggaggtgggccccaccggggagggccgggtgtctgtcatcgagcagctgctggatgaaggagctgaccccaactgctgtgatgaggacaacagacctgtgatcaccgtggccgtgatgaacaagcaccacgaggccatccctgtgctggtgcagagaggagctgacatcgaccagcagtggggccccctgaggaacacagccctgcacgaggccaccctgctgggcctggccggccgggagagcacagccaccctgctgggctgcaatgccagcatccagaagaagaatgctgggggccagacagcctatgacctggccctgaacacaggagatgacctggtgaccagcctgtttgctgccaagtttggccagggcctggaggaccagctggcccagaccaggagcctgagcctggatgactgctag

SEQ ID NO: 38112 - DNA, 1656 bp, Artificial Sequence
  Description of Artificial Sequence: Synthetic coding sequence
tgacagcgggagacagacttcctgaagtgtgcccactgcctggccccccggcccagcgacccctttgcccgcttctgccaggagtgtggcagccctgtgccccccatcttcggctgccgcctgcccccacctgagggcgcccagatgggcctgtgtgccgagtgccgcagcctggtgcccatgaacacccccatctgtgtggtgtgtgaggcccccctggccctgcagctgcagccccaggccagcctgcacctgaaggagaaggtgatctgccgggcctgtggcaccggcaacccagcccacctgcgctactgtgtgacctgtgagggcgccctgcccagcagccaggagagcatgtgcagcggggacaaggcccctcctccacccacccagaagggcggcaccatcagctgctaccgctgtggccgctggaacctgtgggaggccagcttctgtggctggtgtggggccatgctgggcatcccagctggctgcagcgtgtgccccaagtgtggggccagcaaccacctgagcgcccgcttctgtggcagctgtggcatctgtgtgaagagcctggtgaagctgagcctggacaggagcctggccctggccgctgaggagccccggcccttcagcgagagcctgaacatccccctgcccaggagtgatgtgggcaccaagagggacatcggcacccagacagtgggcctcttctaccccagcggcaagctgctggccaagaaggagcaggagctggccagccagaagcagaggcaggagaagatgtctgaccacaagcccctgctgacagccatcagccctggccggggctactggaggcggcagctggaccacatcagcgcccacctgcgctgctacgcccagaacaaccctgagttccgggccctgattgctgagcccaggatgggcaagctgatcagcgccaccgtgcatgaagatggctgtgaggtgtccatccggctgaactacagccaggtgagcaacaagaacctgtacctgaacaaggctgtgaacttcagtgaccacctgctgagcagcgctgctgaaggagatggcggcctgtgtggcagccgcagctcctgggtgtctgactacagccagagcaccagtgacaccatcgagaagatcaagaggatcaagaacttcaagaccaagaccttccaggagaagaaggagcagctgatccctgagaaccggctgctgctgaaggaggtgggccccactggagagggccgggtgtctgtgattgagcagctgctggatgagggcgctgaccccaactgctgtgatgaggacaacagacctgtgatcaccgtggccgtgatgaacaagcaccacgaggccatccctgtgctggtgcagagaggagctgacatcgaccagcagtggggccccctgaggaacacagccctgcacgaggccaccctgctgggcctggccggccgggagagcacagccaccctgctgggctgcaatgccagcatccagaagaagaatgccggcggccagacagcctatgacctggccctgaacacaggagatgacctggtgaccagcctgtttgctgccaagtttggccagggcctggaggaccagctggcccagaccaggagcctgagcctggatgactgctag

SEQ ID NO: 38113 - DNA, 1758 bp, Artificial Sequence
  Description of Artificial Sequence: Synthetic coding sequence
atgctgaccctggagagcttccagagccctggctttgcccacgtgtctggccagaagtgcctgaccagcacagagatcatgaggatccagcgggagacagacttcctgaagtgtgcccactgcctggccccccggcccagcgacccctttgcccgcttctgccaggagtgtggcagccctgtgccccccatcttcggctgccgcctgcccccacctgagggcgcccagatgggcctgtgtgccgagtgccgcagcctggtgcccatgaacacccccatctgtgtggtgtgtgaggcccccctggccctgcagctgcagccccaggccagcctgcacctgaaggagaaggtgatctgccgggcctgtggcaccggcaacccagcccacctgcgctactgtgtgacctgtgagggcgccctgcccagcagccaggagagcatgtgcagcggggacaaggcccctcctccacccacccagaagggcggcaccatcagctgctaccgctgtggccgctggaacctgtgggaggccagcttctgtggctggtgtggggccatgctgggcatcccagctggctgcagcgtgtgccccaagtgtggggccagcaaccacctgagcgcccgcttctgtggcagctgtggcatctgtgtgaagagcctggtgaagctgagcctggacaggagcctggccctggccgctgaggagccccggcccttcagcgagccccgctgtgcctggcagagcctgaacatccccctgcccaggagtgatgtgggcaccaagagggacatcggcacccagacagtgggcctcttctaccccagcggcaagctgctggccaagaaggagcaggagctggccagccagaagcagaggcaggagaagatgtctgaccacaagcccctgctgacagccatcagccctggccggggctactggaggcggcagctggaccacatcagcgcccacctgcgctgctacgcccagaacaaccctgagttccgggccctgattgctgagcccaggatgggcaagctgatcagcgccaccgtgcatgaagatggctgtgaggtgtccatccggctgaactacagccaggtgagcaacaagaacctgtacctgaacaaggctgtgaacttcagtgaccacctgctgagcagcgctgctgaaggagatggcggcctgtgtggcagccgcagctcctgggtgtctgactacagccagagcaccagtgacaccatcgagaagatcaagaggatcaagaacttcaagaccaagaccttccaggagaagaaggagcagctgatccctgagaaccggctgctgctgaaggaggtgggccccactggagagggccgggtgtctgtgattgagcagctgctggatgagggcgctgaccccaactgctgtgatgaggacaacagacctgtgatcaccgtggccgtgatgaacaagcaccacgaggccatccctgtgctggtgcagagaggagctgacatcgaccagcagtggggccccctgaggaacacagccctgcacgaggccaccctgctgggcctggccggccgggagagcacagccaccctgctgggctgcaatgccagcatccagaagaagaatgccggcggccagacagcctatgacctggccctgaacacaggagatgacctggtgaccagcctgtttgctgccaagtttggccagggcctggaggaccagctggcccagaccaggagcctgagcctggatgactgctag

SEQ ID NO: 38114 - DNA, 1614 bp, Artificial Sequence
  Description of Artificial Sequence: Synthetic coding sequence
atgaccatcaacagcttcaagagccctggctttgcccacgtgtctggccagaagtgcctgaccagcacagagatcatgaggatccagcgggagacagacttcctgaagtgtgcccactgcctggccccccggcccagcgacccctttgcccgcttctgccaggagtgtggcagccctgtgccccccatcttcggctgccgcctgcccccacctgagggcgcccagatgggcctgtgtgctgaatgtcgcagcctggtgcccatgaacacccccatctgtgtggtgtgtgaggcccccctggccctgcagctgcagccccaggccagcctgcacctgaaggagaaggtgatctgccgggcctgtggcactggaaatcctgcccacctgcgctactgtgtgacctgtgagggcgccctgcccagcagccaggagctgggcatcccagctggctgcagcgtgtgccccaagtgtggggccagcaaccacctgagcgcccgcttctgtggcagctgtggcatctgtgtgaagagcctggtgaagctgagcctggacaggagcctggccctggccgctgaggagccccggcccttcagcgagagcctgaacatccccctgcccaggagtgatgtgggcaccaagagggacatcggcacccagacagtgggcctcttctaccccagcggcaagctgctggccaagaaggagcaggagctggccagccagaagcagaggcaggagaagatgtctgaccacaagcccctgctgacagccatcagccctggccggggctactggaggcggcagctggaccacatcagcgcccacctgcgctgctacgcccagaacaaccctgagttccgggccctgattgctgagcccaggatgggcaagctgatcagcgccaccgtgcatgaagatggctgtgaggtgtccatccggctgaactacagccaggtgagcaacaagaacctgtacctgaacaaggctgtgaacttcagtgaccacctgctgagcagcgctgctgaaggagatggcggcctgtgtggcagccgcagctcctgggtgtctgactacagccagagcaccagtgacaccatcgagaagatcaagaggatcaagaacttcaagaccaagaccttccaggagaagaaggagcagctgatccctgagaaccggctgctgctgaaggaggtgggccccactggagagggccgggtgtctgtgattgagcagctgctggatgagggcgctgaccccaactgctgtgatgaggacaacagacctgtgatcaccgtggccgtgatgaacaagcaccacgaggccatccctgtgctggtgcagagaggagctgacatcgaccagcagtggggccccctgaggaacacagccctgcacgaggccaccctgctgggcctggccggccgggagagcacagccaccctgctgggctgcaatgccagcatccagaagaagaatgccggcggccagacagcctatgacctggccctgaacacaggagatgacctggtgaccagcctgtttgctgccaagtttggccagggcctggaggaccagctggcccagaccaggagcctgagcctggatgactgctag

SEQ ID NO: 38115 - DNA, 1755 bp, Artificial Sequence
  Description of Artificial Sequence: Synthetic coding sequence
atgaccatcaacagcttcaagagccctggctttgcccacgtgtctggccagaagtgcctgaccagcacagagatcatgaggatccagcgggagacagacttcctgaagtgtgcccactgcctggccccccggcccagcgacccctttgcccgcttctgccaggagtgtggcagccctgtgccccccatcttcggctgccgcctgcccccacctgagggcgcccagatgggcctgtgtgctgaatgtcgcagcctggtgcccatgaacacccccatctgtgtggtgtgtgaggcccccctggccctgcagctgcagccccaggccagcctgcacctgaaggagaaggtgatctgccgggcctgtggcactggaaatcctgcccacctgcgctactgtgtgacctgtgagggcgccctgcccagcagccaggagagcatgtgcagcggggacaaggcccctcctccacccacccagaagggcggcaccatcagctgctaccgctgtggccgctggaacctgtgggaggccagcttctgtggctggtgtggggccatgctgggcatcccagctggctgcagcgtgtgccccaagtgtggggccagcaaccacctgagcgcccgcttctgtggcagctgtggcatctgtgtgaagagcctggtgaagctgagcctggacaggagcctggccctggccgctgaggagccccggcccttcagcgagccccgctgtgcctggcagagcctgaacatccccctgcccaggagtgatgtgggcaccaagagggacatcggcacccagacagtgggcctcttctaccccagcggcaagctgctggccaagaaggagcaggagctggccagccagaagcagaggcaggagaagatgtctgaccacaagcccctgctgacagccatcagccctggccggggctactggaggcggcagctggaccacatcagcgcccacctgcgctgctacgcccagaacaaccctgagttccgggccctgattgctgagcccaggatgggcaagctgatcagcgccaccgtgcatgaagatggctgtgaggtgtccatccggctgaactacagccaggtgagcaacaagaacctgtacctgaacaaggctgtgaacttcagtgaccacctgctgagcagcgctgctgaaggagatggcggcctgtgtggcagccgcagctcctgggtgtctgactacagccagagcaccagtgacaccatcgagaagatcaagaggatcaagaacttcaagaccaagaccttccaggagaagaaggagcagctgatcccagaaaatcggctgctgctgaaggaggtgggccccaccggggagggccgggtgtctgtcatcgagcagctgctggatgaaggagctgaccccaactgctgtgatgaggacaacagacctgtgatcaccgtggccgtgatgaacaagcaccacgaggccatccctgtgctggtgcagagaggagctgacatcgaccagcagtggggccccctgaggaacacagccctgcacgaggccaccctgctgggcctggccggccgggagagcacagccaccctgctgggctgcaatgccagcatccagaagaagaatgctgggggccagacagcctatgacctggccctgaacacaggagatgacctggtgaccagcctgtttgctgccaagtttggccagggcctggaggaccagctggcccagaccaggagcctgagcctggatgactgctag

SEQ ID NO: 38116 - DNA, 1050 bp, Artificial Sequence
  Description of Artificial Sequence: Synthetic coding sequence
atggccggcggcagccctgctgccaagagggtggtggtgtacagaaatggagaccccttcttccctggcagccagctggtggtgacccagaggcgcttccccaccatggaggccttcctgtgtgaggtgaccagcgctgtgcaggcccccctggccgtgcgggccctgtacaccccctgccacggccaccctgtgaccaacctggccgacctgaagaacagaggccagtatgtggccgccggctttgagcgcttccacaagctgcactacctgccccaccggggcaaggaccccggcggcaagagctgccgcctgcagggcccccctgtgaccaggcacctgtgtgatggagccatcggccggcagctgcctgctggggcccccagctacatccacgtgttcagaaatggagacctggtgagcccccccttcagcctgaagctgagccaggccgccagccaggactgggagaccgtgctgaagctgctgacagagaaggtgaagctgcagagcggggctgtgtgcaagctgtgcaccctggagggcctgcccctgtctgctgggaaggagctggtgacaggccactactacgtggccgtgggggaggatgagttcaaggacctgccctacctggagctgctggtgcccagccccagcctgccccggggctgctggcagcccccaggcagcaagagccggccccaccggcagggcgcccagggccaccgggcccaggtgacccagcccagccccaaggagccagaccgcatcaagcccagcgccttctacgcccggccccagcagaccatccagcccaggagcaagctgcccaccctgtccttccccagcggggtcatcggcgtgtatggagccccccacaggaggaaggagacagctggggccctggaggtggctgatgatgaggacacccagacagaggagcccctggaccagagagctgcccagatcgtggaggaggccctgagcctggagaaccagcccggggccggggccgccatcagcgccagcgccccagccctgcccagctag

SEQ ID NO: 38117 - DNA, 453 bp, Artificial Sequence
  Description of Artificial Sequence: Synthetic coding sequence
ctcatcctggaggagcagttccccagcggcctcatcggccccctcttcaccatgaatggccacctgctgggggacagcaaggacctgcaggacaaccacttctacgtggccgtgggcctggagaccttcaagtacttcccctactggaagagcccccgggtgcccagcgaggtgcagcagagatatgccaacgtggagaagaacagccagaggaagaagaaggtggacagcaagggcaaggagccctgcaagtatgatggcatcccccccaagacccaggacagcgtgtactatgccaaggaggagaagaagaagaccctggccgagcccctggtgcagagaggagcagaaggagatgtgtacaaggcccccacccccagcaaggagacccagggcgccctggatgtgaaggaggagcacaacgtgcagctggaggtgcctgtggaccagtag

SEQ ID NO: 38118 - DNA, 579 bp, Artificial Sequence; identical to SEQ ID NO: 38073
  Description of Artificial Sequence: Synthetic coding sequence

SEQ ID NO: 38119 - DNA, 534 bp, Artificial Sequence
  Description of Artificial Sequence: Synthetic coding sequence
atggagagcatctacctgcagaagcacctgggcgcctgcctgacccagggcctggccgaggtggcccgggtgcggcctgtggaccccatcgagtacctggccctgtggatctacaagtacaaggaaaatgtgaccatggagcagctgcggcagaaggagatggccaagctggagcgggagcgggagctggccctgatggagcaggagatgatggagcggctgaaggccgaggagctgctgctgcagcagcagcagctggccctgcagctggagctggagatgcaggagaaggagcggcagaggatccaggagctgcagagggcccaggagcagctgggcaaggagatgaggatgaacatggagaacctggtgagaaatgaagacatcctgcacagcgaggaggccaccctggacagcggcaagaccctggccgagatcagtgaccgctacggggcccccaacctgagccgggtggaggagctggatgagcccatgttcagtgacatcgccctgaacatcgaccaggacctgtag

SEQ ID NO: 38120 - DNA, 534 bp, Artificial Sequence; identical to SEQ ID NO: 38119
  Description of Artificial Sequence: Synthetic coding sequence

SEQ ID NO: 38121 - DNA, 555 bp, Artificial Sequence
  Description of Artificial Sequence: Synthetic coding sequence
atggagagcatctacctgcagaagcacctgggcgcctgcctgacccagggcctggccgaggtggcccgggtgcggcctgtggaccccatcgagtacctggccctgtggatctacaagtacaaggaaaatgtgaccatggagcagctgcggcagaaggagatggccaagctggagcgggagcgggagctggccctgatggagcaggagatgatggagcggctgaaggccgaggagctgctgctgcagcagcagcagctggccctgcagctggagctggagatgcaggagaaggagcggcagaggatccaggagctgcagagggcccaggagcagctgggcaaggagatgaggatgaacatggagaacctggtgagaaatgaagacatcctgcacagcgaggaggccaccctggacagcggcaagaccctggccgagatcagtgaccgctacggggcccccaacctgagccgggtggaggagctggatgagcccatgttcagtgatgtgtccatcagcgtcttctgtgagaagacccgcttctgcttctgcttctag

SEQ ID NO: 38122 - DNA, 243 bp, Artificial Sequence
  Description of Artificial Sequence: Synthetic coding sequence
atggagagcatctacctgcagaagcacctgggcgcctgcctgacccagggcctggccgaggtggcccgggtgcggcctgtggaccccatcgagtacctggccctgtggatctacaagtacaaggaaaatgtgaccatggagcagctgcggcagaaggagatggccaagctggagcgggagcgggagctggccctgatggagcaggagatgatggagcggctgaaggccgaggagctgctgtag

SEQ ID NO: 38123 - DNA, 462 bp, Artificial Sequence
  Description of Artificial Sequence: Synthetic coding sequence
atggagagcatctacctgcagaagcacctgggcgcctgcctgacccagggcctggccgaggtggcccgggtgcggcctgtggaccccatcgagtacctggccctgtggatctacaagtacaaggaaaatgtgaccatggagcagctgcggcagaaggagatggccaagctggagcgggagcgggagctggccctgatggagcaggagatgatggagcggctgaaggccgaggagctgctgctgcagcagcagcagctggccctgcagctggagctggagatgcaggagaaggagcggcagaggatccaggagctgcagagggcccaggagcagctgggcaaggagatgaggatgaacatggagaacctggtgagaaatgaagacatcctgcacagcgaggaggccaccctggacagcggcaagaccctggccgagatcagtgaccgctacggggccccctag

SEQ ID NO: 38124 - DNA, 534 bp, Artificial Sequence
  Description of Artificial Sequence: Synthetic coding sequence
atggagaccaactacctgaagcgctgcttcggcaactgcctggcccaggccctggccgaggtggccaaggtgcggcccagcgaccccatcgagtacctggcccactggctgtaccactacaggaagacagccaaggccaaggaggagaaccgggagaagaagatccacctgcaggaggagtatgacagcagcctgaaggagatggagatgacagagatgctgaagcaggaggagtaccagatccagcagaactgtgagaagtgccacaaggagctgaccagcgagaccgtgtccaccaagaagaccatcttcatgcaggaggacaccaaccccctggagaaggaggccctgaagcaggagttcctgcccggcaccagcagcctcatccctggcatgccccagcaggtgcccccatctgagagcgctggccagattgaccagaacttcaagatgccccaggagatcaactacaaggaggccttccagcacgaggtggcccacgagatgcctcctggcagcaagagccccttctag

SEQ ID NO: 38125 - DNA, 534 bp, Artificial Sequence; identical to SEQ ID NO: 38124
  Description of Artificial Sequence: Synthetic coding sequence

SEQ ID NO: 38126 - DNA, 576 bp, Artificial Sequence
  Description of Artificial Sequence: Synthetic coding sequence
atgatcctgcggcccccccagcagtgtggcacagctgccaggatggagaccaactacctgaagcgctgcttcggcaactgcctggcccaggccctggccgaggtggccaaggtgcggcccagcgaccccatcgagtacctggcccactggctgtaccactacaggaagacagccaaggccaaggaggagaaccgggagaagaagatccacctgcaggaggagtatgacagcagcctgaaggagatggagatgacagagatgctgaagcaggaggagtaccagatccagcagaactgtgagaagtgccacaaggagctgaccagcgagaccgtgtccaccaagaagaccatcttcatgcaggaggacaccaaccccctggagaaggaggccctgaagcaggagttcctgcccggcaccagcagcctcatccctggcatgccccagcaggtgcccccatctgagagcgctggccagattgaccagaacttcaagatgccccaggagatcaactacaaggaggccttccagcacgaggtggcccacgagatgcctcctggcagcaagagccccttctag

SEQ ID NO: 38127 - DNA, 534 bp, Artificial Sequence; identical to SEQ ID NO: 38124
  Description of Artificial Sequence: Synthetic coding sequence

SEQ ID NO: 38128 - DNA, 381 bp, Artificial Sequence
  Description of Artificial Sequence: Synthetic coding sequence
atggagaccaactacctgaagcgctgcttcggcaactgcctggcccaggccctggccgaggtggccaaggtgcggcccagcgaccccatcgagtacctggcccactggctgtaccactacaggaagacagccaaggccaaggaggagaaccgggagaagaagatccacctgcaggaggagtatgacagcagcctgaaggagatggagatgacagagatgctgaagcaggaggagtaccagatccagcagaactgtgagaagtgccacaaggagctgaccagcgagaccgtgtccaccaagaagaccatcttcatgcaggaggacaccaaccccctggagaaggaggccctgaagcaggagttcctgcccggcaccagctag

SEQ ID NO: 38129 - DNA, 534 bp, Artificial Sequence; identical to SEQ ID NO: 38124
  Description of Artificial Sequence: Synthetic coding sequence

SEQ ID NO: 38130 - DNA, 915 bp, Artificial Sequence
  Description of Artificial Sequence: Synthetic coding sequence
atgagcctgaacccccccatcttcctgaagaggtctgaggagaacagcagcaagtttgtggagaccaagcagagccagaccaccagcatcgccagcgaggaccccctgcagaacctgtgcctggccagccaggaggtgctgcagaaggcccagcagagcggccgcagcaagtgcctgaagtgtggcggcagcaggatgttctactgctacacctgctacgtgcctgtggagaatgtgcccatcgagcagatccccctggtgaagctgcccctgaagattgacatcatcaagcaccccaatgaaacagatggcaagagcacagccatccacgccaagctgctggcccctgagtttgtgaacatctacacctacccctgcatcccagaatatgaggagaaggaccacgaggtggccctgatcttccctggcccccagagcatcagcatcaaggacatctccttccacctgcagaagaggatccagaacaacgtgcggggcaagaatgatgatcctgacaagcccagcttcaagaggaagaggacagaggagcaggagttctgtgacctgaatgacagcaaatgtaaaggcaccaccctgaagaagatcatcttcatcgacagcacctggaaccagaccaacaagatcttcacagatgagcggctgcagggcctgctgcaggtggagctgaagaccaggaagacctgcttctggaggcaccagaagggcaagccagacaccttcctgagcaccatcgaggccatctactacttcctggtggactaccacacagacatcctgaaggagaagtaccggggccagtatgacaacctgctcttcttctacagcttcatgtaccagctgatcaagaatgccaagtgcagcggggacaaggagaccgggaagctgacccactag

SEQ ID NO: 38131 - DNA, 330 bp, Artificial Sequence
  Description of Artificial Sequence: Synthetic coding sequence
atgagcctgaacccccccatcttcctgaagaggtctgaggagaacagcagcaagtttgtggagaccaagcagagccagaccaccagcatcgccagcgaggaccccctgcagaacctgtgcctggccagccaggaggtgctgcagaaggcccagcagagcggccgcagcaagtgcctgaagtgtggcggcagcaggatgttctactgctacacctgctacgtgcctgtggagaatgtgcccatcgagcagatccccctggtgaagttcagcctgtaccacctgggccagagcatggtgtcctctgccagcaagatcacctgcatcggctag

SEQ ID NO: 38132 - DNA, 915 bp, Artificial Sequence; identical to SEQ ID NO: 38130
  Description of Artificial Sequence: Synthetic coding sequence

SEQ ID NO: 38133 - DNA, 654 bp, Artificial Sequence
  Description of Artificial Sequence: Synthetic coding sequence
atgctgcccctgaagattgacatcatcaagcaccccaatgaaacagatggcaagagcacagccatccacgccaagctgctggcccctgagtttgtgaacatctacacctacccctgcatcccagaatatgaggagaaggaccacgaggtggccctgatcttccctggcccccagagcatcagcatcaaggacatctccttccacctgcagaagaggatccagaacaacgtgcggggcaagaatgatgatcctgacaagcccagcttcaagaggaagaggacagaggagcaggagttctgtgacctgaatgacagcaagtgcaagggcaccaccctgaagaagatcatcttcatcgacagcacctggaaccagaccaacaagatcttcacagatgagcggctgcagggcctgctgcaggtggagctgaagaccaggaagacctgcttctggaggcaccagaagggcaagccagacaccttcctgagcaccatcgaggccatctactacttcctggtggactaccacacagacatcctgaaggagaagtaccggggccagtatgacaacctgctcttcttctacagcttcatgtaccagctgatcaagaatgccaagtgcagcggggacaaggagaccgggaagctgacccactag

SEQ ID NO: 38134 - DNA, 915 bp, Artificial Sequence; identical to SEQ ID NO: 38130
  Description of Artificial Sequence: Synthetic coding sequence

SEQ ID NO: 38135 - DNA, 285 bp, Artificial Sequence
  Description of Artificial Sequence: Synthetic coding sequence
atgagcctgaacccccccatcttcctgaagaggtctgaggagaacagcagcaagtttgtggagaccaagcagagccagaccaccagcatcgccagcgaggaccccctgcagaacctgtgcctggccagccaggaggtgctgcagaaggcccagcagagcggccgcagcaagtgcctgaagtgtggcggcagcaggatgttctactgctacacctgctacgtgcctgtggagaatgtgcccatcgagcagatccccctggtgaagctgcccctgaagattgattag

SEQ ID NO: 38136 - DNA, 897 bp, Artificial Sequence
  Description of Artificial Sequence: Synthetic coding sequence
atggagagccagaaggaggcccggaccctgcaggagcctgtggcccggcccagcggggccagcagcagccagaccccaaatgacaaggagcggcgggagggcggcgctgtgcctgctgctgctgccctgggcgctgaggctgatgatgattctgcagatggcctgtgggagctgcctgtggagcctgctgagaggaggcctgagtgcacccgctgcagccggccccagaaggtgtgcctgtgccccttcctgcctgcccaccccctgcacatcagcacccacctgtacatcatccagcaccctgctgaggagaacaaggtgctgaggacagtgcccctgctggccgcctgcctgccccaggacaagtgcaaggtgaagattggaagacgcttcagcgaggagcgggaccctgagctgagcacagtgtgcaggaagagcggcaccctcatcctgtacccaggagctgaggccgccaacctggaggagttcatcctggacagccctgtgtaccccagcaccatcatcatcattgatggcacctggagccaggccaaggacatcttctacaagaacagcctcttccgccaccccaagcaggtgcagctgaagaccagcatcagcagccagtatgtgatccgcatgcagcccaccaaccgctgcctgagcaccctggagtgtgccgctgtggccctgagcatcctggagaagaacaactacatccaggagaccctgctgcggcccctgcaggccctgtgcagcttccagctgcagcacggggcccagatccggctgagcaaggagcacctgctgaagaatggcctgtaccccaagcccatgcccaagaacaagaggaagctgaggaagatggagctgctgatgaacagcgtgaagatctag

SEQ ID NO: 38137 - DNA, 3477 bp, Artificial Sequence
  Description of Artificial Sequence: Synthetic coding sequence
atggccaccaggaaggacacagaggaggagcaggtggtgcccagtgaagaagatgaggccaacgtgcgggctgtgcaggcccactacctgcggagccccagccccagccagtacagcatggtgtctgatgctgagacagagagcatcttcatggagcccatccacctgagcagcgccatcgccgccaagcagatcatcaatgaggagctgaagcccccaggagtgcgggcagatgctgagtgccccggcatgctggagagcgctgagcagctgctggtggaggacctgtacaacagagtgcgggagaagatggatgacaccagcctgtacaacaccccctgtgtgctggacctgcagagggccctggtgcaggaccggcaggaggccccctggaatgaggtggatgaggtgtggcccaacgtgttcatcgccgagaagtctgtggccgtgaacaagggccgcctgaagaggctgggcatcacccacatcctgaatgctgcccacggcaccggggtgtacacaggccctgagttctacacaggcctggagatccagtacctgggcgtggaggtggatgacttccctgaggtggacatcagccagcacttcaggaaggccagcgagttcctggatgaggccctgctgacctaccggggcaaggtgctggtgtcctctgagatgggcatcagccgctctgctgtgctggtggtggcctacctgatgatcttccacaacatggccatcctggaggccctgatgacagtgaggaagaagagggccatctacccaaatgaaggcttcctgaagcagctgcgggagctgaatgagaagctgatggaggagcgggaggaggactatggccgggagggcggcagcgctgaggccgaggagggggagggcaccggctccatgctgggcgcccgggtgcacgccctgactgtggaggaggaggatgacagcgccagccacctgagcggcagcagcctgggcaaggccacccaggccagcaagcccctgaccctgattgatgaggaggaggaggagaagctgtatgagcagtggaagaagggccagggcctgctgagtgacaaggtgccccaggacggcggcggctggaggtctgccagcagcggccagggcggggaggagctggaggatgaagatgtggagcgcatcatccaggagtggcagagcagaaatgaaagataccaggccgagggctaccgccgctggggccgggaggaggagaaggaggaggagagtgatgctggcagctctgtgggcagaagaagaaggaccctgtctgagagcagcgcctgggagagcgtgagcagccatgacatctgggtgctgaagcagcagctggagctgaacagaccagaccacggcagaagaagaagagctgacagcatgagcagcgagagcacctgggatgcctggaatgaaaggctgctggagattgagaaggaggccagccgccgctaccacgccaagagcaagcgggaggaggccgctgacaggagcagcgaggccggcagccgggtgagagaagatgatgaggacagcgtgggcagcgaggccagcagcttctacaacttctgcagcaggaacaaggacaagctgacagccctggagcgctggaagatcaagaggatccagtttggcttccacaagaaggacctgggcgctggggacagcagtggagagcccggggctgaggaggccgtgggggagaagaaccccagtgatgtgtccctgacagcctaccaggcctggaagctgaagcaccagaagaaggtgggcagcgagaacaaggaggaggtggtggagctgagcaaaggagaagattctgccctggccaagaagaggcagaggcggctggagctgctggagaggagccggcagaccctggaggagagccagagcatggcctcctgggaggccgacagcagcacagccagcggcagcatccccctgagcgccttctggagcgctgaccccagcgtgtctgcagatggagacaccacctctgtgctgagcacccagagccacaggagccacctgagccaggccgccagcaacattgctggctgcagcaccagcaaccccaccacccccctgcccaacctgcctgtgggccctggggacaccatcagcatcgccagcatccagaactggatcgccaacgtggtgtctgagaccctggcccagaagcagaatgagatgctgctgctgagccgcagccccagcgtggcctccatgaaggctgtgcctgctgccagctgcctgggagatgaccaggtgtccatgctgagcggccacagcagcagcagcctgggcggctgcctgctgccccagagccaggcccggcccagcagtgacatgcagagcgtgctgagctgcaacaccaccctgagcagccctgctgagagctgccgcagcaaggtgcggggcaccagcaagcccatcttcagcctgtttgctgacaacgtggacctgaaggagctgggcaggaaggagaaggagatgcagatggagctgcgggagaagatgtctgagtacaagatggagaagctggccagtgacaacaagaggagcagcctcttcaagaagaagaaggtgaaggaggatgaagatgatggagtgggagatggagatgaggacacagattctgccatcggcagcttccgctacagcagccgcagcaacagccagaagccagagacagacacctgcagcagcctggccgtgtgtgaccactacgccagcggcagccgggtgggcaaggagatggacagcagcatcaacaagtggctgagcggcctgaggacagaggagaagccacccttccagagcgactggagcggcagcagccggggcaagtacaccaggagcagcctgctgcgggagacagagagcaagagcagcagctacaagttcagcaagagccagagcgaggagcaggacaccagcagctaccacgaggccaatggaaacagcgtgcgcagcaccagccgcttcagcagcagcagcacccgggagggccgggagatgcacaagttcagccgcagcacctacaatgagaccagcagcagccgggaggagagccctgagccctacttcttccggaggaccccagagagcagcgagcgggaggagagccctgagccccagaggcccaactgggcccggagccgggactgggaggatgtggaggagagcagcaagagtgacttcagcgagtttggagccaagaggaagttcacccagagcttcatgaggtctgaggaggagggggagaaggagaggacagaaaatcgggaggagggccgctttgccagcggccgccgcagccagtacagaagaagcacagaccgggaggaggaggaggagatggatgatgaggccatcatcgccgcctggaggcggcggcaggaggagaccaggaccaagctgcagaagagaagagaagattag

SEQ ID NO: 38138 - DNA, 3477 bp, Artificial Sequence; identical to SEQ ID NO: 38137
  Description of Artificial Sequence: Synthetic coding sequence

SEQ ID NO: 38139 - DNA, 3477 bp, Artificial Sequence; identical to SEQ ID NO: 38137
  Description of Artificial Sequence: Synthetic coding sequence

SEQ ID NO: 38140 - DNA, 531 bp, Artificial Sequence
  Description of Artificial Sequence: Synthetic coding sequence
atgggccctgctgaggccggcagaagaggagctgccagccctgtgcccccacccctggtgcgggtggcccccagcctcttcctgggcagcgcccgggccgccggggctgaggagcagctggcccgggccggcgtgaccctgtgtgtgaatgtgtcccggcagcagcccggcccccgggcccctggggtggccgagctgcgggtgcctgtgtttgatgatcctgctgaggacctgctggcccacctggagcccacctgtgccgccatggaggccgctgtgcgggccggcggggcctgcctggtgtactgcaagaatggccgcagccgctctgctgctgtgtgcacagcctacctgatgaggcaccggggcctgagcctggccaaggccttccagatggtgaagagcgcccggcctgtggccgagcccaaccctggcttctggagccagctgcagaagtatgaggaggccctgcaggcccagagctgcctgcagggcgagcccccagccctgggcctgggccctgaggcctag

SEQ ID NO: 38141 - DNA, 531 bp, Artificial Sequence; identical to SEQ ID NO: 38140
  Description of Artificial Sequence: Synthetic coding sequence

SEQ ID NO: 38142 - DNA, 1155 bp, Artificial Sequence
  Description of Artificial Sequence: Synthetic coding sequence
atggagggcctgggccgcagctgcctgtggctgcggcgggagctgagccccccccggccccggctgctgctgctggactgccgcagccgggagctgtatgaaagtgcccgcatcggcggggccctgtctgtggccctgcctgccctgctgctgcggcggctgcggcggggcagcctgtctgtgcgggccctgctgcccggcccccccctgcagcccccacctccagcccctgtgctgctgtatgaccagggcggcggcagaagaagaagaggagaggccgaggccgaggccgaggagtgggaggccgagagcgtgctgggcaccctgctgcagaagctgcgggaggagggctacctggcctactacctgcagggcggcttcagccgcttccaggctgaatgtccccacctgtgtgagaccagcctggccggccgggccggcagctccatggcccctgtgcccggccctgtgcctgtggtgggcctgggcagcctgtgcctgggcagtgactgcagtgatgctgagagcgaggccgaccgggacagcatgagctgtggcctggacagcgagggcgccaccccacctcctgtgggcctgcgggccagcttccctgtgcagatcctgcccaacctgtacctgggcagcgcccgggacagcgccaacctggagagcctggccaagctgggcatccgctacatcctgaatgtgacccccaacctgcccaacttctttgagaagaatggagacttccactacaagcagatccccatcagtgaccactggagccagaacctgagccgcttcttccctgaggccatcgagttcattgatgaggccctgagccagaactgtggggtgctggtgcactgcctggccggcgtgagccgctctgtgacagtgacagtggcctacctgatgcagaagctgcacctgagcctgaatgatgcctatgacctggtgaagaggaagaagagcaacatcagccccaacttcaacttcatgggccagctgctggactttgagaggagcctgcggctggaggagcggcacagccaggagcagggcagcggcggccaggccagcgctgccagcaacccccccagcttcttcaccacccccaccagtgatggagcctttgagctggcccccacctag

SEQ ID NO: 38143 - DNA, 1707 bp, Artificial Sequence
  Description of Artificial Sequence: Synthetic coding sequence
atgaagtggaaggagaagctgggagatggagtgtatgacaccttcatgatgattgatgagaccaagtgccccccctgcagcaatgtgctgtgcaaccccagcgagcccccaccaccccggcggctgaacatgaccacagagcagttcaccggggaccacacccagcacttcctggatggaggagagatgaaggtggagcagctgttccaggagtttggaaacaggaagagcaacaccatccagagtgatggcatcagtgacagcgagaagtgcagccccaccgtgtcccagggcaagagcagtgactgcctgaacacagtgaagagcaacagcagcagcaaggcccccaaggtggtgcccctgaccccagagcaggccctgaagcagtacaagcaccacctgacagcctatgagaagctggagatcatcaactacccagagatctactttgtgggccccaatgccaagaagagacatggagtcatcggcggccccaacaatggaggctatgatgatgctgatggagcctacatccacgtgccccgggaccacctggcctaccgctatgaggtgctgaagatcatcggcaagggcagctttggccaggtggcccgggtgtatgaccacaagctgcggcagtatgtggccctgaagatggtgagaaatgagaagcgcttccaccggcaggccgctgaggagatccgcatcctggagcacctgaagaagcaggacaagacaggctccatgaatgtcatccacatgctggagagcttcaccttcagaaatcatgtgtgcatggcctttgagctgctgagcattgacctgtatgagctgatcaagaagaacaagttccagggcttctctgtgcagctggtgaggaagtttgcccagagcatcctgcagagcctggatgccctgcacaagaacaagatcatccactgtgacctgaagccagagaacatcctgctgaagcaccacggccgcagcagcaccaaggtgattgactttggcagcagctgctttgagtaccagaagctgtacacctacatccagagccgcttctaccgggcccctgagatcatcctgggcagccgctacagcacccccatcgacatctggagctttggctgcatcctggccgagctgctgaccggccagcccctcttccctggagaagatgaaggagaccagctggcctgcatgatggagctgctgggcatgcccccacccaagctgctggagcagagcaagagggccaagtacttcatcaacagcaagggcatcccccgctactgcagcgtgaccacccaggctgatggccgggtggtgctggtgggcggccgcagccggcggggcaagaagaggggccccccaggcagcaaggactggggcacagccctgaagggctgtgatgactacctgttcatcgagttcctgaagcgctgcctgcactgggaccccagcgcccggctgaccccagcccaggccctgcggcacccctggatcagcaagtctgtgccccggcccctgaccaccatcgacaaggtgtctgggaagagggtggtgaacccagccagcgccttccagggcctgggcagcaagctgccccctgtggtgggcatcgccaacaagctgaaggccaacctgatgtctgagaccaacggcagcatccccctgtgcagcgtgctgcccaagctgatctcctag

SEQ ID NO: 38144 - DNA, 1767 bp, Artificial Sequence; identical to SEQ ID NO: 36575
  Description of Artificial Sequence: Synthetic coding sequence

SEQ ID NO: 38145 - DNA, 1827 bp, Artificial Sequence; identical to SEQ ID NO: 36574
  Description of Artificial Sequence: Synthetic coding sequence

SEQ ID NO: 38146 - DNA, 288 bp, Artificial Sequence
  Description of Artificial Sequence: Synthetic coding sequence
atgaccaccccagctggcagcggcagcggctttggatctgtgtcctggtggggcctgagccctgccctggacctgcaggccgagagcccccctgtggaccctgacagccaggccgacacagtgcacagcaaccctgagctggatgtgctgctgctgggctctgtggatggccgccacctgctgcggaccctgagccgggccaagttctggccccggcggcgcttcaacgtgtcctgggatgaagatgagagcccagacagccgggtgctggagggcggccgggactag

SEQ ID NO: 38147 - DNA, 9279 bp, Artificial Sequence
  Description of Artificial Sequence: Synthetic coding sequence
atgtctgatgccaacaaggccgccatcgctgctgagaaggaggccctgaacctgaagctgccccccatcgtgcacctgcctgagaacatcggcgtggacacccccacccagagcaagctgctgaagtaccgccgcagcaaggagcagcagcagaagatcaaccagctggtgattgatggagccaagaggaacctggacaggaccctgggcaagaggacccccctgctgcccccaccagactacccccagaccatgaccagcgagatgaagaagaagggcttcaactacatctacatgaagcagtgtgtggagagcagccccctggtgcccatccagcaggagtggctggaccacatgctgcggctcatccctgagagcctgaaggagggcaaggagcgggaggagctgctggagagcctcatcaatgaggtgtccagtgactttgaaaattccatgaagcgctacctggtgcagagcgtgctggtgaagccccctgtgaagagcctggaggatgaaggaggccccctgcctgagagccctgtgggcctggactacagcaacccctggcacagcagctatgtgcaggccaggaaccagatcttcagcaacctgcacatcatccaccccaccatgaagatgctgctggacctgggctacaccacctttgctgacacagtgctgctggacttcaccggcatccgggccaagggccccatcgactgtgagagcctgaagacagacctgagcatccagaccagaaatgctgaggagaagatcatgaacacctggtaccccaaggtgatcaacctcttcaccaagaaggaggccctggagggcgtgaagccagagaagctggatgccttctacagctgtgtgtccaccctgatgagcaaccagctgaaggacctgctgcggaggacagtggagggctttgtgaagctgtttgaccccaaggaccagcagaggctgcccatcttcaagattgagctgacctttgatgatgacaagatggagttctaccccaccttccaggacctggaggacaacgtgctgagcctggtggagagaattgctgaggccctgcagaatgtgcagaccatccccagctggctgagcggcaccagcacccctgtgaacctggacacagagctgcctgagcacgtgctgcactgggccgtggacaccctgaaggctgctgtgcacaggaacctggagggcgccaggaagcactatgagacctacgtggagaagtacaactggctgctggatggaacagctgtggagaacatcgagaccttccagacagaggaccacacctttgatgagtacacagagttcatcgagaagttcctgagcctggccagcgagatcatgctgctgccccagtggatccactacaccatggtgcggctggactgtgaggacctgaagacaggcctgaccaacaaggccaaggcctttgccaacatcctgctgaatgacatcgccagcaagtacagaaaagaaaatgaatgcatctgcagcgagtttgaggccatcaaggagcacgccctgaaggtgcctgagaccacagaggagatgatggacctgatctcctatgtggagaaggccaggacagtgggcatcgaggagctgatcctgcgcatccaggagagcaagaggcagatgagctacttcctggatgtgttcctgttcccccaggaggacctggccctgaatgccaccgtgctgatgtggcccaggaagatcaaccccatctttgatgaaaatgatgagctgattgaaaatgccaagcacaagaaggaaaatgagctgatggccaagcgggagaagctgatcctggagattgagaaggagagcaggaggatggaggagttcacagaatttgctgagctggagaggatgcagcagtatgtgacagatgtgcggcagctgcagaagaggatccaggagagcgaggaggccgtgcagttcatcaacaaggaggaggagctgttcaagtgggagctgaccaagtacccagagctggacaagctgaaggtgaacatcgagccctaccagaagttcttcaactttgtgctgaagtggcagaggtctgagaagcgctggatggatggcggcttcctggacctgaatggagagagcatggaggctgatgtggaggagttcagccgggagatcttcaagaccctgaagttcttccagaccaagctgaagaaggagctgcaggagaagaggaaggccgccaggaagaggagcctggaggaggagaagattgaggaggagcccaaggacaatgccaccatcaccatgtgcaggatgagggcccggcactggaagcagatcagcgagatcgtgggctatgacctgaccccagacagcggcaccaccctgaggaaggtgctgaagctgaacctgaccccctacctggagcagtttgaagtcatctctgctggggccagcaaggagttcagcctggagaaggccatgaacaccatgattggcacctgggaggacatcgccttccacatcagcctgtacagagacaccggggtgtgcatcctgagctctgtggatgagatccaggccatcctggatgaccagatcatcaagacccagaccatgaggggcagccccttcatcaagccctttgagcacgagatcaaggcctgggaggacaggctcatccgcatccaggagaccattgatgagtggctgaaggtgcaggcccagtggctgtacctggagcccatcttctgcagcgaggacatcatgcagcagatgcctgaggagggccggcagttccagacagtggacagacactggagggacatcatgaagttctgtgccaaggaccccaaggtgctggccgccaccagcctgaccggcctgctggagaagctgcagaactgcaatgagctgctggagaagatcatgaagggcctgaatgcctacctggagaagaagaggctcttcttcccccgcttcttcttcctgagcaatgatgagatgctggagatcctgtctgagaccaaggaccccctgcgggtgcagccccacctgaagaagtgctttgagggcatcgccaagctggagttcctgcccaacctggacatcaaggccatgtacagcagcgagggggagcgggtggagctgattgccctgatcagcaccagcgctgcccggggagctgtggagaagtggctgatccaggtggaggacctgatgctgcggtctgtgcatgatgtgattgctgctgcccggctggcctacccagagagcgcccggcgggactgggtgcgggagtggccaggccaggtggtgctgtgcatcagccagatgttctggaccagcgagacccaggaggtgatcagcggcggcacagagggcctgaagaagtactacaaggagctgcagaaccagctgaatgaaattgtggagctggtgcggggcaagctgagcaagcagaccaggaccaccctgggcgccctggtgaccattgatgtgcacgccagagatgtggtgatggacatgatcaagatgggcgtgtcccatgacacagacttcctgtggctggcccagctgcgctactactgggagaatgaaaatgcccgggtgcgcatcatcaactgcaatgtgaagtatgcctatgagtacctgggcaacagcccccggctggtgatcacccccctgacagaccgctgctaccgcaccctcatcggggccttctacctgaacctgggcggggcccctgagggccctgctggcaccgggaagacagagaccaccaaggacctggccaaggccctggccgtgcagtgtgtggtgttcaactgcagtgatggcctggactacctggccatgggcaagttcttcaagggcctggccagcagcggggcctgggcctgctttgatgagttcaaccgcatcgagctggaggtgctgtctgtggtggcccagcagatcctgtgcatccagagggccatccagcagaagctggtggtgtttgtgtttgagggcacagagctgaagctgaaccccaactgctttgtggccatcaccatgaaccctggctacgccggccgctctgagctgcctgacaacctgaaggtgctcttcagaacagtggccatgatggtgcccaactatgccctgattgctgagatcagcctgtacagctatggcttcctgaatgcccggcccctgtctgtgaagatcgtgatgacctaccgcctgtgcagcgagcagctgagcagccagttccactatgactatggcatgagagctgtgaaggctgtgctggtggccgccggcaacctgaagctgaagtacccaaatgaaaatgaagacatcctgctgctgcggagcatcaaggatgtgaatgagcccaagttcctgagccatgacatccccctcttcaacggcatcaccagtgacctcttccctggcatcaagctgcctgaggccgactaccacgagttcctggagtgtgcccacgaggcctgcaatgtgcacaacctgcagcctgtgaagttcttcctggagaagatcatccagacctatgagatgatgattgtgcgccacggcttcatgctggtgggggagccctttgctgccaagaccaaggtgctgcacgtgctggccgacaccctgaccctgatgaatgaacatggctatggagaggaggagaaggtgatctacagaacagtgaaccccaagagcatcaccatgggccagctgtttggccagtttgatcctgtgtcccatgagtggacagatggcatcgtggccaacaccttccgggagtttgccctgtctgagaccccagacaggaagtgggtggtgtttgatggccccatcgacaccctgtggattgaatccatgaacacagtgctggatgacaacaagaagctgtgcctgatgtctggagagatcatccagatgagcccccagatgagcctcatctttgagaccatggacctgagccaggccagccctgccaccgtgagccgctgtggcatgatctacctggagcccagccagctgggctgggagcccctggtgtcctcctggctgaacagcctgaagggccccctgtgtgagcctgagtaccaggccctgctgcggggcctgtttgcctggctgatcccccccagcctgaaccagagggtggagctgttccagctgaactacctgtacaccaccatcgtgtccaagatcctgaagatcctgatcaccttccgcatcagcaactacttcaagtatgtgcccctgaagacccagtgcaccttcatcaagttcttcctgcaccagcaggcctgcttcatcttcagcctcatctggagcattggaggcagctgtgacacagatggccggcgggtgtttgacaccttcatccgcctcatcatcctgggcaaggatgatgaaaatcctgtgcctgattctgtgggcaagtgggagtgcccctttgatgagaagggcctggtgtatgactacatgtatgagctgaagaacaagggccgctgggtgcactggaatgagctgatcaagaacaccaacctgggggacaagcagatcaagatccaggacatcatcgtgcccaccatggacaccatccgctacaccttcctgatggacctgagcatcacctacgccaagcccctgctgtttgtgggccccaccggcaccgggaagtctgtgtatgtgaaggacaagctgatgaaccacctggagaaggaccagtacttccccttctacatcaacctgagcgcccggaccagcgccaaccaggtgcagaacatcatcatggcccggctggacaagaggaggaagggcgtgtttggaccacccatgggcaagaagtgcatcatcttcattgatgacatgaacatgcctgccctggagaagtacggggcccagccccccatcgagctgctgcggcagttctttgactgtggccactggtatgacctgaaggacaccagcaagatcaccctggtggacatcgagctgattgctgccatgggccccccaggcggcggcagaaatcctgtgaccccccgctgcatccgccacttcaacatctgcagcatcaacagcttcagtgatgagaccatggtgcgcatcttcagcagcatcgtggccttctacctgcggacccatgagttccccccagagtactttgtgattggcaaccagatcgtgaatggcaccatggagatctacaagcagagcgtggagaacctgctgcccacccccaccaagagccactacaccttcaacctgcgggacttcagcagggtcatccggggctgcctgctgattgaaagagatgctgtggccaacaagcacaccatgatccggctgtttgtgcatgaggtgctgcgggtcttctatgacaggctcatcaatgatgatgaccggcgctggctgttccagctgaccaagacagtcatcaaggaccacttcaaggagagcttccacagcatcttcagccacctgaggaagcagaatgcccctgtgacagaggaggacctgaggaacctgatgtttggagactacatgaacccagacctggagggagatgacagagtgtacatcgagatccccaacatccaccacttcagtgatgtggtggaccagtgcctggatgagtacaaccagacccacaagaccaggatgaacctggtgatcttccgctacgtgctggagcacctgagccgcatctgccgggtgctgaagcagagcggcggcaatgccctgctggtgggcctgggcggcagcggccggcagagcctgacccggctggccacctccatggccaagatgcacatcttccagcctgagatcagcaagagctatggcatgaatgagtggagggaggacatgaagagcttcatcgctgtgcctgtgaccaaccgcatcgtggacaacaagagcaagatcctggagaagaggctgcgctacctgaatgaccacttcacctacaacctgtactgcaacatctgccgcagcctgtttgagaaggacaagctgctcttctccttcctgctgtgtgccaacctgctgctggccaggaaggagattgagtaccaggagctgatgttcctgctgaccggcggcgtgtccctgaagtctgctgagaagaacccagaccccacctggctgcaggacaagtcctgggaggagatctgccgggccagcgagttccctgccttccggggcctgcggcagcacttctgtgagcacatctatgagtggagggagatctatgacagcaaggagccccacaatgccaagtttcctgcccccatggacaagaacctgaatgagctgcagaagatcatcatcctgcgctgcctgcggccagacaagatcaccccagccatcaccaactacgtgacagacaagctgggcaagaagtttgtggagcccccaccatttgacctgaccaagagctacctggacagcaactgcaccatccccctcatctttgtgctgagccctggagctgaccccatggccagcctgctgaagtttgccaatgacaagtccatgagcggcaacaagttccaggccatcagcctgggccagggccagggccccatcgccgccaagatgatcaaggccgccatcgaggagggcacctgggtgtgcctgcagaactgccacctggccgtgtcctggatgcccatgctggagaagatctgtgaggacttcaccagcgagacctgcaacagcagcttccggctgtggctgaccagctaccccagcagcaagtttcctgtgaccatcctgcagaatggagtgaagatgaccaatgaaccacccaccggcctgcggctgaacctgctgcagagctacctgacagatcctgtgtctgaccctgagttcttcaagggctgccggggcaaggagctggcctgggagaagctgctgtttggagtgtgcttcttccacgccctggtgcaggagaggaagaagtttggccccctgggctggaacatcccctacggcttcaatgaaagtgacctgcgcatcagcatccggcagctgcagctgttcatcaatgaatatgacaccatcccctttgaggccatctcctacctgaccggggagtgcaactatggaggccgggtgacagatgactgggaccggcggctgctgctgaccatgctggccgacttctacaacctgtacatcgtggagaacccccactacaagttcagccccagcggcaactactttgccccacccaagggcacctatgaggactacatcgagttcatcaagaagctgcccttcacccagcaccctgagatcttcggcctgcatgaaaatgtggacatcagcaaggacctgcagcagaccaagaccctgtttgagagcctgctgctgacccagggcggcagcaagcagacaggagccagcggcagcacagaccagatcctgctggagatcaccaaggacatcctgaacaagctgcccagcgactttgacatcgagatggccctgaggaagtaccctgtgcgctatgaggagagcatgaacacagtgctggtgcaggagatggagcgcttcaacaacctgatcatcaccatccggaacaccctgcgggacctggagaaggccatcaagggcgtggtggtgatggacagcgccctggaggccctgagcggcagcctgctggtgggcaaggtgcctgagatctgggccaagaggagctaccccagcctgaagcccctgggcagctacatcacagacttcctggcccggctgaacttcctgcaggactggtacaacagcggcaagccctgtgtgttctggctgagcggcttcttcttcacccaggccttcctgaccggggccatgcagaactatgccaggaagtacaccacccccatcgacctgctgggctatgaatttgaagtcatccccagcgacaccagtgacaccagcccagaagatggagtgtacatccacggcctgtacctggatggagcccgctgggaccgggagagcggcctgctggccgagcagtaccccaagctgctgtttgacctgatgcccatcatctggatcaagcccacccagaagagccgcatcatcaagagtgatgcctacgtgtgccccctgtacaagaccagcgagaggaagggcaccctgagcaccaccggccacagcaccaacttcgtcatcgccatgctgctgaagacagaccagcccaccaggcactggatcaagaggggcgtggccctgctgtgccagctggatgactag

SEQ ID NO: 38148 - DNA, 13374 bp, Artificial Sequence
  Description of Artificial Sequence: Synthetic coding sequence
atgaccatggccccagatgtgcggctggagtacctggaggaggtggccagcatcgtgctgaagttcaagccagacaagtggagcaagctgattggagcagaagaaaatgtggccctcttcacagagttctttgagaagccagatgtgcaggtgctggtgctgaccctgaatgctgctggcatgatcatcccctgcctgggcttcccccagagcctgaagagcaaaggagtgtacttcatcaagaccaagtctgagaacatcaacaaggacaactaccgggcccggctgctgtatggagacatcagccccacccctgtggaccagctgattgctgtggtggaggaggtgctgagcagcctgctgaaccagagcgagaacatggccggctggccccaggtggtgtctgaggacatcgtgaagcaggtgcaccggctgaagaatgagatgtttgtgatgtctgggaagatcaagggcaagaccctgctgcccatccctgagcacctgggcagcctggatggcaccctggagagcatggagcgcatccccagcagcctggacaacctgctgctgcacgccatcgagaccaccatcatcgactggagccaccagatcagagatgtgctgagcaaggacagcgcccaggccctgctggatggcctgcaccccctgccccaggtggagtttgagttctgggacacccggctgctgaacctgaagtgcatccacgagcagctgaaccggcccaaggtgaacaagatcgtggagatcctggagaaggccaagagctgctactggccagccctgcagaatgtgtacaccaacgtgacagagggcctgaaggaggccaatgacatcgtgctgtacctgaagcccctgcgcatcctgctggaggagatggagcaggccgacttcaccatgctgcccaccttcatcgccaaggtgctggacaccatctgcttcatctgggccaccagcgagtactacaacaccccagcccgcatcatcgtcatcctgcaggagttctgcaaccagatcatcgagatgaccaggaccttcctgagccctgaggaggtgctgaagggcctgcagggcgagattgaggaggtgctgagcggcatcagcctggccgtgaatgtgctgaaggagctgtaccagacctatgacttctgctgcgtgaacatgaagctgttcttcaaggacaaggagcctgtgccctgggagttccccagcagcctggccttcagccgcatcaacagcttcttccagaggatccagaccatcgaggagctgtacaagacagccatcgagttcctgaagctggagaagattgagctgggcggcgtgcggggcaacctgctgggcagcctggtgacccgcatctatgatgaggtgtttgagctggtgaaggtgtttgctgactgcaagtatgaccccctggaccccggggacagcaactttgaccgggactatgctgactttgagatcaagatccaggacctggaccggcggctggccaccatcttctgccagggctttgatgactgcagctgcatcaagagcagcgccaagctgctgtacatgtgtggcggcctgatggagcggcccctcatcctggccgaggtggccccccgctacagcgtgatgctggagctgtttgatgctgagctggacaatgccaagatcctgtatgatgcccagatggccgccagcgaggagggcaacatccccctcatccacaagaacatgcctcctgtggccggccagctgaagtggagcctggagctgcaggagcggctggaggtgtccatgaagcacctgaagcacgtggagcaccctgtgatgtctggagctgaggccaagctgacctaccagaagtatgatgagatgatggagctgctgcgctgccaccgggagaagatctaccagcagtgggtggccggcgtggaccaggactgccacttcaacctgggccagcccctcatcctgagagatgctgccagcaacctgattcatgtgaacttcagcaaggccctggtggccgtgctgcgggaggtgaagtacctgaacttccagcagcagaaggagatcccagattctgctgagagcctcttctctgaaaatgagaccttcaggaagtttgtgggcaacctggagctgattgtgggctggtacaatgagatcaagaccatcgtgaaggctgtggagttcctgctgatcaagtctgagctggaggccattgatgtgaagctgctgtctgctgagaccaccctcttctggaatggagaaggagtcttccagtacatccaggaggtgcgggagatcctgcacaacctgcagaacaggatgcagaaggccaagcagaacatcgagggcatcagccaggccatgaaggactggagcgccaaccccctgtttgagaggaaggacaacaagaaggaggccctgctggacctggatggccgcatcgccaacctgaacaagagatatgctgctgtgagagatgctggggtgaagatccaggccatggtggctgaaaatgctgagctgttccgggctgacaccctgagcctgccctggaaggactatgtgatctacattgatgacatggtgctggatgaatttgaccagttcatcaggaagagcctgtccttcctgatggacaacatggagagcatcgcccccctgtttgagatccgcatggagctggatgaagatggcctgaccttcaaccccaccctggaggtgggcagtgaccggggcttcctggccctgattgagggcctggtgaatgacatctacaacgtggcccggctcatcccccggctggccaaggacaggatgaactacaagatggacctggaggacaacacagacctgattgagatgagggaggaggtgagcagcctggtgatcaatgccatgaaggaggccgaggagtaccaggacagctttgagcgctacagctacctgtggacagacaacctgcaggagttcatgaagaacttcctgatctacggctgtgctgtgacagctgaggacctggacacctggacagatgacaccatccccaagaccccacccaccctggcccagttccaggagcagattgacagctatgagaagctgtatgaggaggtgtccaaatgtgagaacaccaaggtgttccacggctggctgcagtgtgactgccggcccttcaagcaggccctgctgagcaccatccgccgctggggcttcatgttcaagaggcacctgagcaaccacgtgaccaacagcctggccgacctggaggccttcatgaaggtggccaggatgggcctgaccaagcccctgaaggagggggactatgatggcctggtggaggtgatgggccacctgatgaaggtgaaggagcggcaggccgccacagacaacatgtttgagcccctgaagcagaccatcgagctgctgaagacctatggagaggagatgcctgaggagatccacctgaagctgcaggagctgcctgagcactgggccaacaccaagaagctggccatccaggtgaagctgactgtggcccccctgcaggccaatgaggtgtccatcctgcggaggaagtgccagcagtttgagctgaagcagcacgagttccgggagcgcttccggcgggaggcccccttctccttcagtgaccccaacccctacaagagcctgaacaagcagcagaagagcatcagcgccatggagggcatcatggaggccctgagcaagagcggcggcctgtttgaggtgcctgtgcctgactacaagcagctgaaggcctgccaccgggaggtgcggctgctgaaggagctgtgggacatggtggtggtggtgaacaccagcattgaggactggaagaccaccaagtggaaggacatcaacgtggagcagatggacatcgactgcaagaagtttgccaaggacatgaggagcctggacaaggagatgaagacctgggatgcctttgtgggcctggacaacacagtgaagaatgtcatcaccagcctgcgggctgtgtctgagctgcagaacccagccatccgggagcggcactggcagcagctgatgcaggccacccaggtgaagttcaagatgtctgaggagaccaccctggccgacctgctgcagctgaacctgcacagctatgaagatgaggtgagaaatattgtggacaaggctgtgaaggagagcggcatggagaaggtgctgaaggccctggacagcacctggagcatgatggagttccagcacgagccccaccccaggacaggcaccatgatgctgaagagcagcgaggtgctggtggagaccctggaggacaaccaggtgcagctgcagaacctgatgatgagcaagtacctggcccacttcctgaaggaggtgacctcctggcagcagaagctgagcacagctgacagcgtcatcagcatctggtttgaggtgcagaggacctggagccacctggagagcatcttcatcggcagcgaggacatccgcacccagctgcccggggacagccagagatttgatgacatcaaccaggagttcaaggccctgatggaggatgctgtgaagacccccaacgtggtggaggccaccagcaagccaggcctgtacaacaagctggaggccctgaagaagagcctggccatctgtgagaaggccctggccgagtacctggagaccaagaggctggccttcccccgcttctactttgtgtcctctgctgacctgctggacatcctgagcaatggaaatgaccctgtggaggtgagccgccacctgagcaagctgtttgacagcctgtgcaagctgaagttccggctggatgccagtgacaagcccctgaaggtgggcctgggcatgtacagcaaggaggatgagtacatggtgtttgaccaggagtgtgacctgagcggccaggtggaggtgtggctgaacagagtgctggacaggatgtgcagcaccctgcggcatgagatccctgaggccgtggtgacctatgaggagaagccccgggagcagtggatcctggactacccagcccaggtggccctgacctgcacccagatctggtggaccacagaggtgggcctggcctttgcccggctggaggagggctatgaaaatgccatccgggactacaacaagaagcagatcagccagctgaatgtgctgatcaccctgctgatgggcaacctgaatgctggggacaggatgaagatcatgaccatctgcaccattgatgtgcacgccagagatgtggtggccaagatgattgtggtggagagcagccaggccttcacctggcaggcccagctgcggcaccgctgggatgaggagaagaggcactgctttgccaacatctgtgatgcccagatccagtacagctatgagtacctgggcaacaccccccggctggtgatcacccccctgacagaccgctgctacatcaccctgacccagagcctgcacctgatcatgggcggggccccagctggccctgctggcaccgggaagacagagaccaccaaggacctgggccgggccctgggcaccatggtgtatgtgttcaactgcagcgagcagatggactacaagagctgtggcaacatctacaagggcctggcccagacaggagcctggggctgctttgatgagttcaaccgcatctctgtggaggtgctgtctgtgattgctgtgcaggtgaagtgtgtgcaggatgccatccgggccaagaagaaggccttcaacttcctgggggagatcatcggcctcatccccaccgtgggcatcttcatcaccatgaaccctggctacgccggccgggcagagctgcctgagaacctgaaggccctcttccggccctgtgccatggtggtgcctgactttgagctgatctgtgagatcatgctgatggccgagggcttcctggaggcccggctgctggccaggaagttcatcaccctgtacaccctgtgcaaggagctgctgagcaagcaggaccactatgactggggcctgcgggccatcaagtctgtgctggtggtggccggcagcctgaagagaggagaccccagcagagctgaggaccaggtgctgatgagggccctgcgggacttcaacatccccaagatcgtgacagatgacctgcccgtcttcatgggcctcatcggggacctcttccctgccctggatgtgcccaggaagagggacctgaactttgagaagatcatcaagcagagcatcgtggagctgaagctgcaggctgaagattcttttgtgctgaaggtggtgcagctggaggagctgctgcaggtgcgccacagcgtcttcatcgtgggcaatgccggcagcggcaagagccaggtgctgaagagcctgaacaagacctaccagaacctgaagaggaagcctgtggccgtggacctggaccccaaggctgtgacctgtgatgagctgtttggcatcatcaaccctgtgacccgggagtggaaggatggcctcttcagcaccatcatgagggacctggccaacatcacccatgatggccccaagtggatcatcctggatggagacatcgaccccatgtggattgagagcctgaacacagtgatggatgacaacaaggtgctgaccctggccagcaatgaaagaatccccctgaacagaaccatgaggctggtgtttgagatcagccacctgaggacagccaccccagccaccgtgtcccgggccggcatcctgtacatcaacccagctgacctgggctggaaccctgtggtgtcctcctggattgaaagaaggaaggtgcagagcgagaaggccaacctgatgatcctgtttgacaagtacctgcccacctgcctggacaagctgcgcttcggcttcaagaagatcacccctgtgcctgagatcaccgtcatccagaccatcctgtacctgctggagtgcctgctgacagagaagacagtgcccccagacagcccccgggagctgtatgagctgtactttgtgttcacctgcttctgggccttcggcggggccatgttccaggaccagctggtggactacagagtggagttcagcaagtggtggatcaatgagttcaagaccatcaagttccccagccagggcaccatctttgactactacatcgaccctgacaccaagaagttcctgccctggacagacaaggtgcccagctttgagctggaccctgatgtgcccctgcaggccagcctggtgcacaccacagagaccatccgcatccgctacttcatggacctgctgatggagaagtcctggcctgtgatgctggtgggcaatgccggcaccgggaagtctgtgctgatgggagacaagctggagagcctgaacacagacaactacctggtgcaggccgtgcccttcaacttctacaccaccagcgccatgctgcagggcgtgctggagaagcccctggagaagaagagcggcaggaactacggccccccaggcaccaagaagctggtgtacttcattgatgacatgaacatgcctgaggtggacaagtatggaacagtggccccccacaccctcatccggcagcacatggaccaccgccactggtatgacagacacaagctgaccctgaaggacatccacaactgccagtatgtggcctgcatgaaccccaccagcggcagcttcaccatcgacagccggctgcagaggcacttctgtgtgtttgctgtgtccttccctggccaggaggccctgaccaccatctacaacaccatcctgacccagcacctggccttccgctctgtgtccatggccatccagaggatcagcagccagctggtggccgccgccctggccctgcaccagaagatcacagccaccttcctgcccacagccatcaagttccactacgtgttcaacctgcgggacctgagcaacatcttccagggcctgctcttcagcacagctgaggtgctgaagacccccctggacctggtgcggctgtggctgcatgaaacagagcgggtgtatggagacaagatggtggatgagaaggaccaggagaccctgcaccgggtgaccatggccagcaccaagaagttctttgatgacctgggagatgagctgctgtttgccaagcccaacatcttctgccactttgcccagggcatcggggaccccaagtatgtgcctgtgacagacatggcccccctgaacaagctgctggtggatgtgctggacagctacaatgaggtgaatgctgtgatgaacctggtgctgtttgaagatgctgtggcccacatctgccgcatcaaccgcatcctggagagccccagaggaaatgccctgctggtgggcgtgggcggcagcggcaagcagagcctgagccggctggccgcctacatcagcggcctggatgtgttccagatcaccctgaagaagggctacggcatcccagacctgaagattgacctggccgcccagtacatcaaggctgctgtgaagaatgtgcccagcgtcttcctgatgacagacagccaggtggccgaggagcagttcctggtgctgatcaatgacctgctggccagcggggagatccctggcctcttcatggaggatgaggtggagaacatcatcagctccatgaggccccaggtgaagagcctgggcatgaatgacacccgggagacctgctggaagttcttcatcgagaaggtgcggcggcagctgaaggtgatcctgtgcttcagccctgtgggctctgtgctgcgggtgcgggccaggaagtttcctgctgtggtgaactgcacagccatcgactggttccacgagtggccagaagatgccctggtgtctgtgtctgcccgcttcctggaggagacagagggcatcccctgggaggtgaaggccagcatctccttcttcatgtcctatgtgcacaccaccgtgaatgagatgagccgggtgtacctggccacagaaagacgctacaactacaccacccccaagaccttcctggagcagatcaagctgtaccagaacctgctggccaagaagaggacagagctggtggccaagattgagcggctggagaatggcctgatgaagctgcagagcacagccagccaggtggatgacctgaaggccaagctggccatccaggaggccgagctgaagcagaagaatgaatctgctgaccagctgatccaggtggtgggcatcgaggccgagaaggtgtccaaggagaaggccatcgctgaccaggaggaggtgaaggtggaggtgatcaacaagaatgtgacagagaagcagaaggcctgtgaaacagacctggccaaggccgagcccgccctgctggccgcccaggaggccctggacaccctgaacaagaacaacctgacagagctgaagagctttggcagccccccagatgctgtggtgaatgtgacagctgctgtgatgatcctgacagcccctgggggcaagatccccaaggacaagtcctggaaggccgccaagatcatgatgggcaaggtggacaccttcctggacagcctgaagaagtttgacaaggagcacatccctgaggcctgcctgaaggccttcaagccctaccagggcaaccccacctttgatcctgagttcatccgcagcaagagcacagctgctgctggcctgtgctcctggtgcatcaacatcgtgcgcttctatgaggtgtactgtgatgtggcccccaagaggcaggccctggaggaggccaatgctgagctggccgaggcccaggagaagctgagccgcatcaagaacaagattgctgagctgaatgccaacctgagcaacctgaccagcgcctttgagaaggccacagctgagaagatcaagtgccagcaggaggctgatgccaccaacagagtcatcctgctggccaaccggctggtgggcggcctggccagcgagaacatccgctgggccgagagcgtggagaacttccgcagccagggcgtgaccctgtgtggagatgtgctgctgatcagcgcctttgtgtcctatgtgggctacttcaccaagaagtacagaaatgagctgatggagaagttctggatcccctacatccacaacctgaaggtgcccatccccatcaccaacggcctggaccccctgagcctgctgacagatgatgctgatgtggccacctggaacaaccagggcctgcccagcgacaggatgagcacagaaaatgccaccatcctgggcaacacagagcgctggcccctcatcgtggatgcccagctgcagggcatcaagtggatcaagaacaagtacagaagtgagctgaaggccatccggctgggccagaagagctacctggatgtgattgagcaggccatcagcgagggggacaccctgctgattgagaacatcggggagaccgtggaccctgtgctggaccccctgctgggcaggaacaccatcaagaagggcaagtacatcaagattggagacaaggaggtggagtaccaccccaagttccgcctcatcctgcacaccaagtacttcaacccccactacaagccagagatgcaggcccagtgcaccctcatcaacttcctggtgaccagagatggcctggaggaccagctgctggccgctgtggtggccaaggagaggccagacctggagcagctgaaggccaacctgaccaagagccagaatgagttcaagatcgtgctgaaggagctggaggacagcctgctggcccggctgtctgctgccagcggcaacttcctgggggacacagccctggtggagaacctggagaccaccaagcacacagccagcgagattgaggagaaggtggtggaggccaagatcacagaggtgaagatcaatgaggcccgggagaactacagacctgctgctgagcgggccagcctgctgtacttcatcctgaatgacctgaacaagatcaaccctgtgtaccagttcagcctgaaggccttcaacgtggtgtttgagaaggccatccagaggaccaccccagccaatgaggtgaagcagagggtcatcaacctgacagatgagatcacctacagcgtgtacatgtacacagcccggggcctgtttgagcgggacaagctgatcttcctggcccaggtgaccttccaggtgctgtccatgaagaaggagctgaaccctgtggagctggacttcctgctgcgcttccccttcaaggccggcgtggtgtcccctgtggacttcctgcagcaccagggctggggcggcatcaaggccctgtctgagatggatgagttcaagaacctggacagcgacatcgagggcagcgccaagcgctggaagaagctggtggagagcgaggcccctgagaaggagatcttccccaaggagtggaagaacaagacagccctgcagaagctgtgcatggtgcgctgcctgcggccagacaggatgacctacgccatcaagaactttgtggaggagaagatgggcagcaagtttgtggagggccgctctgtggagttcagcaagagctatgaggagagcagccccagcaccagcatcttcttcatcctgagccctggggtggaccccctgaaggatgtggaggccctgggcaagaagctgggcttcaccatcgacaatggcaagctgcacaacgtgtccctgggccagggccaggaggtggtggccgagaatgccctggatgtggccgctgagaagggccactgggtgatcctgcagaacatccacctggtggcccgctggctgggcaccctggacaagaagctggagcactacagcacaggcagccatgaggactacagagtcttcatctctgctgagcccgcccccagccctgagacccacatcatcccccagggcatcctggagaatgccatcaagatcaccaatgaaccacccaccggcatgcacgccaacctgcacaaggccctggacctcttcacccaggacaccctggagatgtgcaccaaggagatggagttcaagtgcatgctgtttgccctgtgctacttccacgctgtggtggccgagaggaggaagtttggagcccagggctggaacagaagctaccccttcaacaatggagacctgaccatcagcatcaacgtgctgtacaactacctggaggccaaccccaaggtgccctgggatgacctgcgctacctgtttggagagatcatgtatggaggccacatcacagatgactgggaccggcggctgtgcaggacctacctggccgagtacatcagaacagagatgctggagggagatgtgctgctggcccctggcttccagatcccccccaacctggactacaagggctaccacgagtacattgatgagaacctgcccccagagagcccctacctgtatggcctgcaccccaatgctgagatcggcttcctgactgtgaccagcgagaagctgttcagaacagtgctggagatgcagcccaaggagacagacagcggggccggcaccggggtgtcccgggaggagaaggtgaaggctgtgctggatgacatcctggagaagatccctgagaccttcaacatggccgagatcatggccaaggctgctgagaagaccccctacgtggtggtggccttccaggagtgtgagaggatgaacatcctgaccaatgagatgagaagaagcctgaaggagctgaacctgggcctgaagggggagctgaccatcaccacagatgtggaggacctgagcacagccctcttctatgacacagtgcctgacacctgggtggcccgggcctaccccagcatgatgggcctggccgcctggtatgctgacctgctgctgcgcatccgggagctggaggcctggaccacagactttgccctgcccaccaccgtgtggctggccggcttcttcaacccccagagcttcctgacagccatcatgcagagcatggccaggaagaatgagtggcccctggacaagatgtgcctgtctgtggaggtgaccaagaagaaccgggaggacatgacagccccaccccgggagggcagctatgtgtatggcctcttcatggagggcgcccgctgggacacccagacaggagtgattgctgaggcccggctgaaggagctgaccccagccatgcctgtgatcttcatcaaggccatccctgtggacaggatggagaccaagaacatctatgagtgccctgtgtacaagacccgcatccggggccccacctacgtgtggaccttcaacctgaagaccaaggagaaggccgccaagtggatcctggccgctgtggccctgctgctgcaggtgtag

SEQ ID NO: 38149 - DNA, 13458 bp, Artificial Sequence
  Description of Artificial Sequence: Synthetic coding sequence
atgaccatggccccagatgtgcggctggagtacctggaggaggtggccagcatcgtgctgaagttcaagccagacaagtggagcaagctgattggagcagaagaaaatgtggccctcttcacagagttctttgagaagccagatgtgcaggtgctggtgctgaccctgaatgctgctggcatgatcatcccctgcctgggcttcccccagagcctgaagagcaaaggagtgtacttcatcaagaccaagtctgagaacatcaacaaggacaactaccgggcccggctgctgtatggagacatcagccccacccctgtggaccagctgattgctgtggtggaggaggtgctgagcagcctgctgaaccagagcgagaacatggccggctggccccaggtggtgtctgaggacatcgtgaagcaggtgcaccggctgaagaatgagatgtttgtgatgtctgggaagatcaagggcaagaccctgctgcccatccctgagcacctgggcagcctggatggcaccctggagagcatggagcgcatccccagcagcctggacaacctgctgctgcacgccatcgagaccaccatcatcgactggagccaccagatcagagatgtgctgagcaaggacagcgcccaggccctgctggatggcctgcaccccctgccccaggtggagtttgagttctgggacacccggctgctgaacctgaagtgcatccacgagcagctgaaccggcccaaggtgaacaagatcgtggagatcctggagaaggccaagagctgctactggccagccctgcagaatgtgtacaccaacgtgacagagggcctgaaggaggccaatgacatcgtgctgtacctgaagcccctgcgcatcctgctggaggagatggagcaggccgacttcaccatgctgcccaccttcatcgccaaggtgctggacaccatctgcttcatctgggccaccagcgagtactacaacaccccagcccgcatcatcgtcatcctgcaggagttctgcaaccagatcatcgagatgaccaggaccttcctgagccctgaggaggtgctgaagggcctgcagggcgagattgaggaggtgctgagcggcatcagcctggccgtgaatgtgctgaaggagctgtaccagacctatgacttctgctgcgtgaacatgaagctgttcttcaaggacaaggagcctgtgccctgggagttccccagcagcctggccttcagccgcatcaacagcttcttccagaggatccagaccatcgaggagctgtacaagacagccatcgagttcctgaagctggagaagattgagctgggcggcgtgcggggcaacctgctgggcagcctggtgacccgcatctatgatgaggtgtttgagctggtgaaggtgtttgctgactgcaagtatgaccccctggaccccggggacagcaactttgaccgggactatgctgactttgagatcaagatccaggacctggaccggcggctggccaccatcttctgccagggctttgatgactgcagctgcatcaagagcagcgccaagctgctgtacatgtgtggcggcctgatggagcggcccctcatcctggccgaggtggccccccgctacagcgtgatgctggagctgtttgatgctgagctggacaatgccaagatcctgtatgatgcccagatggccgccagcgaggagggcaacatccccctcatccacaagaacatgcctcctgtggccggccagctgaagtggagcctggagctgcaggagcggctggaggtgtccatgaagcacctgaagcacgtggagcaccctgtgatgtctggagctgaggccaagctgacctaccagaagtatgatgagatgatggagctgctgcgctgccaccgggagaagatctaccagcagtgggtggccggcgtggaccaggactgccacttcaacctgggccagcccctcatcctgagagatgctgccagcaacctgattcatgtgaacttcagcaaggccctggtggccgtgctgcgggaggtgaagtacctgaacttccagcagcagaaggagatcccagattctgctgagagcctcttctctgaaaatgagaccttcaggaagtttgtgggcaacctggagctgattgtgggctggtacaatgagatcaagaccatcgtgaaggctgtggagttcctgctgatcaagtctgagctggaggccattgatgtgaagctgctgtctgctgagaccaccctcttctggaatggagaaggagtcttccagtacatccaggaggtgcgggagatcctgcacaacctgcagaacaggatgcagaaggccaagcagaacatcgagggcatcagccaggccatgaaggactggagcgccaaccccctgtttgagaggaaggacaacaagaaggaggccctgctggacctggatggccgcatcgccaacctgaacaagagatatgctgctgtgagagatgctggggtgaagatccaggccatggtggctgaaaatgctgagctgttccgggctgacaccctgagcctgccctggaaggactatgtgatctacattgatgacatggtgctggatgaatttgaccagttcatcaggaagagcctgtccttcctgatggacaacatggtgattgatgagagcatcgcccccctgtttgagatccgcatggagctggatgaagatggcctgaccttcaaccccaccctggaggtgggcagtgaccggggcttcctggccctgattgagggcctggtgaatgacatctacaacgtggcccggctcatcccccggctggccaaggacaggatgaactacaagatggacctggaggacaacacagacctgattgagatgagggaggaggtgagcagcctggtgatcaatgccatgaaggaggccgaggagtaccaggacagctttgagcgctacagctacctgtggacagacaacctgcaggagttcatgaagaacttcctgatctacggctgtgctgtgacagctgaggacctggacacctggacagatgacaccatccccaagaccccacccaccctggcccagttccaggagcagattgacagctatgagaagctgtatgaggaggtgtccaaatgtgagaacaccaaggtgttccacggctggctgcagtgtgactgccggcccttcaagcaggccctgctgagcaccatccgccgctggggcttcatgttcaagaggcacctgagcaaccacgtgaccaacagcctggccgacctggaggccttcatgaaggtggccaggatgggcctgaccaagcccctgaaggagggggactatgatggcctggtggaggtgatgggccacctgatgaaggtgaaggagcggcaggccgccacagacaacatgtttgagcccctgaagcagaccatcgagctgctgaagacctacggggaggagatgcctgaggagatccacctgaagctgcaggagctgcctgagcactgggccaacaccaagaagctggccatccaggtgaagctgactgtggcccccctgcaggccaatgaggtgtccatcctgcggaggaagtgccagcagtttgagctgaagcagcacgagttccgggagcgcttcagaagagaggcccccttctccttcagtgaccccaacccctacaagagcctgaacaaggtgttcctgctgaagggcatcatggaggccctgagcaagagcggcggcctgtttgaggtgcctgtgcctgactacaagcagctgaaggcctgccaccgggaggtgcggctgctgaaggagctgtgggacatggtggtggtggtgaacaccagcattgaggactggaagaccaccaagtggaaggacatcaacgtggagcagatggacatcgactgcaagaagtttgccaaggacatgaggagcctggacaaggagatgaagacctgggatgcctttgtgggcctggacaacacagtgaagaatgtcatcaccagcctgcgggctgtgtctgagctgcagaacccagccatccgggagcggcactggcagcagctgatgcaggccacccaggtgaagttcaagatgtctgaggagaccaccctggccgacctgctgcagctgaacctgcacagctatgaagatgaggtgaggaacatcgtggacaaggctgtgaaggagagcggcatggagaaggtgctgaaggccctggacagcacctggagcatgatggagttccagcacgagccccaccccaggacaggcaccatgatgctgaagagcagcgaggtgctggtggagaccctggaggacaaccaggtgcagctgcagaacctgatgatgagcaagtacctggcccacttcctgaaggaggtgacctcctggcagcagaagctgagcacagctgacagcgtcatcagcatctggtttgaggtgcagaggacctggagccacctggagagcatcttcatcggcagcgaggacatccgcacccagctgcccggggacagccagagatttgatgacatcaaccaggagttcaaggccctgatggaggatgctgtgaagaccccaaatgtggtggaggccaccagcaagccaggcctgtacaacaagctggaggccctgaagaagagcctggccatctgtgagaaggccctggccgagtacctggagaccaagaggctggccttcccccgcttctactttgtgagcagcgctgacctgctggacatcctgagcaatggaaatgaccctgtggaggtgagccgccacctgagcaagctgtttgacagcctgtgcaagctgaagttccggctggatgccagtgacaagcccctgaaggtgggcctgggcatgtacagcaaagaagatgagtacatggtgtttgaccaggagtgtgacctgagcggccaggtggaggtgtggctgaacagagtgctggacaggatgtgcagcaccctgcggcatgagatccctgaggccgtggtgacctatgaggagaagccccgggagcagtggatcctggactacccagcccagatctggtggaccacagaggtgggcctggcctttgcccggctggaggagggctatgaaaatgccatccgggactacaacaagaagcagatcagccagctgaatgtgctgatcaccctgctgatgggcaacctgaatgctggggacaggatgaagatcatgaccatctgcaccattgatgtgcacgccagagatgtggtggccaagatgattgtggagagcagccaggccttcacctggcaggcccagctgcggcaccgctgggatgaggagaagaggcactgctttgccaacatctgtgatgcccagatccagtacagctatgagtacctgggcaacaccccccggctggtgatcacccccctgacagaccgctgctacatcaccctgacccagagcctgcacctgatcatgggcggggccccagctggccctgctggcaccgggaagacagagaccaccaaggacctgggccgggccctgggcaccatggtgtatgtgttcaactgcagcgagcagatggactacaagagctgtggcaacatctacaagggcctggcccagacaggagcctggggctgctttgatgagttcaaccgcatctctgtggaggtgctgtctgtgattgctgtgcaggtgaagtgtgtgcaggatgccatccgggccaagaagaaggccttcaacttcctgggggagatcatcggcctcatccccaccgtgggcatcttcatcaccatgaaccctggctacgccggccgggcagagctgcctgagaacctgaaggccctcttccggccctgtgccatggtggtgcctgactttgagctgatctgtgagatcatgctgatggccgagggcttcctggaggcccggctgctggccaggaagttcatcaccctgtacaccctgtgcaaggagctgctgagcaagcaggaccactatgactggggcctgcgggccatcaagtctgtgctggtggtggccggcagcctgaagagaggagaccccagcagagctgaggaccaggtgctgatgagggccctgcgggacttcaacatccccaagatcgtgacagatgacctgcctgtgttcatgggcctgattggagacctcttccctgccctggatgtgcccaggaagagggacctgaactttgagaagatcatcaagcagagcatcgtggagctgaagctgcaggccgaggacagctttgtgctgaaggtggtgcagctggaggagctgctgcaggtgcgccacagcgtcttcatcgtgggcaatgccggcagcggcaagagccaggtgctgaagagcctgaacaagacctaccagaacctgaagaggaagcctgtggccgtggacctggaccccaaggctgtgacctgtgatgagctgtttggcatcatcaaccctgtgacccgggagtggaaggatggcctcttcagcaccatcatgagggacctggccaacatcacccatgatggccccaagtggatcatcctggatggagacatcgaccccatgtggattgagagcctgaacacagtgatggatgacaacaaggtgctgaccctggccagcaatgaaagaatccccctgaacagaaccatgaggctggtgtttgagatcagccacctgaggacagccaccccagccaccgtgtccagagctggcatcctgtacatcaacccagctgacctgggctggaaccctgtggtgtcctcctggattgaaagaaggaaggtgcagagcgagaaggccaacctgatgatcctgtttgacaagtacctgcccacctgcctggacaagctgcgcttcggcttcaagaagatcacccctgtgcctgagatcaccgtcatccagaccatcctgtacctgctggagtgcctgctgacagagaagacagtgcccccagacagcccccgggagctgtatgagctgtactttgtgttcacctgcttctgggcctttggaggagccatgttccaggaccagctggtggactacagagtggagttcagcaagtggtggatcaatgagttcaagaccatcaagttccccagccagggcaccatctttgactactacattgatcctgacaccaagaagttcctgccctggacagacaaggtgcccagctttgagctggaccctgatgtgcccctgcaggccagcctggtgcacaccacagagaccatccgcatccgctacttcatggacctgctgatggagaagtcctggcctgtgatgctggtgggcaatgccggcaccgggaagtctgtgctgatgggagacaagctggagagcctgaacacagacaactacctggtgcaggccgtgcccttcaacttctacaccaccagcgccatgctgcagggcgtgctggagaagcccctggagaagaagtctggaagaaattatggccccccaggcaccaagaagctggtgtacttcattgatgacatgaacatgcctgaggtggacaagtatggcaccgtggccccccacaccctcatccggcagcacatggaccaccgccactggtatgacagacacaagctgaccctgaaggacatccacaactgccagtatgtggcctgcatgaaccccaccagcggcagcttcaccatcgacagccggctgcagaggcacttctgtgtgtttgctgtgtccttccctggccaggaggccctgaccaccatctacaacaccatcctgacccagcacctggccttccgctctgtgtccatggccatccagaggatcagcagccagctggtggccgccgccctggccctgcaccagaagatcacagccaccttcctgcccacagccatcaagttccactacgtgttcaacctgcgggacctgagcaacatcttccagggcctgctcttcagcacagctgaggtgctgaagacccccctggacctggtgcggctgtggctgcacgagacagagcgggtgtatggagacaagatggtggatgagaaggaccaggagaccctgcaccgggtgaccatggccagcaccaagaagttctttgatgacctgggagatgagctgctgtttgccaagcccaacatcttctgccactttgcccagggcattggagaccccaagtatgtgcctgtgacagacatggcccccctgaacaagctgctggtggatgtgctggacagctacaatgaggtgaatgctgtgatgaacctggtgctgtttgaagatgctgtggcccacatctgccgcatcaaccgcatcctggagagccccagaggaaatgccctgctggtgggcgtgggcggcagcggcaagcagagcctgagccggctggccgcctacatcagcggcctggatgtgttccagatcaccctgaagaagggctacggcatcccagacctgaagattgacctggccgcccagtacatcaaggctgctgtgaagaatgtgcccagcgtcttcctgatgacagacagccaggtggccgaggagcagttcctggtgctgatcaatgacctgctggccagcggggagatccctggcctcttcatggaggatgaggtggagaacatcatcagctccatgaggccccaggtgaagagcctgggcatgaatgacacccgggagacctgctggaagttcttcatcgagaaggtgcggcggcagctgaaggtgatcctgtgcttcagccctgtgggctctgtgctgcgggtgcgggccaggaagtttcctgctgtggtgaactgcacagccatcgactggttccacgagtggccagaagatgccctggtgtctgtgtctgcccgcttcctggaggagacagagggcatcccctgggaggtgaaggccagcatctccttcttcatgtcctatgtgcacaccaccgtgaatgagatgagccgggtgtacctggccacagagcggcgctacaactacaccacccccaagaccttcctggagcagatcaagctgtaccagaacctgctggccaagaagaggacagagctggtggccaagattgaaaggctggagaatggcctgatgaagctgcagagcacagccagccaggtggatgacctgaaggccaagctggccatccaggaggccgagctgaagcagaagaatgaatctgctgaccagctgatccaggtggtgggcattgaagctgagaaggtgtccaaggagaaggccatcgctgaccaggaggaggtgaaggtggaggtgatcaacaagaatgtgacagagaagcagaaggcctgtgaaacagacctggccaaggccgagcccgccctgctggccgcccaggaggccctggacaccctgaacaagaacaacctgacagagctgaagagctttggcagccccccagatgctgtggtgaatgtgacagctgctgtgatgatcctgacagcccctgggggcaagatccccaaggacaagtcctggaaggccgccaagatcatgatgggcaaggtggacaccttcctggacagcctgaagaagtttgacaaggagcacatccctgaggcctgcctgaaggccttcaagccctaccagggcaaccccacctttgatcctgagttcatccgcagcaagagcacagctgctgctggcctgtgctcctggtgcatcaacatcgtgcgcttctatgaggtgtactgtgatgtggcccccaagaggcaggccctggaggaggccaatgctgagctggccgaggcccaggagaagctgagccgcatcaagaacaagattgctgagctgaatgccaacctgagcaacctgaccagcgcctttgagaaggccacagctgagaagatcaagtgccagcaggaggctgatgccaccaacagagtcatcctgctggccaaccggctggtgggcggcctggccagcgagaacatccgctgggccgagagcgtggagaacttccgcagccagggcgtgaccctgtgtggagatgtgctgctgatcagcgcctttgtgtcctatgtgggctacttcaccaagaagtacagaaatgagctgatggagaagttctggatcccctacatccacaacctgaaggtgcccatccccatcaccaacggcctggaccccctgagcctgctgacagatgatgctgatgtggccacctggaacaaccagggcctgcccagcgacaggatgagcacagaaaatgccaccatcctgggcaacacagagcgctggcccctgattgtggatgcccagctgcagggcatcaagtggatcaagaacaagtacagaagtgagctgaaggccatccggctgggccagaagagctacctggatgtgattgagcaggccatcagcgagggggacaccctgctgattgaaaatattggagagaccgtggaccctgtgctggaccccctgctgggcaggaacaccatcaagaagggcaagtacatcaagatcggggacaaggaggtggagtaccaccccaagttccgcctcatcctgcacaccaagtacttcaacccccactacaagccagagatgcaggcccagtgcaccctcatcaacttcctggtgaccagagatggcctggaggaccagctgctggccgctgtggtggccaaggagaggccagacctggagcagctgaaggccaacctgaccaagagccagaatgagttcaagatcgtgctgaaggagctggaggacagcctgctggcccggctgtctgctgccagcggcaacttcctgggggacacagccctggtggagaacctggagaccaccaagcacacagccagcgagattgaggagaaggtggtggaggccaagatcacagaggtgaagatcaatgaggcccgggagaactacagacctgctgctgagcgggccagcctgctgtacttcatcctgaatgacctgaacaagatcaaccctgtgtaccagttcagcctgaaggccttcaacgtggtgtttgagaaggccatccagaggaccaccccagccaatgaggtgaagcagagggtcatcaacctgacagatgagatcacctacagcgtgtacatgtacacagcccggggcctgtttgagcgggacaagctgatcttcctggcccaggtgaccttccaggtgctgtccatgaagaaggagctgaaccctgtggagctggacttcctgctgcgcttccccttcaaggccggcgtggtgtcccctgtggacttcctgcagcaccagggctggggcggcatcaaggccctgtctgagatggatgagttcaagaacctggacagcgacatcgagggcagcgccaagcgctggaagaagctggtggagagcgaggcccctgagaaggagatcttccccaaggagtggaagaacaagacagccctgcagaagctgtgcatggtgcgctgcctgcggccagacaggatgacctacgccatcaagaactttgtggaggagaagatgggcagcaagtttgtggagggccgctctgtggagttcagcaagagctatgaggagagcagccccagcaccagcatcttcttcatcctgagccctggggtggaccccctgaaggatgtggaggccctgggcaagaagctgggcttcaccatcgacaacgggaagctgcacaacgtgtccctgggccagggccaggaggtggtggctgaaaatgccctggatgtggccgctgagaagggccactgggtgatcctgcaggtgcggggcggccagcactgcaggaacatccacctggtggcccgctggctgggcaccctggacaagaagctggagcactacagcacaggcagccatgaggactacagagtcttcatctctgctgagcccgcccccagccctgagacccacatcatcccccagggcatcctggagaatgccatcaagatcaccaatgagccccccaccggcatgcacgccaacctgcacaaggccctggacctcttcacccaggacaccctggagatgtgcaccaaggagatggagttcaagtgcatgctgtttgccctgtgctacttccacgctgtggtggccgagaggaggaagtttggagcccagggctggaacagaagctaccccttcaacaacggggacctgaccatcagcatcaacgtgctgtacaactacctggaggccaaccccaaggtgccctgggatgacctgcgctacctgtttggagagatcatgtatggaggccacatcacagatgactgggaccggcggctgtgcaggacctacctggccgagtacatcagaacagagatgctggagggagatgtgctgctggcccctggcttccagatcccccccaacctggactacaagggctaccacgagtacattgatgagaacctgcccccagagagcccctacctgtatggcctgcaccccaatgctgagatcggcttcctgactgtgaccagcgagaagctgttcagaacagtgctggagatgcagcccaaggagacagattctggagctggcactggagtgtcccgggaggagaaggccggcagcctgaagctgctgcccagcgagaggaagggggaggacctggagctgcggcggggcggctgccccggcaccggcttccaggtgaaggctgtgctggatgacatcctggagaagatccctgagaccttcaacatggccgagatcatggccaaggctgctgagaagaccccctacgtggtggtggccttccaggagtgtgagaggatgaacatcctgaccaatgagatgagaagaagcctgaaggagctgaacctgggcctgaagggggagctgaccatcaccacagatgtggaggacctgagcacagccctcttctatgacacagtgcctgacacctgggtggcccgggcctaccccagcatgatgggcctggccgcctggtatgctgacctgctgctgcgcatccgggagctggaggcctggaccacagactttgccctgcccaccaccgtgtggctggccggcttcttcaacccccagagcttcctgacagccatcatgcagagcatggccaggaagaatgagtggcccctggacaagatgtgcctgtctgtggaggtgaccaagaagaaccgggaggacatgacagccccaccccgggagggcagctatgtgtatggcctcttcatggagggcgcccgctgggacacccagacaggagtgattgctgaggcccggctgaaggagctgaccccagccatgcctgtgatcttcatcaaggccatccctgtggacaggatggagaccaagaacatctatgagtgccctgtgtacaagacccgcatccggggccccacctacgtgtggaccttcaacctgaagaccaaggagaaggccgccaagtggatcctggccgctgtggccctgctgctgcaggtgtag

SEQ ID NO: 38150 - DNA, 1545 bp, Artificial Sequence
  Description of Artificial Sequence: Synthetic coding sequence
atggctgatgctgaggtgatcatcctgcccaagaagcacaagaagaagaaggagaggaagagcctgcctgaagaagatgtggccgagatccagcacgccgaggagttcctgatcaagccagagagcaaggtggccaagctggacaccagccagtggcccctgctgctgaagaactttgacaagctgaatgtgaggaccacccactacacccccctggcctgtggcagcaaccccctgaagcgggagattggagactacatcagaacaggcttcatcaacctggacaagcccagcaaccccagcagccatgaggtggtggcctggatccgccgcatcctgcgggtggagaagacaggccacagcggcaccctggaccccaaggtgacaggctgcctgattgtgtgcatcgagcgggccacccggctggtgaagagccagcagagcgctgggaaggagtatgtgggcatcgtgcggctgcacaatgccattgaaggaggcacccagctgagccgggccctggagaccctgactggagccctcttccagaggcctcccctgattgctgctgtgaagaggcagctgcgggtgaggaccatctatgagagcaagatgattgaatatgaccctgagcggcggctgggcatcttctgggtgtcctgtgaggccggcacctacatccgcaccctgtgtgtgcacctgggcctgctgctgggcgtgggcggccagatgcaggagctgcggcgggtgcgctctggagtgatgtctgagaaggaccacatggtgaccatgcatgatgtgctggatgcccagtggctgtatgacaaccacaaggatgagagctacctgcggcgggtggtgtaccccctggagaagctgctgaccagccacaagaggctggtgatgaaggacagcgctgtgaatgccatctgctatggagccaagatcatgctgcccggggtgctgcgctatgaagatggcatcgaggtgaaccaggagatcgtggtgatcaccaccaagggggaggccatctgcatggccatcgccctgatgaccacagctgtgatcagcacctgtgaccacggcatcgtggccaagatcaagagggtcatcatggagcgggacacctaccccaggaagtggggcctgggccccaaggccagccagaagaagctgatgatcaagcagggcctgctggacaagcacggcaagcccacagacagcaccccagccacctggaagcaggagtatgtggactacagcgagagcgccaagaaggaggtggtggccgaggtggtgaaggccccccaggtggtggccgaggccgccaagacagccaagaggaagcgggagagcgagagcgagagtgatgagaccccacctgctgccccccagctgatcaagaaggagaagaagaagagcaagaaggacaagaaggccaaggccggcctggagagcggggctgagcctggagatggagacagcgacaccaccaagaagaagaagaagaagaagaaggccaaggaggtggagctggtgtctgagtag

SEQ ID NO: 38151 - DNA, 13125 bp, Artificial Sequence
  Description of Artificial Sequence: Synthetic coding sequence
atgaaggtggacaggaccaagctgaagaagacccccacagaggccccagctgactgccgggccctgattgacaagctgaaggtgtgcaatgatgagcagctgctgctggagctgcagcagatcaagacctggaacatcggcaaatgtgagctgtaccactgggtggacctgctggacagatttgatggcatcctggctgatgctggccagacagtggagaacatgtcctggatgctggtgtgtgacaggcctgagcgggagcagctgaagatgctgctgctggccgtgctgaacttcaccgccctgctgattgagtacagcttcagccgccacctgtacagcagcattgagcacctgaccaccctgctggccagcagtgacatgcaggtggtgctggccgtgctgaacctgctgtatgtgttcagcaagaggagcaactacatcacccggctgggcagtgacaagaggacccccctgctgacccggctgcagcacctggccgagagctggggcggcaaggaaaatggatttggcctggccgagtgctgccgggacctgcacatgatgaagtacccacccagcgccaccaccctgcactttgagttctacgccgaccccggggctgaggtgaagattgagaagaggaccaccagcaacaccctgcactacatccacatcgagcagctggacaagatcagcgagagccccagcgagatcatggagagcctgaccaagatgtacagcatccccaaggacaagcagatgctgctcttcacccacatccggctggcccacggcttcagcaaccacaggaagaggctgcaggccgtgcaggcccggctgcacgccatcagcatcctggtgtacagcaatgccctgcaggagagcgccaacagcatcctgtacaacggcctcatcgaggagctggtggatgtgctgcagatcacagacaagcagctgatggagatcaaggccgccagcctgcggaccctgaccagcatcgtgcacctggagaggacccccaagctgagcagcatcatcgactgcaccggcacagccagctaccacggcttcctgcctgtgctggtgaggaactgcatccaggccatgattgaccccagcatggacccctacccccaccagtttgccacagccctcttctccttcctgtaccacctggccagctatgatgctggaggagaggccctggtgtcctgtggcatgatggaggccctgctgaaggtgatcaagttcctgggagatgagcaggaccagatcacctttgtgaccagggctgtgcgggtggtggacctgatcaccaacctggacatggccgccttccagagccacagcggcctgagcatcttcatctaccgcctggagcacgaggtggacctgtgcaggaaggagtgcccctttgtgatcaagcccaagatccagaggcccaacaccacccaggagggggaggagatggagacagacatggatggagtgcagtgcatcccccagagagctgccctgctgaagtccatgctgaacttcctgaagaaggccatccaggaccctgccttcagtgatggcatccgccacgtgatggatggcagcctgcccaccagcctgaagcacatcatcagcaatgctgagtactacggccccagcctcttcctgctggccacagaggtggtgacagtgtttgtgttccaggagcccagcctgctgagcagcctgcaggacaatggcctgacagatgtgatgctgcacgccctgctgatcaaggatgtgcctgccacccgggaggtgctgggcagcctgcccaacgtgttttctgccctgtgcctgaatgcccggggcctgcagagctttgtgcagtgccagccctttgagcggctcttcaaggtgctgctgagcccagactacctgcctgccatgagaagaagaagaagcagtgaccccctgggggacacagccagcaacctgggcagcgctgtggatgagctgatgaggcaccagcccaccctgaagacagatgccaccacagccatcatcaagctgctggaggagatctgcaacctgggccgggaccccaagtacatctgccagaagcccagcatccagaaggcagatggaacagccacagcccccccacccaggagcaaccacgccgctgaggaggccagcagtgaagatgaggaggaggaggaggtgcaggccatgcagagcttcaacagcacccagcagaatgaaacagagcccaaccagcaggtggtgggcacagaggagcgcatccccatccccctgatggactacatcctgaatgtgatgaagtttgtggagagcatcctgagcaacaacaccacagatgaccactgccaggagtttgtgaaccagaagggcctgctgcccctggtgaccatcctgggcctgcccaacctgcccatcgacttccccaccagcgctgcctgccaggccgtggccggcgtgtgcaagagcatcctgaccctgagccatgagcccaaggtgctgcaggagggcctgctgcagctggacagcatcctgagcagcctggagcccctgcaccggcccatcgagagccctgggggctctgtgctgctgcgggagctggcctgtgctggaaatgtggctgatgccaccctgagcgcccaggccacccccctgctgcacgccctgacagctgcccacgcctacatcatgatgtttgtgcacacctgccgggtgggccagagcgagatccgcagcatctctgtgaaccagtggggcagccagctgggcctgtctgtgctgagcaagctgagccagctgtactgcagcctggtgtgggagagcacagtgctgctgagcctgtgcacccccaacagcctgcccagcggctgtgaatttggccaggccgacatgcagaagctggtgcccaaggatgagaaggccggcaccacccagggcggcaagagaagtgatggagagcaggatggagctgctggctccatggatgccagcacccagggcctgctggagggcatcggcctggatggagacaccctggcccccatggagacagatgagcccacagccagtgacagcaagggcaagagcaagatcaccccagccatggccgcccgcatcaagcagatcaagcccctgctgagcgccagcagccggctgggccgggccctggccgagctgtttggcctgctggtgaagctgtgtgtgggcagccctgtgcggcagaggaggagccaccacgccgccagcaccaccacagcccccaccccagctgcccggagcacagccagcgccctgaccaagctgctgaccaagggcctgtcctggcagcccccaccctacacccccaccccccgcttccggctgaccttcttcatctgcagcgtgggcttcaccagccccatgctgtttgatgagaggaagtacccctaccacctgatgctgcagaagttcctgtgcagcggcggccacaatgccctgtttgagaccttcaactgggccctgtccatgggcggcaaggtgcctgtgtctgagggcctggagcacagcgacctgcctgatggcactggagagttcctggatgcctggctgatgctggtggagaagatggtgaaccccaccaccgtgctggagagcccccacagcctgcctgccaagctgcctggaggagtgcagaacttcccccagttcagcgccctgcgcttcctggtggtgacccagaaggccgccttcacctgcatcaagaacctgtggaacaggaagcccctgaaggtgtatggaggccgcatggccgagagcatgctggccatcctgtgccacatcctgcggggggagcctgtgatccgggagcggctgagcaaggagaaggagggcagcagaggagaggaggacaccggccaggaggagggcggcagccggcgggagccccaggtgaaccagcagcagctgcagcagctgatggacatgggcttcacccgggagcacgccatggaggccctgctgaacaccagcaccatggagcaggccacagagtacctgctgacccaccccccacccatcatgggcggcgtggtgcgggacctgtccatgtctgaggaggaccagatgatgagggccatcgccatgagcctgggccaggacatccccatggaccagagagctgagagccctgaggaggtggcctgcaggaaggaggaggaggagaggaaggcccgggagaagcaggaggaggaggaggccaagtgcctggagaagttccaggatgctgaccccctggagcaggatgagctgcacaccttcacagacaccatgctgcccggctgcttccacctgctggatgagctgcctgacacagtgtacagagtgtgtgacctgatcatgacagccatcaagagaaatggagctgactacagagacatgatcctgaagcaggtggtgaaccaggtgtgggaggccgcagatgtgctgatcaaggccgccctgcccctgaccaccagtgacaccaagacagtgtctgagtggatcagccagatggccaccctgccccaggccagcaacctggccacccgcatcctgctgctgaccctgctgtttgaggagctgaagctgccctgtgcctgggtggtggagagcagcggcatcctgaatgtgctgatcaagctgctggaggtggtgcagccctgcctgcaggccgccaaggagcagaaggaggtgcagacccccaagtggatcacccctgtgctgctgctgattgacttctatgagaagacagccatcagcagcaagaggcgggcccagatgaccaagtacctgcagagcaacagcaacaactggcgctggtttgatgacaggagcggccgctggtgcagctacagcgccagcaacaacagcaccatcgacagcgcctggaagagcggggagacctctgtgcgcttcaccgctggaagaagacgctacacagtgcagttcaccaccatggtgcaggtgaatgaggagaccggcaacagaagacctgtgatgctgaccctgctgcgggtgccccggctgaacaagaacagcaagaacagcaatggccaggagctggagaagaccctggaggagagcaaggagatggacatcaagaggaaggagaacaagggaaatgacacccccctggccctggagagcaccaacacagagaaggagaccagcctggaggagaccaagatcggggagatcctgatccagggcctgacagaggacatggtgacagtgctgatccgggcctgtgtgtccatgctgggcgtgcctgtggaccctgacaccctgcacgccaccctgcggctgtgcctgcggctgacccgggaccacaagtatgccatgatgtttgctgagctgaagagcaccaggatgatcctgaacctgacccagagcagcggcttcaacggcttcacccccctggtgaccctgctgctgcggcacatcatcgaggacccctgcaccctgcggcacaccatggagaaggtggtgcgctctgctgccaccagcggggccggcagcaccaccagcggcgtggtgtctggcagcctgggcagccgggagatcaactacatcctgcgggtgctgggccctgctgcctgcaggaacccagacatcttcacagaggtggccaactgctgcatcagaattgccctgcctgccccccggggcagcggcacagccagtgatgatgaatttgagaacctgcgcatcaagggccccaatgctgtgcagctggtgaagaccacccccctgaagcccagccccctgcccgtcatcccagacaccatcaaggaggtgatctatgacatgctgaatgccctggccgcctaccacgcccctgaggaggccgacaagagtgaccccaagccaggagtgatgacccaggaggtgggccagctgctgcaggacatgggagatgatgtgtaccagcagtaccgcagcctgacccggcagagcagtgactttgacacccagagcggcttcagcatcaacagccaggtgtttgctgctgatggagccagcacagagaccagcgccagcggcaccagccagggcgaggccagcaccccagaggagagcagagatggcaagaaggacaaggagggggaccgggccagcgaggagggcaagcagaagggcaagggcagcaagcccctgatgcccaccagcaccatcctgcggctgctggccgagctggtgcgctcctatgtgggcatcgccaccctgattgccaactacagctacacagtgggccagagcgagctgatcaaggaggactgcagcgtgctggcctttgtgctggaccacctgctgccccacacccagaatgctgaggacaaggacaccccagccctggcccggctcttcctggccagcctggccgccgccggcagcggcacagatgcccaggtggccctggtgaatgaggtgaaggccgccctgggccgggccctggccatggccgagagcacagagaagcacgcccggctgcaggccgtgatgtgcatcatcagcaccatcatggagagctgccccagcaccagcagcttctacagcagcgccacagccaagacccagcacaacggcatgaacaacatcatccgcctcttcctgaagaagggcctggtgaatgacctggcccgggtgccccacagcctggacctgagcagccccaacatggccaacacagtgaatgctgccctgaagcccctggagaccctgagccgcatcgtgaaccagcccagcagcctgtttggcagcaagagcgccagcagcaagaacaagtctgagcaggatgcccagggcgccagccaggacagcagcagcaaccagcaggaccctggagagcccggggaggccgaggtgcaggaggaggaccatgatgtgacccagacagaggtggctgatggagacatcatggatggagaggccgagacagattctgtggtgattgctggccagcctgaggtgctgagcagccaggagatgcaggtggagaatgagctggaggacctgattgatgagctgctggagagagatggcggcagcggcaacagcaccatcatcgtgagccgcagcggggaggatgagagccaggaggatgtgctgatggatgaggcccccagcaacctgagccaggccagcaccctgcaggccaacagagaagattccatgaacatcctggaccctgaagatgaggaggagcacacccaggaggaggacagcagcggcagcaatgaagatgaagatgacagccaggatgaggaggaggaggaggaggaggatgaagaagatgaccaggaggatgatgaaggagaggagggagatgaagatgatgatgatgatggcagcgagatggagctggatgaggactacccagacatgaatgccagccccctggtgcgctttgaaagatttgaccgggaggatgacctgatcattgaatttgacaacatgttcagcagcgccacagacatcccccccagccctggcaacatccccaccacccaccccctgatggtgagacatgctgaccacagcagcctgaccctgggcagcggcagcagcaccacccggctgacccagggcatcggccgcagccagaggaccctgcggcagctgacagccaacacaggccacaccatccacgtgcactacccaggcaaccggcagcccaaccccccactcatcctgcagaggctgctgggccccagcgctgctgctgacatcctgcagctgagcagcagcctgcccctgcagagccggggccgggcccggctgctggtgggcaatgatgatgtgcacatcatcgcccggagtgatgatgagctgctggatgacttcttccatgaccagagcacagccaccagccaggccggcaccctgagcagcatccccacagccctgacccgctggacagaggagtgcaaggtgctggatgctgagagcatgcatgactgtgtgtctgtggtgaaggtgtccatcgtgaaccacctggagttcctgagagatgaggagctggaggagcggcgggagaagaggaggaagcagctggccgaggaggagaccaagatcacagacaagggcaaggaggacaaggaaaatagagaccagagcgcccagtgcacagccagcaagagcaatgacagcacagagcagaacctgagtgatggcacccccatgccagacagctaccccaccacccccagcagcacagatgctgccaccagcgagagcaaggagaccctgggcaccctgcagagcagccagcagcagcccaccctgcccaccccaccagccctgggggaggtgccccaggagctgcagagccctgctggggagggcggcagcagcacccagctgctgatgcctgtggagcctgaggagctgggccccacccggcccagcggggaggccgagaccacccagatggagctgagccctgcccccaccatcaccagcctgagccctgagagagctgaggacagtgatgccctgacagctgtgagcagccagctggagggcagccccatggacaccagcagcctggccagctgcaccctggaggaggccgtgggggacaccagcgctgctggcagcagcgagcagcccagggctggcagcagcaccccaggagatgcccccccagctgtggccgaggtgcagggccgcagtgatggcagcggggagagcgcccagcccccagaggacagcagccccccagccagcagcgagagcagcagcacccgggacagcgctgtggccatcagcggggctgacagccggggcatcctggaggagcccctgcccagcaccagcagcgaggaggaggaccccctggccggcatcagcctgcctgagggcgtggaccccagcttcctggccgccctgcctgatgacatcagaagagaggtgctgcagaaccagctgggcatccggccccccaccaggacagcccccagcaccaacagcagcgccccagctgtggtgggcaaccctggggtgacagaggtgtccccagagttcctggccgccctgcccccagccatccaggaggaggtgctggcccagcagagagctgagcagcagaggcgggagctggcccagaatgccagcagtgacacccccatggaccctgtgaccttcatccagaccctgcccagcgacctgcggcgctctgtgctggaggacatggaggacagcgtgctggccgtgatgcccccagacattgctgctgaggcccaggccctgcggcgggagcaggaggcccggcagaggcagctgatgcatgagcggctgtttggccacagcagcaccagcgccctgagcgccatcctgcggagccctgccttcaccagccggctgagcggcaacagaggagtgcagtacacccggctggccgtgcagaggggcggcaccttccagatgggcggcagcagcagccacaaccggcccagcggcagcaatgtggacaccctgctgcggctgcggggccgcctgctgctggaccacgaggccctgagctgcctgctggtgctgctgtttgtggatgagcccaagctgaacaccagccggctgcaccgggtgctgaggaacctgtgctaccacgcccagaccaggcactgggtgatccgcagcctgctgagcatcctgcagaggagcagcgagagcgagctgtgcatcgagacccccaagctgaccaccagcgaggagaagggcaagaagagcagcaagagctgtggcagcagcagccatgaaaatcggcccctggacctgctgcacaagatggagagcaagagcagcaaccagctgtcctggctgtctgtgtccatggatgctgccctgggctgcaggaccaacatcttccagatccagaggtctgggggcaggaagcacacagagaagcacgccagcggcggcagcacagtgcacatccacccccaggccgcccctgtggtgtgcagacatgtgctggacaccctcatccagctggccaaggtgttccccagccacttcacccagcagaggaccaaggagaccaactgtgagagtgaccgggagcggggcaacaaggcctgcagcccctgcagcagccagagcagcagcagcggcatctgcacagacttctgggacctgctggtgaagctggacaacatgaatgtgtccaggaagggcaagaacagcgtgaagtctgtgcctgtgtctgctggaggagagggggagaccagcccctacagcctggaggccagccccctgggccagctgatgaacatgctgagccaccctgtgatccgccgcagcagcctgctgacagagaagctgctgcggctgctgagcctcatcagcatcgccctgcctgagaacaaggtgtctgaggcccaggccaacagcggcagcggggccagcagcaccaccacagccaccagcaccaccagcaccaccaccaccacagctgccagcaccacccccaccccacccacagcccccacccctgtgaccagcgccccagccctggtggccgccacagccatcagcaccatcgtggtggccgccagcaccaccgtgaccacccccaccacagccaccaccaccgtgtccatcagccccaccaccaagggcagcaagagccctgccaaggtgtctgatggcggcagcagcagcacagacttcaagatggtgagcagcggcctgacagagaaccagctgcagctgtctgtggaggtgctgaccagccacagctgcagcgaggagggcctggaggatgctgccaacgtgctgctgcagctgagcagaggagacagcggcacccgggacacagtgctgaagctgctgctgaatggagcccggcacctgggctacaccctgtgcaagcagatcggcaccctgctggccgagctgcgggagtacaacctggagcagcagaggcgggcccagtgtgagaccctgagcccagatggcctgcctgaggagcagccccagaccaccaagctgaagggcaagatgcagagcagatttgacatggccgagaatgtggtgattgtggccagccagaagaggcccctgggcggccgggagctgcagctgcccagcatgtccatgctgaccagcaagaccagcacccagaagttcttcctgcgggtgctgcaggtgatcatccagctgagagatgacacccggcgggccaacaagaaggccaagcagacaggccgcctgggcagcagcggcctgggcagcgccagcagcatccaggccgctgtgcggcagctggaggccgaggctgatgccatcatccagatggtgcgggagggccagagggcccggcggcagcagcaggccgccaccagcgagagcagccagagcgaggcctctgtgcggcgggaggagagccccatggatgtggaccagcccagccccagcgcccaggacacccagagcatcgccagtgatggcaccccccagggcgagaaggagaaggaggagaggcctcctgagctgcccctgctgtctgagcagctgagcctggatgagctgtgggacatgctgggggagtgcctgaaggagctggaggagagccatgaccagcacgctgtgctggtgctgcagcctgctgtggaggccttcttcctggtgcacgccacagagcgggagagcaagccccctgtgcgggacacccgggagagccagctggcccacatcaaggatgagcccccacccctgagccctgcccccctgaccccagccacccccagcagcctggaccccttcttcagccgggagcccagctccatgcacatcagcagcagcctgcccccagacacccagaagttcctgcgctttgctgagacccacaggacagtgctgaaccagatcctgcggcagagcaccacccacctggctgatggcccctttgctgtgctggtggactacatccgggtgctggactttgatgtgaagaggaagtacttccggcaggagctggagcggctggatgagggcctgaggaaagaagacatggctgtgcacgtgcggcgggaccacgtgtttgaggacagctaccgggagctgcacaggaagagccctgaggagatgaagaaccggctgtacatcgtgtttgaaggagaggagggccaggatgctgggggcctgctgcgggagtggtacatgatcatcagccgggagatgttcaaccccatgtatgccctcttccgcaccagccctggggacagagtgacctacaccatcaaccccagcagccactgcaaccccaaccacctgagctacttcaagtttgtgggcagaattgtggccaaggctgtgtatgacaaccggctgctggagtgctacttcaccaggagcttctacaagcacatcctgggcaagtctgtgcgctacacagacatggagagcgaggactaccacttctaccagggcctggtgtacctgctggagaatgatgtgtccaccctgggctatgacctgaccttcagcacagaggtgcaggagtttggagtgtgtgaggtgcgggacctgaagcccaacggggccaacatcctggtgacagaggagaacaagaaggagtatgtgcacctggtgtgccagatgaggatgaccggggccatcaggaagcagctggccgccttcctggagggcttctatgagatcatccccaagaggctcatcagcatcttcacagagcaggagctggagctgctgatcagcggcctgcccaccattgatattgatgacctgaagagcaacacagagtaccacaagtaccagagcaacagcatccagatccagtggttctggagggccctgcggagctttgaccaggccgaccgggccaagttcctgcagtttgtgacaggcaccagcaaggtgcccctgcagggctttgctgccctggagggcatgaatggcatccagaagttccagatccacagagatgacaggagcacagaccggctgcccagcgcccacacctgcttcaaccagctggacctgcctgcctatgagagctttgagaagctgcggcacatgctgctgctggccatccaggagtgcagcgagggcttcggcctggcctag

SEQ ID NO: 38152 - DNA, 1746 bp, Artificial Sequence
  Description of Artificial Sequence: Synthetic coding sequence
atgaccagcgctgtggtggacagcggcggcaccatcctggagctgagcagcaatggagtggagaaccaggaggagagcgagaaggtgtctgagtacccagctgtgattgtggagcctgtgcccagcgcccggctggagcagggctacgccgcccaggtgctggtgtatgatgatgagacctacatgatgcaggatgtggccgaggagcaggaggtggagacagaaaatgtggagaccgtggaggcctctgtgcacagcagcaatgcccactgcacagacaagaccatcgaggccgctgaggccctgctgcacatggagagccccacctgcctgcgggacagccgcagccctgagttcatccacgccgccatgaggccagatgtgatcacagagaccgtggtggaggtgtccacagaggagagcgagcccatggacaccagccccatccccaccagcccagacagccatgagcccatgaagaagaagaaggtgggcaggaagcccaagacccagcagagccccatcagcaatggcagccctgagctgggcatcaagaagaagccccgggagggcaagggcaacaccacctacctgtgggagttcctgctggacctgctgcaggacaagaacacctgcccccgctacatcaagtggacccagcgggagaagggcatcttcaagctggtggacagcaaggctgtgtccaagctgtggggcaagcacaagaacaagccagacatgaactatgagaccatgggccgggccctgcgctactactaccagaggggcatcctggccaaggtggagggccagaggctggtgtaccagttcaaggacatgcccaagaacatcgtggtgattgatgatgacaagtctgagacctgcaatgaagacctggccggcaccacagatgagaagagcctggagcgggtgtccctgtctgctgagagcctgctgaaggccgccagctctgtgcgcagcggcaagaacagcagccccatcaactgcagcagagctgagaagggcgtggcccgggtggtgaacatcaccagccctggccatgatgccagcagccgcagccccaccaccacagcctctgtgtctgccacagctgcccccaggacagtgcgggtggccatgcaggtgcctgtggtgatgaccagcctgggccagaagatcagcacagtggccgtgcagagcgtgaatgctggggcccccctcatcaccagcaccagccccaccacagccaccagccccaaggtggtgatccagaccatccccaccgtgatgcctgccagcacagaaaatggagacaagatcaccatgcagcctgccaagatcatcaccatcccagccacccagctggcccagtgccagctgcagaccaagagcaacctgactggaagtggcagcatcaacatcgtgggcacccccctggccgtgcgggccctgacccctgtgtccatcgcccacggcacccctgtgatgaggctgtccatgcccacccagcaggccagcggccagaccccacccagggtcatctctgctgtgatcaagggccctgaggtgaagtctgaggccgtggccaagaagcaggagcatgatgtgaagaccctgcagctggtggaggagaagccagcagatggcaacaagacagtgacccacgtggtggtggtgtctgcccccagcgccatcgccctgcctgtgaccatgaagacagagggcctggtgacctgtgagaagtag

SEQ ID NO: 38153 - DNA, 1602 bp, Artificial Sequence
  Description of Artificial Sequence: Synthetic coding sequence
atggccaccagcctgcacgagggccccaccaaccagctggacctgctgatccgggctgtggaggcctctgtgcacagcagcaatgcccactgcacagacaagaccatcgaggccgctgaggccctgctgcacatggagagccccacctgcctgcgggacagccgcagccctgtggaggtgtttgtgcccccctgtgtgtccaccccagagttcatccacgccgccatgaggccagatgtgatcacagagaccgtggtggaggtgtccacagaggagagcgagcccatggacaccagccccatccccaccagcccagacagccatgagcccatgaagaagaagaaggtgggcaggaagcccaagacccagcagagccccatcagcaatggcagccctgagctgggcatcaagaagaagccccgggagggcaagggcaacaccacctacctgtgggagttcctgctggacctgctgcaggacaagaacacctgcccccgctacatcaagtggacccagcgggagaagggcatcttcaagctggtggacagcaaggctgtgtccaagctgtggggcaagcacaagaacaagccagacatgaactatgagaccatgggccgggccctgcgctactactaccagaggggcatcctggccaaggtggagggccagaggctggtgtaccagttcaaggacatgcccaagaacatcgtggtgattgatgatgacaagtctgagacctgcaatgaagacctggccggcaccacagatgagaagagcctggagcgggtgtccctgtctgctgagagcctgctgaaggccgccagctctgtgcgcagcggcaagaacagcagccccatcaactgcagcagagctgagaagggcgtggcccgggtggtgaacatcaccagccctggccatgatgccagcagccgcagccccaccaccacagcctctgtgtctgccacagctgcccccaggacagtgcgggtggccatgcaggtgcctgtggtgatgaccagcctgggccagaagatcagcacagtggccgtgcagagcgtgaatgctggggcccccctcatcaccagcaccagccccaccacagccaccagccccaaggtggtgatccagaccatccccaccgtgatgcctgccagcacagaaaatggagacaagatcaccatgcagcctgccaagatcatcaccatcccagccacccagctggcccagtgccagctgcagaccaagagcaacctgactggaagtggcagcatcaacatcgtgggcacccccctggccgtgcgggccctgacccctgtgtccatcgcccacggcacccctgtgatgaggctgtccatgcccacccagcaggccagcggccagaccccacccagggtcatctctgctgtgatcaagggccctgaggtgaagtctgaggccgtggccaagaagcaggagcatgatgtgaagaccctgcagctggtggaggagaagccagcagatggcaacaagacagtgacccacgtggtggtggtgtctgcccccagcgccatcgccctgcctgtgaccatgaagacagagggcctggtgacctgtgagaagtag

SEQ ID NO: 38154 - DNA, 1515 bp, Artificial Sequence
  Description of Artificial Sequence: Synthetic coding sequence
atggccaccagcctgcacgagggccccaccaaccagctggacctgctgatccgggctgtggaggcctctgtgcacagcagcaatgcccactgcacagacaagaccatcgaggccgctgaggccctgctgcacatggagagccccacctgcctgcgggacagccgcagccctgtggaggtgtttgtgcccccctgtgtgtccaccccagagttcatccacgccgccatgaggccagatgtgatcacagagaccgtggtggaggtgtccacagaggagagcgagcccatggacaccagccccatccccaccagcccagacagccatgagcccatgaagaagaagaagggcaacaccacctacctgtgggagttcctgctggacctgctgcaggacaagaacacctgcccccgctacatcaagtggacccagcgggagaagggcatcttcaagctggtggacagcaaggctgtgtccaagctgtggggcaagcacaagaacaagccagacatgaactatgagaccatgggccgggccctgcgctactactaccagaggggcatcctggccaaggtggagggccagaggctggtgtaccagttcaaggacatgcccaagaacatcgtggtgattgatgatgacaagtctgagacctgcaatgaagacctggccggcaccacagatgagaagagcctggagcgggtgtccctgtctgctgagagcctgctgaaggccgccagctctgtgcgcagcggcaagaacagcagccccatcaactgcagcagagctgagaagggcgtggcccgggtggtgaacatcaccagccctggccatgatgccagcagccgcagccccaccaccacagcctctgtgtctgccacagctgcccccaggacagtgcgggtggccatgcaggtgcctgtggtgatgaccagcctgggccagaagatcagcacagtggccgtgcagagcgtgaatgctggggcccccctcatcaccagcaccagccccaccacagccaccagccccaaggtggtgatccagaccatccccaccgtgatgcctgccagcacagaaaatggagacaagatcaccatgcagcctgccaagatcatcaccatcccagccacccagctggcccagtgccagctgcagaccaagagcaacctgaccggcagcggcagcatcaacatcgtgggcacccccctggccgtgcgggccctgacccctgtgtccatcgcccacggcacccctgtgatgaggctgtccatgcccacccagcaggccagcggccagaccccacccagggtcatctctgctgtgatcaagggccctgaggtgaagtctgaggccgtggccaagaagcaggagcatgatgtgaagaccctgcagctggtggaggagaagccagcagatggcaacaagacagtgacccacgtggtggtggtgtctgcccccagcgccatcgccctgcctgtgaccatgaagacagagggcctggtgacctgtgagaagtag

SEQ ID NO: 38155 - DNA, 1782 bp, Artificial Sequence
  Description of Artificial Sequence: Synthetic coding sequence
atgaccagcgctgtggtggacagcggcggcaccatcctggagctgagcagcaatggagtggagaaccaggaggagagcgagaaggtgtctgagtacccagctgtgattgtggagcctgtgcccagcgcccggctggagcagggctacgccgcccaggtgctggtgtatgatgatgagacctacatgatgcaggatgtggccgaggagcaggaggtggagacagaaaatgtggagaccgtggaggcctctgtgcacagcagcaatgcccactgcacagacaagaccatcgaggccgctgaggccctgctgcacatggagagccccacctgcctgcgggacagccgcagccctgtggaggtgtttgtgcccccctgtgtgtccaccccagagttcatccacgccgccatgaggccagatgtgatcacagagaccgtggtggaggtgtccacagaggagagcgagcccatggacaccagccccatccccaccagcccagacagccatgagcccatgaagaagaagaaggtgggcaggaagcccaagacccagcagagccccatcagcaatggcagccctgagctgggcatcaagaagaagccccgggagggcaagggcaacaccacctacctgtgggagttcctgctggacctgctgcaggacaagaacacctgcccccgctacatcaagtggacccagcgggagaagggcatcttcaagctggtggacagcaaggctgtgtccaagctgtggggcaagcacaagaacaagccagacatgaactatgagaccatgggccgggccctgcgctactactaccagaggggcatcctggccaaggtggagggccagaggctggtgtaccagttcaaggacatgcccaagaacatcgtggtgattgatgatgacaagtctgagacctgcaatgaagacctggccggcaccacagatgagaagagcctggagcgggtgtccctgtctgctgagagcctgctgaaggccgccagctctgtgcgcagcggcaagaacagcagccccatcaactgcagcagagctgagaagggcgtggcccgggtggtgaacatcaccagccctggccatgatgccagcagccgcagccccaccaccacagcctctgtgtctgccacagctgcccccaggacagtgcgggtggccatgcaggtgcctgtggtgatgaccagcctgggccagaagatcagcacagtggccgtgcagagcgtgaatgctggggcccccctcatcaccagcaccagccccaccacagccaccagccccaaggtggtgatccagaccatccccaccgtgatgcctgccagcacagaaaatggagacaagatcaccatgcagcctgccaagatcatcaccatcccagccacccagctggcccagtgccagctgcagaccaagagcaacctgactggaagtggcagcatcaacatcgtgggcacccccctggccgtgcgggccctgacccctgtgtccatcgcccacggcacccctgtgatgaggctgtccatgcccacccagcaggccagcggccagaccccacccagggtcatctctgctgtgatcaagggccctgaggtgaagtctgaggccgtggccaagaagcaggagcatgatgtgaagaccctgcagctggtggaggagaagccagcagatggcaacaagacagtgacccacgtggtggtggtgtctgcccccagcgccatcgccctgcctgtgaccatgaagacagagggcctggtgacctgtgagaagtag

SEQ ID NO: 38156 - DNA, 1746 bp, Artificial Sequence; identical to SEQ ID NO: 38152
  Description of Artificial Sequence: Synthetic coding sequence

SEQ ID NO: 38157 - DNA, 1191 bp, Artificial Sequence
  Description of Artificial Sequence: Synthetic coding sequence
atgtctgtcatcgtgttcaagggcaacaccacctacctgtgggagttcctgctggacctgctgcaggacaagaacacctgcccccgctacatcaagtggacccagcgggagaagggcatcttcaagctggtggacagcaaggctgtgtccaagctgtggggcaagcacaagaacaagccagacatgaactatgagaccatgggccgggccctgcgctactactaccagaggggcatcctggccaaggtggagggccagaggctggtgtaccagttcaaggacatgcccaagaacatcgtggtgattgatgatgacaagtctgagacctgcaatgaagacctggccggcaccacagatgagaagagcctggagcgggtgtccctgtctgctgagagcctgctgaaggccgccagctctgtgcgcagcggcaagaacagcagccccatcaactgcagcagagctgagaagggcgtggcccgggtggtgaacatcaccagccctggccatgatgccagcagccgcagccccaccaccacagcctctgtgtctgccacagctgcccccaggacagtgcgggtggccatgcaggtgcctgtggtgatgaccagcctgggccagaagatcagcacagtggccgtgcagagcgtgaatgctggggcccccctcatcaccagcaccagccccaccacagccaccagccccaaggtggtgatccagaccatccccaccgtgatgcctgccagcacagaaaatggagacaagatcaccatgcagcctgccaagatcatcaccatcccagccacccagctggcccagtgccagctgcagaccaagagcaacctgaccggcagcggcagcatcaacatcgtgggcacccccctggccgtgcgggccctgacccctgtgtccatcgcccacggcacccctgtgatgaggctgtccatgcccacccagcaggccagcggccagaccccacccagggtcatctctgctgtgatcaagggccctgaggtgaagtctgaggccgtggccaagaagcaggagcatgatgtgaagaccctgcagctggtggaggagaagccagcagatggcaacaagacagtgacccacgtggtggtggtgtctgcccccagcgccatcgccctgcctgtgaccatgaagacagagggcctggtgacctgtgagaagtag

SEQ ID NO: 38158 - DNA, 2385 bp, Artificial Sequence
  Description of Artificial Sequence: Synthetic coding sequence
atggccagccccaccctgagcccagacagcagcagccaggaggccctgagcgcccccacctgcagccccaccagtgacagcgagaacctgagcccagatgagctggagctgctggccaagctggaggagcagaaccggctgctggaggccgacagcaagtccatgaggtccatgaatggcagcagaagaaattctggcagcagcctggtgagcagcagcagcgccagcagcaacctgagccacctggaggaggacacctggatcctgtggggcagaattgccaatgagtgggaggagtggaggaggaggaaggagaagctgctgaaggagctgatcaggaagggcatcccccaccacttccgggccatcgtgtggcagctgctgtgcagcgccacagacatgcctgtgaagaaccagtacagcgagctgctgaagatgagcagcccctgtgagaagctgatcagaagagacatcgcccggacctacccagagcacgagttcttcaagggccaggacagcctgggccaggaggtgctcttcaacgtgatgaaggcctacagcctggtggaccgggaggtgggctactgccagggcagcgccttcatcgtgggcctgctgctgatgcagatgcctgaggaggaggccttctgtgtgtttgtgcggctgatgcaggagtaccgcctgcgggagctgttcaagcccagcatggccgagctgggcctgtgcatctaccagtttgagtacatgctgcaggagcagctgcctgacctgaacacccacttccgcagccagagcttccacacctccatgtatgccagctcctggttcctgaccctcttcctgaccaccttccccctgcctgtggccaccagggtgtttgacatcttcatgtatgagggcctggagatcgtgttccgggtgggcctggccctgctgcaggtgaaccaggccgagctgatgcagctggacatggagggcatgagccagtacttccagagggtcatcccccaccagtttgacagctgcccagacaagctggtgctgaaggcctaccaggtgaagtacaaccccaagaagatgaagaggctggagaaggagtatgctgccatgaagagcaaggagatggaggagcagatcgagatcaagaggctgaggacagaaaatcggctgctgaagcagagaattgagaccctggagaagggccaggtgacccgggcccaggaggccgaggagaactacgtgatcaagcgggagctggccgtggtgcggcagcagtgcagcagcgctgctgaggacctgcagaaggcccagagcaccatccggcagctgcaggagcagcaggagaacccccggctgacagaggactttgtgagccacctggagacagagctggagcagagccggctgcgggagacagagaccctgggcgccctgcgggagatgcaggacaaggtgctggacatggagaagaggaacagcagcctgcctgatgagaacaacgtggcccagctgcaggaggagctgaaggccctgaaggtgcgggagggccaggccgtggccagcacccgggagctgaagctgcagctgcaggagctgagtgacacctggcaggcccacctggcccggggcggccgctggaaggagagccccaggaagctggtggtgggggagctgcaggatgagctgatgtctgtgcggctgcgggaggcccaggccctggccgagggccgggagctgcggcagagggtggtggagctggagacccaggaccacatccacaggaacctgctgaacagagtggaggccgagagagctgccctgcaggagaagctgcagtacctggccgcccagaacaagggcctgcagacccagctgtctgagagcaggaggaagcaggccgaggccgagtgcaagagcaaggaggaggtgatggctgtgcggctgcgggaggccgacagcatggctgctgtggccgagatgaggcagagaattgctgagctggagatccagcgggaggagggccgcatccagggccagctgaaccacagcgacagcagccagtacatccgggagctgaaggaccagatcgaggagctgaaggccgaggtgcggctgctgaagggccccccaccatttgaggaccccctggcctttgatggcctgagcctggcccggcacctggatgaggacagcctgcccagcagtgatgaggagctgctgggcgtgggcgtgggcgccgccctgcaggatgccctgtaccccctgagccccagagatgcccgcttcttccggcggctggagaggcctgccaaggacagcgagggcagcagtgacagtgatgctgatgagctggccgccccctacagccagggcctggacaactag

SEQ ID NO: 38159 - DNA, 2418 bp, Artificial Sequence
  Description of Artificial Sequence: Synthetic coding sequence
atggccagccccaccctgagcccagacagcagcagccaggaggccctgagcgcccccacctgcagccccaccagtgacagcgagaacctgagcccagatgagctggagctgctggccaagctggaggagcagaaccggctgctggaggccgacagcaagtccatgaggtccatgaatggcagcagaagaaattctggcagcagcctggtgagcagcagcagcgccagcagcaacctgagccacctggaggaggacacctggatcctgtggggcagaattgccaatgagtgggaggagtggaggaggaggaaggagaagctgctgaaggagctgatcaggaagggcatcccccaccacttccgggccatcgtgtggcagctgctgtgcagcgccacagacatgcctgtgaagaaccagtacagcgagctgctgaagatgagcagcccctgtgagaagctgatcagaagagacatcgcccggacctacccagagcacgagttcttcaagggccaggacagcctgggccaggaggtgctcttcaacgtgatgaaggcctacagcctggtggaccgggaggtgggctactgccagggcagcgccttcatcgtgggcctgctgctgatgcagatgcctgaggaggaggccttctgtgtgtttgtgcggctgatgcaggagtaccgcctgcgggagctgttcaagcccagcatggccgagctgggcctgtgcatctaccagtttgagtacatgctgcaggagcagctgcctgacctgaacacccacttccgcagccagagcttccacacctccatgtatgccagctcctggttcctgaccctcttcctgaccaccttccccctgcctgtggccaccagggtgtttgacatcttcatgtatgagggcctggagatcgtgttccgggtgggcctggccctgctgcaggtgaaccaggccgagctgatgcagctggacatggagggcatgagccagtacttccagagggtcatcccccaccagtttgacagctgcccagacaagctggtgctgaaggcctaccaggtgaagtacaaccccaagaagatgaagaggctggagaaggagtatgctgccatgaagagcaaggagatggaggagcagatcgagatcaagaggctgaggacagaaaatcggctgctgaagcagagaattgagaccctggagaaggagagcgctgccctggccgacaggctcatccagggccaggtgacccgggcccaggaggccgaggagaactacgtgatcaagcgggagctggccgtggtgcggcagcagtgcagcagcgctgctgaggacctgcagaaggcccagagcaccatccggcagctgcaggagcagcaggagaacccccggctgacagaagattttgtgagccacctggagacagagctggagcagagccggctgcgggagacagagaccctgggcgccctgcgggagatgcaggacaaggtgctggacatggagaagaggaacagcagcctgcctgatgaaaataatgtggcccagctgcaggaggagctgaaggccctgaaggtgcgggagggccaggccgtggccagcacccgggagctgaagctgcagctgcaggagctgagtgacacctggcaggcccacctggcccggggcggccgctggaaggagagccccaggaagctggtggtgggggagctgcaggatgagctgatgtctgtgcggctgcgggaggcccaggccctggccgagggccgggagctgcggcagagggtggtggagctggagacccaggaccacatccacaggaacctgctgaacagagtggaggccgagcgggccgccctgcaggagaagctgcagtacctggccgcccagaacaagggcctgcagacccagctgtctgagagcaggaggaagcaggccgaggccgagtgcaagagcaaggaggaggtgatggctgtgcggctgcgggaggccgacagcatggctgctgtggccgagatgaggcagagaattgctgagctggagatccagcgggaggagggccgcatccagggccagctgaaccacagcgacagcagccagtacatccgggagctgaaggaccagatcgaggagctgaaggccgaggtgcggctgctgaagggccccccaccatttgaggaccccctggcctttgatggcctgagcctggcccggcacctggatgaggacagcctgcccagcagtgatgaggagctgctgggcgtgggcgtgggcgccgccctgcaggatgccctgtaccccctgagccccagagatgcccgcttcttccggcggctggagaggcctgccaaggacagcgagggcagcagtgacagtgatgctgatgagctggccgccccctacagccagggcctggacaactag

SEQ ID NO: 38160 - DNA, 7740 bp, Artificial Sequence
  Description of Artificial Sequence: Synthetic coding sequence
atggccgaggccgtgaagccccagaggcgggccaaggccaaggccagcaggaccaagaccaaggagaagaagaagtatgagaccccccagcgggaggagagcagcgaggtgtccctgcccaagaccagccgggagcaggagatccccagcctggcctgtgagttcaagggggaccacctgaaggtggtgacagacagccagctgcaggatgatgccagcggccagaatgaaagtgagatgtttgatgtgcccctgaccagcctgaccatcagcaatgaggagagcctgacctgcaacacagagccccccaaggagggcggggaggcccggccctgtgtgggggacagcgctgtgacccccaaggtgcaccctggggacaacgtgggcaccaaggtggagacccccaagaacttcacagaggtggaggagaacatgtctgtgcagggcggcctgtctgagagcgccccccagagcaacttctcctacacccagcctgccatggagaacatccaggtgcgggagacccagaacagcaaggaggacaagcagggcctggtgtgcagcagcgaggtgccccagaatgtgggcctgcagagcagctgcccagccaagcacggcttccagaccccccgggtgaagaagctgtacccccagctgcctgctgagattgctggggaggccccagccctggtggccgtgaagcccctgctgcggtctgagcggctgtacccagagctgcccagccagctggagctggtgcccttcaccaaggagcagctgaagatcctggagcccggctcctggctggagaatgtggagagctacctggaggagtttgacagcatggcccaccaggacagacatgagttctatgagctgctgctgaactacagccgctgcaggaagcagctgctgctggccgaggccgagctgctgaccctgaccagtgactgccagaatgccaagagccggctgtggcagttcaaggaggagcagatgtctgtgcagggcatctgtgccgaccaggtgaaggtgttctcctaccaccgctaccagagggtggagatgaatgaaaatgccctggtggagctgaagaagctgtttgatgccaagtctgagcacctgcaccagaccctggccctgcacagctacacctctgtgctgagccggctgcaggtggagagctacatctatgccctgctgagcagcagcgctgtgctgcggagcagcgccatccaccagcagggccgggccagcaagcagacagagagcatccccagcgacctgtgccagctgaaggagtgcatctctgtgctcttcatgttcacccggcgggtgaatgaagacacccagttccatgatgacatcctgctgtggctgcagaagctggtgtctgtgctgcagagggtgggctgccctggggaccacctgttcctgctgaaccacatcctgcgctgcccagctggggtgtccaagtgggccgtgcccttcatccagatcaaggtgctgcacaaccccagcggggtcttccacttcatgcagagcctggccctgctgatgagccctgtgaagaacagagctgagttcatgtgccacatgaagcccagcgagaggaagcccagcagcagcggccctggcagcggcacctggaccctggtggatgagggcggggaggaggatgaagatcctgagacctcctggatcctgctgaatgaagatgacctggtgaccatcctggcccagttccccttccacgagctgttccagcacctgctgggcttcaaggccaagggggactacctgcctgagaccacccggccccaggagatgatgaagatctttgcctttgccaacagcctggtggagctgctggccgtgggcctggagaccttcaacagagcccgctaccggcagtttgtgaagagaattggctacatgatccgcatgaccctgggctacgtgtctgaccactgggcccagtatgtgagccacaaccagggcagcggcctggcccagcagccctacagcatggagaagctgcaggtggagtttgatgagctgttcctgcgggctgtgctgcacgtgctgaaggccaagaggctgggcatctggctgttcatgtctgagatgcccttcggcaccctgtctgtgcagatgctgtggaagctgttctacctgatgcaccaggtggagagcgagaacctgcagcagctgagcagcagcctgcagcctgcccagtgcaagcagcagctgcaggaccctgagcacttcaccaactttgagaagtgcctgagctccatgaacagcagcgaggagatctgcctgctgaccacctttgcccagatggcccaggcccggaggaccaacgtggatgaggacttcatcaagatcatcgtgctggagatctatgaggtgtcctatgtgaccctgagcacccgggagaccttcagcaaggtgggccgggagctgctgggcaccatcacagctgtgcaccctgagatcatctctgtgctgctggacagagtgcaggagaccatcgaccaggtgggcatggtgtccctgtacctgttcaaggagctgcccctgtacctgtggcagcccagcgccagcgagattgctgtgatccgggactggctgctgaactacaacctgactgtggtgaagaacaagctggcctgtgtgatcctggagggcctgaactggggctttgccaagcaggccaccctgcacctggaccaggccgtgcatgctgaggtggccctgatggtgctggaggcctaccagaagtacctggcccagaagccctatgccggcatcctgtctgagagcatgaagcaggtgtcctacctggccagcatcgtgcgctacggggagaccccagagaccagcttcaaccagtgggcctggaacctgatcctgcggctgaagctgcacaagaatgactatggcatccagcccaactgcccagctgtgcccttctctgtgacagtgcctgacatgacagagagccccaccttccaccccctgctgaaggctgtgaaggccggcatgcccatcggctgctacctggccctgtccatgacagctgtgggccacagcattgagaagttctgtgccgagggcatccccctgctgggcatcctggtgcagagccgccacctgaggacagtggtgcacgtgctggacaagatcctgcccctcttctacccctgccagtactacctgctgaagaatgagcagttcctgagccacctgctgctcttcctgcacctggacagcggcgtgccccagggcgtgacccagcaggtgacccacaaggtggcccagcacctgaccggggccagccacggggacaacgtgaagctgctgaacagcatgatccaggcccacatctctgtgtccacccagcccaatgaggtgggccctgtggccgtgctggagttctgggtgcaggccctgatcagccagcacctgtggtaccgggagcagcccatcctcttcctgatggaccacctgtgcaaggccgccttccagctgatgcaggaggactgcatccagaagctgctgtaccagcagcacaagaatgccctgggctaccactgtgacaggagcctgctgagcagcctggtgtcctggatcgtggccggcaacatcacccccagctttgtggagggcctggccacccccacccaggtgtggtttgcctggacagtgctgaacatggagagcatctttgaggaggacagccagctgcggcgggtgattgaaggagagctggtgatcaacagcgccttcaccccagaccaggccctgaagaaggcccagacccagctgaagctgcccatcgtgcccagcctgcagaggctgctgatctaccgctgggcccaccaggccctggtgacccccagcgaccaccccctgctgcccctcatctggcagaagttcttcctgctgtacctgcacaggcctggcccccagtatggcctgcccattgatggctgcattggaagacgcttcttccagagccctgcccacatcaacctgctgaaggagatgaagaggcggctgacagaggtggccgacttccaccacgccgccagcaaggccctgcgggtgcctgctgagggcagcgagggcctgcctgagagccacagcggcaccccaggctacctgaccagccctgagctgcacaaggagctggtgcggctcttcaacgtgtacatcctgtggctggaggatgagaacttccagaagggggacacctacatccccagcctgcccaagcactatgacatccaccggctggccaaggtgatgcagaaccagcaggacctgtggatggagtacctgaacatggagcgcatctaccacgagttccaggagaccgtgggcctgtggacccaggccaagctggagagccacagcaccccctgcagcctgtctgtgcagctggacttcacagaccccctgctggccaaggagcgggtgctgagcaacctgaggaagcatgaggccccccagccccccctggccctgcaccccaccaagccccctgtgcctgtgatcagcagcgctgtgctgctgagccagaaggatgccacccagctggtgtgcacagacctgaacctgctgcagcagcaggccaggacagctgccctgcgggagagccagcaggtggccctggatggagagctgctggacaccatgcccaagcagtatgtgaaccgggaggagcagaccaccctgcacctggagtgccggggcagcagcggcaagaagtgccagggcgctgctgtggtgacagtgcagtttgagggcatgcacaagaatgaggccatcagccagcagctgcacgtgctgaggaaggaggtgaagcagctgcaggccgaggccgccaagccacccagcctgaacatcgtggaggccgctgtgcatgctgaaaatctcatcacagccctggtgaatgcctacaagctgcagcccaccccaggcatccagaaggtgggcatcagcctcttcttcaccatcgtggactatgtgtctgatgagacccagaggcacccccccacccggcagttcttcaccagctgcatcgagatcctgggccaggtgttcatcagcggcatcaagtctgagtgcaggaaggtgctggagaccatcctgaagaacagccggctgtgcagcctgctgagccccttcttcaccccaaatgctgccccagctgagttcatccagctgtatgagcaggtggtgaagttcctgtctgaggacaacagcgacatgatcttcatgctgctgaccaagtttgacctgaagcagtggctgagcgccaccaagccacccctgagtgacaggacccggctgctggagagcatccacctggccctgacagcctggggcctggagccagatgaggacatcctgatgcccttcaacctcttctgcaagcactggacctacctgctgctgtaccagttcccagaccagtacagcgacatcctgcggctgctgatgcagagcagcgctgagcagctgctgagccctgagtgctggaaggccaccctgcgggccctgggctgctgtgcccccagctgccagcagggcgccgccagcacagagggcgctgtgctgcccagcagcagtgatgccctgctgagtgacaagcaggtgatggagaccatccagtggctgagtgacttcttctacaagctgcggctgagcaagatggacttcaagagctttggcctcttcagcaagtggagcccctacatggctgatgtgaagaccttcctgggctacctggtgaagaggctgattgacctggagatgacctgcctggcccaggaccccacagccagcaggaagacagtgctgaagagcctgcacagcgtcatcatccagctgttcaagccctggatcctggtgctggaggacaatgaaagcagccagcagaggcactacccctggctggagagtgacacagtggtggccagcagcatcgtgcagctgttcacagactgcatcgacagcctgcacgagagcttcaaggacaagctgctgcctggagatgctggggccctgtggctgcacctgatgcactactgtgaggcctgcacagcccccaagatgcctgagttcatcctgtatgccttccacagcacctacaggaagctgccctggaaggacctgcacccagaccagatgctgatggaggccttcttcaaggtggagcggggcagccccaagagctgcttcctgttcctgggctctgtgctgtgtgaggtgaactgggtgtctgtgctgagtgatgcctggaacagcagcccccaccctgagaccaggtccatgattgtgtgcctgctcttcatgatgatcctgctggccaaggaggtgcagctggtggaccagacagacagccccctgctgagcctgctgggccagaccagcagcctgtcctggcacctggtggacatcgtgtcctaccagagcgtgctgagctacttcagcagccactacccacccagcatcatcctggccaaggagagctatgcagagctgatcatgaagctgctgaaggtgtctgctggcctgagcatccccacagacagccagaagcacctggatgctgtgcccaagtgccaggccttcacccaccagatggtgcagttcctgagcaccctggagcagaatggcaagatcaccctggccgtgctggagcaggagatgagcaagctgctggatgacatcatcgtgttcaaccccccagacatggacagccagaccaggcacatggccctgagcagcctcttcatggaggtgctgatgatgatgaacaatgccaccatccccacagctgagttcctgcggggcagcatccgcacctggattggccagaagatgcacggcctggtggtgctgcccctgctgacagctgcctgccagagcctggcctctgtgcgccacatggccgagaccacagaggcctgcatcacagcctacttcaaggagagccccctgaaccagaacagcggctggggccccatcctggtgtccctgcaggtgcctgagctgaccatggaggagttcctgcaggagtgcctgaccctgggcagctacctgaccctgtatgtgtacctgctgcagtgcctgaacagcgagcagaccctgagaaatgagatgaaggtgctgctgatcctgagcaagtggctggagcaggtgtaccccagctctgtggaggaggaggccaagctgttcctgtggtggcaccaggtgctgcagctgagcctcatccagacagagcagaatgattctgtgctgacagagagcgtcatccgcatcctgctgctggtgcagagccggcagaacctggtggccgaggagcggctgagcagcggcatcctgggcgccatcggcttcggcaggaagagccccctgagcaaccgcttccgggtggtggcccgctccatggccgccttcctgtctgtgcaggtgcccatggaggaccagatccggctgcggcccggcagcgagctgcacctgacccccaaggcccagcaggccctgaatgccctggagagcatggccagcagcaagcagtatgtggagtaccaggaccagatcctgcaggccacccagttcatccgccaccctggccactgcctgcaggacggcaagagcttcctggccctgctggtgaactgcctgtacccagaggtgcactacctggaccacatcagatag

SEQ ID NO: 38161 - DNA, 4071 bp, Artificial Sequence
  Description of Artificial Sequence: Synthetic coding sequence
atgatccaggcccacatctctgtgtccacccagcccaatgaggtgggccctgtggccgtgctggagttctgggtgcaggccctgatcagccagcacctgtggtaccgggagcagcccatcctcttcctgatggaccacctgtgcaaggccgccttccagctgatgcaggaggactgcatccagaagctgctgtaccagcagcacaagaatgccctgggctaccactgtgacaggagcctgctgagcagcctggtgtcctggatcgtggccggcaacatcacccccagctttgtggagggcctggccacccccacccaggtgtggtttgcctggacagtgctgaacatggagagcatctttgaggaggacagccagctgcggcgggtcatcgagggggagctggtgatcaacagcgccttcaccccagaccaggccctgaagaaggcccagacccagctgaagctgcccatcgtgcccagcctgcagaggctgctgatctaccgctgggcccaccaggccctggtgacccccagcgaccaccccctgctgcccctcatctggcagaagttcttcctgctgtacctgcaccggcccggcccccagtatggcctgcccattgatggctgcatcggccgccgcttcttccagagccctgcccacatcaacctgctgaaggagatgaagaggcggctgacagaggtggccgacttccaccacgccgccagcaaggccctgcgggtgcctgctgagggcagcgagggcctgcctgagagccacagcggcaccccaggctacctgaccagccctgagctgcacaaggagctggtgcggctcttcaacgtgtacatcctgtggctggaggatgagaacttccagaagggggacacctacatccccagcctgcccaagcactatgacatccaccggctggccaaggtgatgcagaaccagcaggacctgtggatggagtacctgaacatggagcgcatctaccacgagttccaggagaccgtgggcctgtggacccaggccaagctggagagccacagcaccccctgcagcctgtctgtgcagctggacttcacagaccccctgctggccaaggagcgggtgctgagcaacctgaggaagcatgaggccccccagccccccctggccctgcaccccaccaagccccctgtgcctgtgatcagcagcgctgtgctgctgagccagaaggatgccacccagctggtgtgcacagacctgaacctgctgcagcagcaggccaggacagctgccctgcgggagagccagcaggtggccctggatggagagctgctggacaccatgcccaagcagtatgtgaaccgggaggagcagaccaccctgcacctggagtgccggggcagcagcggcaagaagtgccagggcgctgctgtggtgacagtgcagtttgagggcatgcacaagaatgaggccatcagccagcagctgcacgtgctgaggaaggaggtgaagcagctgcaggccgaggccgccaagccacccagcctgaacatcgtggaggccgctgtgcatgctgagaacctgatcacagccctggtgaatgcctacaagctgcagcccaccccaggcatccagaaggtgggcatcagcctcttcttcaccatcgtggactatgtgtctgatgagacccagaggcacccccccacccggcagttcttcaccagctgcatcgagatcctgggccaggtgttcatcagcggcatcaagtcagaatgtaggaaggtgctggagaccatcctgaagaacagccggctgtgcagcctgctgagccccttcttcaccccaaatgctgccccagctgagttcatccagctgtatgagcaggtggtgaagttcctgtctgaggacaacagcgacatgatcttcatgctgctgaccaagtttgacctgaagcagtggctgagcgccaccaagccacccctgagtgacaggacccggctgctggagagcatccacctggccctgacagcctggggcctggagccagatgaggacatcctgatgcccttcaacctcttctgcaagcactggacctacctgctgctgtaccagttcccagaccagtacagcgacatcctgcggctgctgatgcagagcagcgctgagcagctgctgagccctgagtgctggaaggccaccctgcgggccctgggctgctgtgcccccagctgccagcagggcgccgccagcacagaaggagctgtgctgcccagcagcagtgatgccctgctgagtgacaagcaggtgatggagaccatccagtggctgagtgacttcttctacaagctgcggctgagcaagatggacttcaagagctttggcctcttcagcaagtggagcccctacatggctgatgtgaagaccttcctgggctacctggtgaagaggctgattgacctggagatgacctgcctggcccaggaccccacagccagcaggaagacagtgctgaagagcctgcacagcgtcatcatccagctgttcaagccctggatcctggtgctggaggacaatgaaagcagccagcagaggcactacccctggctggagagtgacacagtggtggccagcagcatcgtgcagctgttcacagactgcatcgacagcctgcacgagagcttcaaggacaagctgctgcctggagatgctggggccctgtggctgcacctgatgcactactgtgaggcctgcacagcccccaagatgcctgagttcatcctgtatgccttccacagcacctacaggaagctgccctggaaggacctgcacccagaccagatgctgatggaggccttcttcaaggtggagcggggcagccccaagagctgcttcctgttcctgggctctgtgctgtgtgaggtgaactgggtgtctgtgctgagtgatgcctggaacagcagcccccaccctgagaccaggtccatgattgtgtgcctgctcttcatgatgatcctgctggccaaggaggtgcagctggtggaccagacagacagccccctgctgagcctgctgggccagaccagcagcctgtcctggcacctggtggacatcgtgtcctaccagagcgtgctgagctacttcagcagccactacccacccagcatcatcctggccaaggagagctatgcagagctgatcatgaagctgctgaaggtgtctgctggcctgagcatccccacagacagccagaagcacctggatgctgtgcccaagtgccaggccttcacccaccagatggtgcagttcctgagcaccctggagcagaatggcaagatcaccctggccgtgctggagcaggagatgagcaagctgctggatgacatcatcgtgttcaaccccccagacatggacagccagaccaggcacatggccctgagcagcctcttcatggaggtgctgatgatgatgaacaatgccaccatccccacagctgagttcctgcggggcagcatccgcacctggattggccagaagatgcacggcctggtggtgctgcccctgctgacagctgcctgccagagcctggcctctgtgcgccacatggccgagaccacagaggcctgcatcacagcctacttcaaggagagccccctgaaccagaacagcggctggggccccatcctggtgtccctgcaggtgcctgagctgaccatggaggagttcctgcaggagtgcctgaccctgggcagctacctgaccctgtatgtgtacctgctgcagtgcctgaacagcgagcagaccctgagaaatgagatgaaggtgctgctgatcctgagcaagtggctggagcaggtgtaccccagctctgtggaggaggaggccaagctgttcctgtggtggcaccaggtgctgcagctgagcctcatccagacagagcagaatgacagcgtgctgacagaatctgtcatccgcatcctgctgctggtgcagagccggcagaacctggtggccgaggagcggctgagcagcggcatcctgggcgccatcggctttggaaggaagagccccctgagcaacagatag

SEQ ID NO: 38162 - DNA, 1524 bp, Artificial Sequence
  Description of Artificial Sequence: Synthetic coding sequence
accacccctgtggagcggggcagccccaagagctgcttcctgttcctgggctctgtgctgtgtgaggtgaactgggtgtctgtgctgagtgatgcctggaacagcagcccccaccctgagaccaggtccatgattgtgtgcctgctcttcatgatgatcctgctggccaaggaggtgcagctggtggaccagacagacagccccctgctgagcctgctgggccagaccagcagcctgtcctggcacctggtggacatcgtgtcctaccagagcgtgctgagctacttcagcagccactacccacccagcatcatcctggccaaggagagctatgcagagctgatcatgaagctgctgaaggtgtctgctggcctgagcatccccacagacagccagaagcacctggatgctgtgcccaagtgccaggccttcacccaccagatggtgcagttcctgagcaccctggagcagaatggcaagatcaccctggccgtgctggagcaggagatgagcaagctgctggatgacatcatcgtgttcaaccccccagacatggacagccagaccaggcacatggccctgagcagcctcttcatggaggtgctgatgatgatgaacaatgccaccatccccacagctgagttcctgcggggcagcatccgcacctggattggccagaagatgcacggcctggtggtgctgcccctgctgacagctgcctgccagagcctggcctctgtgcgccacatggccgagaccacagaggcctgcatcacagcctacttcaaggagagccccctgaaccagaacagcggctggggccccatcctggtgtccctgcaggtgcctgagctgaccatggaggagttcctgcaggagtgcctgaccctgggcagctacctgaccctgtatgtgtacctgctgcagtgcctgaacagcgagcagaccctgagaaatgagatgaaggtgctgctgatcctgagcaagtggctggagcaggtgtaccccagctctgtggaggaggaggccaagctgttcctgtggtggcaccaggtgctgcagctgagcctcatccagacagagcagaatgattctgtgctgacagagagcgtcatccgcatcctgctgctggtgcagagccggcagaacctggtggccgaggagcggctgagcagcggcatcctgggcgccatcggcttcggcaggaagagccccctgagcaaccgcttccgggtggtggcccgctccatggccgccttcctgtctgtgcaggtgcccatggaggaccagatccggctgcggcccggcagcgagctgcacctgacccccaaggcccagcaggccctgaatgccctggagagcatggccagcagcaagcagtatgtggagtaccaggaccagatcctgcaggccacccagttcatccgccaccctggccactgcctgcaggacggcaagagcttcctggccctgctggtgaactgcctgtacccagaggtgcactacctggaccacatcagatag

SEQ ID NO: 38163 - DNA, 636 bp, Artificial Sequence
  Description of Artificial Sequence: Synthetic coding sequence
atgaacaggaagaagctgcagaagctgacagacaccctgaccaagaactgcaagcacttcaacaagtttgaggtgaactgcctgatcaagctgttctatgacctggtgggcggcgtggagcggcagggcctggtggtgggcctggacagaaatgccttcaggaacatcctgcacgtgaccttcggcatgacagatgacatgatcatggacagagtcttccggggctttgacaaggacaatgatggctgtgtgaatgtgctggagtggattcatggcctgagcctcttcctgcggggcagcctggaggagaagatgaagtactgctttgaggtgtttgacctgaatggagatggcttcatcagcaaggaggagatgttccacatgctgaagaacagcctgctgaagcagcccagcgaggaggaccctgatgagggcatcaaggacctggtggagatcaccctgaagaagatggaccatgaccatgatggcaagctgagctttgctgactatgagctggccgtgcgggaggagaccctgctgctggaggccttcggcccctgcctgcctgaccccaagagccagatggagtttgaggcccaggtgttcaaggaccccaatgagttcaatgacatgtag

SEQ ID NO: 38164 - DNA, 480 bp, Artificial Sequence
  Description of Artificial Sequence: Synthetic coding sequence
atgaacaggaagaagctgcagaagctgacagacaccctgaccaagaactgcaagcacctgttccggggctttgacaaggacaatgatggctgtgtgaatgtgctggagtggattcatggcctgagcctcttcctgcggggcagcctggaggagaagatgaagtactgctttgaggtgtttgacctgaatggagatggcttcatcagcaaggaggagatgttccacatgctgaagaacagcctgctgaagcagcccagcgaggaggaccctgatgagggcatcaaggacctggtggagatcaccctgaagaagatggaccatgaccatgatggcaagctgagctttgctgactatgagctggccgtgcgggaggagaccctgctgctggaggccttcggcccctgcctgcctgaccccaagagccagatggagtttgaggcccaggtgttcaaggaccccaatgagttcaatgacatgtag

SEQ ID NO: 38165 - DNA, 636 bp, Artificial Sequence; identical to SEQ ID NO: 38163
  Description of Artificial Sequence: Synthetic coding sequence

SEQ ID NO: 38166 - DNA, 390 bp, Artificial Sequence
  Description of Artificial Sequence: Synthetic coding sequence
tgagtgaatgtgctggagtggattcatggcctgagcctcttcctgcggggcagcctggaggagaagatgaagtactgctttgaggtgtttgacctgaatggagatggcttcatcagcaaggaggagatgttccacatgctgaagaacagcctgctgaagcagcccagcgaggaggaccctgatgagggcatcaaggacctggtggagatcaccctgaagaagatggaccatgaccatgatggcaagctgagctttgctgactatgagctggccgtgcgggaggagaccctgctgctggaggccttcggcccctgcctgcctgaccccaagagccagatggagtttgaggcccaggtgttcaaggaccccaatgagttcaatgacatgtag

SEQ ID NO: 38167 - DNA, 480 bp, Artificial Sequence; identical to SEQ ID NO: 38164
  Description of Artificial Sequence: Synthetic coding sequence

SEQ ID NO: 38168 - DNA, 384 bp, Artificial Sequence
  Description of Artificial Sequence: Synthetic coding sequence
atggagaccagcagccgggagctgcaggccgctgagtacctggagaagcaccagatcaaggaggtggtgtcctacctgaccagcgccctgctcttcttccggcctgagaagcccaaggagtacctgatcagcctgctggagcggctgagaattgccaaggtgactggagtggccttccccttcttcatggacaacagcaacatcgtggccatgtttgagatgatggacagcagcggccggggcaccatcagctttgtgcagtacaaggaggccctgaagaccctgggcctgtgcacagaagatgaggacctgcaggatgatggccacaagatcaccctggacaagttcaaggaggaggtgaacaagaggatgaaggagatctag

SEQ ID NO: 38169 - DNA, 450 bp, Artificial Sequence
  Description of Artificial Sequence: Synthetic coding sequence
atgagcagcatcaaccccaacaccagcggcatcctgctggagggcttcctgaacatcgtgaggaagaagaaggaggcccagcgctacagaaatgaggtgcgccacatcttcaccgcctttgacacctactaccggggcttcctgaccctggaggacttcaagaaggccttccggcaggtggcccccaagctgcctgagaggacagtgctggaggtgttccggggcctgcgcatcttcagcaagtgcctgctgtgccacatcgaccagaagagcaagaaccccagcagcggcctgctggccgctgacagcatcatccaggcccaccccagccctgtgcagatcctgcggcagatgtacatcaacaatgagctggagggccggggcttcatctgggacagcagcatctcctggaggttcatgtggaacatctacggcaccggggagtactag

SEQ ID NO: 38170 - DNA, 492 bp, Artificial Sequence
  Description of Artificial Sequence: Synthetic coding sequence
atgttcttcagcgaggcccgggcccggagcaggacctgggaggccagccccagcgagcacaggaagtgggtggaggtgttcaaggcctgtgatgaggaccacaagggctacctgagccgggaggacttcaagacagctgtggtgatgctgtttggctacaagcccagcaagattgaggtggacagcgtgatgagcagcatcaaccccaacaccagcggcatcctgctggagggcttcctgaacatcgtgaggaagaagaaggaggcccagcgctacagaaatgaggtgcgccacatcttcaccgcctttgacacctactaccggggcttcctgaccctggaggacttcaagaaggccttccggcaggtggcccccaagctgcctgagaggacagtgctggaggtgttccgggaggtggaccgggacagtgatggccacgtgtccttccgggactttgaatatgccctgaactacggccagaaggaggcctag

SEQ ID NO: 38171 - DNA, 420 bp, Artificial Sequence
  Description of Artificial Sequence: Synthetic coding sequence
atggtgttcaaggcctgtgatgaggaccacaagggctacctgagccgggaggacttcaagacagctgtggtgatgctgtttggctacaagcccagcaagattgaggtggacagcgtgatgagcagcatcaaccccaacaccagcggcatcctgctggagggcttcctgaacatcgtgaggaagaagaaggaggcccagcgctacagaaatgaggtgcgccacatcttcaccgcctttgacacctactaccggggcttcctgaccctggaggacttcaagaaggccttccggcaggtggcccccaagctgcctgagaggacagtgctggaggtgttccgggaggtggaccgggacagtgatggccacgtgtccttccgggactttgaatatgccctgaactacggccagaaggaggcctag

SEQ ID NO: 38172 - DNA, 357 bp, Artificial Sequence
  Description of Artificial Sequence: Synthetic coding sequence
atggtgttcaaggcctgtgatgaggaccacaagggctacctgagccgggaggacttcaagacagctgtggtgatgctgtttggctacaagcccagcaagattgaggtggacagcgtgatgagcagcatcaaccccaacaccagcggcatcctgctggagggcttcctgaacatcgtgaggaagaagaaggaggcccagcgctacagaaatgaggtgcgccacatcttcaccgcctttgacacctactaccggggcttcctgaccctggaggacttcaagaaggccttccggcaggtggcccccaagctgcctgagaggacagtgctggaggtgttccggggcatcttcagcgcctag

SEQ ID NO: 38173 - DNA, 2355 bp, Artificial Sequence
  Description of Artificial Sequence: Synthetic coding sequence
atggagaccaaggtgcacctgttctgccaggccgaggagaacatcgacctgctggatgatggcagcaacagctttgccacagacctgagcagcggcaccatcaaccacaagaagtacatcaagttcagcaagaccatcgagaaggagatcagccctgagatccgcagcctgagccctgagtacaagaagatctttgagaccagcatcatcttctgtggggaggagaagagcagtgacttctctggagagaagaaggtgggcaggaagagcctgcaggtgcagcagcacagcaagaggacagagatcatcccccccttcctgaagctgagcaaggagaaggtgaccaggaaggagaacagcctgtgcaagctgcccaaccagtacagcgtgcacaagaccagcagccccctgtgcaccagcagcgccatcacccgggagaaggagatgctgagcaacctgtacatgaccctgtatgatgaggtgacccacggctacctgcacagcaaggagctgagcggcaaccacatggtggacattggagacatcatcttcaccctgaatgagctgcaggagcagtatgaagatgtgtccatcacagagggcagccccctgaatgagatcaccagtgacaggaagctgagctctgtggccggctgctacctgaagtacaagaagaagaacagcctgagcagcaagctgcctgagcccagcatcagcaagaagctgaacaagaagagcaaccagtactacagcaagatcatggagaatgatgacctggagagcaagaggcccaagaacacctggcagatcaggaagttcctgggcggcgtgggcagcagcaatgtgggcgtgcaggagccctacagcaagaatggcatcaacttcaagaagcacagcgagaagggggagatccatgacagcaagagcaagccccagagcctgaagagcagcaccagcctgagcaagagcctggacaagagtgacatcagcagcatccccaagctgcagaagccagctgtgaggaagcacagcagcctgcagaagcaggtgagcagcacagagaagacagccatcagcaccctggagaacttctgtgaggccatcagcaagctgcaggagaactacatcgctgctgaggagctgcagagcatcctgcccagcacaggcatcaacctgctggatgaggagttccagaagatcgtgacagacaccagcagaaatgaaaatggcatggtggagctggatgactttgtgaatgccctggccaaggagaggagcttcccagaatgtaatgccctgcccggggtcatcaaggccatcgacaagatcaaggacaagaatgtggactatgaggacctgaacacctgcctgcagaactttggcatctacctgagcaagccagagttcaagaagatcacagagctgacagaggccggggagaccaagaaggtgaacttcaaggagttcatcgacaccatgatgagcaacacagagtgcttcagcgagaagctggtgctgcctgatgccatcgagaccctggatgacctgaggaaggagaccatgtctgtgtctgacctgtggaacaccctgagcagcctgaacagcaacctgaagaaggatgagttcctggccgccctggagctggtgacagtggatgaaggagacaaggtgcagtttgaggagtttgccaaggtggtgaggaacatgagagatgctgcccggctggaggagctgcaggaggtggtgctggccgctgacctgctggagggggacatgattgctgggaagaacctggaggacttcctgagaaatgtgggcatcaagagccccaaggaggaggtggagaagatcctgcagagcgactttgtgtctgaggacaacatggtgaacatcaaggactgcatgagggccctgcgggacacccagaagttcagcaactacatcgacttcaggaaggaggccagcaacctgaagctgcccaaggtgaatgagatcaaggaggccgccaacatcctgagccacgtggacaatggcaagattggcatcccagacctggagcacgccctgaagtgcctgaatgtgaacctgacagaggaggacttcaatgaggccctgaactgctgcaatgtgtctgacaacatggaggtggacctgaaggacttcctgatgaagatgaaggagagcccccacttccagaagagcaaggccacccagatcctgctggccaccacccagatcctgcagaatgacctggtggatgtgtctgacctgaagaccctgctgatggacaaggacctgcacacagccaatgccatcctgactgtgatgctgcggcacgtgcctgagcacggctag

SEQ ID NO: 38174 - DNA, 810 bp, Artificial Sequence
  Description of Artificial Sequence: Synthetic coding sequence
atgctgggccctggccaggtgcggctgcggccccgggtgtggagggacaaggccggcggccgggtggctgatggagccagcggcctgcccccagcccggggctcctggagggagactggaacaggccgggccctgggcgccagcagcccccccaggcctgcccagggcagcagcagccctggcatccagagcggccccagcagccggcccggcagccccagaggagctgagcaggccggcaccccccggccccggctgagcctgggcatcagccaggccaccggcagcgctgcccgctggaggaccaggagaacaggcaagggcctgggctacaacagtgatgagatccggcccaggaccctgctgattgagcacctgatggagggcggcagaagagaccaccacaccatgacagtgctgtggggcacccaggagatcatcgtggccgagttccacaagaagatcaaggaggcctttgaggtgtttgaccacgagagcaacaacacagtggatgtgcgggagatcggcaccatcatccgcagcctgggctgctgccccacagaaggagagctgcatgacctgattgctgaggtggaggaggaggagcccaccggctacatccgctttgagaagttcctgcctgtgatgacagagatcctgctggagaggaagtaccggcccatcccagaagatgtgctgctgcgggcctttgaggtgctggacagcgccaagaggggcttcctgaccaaggatgagctgatcaagtacatgacagaggaggatggagtgtccctgcggcggcccggctag

SEQ ID NO: 38175 - DNA, 489 bp, Artificial Sequence
  Description of Artificial Sequence: Synthetic coding sequence
atggctgatgagaaggaccgggaggagatcatcgtggccgagttccacaagaagatcaaggaggcctttgaggtgtttgaccacgagagcaacaacacagtggatgtgcgggagatcggcaccatcatccgcagcctgggctgctgccccacagaaggagagctgcatgacctgattgctgaggtggaggaggaggagcccaccggctacatccgctttgagaagttcctgcctgtgatgacagagatcctgctggagaggaagtaccggcccatcccagaagatgtgctgctgcgggcctttgaggtgctggacagcgccaagaggggcttcctgaccaaggatgagctgatcaagtacatgacagaggagggggagcccttcagccaggaggagatggaggagatgctgtctgctgccattgatcctgagagcaacagcatcaactacaaggactacatcaccatgatggtgattgatgaaaattag

SEQ ID NO: 38176 - DNA, 402 bp, Artificial Sequence
  Description of Artificial Sequence: Synthetic coding sequence
atggctgatgagaaggaccgggaggagatcatcgtggccgagttccacaagaagatcaaggaggcctttgaggtgtttgaccacgagagcaacaacacagtggatgtgcgggagatcggcaccatcatccgcagcctgggctgctgccccacagaaggagagctgcatgacctgattgctgaggtggaggaggaggagcccaccggctacatccgctttgagaagttcctgcctgtgatgacagagatcctgctggagaggaagtaccggcccatcccagaagatgtgctgctgcgggcctttgaggtgctggacagcgccaagaggggcttcctgaccaaggatgagctgatcaagtacatgacagaggaggatggagtgtccctgcggcggcccggctag

SEQ ID NO: 38177 - DNA, 1317 bp, Artificial Sequence
  Description of Artificial Sequence: Synthetic coding sequence
atggctgtgtctgagatcaagcccaagctgaagctgaaccccctgaccaaggtgcccatcagccacaacaagagggaccgggacctgcccggcagcctgcagtgccagctgcagcacaaggagaagaagctgagcgccagccagatggccgccttccaggatgcctacaacttcttctacaaggacaagacaggctgcatcgacttccacggcctgatgtgcaccgtggccaagctgggcatgaacctgaccaagcatgatgtgtacaatgagctgaagtgtgccgacatcgacagagatggcaaggtgaacttcagtgacttcatcaaggtgctgacagacaagaacctcttcctgaaggctgtggtgcctgagaaggagacctgcctggacctggccggcaaccctggcatcctgctgtttgagatcctgagccggctgctggagaccagcgccctgcccaggaagagcatcattgaaattgtgtcctacttccagaggaagttccagcacacaggccctggcatgctgtggagcccctacaccatgggctacggcaagaggaccctgaagccagacatctgcaccccacccagcagctccatggccgcctttgccaatgctgccagaattgccatcatgaaggagaaggacctcttcaagttcctggaggagctgaagcgctgcaacagcggcagtgacagcccctacagcaagatccccatcttccccctcttccccaacgtggatggagtggtgatgggcaagcccttcaaggacatgcagaagctggagatgctgcgcatcaaggagcccctgcacttctttgaggactacttcttccacaagagggactggaagacccaggccgccaacatcaagtccatggaccctgccagcggctacagcaacaacatcttcaccatcgaccagatgctgaagaagaagcagacctgcaccgtggctgatgccacagccatcaagcagcacgtgaagagggccacagacacctacaacctgggcatcgccctggagcacaggaaggagatgctgaacctgtggcagaagatccggggggacctgattggcatggacagcagaaatgaaagcttctatgacaccttcagcacctacacctggagctggaatgtgtgccaggagctgctgagccccaaggacctgcggctgtatgatgcctacgtgaacagaaacagcagccacaacagccgcagcagcagcagcagtgacaccagcgagtgctacacagacagcggcaggaagaggaagaggaagggcctgaagggcttccagcagtag

SEQ ID NO: 38178 - DNA, 489 bp, Artificial Sequence
  Description of Artificial Sequence: Synthetic coding sequence
atggctgtgtctgagatcaagcccaagctgaagctgaaccccctgaccaaggtgcccatcagccacaacaagagggaccgggacctgcccggcagcctgcagtgccagctgcagcacaaggagaagaagctgagcgccagccagatggccgccttccaggatgcctacaacttcttctacaaggacaagacaggctgcatcgacttccacggcctgatgtgcaccgtggccaagctgggcatgaacctgaccaagcatgatgtgtacaatgagctgaagtgtgccgacatcgacagagatggcaaggtgaacttcagtgacttcatcaaggtgctgacagacaagaacctcttcctgaaggctgtggtgcctgagaaggagacctgcctggacctggccggcaaccctggcatcctgctgtttgagatcctgagccggctgctggagaccagcgccctgcccaggaagagcatcattgaaattgtgtag

SEQ ID NO: 38179 - DNA, 525 bp, Artificial Sequence
  Description of Artificial Sequence: Synthetic coding sequence
atggctgtgtctgagatcaagcccaagctgaagctgaaccccctgaccaaggtgcccatcagccacaacaagagggaccgggacctgcccggcagcctgcagtgccagctgcagcacaaggagaagaagctgagcgccagccagatggccgccttccaggatgcctacaacttcttctacaaggacaagacaggctgcatcgacttccacggcctgatgtgcaccgtggccaagctgggcatgaacctgaccaagcatgatgtgtacaatgagctgaagtgtgccgacatcgacagagatggcaaggtgaacttcagtgacttcatcaaggtgctgacagacaagaacctcttcctgaaggctgtggtgcctgagaaggagacctgcctggacctggccggcaaccctggcatcctgctgtttgagatcctgagccggctgctggagaccagcgccctgcccaggaagagcatcattgaaattgtgtcctacttccagaggaagttccagcacacaggcccctag

SEQ ID NO: 38180 - DNA, 1473 bp, Artificial Sequence
  Description of Artificial Sequence: Synthetic coding sequence
atgaaggagctgatgccccacctgaccttcaatggaaatggcaagatcaacgtgaacagcatcatggagggcctgaagaagttcaagcccaagggcatggtgaccctgcacaagctgaagacagccaatgacatcaaggacagagtgacaggccacatggctgtgtctgagatcaagcccaagctgaagctgaaccccctgaccaaggtgcccatcagccacaacaagagggaccgggacctgcccggcagcctgcagtgccagctgcagcacaaggagaagaagctgagcgccagccagatggccgccttccaggatgcctacaacttcttctacaaggacaagacaggctgcatcgacttccacggcctgatgtgcaccgtggccaagctgggcatgaacctgaccaagcatgatgtgtacaatgagctgaagtgtgccgacatcgacagagatggcaaggtgaacttcagtgacttcatcaaggtgctgacagacaagaacctcttcctgaaggctgtggtgcctgagaaggagacctgcctggacctggccggcaaccctggcatcctgctgtttgagatcctgagccggctgctggagaccagcgccctgcccaggaagagcatcattgaaattgtgtcctacttccagaggaagttccagcacacaggccctggcatgctgtggagcccctacaccatgggctacggcaagaggaccctgaagccagacatctgcaccccacccagcagctccatggccgcctttgccaatgctgccagaattgccatcatgaaggagaaggacctcttcaagttcctggaggagctgaagcgctgcaacagcggcagtgacagcccctacagcaagatccccatcttccccctcttccccaacgtggatggagtggtgatgggcaagcccttcaaggacatgcagaagctggagatgctgcgcatcaaggagcccctgcacttctttgaggactacttcttccacaagagggactggaagacccaggccgccaacatcaagtccatggaccctgccagcggctacagcaacaacatcttcaccatcgaccagatgctgaagaagaagcagacctgcaccgtggctgatgccacagccatcaagcagcacgtgaagagggccacagacacctacaacctgggcatcgccctggagcacaggaaggagatgctgaacctgtggcagaagatccggggggacctgattggcatggacagcagaaatgaaagcttctatgacaccttcagcacctacacctggagctggaatgtgtgccaggagctgctgagccccaaggacctgcggctgtatgatgcctacgtgaacagaaacagcagccacaacagccgcagcagcagcagcagtgacaccagcgagtgctacacagacagcggcaggaagaggaagaggaagggcctgaagggcttccagcagtag

SEQ ID NO: 38181 - DNA, 4140 bp, Artificial Sequence
  Description of Artificial Sequence: Synthetic coding sequence
atgaatgaaagtgccagccaggaggagctgcggcctgcccaggagaacagaaaagaagacaaggagaggaagtggaacctgacagaggtgaaggagctgcacgagaccctgcagagcgtgcctgatgtgcctgtgaaggaggacaccaacagcgtggtggagaaggccatggatgagatcaagagccaggagctgaacctggagggccagaggaagatcagccctggcagcatcaaggacagcaagacagaggccagcggcaacatcgccatcaggaagagcgccaaggtgatctttgccctggatgaaacagagctgaagagcaagccagagcacacctggaagaagaacctgtttgagaggatggaggcccgggcccaggccatgcagcagaagatcatcgacaaggagaacctgaagaaggagctggagaagaaggccgagaagaagctgccccgggacaacctggccaaggagtggttcaacacagacagcatgaccctgaacaacacagcctacctgctggacaagctgctgcccaccctggtgcctggggtggagaacatgctgacccaggtggagaagaagaaggtgctgacagaggccgacacccccagcaagtttgaccccatcaactacctgggggagtacctgatccggaacaaccccaactacatcaaggaccccggcatgagcggctaccagaggctgatgaaggaggtgacagaggacctgaagatctacgtgcctgacaccatctgcaacagagtgtccaagatgaaggaaaatgtgaagcagaacaggaagcagcgggagagcattgacaagatcatcgtgaaggtggccaacaccaggaagcaggccctgcaggagcagtttgatgagtggatcctggaccccaagggcatgatccccaagagcgtcatccagaatgtgctgcaggagttcttccagaacccagacttcaagctgggcagccactgcaagcagctggacatcacagacagcacagagccccggctgaacaagatggagttcacagagtacatcagcagccacatcaaggacctgaagtctgagatgtttgaggagctgctgaagcacctgtgccacagcgcagatgagttccgggaggtgatcaaggctgacatgaggcggcagatgtttgctgagctgttcctgcactgtgaccacggcaaggtgggcttcctggaccggcagaggaccctggccctgctggagctgttctatgaccacagcagccagatgctgcggagcctgctgaggaacccccggcagtggcccttcattgaatttgaggagatcaacctgacagagctgtggggagacatggacaaccagaagcacatctatgagggctttgacaaggtgctgctggagatgaacaccctgctgagcgccaaccacgccagcaagacccagagcaagctgctggagagcccagaccagcccaagctgaatgagcagaggaccagcacccccagccccaaccccccagagcagcagaggggcgtgacagctgagcagggcccccagaggatcagcattgaggagcagcagcagggcaagaagcccacagctgagcaggagctgtacatcgagagcgtcatcgagcccggcacccacacagagagcaccctggagcagggcagcagccggcggctgctgacagagcaggagacccaccgggagagcaccacagagcagggccagcacaagggcagcattgagggccagggccccaggagagtgtctgtgtctgagcagggcagcagccgggagagcgtggccgagcagggcagcagaagagagagcattgctgagcaggacagacacaagggctctgtggccgagcagggcagcaggaggatgtctgctgctgagcagggcagcctgcgggagagcgtcatcgaggagccctaccagaagtctgagcagggcccctacggggagatcatcagcgaggagcaggaggacatcggcagcaccagccagagcaggaaggacagcatcctgaagagcaccaagtacggggagcccatcaccagcgagtacatcgaggtgcccctgcaggagaagaggtcctgggagcagacctatgaggaggagatcttcctgagcagcgagctgcaggaggaggtgcccaccctgagcaggaaggaccacttccctgagaccaccaagaaggaggtgcagaaggacaagccctgtgagcccaagagccagaagattgagggcaagtcctggagcggggagttcttcacctgcaactggaagatgaagtatgtgacctttgaagatgaggagcaggccaacctgatctacggcaacagccgcttcaccgccaagctgcacatccagttccccaagccccaccctggccacgaggtgcggctgagcagcaagcagttccagaactacatcgagctggtggtgtctgagctgcggggaaatgaagaccaggtgctggagagcgtggtggagttcctgatgaatgccctggagaggagccacatcgagagcctgaggaacagcgcccggaggaagtggctgcaccagatccagtgtgccgctgagaccagcggcgtgtccctggagcctgtgtacagcgagaccttcaaggccctgatgcaggatgctgaggcccacggcaacaagaagatcagcgcccacatcagcctgctggaggagaacctgctgctgcctgagaagggaaatgtgctgctgagaaatgtggcctgcaccctggatgatgcccagtttgtgctgaacagagtgctgtacagagacatgaagggcatctccttcaccgtggtggatgagggcaagcccatccacgtgccccaggtgcagtaccacggcaacatcttcttctggaaccagagcaggaacaagcatgactacaacggcagcttcctggccctgcccctgcaggatgcctacatgaggatcttcggcgtgctggccgtggacaccctgcgggacccccatgagatcaacatcttcctgccccatgagatccgcttctaccagggcgtggccaacgtgttcagcacagcctaccactacgtgcacagccgggagcacatcctgcacatcgtcatcactggaattggctggctgtatgatgtgaccagcagcatcaccagcatcaccacctactttgtggagcccagccctgcccaggacagcgactatgtgctgaggaacatgatggtgacaggccagctgggcctgacagagatccacaagaacccccccaccatccacaggaagagctgcatcttccgggacttcctgttcaagtgcacagacagcagcgaggtggtgctggccagcgcctgtggggagacccacatcgtggtgcccctgcgggagaggactggagaggccctgggcgtgctggacttcaacatcggccagaacaggatgctgctgtgccaggagtacaaggacctgcagaagatgatgaaggtggtgcaggtggcctgctatgagatcctgggggagttctctggagagatcaagaagaagtacatcctggagattgaaaatgtgcgggaggtgcagagagctggcatcctcttcttccgcatcatgctgctggagctgcaggagagcatccagctgctgaacagcatggagtttgtgtccctgctgctgtatgaccacaccctggtgacagagcccaacagcccccaggacagcaagtccatggagctggaggccaacgtgaagctggtgcgggacatcctgaaggctgtgatcctcttcttccaccctgagctggagttcagcagtgactttggctcctgggacaagtgcaagttctacgtgaacaagtacctggtgaacaacatctgtgcctttgaccccacagccaagcacgtggaggtgaatgtgcagctgattgatgagtacatccgggaccacagcaggacagaggtgtggaagtttggaaatgtggtgattgagcacctgtaccactggatccacatctgcagcgccctgatgaagatcaccaagcagctgaacagcggcatcaccccacccctgcccagcaagacagacaactacatgtatgccaagatgcctggagagggcctgcaggagaagtag

SEQ ID NO: 38182 - DNA, 2781 bp, Artificial Sequence
  Description of Artificial Sequence: Synthetic coding sequence
atgaatgaaagtgccagccaggaggagctgcggcctgcccaggagaacagaaaagaagacaaggagaggaagtggaacctgacagaggtgaaggagctgcacgagaccctgcagagcgtgcctgatgtgcctgtgaaggaggacaccaacagcgtggtggagaaggccatggatgagatcaagagccaggagctgaacctggagggccagaggaagatcagccctggcagcatcaaggacagcaagacagaggccagcggcaacatcgccatcaggaagagcgccaaggtgatctttgccctggatgaaacagagctgaagagcaagccagagcacacctggaagaagaacctgtttgagaggatggaggcccgggcccaggccatgcagcagaagatcatcgacaaggagaacctgaagaaggagctggagaagaaggccgagaagaagctgccccgggacaacctggccaaggagtggttcaacacagacagcatgaccctgaacaacacagcctacctgctggacaagctgctgcccaccctggtgcctggggtggagaacatgctgacccaggtggagaagaagaaggtgctgacagaggccgacacccccagcaagtttgaccccatcaactacctgggggagtacctgatccggaacaaccccaactacatcaaggaccccggcatgagcggctaccagaggctgatgaaggaggtgacagaggacctgaagatctacgtgcctgacaccatctgcaacagagtgtccaagatgaaggaaaatgtgaagcagaacaggaagcagcgggagagcattgacaagatcatcgtgaaggtggccaacaccaggaagcaggccctgcaggagcagtttgatgagtggatcctggaccccaagggcatgatccccaagagcgtcatccagaatgtgctgcaggagttcttccagaacccagacttcaagctgggcagccactgcaagcagctggacatcacagacagcacagagccccggctgaacaagatggagttcacagagtacatcagcagccacatcaaggacctgaagtctgagatgtttgaggagctgctgaagcacctgtgccacagcgcagatgagttccgggaggtgatcaaggctgacatgaggcggcagatgtttgctgagctgttcctgcactgtgaccacggcaaggtgggcttcctggaccggcagaggaccctggccctgctggagctgttctatgaccacagcagccagatgctgcggagcctgctgaggaacccccggcagtggcccttcattgaatttgaggagatcaacctgacagagctgtggggagacatggacaaccagaagcacatctatgagggctttgacaaggtgctgctggagatgaacaccctgctgagcgccaaccacgccagcaagacccagagcaagctgctggagagcccagaccagcccaagctgaatgagcagaggaccagcacccccagccccaaccccccagagcagcagaggggcgtgacagctgagcagggcccccagaggatcagcattgaggagcagcagcagggcaagaagcccacagctgagcaggagctgtacatcgagagcgtcatcgagcccggcacccacacagagagcaccctggagcagggcagcagccggcggctgctgacagagcaggagacccaccgggagagcaccacagagcagggccagcacaagggcagcattgagggccagggccccaggagagtgtctgtgtctgagcagggcagcagccgggagagcgtggccgagcagggcagcagaagagagagcattgctgagcaggacagacacaagggctctgtggccgagcagggcagcaggaggatgtctgctgctgagcagggcagcctgcgggagagcgtcatcgaggagccctaccagaagtctgagcagggcccctacggggagatcatcagcgaggagcaggaggacatcggcagcaccagccagagcaggaaggacagcatcctgaagagcaccaagtacggggagcccatcaccagcgagtacatcgaggtgcccctgcaggagaagaggtcctgggagcagacctatgaggaggagatcttcctgagcagcgagctgcaggaggaggtgcccaccctgagcaggaaggaccacttccctgagaccaccaagaaggaggtgcagaaggacaagccctgtgagcccaagagccagaagattgagggcaagtcctggagcggggagttcttcacctgcaactggaagatgaagtatgtgacctttgaagatgaggagcaggccaacctgatctacggcaacagccgcttcacagacctgcacagcatcatccggaacatccagagctgcaaggaggtgaagggccgcacagccttcaacggggtgtccttcaacctgctgcagtttgtgcagctgctggagacctttgtgggagaagatgcccccctgtctgtgtctgagaccctgaccagcttcttcaaggagggctacgtggagacagagcaggagaagatgaatgccctggagcagttcagccagaatgccttccaggtgcggcagaggctgctgctggaggccatcttccagaagtgggacagtgatggcagcggcttcctggacctgaaggaggtggatgagctgctgtacacctacaaggagggcatggagaaggagagcatgaagaagggcctgaccctgagccctggctggagcgctgtggcccagctgtag

SEQ ID NO: 38183 - DNA, 2928 bp, Artificial Sequence
  Description of Artificial Sequence: Synthetic coding sequence
atgaatgaaagtgccagccaggaggagctgcggcctgcccaggagaacagaaaagaagacaaggagaggaagtggaacctgacagaggtgaaggagctgcacgagaccctgcagagcgtgcctgatgtgcctgtgaaggaggacaccaacagcgtggtggagaaggccatggatgagatcaagagccaggagctgaacctggagggccagaggaagatcagccctggcagcatcaaggacagcaagacagaggccagcggcaacatcgccatcaggaagagcgccaaggtgatctttgccctggatgaaacagagctgaagagcaagccagagcacacctggaagaagaacctgtttgagaggatggaggcccgggcccaggccatgcagcagaagatcatcgacaaggagaacctgaagaaggagctggagaagaaggccgagaagaagctgccccgggacaacctggccaaggagtggttcaacacagacagcatgaccctgaacaacacagcctacctgctggacaagctgctgcccaccctggtgcctggggtggagaacatgctgacccaggtggagaagaagaaggtgctgacagaggccgacacccccagcaagtttgaccccatcaactacctgggggagtacctgatccggaacaaccccaactacatcaaggaccccggcatgagcggctaccagaggctgatgaaggaggtgacagaggacctgaagatctacgtgcctgacaccatctgcaacagagtgtccaagatgaaggaaaatgtgaagcagaacaggaagcagcgggagagcattgacaagatcatcgtgaaggtggccaacaccaggaagcaggccctgcaggagcagtttgatgagtggatcctggaccccaagggcatgatccccaagagcgtcatccagaatgtgctgcaggagttcttccagaacccagacttcaagctgggcagccactgcaagcagctggacatcacagacagcacagagccccggctgaacaagatggagttcacagagtacatcagcagccacatcaaggacctgaagtctgagatgtttgaggagctgctgaagcacctgtgccacagcgcagatgagttccgggaggtgatcaaggctgacatgaggcggcagatgtttgctgagctgttcctgcactgtgaccacggcaaggtgggcttcctggaccggcagaggaccctggccctgctggagctgttctatgaccacagcagccagatgctgcggagcctgctgaggaacccccggcagtggcccttcattgaatttgaggagatcaacctgacagagctgtggggagacatggacaaccagaagcacatctatgagggctttgacaaggtgctgctggagatgaacaccctgctgagcgccaaccacgccagcaagacccagagcaagctgctggagagcccagaccagcccaagctgaatgagcagaggaccagcacccccagccccaaccccccagagcagcagaggggcgtgacagctgagcagggcccccagaggatcagcattgaggagcagcagcagggcaagaagcccacagctgagcaggagctgtacatcgagagcgtcatcgagcccggcacccacacagagagcaccctggagcagggcagcagccggcggctgctgacagagcaggagacccaccgggagagcaccacagagcagggccagcacaagggcagcattgagggccagggccccaggagagtgtctgtgtctgagcagggcagcagccgggagagcgtggccgagcagggcagcagaagagagagcattgctgagcaggacagacacaagggctctgtggccgagcagggcagcaggaggatgtctgctgctgagcagggcagcctgcgggagagcgtcatcgaggagccctaccagaagtctgagcagggcccctacggggagatcatcagcgaggagcaggaggacatcggcagcaccagccagagcaggaaggacagcatcctgaagagcaccaagtacggggagcccatcaccagcgagtacatcgaggtgcccctgcaggagaagaggtcctgggagcagacctatgaggaggagatcttcctgagcagcgagctgcaggaggaggtgcccaccctgagcaggaaggaccacttccctgagaccaccaagaaggaggtgcagaaggacaagccctgtgagcccaagagccagaagattgagggcaagtcctggagcggggagttcttcacctgcaactggaagatgaagtatgtgacctttgaagatgaggagcaggccaacctgatctacggcaacagccgcttcacagacctgcacagcatcatccggaacatccagagctgcaaggaggtgaagggccgcacagccttcaacggggtgtccttcaacctgctgcagtttgtgcagctgctggagacctttgtgggagaagatgcccccctgtctgtgtctgagaccctgaccagcttcttcaaggagggctacgtggagacagagcaggagaagatgaatgccctggagcagttcagccagaatgccttccaggtgcggcagaggctgctgctggaggccatcttccagaagtgggacagtgatggcagcggcttcctggacctgaaggaggtggatgagctgctgtacacctacaaggagggcatggagaaggagagcatgaagaaggaccacagcaggacagaggtgtggaagtttggaaatgtggtgattgagcacctgtaccactggatccacatctgcagcgccctgatgaagatcaccaagcagctgaacagcggcatcaccccacccctgcccagcaagacagacaactacatgtatgccaagatgcctggagagggcctgcaggagaagtag

SEQ ID NO: 38184 - DNA, 4512 bp, Artificial Sequence
  Description of Artificial Sequence: Synthetic coding sequence
atgaatgaaagtgccagccaggaggagctgcggcctgcccaggagaacagaaaagaagacaaggagaggaagtggaacctgacagaggtgaaggagctgcacgagaccctgcagagcgtgcctgatgtgcctgtgaaggaggacaccaacagcgtggtggagaaggccatggatgagatcaagagccaggagctgaacctggagggccagaggaagatcagccctggcagcatcaaggacagcaagacagaggccagcggcaacatcgccatcaggaagagcgccaaggtgatctttgccctggatgaaacagagctgaagagcaagccagagcacacctggaagaagaacctgtttgagaggatggaggcccgggcccaggccatgcagcagaagatcatcgacaaggagaacctgaagaaggagctggagaagaaggccgagaagaagctgccccgggacaacctggccaaggagtggttcaacacagacagcatgaccctgaacaacacagcctacctgctggacaagctgctgcccaccctggtgcctggggtggagaacatgctgacccaggtggagaagaagaaggtgctgacagaggccgacacccccagcaagtttgaccccatcaactacctgggggagtacctgatccggaacaaccccaactacatcaaggaccccggcatgagcggctaccagaggctgatgaaggaggtgacagaggacctgaagatctacgtgcctgacaccatctgcaacagagtgtccaagatgaaggaaaatgtgaagcagaacaggaagcagcgggagagcattgacaagatcatcgtgaaggtggccaacaccaggaagcaggccctgcaggagcagtttgatgagtggatcctggaccccaagggcatgatccccaagagcgtcatccagaatgtgctgcaggagttcttccagaacccagacttcaagctgggcagccactgcaagcagctggacatcacagacagcacagagccccggctgaacaagatggagttcacagagtacatcagcagccacatcaaggacctgaagtctgagatgtttgaggagctgctgaagcacctgtgccacagcgcagatgagttccgggaggtgatcaaggctgacatgaggcggcagatgtttgctgagctgttcctgcactgtgaccacggcaaggtgggcttcctggaccggcagaggaccctggccctgctggagctgttctatgaccacagcagccagatgctgcggagcctgctgaggaacccccggcagtggcccttcattgaatttgaggagatcaacctgacagagctgtggggagacatggacaaccagaagcacatctatgagggctttgacaaggtgctgctggagatgaacaccctgctgagcgccaaccacgccagcaagacccagagcaagctgctggagagcccagaccagcccaagctgaatgagcagaggaccagcacccccagccccaaccccccagagcagcagaggggcgtgacagctgagcagggcccccagaggatcagcattgaggagcagcagcagggcaagaagcccacagctgagcaggagctgtacatcgagagcgtcatcgagcccggcacccacacagagagcaccctggagcagggcagcagccggcggctgctgacagagcaggagacccaccgggagagcaccacagagcagggccagcacaagggcagcattgagggccagggccccaggagagtgtctgtgtctgagcagggcagcagccgggagagcgtggccgagcagggcagcagaagagagagcattgctgagcaggacagacacaagggctctgtggccgagcagggcagcaggaggatgtctgctgctgagcagggcagcctgcgggagagcgtcatcgaggagccctaccagaagtctgagcagggcccctacggggagatcatcagcgaggagcaggaggacatcggcagcaccagccagagcaggaaggacagcatcctgaagagcaccaagtacggggagcccatcaccagcgagtacatcgaggtgcccctgcaggagaagaggtcctgggagcagacctatgaggaggagatcttcctgagcagcgagctgcaggaggaggtgcccaccctgagcaggaaggaccacttccctgagaccaccaagaaggaggtgcagaaggacaagccctgtgagcccaagagccagaagattgagggcaagtcctggagcggggagttcttcacctgcaactggaagatgaagtatgtgacctttgaagatgaggagcaggccaacctgatctacggcaacagccgcttcacagacctgcacagcatcatccggaacatccagagctgcaaggaggtgaagggccgcacagccttcaacggggtgtccttcaacctgctgcagtttgtgcagctgctggagacctttgtgggagaagatgcccccctgtctgtgtctgagaccctgaccagcttcttcaaggagggctacgtggagacagagcaggagaagatgaatgccctggagcagttcagccagaatgccttccaggtgcggcagaggctgctgctggaggccatcttccagaagtgggacagtgatggcagcggcttcctggacctgaaggaggtggatgagctgctgtacacctacaaggagggcatggagaaggagagcatgaagaaggccaagctgcacatccagttccccaagccccaccctggccacgaggtgcggctgagcagcaagcagttccagaactacatcgagctggtggtgtctgagctgcggggaaatgaagaccaggtgctggagagcgtggtggagttcctgatgaatgccctggagaggagccacatcgagagcctgaggaacagcgcccggaggaagtggctgcaccagatccagtgtgccgctgagaccagcggcgtgtccctggagcctgtgtacagcgagaccttcaaggccctgatgcaggatgctgaggcccacggcaacaagaagatcagcgcccacatcagcctgctggaggagaacctgctgctgcctgagaagggaaatgtgctgctgagaaatgtggcctgcaccctggatgatgcccagtttgtgctgaacagagtgctgtacagagacatgaagggcatctccttcaccgtggtggatgagggcaagcccatccacgtgccccaggtgcagtaccacggcaacatcttcttctggaaccagagcaggaacaagcatgactacaacggcagcttcctggccctgcccctgcaggatgcctacatgaggatcttcggcgtgctggccgtggacaccctgcgggacccccatgagatcaacatcttcctgccccatgagatccgcttctaccagggcgtggccaacgtgttcagcacagcctaccactacgtgcacagccgggagcacatcctgcacatcgtcatcactggaattggctggctgtatgatgtgaccagcagcatcaccagcatcaccacctactttgtggagcccagccctgcccaggacagcgactatgtgctgaggaacatgatggtgacaggccagctgggcctgacagagatccacaagaacccccccaccatccacaggaagagctgcatcttccgggacttcctgttcaagtgcacagacagcagcgaggtggtgctggccagcgcctgtggggagacccacatcgtggtgcccctgcgggagaggactggagaggccctgggcgtgctggacttcaacatcggccagaacaggatgctgctgtgccaggagtacaaggacctgcagaagatgatgaaggtggtgcaggtggcctgctatgagatcctgggggagttctctggagagatcaagaagaagtacatcctggagattgaaaatgtgcgggaggtgcagagagctggcatcctcttcttccgcatcatgctgctggagctgcaggagagcatccagctgctgaacagcatggagtttgtgtccctgctgctgtatgaccacaccctggtgacagagcccaacagcccccaggacagcaagtccatggagctggaggccaacgtgaagctggtgcgggacatcctgaaggctgtgatcctcttcttccaccctgagctggagttcagcagtgactttggctcctgggacaagtgcaagttctacgtgaacaagtacctggtgaacaacatctgtgcctttgaccccacagccaagcacgtggaggtgaatgtgcagctgattgatgagtacatccgggaccacagcaggacagaggtgtggaagtttggaaatgtggtgattgagcacctgtaccactggatccacatctgcagcgccctgatgaagatcaccaagcagctgaacagcggcatcaccccacccctgcccagcaagacagacaactacatgtatgccaagatgcctggagagggcctgcaggagaagtag

SEQ ID NO: 38185 - DNA, 2571 bp, Artificial Sequence
  Description of Artificial Sequence: Synthetic coding sequence
ctgggccagatgaagtgcaaggagctgaacctggagggccagaggaagatcagccctggcagcatcaaggacagcaagacagaggccagcggcaacatcgccatcaggaagagcgccaaggtgatctttgccctggatgaaacagagctgaagagcaagccagagcacacctggaagaagaacctgtttgagaggatggaggcccgggcccaggccatgcagcagaagatcatcgacaaggagaacctgaagaaggagctggagaagaaggccgagaagaagctgccccgggacaacctggccaaggagtggttcaacacagacagcatgaccctgaacaacacagcctacctgctggacaagctgctgcccaccctggtgcctggggtggagaacatgctgacccaggtggagaagaagaaggtgctgacagaggccgacacccccagcaagtttgaccccatcaactacctgggggagtacctgatccggaacaaccccaactacatcaaggaccccggcatgagcggctaccagaggctgatgaaggaggtgacagaggacctgaagatctacgtgcctgacaccatctgcaacagagtgtccaagatgaaggaaaatgtgaagcagaacaggaagcagcgggagagcattgacaagatcatcgtgaaggtggccaacaccaggaagcaggccctgcaggagcagtttgatgagtggatcctggaccccaagggcatgatccccaagagcgtcatccagaatgtgctgcaggagttcttccagaacccagacttcaagctgggcagccactgcaagcagctggacatcacagacagcacagagccccggctgaacaagatggagttcacagagtacatcagcagccacatcaaggacctgaagtctgagatgtttgaggagctgctgaagcacctgtgccacagcgcagatgagttccgggaggtgatcaaggctgacatgaggcggcagatgtttgctgagctgttcctgcactgtgaccacggcaaggtgggcttcctggaccggcagaggaccctggccctgctggagctgttctatgaccacagcagccagatgctgcggagcctgctgaggaacccccggcagtggcccttcattgaatttgaggagatcaacctgacagagctgtggggagacatggacaaccagaagcacatctatgagggctttgacaaggtgctgctggagatgaacaccctgctgagcgccaaccacgccagcaagacccagagcaagctgctggagagcccagaccagcccaagctgaatgagcagaggaccagcacccccagccccaaccccccagagcagcagaggggcgtgacagctgagcagggcccccagaggatcagcattgaggagcagcagcagggcaagaagcccacagctgagcaggagctgtacatcgagagcgtcatcgagcccggcacccacacagagagcaccctggagcagggcagcagccggcggctgctgacagagcaggagacccaccgggagagcaccacagagcagggccagcacaagggcagcattgagggccagggccccaggagagtgtctgtgtctgagcagggcagcagccgggagagcgtggccgagcagggcagcagaagagagagcattgctgagcaggacagacacaagggctctgtggccgagcagggcagcaggaggatgtctgctgctgagcagggcagcctgcgggagagcgtcatcgaggagccctaccagaagtctgagcagggcccctacggggagatcatcagcgaggagcaggaggacatcggcagcaccagccagagcaggaaggacagcatcctgaagagcaccaagtacggggagcccatcaccagcgagtacatcgaggtgcccctgcaggagaagaggtcctgggagcagacctatgaggaggagatcttcctgagcagcgagctgcaggaggaggtgcccaccctgagcaggaaggaccacttccctgagaccaccaagaaggaggtgcagaaggacaagccctgtgagcccaagagccagaagattgagggcaagtcctggagcggggagttcttcacctgcaactggaagatgaagtatgtgacctttgaagatgaggagcaggccaacctgatctacggcaacagccgcttcacagacctgcacagcatcatccggaacatccagagctgcaaggaggtgaagggccgcacagccttcaacggggtgtccttcaacctgctgcagtttgtgcagctgctggagacctttgtgggagaagatgcccccctgtctgtgtctgagaccctgaccagcttcttcaaggagggctacgtggagacagagcaggagaagatgaatgccctggagcaggtgtccctgtgccggcaggccggcgtgcagtggaggaactgcagcagcctgcagccccccaccccaggcctgaagaggagcagccaccaccggctgctgagcaactgggactaccgggagaggaggaagttcttccccctggagaccaagttcccctag

SEQ ID NO: 38186 - DNA, 1527 bp, Artificial Sequence
  Description of Artificial Sequence: Synthetic coding sequence
atgaaggaaaatgtgaagcagaacaggaagcagcgggagagcattgacaagatcatcgtgaaggtggccaacaccaggaagcaggccctgcaggagcagtttgatgagtggatcctggaccccaagggcatgatccccaagtctgtgctgcagatccagaatgtgctgcaggagttcttccagaacccagacttcaagctgggcagccactgcaagcagctggacatcacagacagcacagagccccggctgaacaagatggagttcacagagtacatcagcagccacatcaaggacctgaagtctgagatgtttgaggagctgctgaagcacctgtgccacagcgcagatgagttccgggaggtgatcaaggctgacatgaggcggcagatgtttgctgagctgttcctgcactgtgaccacggcaaggtgggcttcctggaccggcagaggaccctggccctgctggagctgttctatgaccacagcagccagatgctgcggagcctgctgaggaacccccggcagtggcccttcatcgagtttgaggagatcaacctgacagagctgtggggagacatggacaaccagaagcacatctatgagggctttgacaaggtgctgctggagatgaacaccctgctgagcgccaaccacgccagcaagacccagagcaagctgctggagagcccagaccagcccaagctgaatgagcagaggaccagcacccccagccccaaccccccagagcagcagaggggcgtgacagctgagcagggcccccagaggatcagcattgaggagcagcagcagggcaagaagcccacagctgagcaggagctgtacattgaatctgtgattgagcccggcacccacacagagagcaccctggagcagggcagcagccggcggctgctgacagagcaggagacccaccgggagagcaccacagagcagggccagcacaagggcagcattgagggccagggcccccggcgggtgtctgtgtctgagcagggcagcagccgggagagcgtggccgagcagggcagccggcgggagagcattgctgagcaggacagacacaagggctctgtggccgagcagggcagcaggaggatgtctgctgctgagcagggcagcctgcgggagagcgtgattgaggagccctaccagaagtctgagcagggcccctatggagagatcatcagcgaggagcaggaggacatcggcagcaccagccagagcaggaaggacagcatcctgaagagcaccaagtatggagagcccatcaccagcgagtacatcgaggtgcccctgcaggagaagaggtcctgggagcagacctatgaggaggagatcttcctgagcagcgagctgcaggaggaggtgcccaccctgagcaggaaggaccacttccctgagaccaccaagaaggaggtgcagaaggacaagccctgtgagcccaagagccagaagattgagggcaagtcctggagcggggagttcttcacctgcaactggtag

SEQ ID NO: 38187 - DNA, 2571 bp, Artificial Sequence
  Description of Artificial Sequence: Synthetic coding sequence
atggatgagatcaagagccaggagctgaacctggagggccagaggaagatcagccctggcagcatcaaggacagcaagacagaggccagcggcaacatcgccatcaggaagagcgccaaggtgatctttgccctggatgaaacagagctgaagagcaagccagagcacacctggaagaagaacctgtttgagaggatggaggcccgggcccaggccatgcagcagaagatcatcgacaaggagaacctgaagaaggagctggagaagaaggccgagaagaagctgccccgggacaacctggccaaggagtggttcaacacagacagcatgaccctgaacaacacagcctacctgctggacaagctgctgcccaccctggtgcctggggtggagaacatgctgacccaggtggagaagaagaaggtgctgacagaggccgacacccccagcaagtttgaccccatcaactacctgggggagtacctgatccggaacaaccccaactacatcaaggaccccggcatgagcggctaccagaggctgatgaaggaggtgacagaggacctgaagatctacgtgcctgacaccatctgcaacagagtgtccaagatgaaggaaaatgtgaagcagaacaggaagcagcgggagagcattgacaagatcatcgtgaaggtggccaacaccaggaagcaggccctgcaggagcagtttgatgagtggatcctggaccccaagggcatgatccccaagagcgtcatccagaatgtgctgcaggagttcttccagaacccagacttcaagctgggcagccactgcaagcagctggacatcacagacagcacagagccccggctgaacaagatggagttcacagagtacatcagcagccacatcaaggacctgaagtctgagatgtttgaggagctgctgaagcacctgtgccacagcgcagatgagttccgggaggtgatcaaggctgacatgaggcggcagatgtttgctgagctgttcctgcactgtgaccacggcaaggtgggcttcctggaccggcagaggaccctggccctgctggagctgttctatgaccacagcagccagatgctgcggagcctgctgaggaacccccggcagtggcccttcattgaatttgaggagatcaacctgacagagctgtggggagacatggacaaccagaagcacatctatgagggctttgacaaggtgctgctggagatgaacaccctgctgagcgccaaccacgccagcaagacccagagcaagctgctggagagcccagaccagcccaagctgaatgagcagaggaccagcacccccagccccaaccccccagagcagcagaggggcgtgacagctgagcagggcccccagaggatcagcattgaggagcagcagcagggcaagaagcccacagctgagcaggagctgtacatcgagagcgtcatcgagcccggcacccacacagagagcaccctggagcagggcagcagccggcggctgctgacagagcaggagacccaccgggagagcaccacagagcagggccagcacaagggcagcattgagggccagggccccaggagagtgtctgtgtctgagcagggcagcagccgggagagcgtggccgagcagggcagcagaagagagagcattgctgagcaggacagacacaagggctctgtggccgagcagggcagcaggaggatgtctgctgctgagcagggcagcctgcgggagagcgtcatcgaggagccctaccagaagtctgagcagggcccctacggggagatcatcagcgaggagcaggaggacatcggcagcaccagccagagcaggaaggacagcatcctgaagagcaccaagtacggggagcccatcaccagcgagtacatcgaggtgcccctgcaggagaagaggtcctgggagcagacctatgaggaggagatcttcctgagcagcgagctgcaggaggaggtgcccaccctgagcaggaaggaccacttccctgagaccaccaagaaggaggtgcagaaggacaagccctgtgagcccaagagccagaagattgagggcaagtcctggagcggggagttcttcacctgcaactggaagatgaagtatgtgacctttgaagatgaggagcaggccaacctgatctacggcaacagccgcttcacagacctgcacagcatcatccggaacatccagagctgcaaggaggtgaagggccgcacagccttcaacggggtgtccttcaacctgctgcagtttgtgcagctgctggagacctttgtgggagaagatgcccccctgtctgtgtctgagaccctgaccagcttcttcaaggagggctacgtggagacagagcaggagaagatgaatgccctggagcaggtgtccctgtgccggcaggccggcgtgcagtggaggaactgcagcagcctgcagccccccaccccaggcctgaagaggagcagccaccaccggctgctgagcaactgggactaccgggagaggaggaagttcttccccctggagaccaagttcccctag

SEQ ID NO: 38188 - DNA, 1710 bp, Artificial Sequence
  Description of Artificial Sequence: Synthetic coding sequence
atggagttcacagagtacatcagcagccacatcaaggacctgaagtctgagatgtttgaggagctgctgaagcacctgtgccacagcgcagatgagttccgggaggtgatcaaggctgacatgaggcggcagatgtttgctgagctgttcctgcactgtgaccacggcaaggtgggcttcctggaccggcagaggaccctggccctgctggagctgttctatgaccacagcagccagatgctgcggagcctgctgaggaacccccggcagtggcccttcatcgagtttgaggagatcaacctgacagagctgtggggagacatggacaaccagaagcacatctatgagggctttgacaaggtgctgctggagatgaacaccctgctgagcgccaaccacgccagcaagacccagagcaagctgctggagagcccagaccagcccaagctgaatgagcagaggaccagcacccccagccccaaccccccagagcagcagaggggcgtgacagctgagcagggcccccagaggatcagcattgaggagcagcagcagggcaagaagcccacagctgagcaggagctgtacattgaatctgtgattgagcccggcacccacacagagagcaccctggagcagggcagcagccggcggctgctgacagagcaggagacccaccgggagagcaccacagagcagggccagcacaagggcagcattgagggccagggcccccggcgggtgtctgtgtctgagcagggcagcagccgggagagcgtggccgagcagggcagccggcgggagagcattgctgagcaggacagacacaagggctctgtggccgagcagggcagcaggaggatgtctgctgctgagcagggcagcctgcgggagagcgtgattgaggagccctaccagaagtctgagcagggcccctatggagagatcatcagcgaggagcaggaggacatcggcagcaccagccagagcaggaaggacagcatcctgaagagcaccaagtatggagagcccatcaccagcgagtacatcgaggtgcccctgcaggagaagaggtcctgggagcagacctatgaggaggagatcttcctgagcagcgagctgcaggaggaggtgcccaccctgagcaggaaggaccacttccctgagaccaccaagaaggaggtgcagaaggacaagccctgtgagcccaagagccagaagattgagggcaagtcctggagcggggagttcttcacctgcaactggaagatgaagtatgtgacctttgaagatgaggagcaggccaacctgatctacggcaacagccgcttcacagacctgcacagcatcatccggaacatccagagctgcaaggaggtgaagggccgcacagccttcaatggagtgtccttcaacctgctgcagtttgtgcagctgctggagacctttgtgggggaggatgcccccctgtctgtgtctgagaccctgaccagcttcttcaaggagggctacgtggagacagagcaggagaagatgaatgccctggagcaggtgtccctgtgccggcaggccggcgtgcagtggaggaactgcagcagcctgcagccccccaccccaggcctgaagaggagcagccaccaccggctgctgagcaactgggactaccgggagaggaggaagttcttccccctggagaccaagttcccctag

SEQ ID NO: 38189 - DNA, 1890 bp, Artificial Sequence
  Description of Artificial Sequence: Synthetic coding sequence
atggccatcagccccaggagtgatgccaccttcagcagccagaagagcaccccatctgagagccccaggaccaagaagttccccctgacagaggaggagatcttctacatgaactgcagagctgcctacctgactgtgttcaagagcagcctggagaacatcatcagcaaggaccagctgtacctggccctgcagcacgccggcaggaaccccagccagaagaccatcaacaagtactggaccccccagacagccaagctgaactttgatgacttctgcatcatcctgaggaaggagaagcccaccagcaaggccgagctgctgaagagcttcaagcagctggatgtgaatgatgatggctgcatcctgcacacagacctgtacaagttcctgaccaagagaggagagaagatgacccgggaggaggtgaatgccatcatcaacctggctgatgtgaatgctgatggcaagtttgactacatcaagttctgcaagctgtacatgaccaccaatgagcagtgcctgaagaccaccctggagaagctggaggtggacagcaagctgatgaggcaccagtttggaaaccacatcgagggcagccctgagcgggaccccagccctgtgcccaagcccagccccaagatcaccaggaagacagatcctgagaccttcctgaacaagggggacaccaggagcagcctgctgagcgccaccaggaagttcaagacctctgtgtccttcaccgtgaccatgggcgccaacggcaacagaaacagcaagctgatggagcccaacctgatcaaggactggcagcacatgcagagcaagggctgcttcttcctggaggaggatggagagatcatcagccaccagtacaggatgcagatcgcccagaggtccatggtgtacctgaccatcaagcccctgaacctgagccaggtggagggcaagcccagcccctggctgtctgtggacacagccctgtacatcctgaaggaaaatgaaagccaggccaacctgcagctggtgtgcttcacagagctgaggaaccgggaggtgtttggctggacaggagagctgggccctggcatctactggctgatccccagcaccaccggctgccgcctgaggaagaagatcaagcctgtgacagatgaggcccagctggtgtacagagatgaaacaggagagctgttcctgaccaaggagttcaagagcaccctgagtgacatctttgaggtgattgacctggatggaaatggcctgctgagcctggaggagtacaacttctttgagctgcggaccagcggggagaagtgtgatgaagatgcctgggccgtgtgccgggagaactttgacaccaagagaaatgagctgacccggcagggcttcatggacctgaacctgatggaggccaatgaccgggagggggacccctgtgacctgtgggtgaccctgcacagcatgggctacaacaaggccctggagctgacagaggcctgcccctttgtgattgacatctatgcagagaagtgcaagcccaagatcaaggctgtgcacatggaggcctgcagcggccagctggagaaggccatctgcaagtctgtgctgagcaatggagatgccaaggtgatggatggctatgagaacatcatcgtgcacacctacagctgtgacacctggatcacctctgtgattgagaacaagagtgatgagaaggtgatcatccacatcagcaatgagctgagcaagaactgcatcaacaacagaggcctgaacatctttgctgtggaggtgggccccaagagcaccatggtgtgccagcacgtgatgcccctgaatgaaaggcaggagtggatctactactgcatctacagcctcatctcctag

SEQ ID NO: 38190 - DNA, 594 bp, Artificial Sequence
  Description of Artificial Sequence: Synthetic coding sequence
atgaggctgaagcagggcagcttcctgtggtacctgtacctggacaagatctactgcctgctgtctgtgagaaatgtgaaggccctggccgagtacttccacatcctggatgtgcacggcaagaacaccctgaatgatgtgctcttctaccacttcctgcaccacgtgacagacctgaagaaggcccagatcaacatcgtgtttgacatgctggactggaatgctgtgggggagattgactttgagaagttctacatgctggtgtgcatgctgctggcccaccagaaccacctggagggccagttcatgtaccgccacagcaggcctgtgtttgacctgctggacctgaagggggacctgcgcatcggggccaagaactttgagatgtaccgcttcctgttcaacatccagaagcaggagctgaaggacctcttccgggactttgacatcactggagacaaccggctgaactaccaggagttcaagctgtacaccatcatctacacagacaagctgcagaagaggcagaagacagaggagaaggagaagggggagaggaagaggagcctgtacagcaagtgccacatcaagtag

SEQ ID NO: 38191 - DNA, 2454 bp, Artificial Sequence
  Description of Artificial Sequence: Synthetic coding sequence
atgtatggagtgtgtggctgctgcggggccctgcggccccgctacaagaggctggtggacaacatcttcccagaagatcctgaagatggcctggtgaagaccaacatggagaagctgaccttctacgccctgagcgcccctgagaagctggacagaattggagcctacctgtctgagcggctcatcagagatgtgggccgccacagatatggctacgtgtgcatcgccatggaggccctggaccagctgctgatggcctgccactgccagagcatcaacctgtttgtggagagcttcctgaagatggtggccaagctgctggagagcgagaagcccaacctgcagatcctgggcaccaacagctttgtgaagtttgccaacatcgaggaggacacccccagctaccacaggagctatgacttctttgtgagccgcttcagcgagatgtgccacagcagccatgatgacctggagatcaagaccaagatccgcatgagcggcatcaagggcctgcagggcgtggtgaggaagacagtgaatgatgagctgcaggccaacatctgggacccccagcacatggacaagatcgtgcccagcctgctcttcaacctgcagcacgtggaggaggccgagagccgcagccccagccccctgcaggcccctgagaaggagaaggagagccctgctgagctggccgagcgctgcctgcgggagctgctgggccgggccgcctttggaaacatcaagaatgccatcaagcctgtgctgatccacctggacaaccacagcctgtgggagcccaaggtgtttgccatccgctgcttcaagatcatcatgtacagcatccagccccagcacagccacctggtgatccagcagctgctgggccacctggatgccaacagccgctctgctgccaccgtgcgggccggcatcgtggaggtgctgtctgaggccgctgtgattgctgccactggatctgtgggccccaccgtgctggagatgttcaacaccctgctgcggcagctgcggctgagcattgattatgccctgaccggcagctatgatggagctgtgtccctgggcaccaagatcatcaaggagcacgaggagaggatgttccaggaggccgtcatcaagacagtgggcagctttgccagcaccctgcccacctaccagaggtctgaggtgatcctcttcatcatgagcaaggtgccccggcccagcctgcaccaggccgtggacaccggccgcactggagaaaatagaaaccggctgacccagatcatgctgctgaagagcctgctgcaggtgtccacaggcttccagtgcaacaacatgatgtctgccctgcccagcaacttcctggaccggctgctgagcacagccctgatggaggatgctgagatccggctgtttgtgctggagatcctgatctccttcatcgacagacatggcaacagacacaagttcagcaccatcagcaccctgagtgacatctctgtgctgaagctgaaggtggacaagtgcagccggcaggacacagtgttcatgaagaagcacagccagcagctgtaccgccacatctacctgagctgcaaggaggagaccaacgtgcagaagcactatgaggccctgtatggcctgctggccctgatcagcattgagctggccaatgaggaggtggtggtggacctgatccggctggtgctggccgtgcaggatgtggcccaggtgaatgaggagaacctgcctgtgtacaacagatgtgccctgtatgccctgggcgccgcctacctgaacctgatcagccagctgaccaccgtgcctgccttctgccagcacatccatgaagtcatcgagaccaggaagaaggaggccccctacatgctgcctgaagatgtgtttgtggagcggccccggctgagccagaacctggatggagtggtgattgagctgctcttccggcagagcaagatcagcgaggtgctgggcggcagcggctacaacagcgaccggctgtgcctgccctacatcccccagctgacagatgaagatcggctgagcaagagaagaagcatcggggagaccatcagcctgcaggtggaggtggagagcaggaacagccctgagaaggaggagcgggtgcctgctgaggagatcacctatgagaccctgaagaaggccatcgtggacagcgtggccgtggaggagcaggagcgggagcggcggcggcaggtggtggagaagttccagaaggccccctttgaggagattgctgcccactgtggggcccgggccagcctgctgcagagcaagctgaaccagatctttgagatcaccatccggcccccacccagccccagcggcaccatcacagctgcctacggccagccccagaaccacagcatccctgtgtatgagatgaagttcccagacctgtgtgtgtactag

SEQ ID NO: 38192 - DNA, 2349 bp, Artificial Sequence
  Description of Artificial Sequence: Synthetic coding sequence
atggagaagctgaccttctacgccctgagcgcccctgagaagctggaccgcatcggggcctacctgtctgagcggctcatcagagatgtgggccgccacagatatggctacgtgtgcatcgccatggaggccctggaccagctgctgatggcctgccactgccagagcatcaacctgtttgtggagagcttcctgaagatggtggccaagctgctggagagcgagaagcccaacctgcagatcctgggcaccaacagctttgtgaagtttgccaacatcgaggaggacacccccagctaccacaggagctatgacttctttgtgagccgcttcagcgagatgtgccacagcagccatgatgacctggagatcaagaccaagatccgcatgagcggcatcaagggcctgcagggcgtggtgaggaagacagtgaatgatgagctgcaggccaacatctgggacccccagcacatggacaagatcgtgcccagcctgctcttcaacctgcagcacgtggaggaggccgagagccgcagccccagccccctgcaggcccctgagaaggagaaggagagccctgctgagctggccgagcgctgcctgcgggagctgctgggccgggccgccttcggcaacatcaagaatgccatcaagcctgtgctgatccacctggacaaccacagcctgtgggagcccaaggtgtttgccatccgctgcttcaagatcatcatgtacagcatccagccccagcacagccacctggtgatccagcagctgctgggccacctggatgccaacagccgctctgctgccaccgtgcgggccggcatcgtggaggtgctgtctgaggccgctgtgattgctgccaccggctctgtgggccccaccgtgctggagatgttcaacaccctgctgcggcagctgcggctgagcattgattatgccctgaccggcagctatgatggagctgtgtccctgggcaccaagatcatcaaggagcacgaggagaggatgttccaggaggccgtcatcaagacagtgggcagctttgccagcaccctgcccacctaccagaggtctgaggtgatcctcttcatcatgagcaaggtgccccggcccagcctgcaccaggccgtggacaccggccgcactggagagaacagaaaccggctgacccagatcatgctgctgaagagcctgctgcaggtgtccacaggcttccagtgcaacaacatgatgtctgccctgcccagcaacttcctggaccggctgctgagcacagccctgatggaggatgctgagatccggctgtttgtgctggagatcctgatctccttcatcgacagacatggcaacagacacaagttcagcaccatcagcaccctgagtgacatctctgtgctgaagctgaaggtggacaagtgcagccggcaggacaccgtcttcatgaagaagcacagccagcagctgtaccgccacatctacctgagctgcaaggaggagaccaacgtgcagaagcactatgaggccctgtatggcctgctggccctgatcagcattgagctggccaatgaggaggtggtggtggacctgatccggctggtgctggccgtgcaggatgtggcccaggtgaatgaggagaacctgcctgtgtacaacagatgtgccctgtatgccctgggcgccgcctacctgaacctgatcagccagctgaccaccgtgcctgccttctgccagcacatccacgaggtgattgagaccaggaagaaggaggccccctacatgctgcctgaagatgtgtttgtggagcggccccggctgagccagaacctggatggagtggtgattgagctgctcttccggcagagcaagatcagcgaggtgctgggcggcagcggctacaacagcgaccggctgtgcctgccctacatcccccagctgacagatgaggaccggctgagcaagaggaggagcattggagagaccatcagcctgcaggtggaggtggagagcaggaacagccctgagaaggaggagcgggtgcctgctgaggagatcacctatgagaccctgaagaaggccatcgtggacagcgtggccgtggaggagcaggagcgggagcggcggcggcaggtggtggagaagttccagaaggccccctttgaggagattgctgcccactgtggggcccgggccagcctgctgcagagcaagctgaaccagatctttgagatcaccatccggcccccacccagccccagcggcaccatcacagctgcctacggccagccccagaaccacagcatccctgtgtatgagatgaagttcccagacctgtgtgtgtactag

SEQ ID NO: 38193 - DNA, 4572 bp, Artificial Sequence
  Description of Artificial Sequence: Synthetic coding sequence
atgacctctgtgtggaagaggctgcagagggtgggcaagagagctgccaagttccagtttgtggcctgctaccacgagctggtgctggagtgcaccaagaagtggcagcctgacaagctggtggtggtgtggaccaggaggaacagacgcatctgcagcaaggcccacagctggcagcccggcatccagaacccctaccggggcaccgtggtgtggatggtgcctgaaaatgtggacatctctgtgaccctgtacagagacccccacgtggaccagtatgaggccaaggagtggaccttcatcattgaaaatgaaagcaagggccagaggaaggtgctggccacagctgaggtggacctggcccggcatgctggccctgtgcctgtgcaggtgcctgtgcggctgcggctgaagcccaagtctgtgaaggtggtgcaggccgagctgagcctgaccctgagcggcgtgctgctgcgggagggccgggccacagatgatgacatgcagagcctggccagcctgatgtctgtgaagcccagtgatgtgggcaacctggatgactttgctgagagtgatgaagatgaggcccacggccctggggcccctgaggcccgggcccgggtgccccagcctgaccccagccgggagctgaagaccctgtgtgaggaggaggaggagggccagggccggccccagcaggccgtggccagccccagcaatgctgaggacaccagccctgcccctgtgtctgccccagcccccccagcccggaccagccggggccagggcagcgagcgggccaatgaggccggcggccaggtgggccctgaggcccccaggcctcctgagaccagccctgagatgaggagcagccggcagcctgcccaggacacagcccccaccccagccccccggctgaggaagggcagtgatgccctgcggccccctgtgccccagggagaagatgaggtgcccaaggccagcggggcccctcctgctggcctgggcagcgcccgggagacccaggcccaggcctgcccccaggagggcacagaggcccacggggcccggctgggccccagcattgaagataaaggaagtggggaccccttcggccggcagaggctgaaggccgaggagatggacacagaggacaggcctgaggccagcggcgtggacacagagcccaggtctgggggccgggaggccaacaccaagagaagtggagtgcgggccggggaggccgaggagagcagcgctgtgtgccaggtggatgctgagcagaggagcaaggtgcgccacgtggacaccaagggccctgaggccactggagtgatgcctgaggcccgctgccggggcaccccagaggccccaccccggggcagccagggccgcctgggcgtgaggaccagagatgaggcccccagcggcctgagcctgcccccagctgagcccgccggccacagcggccagctgggggacctggagggcgcccgggctgctgctggccaggagcgggagggcgctgaggtgcggggcggggcccctggcatcgagggcaccggcctggagcagggccccagcgtgggcgccatcagcacccggccccaggtgtcctcctggcagggcgccctgctgagcacagcccagggcgccatcagccggggcctgggcggctgggaggccgaggccggcggcagcggggacctggagacagaaacagaggtggtgggcctggaggtgctgggcacccaggagaaggaggtggagggcagcggcttccctgagaccaggaccctggagattgagatcctgggcgccctggagaaggaggccgcccggagccgggtgctggagagcgaggtggccggcacagcccagtgtgagggcctggagacccaggagacagaggtgggcgtgattgagaccccaggcacagaaacagaggtgctgggcacccagaagacagaggccggcggcagcggcgtgctgcagaccaggaccaccatcgccgagacagaggtgctggtgacccaggagatcagcggggacctgggccccctgaagattgaggacaccatccagagcgagatgctgggcacccaggagacagaggtggaggccagccgggtgcctgagagcgaggccgagggcacagaggccaagatcctgggcacccaggagatcacagcccgggacagcggcgtgcgggagattgaagctgagattgctgagagtgacatcctggtggcccaggagattgaggtgggcctgctgggcgtgctgggcatcgagaccggggctgctgagggcgccatcctgggcacccaggagatcgccagccgggacagcggcgtgcccggcctggaggccgacaccaccggcatccaggtgaaggaggtgggcggcagcgaggtgcctgagatcgccactggaacagctgagacagagatcctgggcacccaggagatcgccagccgcagcagtggagtgcccggcctggagagcgaggtggccggggcccaggagacagaggtgggcggcagcggcatcagcggccctgaggccggcatggccgaggcccgggtgctgatgaccaggaagacagagatcatcgtgcctgaggccgagaaggaggaggcccagaccagcggcgtgcaggaggccgagaccagggtgggcagcgccctgaagtatgaggccctgcgggcccctgtgacccagccccgggtgctgggcagccaggaggccaaggccgagatcagcggcgtgcagggcagcgagacccaggtgctgcgggtgcaggaggccgaggccggcgtgtggggcatgtctgagggcaagagcggggcctggggcgcccaggaggccgagatgaaggtgctggagagccctgagaacaagagcggcaccttcaaggcccaggaggccgaggccggcgtgctgggcaatgagaagggcaaggaggccgagggcagcctgacagaggccagcctgcctgaggcccaggtggccagcggggccggggccggggccccccgggccagcagccctgagaaggccgaggaggaccggcggctgcccggcagccaggcccccccagccctggtgagcagcagccagagcctgctggagtggtgccaggaggtgaccaccggctaccggggcgtgcgcatcaccaacttcaccacctcctggagaaatggcctggccttctgtgccatcctgcaccgcttctacccagacaagattgattatgccagcctggaccccctgaacatcaagcagaacaacaagcaggcctttgatggctttgctgccctgggcgtgtcccggctgctggagcctgctgacatggtgctgctgtctgtgcctgacaagctgattgtgatgacctacctgtgccagatccgggccttctgcaccggccaggagctgcagctggtgcagctggagggcggcggcggggccggcacctacagagtgggcagcgcccagcccagccccccagatgacctggatgctgggggcctggcccagaggctgcggggccatggagctgagggcccccaggagcccaaggaggccgctgacagagcagatggagctgcccctggggtggccagcagaaatgctgtggccggccgggccagcaaggatggcggcgctgaggccccccgggagagcaggcctgctgaggtgcctgctgagggcctggtgaatggagctggggcccctgggggcggcggcgtgcggctgcggcggcccagcgtgaatggagagcccggctctgtgcccccaccccgggcccacggcagcttcagccacgtgagagatgctgacctgctgaagaagaggaggagccggctgaggaacagcagcagcttctccatggatgatcctgatgctggggccatgggcgctgctgctgctgagggccaggccccagaccccagccctgcccctggccccccaacagctgctgacagccagcagcccccaggcggcagcagccccagcgaggagcccccacccagccctggagaggaggccggcctgcagcgcttccaggacaccagccagtatgtgtgtgccgagctgcaggccctggagcaggagcagaggcagattgatggccgggctgctgaggtggagatgcagctgcggagcctgatggagagcggggccaacaagctgcaggaggaggtgctgatccaggagtggttcaccctggtgaacaagaagaatgccctgatccggcggcaggaccagctgcagctgctgatggaggagcaggacctggagaggagatttgagctgctgagccgggagctgcgggccatgctggccatcgaggactggcagaagaccagcgcccagcagcaccgggagcagctgctgctggaggagctggtgtccctggtgaaccagagagatgagctggtgcgggacctggaccacaaggagagaattgccctggaggaggatgagcggctggagcggggcctggagcagaggaggaggaagctgagccggcagctgagccggcgggagcgctgtgtgctgtcctag

SEQ ID NO: 38194 - DNA, 1005 bp, Artificial Sequence
  Description of Artificial Sequence: Synthetic coding sequence
atgaagcacttcctgaggatgctgatccaggtgtgcctgtacttctactgcaagttcctgtggcgctgcctgaagtttgtgatgaggaagctgaccggccgctgtgagctgcagaggatctgctacaacaccaagccaggggccagcaggaccatgaagattgagaccagcctgcgggacagcaagagcaagctgctgcagacctctgtgtctgtgcacccagatgccatcgagaagaccatcgaggacatcatggagctgaagaagatcaacccagatgtgaacccccagctgggcatcagcctgcaggcctgcctgctgcagatcgtgggctacagaaacctgattgctgatgtggagaagctgcggcgggaggcctatgacagcgacaacccccagcacgaggagatgctgctgaagctgtggaagttcctgaagcccaacacccccctggagagccgcatcagcaagcagtggtgtgagatcggcttccagggagatgaccccaagacagacttccggggcatgggcctgctgggcctgtacaacctgcagtactttgctgagagagatgccacagctgcccagcaggtgctgagtgacagcctgcaccccaagtgccgggacatcaccaaggaggagatcagcaagttcagcaaggccgagtgggagaagaagaggatggacaaggccatcggctacagctttgccatcgtgggcatcaacatcacagacctggcctacaacctgctggtgtctggggccctgaagacccacttctacaacatcgcccctgaggcccccaccctgagccacttccagcagaccttctgctacctgatgcatgagttccacaagttctggattgaggaggaccccatggacatcatggagttcaacagagtgcgggagaagttcaggaagaggatcatcaagcagctgcagaacccagacatggccctgtgcccccactttgctgccagcgagggcctcatcaacatgtag

SEQ ID NO: 38195 - DNA, 981 bp, Artificial Sequence
  Description of Artificial Sequence: Synthetic coding sequence
atgaagcacttcctgaggatgctgatccaggtgtgcctgtacttctactgcaagttcctgtggcgctgcctgaagtttgtgatgaggaagctgaccggccgctgtgagctgcagaggatctgctacaacaccaagccaggggccagcaggaccatgaagattgagaccagcctgcgggacagcaagagcaagctgctgcagacctctgtgtctgtgcacccagatgccatcgagaagaccatcgaggacatcatggagctgaagaagatcaacccagatgtgaacccccagctgggcatcagcctgcaggcctgcctgctgcagatcgtgggctacagaaacctgattgctgatgtggagaagctgcggcgggaggcctatgacagcgacaacccccagcacgaggagatgctgctgaagctgtggaagttcctgaagcccaacacccccctggagagccgcatcagcaagcagtggtgtgagatcggcttccagggagatgaccccaagacagacttccggggcatgggcctgctgggcctgtacaacctgcagtactttgctgagagagatgccacagctgcccagcaggtgctgagtgacagcctgcaccccaagtgcagcaagttcagcaaggccgagtgggagaagaagaggatggacaaggccatcggctacagctttgccatcgtgggcatcaacatcacagacctggcctacaacctgctggtgtctggggccctgaagacccacttctacaacatcgcccctgaggcccccaccctgagccacttccagcagaccttctgctacctgatgcatgagttccacaagttctggattgaggaggaccccatggacatcatggagttcaacagagtgcgggagaagttcaggaagaggatcatcaagcagctgcagaacccagacatggccctgtgcccccactttgctgccagcgagggcctcatcaacatgtag

SEQ ID NO: 38196 - DNA, 1176 bp, Artificial Sequence
  Description of Artificial Sequence: Synthetic coding sequence
atgaatgagaagagctgcagcttccacagcaaggaggagctgagagatggccagggcgagcggctgtctgctggctacagccccagctatgacaaggacaagtctgtgctggccttccggggcatccccatcagcgagctgaagaaccacggcatcctgcaggccctgaccacagaggcctatgagtgggagccccgggtggtgtccacagaggtggtgcgggcccaggaggagtgggaggccgtggacaccatccagcctgagaccggcagccaggccagcagcgagcagcccggccagctgatctccttcagcgaggccctgcagcacttccagacagtggacctgagccccttcaagaagaggatccagcccaccatccggaggacaggcctggccgccctgcggcactacctgtttggcccccccaagctgcaccagaggctgcgggaggagcgggacctggtgctgaccatcgcccagtgtggcctggacagccaggaccctgtgcacggccgggtgctgcagaccatctacaagaagctgaccggcagcaagtttgactgtgccctgcacggcaaccactgggaggacctgggcttccagggcgccaacccagccacagacctgcggggagctggcttcctggccctgctgcacctgctgtacctggtgatggacagcaagaccctgcccatggcccaggagatcttccggctgagccgccaccacatccagcagttccccttctgcctgatgtctgtgaacatcacccacatcgccatccaggccctgcgggaggagtgcctgagccgggagtgcaaccggcagcagaaggtgattcctgtggtgaacagcttctatgctgccaccttcctgcacctggcccacgtgtggaggacccagaggaagaccatcagtgacagcggctttgtgctgaagggcgtgctcttcctgctgggccggccccggctgaatgcccagtgccccaggagccgggagcccaaggtggtggcccggctggtgctggccgctgtgctgccccacccccacttcctgaagttccagctgaccaagatcagcatcacccaccccctggagagcgccagcagccccttcagcgccctgactgtggccctcttctggagctacacctatgacaagcacatcttctag

SEQ ID NO: 38197 - DNA, 1146 bp, Artificial Sequence
  Description of Artificial Sequence: Synthetic coding sequence
atgaatgagaagagctgcagcttccacagcaaggaggagctgagagatggccagggcgagcggctgtctgctggctacagccccagctatgacaaggacaagtctgtgctggccttccggggcatccccatcagcgagctgaagaaccacggcatcctgcaggccctgaccacagaggcctatgagtgggagccccgggtggtgtccacagaggtggtgcgggcccaggaggagtgggaggccgtggacaccatccagcctgagaccggcagccaggccagcagcgagcagcccggccagctgatctccttcagcgaggccctgcagcacttccagacagtggacctgagccccttcaagaagaggatccagcccaccatccggaggacaggcctggccgccctgcggcactacctgtttggcccccccaagctgcaccagaggctgcgggaggagcgggacctggtgctgaccatcgcccagtgtggcctggacagccaggaccctgtgcacggccgggtgctgcagaccatctacaagaagctgaccggcagcaagtttgactgtgccctgcacggcaaccactgggaggacctgggcttccagggcgccaacccagccacagacctgcggggagctggcttcctggccctgctgcacctgctgtacctggtgatggacagcaagaccctgcccatggcccaggagatcttccggctgagccgccaccacatccagcagttccccttctgcctgatgtctgtgaacatcacccacatcgccatccaggccctgcgggaggagtgcctgagccgggagtgcaaccggcagcagaaggtgattcctgtggtgaacagcttctatgctgccaccttcctgcacctggcccacgtgtggaggacccagaggaagaccatcagtgacagcggctttgtgctgaaggagctggaggtgctggccaagaagagcccccggcggctgctgaagaccctggagctgtacctggcccgggtgtccaagggccaggccagcctgctgggcgcccagaagtgctacggccctgaggccccacccttcaaggacctgaccttcaccggggagagtgacctgcagagccacagcagcgagggcgtgtggctgatctag

SEQ ID NO: 38198 - DNA, 1146 bp, Artificial Sequence; identical to SEQ ID NO: 38197
  Description of Artificial Sequence: Synthetic coding sequence

SEQ ID NO: 38199 - DNA, 612 bp, Artificial Sequence
  Description of Artificial Sequence: Synthetic coding sequence
atgaatgagaagagctgcagcttccacagcaaggaggagctgagagatggccagggcgagcggctgtctgctggctacagccccagctatgacaaggacaagtctgtgctggccttccggggcatccccatcagcgagctgaagaaccacggcatcctgcaggccctgaccacagaggcctatgagtgggagccccgggtggtgtccacagaggtggtgcgggcccaggaggagtgggaggccgtggacaccatccagcctgagaccggcagccaggccagcagcgagcagcccggccagctgatctccttcagcgaggccctgcagcacttccagacagtggacctgagccccttcaagaagaggatccagcccaccatccggaggacaggcctggccgccctgcggcactacctgtttggcccccccaagctgcaccagaggctgcgggaggagcgggacctggtgctgaccatcgcccagtgtggcctggacagccaggaccctgtgcacggccgggtgctgcagaccatctacaagaagctgaccggcagcaagtttgactgtgccctgcacggcaaccactgggaggacctgggcttccagggctag

SEQ ID NO: 38200 - DNA, 1146 bp, Artificial Sequence; identical to SEQ ID NO: 38197
  Description of Artificial Sequence: Synthetic coding sequence

SEQ ID NO: 38201 - DNA, 1146 bp, Artificial Sequence; identical to SEQ ID NO: 38197
  Description of Artificial Sequence: Synthetic coding sequence

SEQ ID NO: 38202 - DNA, 363 bp, Artificial Sequence
  Description of Artificial Sequence: Synthetic coding sequence
atgaatgagaagagctgcagcttccacagcaaggaggagctgagagatggccagggcgagcggctgtctgctggctacagccccagctatgacaaggacaagtctgtgctggccttccggggcatccccatcagcgagctgaagaaccacggcatcctgcaggccctgaccacagaggcctatgagtgggagccccgggtggtgtccacagaggtggtgcgggcccaggaggagtgggaggccgtggacaccatccagcctgagaccggcagccaggccagcagcgagcagcccggccagctgatctccttcagcgaggccctgcagcacttccagacagtggacctgagccccttcaagtag

SEQ ID NO: 38203 - DNA, 765 bp, Artificial Sequence
  Description of Artificial Sequence: Synthetic coding sequence
atgaatgagaagagctgcagcttccacagcaaggaggagctgagagatggccagggcgagcggctgtctgctggctacagccccagctatgacaaggacaagtctgtgctggccttccggggcatccccatcagcgagctgaagaaccacggcatcctgcaggccctgaccacagaggcctatgagtgggagccccgggtggtgtccacagaggtggtgcgggcccaggaggagtgggaggccgtggacaccatccagcctgagaccggcagccaggccagcagcgagcagcccggccagctgatctccttcagcgaggccctgcagcacttccagacagtggacctgagccccttcaagaagaggatccagcccaccatccggaggacaggcctggccgccctgcggcactacctgtttggcccccccaagctgcaccagaggctgcgggaggagcgggacctggtgctgaccatcgcccagtgtggcctggacagccaggaccctgtgcacggccgggtgctgcagaccatctacaagaagctgaccggcagcaagtttgactgtgccctgcacggcaaccactgggaggacctgggcttccagggcgccaacccagccacagacctgcggggagctggcttcctggccctgctgcacctgctgtacctggtgatggacagcaagaccctgcccatggcccaggagatcttccggctgagccgccaccacatccagattgaaagaaaccagggcaaaggatag

SEQ ID NO: 38204 - DNA, 3363 bp, Artificial Sequence
  Description of Artificial Sequence: Synthetic coding sequence
atggtgctgaacagcctggacaagatgatccagctgcagaagaacacagccaacatccggaacatctgtgtgctggcccacgtggaccacggcaagaccaccctggccgactgcctgatcagcagcaatggcatcatcagcagccggctggccggcaagctgcgctacatggacagcagagaagatgagcagatccggggcatcaccatgaagagcagcgccatcagcctgcactacgccactggaaatgaggagtacctgatcaacctgattgacagccctggccacgtggacttcagcagcgaggtgtccacagctgtgcgcatctgtgatggctgcatcatcgtggtggatgctgtggagggcgtgtgcccccagacccaggccgtgctgcggcaggcctggctggagaacatccggcctgtgctggtgatcaacaagattgacaggctcatcgtggagctgaagttcaccccccaggaggcctacagccacctgaagaacatcctggagcagatcaatgccctgaccggcaccctcttcaccagcaaggtgctggaggagcgggcagagcgggagacagagagccaggtgaaccccaacagcgagcagggcgagcaggtgtatgactggagcacaggcctggaggacacagatgacagccacctgtacttcagccctgagcagggcaatgtggtgttcaccagcgccattgatggctggggctttggaattgagcactttgcccgcatctacagccagaagattggcatcaagaaggaggtgctgatgaagaccctgtggggagactactacatcaacatgaaggccaagaagatcatgaagggggaccaggccaagggcaagaagcccctgtttgtgcagctgatcctggagaacatctggagcctgtatgatgctgtgctgaagaaggacaaggacaagattgacaagatcgtgaccagcctgggcctgaagattggagcccgggaggcccggcacagcgaccccaaggtgcagatcaatgccatctgcagccagtggctgcccatcagccatgctgtgctggccatggtgtgccagaagctgcccagccccctggacatcacagctgagcgggtggagcggctgatgtgcaccggcagccagacctttgacagcttccccccagagacccaggccctgaaggccgccttcatgaagtgtggcagcgaggacacagcccctgtgatcatctttgtgtccaagatgtttgctgtggatgccaaggccctgccccagaacaagccccggcccctgacccaggaggagatcgcccagaggcgggagcgggcccggcagagacatgctgagaagctggccgccgcccagggccaggcccccctggagcccacccaggacggcagcgccatcgagacctgccccaagggggaggagcccagaggagatgagcagcaggtggagagcatgacccccaagcctgtgctgcaggaggagaacaaccaggagagcttcatcgcctttgcccgggtcttctctggagtggcccggcggggcaagaagatctttgtgctgggccccaagtacagccccctggagttcctgcggcgggtgcccctgggcttcagcgcccccccagatggcctgccccaggtgccccacatggcctactgtgccctggagaacctgtacctgctgatgggccgggagctggagtacctggaggaggtgcccccaggaaatgtgctgggcattggaggcctgcaggactttgtgctgaagagcgccaccctgtgcagcctgcccagctgcccccccttcatccccctgaactttgaggccacccccatcgtgcgggtggccgtggagcccaagcaccccagcgagatgccccagctggtgaagggcatgaagctgctgaaccaggccgacccctgtgtgcagatcctgatccaggagaccggggagcacgtgctggtgacagctggggaggtgcacctgcagcgctgcctggatgacctgaaggagagatttgccaagatccacatctctgtgtctgagcccatcatccccttccgggagaccatcaccaagccacccaaggtggacatggtgaatgaggagatcggcaagcagcagaaggtggccgtcatccaccagatgaaggaggaccagagcaagatccctgagggcatccaggtggacagtgatggcctcatcaccatcaccacccccaacaagctggccaccctgtctgtgcgggccatgcccctgcctgaggaggtgacccagatcctggaggagaacagcgacctgatccgctccatggagcagctgaccagcagcctgaatgaaggagagaacacccacatgatccaccagaagacccaggagaagatctgggagttcaagggcaagctggagcagcacctgaccggccgccgctggagaaatattgtggaccagatctggagctttggccccaggaaatgtggccccaacatcctggtgaacaagtctgaggacttccagaacagcgtgtggacaggccctgctgacaaggccagcaaggaggccagccgctacagagacctgggcaacagcatcgtgtctggcttccagctggccaccctgagcggccccatgtgtgaggagcccctgatgggcgtgtgctttgtgctggagaagtgggacctgagcaagtttgaggagcagggcgccagtgacctggccaaggagggccaggaggagaatgagacctgcagcggcggcaatgaaaaccaggagctgcaggacggctgcagcgaggcctttgagaagaggaccagccagaagggggagagccccctgacagactgctacggccccttcagcggccagctgattgccaccatgaaggaggcctgccgctatgccctgcaggtgaagccccagaggctgatggccgccatgtacacctgtgacatcatggccactggagatgtgctgggccgggtgtatgctgtgctgagcaagcgggagggccgggtgctgcaggaggagatgaaggagggcacagacatgttcatcatcaaggctgtgctgcctgtggccgagagctttggatttgctgatgagatcaggaagaggaccagcggcctggccagcccccagctggtgttcagccactgggagatcatccccagcgaccccttctgggtgcccaccacagaggaggagtacctgcactttggagagaaggctgacagcgagaaccaggccaggaagtacatgaatgctgtgaggaagaggaagggcctgtatgtggaggagaagatcgtggagcacgccgagaagcagaggaccctgagcaagaacaagtag

SEQ ID NO: 38205 - DNA, 3210 bp, Artificial Sequence
  Description of Artificial Sequence: Synthetic coding sequence
atggtgctgaacagcctggacaagatgatccagctgcagaagaacacagccaacatccggaacatctgtgtgctggcccacgtggaccacggcaatgaggagtacctgatcaacctgattgacagccctggccacgtggacttcagcagcgaggtgtccacagctgtgcgcatctgtgatggctgcatcatcgtggtggatgctgtggagggcgtgtgcccccagacccaggccgtgctgcggcaggcctggctggagaacatccggcctgtgctggtgatcaacaagattgaccggctgattgtggagctgaagttcaccccccaggaggcctacagccacctgaagaacatcctggagcagatcaatgccctgaccggcaccctcttcaccagcaaggtgctggaggagagagctgagcgggagacagagagccaggtgaaccccaacagcgagcagggcgagcaggtgtatgactggagcacaggcctggaggacacagatgacagccacctgtacttcagccctgagcagggcaatgtggtgttcaccagcgccattgatggctggggcttcggcatcgagcactttgcccgcatctacagccagaagattggcatcaagaaggaggtgctgatgaagaccctgtggggagactactacatcaacatgaaggccaagaagatcatgaagggggaccaggccaagggcaagaagcccctgtttgtgcagctgatcctggagaacatctggagcctgtatgatgctgtgctgaagaaggacaaggacaagattgacaagatcgtgaccagcctgggcctgaagatcggggcccgggaggcccggcacagcgaccccaaggtgcagatcaatgccatctgcagccagtggctgcccatcagccatgctgtgctggccatggtgtgccagaagctgcccagccccctggacatcacagctgagcgggtggagcggctgatgtgcaccggcagccagacctttgacagcttccccccagagacccaggccctgaaggccgccttcatgaagtgtggcagcgaggacacagcccctgtgatcatctttgtgtccaagatgtttgctgtggatgccaaggccctgccccagaacaagccccggcccctgacccaggaggagatcgcccagaggcgggagcgggcccggcagagacatgctgagaagctggccgccgcccagggccaggcccccctggagcccacccaggacggcagcgccatcgagacctgccccaagggggaggagcccagaggagatgagcagcaggtggagagcatgacccccaagcctgtgctgcaggaggagaacaaccaggagagcttcatcgcctttgcccgggtcttcagcggcgtggcccggcggggcaagaagatctttgtgctgggccccaagtacagccccctggagttcctgcggcgggtgcccctgggcttcagcgcccccccagatggcctgccccaggtgccccacatggcctactgtgccctggagaacctgtacctgctgatgggccgggagctggagtacctggaggaggtgcccccaggaaatgtgctgggcatcggcggcctgcaggactttgtgctgaagagcgccaccctgtgcagcctgcccagctgcccccccttcatccccctgaactttgaggccacccccatcgtgcgggtggccgtggagcccaagcaccccagcgagatgccccagctggtgaagggcatgaagctgctgaaccaggccgacccctgtgtgcagatcctgatccaggagactggagagcacgtgctggtgacagctggggaggtgcacctgcagcgctgcctggatgacctgaaggagagatttgccaagatccacatctctgtgtctgagcccatcatccccttccgggagaccatcaccaagccacccaaggtggacatggtgaatgaggagatcggcaagcagcagaaggtggccgtcatccaccagatgaaggaggaccagagcaagatccctgagggcatccaggtggacagtgatggcctcatcaccatcaccacccccaacaagctggccaccctgtctgtgcgggccatgcccctgcctgaggaggtgacccagatcctggaggagaacagcgacctgatccgctccatggagcagctgaccagcagcctgaatgaaggagagaacacccacatgatccaccagaagacccaggagaagatctgggagttcaagggcaagctggagcagcacctgactggaagacgctggaggaacatcgtggaccagatctggagctttggccccaggaaatgtggccccaacatcctggtgaacaagtctgaggacttccagaacagcgtgtggacaggccctgctgacaaggccagcaaggaggccagccgctacagagacctgggcaacagcatcgtgtctggcttccagctggccaccctgagcggccccatgtgtgaggagcccctgatgggcgtgtgctttgtgctggagaagtgggacctgagcaagtttgaggagcagggcgccagtgacctggccaaggagggccaggaggagaatgagacctgcagcggcggcaatgaaaaccaggagctgcaggacggctgcagcgaggcctttgagaagaggaccagccagaagggggagagccccctgacagactgctacggccccttcagcggccagctgattgccaccatgaaggaggcctgccgctatgccctgcaggtgaagccccagaggctgatggccgccatgtacacctgtgacatcatggccactggagatgtgctgggccgggtgtatgctgtgctgagcaagcgggagggccgggtgctgcaggaggagatgaaggagggcacagacatgttcatcatcaaggctgtgctgcctgtggccgagagctttggatttgctgatgagatcaggaagaggaccagcggcctggccagcccccagctggtgttcagccactgggagatcatccccagcgaccccttctgggtgcccaccacagaggaggagtacctgcactttggagagaaggctgacagcgagaaccaggccaggaagtacatgaatgctgtgaggaagaggaagggcctgtatgtggaggagaagatcgtggagcacgccgagaagcagaggaccctgagcaagaacaagtag

SEQ ID NO: 38206 - DNA, 93 bp, Artificial Sequence
  Description of Artificial Sequence: Synthetic coding sequence
atggtgctgaacagcctggacaagatgatccagctgcagaagaacacagccaacatccggaacatctgtgtgctggcccacgtggaccactag

SEQ ID NO: 38207 - DNA, 54 bp, Artificial Sequence
  Description of Artificial Sequence: Synthetic coding sequence
atggtgctgaacagcctggacaagatgatccagctgcagaagaacacagcctag

SEQ ID NO: 38208 - DNA, 420 bp, Artificial Sequence
  Description of Artificial Sequence: Synthetic coding sequence
atgtggcacacagtgccccgggccggcctgggccgggtgggctgccggggcctgcccggctgccgggcccaccccccaggggcctgggcctgctgcacagagcaggcctgggccctggcccccctgactgtgcccagccggcccagcctgtgcagcggccccaggacaggcagcggccagcaggcccctggcctgcaggatgtgctgagcctgtggagcgtgtgtgatgatgagcacagctggagcttcctgtatgccggcccctgggccagcgagcgggccaccggctggaggctgagccatgaggtggagggccagagccagggcctgcaggtgaccagctgccgccaccacgccctgctgccctgggccgtgctgggcgcccccagctggccctgggcccagtggcctgtggcctag

SEQ ID NO: 38209 - DNA, 309 bp, Artificial Sequence
  Description of Artificial Sequence: Synthetic coding sequence
atgggcgctgagtgggagctgggcgctgaggccggcggcagcctgctgctgtgtgccgccctgctggccgccggctgtgccctgggcctgcggctgggccggggccagggcgctgctgacagaggagccctgatctggctgtgctatgatgccctggtgcactttgccctggccttccctgctgaccaccctgtgcgggtgcgggctgtgtggctgctggatgacctgcccccccgggtggcccaccagaagccccagccccagcaccagcagctggccgtgctgctggccctgcctgtgttcttctag

SEQ ID NO: 38210 - DNA, 387 bp, Artificial Sequence
  Description of Artificial Sequence: Synthetic coding sequence
atgggcgctgagtgggagctgggcgctgaggccggcggcagcctgctgctgtgtgccgccctgctggccgccggctgtgccctgggcctgcggctgggccggggccagggcgctgctgacagaggagccctgatctggctgtgctatgatgccctggtgcactttgccctggagggcccctttgtgtacctgagcctggtgggcaatgtggccaacagtgatggcctgattgccagcctgagtgatgcccgctgggtgtactttgaccccaccatcgtgtctgtggagatcctgactgtggccctggatggcagcctggccctcttcctgatctatgccatcgtgaaggagaagtactacagagacagagtggcctggggcgagtag

SEQ ID NO: 38211 - DNA, 1815 bp, Artificial Sequence
  Description of Artificial Sequence: Synthetic coding sequence
atgctgggcatgaacatgctgctgatcaccctcttcctgctgctgcccctgtccatgctgaagggggagccctgggagggctgcctgcactgcacccacaccacctggagcggcaacatcatgaccaagaccctgctgtaccacacctactatgaatgtgccggcacctgcctgggcacctgcacccacaaccagaccacctacagcgtgtgtgaccccggccggggccagccctacgtgtgctatgaccccaagagcagccctggcacctggtttgagatccacgtgggcagcaaggagggggacctgctgaaccagaccaaggtgttccccagcggcaaggatgtggtgtccctgtactttgatgtgtgccagatcgtgtccatgggcagcctcttccctgtgatcttcagctccatggagtactacagcagctgccacaagaacagatatgcccacccagcctgcagcacagacagccctgtgaccacctgctgggactgcaccacctggagcaccaaccagcagagcctgggccccatcatgctgaccaagatccccctggagccagactgcaagaccagcacctgcaacagcgtgaacctgaccatcctggagccagaccagcccatctggaccaccggcctgaaggcccccctgggcgcccgggtgtctggagaggagatcggccctggggcctacgtgtacctgtacatcatcaagaagaccaggaccaggagcacccagcagttccgggtgtttgagagcttctatgagcacgtgaaccagaagctgcctgagcccccacccctggccagcaacctgtttgcccagctggctgaaaatattgccagcagcctgcacgtggccagctgctacgtgtgtggcggcatgaacatgggagaccagtggccctgggaggcccgggagctgatgccccaggacaacttcaccctgacagccagcagcctggagcccgcccccagcagccagagcatctggttcctgaagaccagcatcatcggcaagttctgcatcgcccgctggggcaaggccttcacagatcctgtgggggagctgacctgcctgggccagcagtactacaatgagaccctgggcaagaccctgtggaggggcaagagcaacaacagcgagagcccccaccccagccccttcagccgcttccccagcctgaaccacagctggtaccagctggaggcccccaacacctggcaggcccccagcggcctgtactggatctgtggcccccaggcctaccggcagctgcctgccaagtggagcggggcctgtgtgctgggcaccatccggcccagcttcttcctgatgcccctgaagcagggcgaggccctgggctaccccatctatgatgagaccaagaggaagagcaagaggggcatcaccatcggggactggaaggacaatgagtggcccccagagcgcatcatccagtactacggccctgccacctgggccgaggatggcatgtggggctaccgcacccctgtgtacatgctgaaccgcatcatccggctgcaggccgtgctggagatcatcaccaatgaaacagctggggccctgaacctgctggcccagcaggccaccaagatgagaaatgtcatctaccagaaccggctggccctggactacctgctggcccaggaggagggcgtgtgtgggaagttcaacctgaccaactgctgcctggagctggatgatgagggcaaggtgatcaaggagatcacagccaagatccagaagctggcccacatccctgtgcagacctggaagggctag

SEQ ID NO: 38212 - DNA, 1692 bp, Artificial Sequence
  Description of Artificial Sequence: Synthetic coding sequence
atgggcagcctgagcaactatgccctgctgcagctgaccctgacagccttcctgaccatcctggtgcagccccagcacctgctggcccctgtgttccgcaccctgagcatcctgaccaaccagagcaactgctggctgtgtgagcacctggacaatgctgagcagcctgagctggtgtttgtgcctgccagcgccagcacctggtggacctacagcggccagtggatgtatgagcgggtgtggtacccccaggccgaggtgcagaaccacagcaccagcagctacaggaaggtgacctggcactgggaggcctccatggaggcccagggcctgagctttgcccaggtgcggctgctggagggcaacttcagcctgtgtgtggagaacaagaatggaagtggccccttcctgggcaacatccccaagcagtactgcaaccagatcctgtggtttgacagcacagatggcaccttcatgcccagcattgatgtgaccaatgaaagcagaaatgatgatgatgacacctctgtgtgcctgggcacccggcagtgctcctggtttgctggctgcaccaacagaacctggaacagcagcgctgtgcccctgattggcctgcccaacacccaggactacaagtgggtggacaggaacagcggcctgacctggagcggaaatgacacctgcctgtacagctgccagaaccagaccaagggcctgctgtaccagctgttcaggaacctcttctgcagctatggcctgacagaggcccacggcaagtggaggtgtgctgatgccagcatcaccaatgacaagggccatgatggccacaggacccccacctggtggctgaccggcagcaacctgaccctgtctgtgaacaacagcggcctcttcttcctgtgtggaaatggagtgtacaagggcttcccccccaagtggagcggccgctgtggcctgggctacctggtgcccagcctgacccgctacctgaccctgaatgccagccagatcaccaacctgcggagcttcatccacaaggtgaccccccaccgctgcacccagggcgacacagacaacccccccctgtactgcaaccccaaggacaacagcaccatccgggccctcttccccagcctgggcacctatgacctggagaaggccatcctgaacatcagcaaggccatggagcaggagttcagcgccaccaagcagaccctggaggcccaccagagcaaggtgagcagcctggccagcgccagcaggaaggaccacgtgctggacatccccaccacccagaggcagacagcctgtggcaccgtgggcaagcagtgctgcctgtacatcaactacagcgaggagatcaagagcaacatccagaggctgcacgaggccagcgagaacctgaagaatgtgcccctgctggactggcagggcatctttgccaaggtgggggactggttccgctcctggggctacgtgctgctgattgtgctcttctgcctcttcatctttgtgctgatctacgtgcgggtcttcaggaagagccgccgcagcctgaacagccagcccctgaacctggccctgagcccccagcagagcgcccagctgctggtgtctgagaccagctgccaggtgagcaacagagccatgaagggcctgaccacccaccagtatgacaccagcctgctgtag

SEQ ID NO: 38213 - DNA, 1692 bp, Artificial Sequence; identical to SEQ ID NO: 38212
  Description of Artificial Sequence: Synthetic coding sequence

SEQ ID NO: 38214 - DNA, 1608 bp, Artificial Sequence
  Description of Artificial Sequence: Synthetic coding sequence
atgacagagaagttcctgttcctgtacctgagcctgctgcccatgcccctgctgagccaggcccagtggaatgaaaacagcctggtgtccttcagcaagatcatcgccagcggcaaccacctgagcaactgctggatctgccacaacttcatcaccaggagcagcagctaccagtacatcctggtgaggaacttcagcctgaacctgacctttggaagtggcatccctgagggccagcacaagtctgtgcccctgcaggtgtccctggccaacagcgcccaccaggtgccctgcctggacctgaccccacccttcaaccagagcagcaagaccagcttctacttctacaactgcagcagcctgaaccagacctgctgcccctgcccagagggccactgtgacaggaagaacaccagcgaggagggcttccccagccccaccatccaccccatgtccttctccccagctggctgccaccccaacctgacccactggtgcccagccaagcagatgaatgactacagagacaagagcccccagaacagatgtgccgcctgggagggcaaggagctgatcacctggagggtgctgtacagcctgcccaaggcccacacagtgcccacctggcccaagagcacagtgcccctgggcggccccctgagccctgcctgcaaccagaccatcccagctggctggaagagccagctgcacaagtggtttgacagccacatcccccgctgggcctgcaccccacctggctacgtgttcctgtgtggcccccagaagaacaagctgccctttgatggcagccccaagatcacctacagcaccccacctgtggccaacctgtacacctgcatcaacaacatccagcacactggagaatgtgctgtgggcctgctgggcccccggggcatcggcgtgaccatctacaacaccacccagccccggcagaagagggccctgggcctcatcctggccggcatgggcgccgccatcggcatgattgccccctggggcggcttcacctaccatgatgtgaccctgaggaacctgagccggcagattgacaacatcgccaagagcacccgggacagcatcagcaagctgaaggccagcattgacagcctggccaacgtggtgatggacaaccggctggccctggactacctgctggccgagcagggcggcgtgtgtgccgtcatcaacaagagctgctgcgtgtatgtgaacaacagcggggccatcgaggaggacatcaagaagatctatgatgaggccacctggctgcatgactttggaaaaggaggagccagcgcccgggccatctgggaggccgtgaagagcgccctgcccagcctgaactggtttgtgcccctgctgggccctgccaccgtcatcctgctgctcttcctgtttggcccctgcttcttcaacctgctgatcaagtgtgtgagcagccgcatcaagcagttccacatgaagagcccccagatggagcgctaccagctgtctgtgattggaggccccagcacctacaagcacatcagccccctggatgccagcggccagcgcttccgggagaccatggaggagttcagcctgtag

SEQ ID NO: 38215 - DNA, 795 bp, Artificial Sequence
  Description of Artificial Sequence: Synthetic coding sequence
atggccctggaggccgccggcggccccccagaggagaccctgagcctgtggaagcgggagcaggcccggctgaaggcccacgtggtggaccgggacacagaggcctggcagagggaccctgccttcagcggcctgcagagggtgggcggcgtggatgtgtcctttgtgaagggggacagcgtgcgggcctgtgccagcctggtggtgctgtccttccctgagctggaggtgctgctggtggatggaaatggagtgctgcaccaccggggctttggagtggcctgccacctgggcgtgctgacagacctgccctgtgtgggcgtggccaagaagctgctgcaggtggatggcctggagaacaatgccctgcacaaggagaagatccggctgctgcagaccaggggggacagcttccccctgctgggggacagcggcaccgtgctgggcatggccctgcggagccatgacaggagcacccggcccctgtacatctctgtgggccacaggatgagcctggaggccgctgtgcggctgacctgctgctgctgccgcttccgcatccctgagcctgtgcggcaggccgacatctgcagccgggagcacatcaggaagagcctgggcctgcccggcccccccacccccaggagccccaaggcccagaggcctgtggcctgccccaagggggacagcggggagagcagcggggagggccagcccccccaggaccacagccctggccccaggacagcccccaggcctggcagccaggagcaggccggcaaggactggcagtag

SEQ ID NO: 38216 - DNA, 849 bp, Artificial Sequence
  Description of Artificial Sequence: Synthetic coding sequence
atggccctggaggccgccggcggccccccagaggagaccctgagcctgtggaagcgggagcaggcccggctgaaggcccacgtggtggaccgggacacagaggcctggcagagggaccctgccttcagcggcctgcagagggtgggcggcgtggatgtgtcctttgtgaagggggacagcgtgcgggcctgtgccagcctggtggtgctgtccttccctgagctggaggtggtgtatgaggagagcaggatggtgtccctgacagccccctacgtgtctggcttcctggccttccgggaggtgcccttcctgctggagctggtgcagcagctgcgggagaaggagcccggcctgatgccccaggtgctgctggtggatggaaatggagtgctgcaccaccggggcttcggcgtggcctgccacctgggcgtgctgacagacctgccctgtgtgggcgtggccaagaagctgctgcaggtggatggcctggagaacaatgccctgcacaaggagaagatccggctgctgcagaccaggggggacagcttccccctgctgggggacagcggcaccgtgctgggcatggccctgcggagccatgacaggagcacccggcccctgtacatctctgtgggccacaggatgagcctggaggccgctgtgcggctgacctgctgctgctgccgcttccgcatccctgagcctgtgcggcaggccgacatctgcagccgggagcacatcaggaagagcctgggcctgcccggcccccccacccccaggagccccaaggcccagaggcctgtggcctgccccaagggggacagcggggagagcagcgccctgtgctag

SEQ ID NO: 38217 - DNA, 714 bp, Artificial Sequence
  Description of Artificial Sequence: Synthetic coding sequence
atggccctggaggccgccggcggccccccagaggagaccctgagcctgtggaagcgggagcaggcccggctgaaggcccacgtggtggaccgggacacagaggcctggcagagggaccctgccttcagcggcctgcagagggtgggcggcgtggatgtgtcctttgtgaagggggacagcgtgcgggcctgtgccagcctggtggtgctgtccttccctgagctggaggtgctgctggtggatggaaatggagtgctgcaccaccggggctttggagtggcctgccacctgggcgtgctgacagacctgccctgtgtgggcgtggccaagaagctgctgcaggtggatggcctggagaacaatgccctgcacaaggagaagatccggctgctgcagaccaggggggacagcttccccctgctgggggacagcggcaccgtgctgggcatggccctgcggagccatgacaggagcacccggcccctgtacatctctgtgggccacaggatgagcctggaggccgctgtgcggctgacctgctgctgctgccgcttccgcatccctgagcctgtgcggcaggccgacatctgcagccgggagcacatcaggaagagcctgggcctgcccggcccccccacccccaggagccccaaggcccagaggcctgtggcctgccccaagggggacagcggggagagcagcgccctgtgctag

SEQ ID NO: 38218 - DNA, 771 bp, Artificial Sequence
  Description of Artificial Sequence: Synthetic coding sequence
atggaccccacctgcagcagcgagtgcatctacaacctgatccccagcgacctgaaggagcccccccagcccccacgctacatcagcatcttcaaggccaccgtgaaggatgacatgcagaaggccaagacagccatgaagaccatgggccctgccaaggtggaggtgcccagccccaaggacttcctgaagaagcacagcaaggagaagaccctgccccccaagaagaactttgacagaaatgtgcccaagaagccagctgtgcccctgaagacagaccaccctgtgatgggcatccagagcggcaagaacttcatcaacaccaatgctgctgacatcatcatgggcgtggccaagaagcccaagcccatctacgtggacaagaggactggagacaagcatgacctggagcccagcggcctggtgcccaagtacatcaacaagaaggactatggagtgaccccagagtacatctgcaagagaaatgaggagatcaagaaggcccaggaggactatgaccgctacatccaggagaacctgaagaaggccgccatgaagaggctgagtgatgaggagcgggaggccgtgctgcagggcctgaagaagaactgggaggaggtgcacaaggagttccagagcctgtctgtgttcatcgacagcatccccaagaagatcaggaagcagaggctggaggaggagatgaagcagctggagcatgacatcggcatcatcgagaagcacaagatcatctacatcgccaacaatgcctag

SEQ ID NO: 38219 - DNA, 768 bp, Artificial Sequence
  Description of Artificial Sequence: Synthetic coding sequence
atggaccccacctgcagcagcgagtgcatctacaacctgatccccagcgacctgaaggagcccccccagcccccacgctacatcagcatcttcaaggccaccgtgaaggatgacatgcagaaggccaagacagccatgaagaccatgggccctgccaaggtggaggtgcccagccccaaggacttcctgaagaagcacagcaaggagaagaccctgccccccaagaagaactttgacagaaatgtgcccaagaagccagctgtgcccctgaagacagaccaccctgtgatgggcatccagagcggcaagaacttcatcaacaccaatgctgctgacatcatcatgggcgtggccaagaagcccaagcccatctacgtggacaagaggactggagacaagcatgacctggagcccagcggcctggtgcccaagtacatcaacaagaaggactatggagtgaccccagagtacatctgcaagagaaatgaggagatcaagaaggcccaggaggactatgaccgctacatccaggagaacctgaagaaggccgccatgaagaggctgagtgatgaggagcgggaggccgtgctgcagggcctgaagaagaactgggaggaggtgcacaaggagttccagagcctgtctgtgttcatcgacagcatccccaagaagatcaggaagcagaggctggaggaggagatgaagcagctggagcatgacatcggcatcatcgagaagcacaagatcatctacatcgccaacaagtag

SEQ ID NO: 38220 - DNA, 771 bp, Artificial Sequence; identical to SEQ ID NO: 38218
  Description of Artificial Sequence: Synthetic coding sequence

SEQ ID NO: 38221 - DNA, 1305 bp, Artificial Sequence
  Description of Artificial Sequence: Synthetic coding sequence
atgagcattgagaagatctgggcccgggagatcctggacagccggggcaaccccaccgtggaggtggacctgtacacagccaagggcctcttccgggctgctgtgcccagcggggccagcacaggcatctatgaggccctggagctgagagatggagacaagcagcgctacctgggcaagggcgtgctgaaggctgtggaccacatcaacagcaccatcgccccagccctgatcagcagcggcctgtctgtggtggagcaggagaagctggacaacctgatgctggagctggatggaacagagaacaagagcaagtttggagccaatgccatcctgggcgtgtccctggccgtgtgcaaggccggggctgctgagcgggagctgcccctgtaccgccacatcgcccagctggccggcaacagcgacctgatcctgcctgtgcctgccttcaacgtcatcaatggaggcagccatgctggcaacaagctggccatgcaggagttcatgatcctgcctgtgggcgctgagagcttcagagatgccatgaggctgggcgctgaggtgtaccacaccctgaagggcgtcatcaaggacaagtatggcaaggatgccaccaacgtgggagatgaaggaggctttgcccccaacatcctggagaacagcgaggccctggagctggtgaaggaggccatcgacaaggccggctacacagagaagatcgtcatcggcatggatgtggccgccagcgagttctacagagatggcaagtatgacctggacttcaagagccccacagaccccagccgctacatcaccggggaccagctgggcgccctgtaccaggactttgtgcgggactaccctgtggtgtccattgaggacccctttgaccaggatgactgggccgcctggagcaagttcaccgccaacgtgggcatccagatcgtgggagatgacctgactgtgaccaaccccaagagaattgaaagagctgtggaggagaaggcctgcaactgcctgctgctgaaggtgaaccagatcggctctgtgacagaggccatccaggcctgcaagctggcccaggagaatggctggggcgtgatggtgagccacaggtctggagaaacagaggacaccttcatcgctgacctggtggtgggcctgtgcaccggccagatcaagacaggagccccctgccgctctgagcggctggccaagtacaaccagctgatgagaattgaggaggagctgggagatgaggccaggtttgctggccacaacttcaggaaccccagcgtgctgtag

SEQ ID NO: 38222 - DNA, 1887 bp, Artificial Sequence
  Description of Artificial Sequence: Synthetic coding sequence
atggaggaggagggcggcggccgcagctgtggcaccacccgggagctgcagaagctgaagcagcaggccatggagtactacagagaaaatgatgtgccccggcggctggaggagctgctgaacagcaccttctacctgcagcctgcagatgtgtatggccacctgaaggccaactgcttcagcaagctggccaagccacccaccatctgcaagatcgtgggcaaggatgtgctggatggcctgggcctgcccaccctgcaggtggacatcttctgcaccatccagaacttccccaagaatgtgtgcagcgtggtgatcagcacccactttgaggtgcatgaaaatgccctgcctgagctggccaaggccgaggaggccgagcgggccagcgctgtgtccacagctgtgcagtgggtgaacagcaccatcacccatgagctgcagggcatggcccccagcgaccaggccgaggtggaccacctgctgcgcatcttctttgccagcaaggtgcaggaggacaagggcaggaaggagctggagaagagcctggagtacagcacagtgcccacccccctgccccctgtgcccccacctcctcctcctcctccacccaccaagaagaagggccagaagccaggcaggaaggacaccatcacagagaagcccatcgccccagctgagcctgtggagcctgtgctgagcggctccatggccatcggggctgtgtccctggccgtggccaaggcctgtgccatgctgctgaacaagcccctgtacctgaacatcgccctgctgaagcacaaccaggagcagcccaccaccctgtccatgcccctgctgatggtgtccctggtgtcctgtgggaagagcagcagcggcaagctgaacctgatgaaggaggtgatctgcatcccccaccctgagctgaccaccaagcagggcgtggagatgctgatggagatgcagaagcacatcaacaagatcatcgagatggtgagccccagcccccccaaggccgagaccaagaagggccatgatggcagcaagaggggccagcagcagatcaccgggaagatgagccacctgggctgcctgaccatcaactgtgacagcattgagcagcccctgctgctgatccaggagatctgtgccaacctgggcctggagctgggcaccaacctgcacctggccatcaactgtgccggccacgagctgatggactacaacaagggcaagtatgaagtcatcatgggcacctacaagaatgctgctgagatggtggacctgtatgtggacctgatcaacaagtaccccagcatcatcgccctgattgaccccttcaggaaggaggacagcgagcagtgggacagcatctaccacgccctgggcagccgctgctacatcatcgccggcacagccagcaagagcatcagcaagctgctggagcagggcaacatcagcatccccaagagcaatggcctcatcatcaagcacaccaaccagaccaccatgtctgacctggtggagatcaccaacctgattgacagcaagaagcacatcaccgtgtttggcagcacagaaggagagagcagtgatgacagcctggtggacctggccgtgggcctgggcgtgcgcttcatcaagctgggcggcctgagcagaggagagcgggtgaccaagtacaaccggctgctgaccatcgaggaggagctggtgcagaatggcaccctgggcttcaaggaggagcacaccttcttctacttcaatgaggaggccgagaaggctgctgaggccctggaggccgctgctgcccgggagcccctggtgcccaccttccccacccagggcgtggaggagagcgctgagactggagccagcagtggatag

SEQ ID NO: 38223 - DNA, 1824 bp, Artificial Sequence
  Description of Artificial Sequence: Synthetic coding sequence
atggccttccggcggcaggtgaagaactttgtgaagaactacagtgatgctgagatcaaggtgcgggaggccaccagcaatgacccctggggccccagcagcagcctgatgctggacatcagtgacctgaccttcaacaccatcagcctgtctgagatcatgaacatgctgtggcaccggctgaatgaccacggcaagaactggaggcatgtgtacaagagcctgaccctgatggactacctgatcaagaatggcagcaagaaggtgatccagcactgccgggagggcttctgcaacctgcagaccctgaaggacttccagcacattgatgaggccggcaaggaccagggctactacatccgggagaagagcaagcaggtgatcaccctgctgatggatgagcccctgctgtgcaaggagcgggaggtggcctgcaggacccggcagaggaccagccacagcatcctcttcagcaagaggcagctgggcagcagcaacagcctgacagcctgcaccagcgcccccaccccagacatcagcgccagcgagaagaagtacaagctgcccaagtttggccgcctgcacaacaagagaaatgtgtgcaaggccggcctgaagcaggagcactgccaggatgtgcacctgcccacagagaccatgctgagccaggagaccctgcccctgaagatccacggctggaagagcacagaggacctgatgaccttcctggatgatgatcctgagctgcccctgctggccaccccacccagcatcgtgagccccatcacctgcctgtctgaggccgaggaggtgtgcaacctgtctggagcagatgctgtgcccaccctgtctgagaacagccccagcggccagagagatgtgtccctggacaagagaagtgatggcatcttcaccaacacagtgacagagaacctgctggagacccccctggagaagcagagcgctgctgagggcctgaagaccctgaccatcctgcctgcctgctggagcagcaaggaggagttcatcagcccagacctgcgggtgtccaagagtgacagcaccttccacaaccaggcctctgtggagaccctgtgcctgagccccagcttcaagatctttgacagagtgaaggagatcgtcatcaacaaggcctaccagaagccagcccagagcagcatccagatggatgacaagatcctgaagaccaccaccagggtgtccacagccagcgagggcgccagcagcttcagccccctgtccatgagcagcccagacctggccagccctgagaagagcgcccacctgctgagccccatcctggccggccccagcttctggaccctgagccaccagcagctgagcagcaccagcttcaaggatgaggacaagacagccaagctgcaccacagctttgccagccggggccctgtgtccagtgatgtggaggagaatgacagcctgaacctgctgggcatcctgcccaacaacagcgacagcgccaagaagaacatcagccacatcagcagcagccactggggcgagttcagcacccagaatgtggaccagttcatccccctgagctgcagcggcttccagagcaccaaggacttcccccaggagcctgaggccaagaacagcatctctgtgctgctgcgggaggtgaagagggccatcgcccggctgcacgaggacctgagcaccgtcatccaggagctgaatgtcatcaacaacatcctgatgtccatgagcctgaacagcagccagatcagccagagcagccaggtgccccagagcagcgagggcagcagtgaccagatctag

SEQ ID NO: 38224 - DNA, 906 bp, Artificial Sequence
  Description of Artificial Sequence: Synthetic coding sequence
atgcaggccagcgctgaccaggtggagcgggacatcctggagacccagaagaggctgcagcaggaccggctgaacagcgagcagagccaggccctgcagcaccagcaggagaccggcagcagcctgaaggaggccgaggtgctgctgaaggacctcttcctggatgtggacaaggcccggcggctgaagcacccccaggccgaggagacagagaaggacatcgagcagctgcacgagcgggtgacccaggagtgtgccgagtactgtgccctgtatgagaagatggtgctgcccccccggcggggcatccagggccgcctgggcaccagggctggagctgagacagaagctggcctgcggcggcctgtgtgggccggccatggaggagctgggggcacagacagaggagcccagcacagagctgagggggaccagaggccccggcgggctgctgctgagcccggcggggccggctgccgccaccaccctgagcccatcccccggcccacagagggcggcgtggtggcccgggcagagcccggccagcctgtgcacgccctgcagggctgcacctggcagctgagcgccctggccgagcagcagaggcgcatcctgcagcaggactggagcgacctgatggctgaccctgctggggtgcggcgggagtatgagcacttcaagcagcacgagctgctgagccaggagcagagcgtgaaccagctggaggaggatggcaagaggatggtggagctgcggcaccctgctgtgggccccatccaggcccaccaggaggccctgaagatggagtggcagaacttcctgaacctgtgcatctgccaggagacccagctgcagcacgtggaggactacagccgcatcctgtgccccagcagcagcccccactag

SEQ ID NO: 38225 - DNA, 1038 bp, Artificial Sequence
  Description of Artificial Sequence: Synthetic coding sequence
atgcagcacgtgagcagcagccagagcagccagagacatgtgcagtggccaggggcctgccctggagctggggaggagcagcctgcctgcagccagcccagcctgcccctgaccctgcccagccccagccaccagctgcagcagctgatggatggcagcggcctgacccagatcgcccagggcgcccaggtgcagctgcagcaccctggcacccccatcaccgtgcgggagcggcggcccagccagccccacacccagagcggcggcaccatccaccacctgggcccccagagccctgctgctgctgggggcgccggcctgcagcccctggccagccccagccacatcaccacagccaacctgcccccccagccccggcccctgggctttgagaggaccccaggagtgctgctgcctggagctggaggagctgctggcttcggcatgaccagccccccaccacccaccagccccagcaggacagctgtgcccccaggcctgagcagcctgcccctgacctctgtgggcaacacaggcatgaagaaggtgcccaagaagctggaggagatccccccagccagccctgagatggcccagatgaggaagcagtgcctggactaccaccaccaggagatgcaggccctgaaggaggtgttcaaggagtacctgattgagctgttcttcctgcagcacttccagggcaacatgatggacttcctggccttcaaggagcggctgtatggccccctgcaggcctacctgcggcagaatgacctggacatcgaggaggaggaggaggagcactttgaagtcatcaatgatgaggtgaaggtggtggccaggaagcacggccagcccggcacccctgtggccatcgccacccagctgccccccaggaccagcgctgccttccctgcccagcagcagcccctgcagcccctggcccccaccaccgtgctgtctgtgtctgctgactggaatgccctgctgcagaggcccaacaagtacatctggggcctgcagtacctggagatgtag

SEQ ID NO: 38226 - DNA, 1467 bp, Artificial Sequence
  Description of Artificial Sequence: Synthetic coding sequence
atgcagcacgtgagcagcagccagagcagccagagacatgtgcagtggccaggggcctgccctggagctggggaggagcagcctgcctgcagccagcccagcctgcccctgaccctgcccagccccagccaccagctgcagcagctgatggtgcggggcggccctgctgggggccagaacatgaatgtggacctgcagggcgtgggccctggcctgcagggcagcccccaggtgaccctggcccccctgcccctgcccagccccaccagccctggcttccagttcagcgcccagcccaggagatttgagcacggcagccccagctacatccaggtgaccagccccctgagccagcaggtgcagacccagagccccacccagcccagccctggccctggccaggccctgcagaatgtgcgggccggggcccctggccctggcctgggcctgtgcagcagcagccccaccggggactttgtggatgcctctgtgctggtgcggcagatcagcctgagccccagcagcggcggccactttgtgttccaggacggcagcggcctgacccagatcgcccagggcgcccaggtgcagctgcagcaccctggcacccccatcaccgtgcgggagcggcggcccagccagccccacacccagagcggcggcaccatccaccacctgggcccccagagccctgctgctgctgggggcgccggcctgcagcccctggccagccccagccacatcaccacagccaacctgcccccccagatcagcagcatcatccagggccagctggtgcagcagcagcaggtgctgcagggcccccccctgccccggcccctgggctttgagaggaccccaggagtgctgctgcccggggccggcggggccgccggcttcggcatgaccagccccccaccacccaccagccccagcaggacagctgtgcccccaggcctgagcagcctgcccctgacctctgtgggcaacacaggcatgaagaaggtgcccaagaagctggaggagatccccccagccagccctgagatggcccagatgaggaagcagtgcctggactaccaccaccaggagatgcaggccctgaaggaggtgttcaaggagtacctgattgagctgttcttcctgcagcacttccagggcaacatgatggacttcctggccttcaaggagcggctgtatggccccctgcaggcctacctgcggcagaatgacctggacatcgaggaggaggaggaggagcactttgaggtgatcaatgatgaggtgaaggtggtggccaggaagcacggccagcccggcacccctgtggccatcgccacccagctgccccccaggaccagcgctgccttccctgcccagcagcagcccctgcagcagatccacatgggcacccctgtgcctggagatgtgaacagcatcaagatggaggccagcaagaggcagtag

SEQ ID NO: 38227 - DNA, 1260 bp, Artificial Sequence
  Description of Artificial Sequence: Synthetic coding sequence
atgcagcacgtgagcagcagccagagcagccagagacatgtgcagtggccaggggcctgccctggagctggggaggagcagcctgcctgcagccagcccagcctgcccctgaccctgcccagccccagccaccagctgcagcagctgatggtgcagacccagagccccacccagcccagccctggccctggccaggccctgcagaatgtgcgggccggggcccctggccctggcctgggcctgtgcagcagcagccccactggagactttgtggatgcctctgtgctggtgcggcagatcagcctgagccccagcagcggcggccactttgtgttccaggacggcagcggcctgacccagatcgcccagggcgcccaggtgcagctgcagcaccctggcacccccatcaccgtgcgggagcggcggcccagccagccccacacccagagcggcggcaccatccaccacctgggcccccagagccctgctgctgctggaggagctggcctgcagcccctggccagccccagccacatcaccacagccaacctgcccccccagatcagcagcatcatccagggccagctggtgcagcagcagcaggtgctgcagggcccccccctgccccggcccctgggctttgagaggaccccaggagtgctgctgcctggagctggaggagctgctggcttcggcatgaccagccccccaccacccaccagccccagcaggacagctgtgcccccaggcctgagcagcctgcccctgacctctgtgggcaacacaggcatgaagaaggtgcccaagaagctggaggagatccccccagccagccctgagatggcccagatgaggaagcagtgcctggactaccaccaccaggagatgcaggccctgaaggaggtgttcaaggagtacctgattgagctgttcttcctgcagcacttccagggcaacatgatggacttcctggccttcaaggagcggctgtatggccccctgcaggcctacctgcggcagaatgacctggacatcgaggaggaggaggaggagcactttgaagtcatcaatgatgaggtgaaggtggtggccaggaagcacggccagcccggcacccctgtggccatcgccacccagctgccccccaggaccagcgctgccttccctgcccagcagcagcccctgcaggtgctgagtgatggcagcacagtgcagctgccccggctgagcagcctgggctttgaagattccatgtgctag

SEQ ID NO: 38228 - DNA, 1071 bp, Artificial Sequence
  Description of Artificial Sequence: Synthetic coding sequence
atgcagcacgtgagcagcagccagagcagccagagacatgtgcagtggccaggggcctgccctggagctggggaggagcagcctgcctgcagccagcccagcctgcccctgaccctgcccagccccagccaccagctgcagcagctgatggatggcagcggcctgacccagatcgcccagggcgcccaggtgcagctgcagcaccctggcacccccatcaccgtgcgggagcggcggcccagccagccccacacccagagcggcggcaccatccaccacctgggcccccagagccctgctgctgctgggggcgccggcctgcagcccctggccagccccagccacatcaccacagccaacctgcccccccagatcagcagcatcatccagggccagctggtgcagcagcagcaggtgctgcagggcccccccctgccccggcccctgggctttgagaggaccccaggagtgctgctgcccggggccggcggggccgccggcttcggcatgaccagccccccaccacccaccagccccagcaggacagctgtgcccccaggcctgagcagcctgcccctgacctctgtgggcaacacaggcatgaagaaggtgcccaagaagctggaggagatccccccagccagccctgagatggcccagatgaggaagcagtgcctggactaccaccaccaggagatgcaggccctgaaggaggtgttcaaggagtacctgattgagctgttcttcctgcagcacttccagggcaacatgatggacttcctggccttcaaggagcggctgtatggccccctgcaggcctacctgcggcagaatgacctggacatcgaggaggaggaggaggagcactttgaggtgatcaatgatgaggtgaaggtggtggccaggaagcacggccagcccggcacccctgtggccatcgccacccagctgccccccaggaccagcgctgccttccctgcccagcagcagcccctgcaggtgctgagtgatggcagcacagtgcagctgccccggctgagcagcctgggctttgaggacagcatgtgctag

SEQ ID NO: 38229 - DNA, 654 bp, Artificial Sequence
  Description of Artificial Sequence: Synthetic coding sequence
atgcagcacgtgagcagcagccagagcagccagagacatgtgcagtggccaggggcctgccctggagctggggaggagcagcctgcctgcagccagcccagcctgcccctgaccctgcccagccccagccaccagctgcagcagctgatggatggcagcggcctgacccagatcgcccagggcgcccaggtgcagctgcagcaccctggcacccccatcaccgtgcgggagcggcggcccagccagccccacacccagagcggcggcaccatccaccacctgggcccccagagccctgctgctgctgggggcgccggcctgcagcccctggccagccccagccacatcaccacagccaacctgcccccccagatcagcagcatcatccagggccagctggtgcagcagcagcaggtgctgcagggcccccccctgccccggcccctgggctttgagaggaccccaggagtgctgctgcccggggccggcggggccgccggcttcggcatgaccagccccccaccacccaccagccccagcaggacagctgtgcccccaggcctgagcagcctgcccctgacctctgtgggcaacacaggcatgaagaaggtgcccaagaagctggaggagatccccccagccagccctgagtag

SEQ ID NO: 38230 - DNA, 1071 bp, Artificial Sequence; identical to SEQ ID NO: 38228
  Description of Artificial Sequence: Synthetic coding sequence

SEQ ID NO: 38231 - DNA, 672 bp, Artificial Sequence
  Description of Artificial Sequence: Synthetic coding sequence
atgcagcacgtgagcagcagccagagcagccagagacatgtgcagtggccaggggcctgccctggagctggggaggagcagcctgcctgcagccagcccagcctgcccctgaccctgcccagccccagccaccagctgcagcagctgatggtgcagacccagagccccacccagcccagccctggccctggccaggccctgcagaatgtgcgggccggggcccctggccctggcctgggcctgtgcagcagcagccccactggagactttgtggatgcctctgtgctggtgcggcagatcagcctgagccccagcagcggcggccactttgtgttccaggacggcagcggcctgacccagatcgcccagggcgcccaggtgcagctgcagcaccctggcacccccatcaccgtgcgggagcggcggcccagccagccccacacccagagcggcggcaccatccaccacctgggcccccagagccctgctgctgctggaggagctggcctgcagcccctggccagccccagccacatcaccacagccaacctgcccccccagatcagcagcatcatccagggccagctggtgcagcagcagcaggtgctgcagggcccccccctgccccggcccctgggctttgagaggaccccaggagtgctgctgccctag

SEQ ID NO: 38232 - DNA, 471 bp, Artificial Sequence
  Description of Artificial Sequence: Synthetic coding sequence
atgcagcacgtgagcagcagccagagcagccagagacatgtgcagtggccaggggcctgccctggagctggggaggagcagcctgcctgcagccagcccagcctgcccctgaccctgcccagccccagccaccagctgcagcagctgatggtgcagacccagagccccacccagcccagccctggccctggccaggccctgcagaatgtgcgggccggggcccctggccctggcctgggcctgtgcagcagcagccccactggagactttgtggatgcctctgtgctggtgcggcagatcagcctgagccccagcagcggcggccactttgtgttccaggacggcagcggcctgacccagatcgcccagggcgcccaggtgcagctgcagcaccctggcacccccatcaccgtgcgggagcggcggcccagccagccccacacccagagcggcggcaccatccaccactag

SEQ ID NO: 38233 - DNA, 3393 bp, Artificial Sequence
  Description of Artificial Sequence: Synthetic coding sequence
atgcagttccccagccccccagctgcccggagcagccctgccccccaggccgccagcagcagcgaggccgccgccccagccaccggccagcccggccccagctgccctgtgcccggcaccagccggcggggccggcccggcaccccacctgctggccgggtggaggaggaggaggaggaggaggaggaggatgtggacaaggacccccaccccacccagaacacctgcctgcgctgccgccacttcagcctgcgggagaggaagcgggagcccaggaggaccatgggcggctgtgaggtgcgggagttcctgctgcagtttggcttcttcctgcccctgctgacagcctggccaggggactgcagccacgtgagcaacaaccaggtggtgctgctggacaccaccaccgtgctgggggagctgggctggaagacctaccccctgaatggctgggatgccatcacagagatggatgagcacaaccggcccatccacacctaccaggtgtgcaatgtgatggagcccaaccagaacaactggctgcggaccaactggatcagcagagatgctgcccagaagatctacgtggagatgaagttcaccctgcgggactgcaacagcatcccctgggtgctgggcacctgcaaggagaccttcaacctcttctacatggagagtgatgagagccacggcatcaagttcaagcccaaccagtacaccaagattgacaccatcgctgctgatgagagcttcacccagatggacctgggggaccgcatcctgaagctgaacacagagatccgggaggtgggccccattgaaaggaagggcttctacctggccttccaggacattggagcctgcatcgccctggtgtctgtgcgggtcttctacaagaagtgccccttcaccgtgaggaacctggccatgtttcctgacaccatcccccgggtggacagcagcagcctggtggaggtgcggggcagctgtgtgaagtctgctgaggagcgggacacccccaagctgtactgtggggctgatggagactggctggtgcccctgggccgctgcatctgcagcacaggctatgaggagattgagggcagctgccacgcctgcaggcctggcttctacaaggcctttgctggcaacaccaagtgcagcaaatgtcctccccacagcctgacctacatggaggccacctctgtgtgccagtgtgagaagggctacttccgggcagagaaggaccccccatccatggcctgcaccaggcctccttctgcccccagaaatgtggtgttcaacatcaatgaaacagccctgatcctggagtggagccccccaagtgacacaggaggcaggaaggacctgacctacagcgtcatctgcaagaagtgtggcctggacaccagccagtgtgaggactgtggcggcggcctgcgcttcatccccaggcacacaggcctcatcaacaacagcgtgattgtgctggactttgtgagccacgtgaactacacctttgaaattgaggccatgaatggagtgtctgagctgtccttcagccccaagcccttcaccgccatcaccgtgaccacagaccaggatgcccccagcctcatcggcgtggtgaggaaggactgggccagccagaacagcatcgccctgtcctggcaggccccagccttcagcaatggagccatcctggactatgagatcaagtactatgagaaggagcacgagcagctgacctacagcagcaccaggagcaaggcccccagcgtcatcatcaccggcctgaagccagccaccaagtatgtgttccacatccgggtgaggacagccaccggctacagcggctacagccagaagtttgaatttgaaacaggagatgagaccagtgacatggctgctgagcagggccagatcctggtgattgccacagctgctgtgggcggcttcaccctgctggtgatcctgaccctcttcttcctgatcaccggccgctgccagtggtacatcaaggccaagatgaagtctgaggagaagagaagaaaccacctgcagaatggccacctgcgcttccctggcatcaagacctacattgatcctgacacctatgaggaccccagcctggccgtgcatgaatttgccaaggagattgaccccagccgcatcagaattgagcgggtgattggagctggggagtttggagaggtgtgcagcggccgcctgaagaccccaggcaagcgggagatccctgtggccatcaagaccctgaagggcggccacatggaccggcagaggcgggacttcctgcgggaggccagcatcatgggccagtttgaccaccccaacatcatccggctggagggcgtggtgaccaagaggagcttccctgccatcggcgtggaggccttctgccccagcttcctgcgggccggcttcctgaacagcatccaggccccccaccctgtgcctgggggcggcagcctgcccccacgcatcccagctggccggcctgtgatgattgtggtggagtacatggagaatggcagcctggacagcttcctgaggaagcatgatggccacttcaccgtcatccagctggtgggcatgctgcggggcatcgccagcggcatgaagtacctgagtgacatgggctacgtgcaccgggacctggccgccaggaacatcctggtgaacagcaacctggtgtgcaaggtgtctgactttggcctgagccgggtgctggaggatgatcctgaggccgcctacaccaccaccggcggcaagatccccatccgctggacagcccctgaggccatcgcctacaggaagttcagcagcgccagtgatgcctggagctatggcatcgtgatgtgggaggtgatgtcctatggagagcggccctactgggagatgagcaaccaggacgtcatcctgagcattgaggagggctaccgcctgcctgcccccatgggctgcccagccagcctgcaccagctgatgctgcactgctggcagaaggagaggaaccaccggcccaagttcacagacatcgtgtccttcctggacaagctgatccggaaccccagcgccctgcacaccctggtggaggacatcctggtgatgcctgagagccctggagaggtgcctgagtaccccctgtttgtgacagtgggggactggctggacagcatcaagatgggccagtacaagaacaactttgtggccgccggcttcaccacctttgacctgatcagcaggatgagcattgatgacatccgccgcatcggggtcatcctgattggccaccagaggagaattgtgagcagcatccagaccctgcggctgcacatgatgcacatccaggagaagggcttccacgtgtag

SEQ ID NO: 38234 - DNA, 726 bp, Artificial Sequence
  Description of Artificial Sequence: Synthetic coding sequence
atggctgctgagcagggccagatcctggtgattgccacagctgctgtgggcggcttcaccctgctggtgatcctgaccctcttcttcctgatcaccggccgctgccagtggtacatcaaggccaagatgaagtctgaggagaagagaagaaaccacctgcagaatggccacctgcgcttccctggcatcaagacctacattgatcctgacacctatgaggaccccagcctggccgtgcatgaatttgccaaggagattgaccccagccgcatcagaattgagcgggtgattggagctggggagtttggagaggtgtgcagcggccgcctgaagaccccaggcaagcgggagatccctgtggccatcaagaccctgaagggcggccacatggaccggcagaggcgggacttcctgcgggaggccagcatcatgggccagtttgaccaccccaacatcatccggctggagggcgtggtgaccaagaggagcttccctgccatcggcgtggaggccttctgccccagcttcctgcgggccggcttcctgaacagcatccaggccccccaccctgtgcctgggggcggcagcctgcccccacgcatcccagctggccggcctgtgatgattgtggtggagtacatggagaatggcagcctggacagcttcctgcggctgtaccccaaggccgagtacaacgggaagcagtgcagccgctacagcatctag

SEQ ID NO: 38235 - DNA, 1005 bp, Artificial Sequence
  Description of Artificial Sequence: Synthetic coding sequence
atgaaggacagccccttccaggtgaccaagctgtactggctgaatgagaagtgggacttcatcgccagcgccagtgacatggctgctgagcagggccagatcctggtgattgccacagctgctgtgggcggcttcaccctgctggtgatcctgaccctcttcttcctgatcaccggccgctgccagtggtacatcaaggccaagatgaagtctgaggagaagagaagaaaccacctgcagaatggccacctgcgcttccctggcatcaagacctacattgatcctgacacctatgaggaccccagcctggccgtgcatgaatttgccaaggagattgaccccagccgcatcagaattgagcgggtgattggagctggggagtttggagaggtgtgcagcggccgcctgaagaccccaggcaagcgggagatccctgtggccatcaagaccctgaagggcggccacatggaccggcagaggcgggacttcctgcgggaggccagcatcatgggccagtttgaccaccccaacatcatccggctggagggcgtggtgaccaagaggagcttccctgccatcggcgtggaggccttctgccccagcttcctgcgggccggcttcctgaacagcatccaggccccccaccctgtgcctgggggcggcagcctgcccccacgcatcccagctggccggcctgtgatgattgtggtggagtacatggagaatggcagcctggacagcttcctgaggaagcatgatggccacttcaccgtcatccagctggtgggcatgctgcggggcatcgccagcggcatgaagtacctgagtgacatgggctacgtgcaccgggacctggccgccaggaacatcctggtgaacagcaacctggtgtgcaaggtgtctgactttggcctgagccgggtgctggaggatgatcctgaggccgcctacaccaccacagacctcttccagaccctgaccctgaacctgtgctacagcgcctag

SEQ ID NO: 38236 - DNA, 858 bp, Artificial Sequence
  Description of Artificial Sequence: Synthetic coding sequence
atgggcggctgtgaggtgcgggagttcctgctgcagtttggcttcttcctgcccctgctgacagcctggccaggggactgcagccacgtgagcaacaaccaggtggtgctgctggacaccaccaccgtgctgggggagctgggctggaagacctaccccctgaatggctgggatgccatcacagagatggatgagcacaaccggcccatccacacctaccaggtgtgcaatgtgatggagcccaaccagaacaactggctgcggaccaactggatcagcagagatgctgcccagaagatctacgtggagatgaagttcaccctgcgggactgcaacagcatcccctgggtgctgggcacctgcaaggagaccttcaacctcttctacatggagagtgatgagagccacggcatcaagttcaagcccaaccagtacaccaagattgacaccatcgctgctgatgagagcttcacccagatggacctgggggaccgcatcctgaagctgaacacagagatccgggaggtgggccccattgaaaggaagggcttctacctggccttccaggacattggagcctgcatcgccctggtgtctgtgcgggtcttctacaagaagtgccccttcaccgtgaggaacctggccatgtttcctgacaccatcccccgggtggacagcagcagcctggtggaggtgcggggcagctgtgtgaagtctgctgaggagcgggacacccccaagctgtactgtggggctgatggagactggctggtgcccctgggccgctgcatctgcagcacaggctatgaggagattgagggcagctgccacggggccagcaagggccgctgcttctag

SEQ ID NO: 38237 - DNA, 7263 bp, Artificial Sequence
  Description of Artificial Sequence: Synthetic coding sequence
atgagcggccacaccctgccccccctgcctgtgcccggcaccaacagcacagagcaggcctctgtgccccgggccatggccgccaccctgggcgccggcaccccaccccggccccaggcccggagcattgctggggtgtatgtggaggccagcggccaggcccagagcgtgtatgctgccatggagcagggcctgctgcctgctggcctgggccaggccctgctggaggcccaggccgccactggaggcctggtggacctggcccggggccagctgctgcctgtgtccaaggccctgcagcagggcctggtgggcctggagctgaaggagaagctgctggccgctgagcgggccaccaccggctacccagacccctacggcggggagaagctggccctcttccaggccatcggcaaggaggtggtggaccgggccctgggccagagctggctggaggtgcagctggccactggaggcctggtggaccctgcccagggcgtgctggtggcccctgagcccgcctgccaccagggcctgctggaccgggagacctggcacaagctgtctgagctggagcccggcactggagacctgcgcttcctggaccccaacaccctggagcggctgacctaccaccagctgctggagcgctgtgtgcgggcccctggcagcggcctggccctgctgcccctgaagatcaccttccgctccatgggcggcgctgtgtctgctgctgagctgctggaggtgggcatcctggatgagcaggccgtgcagggcctgcgggagggccgcctggccgctgtggatgtgtctgcccgggcagaggtgcggcgctacctggagggcaccggctctgtggccggcgtggtgctgctgcctgagggccacaagaagagcttcttccaggccgccacagagcacctgctgcccatgggcacagccctgcccctgctggaggcccaggccgccacccacaccctggtggaccccatcaccggccagaggctgtgggtggatgaggccgtgcgggccggcctggtgtccccagagctgcacgagcagctgctggtggccgagcaggccgtgacaggccaccacgaccccttcagcggcagccagatccccctcttccaggccatgaagaagggcctggtggaccggcccctggccctgcggctgctggatgcccagctggccactggaggcctggtgtgcccagcccggcggctgcggctgcccctggaggccgccctgcgctgtggctgcctggatgaggacacccagaggcagctgagccaggccggcagcttcagtgatggcacccatggaggcctgcgctatgagcagctgctggccctgtgtgtgacagatcctgagaccggcctggccttcctgcccctgagcggcggcccccggggcggggagccccagggcccccccttcatcaagtacagcacccggcaggccctgagcacagccacagccaccgtgtctgtgggcaagttccggggccggcctgtgtccctgtgggagctgctcttcagcgaggccatcagcagcgagcagagggccatgctggcccagcagtaccaggagggcaccctgtctgtggagaagctggccgccaagctgagcgccaccctggagcaggccgccgccacagcccgggtgaccttcagcggcctgcgggacacagtgaccccaggagagctgctgaaggccgagatcatcgaccaggacctgtatgagcggctggagcacggccaggccacagccaaggatgtgggcagcctggcctctgtgcagcgctacctgcagggcaccggctgcatcgccggcctgctgctgcccggcagccaggagcggctgagcatctatgaggcccgctgcaagggcctgctgcggcctggaacagccctgatcctgctggaggcccaggccgccaccggcttcatcatcgaccccaaggccaacaagggccacagcgtggaggaggccctgcgggctgctgtgattggaccagatgtgtttgccaagctgctgtctgctgagagagctgtgacaggctacacagacccctacacaggccagcagatcagcctcttccaggccatgcagaagggcctgattgtgcgggagcacggcatccggctgctggaggcccagatcgccaccggcggcgtcatcgaccctgtgcacagccaccgggtgcctgtggatgtggcctacagaagaggctactttgaccagatgctgaacctgatcctgctggaccccagtgatgacaccaagggcttctttgaccccaacacccatgagaacctgacctacctgcagctgctggagcgctgtgtgcgggaccctgagaccggcctgtacctgctgcccctgagcagcacccagagccccctggtggacagcgccacccagcaggccttccagaacctgctgctgtctgtgaagtatggccgcttccagggccagagggtgtctgcctgggagctgatcaacagcgagtacttcagcgagggcagaagacggcagctgctgcggcgctaccggcagcgggaggtgaccctgggccaggtggccaagctgctggaggccgagacccagaggcaggccgacatcatgctgcctgccctgcggagccgggtgacagtgcaccagctgctggaggccggcatcatcgaccagcagctgctggaccaggtgctggccggcaccatcagccctgaggccctgctgctgatggatggagtgcggcgctacctgtgtggcctgggcgctgtgggcggcgtgcggctgctgcccagcggccagaggctgagcctgtaccaggccatgaggcagaagctgctgggcccccgggtggccctggccctgctggaggcccaggccgccaccggcaccatcatggacccccacagccctgagagcctgtctgtggatgaagctgtgagaagaggagtggtgggccctgagctgtatggccgcctgaagagagctgagggcgccatcgccggcttccgggaccccttcagcggcaagcaggtgtctgtgttccaggccatgaagaagggcctcatcccctgggagcaggccgcccggctgctggaggcccaggtggccaccggcggcatcatcgaccccaccagccaccaccacctgcccatgcctgtggccatccagaggggctacgtggaccaggagatggagacagccctgagcagcagcagcgagaccttccccaccccagatggccagggccgcaccagctatgcccagctgctggaggagtgccccagagatgagaccagcggcctgcacctgctgcccctgcctgagagcgccccagccctgcccacagaggagcaggtgcagaggagcctgcaggccgtgcctggggccaaggatggcaccagcctgtgggacctgctgagcagctgccacttcacagaggagcagaggcggggcctgctggaggatgtgcaggagggccgcaccaccgtgccccagctgctggcctctgtgcagcgctgggtgcaggagaccaagctgctggcccaggcccgggtgatggtgcccggccccagaggagaggtgcctgctgtgtggctgctggatgctggcatcatcacccaggagaccctggaggccctggcccagggcacccagagccctgcccaggtggccgagcagcctgctgtgaaggcctgcctgtggggcaccggctgtgtggccggcgtgctgctgcagcccagcggggccaaggccagcatcgcccaggccgtgagagatggcctgctgcccaccggcctgggccagaggctgctggaggcccaggtggccagcggcttcctggtggaccccctgaacaaccagaggctgtctgtggaggatgctgtgaaggtgggcctggtgggccgggagctgtctgagcagctgggccaggccgagagagctgctgctggctacccagacccctacagccgggccagcctgagcctgtggcaggccatggagaagggcctggtgccccagaatgaaggcctgcccctgctgcaggtgcagctggccaccggcggcgtggtggaccctgtgcacggcgtgcacctgccccaggccgccgcctgccgcctgggcctgctggacacccagaccagccaggtgctgacagctgtggacaaggacaacaagttcttctttgaccccagcgcccgggaccaggtgacctaccagcagctgcgggagcgctgtgtgtgtgacagcgagaccggcctgctgctgctgcccctgcccagcgacacagtgctggaggtggatgaccacacagctgtggccctgcgggccatgaaggtgcctgtgtccacaggccgcttcaagggctgcagcgtgtccctgtgggacctgctgctgtctgaatatgtgggcgctgacaagagaagagagctggtggccctgtgccgcagcggccgggccgccgccctgcggcaggtggtgtctgctgtgaccaccctggtggaggccgctgagcggcagcccctgcaggccaccttccggggcctgaggaagcaggtgtctgcccgggacctcttccgggcccagctgatcagcaggaagaccctggatgagctgagccagggcaccaccaccgtgaaggaggtggccgagatggacagcgtgaagaggagcctggagggcggcaacttcatcgccggcgtgctgatccagggcacccaggagaggatgagcatccctgaggccctgcggcggcacatcctgcggcccggcacagccctggtgctgctggaggcccaggccgccaccggcttcatcattgatcctgtggagaacaggaagctgactgtggaggaggccttcaaggccggcatgtttgggaaggagacctacgtgaagctgctgtctgctgagagagctgtgacaggctacacagacccctacacaggccagcagatcagcctcttccaggccatgcagaaggacctgattgtgcgggagcacggcatccggctgctggaggcccagatcgccactggaggcatcattgatcctgtgcacagccaccgggtgcctgtggatgtggcctaccgctgtggctactttgatgaggagatgaaccgcatcctggccgaccccagtgatgacaccaagggcttctttgaccccaacacccatgagaacctgacctacctgcagctgctggagcgctgtgtggaggaccctgagaccggcctgtacctgctgcagatcatcaagaagggggagaactacgtgtacatcaatgaggccaccaggcatgtgctgcagagcaggacagccaagatgagggtgggccgctttgctgaccaggtggtgtccttctgggacctgctgagcagcccctacttcacagaggacaggaagcgggagctgatccaggagtatggagcccagagcggcggcctggagaagctgctggagatcatcaccaccaccatcgaggagacagagacccagaaccagggcatcaaggtggccgccatccggggggaggtgacagctgctgacctcttcaacagccgggtgattgaccagaagaccctgcacaccctgcgggtgggccgcactggaggccaggccctgagcaccctggagtgtgtgaagccctacctggagggcagcggctgcatcgccggcgtgacagtgcccagcacccgggaggtgatgagcctgcacgaggccagcaggaaggagctgatcccagctgcctttgccacctggctgctggaggcccaggccgccaccggcttcctgctggacccctgcacccggcagaagctgtctgtggatgaggccgtggatgtgggcctggtgaatgaggagctgcgggagcggctgctgaaggccgagcgggccgccaccggctacagagatcctgccactggagacaccatccccctcttccaggccatgcagaagcagctgattgagaaggccgaggccctgcggctgctggaggtgcaggtggccactggaggagtgattgacccccagcaccaccaccggctgcccctggagacagcctaccgccggggctgcctgcacaaggacatctatgccctgatcagtgaccagaagcacatgaggaagagatttgtggaccccaacacccaggagaaggtgtcctaccgggagctgcaggagcgctgccggccccaggaggacaccggctggctgctcttccctgtgaacaaggccgcccgggacagcgagcacattgatgatgagacccggcgggccctggaggccgagcaggtggagatcaccgtgggccgcttccggggccagaagcccaccctgtgggccctgctgaacagtgaatatgtgacagaggagaagaagctgcagctggtgaggatgtaccgcacccacacccggcgggccctgcagacagtggcccagctgatcctggagctgattgagaagcaggagaccagcaacaagcacctgtggttccagggcatccggcggcagatcacagccagcgagctgctgagcagcgccatcatcacagaggagatgctgcaggacctggagaccggccgcagcaccacccaggagctgatggaggatgacagagtgaagcgctacctggagggcaccagctgcatcgccggcgtgctggtgcctgccaaggaccagcccggccggcaggagaagatgagcatctaccaggccatgtggaagggcgtgctgcggcccggcacagccctggtgctgctggaggcccaggccgccactggatttgtgattgatcctgtgaggaacctgcggctgtctgtggaggaggccgtggccgccggcgtggtgggcggggagatccaggagaagctgctgtctgctgagagagctgtgacaggctacacagacccctacacaggccagcagatcagcctcttccaggccatgcagaaggacctgattgtgcgggagcacggcatccggctgctggaggcccagatcgccactggaggagtgattgatcctgtgcacagccaccgggtgcctgtggatgtggcctaccgccggggctactttgatgaggagatgaacagagtgctggccgaccccagtgatgacaccaagggcttctttgaccccaacacccatgagaacctgacctacctgcagctgctgcagagggccaccctggaccctgagaccggcctgctcttcctgagcctgagcctgcagtag

SEQ ID NO: 38238 - DNA, 15267 bp, Artificial Sequence
  Description of Artificial Sequence: Synthetic coding sequence
atgagcggccacaccctgccccccctgcctgtgcccggcaccaacagcacagagcaggcctctgtgccccgggccatggccgccaccctgggcgccggcaccccaccccggccccaggcccggagcattgctggggtgtatgtggaggccagcggccaggcccagagcgtgtatgctgccatggagcagggcctgctgcctgctggcctgggccaggccctgctggaggcccaggccgccactggaggcctggtggacctggcccggggccagctgctgcctgtgtccaaggccctgcagcagggcctggtgggcctggagctgaaggagaagctgctggccgctgagcgggccaccaccggctacccagacccctacggcggggagaagctggccctcttccaggccatcggcaaggaggtggtggaccgggccctgggccagagctggctggaggtgcagctggccactggaggcctggtggaccctgcccagggcgtgctggtggcccctgagcccgcctgccaccagggcctgctggaccgggagacctggcacaagctgtctgagctggagcccggcactggagacctgcgcttcctggaccccaacaccctggagcggctgacctaccaccagctgctggagcgctgtgtgcgggcccctggcagcggcctggccctgctgcccctgaagatcaccttccgctccatgggcggcgctgtgtctgctgctgagctgctggaggtgggcatcctggatgagcaggccgtgcagggcctgcgggagggccgcctggccgctgtggatgtgtctgcccgggcagaggtgcggcgctacctggagggcaccggctctgtggccggcgtggtgctgctgcctgagggccacaagaagagcttcttccaggccgccacagagcacctgctgcccatgggcacagccctgcccctgctggaggcccaggccgccacccacaccctggtggaccccatcaccggccagaggctgtgggtggatgaggccgtgcgggccggcctggtgtccccagagctgcacgagcagctgctggtggccgagcaggccgtgacaggccaccacgaccccttcagcggcagccagatccccctcttccaggccatgaagaagggcctggtggaccggcccctggccctgcggctgctggatgcccagctggccactggaggcctggtgtgcccagcccggcggctgcggctgcccctggaggccgccctgcgctgtggctgcctggatgaggacacccagaggcagctgagccaggccggcagcttcagtgatggcacccatggaggcctgcgctatgagcagctgctggccctgtgtgtgacagatcctgagaccggcctggccttcctgcccctgagcggcggcccccggggcggggagccccagggcccccccttcatcaagtacagcacccggcaggccctgagcacagccacagccaccgtgtctgtgggcaagttccggggccggcctgtgtccctgtgggagctgctcttcagcgaggccatcagcagcgagcagagggccatgctggcccagcagtaccaggagggcaccctgtctgtggagaagctggccgccaagctgagcgccaccctggagcaggccgccgccacagcccgggtgaccttcagcggcctgcgggacacagtgaccccaggagagctgctgaaggccgagatcatcgaccaggacctgtatgagcggctggagcacggccaggccacagccaaggatgtgggcagcctggcctctgtgcagcgctacctgcagggcaccggctgcatcgccggcctgctgctgcccggcagccaggagcggctgagcatctatgaggcccgctgcaagggcctgctgcggcctggaacagccctgatcctgctggaggcccaggccgccaccggcttcatcatcgaccccaaggccaacaagggccacagcgtggaggaggccctgcgggctgctgtgattggaccagatgtgtttgccaagctgctgtctgctgagagagctgtgacaggctacacagacccctacacaggccagcagatcagcctcttccaggccatgcagaagggcctgattgtgcgggagcacggcatccggctgctggaggcccagatcgccaccggcggcgtcatcgaccctgtgcacagccaccgggtgcctgtggatgtggcctacagaagaggctactttgaccagatgctgaacctgatcctgctggaccccagtgatgacaccaagggcttctttgaccccaacacccatgagaacctgacctacctgcagctgctggagcgctgtgtgcgggaccctgagaccggcctgtacctgctgcccctgagcagcacccagagccccctggtggacagcgccacccagcaggccttccagaacctgctgctgtctgtgaagtatggccgcttccagggccagagggtgtctgcctgggagctgatcaacagcgagtacttcagcgagggcagaagacggcagctgctgcggcgctaccggcagcgggaggtgaccctgggccaggtggccaagctgctggaggccgagacccagaggcaggccgacatcatgctgcctgccctgcggagccgggtgacagtgcaccagctgctggaggccggcatcatcgaccagcagctgctggaccaggtgctggccggcaccatcagccctgaggccctgctgctgatggatggagtgcggcgctacctgtgtggcctgggcgctgtgggcggcgtgcggctgctgcccagcggccagaggctgagcctgtaccaggccatgaggcagaagctgctgggcccccgggtggccctggccctgctggaggcccaggccgccaccggcaccatcatggacccccacagccctgagagcctgtctgtggatgaagctgtgagaagaggagtggtgggccctgagctgtatggccgcctgaagagagctgagggcgccatcgccggcttccgggaccccttcagcggcaagcaggtgtctgtgttccaggccatgaagaagggcctcatcccctgggagcaggccgcccggctgctggaggcccaggtggccaccggcggcatcatcgaccccaccagccaccaccacctgcccatgcctgtggccatccagaggggctacgtggaccaggagatggagacagccctgagcagcagcagcgagaccttccccaccccagatggccagggccgcaccagctatgcccagctgctggaggagtgccccagagatgagaccagcggcctgcacctgctgcccctgcctgagagcgccccagccctgcccacagaggagcaggtgcagaggagcctgcaggccgtgcctggggccaaggatggcaccagcctgtgggacctgctgagcagctgccacttcacagaggagcagaggcggggcctgctggaggatgtgcaggagggccgcaccaccgtgccccagctgctggcctctgtgcagcgctgggtgcaggagaccaagctgctggcccaggcccgggtgatggtgcccggccccagaggagaggtgcctgctgtgtggctgctggatgctggcatcatcacccaggagaccctggaggccctggcccagggcacccagagccctgcccaggtggccgagcagcctgctgtgaaggcctgcctgtggggcaccggctgtgtggccggcgtgctgctgcagcccagcggggccaaggccagcatcgcccaggccgtgagagatggcctgctgcccaccggcctgggccagaggctgctggaggcccaggtggccagcggcttcctggtggaccccctgaacaaccagaggctgtctgtggaggatgctgtgaaggtgggcctggtgggccgggagctgtctgagcagctgggccaggccgagagagctgctgctggctacccagacccctacagccgggccagcctgagcctgtggcaggccatggagaagggcctggtgccccagaatgaaggcctgcccctgctgcaggtgcagctggccaccggcggcgtggtggaccctgtgcacggcgtgcacctgccccaggccgccgcctgccgcctgggcctgctggacacccagaccagccaggtgctgacagctgtggacaaggacaacaagttcttctttgaccccagcgcccgggaccaggtgacctaccagcagctgcgggagcgctgtgtgtgtgacagcgagaccggcctgctgctgctgcccctgcccagcgacacagtgctggaggtggatgaccacacagctgtggccctgcgggccatgaaggtgcctgtgtccacaggccgcttcaagggctgcagcgtgtccctgtgggacctgctgctgtctgaatatgtgggcgctgacaagagaagagagctggtggccctgtgccgcagcggccgggccgccgccctgcggcaggtggtgtctgctgtgaccaccctggtggaggccgctgagcggcagcccctgcaggccaccttccggggcctgaggaagcaggtgtctgcccgggacctcttccgggcccagctgatcagcaggaagaccctggatgagctgagccagggcaccaccaccgtgaaggaggtggccgagatggacagcgtgaagaggagcctggagggcggcaacttcatcgccggcgtgctgatccagggcacccaggagaggatgagcatccctgaggccctgcggcggcacatcctgcggcccggcacagccctggtgctgctggaggcccaggccgccaccggcttcatcattgatcctgtggagaacaggaagctgactgtggaggaggccttcaaggccggcatgtttgggaaggagacctacgtgaagctgctgtctgctgagagagctgtgacaggctacacagacccctacacaggccagcagatcagcctcttccaggccatgcagaaggacctgattgtgcgggagcacggcatccggctgctggaggcccagatcgccactggaggcatcattgatcctgtgcacagccaccgggtgcctgtggatgtggcctaccgctgtggctactttgatgaggagatgaaccgcatcctggccgaccccagtgatgacaccaagggcttctttgaccccaacacccatgagaacctgacctacctgcagctgctggagcgctgtgtggaggaccctgagaccggcctgtacctgctgcagatcatcaagaagggggagaactacgtgtacatcaatgaggccaccaggcatgtgctgcagagcaggacagccaagatgagggtgggccgctttgctgaccaggtggtgtccttctgggacctgctgagcagcccctacttcacagaggacaggaagcgggagctgatccaggagtatggagcccagagcggcggcctggagaagctgctggagatcatcaccaccaccatcgaggagacagagacccagaaccagggcatcaaggtggccgccatccggggggaggtgacagctgctgacctcttcaacagccgggtgattgaccagaagaccctgcacaccctgcgggtgggccgcactggaggccaggccctgagcaccctggagtgtgtgaagccctacctggagggcagcggctgcatcgccggcgtgacagtgcccagcacccgggaggtgatgagcctgcacgaggccagcaggaaggagctgatcccagctgcctttgccacctggctgctggaggcccaggccgccaccggcttcctgctggacccctgcacccggcagaagctgtctgtggatgaggccgtggatgtgggcctggtgaatgaggagctgcgggagcggctgctgaaggccgagcgggccgccaccggctacagagatcctgccactggagacaccatccccctcttccaggccatgcagaagcagctgattgagaaggccgaggccctgcggctgctggaggtgcaggtggccactggaggagtgattgacccccagcaccaccaccggctgcccctggagacagcctaccgccggggctgcctgcacaaggacatctatgccctgatcagtgaccagaagcacatgaggaagagatttgtggaccccaacacccaggagaaggtgtcctaccgggagctgcaggagcgctgccggccccaggaggacaccggctggctgctcttccctgtgaacaaggccgcccgggacagcgagcacattgatgatgagacccggcgggccctggaggccgagcaggtggagatcaccgtgggccgcttccggggccagaagcccaccctgtgggccctgctgaacagtgaatatgtgacagaggagaagaagctgcagctggtgaggatgtaccgcacccacacccggcgggccctgcagacagtggcccagctgatcctggagctgattgagaagcaggagaccagcaacaagcacctgtggttccagggcatccggcggcagatcacagccagcgagctgctgagcagcgccatcatcacagaggagatgctgcaggacctggagaccggccgcagcaccacccaggagctgatggaggatgacagagtgaagcgctacctggagggcaccagctgcatcgccggcgtgctggtgcctgccaaggaccagcccggccggcaggagaagatgagcatctaccaggccatgtggaagggcgtgctgcggcccggcacagccctggtgctgctggaggcccaggccgccactggatttgtgattgatcctgtgaggaacctgcggctgtctgtggaggaggccgtggccgccggcgtggtgggcggggagatccaggagaagctgctgtctgctgagagagctgtgacaggctacacagacccctacacaggccagcagatcagcctcttccaggccatgcagaaggacctgattgtgcgggagcacggcatccggctgctggaggcccagatcgccactggaggagtgattgatcctgtgcacagccaccgggtgcctgtggatgtggcctaccgccggggctactttgatgaggagatgaacagagtgctggccgaccccagtgatgacaccaagggcttctttgaccccaacacccatgagaacctgacctacgtgcagctgctgcggcgctgtgtgcctgaccctgacaccggcctgtacatgctgcagctggccggccggggcagcgctgtgcaccagctgtctgaggagctgcgctgtgccctgagagatgcccgggtgaccccaggcagcggggccctgcagggccagagcgtgtctgtgtgggagctgctcttctaccgggaggtgtctgaagatcggcggcaggacctgctgagccgctacagagctggcaccctgactgtggaggagctgggcgccaccctgaccagcctgctggcccaggcccaggcccaggcccgggcagaggccgaggccggcagccccaggccagacccccgggaggccctgcgggccgccaccatggaggtgaaggtgggccgcctgcggggccgggctgtgcctgtgtgggatgtgctggccagcggctacgtgtcccgggccgcccgggaggagctgctggccgagtttggaagtggcaccctggacctgcctgccctgacccggcggctgacagccatcatcgaggaggccgaggaggcccctggggcccggccccagctgcaggatgcctggaggggcccccgggagcccggccctgctggaagaggagatggagacagcggccgcagccagcgggagggccagggcgagggggagacccaggaggccgctgctgctgctgctgctgctgctgcccggcggcaggagcagaccctgagagatgccaccatggaggtgcagaggggccagttccagggccggcctgtgtctgtgtgggatgtgctcttcagcagctacctgtctgaggccaggagagatgagctgctggcccagcacgccgccggggccctgggcctgcctgacctggtggccgtgctgaccagggtcatcgaggagacagaggagcggctgagcaaggtgtccttccggggcctgcggcggcaggtgtctgccagcgagctgcacaccagcggcatcctgggccctgagaccctgcgggacctggcccagggcaccaagaccctgcaggaggtgacagagatggattctgtgaagcgctacctggagggcaccagctgcatcgccggcgtgctggtgcctgccaaggaccagcccggccggcaggagaagatgagcatctaccaggccatgtggaagggcgtgctgcggcccggcacagccctggtgctgctggaggcccaggccgccactggatttgtgattgatcctgtgaggaacctgcggctgtctgtggaggaggccgtggccgccggcgtggtgggcggggagatccaggagaagctgctgtctgctgagagagctgtgacaggctacacagacccctacacaggccagcagatcagcctcttccaggccatgcagaaggacctgattgtgcgggagcacggcatccggctgctggaggcccagatcgccactggaggagtgattgatcctgtgcacagccaccgggtgcctgtggatgtggcctaccagaggggctactttgatgaggagatgaacagagtgctggccgaccccagtgatgacaccaagggcttctttgaccccaacacccatgagaacctgacctacgtgcagctgctgcggcgctgtgtgcctgaccctgacaccggcctgtacatgctgcagctggccggccggggcagcgctgtgcaccagctgtctgaggagctgcgctgtgccctgagagatgcccgggtgaccccaggcagcggggccctgcagggccagagcgtgtctgtgtgggagctgctcttctaccgggaggtgtctgaagatcggcggcaggacctgctgagccgctacagagctggcaccctgactgtggaggagctgggcgccaccctgaccagcctgctggcccaggcccaggcccaggcccgggcagaggccgaggccggcagccccaggccagacccccgggaggccctgcgggccgccaccatggaggtgaaggtgggccgcctgcggggccgggctgtgcctgtgtgggatgtgctggccagcggctacgtgtcccgggccgcccgggaggagctgctggccgagtttggaagtggcaccctggacctgcctgccctgacccggcggctgacagccatcatcgaggaggccgaggaggcccctggggcccggccccagctgcaggatgcctggaggggcccccgggagcccggccctgctggaagaggagatggagacagcggccgcagccagcgggagggccagggcgagggggagacccaggaggccgctgctgctgcccggcggcaggagcagaccctgagagatgccaccatggaggtgcagaggggccagttccagggccggcctgtgtctgtgtgggatgtgctcttcagcagctacctgtctgaggccaggagagatgagctgctggcccagcacgccgccggggccctgggcctgcctgacctggtggccgtgctgaccagggtgattgaggagacagaggagcggctgagcaaggtgtccttccggggcctgcgctgccaggtgtctgccagcgagctgcacaccagcggcatcctgggccctgagaccctgcgggacctggcccagggcaccaagaccctgcaggaggtgacagagatggacagcgtgaagcgctacctggagggcaccagctgcatcgccggcgtgctggtgcctgccaaggaccagcccggccggcaggagaagatgagcatctaccaggccatgtggaagggcgtgctgcggcctggaacagccctggtgctgctggaggcccaggccgccaccggcttcgtcatcgaccctgtgaggaacctgcggctgtctgtggaggaggccgtggccgccggcgtggtgggcggggagatccaggagaagctgctgtctgctgagagagctgtgacaggctacacagacccctacacaggccagcagatcagcctcttccaggccatgcagaaggacctgattgtgcgggagcacggcatccggctgctggaggcccagatcgccaccggcggcgtcatcgaccctgtgcacagccaccgggtgcctgtggatgtggcctacagaagaggctactttgatgaggagatgaacagagtgctggccgaccccagtgatgacaccaagggcttctttgaccccaacacccatgagaacctgacctacgtgcagctgctgcggcgctgtgtgcctgaccctgacaccggcctgtacatgctgcagctggccggccggggcagcgctgtgcaccagctgtctgaggagctgcgctgtgccctgagagatgcccgggtgaccccaggcagcggggccctgcagggccagagcgtgtctgtgtgggagctgctcttctaccgggaggtgtctgaggaccggcggcaggacctgctgagccgctaccgggccggcaccctgactgtggaggagctgggcgccaccctgaccagcctgctggcccaggcccaggcccaggcccgggcagaggccgaggccggcagccccaggccagacccccgggaggccctgcgggccgccaccatggaggtgaaggtgggccgcctgcggggccgggctgtgcctgtgtgggatgtgctggccagcggctacgtgtccagagctgcccgggaggagctgctggccgagtttggcagcggcaccctggacctgcctgccctgacccggcggctgacagccatcatcgaggaggccgaggaggcccctggggcccggccccagctgcaggatgcctggaggggcccccgggagcccggccctgctggaagaggagatggagacagcggccgcagccagcgggagggccagggcgagggggagacccaggaggccgctgctgccacagctgctgcccggcggcaggagcagaccctgagagatgccaccatggaggtgcagaggggccagttccagggccggcctgtgtctgtgtgggatgtgctcttcagcagctacctgtctgaggccaggagagatgagctgctggcccagcacgccgccggggccctgggcctgcctgacctggtggccgtgctgaccagggtgattgaggagacagaggagcggctgagcaaggtgtccttccggggcctgcggcggcaggtgtctgccagcgagctgcacaccagcggcatcctgggccctgagaccctgcgggacctggcccagggcaccaagaccctgcaggaggtgacagagatggacagcgtgaagcgctacctggagggcaccagctgcatcgccggcgtgctggtgcctgccaaggaccagcccggccggcaggagaagatgagcatctaccaggccatgtggaagggcgtgctgcggcctggaacagccctggtgctgctggaggcccaggccgccaccggcttcgtcatcgaccctgtgaggaacctgcggctgtctgtggaggaggccgtggccgccggcgtggtgggcggggagatccaggagaagctgctgtctgctgagagagctgtgacaggctacacagacccctacacaggccagcagatcagcctcttccaggccatgcagaaggacctgattgtgcgggagcacggcatccggctgctggaggcccagatcgccaccggcggcgtcatcgaccctgtgcacagccaccgggtgcctgtggatgtggcctacagaagaggctactttgatgaggagatgaacagagtgctggccgaccccagtgatgacaccaagggcttctttgaccccaacacccatgagaacctgacctacgtgcagctgctgcggcgctgtgtgcctgaccctgacaccggcctgtacatgctgcagctggccggccggggcagcgctgtgcaccagctgtctgaggagctgcgctgtgccctgagagatgcccgggtgaccccaggcagcggggccctgcagggccagagcgtgtctgtgtgggagctgctcttctaccgggaggtgtctgaggaccggcggcaggacctgctgagccgctaccgggccggcaccctgactgtggaggagctgggcgccaccctgaccagcctgctggcccaggcccaggcccaggcccgggcagaggccgaggccggcagccccaggccagacccccgggaggccctgcgggccgccaccatggaggtgaaggtgggccgcctgcggggccgggctgtgcctgtgtgggatgtgctggccagcggctacgtgtccagagctgcccgggaggagctgctggccgagtttggcagcggcaccctggacctgcctgccctgacccggcggctgacagccatcatcgaggaggccgaggaggcccctggggcccggccccagctgcaggatgcctggaggggcccccgggagcccggccctgctggaagaggagatggagacagcggccgcagccagcgggagggccagggcgagggggagacccaggaggccgctgctgccacagctgctgcccggcggcaggagcagaccctgagagatgccaccatggaggtgcagaggggccagttccagggccggcctgtgtctgtgtgggatgtgctcttcagcagctacctgtctgaggccaggagagatgagctgctggcccagcacgccgccggggccctgggcctgcctgacctggtggccgtgctgaccagggtgattgaggagacagaggagcggctgagcaaggtgtccttccggggcctgcggcggcaggtgtctgccagcgagctgcacaccagcggcatcctgggccctgagaccctgcgggacctggcccagggcaccaagaccctgcaggaggtgacagagatggacagcgtgaagcgctacctggagggcaccagctgcatcgccggcgtgctggtgcctgccaaggaccagcccggccaccaggagaagatgagcatctaccaggccatgtggaagggcgtgctgcggcctggaacagccctggtgctgctggaggcccaggccgccaccggcttcgtcatcgaccctgtgaggaacctgcggctgtctgtggaggaggccgtggccgccggcgtggtgggcggggagatccaggagaagctgctgtctgctgagagagctgtgacaggctacacagacccctacacaggccagcagatcagcctcttccaggccatgcagaaggacctgattgtgcgggagcacggcatccggctgctggaggcccagatcgccaccggcggcgtcatcgaccctgtgcacagccaccgggtgcctgtggatgtggcctacagaagaggctactttgatgaggagatgaacagagtgctggcccaccccagtgatgacaccaagggcttctttgaccccaacacccatgagaacctgacctacgtgcagctgctgcggcgctgtgtgcctgaccctgacaccggcctgtacatgctgcagctggccggccggggcagcgctgtgcaccagctgtctgaggagctgcgctgtgccctgagagatgcccgggtgatgcctggcagcggggccctgcagggccagagcgtgtctgtgtgggagctgctcttctaccgggaggtgtctgaggaccggcggcaggacctgctgagccgctaccgggccggcaccctgactgtggaggagctgggcgccaccctgaccagcctgctggcccaggcccaggcccaggcccgggcagaggccgaggccgaggccggcagccccaggccagacccccgggaggccctgcgggccgccaccatggaggtgaaggtgggccgcctgcggggccgggctgtgcctgtgtgggatgtgctggccagcggctacgtgtctggagctgcccgggaggagctgctggccgagtttggcagcggcaccctggacctgcctgccctgacccggcggctgacagccatcatcgaggaggccgaggaggcccctggggcccggccccagctgcaggatgcctggaggggcccccgggagcccggccctgctggaagaggagatggagacagcggccgcagccagcgggagggccagggcgagggggagacccaggaggccgctgctgctgcccggcggcaggagcagaccctgagagatgccaccatggaggtgcagaggggccagttccagggccggcctgtgtctgtgtgggatgtgctcttcagcagctacctgtctgaggcccacagagatgagctgctggcccagcacgccgccggggccctgggcctgcctgacctggtggccgtgctgaccagggtcatcgaggagacagaggagcggctgagcaaggtgtccttccggggcctgcggcggcaggtgtctgccagcgagctgcacaccagcggcatcctgggccctgagaccctgcgggacctggcccagggcaccaagaccctgcaggaggtgacagagatggattctgtgaagcgctacctggagggcaccagctgcatcgccggcgtgctggtgcctgccaaggaccagcccggccggcaggagaagatgagcatctaccaggccatgtggaagggcgtgctgcggcccggcacagccctggtgctgctggaggcccaggccgccactggatttgtgattgatcctgtgaggaacctgcggctgtctgtggaggaggccgtggccgccggcgtggtgggcggggagatccaggagaagctgctgtctgctgagagagctgtgacaggctacacagacccctacacaggccagcagatcagcctcttccaggccatgcagaaggacctgattgtgcgggagcacggcatccggctgctggaggcccagatcgccactggaggagtgattgatcctgtgcacagccaccgggtgcctgtggatgtggcctaccgccggggctactttgatgaggagatgaacagagtgctggccgaccccagtgatgacaccaagggcttctttgaccccaacacccatgagaacctgacctacctgcagctgctgcagagggccaccctggaccctgagaccggcctgctcttcctgagcctgagcctgcagtag

SEQ ID NO: 38239 - DNA, 2715 bp, Artificial Sequence
  Description of Artificial Sequence: Synthetic coding sequence
atggagagcttccacacccgcttcagcgcctggacccccttcagcaacaagagcctgaaccggcagctgttccaggagcgggtggccctgatcagccactggtttgacctgtggaccaacaagcagaggcaggagttcctgtttgccatcttcctgcgctgcaccaagagccagctgcgctttgtgcaggactggttcagcgagaggatgcaggtggccaaggtggacttcagcacagtgctgccccgcttcatcagcctgtacatcttctccttcctgagccccaaggacctgtgtgccgccgcccaggtgtcctggccctggaagttcctgacagagcaggactgcctgtggatgcccaagtgtgtgaagtttggctggttcctgccctacacccccacagacaatgaatatggagcctggaagaggcactacatcgcctgtgtgagccacctggactggctgaccccccgggaggccgccgccacctacggcaccctgaatgagcccaagacagaagatgaggagctgctggagcggcagcgggagaagtgcctgaggaagaggatctgggagaagatcgccctgaggaagaaggagctgttcaaggtgcggcccccctgggtgtctggcacctgctgcagctctgtgctgaagccccgctgccagccccggctgagccagacagtgcgggagcgggtgggcctgcacgaggccctggagaagcagctggtgctgaccagcctggagaccctgcccaagaggagcaacatcagcggcagccacagctaccccctgctgagcaagaagaactggcatggagtgcacaagaatgatgacaggagcagctatgccctgcggccccacttcatgctgatcagcagccgcatcccagcctatgagatggtgatggagagcgtgaaggccggcgtggtgtctgtggtgtatgagcacagcgtgaccctggagagcctgctgtacctgattgagaaggccctggatggccagaaggcccagagcatcggcatcttcagtgatggagacagccgggagatcaacctgctgcagggctacaagattggagtgaagaacctgctgcggcctgaggtgcgggacttctgggagaagctgggcagctatgtggccacagaggaggagggcggccacgtggacttctttgtgcccctgggcgccagcgaggccggcatcgaggtgctgagccagctgagccagctgaccggcaccttcttcaccgcccccactggaattgccaccggcagctaccagcacatcctgagtgactggctgggcagccagtggggcaaggcccccagcagcatctacttctgtgagagcaagctgcagacctggagcagcttcacagacttcctggaggagaccctgaagacagtgaggaagcagctgtaccccttcttcaaggagctgcagaagagcatcagcggccgcatgattggccagttcatgtttgacaccatgggcatgaccaacatcctgaacaaccaggacacagcccaggccctggctgatggcctgatggagctgagcaaggaggacagcgagagaaatgtggtggaggacaacagctgggacaccaagagccggctgagcaagaatgacctgaactttgaggccctgatcaacctggagcgcatcctgcagaaggacagcgctgagaagagggcccgggtggtgcgggagctgctgcagagcgagaggaaatatgtgcagatcctggagatcgtgagagatgtgtatgtggcccccctgaaggccgccctgagcagcaacagagccatcctgtctgctgccaacatccagatcatcttctgtgacatcctgcagatcctgagcctgaaccggcagttcctggacaacctgcgggaccggctgcaggagtggggccctgcccactgtgtgggggagatcgtgaccaagtttggcagccagctgaacacctacaccaacttcttcaacaactaccctgtgatcctgaagaccatcgagaagtgccgggagatgatcccagccttccgcaccttcctgaagagacatgacaagaccatcgtgaccaagatgctgagcctgcctgagctgctgctgtaccccagcagaagatttgaggagtacctgaacctgctgtatgctgtgcggctgcacaccccagctgagcacgtggacagaggagacctgaccacagccatcgaccagatcaagaagtacaagggctacatcgaccagatgaagcagaacatcaccatgaaggaccacctgagtgacatccagaggatcatctggggctgccccaccctgtctgaggtgaaccgctacctgatccgggtgcaggatgtggcccagctgcactgctgtgatgaggagatctccttcagcctgcggctgtatgagcacatccatgacctgagcctcttcctgttcaatgatgccctgctggtgagcagccggggcaccagccacaccccatttgagaggaccagcaagaccacctaccagttcatcgcctctgtggccctgcaccggctgctgattgagaacatcccagacagcaaatatgtgaagaatgccttcatcctgcagggccccaagtacaagtggatctgtgccacagaaattgaagatgacaagttcctgtggctgtctgtgctgagaaatgccatcaagagctccatggagaagtag

SEQ ID NO: 38240 - DNA, 234 bp, Artificial Sequence
  Description of Artificial Sequence: Synthetic coding sequence
atggagagcttccacacccgcttcagcgcctggacccccttcagcaacaagagcctgaaccggcagctgttccaggagcgggtggccctgatcagccactggtttgacctgtggaccaacaagcagaggcaggagttcctgtttgccatcttcctgcgctgcaccaagagccagctgcgctttgtgcaggactggttcagcgagaggatgcaggtggccaaggtggacttctag

SEQ ID NO: 38241 - DNA, 2715 bp, Artificial Sequence; identical to SEQ ID NO: 38239
  Description of Artificial Sequence: Synthetic coding sequence

SEQ ID NO: 38242 - DNA, 2277 bp, Artificial Sequence
  Description of Artificial Sequence: Synthetic coding sequence
atgcaggtggccaaggtggacttcagcacagtgctgccccgcttcatcagcctgtacatcttctccttcctgagccccaaggacctgtgtgccgccgcccaggtgtcctggccctggaagttcctgacagagcaggactgcctgtggatgcccaagtgtgtgaagtttggctggttcctgccctacacccccacagacaatgaatatggagcctggaagaggcactacatcgcctgtgtgagccacctggactggctgaccccccgggaggccgccgccacctacggcaccctgaatgagcccaagacagaagatgaggagctgctggagcggcagcgggagaagtgcctgaggaagaggatctgggagaagatcgccctgaggaagaaggagctgttcaaggtgcggcccccctgggtgtctggcacctgctgcagctctgtgctgaagccccgctgccagccccggctgagccagacagtgcgggagcgggtgggcctgcacgaggccctggagaagcagctggtgctgaccagcctggagaccctgcccaagaggagcaacatcagcggcagccacagctaccccctgctgagcaagaagaactggcacggcgtgcacaagaatgatgacaggagcagctatgccctgcggccccacttcatgctgatcagcagccgcatcccagcctatgagatggtgatggagagcgtgaaggccggcgtggtgtctgtggtgtatgagcacagcgtgaccctggagagcctgctgtacctgattgagaaggccctggatggccagaaggcccagagcatcggcatcttcagtgatggagacagccgggagatcaacctgctgcagggctacaagattggagtgaagaacctgctgcggcctgaggtgcgggacttctgggagaagctgggcagctatgtggccacagaggaggagggcggccacgtggacttctttgtgcccctgggcgccagcgaggccggcatcgaggtgctgagccagctgagccagctgaccggcaccttcttcaccgcccccaccggcatcgccaccggcagctaccagcacatcctgagtgactggctgggcagccagtggggcaaggcccccagcagcatctacttctgtgagagcaagctgcagacctggagcagcttcacagacttcctggaggagaccctgaagacagtgaggaagcagctgtaccccttcttcaaggagctgcagaagagcatcagcggccgcatgattggccagttcatgtttgacaccatgggcatgaccaacatcctgaacaaccaggacacagcccaggccctggctgatggcctgatggagctgagcaaagaagattctgaaagaaatgtggtggaggacaacagctgggacaccaagagccggctgagcaagaatgacctgaactttgaggccctgatcaacctggagcgcatcctgcagaaggacagcgctgagaagagggcccgggtggtgcgggagctgctgcagagcgagaggaaatatgtgcagatcctggagatcgtgagagatgtgtatgtggcccccctgaaggccgccctgagcagcaacagagccatcctgtctgctgccaacatccagatcatcttctgtgacatcctgcagatcctgagcctgaaccggcagttcctggacaacctgcgggaccggctgcaggagtggggccctgcccactgtgtgggggagatcgtgaccaagtttggcagccagctgaacacctacaccaacttcttcaacaactaccctgtgatcctgaagaccatcgagaagatgaagcagaacatcaccatgaaggaccacctgagtgacatccagaggatcatctggggctgccccaccctgtctgaggtgaaccgctacctgatccgggtgcaggatgtggcccagctgcactgctgtgatgaggagatctccttcagcctgcggctgtatgagcacatccatgacctgagcctcttcctgttcaatgatgccctgctggtgagcagccggggcaccagccacaccccatttgagaggaccagcaagaccacctaccagttcatcgcctctgtggccctgcaccggctgctgattgagaacatcccagacagcaaatatgtgaagaatgccttcatcctgcagggccccaagtacaagtggatctgtgccacagaaattgaagatgacaagttcctgtggctgtctgtgctgagaaatgccatcaagagctccatggagaagtag

SEQ ID NO: 38243 - DNA, 987 bp, Artificial Sequence
  Description of Artificial Sequence: Synthetic coding sequence
atggccaccaagaggctggcccggcagctgggcctcatccggaggaagagcatcgccccagccaacggcaacctgggccgcagcaagagcaagcagctgtttgactacctgattgtcatcgactttgagagcacctgctggaatgatggcaagcaccaccacagccaggagatcatcgagttccctgctgtgctgctgaacaccagcacaggccagattgattctgagttccaggcctacgtgcagccccaggagcaccccatcctgtctgagttctgcatggagctgaccggcatcaagcaggcccaggtggatgaaggagtgcccctgaagatctgcctgagccagttctgcaagtggatccacaagatccagcagcagaagaacatcatctttgccaccggcatcagcgagcccagcgccagcgaggtgaagctgtgtgcctttgtgacctggagcgactgggacctgggcgtgtgcctggagtatgagtgcaagaggaagcagctgctgaagcctgtgttcctgaacagctggattgacctgcgggccacctacaagctgttctacagaaggaagcccaagggcctgagcggggccctgcaggaggtgggcatcgagttcagcggccgggagcacagcggcctggatgacagcaggaacacagccctgctggcctggaagatgatcagagatggctgtgtgatgaagatcaccaggagcctgaacaagggccccttcctgctgcccagctggacctggaacagcgacctggccagcggggaccagcacgccttcctgcagcaggagtttggctgcggcacctaccgcaccctgctgcagaagcccaacatgagcaagcaggagaagggcaacatcctgtggctgaccatggtgtggctgagcctggcctgcctgcagaggaagaactacaatgactgcatgctgaacacagccagccagacagtgaccacagagaagttctag

SEQ ID NO: 38244 - DNA, 2076 bp, Artificial Sequence
  Description of Artificial Sequence: Synthetic coding sequence
atggccaccaagaggctggcccggcagctgggcctcatccggaggaagagcatcgccccagccaacggcaacctgggccgcagcaagagcaagcagctgtttgactacctgattgtcatcgactttgagagcacctgctggaatgatggcaagcaccaccacagccaggagatcatcgagttccctgctgtgctgctgaacaccagcacaggccagattgattctgagttccaggcctacgtgcagccccaggagcaccccatcctgtctgagttctgcatggagctgaccggcatcaagcaggcccaggtggatgaaggagtgcccctgaagatctgcctgagccagttctgcaagtggatccacaagatccagcagcagaagaacatcatctttgccaccggcatcagcgagcccagcgccagcgaggtgaagctgtgtgcctttgtgacctggagcgactgggacctgggcgtgtgcctggagtatgagtgcaagaggaagcagctgctgaagcctgtgttcctgaacagctggattgacctgcgggccacctacaagctgttctacagaaggaagcccaagggcctgagcggggccctgcaggaggtgggcatcgagttcagcggccgggagcacagcggcctggatgacagcaggaacacagccctgctggcctggaagatgatcagagatggctgtgtgatgaagatcaccaggagcctgaacaaggtgcccaccaagaagaacttcagcatcctggccaggaacctgaacaccatccaggtggaggagatgtctgcctgcaacatcagcatccagggccccagcatctacaacaaggagcccaagaacatcatcaacccccatgagaaggtgcagatgaagagcatctgtgccaacagccccatcaaggcccagcaggaccagctgcaggtgaagaacaacatcaaggccagcctgcacaacgtgaagagcagcctgcccctcttcaacaccaagagcagcacctctgtgggccagctgcagagccccaccctgaacagccccatctacatgcagaagcagggcaagaatgagcacctggccttcaacaccaagagcaaggccagcacagtgggcagcgagctggtgctggtgtccaccaccgtgcccaccgtgcaccacgtgtctgacctggagatgagcagcaccctggactgcctgcctgtgctggccgactgggaggatgtggtgctgctgcctgccagccagccagaagaaaatgtggactgcaccgtgcccatcagtgacagcgacctggagatctccttcaacagcggggagcggctgatggtgctgaaggagctggagatgagcagccatgagaactttggagacatcgaggagaccccccagaagtctgagaccagcaagagcatcgtgtacaagagcccccacaccaccatctacaacgtgaaggaggccaaggaccccggcagtgacatcagcgccttcaagctgcctgagcacaagagcagcaccttcaacagagtgaatgccaacatgagccaccccctggtgctgggcaagcaccccctgctgagcggcggcaccaagaggaacccctgcagcccccaggccttccccccagccaagaagcagcccttcaccatccacgaggagaagcccaccagcagtgactgcagccctgtgcgcagcagctcctggaggcggctgcccagcatcctgaccagcacagtgaacctgcaggagccctggaagagcggcaagatgaccccacccctgtgcaagtgtggcagaagaagcaagaggctggtggtgagcaacaacggccccaaccacggcaaggtgttctactgctgccccatcggcaagtaccaggagaacaggaagtgctgcggctacttcaagtgggagcagaccctgcagaaggagcgggccaacagcatggtgcccagccacagcactggaggcctgaccttcagcagccctgagaccagccacatctgtgacaggaacctgagcatcagcaccaagaacagcctgcggctgcggcccagcatgaggaactag

SEQ ID NO: 38245 - DNA, 1281 bp, Artificial Sequence
  Description of Artificial Sequence: Synthetic coding sequence
atgtctgcctgcaacatcagcatccagggccccagcatctacaacaaggagcccaagaacatcatcaacccccatgagaaggtgcagatgaagagcatctgtgccaacagccccatcaaggcccagcaggaccagctgcaggtgaagaacaacatcaaggccagcctgcacaacgtgaagagcagcctgcccctcttcaacaccaagagcagcacctctgtgggccagctgcagagccccaccctgaacagccccatctacatgcagaagcagggcaagaatgagcacctggccttcaacaccaagagcaaggccagcacagtgggcagcgagctggtgctggtgtccaccaccgtgcccaccgtgcaccacgtgtctgacctggagatgagcagcaccctggactgcctgcctgtgctggccgactgggaggatgtggtgctgctgcctgccagccagcctgaggagaatgtggactgcaccgtgcccatcagtgacagcgacctggagatctccttcaacagcggggagcggctgatggtgctgaaggagctggagatgagcagccatgaaaattttggagacatcgaggagaccccccagaagtctgagaccagcaagagcatcgtgtacaagagcccccacaccaccatctacaacgtgaaggaggccaaggaccccggcagtgacatcagcgccttcaagctgcctgagcacaagagcagcaccttcaacagagtgaatgccaacatgagccaccccctggtgctgggcaagcaccccctgctgagcggcggcaccaagaggaacccctgcagcccccaggccttccccccagccaagaagcagcccttcaccatccacgaggagaagcccaccagcagtgactgcagccctgtgcgcagcagctcctggaggcggctgcccagcatcctgaccagcacagtgaacctgcaggagccctggaagagcggcaagatgaccccacccctgtgcaagtgtggccgccgcagcaagaggctggtggtgagcaacaacggccccaaccacggcaaggtgttctactgctgccccatcggcaagtaccaggagaacaggaagtgctgcggctacttcaagtgggagcagaccctgcagaaggagcgggccaacagcatggtgcccagccacagcactggaggcctgaccttcagcagccctgagaccagccacatctgtgacaggaacctgagcatcagcaccaagaacagcctgcggctgcggcccagcatgagaaattag

SEQ ID NO: 38246 - DNA, 696 bp, Artificial Sequence
  Description of Artificial Sequence: Synthetic coding sequence
atggtgtccttccccccccagcgctaccactacttcctggtgctggactttgaggccacctgtgacaagccccagatccacccccaggagatcatcgagttccccatcctgaagctgaatggccgcaccatggagattgagagcaccttccacatgtatgtgcagcctgtggtgcacccccagctgacccccttctgcacagagctgaccggcatcatccaggccatggtggatggccagcccagcctgcagcaggtgctggagcgggtggatgagtggatggccaaggagggcctgctggaccccaacgtgaagagcatctttgtgacctgtggggactgggacctgaaggtgatgctgcccggccagtgccagtacctgggcctgcctgtggccgactacttcaagcagtggatcaacctgaagaagggcagcagccctggaacagccagcggcaccagctgctaccagagcgaggaggcccagaggaaagaaaacaccccaggagtgaaggcctacagctttgccatgggctgctggcccaagaatggcctgctggacatgaacaagggcctgagcctgcagcacatcggccggccccacagcggcattgatgactgcaagaacatcgccaacatcatgaagaccctggcctaccggggcttcatcttcaagcagaccagcaagcccttctag

SEQ ID NO: 38247 - DNA, 1014 bp, Artificial Sequence
  Description of Artificial Sequence: Synthetic coding sequence
atggccacagccagccctgctgctgatggcggccggggccggccctgggagggcggcctggtgtcctggcccccagccccacccctgaccctgccctggacctggatgggccccagctggggccagcaccctggccactggggcttccctgccctgacagagcccagcgccagccctgctgctggcctgggcatctttgaggtgagaagagtgctggatgccagcggctgcagcatgctggcccccctgcagacaggagctgcccgcttcagcagctacctgctgagccgggccaggaaggtgctgggcagccacctgttcagcccctgtggggtgcctgagttctgcagcatcagcaccaggaagctggccgcccacggctttggagcctccatggccgccatggtgtccttccccccccagcgctaccactacttcctggtgctggactttgaggccacctgtgacaagccccagatccacccccaggagatcatcgagttccccatcctgaagctgaatggccgcaccatggagattgagagcaccttccacatgtatgtgcagcctgtggtgcacccccagctgacccccttctgcacagagctgaccggcatcatccaggccatggtggatggccagcccagcctgcagcaggtgctggagcgggtggatgagtggatggccaaggagggcctgctggaccccaacgtgaagagcatctttgtgacctgtggggactgggacctgaaggtgatgctgcccggccagtgccagtacctgggcctgcctgtggccgactacttcaagcagtggatcaacctgaagaaggcctacagctttgccatgggctgctggcccaagaatggcctgctggacatgaacaagggcctgagcctgcagcacatcggccggccccacagcggcattgatgactgcaagaacatcgccaacatcatgaagaccctggcctaccggggcttcatcttcaagcagaccagcaagcccttctag

SEQ ID NO: 38248 - DNA, 669 bp, Artificial Sequence
  Description of Artificial Sequence: Synthetic coding sequence
atgtttgtgatgctgcaggtgccctggctgcagagctgtgccaacctggtgcagattggagcccccctgcccctgctgggctgcctgggccagtactttgaggtgctgggctccatggaggtgctggccggccagtatggcatggagatcatcgagttccccatcctgaagctgaatggaagaaccatggagattgagagcaccttccacatgtatgtgcagcctgtggtgcacccccagctgacccccttctgcacagagctgaccggcatcatccaggccatggtggatggccagcccagcctgcagcaggtgctggagcgggtggatgagtggatggccaaggagggcctgctggaccccaacgtgaagagcatctttgtgacctgtggggactgggacctgaaggtgatgctgcccggccagtgccagtacctgggcctgcctgtggccgactacttcaagcagtggatcaacctgaagaaggcctacagctttgccatgggctgctggcccaagaatggcctgctggacatgaacaagggcctgagcctgcagcacatcggccggccccacagcggcattgatgactgcaagaacatcgccaacatcatgaagaccctggcctaccggggcttcatcttcaagcagaccagcaagcccttctag

SEQ ID NO: 38249 - DNA, 660 bp, Artificial Sequence
  Description of Artificial Sequence: Synthetic coding sequence
atggccacagccagccctgctgctgatggcggccggggccggccctgggagggcggcctggtgtcctggcccccagccccacccctgaccctgccctggacctggatgggccccagctggggccagcaccctggagagatcatcgagttccccatcctgaagctgaatggccgcaccatggagattgagagcaccttccacatgtatgtgcagcctgtggtgcacccccagctgacccccttctgcacagagctgaccggcatcatccaggccatggtggatggccagcccagcctgcagcaggtgctggagcgggtggatgagtggatggccaaggagggcctgctggaccccaacgtgaagagcatctttgtgacctgtggggactgggacctgaaggtgatgctgcccggccagtgccagtacctgggcctgcctgtggccgactacttcaagcagtggatcaacctgaagaaggcctacagctttgccatgggctgctggcccaagaatggcctgctggacatgaacaagggcctgagcctgcagcacatcggccggccccacagcggcattgatgactgcaagaacatcgccaacatcatgaagaccctggcctaccggggcttcatcttcaagcagaccagcaagcccttctag

SEQ ID NO: 38250 - DNA, 531 bp, Artificial Sequence
  Description of Artificial Sequence: Synthetic coding sequence
atggccacagccagccctgctgctgatggcggccggggccggccctgggagggcggcctggtgtcctggcccccagccccacccctgaccctgccctggacctggatgggccccagctggggccagcaccctggagagatcatcgagttccccatcctgaagctgaatggccgcaccatggagattgagagcaccttccacatgtatgtgcagcctgtggtgcacccccagctgacccccttctgcacagagctgaccggcatcatccaggccatggtggatggccagcccagcctgcagcaggtgctggagcgggtggatgagtggatggccaaggagggcctgctggaccccaacgtgaagagcatctttgtgacctgtggggactgggacctgaaggtgatgctgcccggccagtgccagtacctgggcctgcctgtggccgactacttcaagcagtggatcaacctgaagaaggcctacagctttgccatgggctgctggcccaagaatggcctgctggacatgtag

SEQ ID NO: 38251 - DNA, 615 bp, Artificial Sequence
  Description of Artificial Sequence: Synthetic coding sequence
ctgcaggagatcatcgagttccccatcctgaagctgaatggaagaaccatggagattgagagcaccttccacatgtatgtgcagcctgtggtgcacccccagctgacccccttctgcacagagctgaccggcatcatccaggccatggtggatggccagcccagcctgcagcaggtgctggagcgggtggatgagtggatggccaaggagggcctgctggaccccaacgtgaagagcatctttgtgacctgtggggactgggacctgaaggtgatgctgcccggccagtgccagtacctgggcctgcctgtggccgactacttcaagcagtggatcaacctgaagaagggcagcagccctggaacagccagcggcaccagctgctaccagagcgaggaggcccagaggaaggagaacaccccaggagtgaaggcctacagctttgccatgggctgctggcccaagaatggcctgctggacatgaacaagggcctgagcctgcagcacatcggccggccccacagcggcattgatgactgcaagaacatcgccaacatcatgaagaccctggcctaccggggcttcatcttcaagcagaccagcaagcccttctag

SEQ ID NO: 38252 - DNA, 753 bp, Artificial Sequence
  Description of Artificial Sequence: Synthetic coding sequence
atggccacagccagccctgctgctgatggcggccggggccggccctgggagggcggcctggtgtcctggcccccagccccacccctgaccctgccctggacctggatgggccccagctggggccagcaccctggccactggggcttccctgccctgacagagcccagcgccagccctgctgctggcctgggcatctttgaggtgagaagagatgccagcggctgcagcatgctggcccccctgcagacaggagctgcccgcttcagcagctacctgctgagccgggccaggaaggtgctgggcagccacctgttcagcccctgtggggtgcctgagttctgcagcatcagcaccaggaagctggccgcccacggctttggagcctccatggccgccatggtgtccttccccccccagcgctaccactacttcctggtgctggactttgaggccacctgtgacaagccccagatccacccccaggagatcatcgagttccccatcctgaagctgaatggccgcaccatggagattgagagcaccttccacatgtatgtgcagcctgtggtgcacccccagctgacccccttctgcacagagctgaccggcatcatccaggccatggtggatggccagcccagcctgcagcaggtgctggagcgggtggatgagtggatggccaaggagggcctgctggaccccaacgtgaagagcatctttgtgacctgtggggactgggacctgaaggtgtag

SEQ ID NO: 38253 - DNA, 483 bp, Artificial Sequence
  Description of Artificial Sequence: Synthetic coding sequence
atggagattgagagcaccttccacatgtatgtgcagcctgtggtgcacccccagctgacccccttctgcacagagctgaccggcatcatccaggccatggtggatggccagcccagcctgcagcaggtgctggagcgggtggatgagtggatggccaaggagggcctgctggaccccaacgtgaagagcatctttgtgacctgtggggactgggacctgaaggtgatgctgcccggccagtgccagtacctgggcctgcctgtggccgactacttcaagcagtggatcaacctgaagaaggcctacagctttgccatgggctgctggcccaagaatggcctgctggacatgaacaagggcctgagcctgcagcacatcggccggccccacagcggcattgatgactgcaagaacatcgccaacatcatgaagaccctggcctaccggggcttcatcttcaagcagaccagcaagcccttctag

SEQ ID NO: 38254 - DNA, 3018 bp, Artificial Sequence
  Description of Artificial Sequence: Synthetic coding sequence
atggagaagcagagggccctggtggccgccaaggatggagatgtggccaccctggagcggctgctggaggccggggccctgggccctggcatcacagatgccctgggcgccggcctggtgcaccacgccacccgggccggccacctggactgtgtgaagttcctggtgcagagggcccagctgcccggcaaccagagggcccacaatggagccaccccagcccatgatgctgctgccaccggcagcctggccgagctgtgctggctggtgcgggagggcggctgcggcctgcaggaccaggatgccagcggcgtgagccccctgcacctggccgcccgcttcggccaccctgtgctggtggagtggctgctgcacgagggccacagcgccaccctggagacccgggagggcgcccggcccctgcaccacgccgctgtgtctggggacctgacctgcctgaagctgctgacagctgcccacggcagctctgtgaacagaaggaccaggtctggggccagccccctgtacctggcctgccaggagggccacctgcacctggcccagttcctggtgaaggactgtggggctgatgtgcacctgcgggccctggatggcatgtctgccctgcatgctgctgctgcccggggccactacagcctggtggtgtggctggtgaccttcacagacatcggcctgacagcccgggacaatgaaggagccacagccctgcactttgctgcccggggcggccacacccccatcctggaccggctgctgctgatgggcacccccatcctgcgggacagctggggcggcacccccctgcatgatgctgctgaaaatggccagatggagtgctgccagaccctggtgagccaccacgtggaccccagcctgagagatgaagatggctacacagctgctgacctggccgagtaccacggccaccgggactgtgcccagtacctgcgggaggtggcccagcctgtgcccctgctgatgaccccacctcctccacccttccccccaccacccctgctggccacccggcgcagcctggaggatggaagaagaggaggccctggccctggcaaccccagccccatgagcctgagccctgcctggccaggccacccagaccagcccctgccccgggagcagatgaccagccctgccccaccccgcatcatcaccagcgccacagctgaccctgagggcacagaaacagccctggccggggacaccagtgatggcctggccgccctgcagctggatggcctgcccagcggggacattgatggcctggtgcccaccagagatgagcggggccagcccatccctgagtggaagaggcaggtgatggtgaggaagctgcaggcccggctgggcgctgagagcagcgctgaggcccaggacaatggaggcagcagcggccccacagagcaggccgcctggagatacagccagacccaccaggccatcctgggcccctttggagagctgctgacagaagatgacctggtgtacctggagaagcagattgctgacctgcagctgcggcggcgctgccaggagtatgagagcgagctgggccgcctggccgctgagctgcaggccctgctgcctgagcccctggtgtccatcaccgtgaacagccacttcctgccccgggcccctggcctggaggtggaggaggccagcatcccagctgctgagcccgccggcagcgctgaggccagcgaggtggcccctggggtgcagcccctgcccttctggtgcagccacatcagccggctggtgcgcagcctgagcctgctgctgaagggcgtgcacggcctggtgcagggagatgagaagcccagcacccggcccctgcaggacacctgccgggaggccagcgccagcccccccaggtctgaggcccagaggcagatccaggagtggggcgtgtctgtgaggaccctgcggggcaactttgaaagtgccagcggccccctgtgtggcttcaaccctggcccctgtgagcccggggcccagcaccggcagtgcctgagcggctgctggccagccctgcccaagcccaggagcggcctggccagcggggagcccaggcctggggacacagaggaggccagtgacagcggcatcagctgtgaggaggtgcccagcgaggccggggctgctgctggccctgacctggccagcctgaggaaggagcgcatcatcatgctgttcctgagccactggaggagaagtgcctacaccccagccctgaagacagtggcctgcaggaccctgggcgcccggcatgctggcctgcggggccaggaggccgcccggagccctggcccccccagccccccatctgagggcccccggctgggccacctgtggcagcagaggagcaccatcacccacctgctgggcaactggaaggccatcatggcccacgtgcctgcccggcagctgcggcggctgagccggcagcccaggggggccctgagccctgagcagttcctgccccacgtggatggagcccctgtgccctacagcagcctgagcctggacctcttcatgctgggctacttccagctgctggagtgtgacctgcctgctgaggagaggaagctgcggcacctgctgtgctttgaggtgtttgagcacctgggcacccacggctgggaggccgtgcgggccttccacaaggctgtgacagatgaggtggccgccggccggcgggcctggacagatggctttgaggacatcaaggcccgcttcttcggcagcagccagaggcctgcctgggacacagagcccggcaggaagagcggcctgaccctgctgggccccctgccccacgccgctgtgccctgcagcggccctgagcccacagcccagaggctgggcagccgcagccagcagggcagcttcaacggggaggacatctgtggctacatcaacagaagctttgccttctggaaggagaaggaggccgagatgttcaactttggagagtag

SEQ ID NO: 38255 - DNA, 2886 bp, Artificial Sequence
  Description of Artificial Sequence: Synthetic coding sequence
atggagaagcagagggccctggtggccgccaaggatggagatgtggccaccctggagcggctgctggaggccggggccctgggccctggcatcacagatgccctgggcgccggcctggtgcaccacgccacccgggccggccacctggactgtgtgaagttcctggtgcagagggcccagctgcccggcaaccagagggcccacaatggagccaccccagcccatgatgctgctgccaccggcagcctggccgagctgtgctggctggtgcgggagggcggctgcggcctgcaggaccaggatgccagcggcgtgagccccctgcacctggccgcccgcttcggccaccctgtgctggtggagtggctgctgcacgagggccacagcgccaccctggagacccgggagggcgcccggcccctgcaccacgccgctgtgtctggggacctgacctgcctgaagctgctgacagctgcccacggcagctctgtgaacagaaggaccaggtctggggccagccccctgtacctggcctgccaggagggccacctgcacctggcccagttcctggtgaaggactgtggggctgatgtgcacctgcgggccctggatggcatgtctgccctgcatgctgctgctgcccggggccactacagcctggtggtgtggctggtgaccttcacagacatcggcctgacagcccgggacaatgaaggagccacagccctgcactttgctgcccggggcggccacacccccatcctggaccggctgctgctgatgggcacccccatcctgcgggacagctggggcggcacccccctgcatgatgctgctgaaaatggccagatggaggtgcccctgctgatgaccccacctcctccacccttccccccaccacccctgctggccacccggcgcagcctggaggatggaagaagaggaggccctggccctggcaaccccagccccatgagcctgagccctgcctggccaggccacccagaccagcccctgccccgggagcagatgaccagccctgccccaccccgcatcatcaccagcgccacagctgaccctgagggcacagaaacagccctggccggggacaccagtgatggcctggccgccctgcagctggatggcctgcccagcggggacattgatggcctggtgcccaccagagatgagcggggccagcccatccctgagtggaagaggcaggtgatggtgaggaagctgcaggcccggctgggcgctgagagcagcgctgaggcccaggacaatggaggcagcagcggccccacagagcaggccgcctggagatacagccagacccaccaggccatcctgggcccctttggagagctgctgacagaagatgacctggtgtacctggagaagcagattgctgacctgcagctgcggcggcgctgccaggagtatgagagcgagctgggccgcctggccgctgagctgcaggccctgctgcctgagcccctggtgtccatcaccgtgaacagccacttcctgccccgggcccctggcctggaggtggaggaggccagcatcccagctgctgagcccgccggcagcgctgaggccagcgaggtggcccctggggtgcagcccctgcccttctggtgcagccacatcagccggctggtgcgcagcctgagcctgctgctgaagggcgtgcacggcctggtgcagggagatgagaagcccagcacccggcccctgcaggacacctgccgggaggccagcgccagcccccccaggtctgaggcccagaggcagatccaggagtggggcgtgtctgtgaggaccctgcggggcaactttgaaagtgccagcggccccctgtgtggcttcaaccctggcccctgtgagcccggggcccagcaccggcagtgcctgagcggctgctggccagccctgcccaagcccaggagcggcctggccagcggggagcccaggcctggggacacagaggaggccagtgacagcggcatcagctgtgaggaggtgcccagcgaggccggggctgctgctggccctgacctggccagcctgaggaaggagcgcatcatcatgctgttcctgagccactggaggagaagtgcctacaccccagccctgaagacagtggcctgcaggaccctgggcgcccggcatgctggcctgcggggccaggaggccgcccggagccctggcccccccagccccccatctgagggcccccggctgggccacctgtggcagcagaggagcaccatcacccacctgctgggcaactggaaggccatcatggcccacgtgcctgcccggcagctgcggcggctgagccggcagcccaggggggccctgagccctgagcagttcctgccccacgtggatggagcccctgtgccctacagcagcctgagcctggacctcttcatgctgggctacttccagctgctggagtgtgacctgcctgctgaggagaggaagctgcggcacctgctgtgctttgaggtgtttgagcacctgggcacccacggctgggaggccgtgcgggccttccacaaggctgtgacagatgaggtggccgccggccggcgggcctggacagatggctttgaggacatcaaggcccgcttcttcggcagcagccagaggcctgcctgggacacagagcccggcaggaagagcggcctgaccctgctgggccccctgccccacgccgctgtgccctgcagcggccctgagcccacagcccagaggctgggcagccgcagccagcagggcagcttcaacggggaggacatctgtggctacatcaacagaagctttgccttctggaaggagaaggaggccgagatgttcaactttggagagtag

SEQ ID NO: 38256 - DNA, 1914 bp, Artificial Sequence
  Description of Artificial Sequence: Synthetic coding sequence
atgagcctgagccctgcctggccaggccacccagaccagcccctgccccgggagcagatgaccagccctgccccaccccgcatcatcaccagcgccacagctgaccctgagggcacagaaacagccctggccggggacaccagtgatggcctggccgccctgcagctggatggcctgcccagcggggacattgatggcctggtgcccaccagagatgagcggggccagcccatccctgagtggaagaggcaggtgatggtgaggaagctgcaggcccggctgggcgctgagagcagcgctgaggcccaggacaatggaggcagcagcggccccacagagcaggccgcctggagatacagccagacccaccaggccatcctgggcccctttggagagctgctgacagaagatgacctggtgtacctggagaagcagattgctgacctgcagctgcggcggcgctgccaggagtatgagagcgagctgggccgcctggccgctgagctgcaggccctgctgcctgagcccctggtgtccatcaccgtgaacagccacttcctgccccgggcccctggcctggaggtggaggaggccagcatcccagctgctgagcccgccggcagcgctgaggccagcgaggtggcccctggggtgcagcccctgcccttctggtgcagccacatcagccggctggtgcgcagcctgagcctgctgctgaagggcgtgcacggcctggtgcagggagatgagaagcccagcacccggcccctgcaggacacctgccgggaggccagcgccagcccccccaggtctgaggcccagaggcagatccaggagtggggcgtgtctgtgaggaccctgcggggcaactttgaaagtgccagcggccccctgtgtggcttcaaccctggcccctgtgagcccggggcccagcaccggcagtgcctgagcggctgctggccagccctgcccaagcccaggagcggcctggccagcggggagcccaggcctggggacacagaggaggccagtgacagcggcatcagctgtgaggaggtgcccagcgaggccggggctgctgctggccctgacctggccagcctgaggaaggagcgcatcatcatgctgttcctgagccactggaggagaagtgcctacaccccagccctgaagacagtggcctgcaggaccctgggcgcccggcatgctggcctgcggggccaggaggccgcccggagccctggcccccccagccccccatctgagggcccccggctgggccacctgtggcagcagaggagcaccatcacccacctgctgggcaactggaaggccatcatggcccacgtgcctgcccggcagctgcggcggctgagccggcagcccaggggggccctgagccctgagcagttcctgccccacgtggatggagcccctgtgccctacagcagcctgagcctggacctcttcatgctgggctacttccagctgctggagtgtgacctgcctgctgaggagaggaagctgcggcacctgctgtgctttgaggtgtttgagcacctgggcacccacggctgggaggccgtgcgggccttccacaaggctgtgacagatgaggtggccgccggccggcgggcctggacagatggctttgaggacatcaaggcccgcttcttcggcagcagccagaggcctgcctgggacacagagcccggcaggaagagcggcctgaccctgctgggccccctgccccacgccgctgtgccctgcagcggccctgagcccacagcccagaggctgggcagccgcagccagcagggcagcttcaacggggaggacatctgtggctacatcaacagaagctttgccttctggaaggagaaggaggccgagatgttcaactttggagagtag

SEQ ID NO: 38257 - DNA, 249 bp, Artificial Sequence
  Description of Artificial Sequence: Synthetic coding sequence
atgagcctgagccctgcctggccaggccacccagaccagcccctgccccgggagcagatgaccagccctgccccaccccgcatcatcaccagcgccacagctgaccctgagggcacagaaacagccctggccggggacaccagtgatggcctggccgccctgcagctggatggcctgcccagcggggacattgatggcctggtgcccaccagagatgagcggggccagcccatccctgagtggaagtag

SEQ ID NO: 38258 - DNA, 1188 bp, Artificial Sequence
  Description of Artificial Sequence: Synthetic coding sequence
atggccggctatgaatatgtgtccccagagcagctggccggctttgacaagtacaagtacagcgctgtggacaccaaccccctgagcctgtatgtgatgcaccccttctggaacaccatcgtgaaggtgttccccacctggctggcccccaacctgatcaccttcagcggcttcctgctggtggtgttcaacttcctgctgatggcctactttgatcctgacttctacgccagcgcccctggccacaagcacgtgcctgactgggtgtggatcgtggtgggcatcctgaactttgtggcctacaccctggatggagtggatggcaagcaggcccggaggaccaacagcagcacccccctgggggagctgtttgaccacggcctggacagctggagctgtgtgtactttgtggtgacagtgtacagcatcttcggccggggcagcactggagtgtctgtgtttgtgctgtacctgctgctgtgggtggtgctcttctccttcatcctgagccactgggagaagtacaacacaggcatcctcttcctgccctggggctatgacatcagccaggtgaccatcagctttgtgtacatcgtgacagctgtggtgggcgtggaggcctggtatgagcccttcctgttcaacttcctgtacagagacctcttcaccgccatgatcatcggctgtgccctgtgtgtgaccctgcccatgagcctgctgaacttcttccgcagctacaagaacaacaccctgaagctgaacagcgtgtatgaggccatggtgcccctcttcagcccctgcctgctcttcatcctgagcacagcctggatcctgtggagccccagcgacatcctggagctgcaccccagggtcttctacttcatggtgggcacagcctttgccaacagcacctgccagctgattgtgtgccagatgagcagcacccgctgccccaccctgaactggctgctggtgcccctcttcctggtggtgctggtggtgaacctgggcgtggccagctatgtggagagcatcctgctgtacaccctgaccacagccttcaccctggcccacatccactatggagtgcgggtggtgaagcagctgagcagccacttccagatctaccccttcagcctgaggaagcccaacagtgatggcatggaggagaagaacatcggcctgtag

SEQ ID NO: 38259 - DNA, 357 bp, Artificial Sequence
  Description of Artificial Sequence: Synthetic coding sequence
atgcaccccttctggaacaccatcgtgaaggtgttccccacctggctggcccccaacctgatcaccttcagcggcttcctgctggtggtgttcaacttcctgctgatggcctactttgatcctgacttctacgccagcgcccctggccacaagcacgtgcctgactgggtgtggatcgtggtgggcatcctgaactttgtggcctacaccctggatggagtggatggcaagcaggcccggaggaccaacagcagcacccccctgggggagctgtttgaccacggcctggacagctggagctgtgtgtactttgtggtgacagtgtacagcatcttcggccggggcagcactggatag

SEQ ID NO: 38260 - DNA, 1200 bp, Artificial Sequence
  Description of Artificial Sequence: Synthetic coding sequence
atgggcaggaagagcctgtacctgctgattgtgggcatcctgattgcctactacatctacacccccctgcctgacaacgtggaggagccctggaggatgatgtggatcaatgcccacctgaagaccatccagaacctggccacctttgtggagctgctgggcctgcaccacttcatggacagcttcaaggtggtgggcagctttgatgaggtgccccccaccagtgatgaaaatgtgacagtgacagagaccaagttcaacaacatcctggtgcgggtgtatgtgcccaagaggaagtctgaggccctgcggcggggcctcttctacatccatggaggcggctggtgtgtgggcagcgctgccctgagcggctatgacctgctgagccgctggacagctgaccggctggatgctgtggtggtgtccaccaactaccgcctggcccccaagtaccacttccccatccagtttgaagatgtgtacaatgccctgcgctggttcctgaggaagaaggtgctggccaagtatggagtgaaccctgagagaattggcatcagcggggacagcgctgggggcaacctggccgctgctgtgacccagcagctgctggatgatcctgatgtgaagatcaagctgaagatccagagcctcatctacccagccctgcagcccctggatgtggacctgcccagctaccaggagaacagcaacttcctgttcctgagcaagagcctgatggtgcgcttctggagcgagtacttcaccacagacaggagcctggagaaggccatgctgagccggcagcacgtgcctgtggagagcagccacctgttcaagtttgtgaactggagcagcctgctgcctgagcgcttcatcaagggccacgtgtacaacaaccccaactacggcagcagcgagctggccaagaagtacccaggcttcctggatgtgcgggccgcccccctgctggctgatgacaacaagctgcggggcctgcccctgacctacgtgatcacctgccagtatgacctgctgagagatgatggcctgatgtatgtgacccggctgagaaatactggagtgcaggtgacccacaaccacgtggaggatggcttccatggagccttctccttcctgggcctgaagatcagccacaggctcatcaaccagtacatcgagtggctgaaggagaacctgtag

SEQ ID NO: 38261 - DNA, 2745 bp, Artificial Sequence
  Description of Artificial Sequence: Synthetic coding sequence
atgagccgcttcttcaccactggaagtgacagcgagagcgagagcagcctgagcggggaggagctggtgaccaagcctgtgggcggcaactacggcaagcagcccctgctgctgtctgaagatgaggaggacaccaagagggtggtgcgcagcgccaaggacaagagatttgaggagctgaccaacctgatccgcaccatcagaaatgccatgaagatcagagatgtgaccaagtgcctggaggagtttgagctgctgggcaaggcctacggcaaggccaagagcatcgtggacaaggagggcgtgccccgcttctacatccgcatcctggccgacctggaggactacctgaatgagctgtgggaggacaaggagggcaagaagaagatgaacaagaacaatgccaaggccctgagcaccctgcggcagaagatcaggaagtacaacagagactttgagagccacatcaccagctacaagcagaaccctgagcagagcgcagatgaagatgctgagaagaatgaggaggacagcgagggcagcagtgatgaagatgaagatgaagatggagtgtctgctgccaccttcctgaagaagaagtctgaggcccccagcggggagagcaggaagttcctgaagaagatggatgatgaagatgaggacagtgaagattctgaagatgatgaggactgggacaccggcagcaccagcagtgacagcgacagcgaggaggaggagggcaagcagacagccctggccagccgcttcctgaagaaggcccccaccacagatgaggacaagaaggctgctgagaagaagcgggaggacaaggccaagaagaagcatgacaggaagagcaagaggctggatgaggaggaggaggaggacaatgaaggaggagagtgggagcgggtgcggggcggcgtgcccctggtgaaggagaagcccaagatgtttgccaagggcacagagatcacccatgctgtggtgatcaagaagctgaatgagatcctgcaggcccggggcaagaagggcacagacagagctgcccagatcgagctgctgcagctgctggtgcagattgctgctgagaacaacctgggggagggcgtcatcgtgaagatcaagttcaacatcatcgccagcctgtatgactacaaccccaacctggccacctacatgaagccagagatgtggggcaagtgcctggactgcatcaatgagctgatggacatcctgtttgccaaccccaacatctttgtgggggagaacatcctggaggagagcgagaacctgcacaatgctgaccagcccctgcgggtgcggggctgcatcctgaccctggtggagaggatggatgaggagttcaccaagatcatgcagaacacagacccccacagccaggagtatgtggagcacctgaaggatgaggcccaggtgtgtgccatcatcgagcgggtgcagcgctacctggaggagaagggcaccacagaggaggtgtgccgcatctacctgctgcgcatcctgcacacctactacaagtttgactacaaggcccaccagaggcagctgaccccacctgagggcagcagcaagtctgagcaggaccaggctgaaaatgaaggagaagattctgctgtgctgatggagcggctgtgcaagtacatctatgccaaggacagaacagaccgcatccgcacctgtgccatcctgtgccacatctaccaccacgccctgcacagccgctggtaccaggcccgggacctgatgctgatgagccacctgcaggacaacatccagcacgccgacccccctgtgcagatcctgtacaacagaaccatggtgcagctgggcatctgtgccttccggcagggcctgaccaaggatgcccacaatgccctgctggacatccagagcagcggccgggccaaggagctgctgggccagggcctgctgctgcggagcctgcaggagaggaaccaggagcaggagaaggtggagcggcggcggcaggtgcccttccacctgcacatcaacctggagctgctggagtgtgtgtacctggtgtctgccatgctgctggagatcccctacatggccgcccacgagagtgatgcccggcggaggatgatcagcaagcagttccaccaccagctgcgggtgggggagcggcagcccctgctgggccccccagagagcatgagggagcacgtggtggccgccagcaaggccatgaagatgggagactggaagacctgccacagcttcatcatcaatgagaagatgaatggcaaggtgtgggacctcttccctgaggccgacaaggtgaggaccatgctggtgaggaagatccaggaggagagcctgcggacctacctgttcacctacagctctgtgtatgacagcatctccatggagaccctgagtgacatgtttgagctggacctgcccaccgtgcacagcatcatcagcaagatgatcatcaatgaggagctgatggccagcctggaccagcccacccagacagtggtgatgcacaggacagagcccacagcccagcagaacctggccctgcagctggccgagaagctgggcagcctggtggagaacaatgaaagagtgtttgaccacaagcagggcacctacggcggctacttccgggaccagaaggatggctacaggaagaatgaaggctacatgagaagaggaggctaccggcagcagcagagccagacagcctactag

SEQ ID NO: 38262 - DNA, 2745 bp, Artificial Sequence; identical to SEQ ID NO: 38261
  Description of Artificial Sequence: Synthetic coding sequence

SEQ ID NO: 38263 - DNA, 2745 bp, Artificial Sequence; identical to SEQ ID NO: 38261
  Description of Artificial Sequence: Synthetic coding sequence

SEQ ID NO: 38264 - DNA, 2289 bp, Artificial Sequence
  Description of Artificial Sequence: Synthetic coding sequence
atgagccgcttcttcaccactggaagtgacagcgagagcgagagcagcctgagcggggaggagctggtgaccaagcctgtgggcggcaactacggcaagcagcccctgctgctgtctgaagatgaggaggacaccaagagggtggtgcgcagcgccaaggacaagagatttgaggagctgaccaacctgatccgcaccatcagaaatgccatgaagatcagagatgtgaccaagtgcctggaggagtttgagctgctgggcaaggcctacggcaaggccaagagcatcgtggacaaggagggcgtgccccgcttctacatccgcatcctggccgacctggaggactacctgaatgagctgtgggaggacaaggagggcaagaagaagcatgacaggaagagcaagaggctggatgaggaggaggaggaggacaatgaaggaggagagtgggagcgggtgcggggcggcgtgcccctggtgaaggagaagcccaagatgtttgccaagggcacagagatcacccatgctgtggtgatcaagaagctgaatgagatcctgcaggcccggggcaagaagggcacagacagagctgcccagatcgagctgctgcagctgctggtgcagattgctgctgagaacaacctgggggagggcgtcatcgtgaagatcaagttcaacatcatcgccagcctgtatgactacaaccccaacctggccacctacatgaagccagagatgtggggcaagtgcctggactgcatcaatgagctgatggacatcctgtttgccaaccccaacatctttgtgggggagaacatcctggaggagagcgagaacctgcacaatgctgaccagcccctgcgggtgcggggctgcatcctgaccctggtggagaggatggatgaggagttcaccaagatcatgcagaacacagacccccacagccaggagtatgtggagcacctgaaggatgaggcccaggtgtgtgccatcatcgagcgggtgcagcgctacctggaggagaagggcaccacagaggaggtgtgccgcatctacctgctgcgcatcctgcacacctactacaagtttgactacaaggcccaccagaggcagctgaccccacctgagggcagcagcaagtctgagcaggaccaggctgaaaatgaaggagaagattctgctgtgctgatggagcggctgtgcaagtacatctatgccaaggacagaacagaccgcatccgcacctgtgccatcctgtgccacatctaccaccacgccctgcacagccgctggtaccaggcccgggacctgatgctgatgagccacctgcaggacaacatccagcacgccgacccccctgtgcagatcctgtacaacagaaccatggtgcagctgggcatctgtgccttccggcagggcctgaccaaggatgcccacaatgccctgctggacatccagagcagcggccgggccaaggagctgctgggccagggcctgctgctgcggagcctgcaggagaggaaccaggagcaggagaaggtggagcggcggcggcaggtgcccttccacctgcacatcaacctggagctgctggagtgtgtgtacctggtgtctgccatgctgctggagatcccctacatggccgcccacgagagtgatgcccggcggaggatgatcagcaagcagttccaccaccagctgcgggtgggggagcggcagcccctgctgggccccccagagagcatgagggagcacgtggtggccgccagcaaggccatgaagatgggagactggaagacctgccacagcttcatcatcaatgagaagatgaatggcaaggtgtgggacctcttccctgaggccgacaaggtgaggaccatgctggtgaggaagatccaggaggagagcctgcggacctacctgttcacctacagctctgtgtatgacagcatctccatggagaccctgagtgacatgtttgagctggacctgcccaccgtgcacagcatcatcagcaagatgatcatcaatgaggagctgatggccagcctggaccagcccacccagacagtggtgatgcacaggacagagcccacagcccagcagaacctggccctgcagctggccgagaagctgggcagcctggtggagaacaatgaaagagtgtttgaccacaagcagggcacctacggcggctacttccgggaccagaaggatggctacaggaagaatgaaggctacatgagaagaggaggctaccggcagcagcagagccagacagcctactag

SEQ ID NO: 38265 - DNA, 2700 bp, Artificial Sequence
  Description of Artificial Sequence: Synthetic coding sequence
atgagccgcttcttcaccactggaagtgacagcgagagcgagagcagcctgagcggggaggagctggtgaccaagcctgtgggcggcaactacggcaagcagcccctgctgctgtctgaagatgaggaggacaccaagagggtggtgcgcagcgccaaggacaagagatttgaggagctgaccaacctgatccgcaccatcagaaatgccatgaagatcagagatgtgaccaagtgcctggaggagtttgagctgctgggcaaggcctacggcaaggccaagagcatcgtggacaaggagggcgtgccccgcttctacatccgcatcctggccgacctggaggactacctgaatgagctgtgggaggacaaggagggcaagaagaagatcaggaagtacaacagagactttgagagccacatcaccagctacaagcagaaccctgagcagagcgcagatgaagatgctgagaagaatgaagaagattctgagggcagcagtgatgaagatgaagatgaagatggagtgtctgctgccaccttcctgaagaagaagtctgaggcccccagcggggagagcaggaagttcctgaagaagatggatgatgaagatgaagattctgaggacagtgaagatgatgaggactgggacaccggcagcaccagcagtgacagcgacagcgaggaggaggagggcaagcagacagccctggccagccgcttcctgaagaaggcccccaccacagatgaggacaagaaggctgctgagaagaagcgggaggacaaggccaagaagaagcatgacaggaagagcaagaggctggatgaggaggaggaggaggacaatgaaggaggagagtgggagcgggtgcggggcggcgtgcccctggtgaaggagaagcccaagatgtttgccaagggcacagagatcacccatgctgtggtgatcaagaagctgaatgagatcctgcaggcccggggcaagaagggcacagaccgggccgcccagatcgagctgctgcagctgctggtgcagattgctgctgagaacaacctgggggagggcgtgattgtgaagatcaagttcaacatcatcgccagcctgtatgactacaaccccaacctggccacctacatgaagccagagatgtggggcaagtgcctggactgcatcaatgagctgatggacatcctgtttgccaaccccaacatctttgtgggggagaacatcctggaggagagcgagaacctgcacaatgctgaccagcccctgcgggtgcggggctgcatcctgaccctggtggagaggatggatgaggagttcaccaagatcatgcagaacacagacccccacagccaggagtatgtggagcacctgaaggatgaggcccaggtgtgtgccatcatcgagcgggtgcagcgctacctggaggagaagggcaccacagaggaggtgtgccgcatctacctgctgcgcatcctgcacacctactacaagtttgactacaaggcccaccagaggcagctgaccccacctgagggcagcagcaagtctgagcaggaccaggccgagaatgaaggagaggacagcgctgtgctgatggagcggctgtgcaagtacatctatgccaaggacagaacagaccgcatccgcacctgtgccatcctgtgccacatctaccaccacgccctgcacagccgctggtaccaggcccgggacctgatgctgatgagccacctgcaggacaacatccagcacgccgacccccctgtgcagatcctgtacaacagaaccatggtgcagctgggcatctgtgccttccggcagggcctgaccaaggatgcccacaatgccctgctggacatccagagcagcggccgggccaaggagctgctgggccagggcctgctgctgcggagcctgcaggagaggaaccaggagcaggagaaggtggagcggcggcggcaggtgcccttccacctgcacatcaacctggagctgctggagtgtgtgtacctggtgtctgccatgctgctggagatcccctacatggccgcccatgaaagtgatgcccggcggaggatgatcagcaagcagttccaccaccagctgcgggtgggggagcggcagcccctgctgggccccccagagagcatgagggagcacgtggtggccgccagcaaggccatgaagatgggagactggaagacctgccacagcttcatcatcaatgagaagatgaatggcaaggtgtgggacctcttccctgaggccgacaaggtgaggaccatgctggtgaggaagatccaggaggagagcctgcggacctacctgttcacctacagctctgtgtatgacagcatctccatggagaccctgagtgacatgtttgagctggacctgcccaccgtgcacagcatcatcagcaagatgatcatcaatgaggagctgatggccagcctggaccagcccacccagacagtggtgatgcacaggacagagcccacagcccagcagaacctggccctgcagctggccgagaagctgggcagcctggtggagaacaatgaaagagtgtttgaccacaagcagggcacctatggaggctacttccgggaccagaaggatggctacaggaagaatgaaggctacatgaggcggggcggctaccggcagcagcagagccagacagcctactag

SEQ ID NO: 38266 - DNA, 729 bp, Artificial Sequence
  Description of Artificial Sequence: Synthetic coding sequence
atgctggccgtggaggtgtctgaggccgagggcggcatccgggagtgggaggaggaggagaaggaggaggaggccgctgagaggacccccactggagagaagagccccaacagccccaggaccctgctgagcctgcggggcaaggccaggactggaggccccatggaggtgaagctggagctgcaccccctgcagaaccgctgggccctgtggttcttcaagaatgacaggagccgggcctggcaggacaacctgcacctggtgaccaaggtggacacagtggaggacttctgggccctgtacagccacatccagctggccagcaagctgagcagcggctgtgactatgccctcttcaaggatggcatccagcccatgtgggaggacagcaggaacaagagaggaggccgctggctggtgtccctggccaagcagcagaggcacatcgagctggaccggctgtggctggagaccctgctgtgcctgattggagagagctttgaggagcacagccgggaggtgtgtggggctgtggtgaacatccgcaccaagggggacaagattgctgtgtggacccgggaggccgagaaccaggccggcgtgctgcacgtgggccgggtgtacaaggagcggctgggcctgagccccaagaccatcatcggctaccaggcccacgccgacacagccaccaagagcaacagcctggccaagaacaagtttgtggtgtag

SEQ ID NO: 38267 - DNA, 729 bp, Artificial Sequence; identical to SEQ ID NO: 38266
  Description of Artificial Sequence: Synthetic coding sequence

SEQ ID NO: 38268 - DNA, 273 bp, Artificial Sequence
  Description of Artificial Sequence: Synthetic coding sequence
atgctggccgtggaggtgtctgaggccgagggcggcatccgggagtgggaggaggaggagaaggaggaggaggccgctgagaggacccccactggagagaagagccccaacagccccaggaccctgctgagcctgcggggcaaggccaggactggaggccccatggaggtgaagctggagctgcaccccctgcagaaccgctgggccctgtggttcttcaagaatgacaggagccgggcctggcaggacaacctgcacctggtgaccaagtag

SEQ ID NO: 38269 - DNA, 525 bp, Artificial Sequence
  Description of Artificial Sequence: Synthetic coding sequence
atggctgctgccatggtgcccggccgctctgagagctgggagcggggggagcccggccgcccagccctgtacttctgtggcagcatccggggcggccgggaggacaggaccctgtatgagcgcatcgtgtcccggctgcggagatttggaacagtgctgacagagcacgtggccgctgctgagctgggcgcccggggggaggaggccgccggcggggacaggctcatccacgagcaggacctggagtggctgcagcaggctgatgtggtggtggccgaggtgacccagcccagcctgggcgtgggctatgagctgggccgggctgtggccttcaacaagaggatcctgtgcctcttccggccccagagcggccgggtgctgagcgccatgatcagaggagctgctgatggcagccgcttccaggtgtgggactatgaggagggggaggtggaggccctgctggaccgctactttgaggccgaccccccaggccaggtggccgccagcccagaccccaccacctag

SEQ ID NO: 38270 - DNA, 423 bp, Artificial Sequence
  Description of Artificial Sequence: Synthetic coding sequence
atgagccgcagccggcagccccccctggtgacaggcatcagccccaatgaaggcatcccctggaccaaggtgaccatcagaggagagaacctgggcaccggccccacagacctgattggcctgaccatctgtggccacaactgcctgctgacagctgagtggatgtctgccagcaagatcgtgtgccgggtgggccaggccaagaatgacaagggggacatcatcgtgaccaccaagagcggcggccggggcaccagcacagtgtccttcaagctgctgaagccagagaagattggcatcctggaccagagcgctgtgtgggtggatgagatgaactactatgacatgaggacagacaggaacaagggcatcccccccctgagcctgcggcctgccaaccccctgggcattgaaattgaatag

SEQ ID NO: 38271 - DNA, 1560 bp, Artificial Sequence
  Description of Artificial Sequence: Synthetic coding sequence
atgctggacctggacaatgacacccggcccagcgtgctgggccacctgagccagacagccagcctgaagaggggcagcagcttccagagcggcagagatgacacctggagatacaagaccccccaccgggtggcctttgtggagaagctgaccaagctggtgctgagccagctgcccaacttctggaagctgtggatctcctatgtgaatggcagcctcttcagcgagacagctgagaagagcggccagatcgagaggagcaagaatgtgcggcagaggcagaatgacttcaagaagatgatccaggaggtgatgcacagcctggtgaagctgaccaggggggccctgctgcccctgagcatcagagatggagaggccaagcagtatggaggctgggaggtgaagtgtgagctgagcggccagtggctggcccacgccatccagacagtgcggctgacccatgagagcctgacagccctggagatccccaatgacctgctgcagaccatccaggacctgatcctggacctgcgggtgcgctgtgtgatggccaccctgcagcacacagctgaggagatcaagaggctggccgagaaggaggactggatcgtggacaatgaaggcctgaccagcctgccctgccagtttgagcagtgcatcgtgtgcagcctgcagagcctgaagggcgtgctggagtgcaagccaggagaggcctctgtgttccagcagcccaagacccaggaggaggtgtgccagctgagcatcaacatcatgcaggtgttcatctactgcctggagcagctgagcaccaagccagatgctgacatcgacaccacccacctgtctgtggatgtgagcagcccagacctgtttggcagcatccacgaggacttcagcctgaccagcgagcagaggctgctgattgtgctgagcaactgctgctacctggagcggcacaccttcctgaacattgctgagcactttgagaagcacaacttccagggcatcgagaagatcacccaggtgtccatggccagcctgaaggagctggaccagaggctgtttgagaactacatcgagctgaaggctgaccccatcgtgggcagcctggagcccggcatctatgccggctactttgactggaaggactgcctgccccccaccggggtgaggaactacctgaaggaggccctggtgaacatcatcgctgtgcacgccgaggtgttcaccatcagcaaggagctggtgccccgggtgctgagcaaggtgattgaggccgtgtctgaggagctgagccggctgatgcagtgtgtgagcagcttcagcaagaatggagccctgcaggcccggctggagatctgtgccctgcgggacacagtggccgtgtacctgaccccagagagcaagagcagcttcaagcaggccctggaggccctgccccagctgagcagcggggctgacaagaagctgctggaggagctgctgaacaagttcaagagctccatgcacctgcagctgacctgcttccaggccgccagcagcaccatgatgaagacctag

SEQ ID NO: 38272 - DNA, 1230 bp, Artificial Sequence
  Description of Artificial Sequence: Synthetic coding sequence
atggccgccctggagaatggagagctgggccccctgctgagccctggcaccctgcggggcctggaggatgaatgtgtgacagatgtgaaggcccagaccagggctgccctgctgcgggtgctgcaggaggatgaggagcactggggcagcctggaggaccagcccagcagcctggcccaggatgtgtgtgagctgctggaggagcacacagagcgggccccccgcatcagccaggagtttggagagaggatggcccactgctgcctgggcggcctggccgagttcctgcagagcttccagcagagggtggagcgcttccacgagaacccagctgtgcgggagatgctgcctgacacctacatcagcaagaccatcgccctggtgaactgtggcccccccctgcgggccctggccgagcggctggcccgggtgggccccccagagagcgagcccgcccgggaggccagcgccagcgccctggaccacgtgacccggctgtgccaccgggtggtggccaacctgctcttccaggagctgcagccccacttcaacaagctgatgaggaggaagtggctgagcagccctgaggccctggatggcatcgtgggcaccctgggcgcccaggccctggccctgcggaggatgcaggatgagccctaccaggccctggtggccgagctgcacagaagagccctggtggagtatgtgcggcccctgctgcggggccgcctgcgctgcagcagcgcccggaccaggagccgggtggccggccgcctgagagaagatgctgcccagctgcagaggctcttccggcggctggagagccaggcctcctggctggatgctgtggtgccccacctggccgaggtgatgcagctggaggacacccccagcatccaggtggaggtgggcgtgctggtgcgggactacccagacatccggcagaagcacgtggccgccctgctggacatccggggcctgaggaacacagctgcccggcaggagatcctggccgtggcccgggacctggagctgtctgaggagggcgccctgagccccccccgggaccgggccttctttgctgacatccctgtgccccggcccagcttctgcctgagcctgcccctcttcctgggccgcctgcccctgagccggctggcccggcccagcctggcctgcctgccccggcccaggcctcccagcctggcccggccccgggcccagaggtag

SEQ ID NO: 38273 - DNA, 1230 bp, Artificial Sequence; identical to SEQ ID NO: 38272
  Description of Artificial Sequence: Synthetic coding sequence

SEQ ID NO: 38274 - DNA, 2169 bp, Artificial Sequence
  Description of Artificial Sequence: Synthetic coding sequence
atgcccagcccccagacagacaccccaggccctgagctgcagagccccaaggaggccgaggagccccagaccccagcccagggcagcaggaggaccagcagcaggaaggagcccaatgcccacaggaaggatggcacccggctgggcctgggcagcctgcggcaggccttcagccgggccagccagagggccctgacccaggtgtccaaagaagacaccggcctcttcagaagaagcagctgcagcctcttccgctccttccggcaggccctgaatgatggccctgccaccggccacagccaggccaccccagaggtgcccagcggcgtgatgaatggagtgtcccagcaggccagcactggagctgccagcgaggagctgaagccagaggccgagggcaagtctgtggccgacctgatcacagagcggcagctgctggccgcctttgagcagctgctgcggctggagaccctgctggtggccgagaaggccagcaggacctttgagcaggaccccacagcctttgcccggcgggccatggatgtgtgcctgctgtatgatggcctggccgctgagattggagccatcgtgcgggagaccctggacagtgatggagtggatgctgctgccctggccgagctggcccgggtggtgtctgctgaggaggaggcccaccccagccccccagatgatggagacttcctgcggaccccccggcgctggaggcagcactgggaggaggccgtgcggcgcagcgcccaggagcgggtgcggcggcctggggccggctgggccttcggggaggccgagggcgccagcggcctggcccagctgctggccgagctgggcggcctggtgagaagagacctgcagaaggtgcggcaggaggtgcagcctgcctatgctgctgctggcttccctgcctgggaggtgtacctgcgggccttccacagcgctgtggcccagaggctgcaggagctggccagagatgcccggggctgtgagcagctgtacatcctgctggactgggccgccaacgtgtatggcagcccagacttcctgggcgcccctggcctggccctgcctgctgagcccctgccccccctgctggccccagatgtgtgggcccggctggagagtgactacaccagcttcctggaggccaagatcgccagctgctttgacagcatcctgcagctggagcagagccactgggccgctgctgaggtgcctgaggtgctgcagggcctgtaccaggcccccctgtccatggatgtgcacatgctggtggccgagcacgtgaaggctgctggggccatctctgctgagctggaggccaccaccctgcgcatctgcacccgggccctgggcctgtttgtgcccaggtttgagaaggccttcctggccagcgaggccgtgtctgagccccacctgggcgcctacatcaatgcctgtgaggagctgcggaccagcctgctgagccgcttccctggcacccaggaggagctggagaagcccctggtgacagccacctgcagcttccagaagcacctgctgcagggcctgcagcgggagctgcagcccctcttccgggtggtgtgcacccgggactggctgacccaggactggctgcaccccctgatggacaaggtggtgacctttgctggccacctgcagagggtggcccggccccgggcccaggagaccctgcaggaggtgcacagatttgtggtgcgggagtacctggcccgggccctgcggccccgggagcgcttccggggcatggagaggatgcacggcagccagaagatgagcctggatgcccaggccatcagtgacaccttccagggcctgggcagcgaggccacctggctggaccaggccatccagtgtgtggccgagatcctgggggagacctacaaggatgacatccagaggcacctggagaccctcatccgcagctacccagacatcagaagagaccacatcctggccatcctggccctgcggcggctgggccggcagaggaaccagcacctgctgcagcacacccaggacctgctgcgggctgctgctggagctgctggagctgaggccccccggggccgggtgctgtttgaggagatcaaggtgcccagcgccatggctgtgctgatcacctgtgtgtag

SEQ ID NO: 38275 - DNA, 1545 bp, Artificial Sequence
  Description of Artificial Sequence: Synthetic coding sequence
atggaggacagcgagttcctggcctacgtggagctgctggatgaggtggagcagggctctgtgcgggccaaggccagctctgtgtccctgcacgccgagaggacctggatggagaagatgaaggtggaggacctgaatgtgtgtgagcccgccagccctgcccctgaggccccagccaccagcctgctgaatgacctgaagtacagccccagcgaggaggaggaggtgacctacaccgtcatcaaccagttccagcagaagtttggagctgccatcctgcacatcaagaagcagaatgtgctgtctgtggccgctgagggcgccaacgtgtgcagacatggcaagctgtgctggctgcaggtggccaccaactgccgggtgtacctgtttgacatcttcctgctgggcagccgggccttccacaacggcctgcagatgatcctggaggacaagaggatcctgaaggtgattcatgactgccgctggctgagtgactgcctgagccaccagtatggcatcctgctgaacaacgtgtttgacacccaggtggctgatgtgctgcagttctccatggagactggaggctacctgcccaactgcatcaccaccctgcaggagagcctcatcaagcacctgcaggtggcccccaagtacctgtccttcctggagaagaggcagaagctgatccaggagaaccctgaggtgtggttcatccggcctgtgagccccagcctgctgaagatcctggccctggaggccacctacctgctgcccctgcggctggccctgctggatgagatgatgtctgacctgaccaccctggtggatggctacctgaacacctaccgggagggcagcgctgaccggctgggcggcacagagcccacctgcatggagctgcctgaggagctgctgcagctgaaggacttccagaagcagaggcgggagaaggccgcccgggagtacagagtgaatgcccagggcctgctgatcagaacagtgctgcagcccaagaagctggtgacagaaacagctgggaaggaggagaaggtgaagggcttcctgtttgggaagaacttcagaattgacaaggcccccagcttcaccagccaggacttccatggagatgtgaacctgctgaaggaggagagcctgaacaagcaggccaccaacccccagcacctgcccccaacagaggagggggagaccagcgaggacagcagcaacaagctgatctgcaccaagagcaaaggaagtgaggaccagaggatcacccagaaggagcacttcatgacccccaagcatgagttccaggccagcctgagcctgaaggaggagacagagcagctgctgatggtggagaacaaggaggacctgaagtgcaccaagcaggccgtgtccatgagcagcttcccccaggagaccagggtgagccccagcgacaccttctaccccatcaggaagacagtggtgtccaccctgcccccctgcccagccctggagaagattgacagctggatcagccccttcctgaacctgccctag

SEQ ID NO: 38276 - DNA, 1719 bp, Artificial Sequence
  Description of Artificial Sequence: Synthetic coding sequence
atggaccccagcagtgactaccacttcctgagccagatcctgtggaagagggtgaagctgaccctggtgtgtggggtgtttgaaggagtgctgcagcacgtggaccccaacaagatcgtggtgctgaagaaggtgaagaatgtggagaccggccgctctgtgcctggggtgaagctgttctttggacatgaaattgtgaatgtggagctgctggatgaggtggagcagggctctgtgcgggccaaggccagctctgtgtccctgcacgccgagaggacctggatggagaagatgaaggtggaggacctgaatgtgtgtgagcccgccagccctgcccctgaggccccagccaccagcctgctgaatgacctgaagtacagccccagcgaggaggaggaggtgacctacaccgtcatcaaccagttccagcagaagtttggagctgccatcctgcacatcaagaagcagaatgtgctgtctgtggccgctgagggcgccaacgtgtgcagacatggcaagctgtgctggctgcaggtggccaccaactgccgggtgtacctgtttgacatcttcctgctgggcagccgggccttccacaacggcctgcagatgatcctggaggacaagaggatcctgaaggtgattcatgactgccgctggctgagtgactgcctgagccaccagtatggcatcctgctgaacaacgtgtttgacacccaggtggctgatgtgctgcagttctccatggagactggaggctacctgcccaactgcatcaccaccctgcaggagagcctcatcaagcacctgcaggtggcccccaagtacctgtccttcctggagaagaggcagaagctgatccaggagaaccctgaggtgtggttcatccggcctgtgagccccagcctgctgaagatcctggccctggaggccacctacctgctgcccctgcggctggccctgctggatgagatgatgtctgacctgaccaccctggtggatggctacctgaacacctaccgggagggcagcgctgaccggctgggcggcacagagcccacctgcatggagctgcctgaggagctgctgcagctgaaggacttccagaagcagaggcgggagaaggccgcccgggagtacagagtgaatgcccagggcctgctgatcagaacagtgctgcagcccaagaagctggtgacagaaacagctgggaaggaggagaaggtgaagggcttcctgtttgggaagaacttcagaattgacaaggcccccagcttcaccagccaggacttccatggagatgtgaacctgctgaaggaggagagcctgaacaagcaggccaccaacccccagcacctgcccccaacagaggagggggagaccagcgaggacagcagcaacaagctgatctgcaccaagagcaaaggaagtgaggaccagaggatcacccagaaggagcacttcatgacccccaagcatgagttccaggccagcctgagcctgaaggaggagacagagcagctgctgatggtggagaacaaggaggacctgaagtgcaccaagcaggccgtgtccatgagcagcttcccccaggagaccagggtgagccccagcgacaccttctaccccatcaggaagacagtggtgtccaccctgcccccctgcccagccctggagaagattgacagctggatcagccccttcctgaacctgccctag

SEQ ID NO: 38277 - DNA, 816 bp, Artificial Sequence
  Description of Artificial Sequence: Synthetic coding sequence
atgagccggcagaacctggtggccctgactgtgaccaccctgctgggcgtggccgtgggcggctttgtgctgtggaagggcatccagaggagaagaagaagcaagaccagccctgtgacccagcagccccagcagaaggtgctgggcagccgggagctgcccccaccagaagatgaccagctgcacagcagcgcccccaggagctcctggaaggagcgcatcctgaaggccaaggtggtgacagtgtcccaggaggccgagtgggaccagatcgagcccctgctgcggtctgagctggaggacttccctgtgctgggcatcgactgtgagtgggtgaacctggagggcaaggccagccccctgagcctgctgcagatggccagccccagcggcctgtgtgtgctggtgcggctgcccaagctgatctgtggcggcaagaccctgcccaggaccctgctggacatcctggctgatggcaccatcctgaaggtgggcgtgggctgcagtgaagatgccagcaagctgctgcaggactatggcctggtggtgcggggctgcctggacctgcgctacctggccatgaggcagaggaacaacctgctgtgcaatggcctgagcctgaagagcctggccgagaccgtgctgaacttccccctggacaagagcctgctgctgcgctgcagcaactgggatgctgagaccctgacagaggaccaggtgatctatgctgccagagatgcccagatctctgtggccctcttcctgcacctgctgggctaccccttcagcaggaacagccctggagagaagaggtag

SEQ ID NO: 38278 - DNA, 1866 bp, Artificial Sequence
  Description of Artificial Sequence: Synthetic coding sequence
atgagccggcagaacctggtggccctgactgtgaccaccctgctgggcgtggccgtgggcggctttgtgctgtggaagggcatccagaggagaagaagaagcaagaccagccctgtgacccagcagccccagcagaaggtgctgggcagccgggagctgcccccaccagaagatgaccagctgcacagcagcgcccccaggagctcctggaaggagcgcatcctgaaggccaaggtggtgacagtgtcccaggaggccgagtgggaccagatcgagcccctgctgcggtctgagctggaggacttccctgtgctgggcatcgactgtgagtgggtgaacctggagggcaaggccagccccctgagcctgctgcagatggccagccccagcggcctgtgtgtgctggtgcggctgcccaagctgatctgtggcggcaagaccctgcccaggaccctgctggacatcctggctgatggcaccatcctgaaggtgggcgtgggctgcagtgaagatgccagcaagctgctgcaggactatggcctggtggtgcggggctgcctggacctgcgctacctggccatgaggcagaggaacaacctgctgtgcaatggcctgagcctgaagagcctggccgagaccgtgctgaacttccccctggacaagagcctgctgctgcgctgcagcaactgggatgctgagaccctgacagaggaccaggtgatctatgctgccagagatgcccagatctctgtggccctcttcctgcacctgctgggctaccccttcagcaggaacagccctggagagaagaatgatgaccacagctcctggaggaaggtgctggagaagtgccagggcgtggtggacatccccttccgcagcaagggcatgagccggctgggggaggaggtgaatggagaggccacagagagccagcagaagcccaggaacaagaagagcaagatggatggcatggtgcccggcaaccaccagggccgggaccccaggaagcacaagaggaagcccctgggcgtgggctacagcgccaggaagagccccctgtatgacaactgcttcctgcacgccccagatggccagcccctgtgcacctgtgacaggaggaaggcccagtggtacctggacaagggcatcggggagctggtgtctgaggagccctttgtggtgaagctgcgctttgagcccgccggccggcctgagagccctggggactactacctgatggtgaaggagaacctgtgtgtggtgtgtgggaagagggacagctacatcaggaagaatgtcatcccccatgagtacaggaagcacttccccatcgagatgaaggaccacaacagccatgatgtgctgctgctgtgcaccagctgccacgccatcagcaactactatgacaaccacctgaagcagcagctggccaaggagttccaggcccccatcggcagcgaggagggcctgcggctgctggaggaccctgagcggcggcaggtgcgcagcggggcccgggccctgctgaatgctgagagcctgcccacccagaggaaggaggagctgctgcaggccctgcgggagttctacaacacagatgtggtgacagaggagatgctgcaggaggccgccagcctggagacccgcatcagcaatgaaaactacgtgccccacggcctgaaggtggtgcagtgccacagccagggcggcctgcggagcctgatgcagctggagagccgctggaggcagcacttcctggacagcatgcagcccaagcacctgccccagcagtggagcgtggaccacaaccaccagaagctgctgaggaagtttggagaggacctgcccatccagctgtcctag

SEQ ID NO: 38279 - DNA, 1491 bp, Artificial Sequence
  Description of Artificial Sequence: Synthetic coding sequence
atggccagccccagcggcctgtgtgtgctggtgcggctgcccaagctgatctgtggcggcaagaccctgcccaggaccctgctggacatcctggctgatggcaccatcctgaaggtgggcgtgggctgcagtgaagatgccagcaagctgctgcaggactatggcctggtggtgcggggctgcctggacctgcgctacctggccatgaggcagaggaacaacctgctgtgcaatggcctgagcctgaagagcctggccgagaccgtgctgaacttccccctggacaagagcctgctgctgcgctgcagcaactgggatgctgagaccctgacagaggaccaggtgatctatgctgccagagatgcccagatctctgtggccctcttcctgcacctgctgggctaccccttcagcaggaacagccctggagagaagaatgatgaccacagctcctggaggaaggtgctggagaagtgccagggcgtggtggacatccccttccgcagcaagggcatgagccggctgggggaggaggtgaatggagaggccacagagagccagcagaagcccaggaacaagaagagcaagatggatggcatggtgcccggcaaccaccagggccgggaccccaggaagcacaagaggaagcccctgggcgtgggctacagcgccaggaagagccccctgtatgacaactgcttcctgcacgccccagatggccagcccctgtgcacctgtgacaggaggaaggcccagtggtacctggacaagggcattggagagctggtgtctgaggagccctttgtggtgaagctgcgctttgagcctgctggccggcctgagagccctggggactactacctgatggtgaaggagaacctgtgtgtggtgtgtgggaagagggacagctacatcaggaagaatgtcatcccccatgagtacaggaagcacttccccatcgagatgaaggaccacaacagccatgatgtgctgctgctgtgcaccagctgccacgccatcagcaactactatgacaaccacctgaagcagcagctggccaaggagttccaggcccccatcggcagcgaggagggcctgcggctgctggaggaccctgagcggcggcaggtgcgcagcggggcccgggccctgctgaatgctgagagcctgcccacccagaggaaggaggagctgctgcaggccctgcgggagttctacaacacagatgtggtgacagaggagatgctgcaggaggccgccagcctggagacccgcatcagcaatgaaaattatgtgccccacggcctgaaggtggtgcagtgccacagccagggcggcctgcggagcctgatgcagctggagagccgctggaggcagcacttcctggacagcatgcagcccaagcacctgccccagcagtggagcgtggaccacaaccaccagaagctgctgaggaagtttggagaggacctgcccatccagctgtcctag

SEQ ID NO: 38280 - DNA, 1866 bp, Artificial Sequence; identical to SEQ ID NO: 38278
  Description of Artificial Sequence: Synthetic coding sequence

SEQ ID NO: 38281 - DNA, 1491 bp, Artificial Sequence; identical to SEQ ID NO: 38279
  Description of Artificial Sequence: Synthetic coding sequence

SEQ ID NO: 38282 - DNA, 1491 bp, Artificial Sequence; identical to SEQ ID NO: 38279
  Description of Artificial Sequence: Synthetic coding sequence

SEQ ID NO: 38283 - DNA, 1491 bp, Artificial Sequence; identical to SEQ ID NO: 38279
  Description of Artificial Sequence: Synthetic coding sequence

SEQ ID NO: 38284 - DNA, 345 bp, Artificial Sequence
  Description of Artificial Sequence: Synthetic coding sequence
atggccagccccagcggcctgtgtgtgctggtgcggctgcccaagctgatctgtggcggcaagaccctgcccaggaccctgctggacatcctggctgatggcaccatcctgaaggtgggcgtgggctgcagtgaagatgccagcaagctgctgcaggactatggcctggtggtgcggggctgcctggacctgcgctacctggccatgaggcagaggaacaacctgctgtgcaatggcctgagcctgaagagcctggccgagaccgtgctgaacttccccctggacaagagcctgctgctgcgctgcagcaactgggatgctgagaccctgacagaggaccagtag

SEQ ID NO: 38285 - DNA, 1491 bp, Artificial Sequence; identical to SEQ ID NO: 38279
  Description of Artificial Sequence: Synthetic coding sequence

SEQ ID NO: 38286 - DNA, 2631 bp, Artificial Sequence
  Description of Artificial Sequence: Synthetic coding sequence
atggaccccggggaccctgctggggaccctgctgctggggagcggcacaggatgggccgggaccccctgctgctgctgcaggccctgcagaccctgtggagcacccgggagaggaagcagctgcgggaggaggcctggaggggctttgctgccctggatgaccccctggccggcctgctggacatgctggagagctgccggggccagagaggagagggccccagcctggccgcctggatcagccaccagctgcagtgctggctgcaggcccagccctgccccagcctggcccagcacagcctgcggctgaagcagctgcaggcccgggctgtgaaggtgctgacagagagcccccccagcctggccgcccccctggccagcatcttccagctgcaggatgctgacaggagctgcctgctggcccacgtgcaccggctgcaccacgagggccgcttccgggaggccgccaccctgggcgccaccctgaagctgcagagcgagctgggcgtggagaagatgagcatccccctgctgctgcaggacaaggtggccctggtggagagatatgtggccggcttcccagacctgcagaggcggctgctggtgctgatggacagctggtgccagcccggctttgacatcaaggatgtggcccggcgctacccagaggtgaccagcctgagcctggagaagctgagccccaaggccctgagccggcaggtgctgcggctgcaggagagatatggagtggccccagccctgtgccccaatgctgccatccagcagaggctggccgccctgcggcacctgtgccacaagagatttgtggagaagagcctgagccaggagaactggacagaccacgtgcagggcctggtgggccagagcccctggctgcaggagcagctgagccagctgctggtgagccacagcgaccctgtgacagctgcccagtgtgccatggagctgctgctgcctgaggagcggctgcctgctgctgtggccgtggagctgcggcgcttccggctgcagggccgggccacagaggccgacagccggctggaggtgaaggacatgaaggaccgctactaccagctgcccatccccagagaaaatgtgcacctgctggcctcctgggaggacctgaccaggcatgaaggagccctgctgcagtgccaccaggtggtgggcgtggatgtggagtggacccctgtgtttgtggccggcggccggccccggcccagcctgctgcaggtggccgtggagggccacgtgttcctgctggatgtgctggccctgagccagccccccaccggccagggcgcccaggccttcagccggctggtggcccagctgctgagtgaccccagcatcaccaagctgggctacggcatggtgggggacctgcagaagctgggcaccagctgcccagccctggcccacgtggagaagcagatcctgggcggcatggacctgctgctggtgcaccggcagatgagggtggcctctgtgcctgccccagctgtggaccgggcccgggagctgcggggcctgagcctgctggtgcagcaggtgctgggcacagccctggacaagacccagcagctgagcaactgggacagaagacccctgtgtgaggagcaggtgatctatgctgctgctgatgcctactgcctgctggaggtgcaccaggccctgtgccgggagcccgcccgcttccacctgtctgaggacctggccggcagcagaagacccaggcaccgggagaggcctggggccaggaagcccccaggcctgcagaaggccagcgccccagctgccccccggcaggtgcctgtggccgtggccgtgtctgagggcgccgccccccagatcccagcccgggccttccgggtggtgtgtgacaacatgctgcagggcctggcccggagcctgcgctgcctgggcgtggatgccaggatgctgggcaatggagaggaccaccggcgggctgctgaggtggcccggcaggagggccgcatcatcctgaccagcggccagcccttccacaagctgcgggcccaggtgggcgccggccgctgcctgtctgtggactgcagcctgaaggcccagcagcaggccaaggctgtgctgaagcacttcaacgtgcgggtgacccatgctgacatcttcagccgctgccaggcctgcaactgtgaccagtacctgaaggtgtcccgggacatgatgaagcagctgatgtggctgagcagccaccaggagggccccaggagcagtggagatgaggccacccagagccaggccgtgcaggagcccggccctgccccagatgctgcccctgagggctgcacctatgaccggccctgccgctggctgcagatggctgacctgcgggcagagaccccagacatgctggctgatggcacccggctgcagctggccggcgtgcctgtgggcgtgctgcggaccccaggcctgcgctgcttctactgctgcaccggctgcggcaaggtgttctgggatggcagccacctgggccgggtggccacccacttccgggacatgctggagagcgcccccagcccctgtgagcccagccctgcccccagccctgccagcagccccttctag

SEQ ID NO: 38287 - DNA, 1545 bp, Artificial Sequence
  Description of Artificial Sequence: Synthetic coding sequence
atggagctgctgctgcctgaggagcggctgcctgctgctgtggccgtggagctgcggcgcttccggctgcagggccgggccacagaggccgacagccggctggaggtgaaggacatgaaggaccgctactaccagctgcccatccccagagaaaatgtgcacctgctggcctcctgggaggacctgaccaggcatgaaggagccctgctgcagtgccaccaggtggtgggcgtggatgtggagtggacccctgtgtttgtggccggcggccggccccggcccagcctgctgcaggtggccgtggagggccacgtgttcctgctggatgtgctggccctgagccagccccccaccggccagggcgcccaggccttcagccggctggtggcccagctgctgagtgaccccagcatcaccaagctgggctacggcatggtgggggacctgcagaagctgggcaccagctgcccagccctggcccacgtggagaagcagatcctgggcggcatggacctgctgctggtgcaccggcagatgagggtggcctctgtgcctgccccagctgtggaccgggcccgggagctgcggggcctgagcctgctggtgcagcaggtgctgggcacagccctggacaagacccagcagctgagcaactgggacagaagacccctgtgtgaggagcaggtgatctatgctgctgctgatgcctactgcctgctggaggtgcaccaggccctgtgccgggagcccgcccgcttccacctgtctgaggacctggccggcagcagaagacccaggcaccgggagaggcctggggccaggaagcccccaggcctgcagaaggccagcgccccagctgccccccggcagggcctggcccggagcctgcgctgcctgggcgtggatgccaggatgctgggcaatggagaggaccacagaagagctgctgaggtggcccggcaggagggccgcatcatcctgaccagcggccagcccttccacaagctgcgggcccaggtgggcgccggccgctgcctgtctgtggactgcagcctgaaggcccagcagcaggccaaggctgtgctgaagcacttcaacgtgcgggtgacccacgccgacatcttcagccgctgccaggcctgcaactgtgaccagtacctgaaggtgtcccgggacatgatgaagcagctgatgtggctgagcagccaccaggagggccccaggagcagcggccctgccccagatgctgcccctgagggctgcacctatgaccggccctgccgctggctgcagatggctgacctgcgggcagagaccccagacatgctggctgatggcacccggctgcagctggccggcgtgcctgtgggcgtgctgcggaccccaggcctgcgctgcttctactgctgcaccggctgcggcaaggtgttctgggatggcagccacctgggccgggtggccacccacttccgggacatgctggagagcgcccccagcccctgtgagcccagccctgcccccagccctgccagcagccccttctag

SEQ ID NO: 38288 - DNA, 2682 bp, Artificial Sequence
  Description of Artificial Sequence: Synthetic coding sequence
atgaccccacccagcagagctgaggccggcgtgcggcgcagccgggtgcccagcgagggccgctggagaggagctgagcccccaggcatcagcgccagcacccagcctgccagcgctggccgggccgcccggcactgtggggccatgtctggggcccggggggagggccctgaggccggggccggcggggccggcggccgggccgccccagaaaatcctggaggagtgctgtctgtggagctgcccggcctgctggcccagctggcccggagctttgccctgctgctgcctgtgtatgccctgggctacctgggcctgtccttctcctgggtgctgctggccctggccctgctggcctggtgccgccgcagccggggcctgaaggccctgcggctgtgccgggccctggccctgctggaggatgaggagcgggtggtgcggctgggcgtgcgggcctgtgacctgcctgcctgggtgcacttcccagacacagaaagagctgagtggctgaacaagacagtgaagcacatgtggcccttcatctgccagttcatcgagaagctgttccgggagaccatcgagcctgctgtgcggggggccaacacccacctgagcaccttctccttcaccaaggtggatgtgggccagcagcccctgcgcatcaacggggtgaaggtgtacacagaaaatgtggacaagaggcagatcatcctggacctgcagatcagctttgtgggcaactgtgaaattgacctggagatcaagcgctacttctgcagagctggggtgaagagcatccagatccacggcaccatgagggtcatcctggagcccctcatcggggacatgcccctggtgggcgccctgagcatcttcttcctgaggaagcccctgctggagatcaactggacaggcctgaccaacctgctggatgtgcccggcctgaatggcctgagtgacaccatcatcctggacatcatcagcaactacctggtgctgcccaaccgcatcaccgtgcccctggtgtctgaggtgcagatcgcccagctgcgcttccctgtgcccaagggcgtgctgcgcatccacttcatcgaggcccaggacctgcagggcaaggacacctacctgaagggcctggtgaagggcaagagtgacccctacggcatcatccgggtgggcaaccagatcttccagagcagggtcatcaaggagaacctgagccccaagtggaatgaggtgtatgaggccctggtgtatgagcaccctggccaggagctggagattgagctgtttgatgaagatcctgacaaggatgacttcctgggcagcctgatgattgacctgattgaggtggagaaggagcggctgctggatgagtggttcaccctggatgaggtgcccaagggcaagctgcacctgcggctggagtggctgaccctgatgcccaatgccagcaacctggacaaggtgctgacagacatcaaggctgacaaggaccaggccaatgatggcctgagcagcgccctgctgatcctgtacctggacagcgccaggaacctgcccagcggcaagaagatcagcagcaaccccaaccctgtggtgcagatgtctgtgggccacaaggcccaggagagcaagatccgctacaagaccaatgaacctgtgtgggaggagaacttcaccttcttcatccacaaccccaagaggcaggacctggaggtggaggtgagagatgagcagcaccagtgcagcctgggcaacctgaaggtgcccctgagccagctgctgaccagcgaggacatgacagtgtcccagcgcttccagctgagcaacagcggccccaacagcaccatcaagatgaagatcgccctgcgggtgctgcacctggagaagcgggagcggcccccagaccaccagcacagcgcccaggtgaagaggcccagcgtgtccaaggagggcaggaagaccagcatcaagagccacatgagcggcagccctggccctgggggcagcaacacagcccccagcacccctgtgattggaggcagtgacaagccaggcatggaggagaaggcccagcccccagaggccggcccccagggcctgcatgacctgggccgcagcagcagcagcctgctggccagccctggccacatctctgtgaaggagcccacccccagcatcgccagtgacatcagcctgcccatcgccacccaggagctgcggcagaggctgcggcagctggagaatggcaccaccctgggccagagccccctgggccagatccagctgaccatccgccacagcagccagaggaacaagctgattgtggtggtgcacgcctgcaggaacctgattgccttctctgaagatggcagtgacccctacgtgaggatgtacctgctgcctgacaagaggaggagcggccgcaggaagacccacgtgtccaagaagaccctgaaccctgtgtttgaccagagctttgacttctctgtgtccctgcctgaggtgcagaggaggaccctggatgtggccgtgaagaacagcggcggcttcctgagcaaggacaagggcctgctgggcaaggtgctggtggccctggccagcgaggagctggccaagggctggacccagtggtatgacctgacagaagatggcacccggccccaggccatgacctag

SEQ ID NO: 38289 - DNA, 672 bp, Artificial Sequence
  Description of Artificial Sequence: Synthetic coding sequence
atgcctgtgtttcctccctgtgtgctgcaggtgagagatgagcagcaccagtgcagcctgggcaacctgaaggtgcccctgagccagctgctgaccagcgaggacatgacagtgtcccagcgcttccagctgagcaacagcggccccaacagcaccatcaagatgaagatcgccctgcgggtgctgcacctggagaagcgggagcggcccccagaccaccagcacagcgcccaggtgaagaggccttctgtgtccaaggagggcaggaagaccagcatcaagagccacatgagcggcagccctggccctgggggcagcaacacagcccccagcacccctgtgattggaggcagtgacaagccaggcatggaggagaaggcccagcccccagaggccggcccccagggcctgcatgacctgggccgcagcagcagcagcctgctggccagccctggccacatctctgtgaaggagcccacccccagcatcgccagtgacatcagcctgcccatcgccacccaggagctgcggcagaggctgcggcagctggagaatggcaccaccctgggccagagccccctgggccagatccagctgaccatccgccacagcagccagaagcaggcctaccggggccgggcctgcctgcagaagccccactgcctgctgtag

SEQ ID NO: 38290 - DNA, 2829 bp, Artificial Sequence
  Description of Artificial Sequence: Synthetic coding sequence
atgacagccaacagagatgctgccctgagcagccaccgccaccctggctgtgcccagaggcccaggacccccacctttgccagcagcagccagaggagaagtgccttcggctttgatgatggcaacttccctggcctgggggagaggagccacgcccctggcagccggctgggcgccaggagaagagccaagacagcccggggcctgcggggccaccggcagagaggagctggagctggcctgagccggcccggcagcgcccgggcccccagcccccccaggcctggggccccagaaaatcctggaggagtgctgtctgtggagctgcccggcctgctggcccagctggcccggagctttgccctgctgctgcctgtgtatgccctgggctacctgggcctgtccttctcctgggtgctgctggccctggccctgctggcctggtgccgccgcagccggggcctgaaggccctgcggctgtgccgggccctggccctgctggaggatgaggagcgggtggtgcggctgggcgtgcgggcctgtgacctgcctgcctgggtgcacttcccagacacagaaagagctgagtggctgaacaagacagtgaagcacatgtggcccttcatctgccagttcatcgagaagctgttccgggagaccatcgagcctgctgtgcggggggccaacacccacctgagcaccttctccttcaccaaggtggatgtgggccagcagcccctgcgcatcaacggggtgaaggtgtacacagaaaatgtggacaagaggcagatcatcctggacctgcagatcagctttgtgggcaactgtgaaattgacctggagatcaagcgctacttctgcagagctggggtgaagagcatccagatccacggcaccatgagggtcatcctggagcccctcatcggggacatgcccctggtgggcgccctgagcatcttcttcctgaggaagcccctgctggagatcaactggacaggcctgaccaacctgctggatgtgcccggcctgaatggcctgagtgacaccatcatcctggacatcatcagcaactacctggtgctgcccaaccgcatcaccgtgcccctggtgtctgaggtgcagatcgcccagctgcgcttccctgtgcccaagggcgtgctgcgcatccacttcatcgaggcccaggacctgcagggcaaggacacctacctgaagggcctggtgaagggcaagagtgacccctacggcatcatccgggtgggcaaccagatcttccagagcagggtcatcaaggagaacctgagccccaagtggaatgaggtgtatgaggccctggtgtatgagcaccctggccaggagctggagattgagctgtttgatgaagatcctgacaaggatgacttcctgggcagcctgatgattgacctgattgaggtggagaaggagcggctgctggatgagtggttcaccctggatgaggtgcccaagggcaagctgcacctgcggctggagtggctgaccctgatgcccaatgccagcaacctggacaaggtgctgacagacatcaaggctgacaaggaccaggccaatgatggcctgagcagcgccctgctgatcctgtacctggacagcgccaggaacctgcccagcaaccccctggagttcaacccagatgtgctgaagaagacagctgtgcagagggccctgaagagcggcaagaagatcagcagcaaccccaaccctgtggtgcagatgtctgtgggccacaaggcccaggagagcaagatccgctacaagaccaatgaacctgtgtgggaggagaacttcaccttcttcatccacaaccccaagaggcaggacctggaggtggaggtgagagatgagcagcaccagtgcagcctgggcaacctgaaggtgcccctgagccagctgctgaccagcgaggacatgacagtgtcccagcgcttccagctgagcaacagcggccccaacagcaccatcaagatgaagatcgccctgcgggtgctgcacctggagaagcgggagcggcccccagaccaccagcacagcgcccaggtgaagaggccttctgtgtccaaggagggcaggaagaccagcatcaagagccacatgagcggcagccctggccctgggggcagcaacacagcccccagcacccctgtgattggaggcagtgacaagccaggcatggaggagaaggcccagcccccagaggccggcccccagggcctgcatgacctgggccgcagcagcagcagcctgctggccagccctggccacatctctgtgaaggagcccacccccagcatcgccagtgacatcagcctgcccatcgccacccaggagctgcggcagaggctgcggcagctggagaatggcaccaccctgggccagagccccctgggccagatccagctgaccatccgccacagcagccagaggaacaagctgattgtggtggtgcacgcctgcaggaacctgattgccttctctgaagatggcagtgacccctacgtgaggatgtacctgctgcctgacaagagaagaagtggaagaaggaagacccacgtgtccaagaagaccctgaaccctgtgtttgaccagagctttgacttctctgtgtccctgcctgaggtgcagaggaggaccctggatgtggccgtgaagaacagcggcggcttcctgagcaaggacaagggcctgctgggcaaggtgctggtggccctggccagcgaggagctggccaagggctggacccagtggtatgacctgacagaagatggcacccggccccaggccatgacctag

SEQ ID NO: 38291 - DNA, 1584 bp, Artificial Sequence
  Description of Artificial Sequence: Synthetic coding sequence
atgtggcccttcatctgccagttcatcgagaagctgttccgggagaccatcgagcctgctgtgcggggggccaacacccacctgagcaccttctccttcaccaaggtggatgtgggccagcagcccctgcgcatcaacggggtgaaggtgtacacagaaaatgtggacaagaggcagatcatcctggacctgcagatcagctttgtgggcaactgtgaaattgacctggagatcaagcgctacttctgcagagctggggtgaagagcatccagatccacggcaccatgagggtcatcctggagcccctcatcggggacatgcccctggtgggcgccctgagcatcttcttcctgaggaagcccctgctggagatcaactggacaggcctgaccaacctgctggatgtgcccggcctgaatggcctgagtgacaccatcatcctggacatcatcagcaactacctggtgctgcccaaccgcatcaccgtgcccctggtgtctgaggtgcagatcgcccagctgcgcttccctgtgcccaagggcgtgctgcgcatccacttcatcgaggcccaggacctgcagggcaaggacacctacctgaagggcctggtgaagggcaagagtgacccctacggcatcatccgggtgggcaaccagatcttccagagcagggtcatcaaggagaacctgagccccaagtggaatgaggtgtatgaggccctggtgtatgagcaccctggccaggagctggagattgagctgtttgatgaagatcctgacaaggatgacttcctgggcagcctgatgattgacctgattgaggtggagaaggagcggctgctggatgagtggttcaccctggatgaggtgcccaagggcaagctgcacctgcggctggagtggctgaccctgatgcccaatgccagcaacctggacaaggtgctgacagacatcaaggctgacaaggaccaggccaatgatggcctgagcagcgccctgctgatcctgtacctggacagcgccaggaacctgcccagcggcaagaagatcagcagcaaccccaaccctgtggtgcagatgtctgtgggccacaaggcccaggagagcaagatccgctacaagaccaatgaacctgtgtgggaggagaacttcaccttcttcatccacaaccccaagaggcaggacctggaggtggaggtgagagatgagcagcaccagtgcagcctgggcaacctgaaggtgcccctgagccagctgctgaccagcgaggacatgacagtgtcccagcgcttccagctgagcaacagcggccccaacagcaccatcaagatgaagatcgccctgcgggtgctgcacctggagaagcgggagcggcccccagaccaccagcacagcgcccaggtgaagaggcccagcgtgtccaaggagggcaggaagaccagcatcaagagccacatgagcggcagccctggccctgggggcagcaacacagccccagccaccagccagagccgcagccggcccccagccagccccaggaccagccgctgccccagcccccccaggagctgtgggaagggctag

SEQ ID NO: 38292 - DNA, 987 bp, Artificial Sequence
  Description of Artificial Sequence: Synthetic coding sequence
atgcctgtgtttcctccctgtgtgctgcaggtgagagatgagcagcaccagtgcagcctgggcaacctgaaggtgcccctgagccagctgctgaccagcgaggacatgacagtgtcccagcgcttccagctgagcaacagcggccccaacagcaccatcaagatgaagatcgccctgcgggtgctgcacctggagaagcgggagcggcccccagaccaccagcacagcgcccaggtgaagaggccttctgtgtccaaggagggcaggaagaccagcatcaagagccacatgagcggcagccctggccctgggggcagcaacacagcccccagcacccctgtgattggaggcagtgacaagccaggcatggaggagaaggcccagcccccagaggccggcccccagggcctgcatgacctgggccgcagcagcagcagcctgctggccagccctggccacatctctgtgaaggagcccacccccagcatcgccagtgacatcagcctgcccatcgccacccaggagctgcggcagaggctgcggcagctggagaatggcaccaccctgggccagagccccctgggccagatccagctgaccatccgccacagcagccagaggaacaagctgattgtggtggtgcacgcctgcaggaacctgattgccttctctgaagatggcagtgacccctacgtgaggatgtacctgctgcctgacaagagaagaagtggaagaaggaagacccacgtgtccaagaagaccctgaaccctgtgtttgaccagagctttgacttctctgtgtccctgcctgaggtgcagaggaggaccctggatgtggccgtgaagaacagcggcggcttcctgagcaaggacaagggcctgctgggcaaggtgctggtggccctggccagcgaggagctggccaagggctggacccagtggtatgacctgacagaagatggcacccggccccaggccatgacctag

SEQ ID NO: 38293 - DNA, 2487 bp, Artificial Sequence
  Description of Artificial Sequence: Synthetic coding sequence
atggccggccggggctggggcgccctgtgggtgtgtgtggccgccgccaccctgctgcatgctgggggcctggcccgggctgactgctggctgattgaaggagacaagggctttgtgtggctggccatctgcagccagaaccagcccccctatgaggccatcccccagcagatcaacagcaccatcgtggacctgcggctgaatgaaaatcgcatccgctctgtgcagtatgccagcctgagcagatttggaaacctgacctacctgaacctgaccaagaatgagatcggctacattgaagatggagccttcagcggccagttcaacctgcaggtgctgcagctgggctacaaccggctgaggaacctgacagagggcatgctgcggggcctgggcaagctggagtacctgtacctgcaggccaacctgattgaggtggtgatggccagcagcttctgggagtgccccaacatcgtgaacatcgacctgtccatgaaccgcatccagcagctgaacagcggcacctttgctggcctggccaagctgtctgtgtgtgagctgtacagcaaccccttctactgcagctgtgagctgctgggcttcctgcgctggctggccgccttcaccaatgccacccagacctatgacaggatgcagtgtgagagcccccctgtgtacagcggctactacctgctgggccagggccggcggggccacaggagcatcctgagcaagctgcagagcgtgtgcacagaggacagctatgctgctgaggtggtgggcccccccaggcctgccagcggccgcagccagcccggccgcagccccccacctcctcctcctcctgagcccagcgacatgccctgtgctgatgatgagtgcttctctggagatggcaccacccccctggtggccctgcccaccctggccacccaggccgaggcccggcccctcatcaaggtgaagcagctgacccagaacagcgccaccatcaccgtgcagctgcccagccccttccacaggatgtacaccctggagcacttcaacaacagcaaggccagcacagtgtcccggctgaccaaggcccaggaggagatccggctgaccaacctcttcaccctgaccaactacacctactgtgtggtgtccaccagcgctggcctgcggcacaaccacacctgcctgaccatctgcctgccccggctgcccagccccccaggccctgtgcccagccccagcacagccacccactacatcatgaccatcctgggctgcctgtttggcatggtgctggtgctgggcgctgtgtactactgcctgcggaggagaagacggcaggaggagaagcacaagaaggccgccagcgctgctgctgctggcagcctgaagaagaccatcatcgagctgaagtatggccctgagctggaggcccctggcctggcccccctgagccagggccccctgctgggccctgaggccgtgacccgcatcccctacctgcctgctgctggggaggtggagcagtacaagctggtggagagcgctgacacccccaaggccagcaagggcagctacatggaggtgaggactggagaccccccagagcggcgggactgtgagctgggccggcccggccctgacagccagagctctgtggccgagatcagcaccatcgccaaggaggtggacaaggtgaaccagatcatcaacaactgcattgatgccctgaagtctgagagcaccagcttccagggcgtgaagagcggccctgtgtctgtggccgagccccccctggtgctgctgtctgagcccctggccgccaagcacggcttcctggcccctggctacaaggatgccttcggccacagcctgcagaggcaccacagcgtggaggccgccggccccccccgggccagcaccagcagcagcggctctgtgcgcagcccccgggccttccgggcagaggccgtgggcgtgcacaaggctgctgctgctgaggccaagtacatcgagaagggcagccctgctgctgatgccatcctgactgtgaccccagctgctgctgtgctgcgggcagaggccgagaagggccggcagtacggggagcaccgccacagctacccaggcagccaccctgctgagcccccagcccctcctggccccccacctcctcctcctcatgagggcctgggcaggaaggccagcatcctggagcccctgacccggccccggccccgggacctggcctacagccagctgagcccccagtaccacagcctgagctacagcagcagccctgagtacacctgccgggccagccagagcatctgggagcgcttccggctgagcagaagaagacacaaggaggaggaggagttcatggccgccggccacgccctgaggaagaaggtgcagtttgccaaggatgaggacctgcatgacatcctggactactggaagggcgtgtctgcccagcacaagagctag

SEQ ID NO: 38294 - DNA, 2487 bp, Artificial Sequence; identical to SEQ ID NO: 38293
  Description of Artificial Sequence: Synthetic coding sequence

SEQ ID NO: 38295 - DNA, 495 bp, Artificial Sequence
  Description of Artificial Sequence: Synthetic coding sequence
atgctgcagcaggacagcaatgatgacacagaagatgtgtccctgtttgatgctgaggaggagaccaccaaccggcccaggaaggccaagatccgccaccctgtggccagcttcttccacctgttcttccgggtgtctgccatcatcgtgtgcctgctgtgtgagctgctgagcagcagcttcatcacctgcatggtgaccatcatcctgctgctgagctgtgacttctgggccgtgaagaatgtgacaggccgcctgatggtgggcctgcgctggtggaaccacattgatgaagatggcaagagccactgggtgtttgagagcaggaaggagagcagccaggagaacaagacagtgtctgaggccgagagccgcatcttctggctgggcctcatcgcctgcagcgtgctgtgggtgatctttgccttcagcgccctcttctccttcaccgtgaagtggctggagagcgagcctgtgatgctgaggaaccagtag

SEQ ID NO: 38296 - DNA, 534 bp, Artificial Sequence
  Description of Artificial Sequence: Synthetic coding sequence
atgtctgtgaacatggatgagctgaagcaccaggtgatgatcaaccagtttgtgctgacagctggctgtgccgctgaccaggccaagcagctgctgcaggccgcccactggcagtttgaaacagccctgagcgccttcttccaggagaccaacatcccctacagccaccaccaccaccagatgatgtgcaccccagccaacaccccagccaccccacccaacttcccagatgccctgaccatgttcagccggctgaaggccagcgagagcttccacagcggcggcagcggcagccccatggccgccacagccaccagccccccaccccacttcccccacgccgccaccagcagcagcgctgccagctcctggcccacagctgccagccccccaggcggcccccagcaccaccagccccagccccccctgtggacccccaccccacccagccctgccagtgactggccacccctggccccccagcaggccaccagcgagccccgggcccacccagccatggaggccgagaggtag

SEQ ID NO: 38297 - DNA, 495 bp, Artificial Sequence
  Description of Artificial Sequence: Synthetic coding sequence
atgtctgtgaacatggatgagctgcggcaccaggtgatgatcaaccagtttgtgctggccgccggctgtgccgctgaccaggccaagcagctgctgcaggccgcccactggcagtttgaaacagccctgagcaccttcttccaggagaccaacatccccaacagccaccaccaccaccagatgatgtgcacccccagcaacaccccagccaccccacccaacttcccagatgccctggccatgttcagcaagctgcgggccagcgagggcctgcagagcagcaacagccccatgacagctgctgcctgcagccccccagccaacttcagccccttctgggccagcagcccccccagccaccaggccccctggatcccccccagcagccccaccaccttccaccacctgcaccggccccagcccacctggcccccaggggcccagcagggcggggcccagcagaaggccatggccgccatggatggccagaggtag

SEQ ID NO: 38298 - DNA, 435 bp, Artificial Sequence
  Description of Artificial Sequence: Synthetic coding sequence
agccctgccagcctgcccctggcccctggctgtgccctgcggctgtgccccctgagctttggagaaggagtggagtttgaccccctgccccccaaggaggtgcgctacaccagcctggtgaagtatgacagcgagcggcacttcattgatgatgtgcagctgcccctgggcctggccgtggccagctgcagccagacagtgacctgtgtgcccaacggcacctggaggaactacaaggccgaggtgcgctttgagcccaggcaccggcccacccgcttcctgagcaccaccatcgtgtaccccaagtaccccaaggctgtgtacaccaccaccctggactacaactgcaggaagaccctgcggcgcttcctgagctctgtggagctggaggccgctgagctgcccggcagtgatgacctgagtgatgaatgttag

SEQ ID NO: 38299 - DNA, 408 bp, Artificial Sequence
  Description of Artificial Sequence: Synthetic coding sequence
atgaggcccaggatgctgcctgtgttcttcggggagagcatcaaggtgaaccctgagcccacccatgagatccgctgcaacagcgaggtgaagtatgccagcgagaagcacttccaggacaaggtgttctacgcccctgtgcccaccgtgacagcctacagcgagaccatcgtggccgcccccaactgcacctggaggaactaccgcagccagctgaccctggagccccggccccgggccctgcgcttccgcagcaccaccatcatcttccccaagcacgcccggagcaccttccgcaccaccctgcactgcagcctgggccggcccagccgctggttcaccgcctctgtgcagctgcagctgtgccaggaccctgcccccagcctgctgggccctgccaccctgtag

SEQ ID NO: 38300 - DNA, 408 bp, Artificial Sequence; identical to SEQ ID NO: 38299
  Description of Artificial Sequence: Synthetic coding sequence

SEQ ID NO: 38301 - DNA, 651 bp, Artificial Sequence
  Description of Artificial Sequence: Synthetic coding sequence
atggtgggccacctgcacctgcagggcatggaggacagcctgaaggagcagggccgggagggcctgctggacagcccagacagcggcctgccccccagccccagccccagcccccccttctacagcctggcccctggcatcctggatgcccgggccggcggggccggggccagcagcgagcccccaggccccagcgaggcccgggccccacccagccagctgcccaaccccccagccagcgagatgaggcccaggatgctgcccgtcttctttggagagagcatcaaggtgaaccctgagcccacccatgagatccgctgcaacagcgaggtgaagtatgccagcgagaagcacttccaggacaaggtgttctacgcccctgtgcccaccgtgacagcctacagcgagaccatcgtggccgcccccaactgcacctggaggaactaccgcagccagctgaccctggagccccggccccgggccctgcgcttccgcagcaccaccatcatcttccccaagcacgcccggagcaccttccgcaccaccctgcactgcagcctgggccggcccagccgctggttcaccgcctctgtgcagctgcagctgtgccaggaccctgcccccagcctgctgggccctgccaccctgtag

SEQ ID NO: 38302 - DNA, 369 bp, Artificial Sequence
  Description of Artificial Sequence: Synthetic coding sequence
atgaggcccaggatgctgcctgtgttcttcggggagagcatcaaggtgaaccctgagcccacccatgagatccgctgcaacagcgaggtgaagtatgccagcgagaagcacttccaggacaaggtgttctacgcccctgtgcccaccgtgacagcctacagcgagaccatcgtggccgcccccaactgcacctggaggaactaccgcagccgctggttcaccgcctctgtgcagctgcagctgtgccaggaggccggccgggaggccgcccggcccaggaccagggtggagggcggcggcagccccctgcctgccctgacctaccgcctgggcggcggcctgctggtgctggtgtccaggacccagtag

SEQ ID NO: 38303 - DNA, 408 bp, Artificial Sequence; identical to SEQ ID NO: 38299
  Description of Artificial Sequence: Synthetic coding sequence

SEQ ID NO: 38304 - DNA, 435 bp, Artificial Sequence; identical to SEQ ID NO: 38298
  Description of Artificial Sequence: Synthetic coding sequence

SEQ ID NO: 38305 - DNA, 1083 bp, Artificial Sequence
  Description of Artificial Sequence: Synthetic coding sequence
atgatgaagaagaagaagttcaagttcaaggtggactttgagctggaggagctgagctctgtgccctttgtgaatggagtgctcttctgcaagatgaggctgctggatggcggcagcttcaccgctgagagcagccgggaggtggtgcaggccaactgtgtgcgctggaggaagaagttctccttcatgtgcaagatgtctgccagcgctgccaccggcatcctggacccctgcatctacagagtgtctgtgaggaaggagctgaagggcggcaaggcctatgccaagctgggctttgctgacctgaacctggccgagtttgctggcagcggcaacaccacccggcgctgcctgctggagggctatgacaccaagaacacccggcaggacaacagcatcctgaaggtgctgatctccatgcagctgatgtctggggacccctgcttcaagaccccacccagcacctccatgagcatccccatcgccggggagagcgagagcctgcaggaggacagaaaaggaggagagaccctgaaggtgcacctgggcattgctgacctgagcgccaagagcgcctctgtgcctgatgagctgggcgcctgtggccacagcaggaccagcagctatgccagccagcagagcaaggtgtctggctacagcacctgccacagccgcagcagcagcttcagcgagctgtgccacagaagaaacacctctgtgggcagcaccagcactggagtggagagcatcctggagccctgtgatgaaattgagcagaagattgctgagcccaacctggacacagctgacaaggaggacacagccagcgagaagctgagccgctgccctgtgaagcaggacagcgtggagagccagctgaagagggtggatgacaccagggtggatgctgatgacatcgtggagaagatcctgcagagccaggacttcagcctggacagcagcgctgaggaggagggcctgcggctgtttgtgggccctgggggcagcaccaccttcggcagccaccacctgcccaacagagtgggcagcggggcctatgagcaggtggtgatcaagaggtag

SEQ ID NO: 38306 - DNA, 1068 bp, Artificial Sequence
  Description of Artificial Sequence: Synthetic coding sequence
atgatgaagaagaagaagttcaagttcaaggtggactttgagctggaggagctgagctctgtgccctttgtgaatggagtgctcttctgcaagatgaggctgctggatggcggcagcttcaccgctgagagcagccgggaggtggtgcaggccaactgtgtgcgctggaggaagaagttctccttcatgtgcaagatgtctgccagcgctgccaccggcatcctggacccctgcatctacagagtgtctgtgaggaaggagctgaagggcggcaaggcctatgccaagctgggctttgctgacctgaacctggccgagtttgctggcagcggcaacaccacccggcgctgcctgctggagggctatgacaccaagaacacccggcaggacaacagcatcctgaaggtgctgatctccatgcagctgatgtctggggacccctgcttcaagaccccacccagcacctccatgagcatccccatcgccggggagagcgagagcctgcaggaggacagaaaaggaggagagaccctgaaggtgcacctgggcattgctgacctgagcgccaagagcgcctctgtgcctgatgagctgggcgcctgtggccacagcaggaccagcagctatgccagccagcagagcaaggtgtctggctacagcacctgccacagccgcagcagcagcttcagcgagctgtgccacagaagaaacacctctgtgggcagcaccagcactggagtggagagcatcctggagccctgtgatgaaattgagcagaagattgctgagcccaacctggacacagctgacaaggaggacacagccagcgagaagctgagccgctgccctgtgaagcaggacagcgtggagagccagctgaagagggtggatgacaccagggtggatgctgatgacatcgtggagaagatcctgcagagccaggacttcagcctggacagcagcgctgaggaggagggcctgcggctgtttgtgggccctgggggcagcaccaccttcggcagccaccacctgcccaacagcttcctgaacagcggcagcctcatctag

SEQ ID NO: 38307 - DNA, 357 bp, Artificial Sequence
  Description of Artificial Sequence: Synthetic coding sequence
atgacagacacagctgaggccgtgcccaagtttgaggagatgtttgccagccgcttcacagaaaatgacaaggagtaccaggagtacctgaagaggcctcctgagagcccccccatcgtggaggagtggaacagcagagctgggggcaaccagaggaacagaggcaaccggctgcaggacaaccggcagttccggggccgggacaaccgctggggctggcccagcgacaacagaagcaaccagtggcacggccgctcctggggcaacaactacccccagcaccggcaggagccctactacccccagcagtatggccactacggctacaaccagaggcctccctacggctactactag

SEQ ID NO: 38308 - DNA, 141 bp, Artificial Sequence
  Description of Artificial Sequence: Synthetic coding sequence
atgggcggctgccctgtgaggaagagaagaagaaatggcagcaaggagggcaaccaccacagcacccagcccaagaggaacaagaggaaccccatcttccaggacagccaggacacagaggtggccatcttcatggagtag

SEQ ID NO: 38309 - DNA, 339 bp, Artificial Sequence
  Description of Artificial Sequence: Synthetic coding sequence
atgacctgcaggaagagaagaagaaatggcagcaaggagggcaaccaccacagcacccagcccaagaggaacaagaggaaccccatcttccaggacagccaggacacagagttctcctggagcgacaatgaaagaagcagcagccgcatcaacatccctgagcgggccagcggccctgagggcaacctgaaccagatcgtgacagagccagatgccaacttcccccagttcctgcacgagggctacgtgccctgccagggcctgtacagccacatcaaccagaccctgaaggaggcccacttcaacagcctgcagcagaggggccaggcccccacctag

SEQ ID NO: 38310 - DNA, 345 bp, Artificial Sequence
  Description of Artificial Sequence: Synthetic coding sequence
atgctggtgctgtggctgaagagaagaagaaatggcagcaaggagggcaaccaccacagcacccagcccaagaggaacaagaggaaccccatcttccaggacagccaggacacagagttctcctggagcgacaatgaaagaagcagcagccgcatcaacatccctgagcgggccagcggccctgagggcaacctgaaccagatcgtgacagagccagatgccaacttcccccagttcctgcacgagggctacgtgccctgccagggcctgtacagccacatcaaccagaccctgaaggaggcccacttcaacagcctgcagcagaggggccaggcccccacctag

SEQ ID NO: 38311 - DNA, 561 bp, Artificial Sequence
  Description of Artificial Sequence: Synthetic coding sequence
atgggcggccgcggggctgatgctggcagcagcggcggcaccggccccacagagggctacagccccccagctgccagcaccagggctgctgcccgggccaaggcccggggcggcggccggggcggcagaagaaacaccaccccatctgtgcccagcctgcggggggccgcccccaggagcttccaccccccagctgccatgtctgagcggctgcggcccaggaagagaagaagaaatggaaatgaggaggacaaccacctgcccccccagaccaagaggagcagcaggaaccctgtgttccaggacagctgggacacagagagcagcggcagtgacagcggcggcagcagcagcagcagcagcagcagcatcaacagcccagaccgggccagcggccctgagggcagcctgagccagaccatggccggcagcagccccaacaccccccagcctgtgcctgagcagagcgccctgtgccagggcctgtacttccacatcaaccagaccctgcgggaggcccacttccacagcctgcagcaccggggccggcccctgacctag

SEQ ID NO: 38312 - DNA, 624 bp, Artificial Sequence
  Description of Artificial Sequence: Synthetic coding sequence
atgggcggccgcggggctgatgctggcagcagcggcggcaccggccccacagagggctacagccccccagctgccagcaccagggctgctgcccgggccaaggcccggggcggcggccggggcggcagaagaaacaccaccccatctgtgcccagcctgcggggggccgcccccaggagcttccaccccccagctgccatgtctgagcggctgcggcccaggaagagaagaagaaatggaaatgaggaggacaaccacctgcccccccagaccaagaggagcagcaggaaccctgtgttccaggacagctgggacacagagaccgtgcctgtgatgaggaacagcaaagaaaatcggctgcggggcaacaaggccttctgtgccagcagcggcagtgacagcggcggcagcagcagcagcagcagcagcagcatcaacagcccagaccgggccagcggccctgagggcagcctgagccagaccatggccggcagcagccccaacaccccccagcctgtgcctgagcagagcgccctgtgccagggcctgtacttccacatcaaccagaccctgcgggaggcccacttccacagcctgcagcaccggggccggcccctgacctag

SEQ ID NO: 38313 - DNA, 351 bp, Artificial Sequence
  Description of Artificial Sequence: Synthetic coding sequence
atgggcggctgccctgtgaggaagagaagaagaaatggcagcaaggagggcaaccaccacagcacccagcccaagaggaacaagaggaaccccatcttccaggacagccaggacacagaggtgttctcctggagcgacaatgaaagaagcagcagccgcatcaacatccctgagcgggccagcggccctgagggcaacctgaaccagatcgtgacagagccagatgccaacttcccccagttcctgcacgagggcctgagcaagcctgtgtatgtgatcaactggttcatgagctttggacctgagatcaagctgaacaccagccagcagggcaggaaccaggccgtgtag

SEQ ID NO: 38314 - DNA, 348 bp, Artificial Sequence
  Description of Artificial Sequence: Synthetic coding sequence
atgggcggctgccctgtgaggaagagaagaagaaatggcagcaaggagggcaaccaccacagcacccagcccaagaggaacaagaggaaccccatcttccaggacagccaggacacagagttctcctggagcgacaatgaaagaagcagcagccgcatcaacatccctgagcgggccagcggccctgagggcaacctgaaccagatcgtgacagagccagatgccaacttcccccagttcctgcacgagggcctgagcaagcctgtgtatgtgatcaactggttcatgagctttggacctgagatcaagctgaacaccagccagcagggcaggaaccaggccgtgtag

SEQ ID NO: 38315 - DNA, 351 bp, Artificial Sequence
  Description of Artificial Sequence: Synthetic coding sequence
atgggcggctgccctgtgaggaagagaagaagaaatggcagcaaggagggcaaccaccacagcacccagcccaagaggaacaagaggaaccccatcttccaggacagccaggacacagaggtgttctcctggagcgacaatgaaagaagcagcagccgcatcaacatccctgagcgggccagcggccctgagggcaacctgaaccagatcgtgacagagccagatgccaacttcccccagttcctgcacgagggctacgtgccctgccagggcctgtacagccacatcaaccagaccctgaaggaggcccacttcaacagcctgcagcagaggggccaggcccccacctag

SEQ ID NO: 38316 - DNA, 1071 bp, Artificial Sequence
  Description of Artificial Sequence: Synthetic coding sequence
atggccgccaccaggagccccacccgggcccgggagcgggagaggtctggggccccagctgctggcagtgaccaggtgcacagctggatgctggccaccagccaggccctggacacagtgtggaggatggccaagggctttgtgatgctggccgtgtccttcctggtggccgccatctgctacttccggcggctgcacctgtacagcggccacaagctgaagtggtggattggctacctgcagaggaagttcaagaggaacctgtctgtggaggccgaggtggacctgctgagctactgtgcccgggagtggaagggggagacccccaggaacaagctgatgaggaaggcctatgaggagctgttctggaggcaccacatcaagtgtgtgcggcaggtgcggcgggacaactatgatgccctgcggtctgtgctcttccagatcttcagccagggcatctccttccccagctggatgaaggagaaggacatcgtgaagctgcctgagaagctgctcttcagccagggctgcaactggatccagcagtacagctttggacctgagaagtacacaggcagcaatgtgtttgggaagctgaggaaatatgtggagctgctgaagacccagtggacagagttcaacggcatccgggactaccacaagaggggctccatgtgcaacaccctcttcagtgatgccatcctggagtacaagctgtatgaggccctgaagttcatcatgctgtaccaggtgacagaggtgtatgagcagatgaagaccaagaaggtgatccccagcctcttccggctgctcttcagccgggagaccagcagtgaccccctgtccttcatgatgaaccacctgaacagcgtgggggacacctgtggcctggagcagattgacatgttcatcctgggctacagcctggaggtgaagatcaaggtgttccgcctcttcaagttcaacagccgggactttgaggtgtgctacccagaggagcccctgcgggactggccagagatcagcctgctgacagaaaatgacagacactaccacatccctgtgttctag

SEQ ID NO: 38317 - DNA, 1059 bp, Artificial Sequence
  Description of Artificial Sequence: Synthetic coding sequence
atgagccggggcaccatgccccagcctgaggcctggccaggggccagctgtgccgagaccccagcccgggaggccgccgccacagccagagatggcggcaaggccgccgccagcggccagcccaggcctgagatgcagtgcccagctgagcacgaggaggacatgtacagagctgctgatgaaattgagaaggagaaggagctgctgattcatgagcggggggccagcgagccccggctgtctgtggcccctgagatggacatcatggactactgcaagaaggagtggaggggcaacacccagaaggccacctgcatgaagatgggctatgaggaggtgtcccagaagttcaccagcatcagaagagtgcggggggacaactactgtgccctgcgggccaccctcttccaggccatgagccaggccgtgggcctgcccccctggctgcaggaccctgagctgatgctgctgcctgagaagctgatcagcaagtacaactggatcaagcagtggaagctgggcctgaagtttgatggcaagaatgaagacctggtggacaagatcaaggagagcctgaccctgctgaggaagaagtgggccggcctggccgagatgaggacagctgaggcccggcagatcgcctgtgatgagctgttcaccaatgaagctgaggagtacagcctgtatgaagctgtgaagttcctgatgctgaacagagccatcgagctgtacaatgacaaggagaagggcaaggaggtgcccttcttctctgtgctgctgtttgcccgggacaccagcaatgaccccggccagctgctgaggaaccacctgaaccaggtgggccacactggaggcctggagcaggtggagatgttcctgctggcctatgctgtgcgccacaccatccaggtgtaccgcctgagcaagtacaacacagaggagttcatcaccgtgtaccccacagatcctcccaaggactggcctgtggtgaccctgattgctgaagatgacagacactacaacatccctgtgcgggtgtgtgaggagaccagcctgtag

SEQ ID NO: 38318 - DNA, 510 bp, Artificial Sequence
  Description of Artificial Sequence: Synthetic coding sequence
atgctgcccagcaccatgttcctggtgcacctgcccctgagcaccaaccggctgcactgcctgaggaacaccagcctggagagctacctgtgcagctttgtgcacctgaaccaccccctgcacatcagtgacagagtcatcctgatcagcctgcacgaggccgtgcgcttctcctttgccttctccttcccccggggcaccctgagcatcgcctactgcctgatgagctctgtgtccaccagcagcgaggccatcatgagcacagagctgctggccaactactgccacagcagcctgcacgtgtgcatctgcatcagcagcttccccaatgagaccggcaaccacgacagcttccctggagctgtggtgtccatcagtgaccagcccacagaccagtgcaagctggccgccaaggagctgcccctgaggaacctgctggagtgccgcttctttgactgcatgggagaagaagatctcatcaacctgggcgtgattggaacagaaagatag

SEQ ID NO: 38319 - DNA, 510 bp, Artificial Sequence
  Description of Artificial Sequence: Synthetic coding sequence
atgctgcccagcaccatgttcctggtgcacctgcccctgagcaccaaccggctgcactgcctgaggaacaccagcctggagccctgcctgtgcagctttgtgcacctgaaccaccccctgcacatcagtgaccctgtgatcctgatcagcctgcacgaggccgtgcgcttctcctttgccttctccttcccccggggcaccctgagcatcgcctactgcctgatgagctctgtgtccaccagcagcgaggccatcatgagcacagagctgctggccaactactgccacagcagcctgcacgtgtgcatctgcatcagcagcttccccaatgagaccggcaaccacgacagcttccctggagctgtggtgtccatcagtgaccagcccacagaccagtgcaagctggccgccaaggagctgcccctgaggaacctgctggagtgccgcttctttgactgcatgggagaagaagatctcatcaacctgggcgtgattggaacagaaagatag

SEQ ID NO: 38320 - DNA, 921 bp, Artificial Sequence
  Description of Artificial Sequence: Synthetic coding sequence
atgagcacctggaaggcccggctgaccaagaggctgaagagccccagccgctccatgcaccccttcccctgcagcgccctgctggcctgctttggaaacacccgggagagcgccagcttcaaccagagcggcgtggccgacacccacagcacagtgcgggtgcagcctgtggccaaggccggccggcagcccaggcaccccagcgctgagggcgcccctgagaagaggcaggacagcagcacccatgctgagagaaatggcagcgccaacagaaacagcagccacaggacagctgcccagcctgctgagaccccagaagatgtgcccggcagcctggatgatggagctgactgtgaggccgtggtgttccacgccagcatcccccggcccagcatcatcgacacccccaaggaggaggagttccgggaggagcccaagtgcctggagctggagcagaagatgaccagtgacagccccccagaagatattgaccacaaggacagctacctgatcaccaggagcatcatggccgagccagactacattgaagatgacaaccctgagctgatccggccccagaagctgatcaaccctgtgaagaccagcaggaaccaccaggacctgcaccgggagctgctgatgaaccagaagaggggcctggccccccagaacaagccagagctgcagaaggtgatggagaagaggaagagggaccaggtgatcaagcagaaggaggaggaggcccagaagaagaagagtgacctggagattgagctgctgaagaggcagcagaagctggagcagctggagctggagaagcagaagctgcaggaggagcaggagaatgcccctgagtttgtgaaggtgaagggcaacctgcggaggacaggccaggaggtggcccaggcccaggagagctag

SEQ ID NO: 38321 - DNA, 396 bp, Artificial Sequence
  Description of Artificial Sequence: Synthetic coding sequence
atggccgagccagactacattgaagatgacaaccctgagctgatccggccccagaagctgatcaaccctgtgaagaccagcaggaaccaccaggacctgcaccgggagctgctgatgaaccagaagaggggcctggccccccagaacaagccagagctgcagaaggtgatggagaagaggaagagggaccaggtgatcaagcagaaggaggaggaggcccagaagaagaagagtgacctggagattgagctgctgaagaggcagcagaagctggagcagctggagctggagaagcagaagctgcaggaggagcaggagaatgcccctgagtttgtgaaggtgaagggcaacctgcggaggacaggccaggaggtggcccaggcccaggagagctag

SEQ ID NO: 38322 - DNA, 396 bp, Artificial Sequence; identical to SEQ ID NO: 38321
  Description of Artificial Sequence: Synthetic coding sequence

SEQ ID NO: 38323 - DNA, 396 bp, Artificial Sequence; identical to SEQ ID NO: 38321
  Description of Artificial Sequence: Synthetic coding sequence

SEQ ID NO: 38324 - DNA, 396 bp, Artificial Sequence; identical to SEQ ID NO: 38321
  Description of Artificial Sequence: Synthetic coding sequence

SEQ ID NO: 38325 - DNA, 396 bp, Artificial Sequence; identical to SEQ ID NO: 38321
  Description of Artificial Sequence: Synthetic coding sequence

SEQ ID NO: 38326 - DNA, 396 bp, Artificial Sequence; identical to SEQ ID NO: 38321
  Description of Artificial Sequence: Synthetic coding sequence

SEQ ID NO: 38327 - DNA, 273 bp, Artificial Sequence
  Description of Artificial Sequence: Synthetic coding sequence
atggccgagccagactacattgaagatgacaaccctgagctgatccggccccagaagctgatcaaccctgtgaagaccagcaggaaccaccaggacctgcaccgggagctgctgatgaaccagaagaggggcctggccccccagaacaagccagagctgcagaaggtgatggagaagaggaagagggaccaggtgatcaagcagaaggaggaggaggcccagaagaagaagagtgacctggagattgagctgctgaagaggcagcagaagtag

SEQ ID NO: 38328 - DNA, 387 bp, Artificial Sequence
  Description of Artificial Sequence: Synthetic coding sequence
atggccgagccagactacattgaagatgacaaccctgagctgatccggccccagaagctgatcaaccctgtgaagaccagcaggaaccaccaggacctgcaccgggagctgctgatgaaccagaagaggggcctggccccccagaacaagccagagctgcagaaggtgatggagaagaggaagagggaccaggtgatcaagcagaaggaggaggaggcccagaagaagaagagtgacctggagattgagctgctgaagaggcagcagaagctggagcagctggagctggagaagcagaagctgcaggaggagcaggagaatgcccctgagtttgtgaaggtgaagggcaacctgcggaggacaggccaggaggtggcccaggcctag

SEQ ID NO: 38329 - DNA, 396 bp, Artificial Sequence; identical to SEQ ID NO: 38321
  Description of Artificial Sequence: Synthetic coding sequence

SEQ ID NO: 38330 - DNA, 396 bp, Artificial Sequence; identical to SEQ ID NO: 38321
  Description of Artificial Sequence: Synthetic coding sequence

SEQ ID NO: 38331 - DNA, 204 bp, Artificial Sequence
  Description of Artificial Sequence: Synthetic coding sequence
atggccgagccagactacattgaagatgacaaccctgagctgatccggccccagaagctgatcaaccctgtgaagaccagcaggaaccaccaggacctgcaccgggagctgctgatgaaccagaagaggggcctggccccccagaacaagccagagctgcagaaggtgatggagaagaggaagagggaccaggtgatcaagtag

SEQ ID NO: 38332 - DNA, 306 bp, Artificial Sequence
  Description of Artificial Sequence: Synthetic coding sequence
atggccgagccagactacattgaagatgacaaccctgagctgatccggccccagaagctgatcaaccctgtgaagaccagcaggaaccaccaggacctgcaccgggagctgctgatgaaccagaagaggggcctggccccccagaacaagccagagctgcagaaggtgatggagaagaggaagagggaccaggtgatcaagcagaaggaggaggaggcccagaagaagaagagtgacctggagattgagctgctgaagaggcagcagaagctggagcagctggagctggagaagcagaagctgtag

SEQ ID NO: 38333 - DNA, 396 bp, Artificial Sequence; identical to SEQ ID NO: 38321
  Description of Artificial Sequence: Synthetic coding sequence

SEQ ID NO: 38334 - DNA, 396 bp, Artificial Sequence; identical to SEQ ID NO: 38321
  Description of Artificial Sequence: Synthetic coding sequence

SEQ ID NO: 38335 - DNA, 255 bp, Artificial Sequence
  Description of Artificial Sequence: Synthetic coding sequence
atggccgagccagactacattgaagatgacaaccctgagctgatccggccccagaagctgatcaaccctgtgaagaccagcaggaaccaccaggacctgcaccgggagctgctgatgaaccagaagaggggcctggccccccagaacaagccagagctgcagaaggtgatggagaagaggaagagggaccaggtgatcaagcagaaggaggaggaggcccagaagaagaagagtgacctggagattgagctgtag

SEQ ID NO: 38336 - DNA, 282 bp, Artificial Sequence
  Description of Artificial Sequence: Synthetic coding sequence
atggccgagccagactacattgaagatgacaaccctgagctgatccggccccagaagctgatcaaccctgtgaagaccagcaggaaccaccaggacctgcaccgggagctgctgatgaaccagaagaggggcctggccccccagaacaagccagagctgcagaaggtgatggagaagaggaagagggaccaggtgatcaagcagaaggaggaggaggcccagaagaagaagagtgacctggagattgagctgctgaagaggcagcagaagctggagcagtag

SEQ ID NO: 38337 - DNA, 381 bp, Artificial Sequence
  Description of Artificial Sequence: Synthetic coding sequence
atggccgagccagactacattgaagatgacaaccctgagctgatccggccccagaagctgatcaaccctgtgaagaccagcaggaaccaccaggacctgcaccgggagctgctgatgaaccagaagaggggcctggccccccagaacaagccagagctgcagaaggtgatggagaagaggaagagggaccaggtgatcaagcagaaggaggaggaggcccagaagaagaagagtgacctggagattgagctgctgaagaggcagcagaagctggagcagctggagctggagaagcagaagctgcaggaggagcaggagaatgcccctgagtttgtgaaggtgaagggcaacctgcggaggacaggccaggaggtggcctag

SEQ ID NO: 38338 - DNA, 378 bp, Artificial Sequence
  Description of Artificial Sequence: Synthetic coding sequence
atggccgagccagactacattgaagatgacaaccctgagctgatccggccccagaagctgatcaaccctgtgaagaccagcaggaaccaccaggacctgcaccgggagctgctgatgaaccagaagaggggcctggccccccagaacaagccagagctgcagaaggtgatggagaagaggaagagggaccaggtgatcaagcagaaggaggaggaggcccagaagaagaagagtgacctggagattgagctgctgaagaggcagcagaagctggagcagctggagctggagaagcagaagctgcaggaggagcaggagaatgcccctgagtttgtgaaggtgaagggcaacctgcggaggacaggccaggaggtgtag

SEQ ID NO: 38339 - DNA, 396 bp, Artificial Sequence; identical to SEQ ID NO: 38321
  Description of Artificial Sequence: Synthetic coding sequence

SEQ ID NO: 38340 - DNA, 990 bp, Artificial Sequence
  Description of Artificial Sequence: Synthetic coding sequence
atgcctgagcccggccccaggatgaatggcttcagcctgggggagctgtgctggctgttctgctgccccccctgccccagcagaattgctgccaagctggccttcctgcccccagagcccacctacacagtgctggcccctgagcagagaggagctggggccagcgccccagccccagcccaggccacagctgctgctgctgctgcccagcctgccccccagcagcctgaggagggcgctggggccggccctggggcctgcagcctgcacctgtctgaaagagctgactggcagtacagccagcgggagctggatgctgtggaggtgttcttcagcaggacagcccgggacaaccggctgggctgcatgtttgtgcgctgtgcccccagcagccgctacaccctgctcttcagccatggaaatgctgtggacctgggccagatgtgcagcttctacatcggcctgggcagccgcatcaactgcaacatcttctcctatgactacagcggctatggagtgtcctctgggaagcccagcgagaagaacctgtatgctgacattgatgctgcctggcaggccctgcggaccaggtatggagtgtccccagagaacatcatcctgtatggccagagcatcggcaccgtgcccaccgtggacctggccagccgctatgaatgtgccgccgtcatcctgcacagccccctgatgagcggcctgcgggtggccttcccagacaccaggaagacctactgctttgatgccttccccagcattgacaagatcagcaaggtgaccagccctgtgctggtgatccacggcacagaagatgaggtgattgacttcagccacggcctggccatgtatgagcgctgccccagggctgtggagcccctgtgggtggagggcgccggccacaatgacatcgagctgtatgcccagtacctggagcggctgaagcagttcatcagccatgagctgcccaacagctag

SEQ ID NO: 38341 - DNA, 888 bp, Artificial Sequence
  Description of Artificial Sequence: Synthetic coding sequence
atgcctgagcccggccccaggatgaatggcttcagcctgggggagctgtgctggctgttctgctgccccccctgccccagcagaattgctgccaagctggccttcctgcccccagagcccacctacacagtgctggcccctgagcagagaggagctggggccagcgccccagccccagcccaggccacagctgctgctgctgctgcccagcctgccccccagcagcctgaggagggcgctggggccggccctggggcctgcagcctgcacctgtctgaaagagctgactggcagtacagccagcgggagctggatgctgtggaggtgttcttcagcaggacagcccgggacaaccggctgggctgcatgtttgtgcgctgtgcccccagcagccgctacaccctgctcttcagccatggaaatgctgtggacctgggccagatgtgcagcttctacatcggcctgggcagccgcatcaactgcaacatcttctcctatgactacagcggctatggagtgtcctctgggaagcccagcgagaagaacctgtatgctgacattgatgctgcctggcaggccctgcggaccaggtatggagtgtccccagagaacatcatcctgtatggccagagcatcggcaccgtgcccaccgtggacctggccagcagcattgacaagatcagcaaggtgaccagccctgtgctggtgatccacggcacagaagatgaggtgattgacttcagccacggcctggccatgtatgagcgctgccccagggctgtggagcccctgtgggtggagggcgccggccacaatgacatcgagctgtatgcccagtacctggagcggctgaagcagttcatcagccatgagctgcccaacagctag

SEQ ID NO: 38342 - DNA, 816 bp, Artificial Sequence
  Description of Artificial Sequence: Synthetic coding sequence
atgctgctggccccacccagcacccccagccggggccgcacccccagcgctgtggagcggctggaggccgacaaggccaagtatgtgaagacccaccaggtgattgcccggcggcaggagcccgccctgcggggcagccctggccccctgaccccccacccctgcaatgagctgggccccccagccagccccaggacccccaggcctgtgagaagaggcagcggccggcggctgcccaggccagacagcctcatcttctaccggcagaagagggactgcaaggcctctgtgaacaaggaaaatgccaagggccagggcctggtgagaagactcttcctgggcgcccccagagatgctgcccccagcagccctgccagcacagagaggcctgctgccagcggcggctgggccgccccccaggatgcccctgaggccgccggcaagagggccctgtgccccacctgcagcctgcccctgtctgagaaggagcgcttcttcaactactgcggcctggagcgggccctggtggaggtgctgggcgctgagcgcttcagcccccagagctggggcgcagatgccagcccccaggccggcaccagccccccacctggcagcggagatgccagtgactggaccagcagtgacagaggagtggacagccctggaggagctgggggcggcggcggcagcgaggccgccggcagcgcccgggacagaagacctcctgtgtctgtggtggagagaaatgcccgggtcatccagtggctgtatggctgccagagggcccggggccccccccgggagagcgaggtgtag

SEQ ID NO: 38343 - DNA, 1836 bp, Artificial Sequence
  Description of Artificial Sequence: Synthetic coding sequence
atgagctgcaagaagcagaggagcaggaagcacagcgtgaatgagaagtgcaacatgaagattgagcactacttcagccctgtgtccaaggagcagcagaacaactgcagcaccagcctgatgaggatggagagcagaggagacccccgggccaccaccaacacccaggcccagcgcttccacagccccaagaagaaccctgaggaccagaccatgccccagaacagaaccatctacgtgaccctgaaggtgaaccacagaagaaaccaggacatgaagctgaagctgacccacagcgagaacagcagcctgtacatggccctgaacaccctgcaggccgtgaggaaggagattgagacccaccagggccaggagatgctggtgcggggcacagagggcatcaaggagtacatcaacctgggcatgcccctgagctgcttccctgagggcggccaggtggtgatcaccttcagccagagcaagagcaagcagaaggaggacaaccacatcttcggccggcaggacaaggccagcacagaatgtgtgaagttctacatccacgccatcggcatcggcaagtgcaagaggcgcatcgtgaagtgtgggaagctgcacaagaagggcaggaagctgtgtgtgtatgccttcaagggggagaccatcaaggatgccctgtgcaaggatggccgcttcctgtccttcctggagaatgatgactggaagctgattgagaacaatgacaccatcctggagagcacccagcctgtggatgagctggagggccgctacttccaggtggaggtggagaagaggatggtgcccagcgctgctgccagccagaaccctgagagcgagaagaggaacacctgtgtgctgcgggagcagatcgtggcccagtaccccagcctgaagcgggagagcgagaagatcatcgagaacttcaagaagaagatgaaggtgaagaatggagagaccctgtttgagctgcacaggaccaccttcggcaaggtgaccaagaacagcagcagcatcaaggtggtgaagctgctggtgcggctgagtgacagcgtgggctacctgttctgggacagcgccaccaccggctacgccacctgctttgtgttcaagggcctcttcatcctgacctgcagacatgtgattgacagcatcgtgggagatggcatcgagcccagcaagtgggccaccatcatcggccagtgtgtgcgggtgaccttcggctatgaggagctgaaggacaaggagaccaactacttctttgtggagccctggtttgagatccacaatgaggagctggactatgctgtgctgaagctgaaggaaaatggccagcaggtgcccatggagctgtacaacggcatcacccctgtgcccctgagcggcctcatccacatcatcggccacccctacggggagaagaagcagattgatgcctgtgccgtcatcccccagggccagagggccaagaagtgccaggagcgggtgcagagcaagaaggccgagagcccagaatatgtgcacatgtacacccagaggagcttccagaagatcgtgcacaacccagatgtgatcacctatgacacagagttcttcttcggggccagcggcagccctgtgtttgacagcaagggcagcctggtggccatgcatgctgctggctttgcctacacctaccagaatgagaccaggagcatcatcgagtttggcagcaccatggagagcatcctgctggacatcaagcagaggcacaagccctggtatgaggaggtgtttgtgaaccagcaggatgtggagatgatgtctgatgaggacctgtag

SEQ ID NO: 38344 - DNA, 1836 bp, Artificial Sequence; identical to SEQ ID NO: 38343
  Description of Artificial Sequence: Synthetic coding sequence

SEQ ID NO: 38345 - DNA, 552 bp, Artificial Sequence
  Description of Artificial Sequence: Synthetic coding sequence
atgagctgcaagaagcagaggagcaggaagcacagcgtgaatgagaagtgcaacatgaagattgagcactacttcagccctgtgtccaaggagcagcagaacaactgcagcaccagcctgatgaggatggagagcagaggagacccccgggccaccaccaacacccaggcccagcgcttccacagccccaagaagaaccctgaggaccagaccatgccccagaacagaaccatctacgtgaccctgaaggtgaaccacagaagaaaccaggacatgaagctgaagctgacccacagcgagaacagcagcctgtacatggccctgaacaccctgcaggccgtgaggaaggagattgagacccaccagggccaggagatgctggtgcggggcacagagggcatcaaggagtacatcaacctgggcatgcccctgagctgcttccctgagggcggccaggtggtgatcaccttcagccagagcaagagcaagcagaaggaggacaaccacatcttcggccggcaggacaaggccagcacagaatgtgtgaagtag

SEQ ID NO: 38346 - DNA, 1836 bp, Artificial Sequence; identical to SEQ ID NO: 38343
  Description of Artificial Sequence: Synthetic coding sequence

SEQ ID NO: 38347 - DNA, 1836 bp, Artificial Sequence; identical to SEQ ID NO: 38343
  Description of Artificial Sequence: Synthetic coding sequence

SEQ ID NO: 38348 - DNA, 291 bp, Artificial Sequence
  Description of Artificial Sequence: Synthetic coding sequence
atgagctgcaagaagcagaggagcaggaagcacagcgtgaatgagaagtgcaacatgaagattgagcactacttcagccctgtgtccaaggagcagcagaacaactgcagcaccagcctgatgaggatggagagcagaggagacccccgggccaccaccaacacccaggcccagcgcttccacagccccaagaagaaccctgaggaccagaccatgccccagaacagaaccatctacgtgaccctgaaggtgaaccacagaagaaaccaggacatgaagctgaagctgtag

SEQ ID NO: 38349 - DNA, 1836 bp, Artificial Sequence; identical to SEQ ID NO: 38343
  Description of Artificial Sequence: Synthetic coding sequence

SEQ ID NO: 38350 - DNA, 2205 bp, Artificial Sequence
  Description of Artificial Sequence: Synthetic coding sequence
atgaacagcatgaagacagaggagaacaagagcttcagcgccatggaggatgaccagaggaccaggcctgaggtgtccaaggacacagtgatgaagcagacccacgccgacacccctgtggaccactgcctgagcggcatcaggaagtgcagcagcaccttcaagctgaagtctgaggtgaacaagcatgaaacagccctggagatgcagaaccccaacctgaacaacaaggagtgctgcttcaccttcaccctgaatggaaacagcaggaagctggacagatctgtgttcaccgcctacggcaagcccagcgagagcatctacagcgccctgagcgccaatgactacttcagcgagcgcatcaagaaccagttcaacaagaacatcatcgtgtatgaggagaagaccattgatggccacatcaacctgggcatgcccctgaagtgcctgcccagcgacagccacttcaagatcaccttcggccagaggaagagcagcaaggaggatggccacatcctgcggcagtgtgagaaccccaacatggagtgcatcctcttccacgtggtggccatcggccgcaccaggaagaagatcgtgaagatcaatgagctgcacgagaagggcagcaagctgtgcatctatgccctgaagggggagaccattgaaggagccctgtgcaaggatggccgcttcagaagtgacattggagaatttgagtggaagctgaaggagggccacaagaagatctacggcaagcagagcatggtggatgaggtgtctgggaaggtgctggagatggacatcagcaagaagaaggccctgcagcagaaggacatccacaagaagatcaagcagaatgaaagtgccacagatgagatcaaccaccagagcctcatccagagcaagaagaaggtgcacaagcccaagaaggatggagagaccaaggatgtggagcacagccgggagcagatcctgcccccccaggacctgagccactacatcaaggacaagacccggcagaccatcccccgcatccggaactactacttctgcagcctgcccaggaagtaccggcagatcaacagccaggtgagaagaagaccccacctgggccgccgctatgccatcaacctggatgtgcagaaggaggccatcaacctgctgaagaactaccagaccctgaatgaggccatcatgcaccagtaccccaacttcaaggaggaggcccagtgggtgaggaagtacttccgggaggagcagaagaggatgaacctgagccctgccaagcagttcaacatctacaagaaggactttgggaagatgacagccaacagcgtgtctgtggccacctgtgagcagctgacctactacagcaagtctgtgggcttcatgcagtgggacaacaatggaaacacaggaaatgccacctgctttgtgttcaatggaggctacatcttcacctgccgccacgtggtgcacctgatggtgggcaagaacacccaccccagcctgtggccagacatcatcagcaaatgtgccaaggtgaccttcacctacacagagttctgccccaccccagacaactggttcagcattgagccctggctgaaggtgtccaatgaaaacctggactatgccatcctgaagctgaaggaaaatggaaatgccttccccccaggcctgtggaggcagatcagcccccagcccagcacaggcctcatctacctgattggccaccctgagggccagatcaagaagattgatggctgcaccgtcatccccctgaatgaaaggctgaagaagtacccaaatgactgccaggacggcctggtggacctgtatgacaccaccagcaatgtgtactgcatgttcacccagaggagcttcctgtctgaggtgtggaacacccacaccctgtcctatgacacctgcttcagtgatggcagcagcggcagccctgtgttcaatgccagcggcaagctggtggccctgcacaccttcggcctcttctaccagaggggcttcaacgtgcacgccctgattgaatttggctacagcatggacagcatcctgtgtgacatcaagaagaccaatgaaagcctgtacaagagcctgaatgatgagaagctggagacctatgatgaggagaagggcaagcaggagagcagcctgcaggaccaccagatcgagcccatggagtgctag

SEQ ID NO: 38351 - DNA, 2115 bp, Artificial Sequence
  Description of Artificial Sequence: Synthetic coding sequence
atgaagcagacccacgccgacacccctgtggaccactgcctgagcggcatcaggaagtgcagcagcaccttcaagctgaagtctgaggtgaacaagcatgaaacagccctggagatgcagaaccccaacctgaacaacaaggagtgctgcttcaccttcaccctgaatggaaacagcaggaagctggacagatctgtgttcaccgcctacggcaagcccagcgagagcatctacagcgccctgagcgccaatgactacttcagcgagcgcatcaagaaccagttcaacaagaacatcatcgtgtatgaggagaagaccattgatggccacatcaacctgggcatgcccctgaagtgcctgcccagcgacagccacttcaagatcaccttcggccagaggaagagcagcaaggaggatggccacatcctgcggcagtgtgagaaccccaacatggagtgcatcctcttccacgtggtggccatcggccgcaccaggaagaagatcgtgaagatcaatgagctgcacgagaagggcagcaagctgtgcatctatgccctgaagggggagaccattgaaggagccctgtgcaaggatggccgcttcagaagtgacattggagaatttgagtggaagctgaaggagggccacaagaagatctacggcaagcagagcatggtggatgaggtgtctgggaaggtgctggagatggacatcagcaagaagaaggccctgcagcagaaggacatccacaagaagatcaagcagaatgaaagtgccacagatgagatcaaccaccagagcctcatccagagcaagaagaaggtgcacaagcccaagaaggatggagagaccaaggatgtggagcacagccgggagcagatcctgcccccccaggacctgagccactacatcaaggacaagacccggcagaccatcccccgcatccggaactactacttctgcagcctgcccaggaagtaccggcagatcaacagccaggtgagaagaagaccccacctgggccgccgctatgccatcaacctggatgtgcagaaggaggccatcaacctgctgaagaactaccagaccctgaatgaggccatcatgcaccagtaccccaacttcaaggaggaggcccagtgggtgaggaagtacttccgggaggagcagaagaggatgaacctgagccctgccaagcagttcaacatctacaagaaggactttgggaagatgacagccaacagcgtgtctgtggccacctgtgagcagctgacctactacagcaagtctgtgggcttcatgcagtgggacaacaatggaaacacaggaaatgccacctgctttgtgttcaatggaggctacatcttcacctgccgccacgtggtgcacctgatggtgggcaagaacacccaccccagcctgtggccagacatcatcagcaaatgtgccaaggtgaccttcacctacacagagttctgccccaccccagacaactggttcagcattgagccctggctgaaggtgtccaatgaaaacctggactatgccatcctgaagctgaaggaaaatggaaatgccttccccccaggcctgtggaggcagatcagcccccagcccagcacaggcctcatctacctgattggccaccctgagggccagatcaagaagattgatggctgcaccgtcatccccctgaatgaaaggctgaagaagtacccaaatgactgccaggacggcctggtggacctgtatgacaccaccagcaatgtgtactgcatgttcacccagaggagcttcctgtctgaggtgtggaacacccacaccctgtcctatgacacctgcttcagtgatggcagcagcggcagccctgtgttcaatgccagcggcaagctggtggccctgcacaccttcggcctcttctaccagaggggcttcaacgtgcacgccctgattgaatttggctacagcatggacagcatcctgtgtgacatcaagaagaccaatgaaagcctgtacaagagcctgaatgatgagaagctggagacctatgatgaggagaagggcaagcaggagagcagcctgcaggaccaccagatcgagcccatggagtgctag

SEQ ID NO: 38352 - DNA, 2115 bp, Artificial Sequence; identical to SEQ ID NO: 38351
  Description of Artificial Sequence: Synthetic coding sequence

SEQ ID NO: 38353 - DNA, 489 bp, Artificial Sequence
  Description of Artificial Sequence: Synthetic coding sequence
atgaagcagacccacgccgacacccctgtggaccactgcctgagcggcatcaggaagtgcagcagcaccttcaagctgaagtctgaggtgaacaagcatgaaacagccctggagatgcagaaccccaacctgaacaacaaggagtgctgcttcaccttcaccctgaatggaaacagcaggaagctggacagatctgtgttcaccgcctacggcaagcccagcgagagcatctacagcgccctgagcgccaatgactacttcagcgagcgcatcaagaaccagttcaacaagaacatcatcgtgtatgaggagaagaccattgatggccacatcaacctgggcatgcccctgaagtgcctgcccagcgacagccacttcaagatcaccttcggccagaggaagagcagcaaggaggatggccacatcctgcggcagtgtgagaaccccaacatggagtgcatcctcttccacgtggtggccatcggctag

SEQ ID NO: 38354 - DNA, 1212 bp, Artificial Sequence
  Description of Artificial Sequence: Synthetic coding sequence
atggtgttctgcctgagcagcgaggagccccggcggcccctgcggagtgacatggtgcacttccaggccagcgaggtgcagcagctgctgcacaacaagtttgtggtgatcctgggggacagcatccagagagctgtgtacaaggacctggtgctgctgctgcagaaggacagcctgctgacagctgcccagctgaaggccaagtacctggaggatgtgctggaggagctgacctacggccctgccccagacctggtgatcatcaacagctgcctgtgggacctgagccgctatggccgctgcagcatggagagctaccgggagaacctggagcgggtgtttgtgaggatggaccaggtgctgcctgacagctgcctgctggtgtggaacatggccatgcccctgggggagcgcatcaccggcggcttcctgctgcctgagctgcagcccctggccggcagcctgcggagagatgtggtggagggcaacttctacagcgccaccctggccggggaccactgctttgatgtgctggacctgcacttccacttcagacatgctgtgcagcaccgccacagagatggagtgcactgggaccagcacgcccaccgccacctgagccacctgctgctgacccacgtggctgatgcctggggcgtggagctgcccaagaggggctaccccccagacccctggattgaggactgggccgagatgaaccaccccttccagggcagccaccggcagaccccagactttggagagcacctggccctgctgcccccaccacccagcagcctgcccccacccatgcccttcccctaccccctgccccagcccagccccccacccctcttcccccccctgccccaggacacccccttcttccctggccagcccttcccccctcatgagttcttcaactacaaccctgtggaggacttctccatgccaccccacctgggctgcggccctggggtgaactttgtgcccggccccctgcccccacccatccctggccccaacccccacggccagcactggggccctgtggtgcaccggggcatgcccaggtatgtgcccaacagcccctaccacgtgcggaggatgggcggcccctgccggcagaggctgcggcacagcgagcggctcatccacacctacaagctggaccggcggcccccagcccacagcggcacctggccaggatag

SEQ ID NO: 38355 - DNA, 1365 bp, Artificial Sequence
  Description of Artificial Sequence: Synthetic coding sequence
atggtgttctgcctgagcagcgaggagccccggcggcccctgcggagtgacatggtgcacttccaggccagcgaggtgcagcagctgctgcacaacaagtttgtggtgatcctgggggacagcatccagagagctgtgtacaaggacctggtgctgctgctgcagaaggacagcctgctgacagctgcccagctgaaggccaagggggagctgagctttgagcaggaccagctggtggccggcggccagctgggggagctgcacaacggcacccagtaccgggaggtgcggcagttctgcagcggcagcggccaccacctggtgcgcttctacttcctgaccagggtgtacagcgagtacctggaggatgtgctggaggagctgacctacggccctgccccagacctggtgatcatcaacagctgcctgtgggacctgagccgctatggccgctgcagcatggagagctaccgggagaacctggagcgggtgtttgtgaggatggaccaggtgctgcctgacagctgcctgctggtgtggaacatggccatgcccctgggggagcgcatcactggaggcttcctgctgcctgagctgcagcccctggccggcagcctgcggagagatgtggtggagggcaacttctacagcgccaccctggccggggaccactgctttgatgtgctggacctgcacttccacttcagacatgctgtgcagcaccgccacagagatggagtgcactgggaccagcacgcccaccgccacctgagccacctgctgctgacccacgtggctgatgcctggggcgtggagctgcccaagaggggctaccccccagacccctggattgaggactgggccgagatgaaccaccccttccagggcagccaccggcagaccccagactttggagagcacctggccctgctgcccccaccacccagcagcctgcccccacccatgcccttcccctaccccctgccccagcccagccccccacccctcttcccccccctgccccaggacacccccttcttccctggccagcccttcccccctcatgagttcttcaactacaaccctgtggaggacttctccatgccaccccacctgggctgcggccctggggtgaactttgtgcccggccccctgcccccacccatccctggccccaacccccacggccagcactggggccctgtggtgcaccggggcatgccccgctacgtgcccaacagcccctaccacgtgcggaggatgggcggcccctgccggcagaggctgcggcacagcgagcggctcatccacacctacaagctggacagaagacctccagcccacagcggcacctggccaggatag

SEQ ID NO: 38356 - DNA, 465 bp, Artificial Sequence
  Description of Artificial Sequence: Synthetic coding sequence
atggtgttctgcctgagcagcgaggagccccggcggcccctgcggagtgacatggtgcacttccaggccagcgaggtgcagcagctgctgcacaacaagtttgtggtgatcctgggggacagcatccagagagctgtgtacaaggacctggtgctgctgctgcagaaggacagcctgctgacagctgcccagctgaaggccaagggggagctgagctttgagcaggaccagctggtggccggcggccagctgggggagctgcacaacggcacccagtaccgggaggtgcggcagttctgcagcggcagcggccaccacctggtgcgcttctacttcctgaccagggtgtacagcgagtacctggaggatgtgctggaggagctgacctacggggccagccccagccaccccatgaacagcagcaccatcatccagtggaggaccagccgctgccaccccacctag

SEQ ID NO: 38357 - DNA, 843 bp, Artificial Sequence
  Description of Artificial Sequence: Synthetic coding sequence
atggtgttctgcctgagcagcgaggagccccggcggcccctgcggagtgacatggtgcacttccaggccagcgaggtgcagcagctgctgcacaacaagtttgtggtgatcctgggggacagcatccagagagctgtgtacaaggacctggtgctgctgctgcagaaggacagcctgctgacagctgcccagctgaaggccaagggggagctgagctttgagcaggaccagctggtggccggcggccagctgggggagctgcacaacggcacccagtaccgggaggtgcggcagttctgcagcggcagcggccaccacctggtgcgcttctacttcctgaccagggtgtacagcgagtacctggaggatgtgctggaggagctgacctacggccctgccccagacctggtgatcatcaacagctgcctgtgggacctgagccgctatggccgctgcagcatggagagctaccgggagaacctggagcgggtgtttgtgaggatggaccaggtgctgcctgacagctgcctgctggtgtggaacatggccatgcccctgggggagcgcatcactggaggcttcctgctgcctgagctgcagcccctggccggcagcctgcggagagatgtggtggagggcaacttctacagcgccaccctggccggggaccactgctttgatgtgctggacctgcacttccacttcagacatgctgtgcagcaccgccacagagatggagtgcactgggaccagcacgcccaccgccacctgagccacctgctgctgacccacgtggctgatgcctggggcgtggagctgcccaagaggggctacccaccctag

SEQ ID NO: 38358 - DNA, 690 bp, Artificial Sequence
  Description of Artificial Sequence: Synthetic coding sequence
atggtgttctgcctgagcagcgaggagccccggcggcccctgcggagtgacatggtgcacttccaggccagcgaggtgcagcagctgctgcacaacaagtttgtggtgatcctgggggacagcatccagagagctgtgtacaaggacctggtgctgctgctgcagaaggacagcctgctgacagctgcccagctgaaggccaagtacctggaggatgtgctggaggagctgacctacggccctgccccagacctggtgatcatcaacagctgcctgtgggacctgagccgctatggccgctgcagcatggagagctaccgggagaacctggagcgggtgtttgtgaggatggaccaggtgctgcctgacagctgcctgctggtgtggaacatggccatgcccctgggggagcgcatcaccggcggcttcctgctgcctgagctgcagcccctggccggcagcctgcggagagatgtggtggagggcaacttctacagcgccaccctggccggggaccactgctttgatgtgctggacctgcacttccacttcagacatgctgtgcagcaccgccacagagatggagtgcactgggaccagcacgcccaccgccacctgagccacctgctgctgacccacgtggctgatgcctggggcgtggagctgcccaagaggggctacccaccctag

SEQ ID NO: 38359 - DNA, 840 bp, Artificial Sequence
  Description of Artificial Sequence: Synthetic coding sequence
atgaacagctgcctgtgggacatcagccgctatggccccaacagctggaggagctacctggagaacctggagaacctcttccagtgcctgggccaggtgctgcctgagagctgcctgctggtgtggaacacagccatgcctgtgggggaggaggtgactggaggcttcctgccccccaagctgcggcggcagaaggccaccttcctgaagaatgaggtggtgaaggccaacttccacagcgccacagaggccaggaagcacaactttgatgtgctggacctgcacttccacttcagacatgcccgggagaacctgcactgggatggagtgcactggaatggccgggtgcaccgctgcctgagccagctgctgctggcccacgtggctgatgcctggggcgtggagctgccccaccgccaccctgtgggggagtggatcaagaagaagaagccaggcccccgggtggagggccccccccaggccaacagaaaccacccagccctgcccctgagcccccccctgcccagccccacctaccggcccctgctgggcttccccccccagaccatcctgagcagccgcatcaacagcatcgccatccagatgagcccccaccagcccatgcaggtgagcagcagcaagaccatcctgtggctggtgctgagctgcctgtgccccagcagcccccaccctgtgatcagcggcctgccccagtggtacatcggcgtgctggccggcatcgtgcctgtggcccccatccggcctggggacagcggcctggacctgcagcgggagggcccccagcccatcctgagccagggcctgaacagaagaacatag

SEQ ID NO: 38360 - DNA, 1299 bp, Artificial Sequence
  Description of Artificial Sequence: Synthetic coding sequence
atgatcctgctgcgggccagcgaggtgcggcagctgctgcacaacaagtttgtggtgatcctgggggacagcgtgcacagagctgtgtacaaggacctggtgctgctgctgcagaaggaccggctgctgaccccaggccagctgcgggcccggggggagctgaactttgagcaggatgagctggtggatggcggccagaggggccacatgcacaacggcctgaactaccgggaggtgcgggagttcagaagtgaccaccacctggtgcgcttctacttcctgaccagggtgtacagcgactacctgcagaccatcctgaaggagctgcagagcggggagcacgccccagacctggtgatcatgaacagctgcctgtgggacatcagccgctatggccccaacagctggaggagctacctggagaacctggagaacctcttccagtgcctgggccaggtgctgcctgagagctgcctgctggtgtggaacacagccatgcctgtgggggaggaggtgactggaggcttcctgccccccaagctgcggcggcagaaggccaccttcctgaagaatgaggtggtgaaggccaacttccacagcgccacagaggccaggaagcacaactttgatgtgctggacctgcacttccacttcagacatgcccgggagaacctgcactgggatggagtgcactggaatggccgggtgcaccgctgcctgagccagctgctgctggcccacgtggctgatgcctggggcgtggagctgccccaccgccaccctgtgggggagtggatcaagaagaagaagccaggcccccgggtggagggccccccccaggccaacagaaaccacccagccctgcccctgagcccccccctgcccagccccacctaccggcccctgctgggcttccccccccagaggctgcccctgctgcccctgctgagcccccagcccccaccacccatcctgcaccaccagggcatgccccgcttcccccagggccccccagatgcctgcttcagcagtgaccacaccttccagagcgaccagttctactgccacagtgatgtgcccagcagcgcccatgctggcttctttgtggaggacaacttcatggtgggcccccagctgcccatgcccttcttccccaccccccgctaccagaggcctgcccctgtggtgcaccggggcttcggccgctaccggccccggggcccctacaccccctggggccagaggccccggcccagcaagagaagagccccagccaaccctgagccccggccccagtag

SEQ ID NO: 38361 - DNA, 1299 bp, Artificial Sequence; identical to SEQ ID NO: 38360
  Description of Artificial Sequence: Synthetic coding sequence

SEQ ID NO: 38362 - DNA, 504 bp, Artificial Sequence
  Description of Artificial Sequence: Synthetic coding sequence
atgatcctgctgcgggccagcgaggtgcggcagctgctgcacaacaagtttgtggtgatcctgggggacagcgtgcacagagctgtgtacaaggacctggtgctgctgctgcagaaggaccggctgctgaccccaggccagctgcgggcccggggggagctgaactttgagcaggatgagctggtggatggcggccagaggggccacatgcacaacggcctgaactaccgggaggtgcgggagttcagaagtgaccaccacctggtgcgcttctacttcctgaccagggtgtacagcgactacctgcagaccatcctgaaggagctgcagagcggggagcacgccccagacctggtgatcatgaacagctgcctgtgggacatcagccgctatggccccaacagctggaggagctacctggagaacctggagaacctcttccagtgcctgggccaggtgctgcctgagagctgcctgctggtgtggaacacagccatgccctag

SEQ ID NO: 38363 - DNA, 507 bp, Artificial Sequence
  Description of Artificial Sequence: Synthetic coding sequence
atgatcctgctgcgggccagcgaggtgcggcagctgctgcacaacaagtttgtggtgatcctgggggacagcgtgcacagagctgtgtacaaggacctggtgctgctgctgcagaaggaccggctgctgaccccaggccagctgcgggcccggggggagctgaactttgagcaggatgagctggtggatggcggccagaggggccacatgcacaacggcctgaactaccgggaggtgcgggagttcagaagtgaccaccacctggtgcgcttctacttcctgaccagggtgtacagcgactacctgcagaccatcctgaaggagctgcagagcggggagcacgccccagacctggtgatcatgaacagctgcctgtgggacatcagccgctatggccccaacagctggaggagctacctggagaacctggagaacctcttccagtgcctgggccaggtgctgcctgagagctgcctgctggtgtggaacacagccatgcctgtgtag

SEQ ID NO: 38364 - DNA, 177 bp, Artificial Sequence
  Description of Artificial Sequence: Synthetic coding sequence
atgatcctgctgcgggccagcgaggtgcggcagctgctgcacaacaagtttgtggtgatcctgggggacagcgtgcacagagctgtgtacaaggacctggtgctgctgctgcagaaggaccggctgctgaccccaggccagctgcgggcccggggggagctgaactttgagcagtag

SEQ ID NO: 38365 - DNA, 1518 bp, Artificial Sequence
  Description of Artificial Sequence: Synthetic coding sequence
atgtctgacaaggatgacatcgagacccccctgctgacagaagctgcccccatcctggaggatggcaactgtgagcccgccaagaacagcgagagcgtggaccagggcgccaagccagagagcaagtctgagcctgtggtgtccaccaggaagaggcctgagaccaagcccagcagtgacctggagaccagcaaggtgctgcccatccaggacaacgtgtccaaggatgtgccccagacccgctggggctactggggctcctggggcaagagcatcctgagcagcgccagcgccaccgtggccaccgtgggccagggcatcagcaatgtgattgagaaggccgagaccagcctgggcatccctggccccagcgagatcagcacagaggtgaagtatgtggccggggagaccaatgccaaggaaaatgaaaacagcagccctgtggccggggccttcggggtcttcagcaccatcagcacagctgtgcagagcacaggcaagagcgtcatcagcggcggcctggatgccctggagttcatcggcaagaagaccatggatgtgattgctgagggggaccccggcttcaagaggaccaagggcctgatgaacagaaatgccaccctgagccaggtgctgcgggaggccaaggagaaggaggagatccgcaccagcaatgaggtgacagtggagacagacaagaagacccactacggcctgctgtttgatgagttccagggcctgagccacctggaggccctggagatgctgagccaggagagcgagatcaaggtgaagagcatcctgaacagcctgagcggggaggagctggagaccctgaaggtggagctggagcagctgaaggagaccttcagcctggccgagttctgtgaggaggaggaggaggagaagaagggagatgaggacttcaccaaggacatcacagagctgttcagccagctgcacgtgagcagcaagccagagaagctggcccgggccaggaacacagcccacgagtggatcaggaagagcctgaccaagcccctggccgagaatgaggagggggagaagcagagcgaggctgaaaatacagagcaggtgaacaagaacagcattgaggacatccacgcctttgccatccgcagcctggccgagctgacagcctgcagcattgagctgttccacaagacagctgccctggtgctgcacggcaggaagcaggaggtgacagccatcgagaggagccagaccctgagccagatgaccatcgtgctgtgcaaggagctgagcagcctgagcaaggagttcaccacctgcctgaccacagctggggtgaaggagatggctgatgtgctgaaccccctcatcacagctgtgttcctggaggccagcaacagcgccagctacatccaggatgccttccagctgctgctgcctgtgctggagatcagcctgattgagaacaagattgagagccacagacatgagctgcagggccagaagcccctgctggagcactag

SEQ ID NO: 38366 - DNA, 750 bp, Artificial Sequence
  Description of Artificial Sequence: Synthetic coding sequence
atgtctgacaaggatgacatcgagacccccctgctgacagaagctgcccccatcctggaggatggcaactgtgagcccgccaagaacagcgagagcgtggaccagggcgccaagccagagagcaagtctgagcctgtggtgtccaccaggaagaggcctgagaccaagcccagcagtgacctggagaccagcaaggtgctgcccatccaggacaacgtgtccaaggatgtgccccagacccgctggggctactggggctcctggggcaagagcatcctgagcagcgccagcgccaccgtggccaccgtgggccagggcatcagcaatgtgattgagaaggccgagaccagcctgggcatccctggccccagcgagatcagcacagaggtgaagtatgtggccggggagaccaatgccaaggaaaatgaaaacagcagccctgtggccggggccttcggggtcttcagcaccatcagcacagctgtgcagagcacaggcaagagcgtcatcagcggcggcctggatgccctggagttcatcggcaagaagaccatggatgtgattgctgagggggaccccggcttcaagaggaccaagggcctgatgaacagaaatgccaccctgagccaggtgctgcgggaggccaaggagaaggaggagatccgcaccagcaatgaggtgacagtggagacagacaagaagacccactacggcctgctgtttgatgagttccagggcctgcacatctag

SEQ ID NO: 38367 - DNA, 195 bp, Artificial Sequence
  Description of Artificial Sequence: Synthetic coding sequence
atgtctgacaaggatgacatcgagacccccctgctgacagaagctgcccccatcctggaggatggcaactgtgagcccgccaagaacagcgagagcgtggaccagggcgccaagccagagagcaagtctgagcctgtggtgtccaccaggaagaggcctgagaccaagcccagcagtgacctggagaccagctag

SEQ ID NO: 38368 - DNA, 312 bp, Artificial Sequence
  Description of Artificial Sequence: Synthetic coding sequence
atgtctgacaaggatgacatcgagacccccctgctgacagaagctgcccccatcctggaggatggcaactgtgagcccgccaagaacagcgagagcgtggaccagggcgccaagccagagagcaagtctgagcctgtggtgtccaccaggaagaggcctgagaccaagcccagcagtgacctggagaccagcaaggtgctgcccatccaggacaacgtgtccaaggatgtgccccagacccgctggggctactggggctcctggggcaagagcatcctgagcagcgccagcgccaccgtggccaccgtgtag

SEQ ID NO: 38369 - DNA, 378 bp, Artificial Sequence
  Description of Artificial Sequence: Synthetic coding sequence
atgtctgacaaggatgacatcgagacccccctgctgacagaagctgcccccatcctggaggatggcaactgtgagcccgccaagaacagcgagagcgtggaccagggcgccaagccagagagcaagtctgagcctgtggtgtccaccaggaagaggcctgagaccaagcccagcagtgacctggagaccagcaaggtgctgcccatccaggacaacgtgtccaaggatgtgccccagacccgctggggctactggggctcctggggcaagagcatcctgagcagcgccagcgccaccgtggccaccgtgggccagggcatcagcaatgtgattgagaaggccgagaccagcctgggcatccctggccccagcgagtag

SEQ ID NO: 38370 - DNA, 1518 bp, Artificial Sequence; identical to SEQ ID NO: 38365
  Description of Artificial Sequence: Synthetic coding sequence

SEQ ID NO: 38371 - DNA, 633 bp, Artificial Sequence
  Description of Artificial Sequence: Synthetic coding sequence
atgtctgacaaggatgacatcgagacccccctgctgacagaagctgcccccatcctggaggatggcaactgtgagcccgccaagaacagcgagagcgtggaccagggcgccaagccagagagcaagtctgagcctgtggtgtccaccaggaagaggcctgagaccaagcccagcagtgacctggagaccagcaaggtgctgcccatccaggacaacgtgtccaaggatgtgccccagacccgctggggctactggggctcctggggcaagagcatcctgagcagcgccagcgccaccgtggccaccgtgggccagggcatcagcaatgtgattgagaaggccgagaccagcctgggcatccctggccccagcgagatcagcacagaggtgaagtatgtggccggggagaccaatgccaaggaaaatgaaaacagcagccctgtggccggggccttcggggtcttcagcaccatcagcacagctgtgcagagcacaggcaagagcgtcatcagcggcggcctggatgccctggagttcatcggcaagaagaccatggatgtgattgctgagggggaccccggcttcaagaggaccaagggcctgatgaacagaaatgccaccctgagccagtag

SEQ ID NO: 38372 - DNA, 240 bp, Artificial Sequence
  Description of Artificial Sequence: Synthetic coding sequence
atgtctgacaaggatgacatcgagacccccctgctgacagaagctgcccccatcctggaggatggcaactgtgagcccgccaagaacagcgagagcgtggaccagggcgccaagccagagagcaagtctgagcctgtggtgtccaccaggaagaggcctgagaccaagcccagcagtgacctggagaccagcaaggtgctgcccatccaggacaacgtgtccaaggatgtgccccagtag

SEQ ID NO: 38373 - DNA, 1518 bp, Artificial Sequence; identical to SEQ ID NO: 38365
  Description of Artificial Sequence: Synthetic coding sequence

SEQ ID NO: 38374 - DNA, 501 bp, Artificial Sequence
  Description of Artificial Sequence: Synthetic coding sequence
atgtctgacaaggatgacatcgagacccccctgctgacagaagctgcccccatcctggaggatggcaactgtgagcccgccaagaacagcgagagcgtggaccagggcgccaagccagagagcaagtctgagcctgtggtgtccaccaggaagaggcctgagaccaagcccagcagtgacctggagaccagcaaggtgctgcccatccaggacaacgtgtccaaggatgtgccccagacccgctggggctactggggctcctggggcaagagcatcctgagcagcgccagcgccaccgtggccaccgtgggccagggcatcagcaatgtgattgagaaggccgagaccagcctgggcatccctggccccagcgagatcagcacagaggtgaagtatgtggccggggagaccaatgccaaggaaaatgaaaacagcagccctgtggccggggccttcggggtcttcagcaccatcagcacagctgtgcagagcactggatag

SEQ ID NO: 38375 - DNA, 48 bp, Artificial Sequence
  Description of Artificial Sequence: Synthetic coding sequence
atgtctgacaaggatgacatcgagacccccctgctgacagaggcctag

SEQ ID NO: 38376 - DNA, 2760 bp, Artificial Sequence
  Description of Artificial Sequence: Synthetic coding sequence
atggccaccccatctgctgcctttgaggccctgatgaatggagtgacctcctgggatgtgcctgaagatgctgtgccctgtgagctgctgctgattggagaggccagcttccctgtgatggtgaatgacatgggccaggtgctgattgctgccagcagctatggccggggccgcctggtggtggtgtcccatgaggactacctggtggaggcccagctgacccccttcctgctgaatgctgtgggctggctgtgcagcagccctggggcccccatcggcgtgcaccccagcctggcccccctggccaagatcctggagggcagcggcgtggatgccaaggtggagcctgaggtgaaggacagcctgggcgtgtactgcattgatgcctacaatgagaccatgacagagaagctggtgaagttcatgaagtgtggcggcggcctgctgattggaggccaggcctgggactgggccaaccagggagaagatgagcgggtgctcttcaccttccctggcaacctggtgacctctgtggccggcatctacttcacagacaacaagggggacaccagcttcttcaaggtgtccaagaagatgcccaagatccctgtgctggtgtcctgtgaagatgacctgagtgatgaccgggaggagctgctgcacggcatcagcgagctggacatcagcaacagcgactgcttccccagccagctgctggtgcatggagccctggccttccccctgggcctggacagctaccacggctgtgtgattgctgctgcccgctatggccggggccgggtggtggtgacaggccacaaggtgctcttcaccgtgggcaagctgggccccttcctgctgaatgctgtgcgctggctggatggcggcagaagaggcaaggtggtggtgcagacagagctgcggaccctgagcggcctgctggccgtgggcggcatcgacaccagcattgagcccaacctgaccagtgatgcctctgtgtactgctttgagcctgtgtctgaggtgggcgtgaaggagctgcaggagtttgtggccgagggcggcggcctgtttgtgggcgcccaggcctggtggtgggccttcaagaaccctggggtgagccccctggcccgcttccctggcaacctgctgctgaaccccttcggcatcagcatcaccagccagagcctgaaccctggccccttccgcacccccaaggccggcatccgcacctaccacttccgcagcaccctggccgagttccaggtgatcatgggcaggaagagaggaaatgtggagaagggctggctggccaagctgggcccagatggagctgccttcctgcagatcccagctgaggagatcccagcctacatgtctgtgcaccggctgctgaggaagctgctgagccgctaccgcctgcctgtggccacccgggagaaccctgtgatcaatgactgctgccgcggggccatgctgagcctggccaccggcctggcccacagcggcagtgacctgagcctgctggtgcctgagattgaggacatgtacagcagcccctacctgcggcccagcgagagccccatcaccgtggaggtgaactgcaccaaccctggcacccgctactgctggatgagcacaggcctgtacatccctggccggcagatcatcgaggtgtccctgcctgaggccgccgccagcgctgacctgaagatccagatcggctgccacacagatgacctgacccgggccagcaagctgttccggggccccctggtgatcaaccgctgctgcctggacaagcccaccaagagcatcacctgcctgtggggcggcctgctgtacatcatcgtgccccagaacagcaagctgggctctgtgcctgtgacagtgaagggagctgtgcacgccccctactacaagctgggggagaccaccctggaggagtggaagaggcgcatccaggagaaccctggcccctggggcgagctggccacagacaacatcatcctgactgtgcccacagccaacctgcggaccctggagaaccctgagcccctgctgcggctgtgggatgaggtgatgcaggccgtggcccggctgggcgctgagcccttccccctgcggctgccccagagaattgtggctgatgtgcagatctctgtgggctggatgcatgctggctaccccatcatgtgccacctggagagcgtgcaggagctgatcaatgagaagctgatccgcaccaagggcctgtggggccctgtgcatgagctgggcaggaaccagcagaggcaggagtgggagttccccccccacaccacagaggccacctgcaacctgtggtgtgtgtatgtgcatgaaacagtgctgggcatccccaggagccgggccaacatcgccctgtggccccctgtgcgggagaagagggtgcgcatctacctgagcaagggccccaacgtgaagaactggaatgcctggacagccctggagacctacctgcagctgcaggaggccttcggctgggagcccttcatccgcctcttcacagagtacagaaaccagaccaacctgcccacagaaaatgtggacaagatgaacctgtgggtgaagatgttcagccaccaggtgcagaagaacctggcccccttctttgaggcctgggcctggcccatccagaaggaggtggccaccagcctggcctacctgcctgagtggaaggagaacatcatgaagctgtacctgctgacccagatgtag

SEQ ID NO: 38377 - DNA, 504 bp, Artificial Sequence
  Description of Artificial Sequence: Synthetic coding sequence
atggccaccccatctgctgcctttgaggccctgatgaatggagtgacctcctgggatgtgcctgaagatgctgtgccctgtgagctgctgctgattggagaggccagcttccctgtgatggtgaatgacatgggccaggtgctgattgctgccagcagctatggccggggccgcctggtggtggtgtcccatgaggactacctggtggaggcccagctgacccccttcctgctgaatgctgtgggctggctgtgcagcagccctggggcccccatcggcgtgcaccccagcctggcccccctggccaagatcctggagggcagcggcgtggatgccaaggtggagcctgaggtgaaggacagcctgggcgtgtactgcattgatgcctacaatgagaccatgacagagaagctggtgaagttcatgaagtgtggcggcggcctgctgattggaggccaggcctgggactgggccaaccagggagaagatgagcgggtgctgtag

SEQ ID NO: 38378 - DNA, 441 bp, Artificial Sequence
  Description of Artificial Sequence: Synthetic coding sequence
atggccaccccatctgctgcctttgaggccctgatgaatggagtgacctcctgggatgtgcctgaagatgctgtgccctgtgagctgctgctgattggagaggccagcttccctgtgatggtgaatgacatgggccaggtgctgattgctgccagcagctatggccggggccgcctggtggtggtgtcccatgaggactacctggtggaggcccagctgacccccttcctgctgaatgctgtgggctggctgtgcagcagccctggggcccccatcggcgtgcaccccagcctggcccccctggccaagatcctggagggcagcggcgtggatgccaaggtggagcctgaggtgaaggacagcctgggcgtgtactgcattgatgcctacaatgagaccatgacagagaagctggtgaagttcatgaagtgtggcggctag

SEQ ID NO: 38379 - DNA, 2766 bp, Artificial Sequence
  Description of Artificial Sequence: Synthetic coding sequence
atggccaccccatctgctgcctttgaggccctgatgaatggagtgacctcctgggatgtgcctgaagatgctgtgccctgtgagctgctgctgattggagaggccagcttccctgtgatggtgaatgacatgggccaggtgctgattgctgccagcagctatggccggggccgcctggtggtggtgtcccatgaggactacctggtggaggcccagctgacccccttcctgctgaatgctgtgggctggctgtgcagcagccctggggcccccatcggcgtgcaccccagcctggcccccctggccaagatcctggagggcagcggcgtggatgccaaggtggagcctgaggtgaaggacagcctgggcgtgtactgcattgatgcctacaatgagaccatgacagagaagctggtgaagttcatgaagtgtggcggcggcctgctgattggaggccaggcctgggactgggccaaccagggagaagatgagcgggtgctcttcaccttccctggcaacctggtgacctctgtggccggcatctacttcacagacaacaagggggacaccagcttcttcaaggtgtccaagaagatgcccaagatccctgtgctggtgtcctgtgaagatgacctgagtgatgaccgggaggagctgctgcacggcatcagcgagctggacatcagcaacagcgactgcttccccagccagctgctggtgcatggagccctggccttccccctgggcctggacagctaccacggctgtgtgattgctgctgcccgctatggccggggccgggtggtggtgacaggccacaaggtgctcttcaccgtgggcaagctgggccccttcctgctgaatgctgtgcgctggctggatggcggcagaagaggcaaggtggtggtgcagacagagctgcggaccctgagcggcctgctggccgtgggcggcatcgacaccagcattgagcccaacctgaccagtgatgcctctgtgtactgctttgagcctgtgtctgaggtgggcgtgaaggagctgcaggagtttgtggccgagggcggcggcctgtttgtgggcgcccaggcctggtggtgggccttcaagaaccctggggtgagccccctggcccgcttccctggcaacctgctgctgaaccccttcggcatcagcatcaccagccagagcctgaaccctggccccttccgcacccccaaggccggcatccgcacctaccacttccgcagcaccctggccgagttccaggtgatcatgggcaggaagagaggaaatgtggagaagggctggctggccaagctgggcccagatggagctgccttcctgcagatcccagctgaggagatcccagcctacatgtctgtgcaccggctgctgaggaagctgctgagccgctaccgcctgcctgtggccacccgggagaaccctgtgatcaatgactgctgccgcggggccatgctgagcctggccaccggcctggcccacagcggcagtgacctgagcctgctggtgcctgagattgaggacatgtacagcagcccctacctgcggcccagcgagagccccatcaccgtggaggtgaactgcaccaaccctggcacccgctactgctggatgagcacaggcctgtacatccctggccggcagatcatcgaggtgtccctgcctgaggccgccgccagcgctgacctgaagatccagatcggctgccacacagatgacctgacccgggccagcaagctgttccggggccccctggtgatcaaccgctgctgcctggacaagcccaccaagagcatcacctgcctgtggggcggcctgctgtacatcatcgtgccccagaacagcaagctgggctctgtgcctgtgacagtgaagggagctgtgcacgccccctactacaagctgggggagaccaccctggaggagtggaagaggcgcatccaggagaaccctggcccctggggcgagctggccacagacaacatcatcctgactgtgcccacagccaacctgcggaccctggagaaccctgagcccctgctgcggctgtgggatgaggtgatgcaggccgtggcccggctgggcgctgagcccttccccctgcggctgccccagagaattgtggctgatgtgcagatctctgtgggctggatgcatgctggctaccccatcatgtgccacctggagagcgtgcaggagctgatcaatgagaagctgatccgcaccaagggcctgtggggccctgtgcatgagctgggcaggaaccagcagaggcaggagtgggagttccccccccacaccacagaggccacctgcaacctgtggtgtgtgtatgtgcatgaaacagtgctgggcatccccaggagccgggccaacatcgccctgtggccccctgtgcgggagaagagggtgcgcatctacctgagcaagggccccaacgtgaagaactggaatgcctggacagccctggagacctacctgcagctgcaggaggccttcggctgggagcccttcatccgcctcttcacagagtacagaaaccagaccaacctgcccacagaaaatgtggacaagatgaacctgtgggtgaagatgttcagccaccaggtgcagaagaacctggcccccttctttgaggcctgggcctggcccatccagaaggaggtggccaccagcctggcctacctgcctgagtggaaggagaacatcatgaagctgtacctgctgacccagatgccccactag

SEQ ID NO: 38380 - DNA, 228 bp, Artificial Sequence
  Description of Artificial Sequence: Synthetic coding sequence
atggccaccccatctgctgcctttgaggccctgatgaatggagtgacctcctgggatgtgcctgaagatgctgtgccctgtgagctgctgctgattggagaggccagcttccctgtgatggtgaatgacatgggccaggtgctgattgctgccagcagctatggccggggccgcctggtggtggtgtcccatgaggactacctggtggaggcccagctgaccccctag

SEQ ID NO: 38381 - DNA, 453 bp, Artificial Sequence
  Description of Artificial Sequence: Synthetic coding sequence
atggccaccccatctgctgcctttgaggccctgatgaatggagtgacctcctgggatgtgcctgaagatgctgtgccctgtgagctgctgctgattggagaggccagcttccctgtgatggtgaatgacatgggccaggtgctgattgctgccagcagctatggccggggccgcctggtggtggtgtcccatgaggactacctggtggaggcccagctgacccccttcctgctgaatgctgtgggctggctgtgcagcagccctggggcccccatcggcgtgcaccccagcctggcccccctggccaagatcctggagggcagcggcgtggatgccaaggtggagcctgaggtgaaggacagcctgggcgtgtactgcattgatgcctacaatgagaccatgacagagaagctggtgaagttcatgaagtgtggcggcggcctgctgatctag

SEQ ID NO: 38382 - DNA, 2538 bp, Artificial Sequence
  Description of Artificial Sequence: Synthetic coding sequence
atggccaccatcgctgctgctgcctttgaggccctgatggatggagtgacctgctgggatgtgccccggggccccatccccagcgagctgctgctgattggagaggccgccttccctgtgatggtgaatgacaagggccaggtgctgattgctgccagcagctatggccggggccgcctggtggtggtgtcccatgagggctacctgagccacacaggcctggcccccttcctgctgaatgctgtgtcctggctgtgcccctgccctggggcccctgtgggcgtgcaccccagcctggcccccctggtgaacatcctgcaggatgctggcctggaggcccaggtgaagccagagcctggagagcccctgggcgtgtactgcatcaatgcctacaatgacaccctgacagccaccctcatccagtttgtgaagcatggaggcggcctgctgattggaggccaggcctggtactgggccagccagcacggccctgacaaggtgctgagccgcttccctggcaacaaggtgacctctgtggccggcgtgtacttcacagacacctacggggaccgggaccgcttcaaggtgtccaagaaggtgcccaagatccccctgcacgtgcgctatggagaagatgtgcggcaggaccagcagcagctgctggagggcatcagcgagctggacatcagaactggaggagtgcccagccagctgctggtgcatggagccctggccttccccctgggcctggatgccagcctgaactgcttcctggccgccgcccactacggccggggccgggtggtgctggccgcccacgagtgcctgctgtgtgcccccaagatgggccccttcctgctgaatgctgtgcgctggctggcccggggccagacaggcaaggtgggcgtgaacaccaacctgaaggacctgtgccccctgctgtctgaacatggcctgcagtgcagcctggagccccacctgaacagcgacctgtgtgtgtactgctgcaaggcctacagcgacaaggaggccaagcagctgcaggagtttgtggccgagggcggcggcctgctgattggaggccaggcctggtggtgggccagccagaaccctggccactgccccctggccggcttccctggcaacatcatcctgaactgcttcggcctgagcatcctgccccagaccctgaaggccggctgcttccctgtgcccaccccagagatgaggagctaccacttcaggaaggccctgagccagttccaggccatcctgaaccatgaaaatggaaacctggagaagagctgcctggccaagctgcgggtggatggagctgccttcctgcagatcccagctgagggcgtgcctgcctacatcagcctgcaccggctgctgaggaagatgctgcggggcagcggcctgcctgctgtgtcccgggagaaccctgtggccagtgacagctatgaggccgctgtgctgagcctggccaccggcctggcccacagcggcacagactgcagccagctggcccagggcctgggcacctggacctgcagcagcagcctgtaccccagcaagcaccccatcaccgtggagatcaatggcatcaaccctggcaacaatgactgctgggtgtccacaggcctgtacctgctggagggccagaatgctgaggtgtccctgtctgaggccgccgccagcgctggcctgcgggtgcagatcggctgccacacagatgacctgaccaaggccaggaagctgagccgggcccctgtggtgacccaccagtgctggatggacagaacagagaggtctgtgtcctgcctgtggggcggcctgctgtatgtgattgtgcccaagggcagccagctgggccctgtgcctgtgaccatcagaggagctgtgcctgccccctactacaagctgggcaagaccagcctggaggagtggaagaggcagatgcaggagaacctggccccctggggcgagctggccacagacaacatcatcctgactgtgcccaccaccaacctgcaggccctgaaggaccctgagcctgtgctgcggctgtgggatgagatgatgcaggccgtggcccggctggccgctgagcccttccccttcagaagacctgagcgcatcgtggctgatgtgcagatctctgctggctggatgcacagcggctaccccatcatgtgccacctggagagcgtgaaggagatcatcaatgagatggacatgaggagcagaggagtgtggggccccatccacgagctgggccacaaccagcagagacatggctgggagttccccccccacaccacagaggccacctgcaacctgtggagcgtgtatgtgcatgaaacagtgctgggcatcccccgggcccaggcccacgaggccctgagccccccagagcgggagcggcgcatcaaggcccacctgggcaaaggagcccccctgtgtgactggaatgtgtggacagccctggagacctacctgcaggtgctgagcagaaattctggaagaagaggatag

SEQ ID NO: 38383 - DNA, 2448 bp, Artificial Sequence
  Description of Artificial Sequence: Synthetic coding sequence
atgaagatcttccagaaggagttcaagttcatcctgaagaagtgcacccccatccagaagtaccgggaggagaatggaaacagcagcagcagcccccaccaccagctgcagagccacgccagcggccccaggtatggagaagatgtgcggcaggaccagcagcagctgctggagggcatcagcgagctggacatcagaactggaggagtgcccagccagctgctggtgcatggagccctggccttccccctgggcctggatgccagcctgaactgcttcctggccgccgcccactacggccggggccgggtggtgctggccgcccacgagtgcctgctgtgtgcccccaagatgggccccttcctgctgaatgctgtgcgctggctggcccggggccagacaggcaaggtgggcgtgaacaccaacctgaaggacctgtgccccctgctgtctgaacatggcctgcagtgcagcctggagccccacctgaacagcgacctgtgtgtgtactgctgcaaggcctacagcgacaaggaggccaagcagctgcaggagtttgtggccgagggcggcggcctgctgattggaggccaggcctggtggtgggccagccagaaccctggccactgccccctggccggcttccctggcaacatcatcctgaactgcttcggcctgagcatcctgccccagaccctgaaggccggctgcttccctgtgcccaccccagagatgaggagctaccacttcaggaaggccctgagccagttccaggccatcctgaaccatgaaaatggaaacctggagaagagctgcctggccaagctgcgggtggatggagctgccttcctgcagatcccagctgagggcgtgcctgcctacatcagcctgcaccggctgctgaggaagatgctgcggggcagcggcctgcctgctgtgtcccgggagaaccctgtggccagtgacagctatgaggccgctgtgctgagcctggccaccggcctggcccacagcggcacagactgcagccagctggcccagggcctgggcacctggacctgcagcagcagcctgtaccccagcaagcaccccatcaccgtggagatcaatggcatcaaccctgagagccacagcgtcatccaggtgggcatgcagtggagggacctgagcagctgcaacctgcacctgctgggcctgagcaacagcagcctgagcgccagctgtgtggccggcaccaccggcaccaggcaccacgcctggctgatctttgtgttcctggtggagcgggagttccacaggaagggcaacaatgactgctgggtgtccacaggcctgtacctgctggagggccagaatgctgaggtgtccctgtctgaggccgccgccagcgctggcctgcgggtgcagatcggctgccacacagatgacctgaccaaggccaggaagctgagccgggcccctgtggtgacccaccagtgctggatggacagaacagagaggtctgtgtcctgcctgtggggcggcctgctgtatgtgattgtgcccaagggcagccagctgggccctgtgcctgtgaccatcagaggagctgtgcctgccccctactacaagctgggcaagaccagcctggaggagtggaagaggcagatgcaggagaacctggccccctggggcgagctggccacagacaacatcatcctgactgtgcccaccaccaacctgcaggccctgaaggaccctgagcctgtgctgcggctgtgggatgagatgatgcaggccgtggcccggctggccgctgagcccttccccttcagaagacctgagcgcatcgtggctgatgtgcagatctctgctggctggatgcacagcggctaccccatcatgtgccacctggagagcgtgaaggagatcatcaatgagatggacatgaggagcagaggagtgtggggccccatccacgagctgggccacaaccagcagagacatggctgggagttccccccccacaccacagaggccacctgcaacctgtggagcgtgtatgtgcatgaaacagtgctgggcatcccccgggcccaggcccacgaggccctgagccccccagagcgggagcggcgcatcaaggcccacctgggcaaaggagcccccctgtgtgactggaatgtgtggacagccctggagacctacctgcagctgcaggaggccttcggctgggagcccttcacccagctgtttgctgagtaccagaccctgagccacctgcccaaggacaacacaggccgcatgaacctgtgggtgaagaagttcagcgagaaggtgaagaagaacctggtgcccttctttgaggcctggggctggcccatccagaaggaggtggccgacagcctggccagcctgcctgagtggcaggagaaccccatgcaggtgtacctgcgggccaggaagtag

SEQ ID NO: 38384 - DNA, 1695 bp, Artificial Sequence
  Description of Artificial Sequence: Synthetic coding sequence
atgggccccttcctgctgaatgctgtgcgctggctggcccggggccagacaggcaaggtgggcgtgaacaccaacctgaaggacctgtgccccctgctgtctgagcacggcctgcagtgcagcctggagccccacctgaacagcgacctgtgtgtgtactgctgcaaggcctacagcgacaaggaggccaagcagctgcaggagtttgtggccgagggcggcggcctgctgattggaggccaggcctggtggtgggccagccagaaccctggccactgccccctggccggcttccctggcaacatcatcctgaactgcttcggcctgagcatcctgccccagaccctgaaggccggctgcttccctgtgcccaccccagagatgaggagctaccacttcaggaaggccctgagccagttccaggccatcctgaaccatgaaaatggaaacctggagaagagctgcctggccaagctgcgggtggatggagctgccttcctgcagatcccagctgagggcgtgcctgcctacatcagcctgcaccggctgctgaggaagatgctgcggggcagcggcctgcctgctgtgtccagagaaaatcctgtggccagtgacagctatgaagctgctgtgctgagcctggccaccggcctggcccacagcggcacagactgcagccagctggcccagggcctgggcacctggacctgcagcagcagcctgtaccccagcaagcaccccatcaccgtggagatcaatggcatcaaccctggcaacaatgactgctgggtgtccacaggcctgtacctgctggagggccagaatgctgaggtgtccctgtctgaggccgccgccagcgctggcctgcgggtgcagatcggctgccacacagatgacctgaccaaggccaggaagctgagccgggcccctgtggtgacccaccagtgctggatggacagaacagagaggtctgtgtcctgcctgtggggcggcctgctgtatgtgattgtgcccaagggcagccagctgggccctgtgcctgtgaccatcagaggagctgtgcctgccccctactacaagctgggcaagaccagcctggaggagtggaagaggcagatgcaggagaacctggccccctggggcgagctggccacagacaacatcatcctgactgtgcccaccaccaacctgcaggccctgaaggaccctgagcctgtgctgcggctgtgggatgagatgatgcaggccgtggcccggctggccgctgagcccttccccttccggcggcctgagagaattgtggctgatgtgcagatctctgctggctggatgcacagcggctaccccatcatgtgccacctggagagcgtgaaggagatcatcaatgagatggacatgaggagccggggcgtgtggggccccatccacgagctgggccacaaccagcagagacatggctgggagttccccccccacaccacagaggccacctgcaacctgtggagcgtgtatgtgcatgagaccgtgctgggcatcccccgggcccaggcccacgaggccctgagccccccagagcgggagcggcgcatcaaggcccacctgggcaagggggcccccctgtgtgactggaatgtgtggacagccctggagacctacctgcaggtgctgagcaggaacagcggccggcggggctag

SEQ ID NO: 38385 - DNA, 1695 bp, Artificial Sequence; identical to SEQ ID NO: 38384
  Description of Artificial Sequence: Synthetic coding sequence

SEQ ID NO: 38386 - DNA, 2760 bp, Artificial Sequence
  Description of Artificial Sequence: Synthetic coding sequence
atggccaccatcgctgctgctgcctttgaggccctgatggatggagtgacctgctgggatgtgccccggggccccatccccagcgagctgctgctgattggagaggccgccttccctgtgatggtgaatgacaagggccaggtgctgattgctgccagcagctatggccggggccgcctggtggtggtgtcccatgagggctacctgagccacacaggcctggcccccttcctgctgaatgctgtgtcctggctgtgcccctgccctggggcccctgtgggcgtgcaccccagcctggcccccctggtgaacatcctgcaggatgctggcctggaggcccaggtgaagccagagcctggagagcccctgggcgtgtactgcatcaatgcctacaatgacaccctgacagccaccctcatccagtttgtgaagcatggaggcggcctgctgattggaggccaggcctggtactgggccagccagcacggccctgacaaggtgctgagccgcttccctggcaacaaggtgacctctgtggccggcgtgtacttcacagacacctacggggaccgggaccgcttcaaggtgtccaagaaggtgcccaagatccccctgcacgtgcgctatggagaagatgtgcggcaggaccagcagcagctgctggagggcatcagcgagctggacatcagaactggaggagtgcccagccagctgctggtgcatggagccctggccttccccctgggcctggatgccagcctgaactgcttcctggccgccgcccactacggccggggccgggtggtgctggccgcccacgagtgcctgctgtgtgcccccaagatgggccccttcctgctgaatgctgtgcgctggctggcccggggccagacaggcaaggtgggcgtgaacaccaacctgaaggacctgtgccccctgctgtctgaacatggcctgcagtgcagcctggagccccacctgaacagcgacctgtgtgtgtactgctgcaaggcctacagcgacaaggaggccaagcagctgcaggagtttgtggccgagggcggcggcctgctgattggaggccaggcctggtggtgggccagccagaaccctggccactgccccctggccggcttccctggcaacatcatcctgaactgcttcggcctgagcatcctgccccagaccctgaaggccggctgcttccctgtgcccaccccagagatgaggagctaccacttcaggaaggccctgagccagttccaggccatcctgaaccatgaaaatggaaacctggagaagagctgcctggccaagctgcgggtggatggagctgccttcctgcagatcccagctgagggcgtgcctgcctacatcagcctgcaccggctgctgaggaagatgctgcggggcagcggcctgcctgctgtgtcccgggagaaccctgtggccagtgacagctatgaggccgctgtgctgagcctggccaccggcctggcccacagcggcacagactgcagccagctggcccagggcctgggcacctggacctgcagcagcagcctgtaccccagcaagcaccccatcaccgtggagatcaatggcatcaaccctggcaacaatgactgctgggtgtccacaggcctgtacctgctggagggccagaatgctgaggtgtccctgtctgaggccgccgccagcgctggcctgcgggtgcagatcggctgccacacagatgacctgaccaaggccaggaagctgagccgggcccctgtggtgacccaccagtgctggatggacagaacagagaggtctgtgtcctgcctgtggggcggcctgctgtatgtgattgtgcccaagggcagccagctgggccctgtgcctgtgaccatcagaggagctgtgcctgccccctactacaagctgggcaagaccagcctggaggagtggaagaggcagatgcaggagaacctggccccctggggcgagctggccacagacaacatcatcctgactgtgcccaccaccaacctgcaggccctgaaggaccctgagcctgtgctgcggctgtgggatgagatgatgcaggccgtggcccggctggccgctgagcccttccccttcagaagacctgagcgcatcgtggctgatgtgcagatctctgctggctggatgcacagcggctaccccatcatgtgccacctggagagcgtgaaggagatcatcaatgagatggacatgaggagcagaggagtgtggggccccatccacgagctgggccacaaccagcagagacatggctgggagttccccccccacaccacagaggccacctgcaacctgtggagcgtgtatgtgcatgaaacagtgctgggcatcccccgggcccaggcccacgaggccctgagccccccagagcgggagcggcgcatcaaggcccacctgggcaaaggagcccccctgtgtgactggaatgtgtggacagccctggagacctacctgcagctgcaggaggccttcggctgggagcccttcacccagctgtttgctgagtaccagaccctgagccacctgcccaaggacaacacaggccgcatgaacctgtgggtgaagaagttcagcgagaaggtgaagaagaacctggtgcccttctttgaggcctggggctggcccatccagaaggaggtggccgacagcctggccagcctgcctgagtggcaggagaaccccatgcaggtgtacctgcgggccaggaagtag

SEQ ID NO: 38387 - DNA, 2538 bp, Artificial Sequence; identical to SEQ ID NO: 38382
  Description of Artificial Sequence: Synthetic coding sequence

SEQ ID NO: 38388 - DNA, 1827 bp, Artificial Sequence
  Description of Artificial Sequence: Synthetic coding sequence
atggccctgcggggccctgctggcctgggccctggcagccggcggcccctggatgaggccgtggccggggctgagggccgggaggccccagccctggtggccgccggcggggccccagaagatgatgaggaggatgatggccggggccggggcctgctgcgctgggacagcttcagcgcctggctgcactgtgtgtgtgtggtgggctttgacctggagctgggccaggccgtggaggtgatctacccccagcacagcaagctgacagaccgggagaagaccaacatctgctacctgtccttcccagacagcaacagcggctgcctgggggacacccagttctgcttccgcttccggcagagcagcggccggcgggtgtccctgcactgcctgctggaccagtttgacaaggacctgcctgtgtacctgaagaaggaccctgcctacttctacggctacgtgtacttccggcaggtgcgggacaagaccctgaagaggggctacttccagaagagcctggtgctgatcagcaagctgccctacatccacttcttccacacagtgctgaagcagatcgcccctgagtactttgagaagaatgagccctacctggaggccgcctgcaatgatgtggaccgctggccagcccctgtgcctgggaagaccctgcacctgcccatcatgggcgtggtgatgaaggtgcgcatccccacctgccacgacaagccaggcaccacccagatcgtgcagctgacccagcaggtggacaccaacatcagcgtcatcctgcccaccgtgcatgaggtggacatcttccgctgcttctgccctgtgttcctgcacagccagatgctgtgggagctggtgctgctgggggagcccctggtggtgatggcccccagccccagcgagagcagcgagaccgtgctggccctggtgaactgcatcagccccctgaagtacttcagtgacttccggccctacttcaccatccatgacagcgagttcaaggagtacaccaccaggacccaggccccacccagcgtcatcctgggcgtgaccaaccccttctttgccaagaccctgcagcactggccccacatcatcagaattggagacctgaagcccactggagagatccccaagcaggtgaaggtgaagaagctgaagaacctgaagaccctggacagcaagccaggagtgtacaccagctacaagccctacctgaacagagatgaggagatcatcaagcagctgcagaagggcgtgcagcagaagaggccttctgaggcccagagcgtcatcctgcggcgctacttcctggagctgacccagagcttcatcatccccctggagcgctacgtggccagcctgatgcccctgcagaagagcatcagcccctggaagagccccccccagctgcggcagttcctgcctgaggagttcatgaagaccctggagaagacaggcccccagctgaccagccgcatcaagggggactggattggcctgtaccgccacttcctgaagagccccaactttgatggctggttcaagaccaggaggaaggagatgacccagaagctggaggccctgcacctggaggccctgtgtgaggaggacctgctgctgtggatccagaagcacacagaggtggagaccgtggacctggtgctgaagctgaagaacaagctgctgcaggccgaccgggagcacctgcctgtgaagccagacaccatggagaagctgcggacccacattgatgccatcatcctggccctgcctgaggacctgcagggcatcctgctgaagacaggcatgacctag

SEQ ID NO: 38389 - DNA, 1758 bp, Artificial Sequence
  Description of Artificial Sequence: Synthetic coding sequence
atggatgccctgctgggcaccggcccccggcgggcccggggctgcctgggcgctgctggccccaccagcagcggccgggccgcccggaccccagctgccccctgggcccgcttcagcgcctggctggagtgtgtgtgtgtggtgacctttgacctggagctgggccaggccctggagctggtgtacccaaatgacttccggctgacagacaaggagaagagcagcatctgctacctgtccttcccagacagccacagcggctgcctgggggacacccagttctccttcaggatgaggcagtgtggcggccagaggagcccctggcacgcagatgacagacactacaacagccgggcccctgtggccctgcagcgggagcccgcccactacttcggctacgtgtacttccggcaggtgaaggacagctctgtgaagaggggctacttccagaagagcctggtgctggtgtcccggctgccctttgtgcggctcttccaggccctgctgagcctcatcgcccctgagtactttgacaagctggccccctgcctggaggccgtgtgcagcgagattgaccagtggccagccccagcccctggccagaccctgaacctgcctgtgatgggcgtggtggtgcaggtgcgcatccccagccgggtggacaagtctgagagcagcccccccaagcagtttgaccaggagaacctgctgcctgcccctgtggtgctggcctctgtgcatgagctggacctcttccgctgcttccggcctgtgctgacccacatgcagaccctgtgggagctgatgctgctgggggagcccctgctggtgctggcccccagcccagatgtgagcagcgagatggtgctggccctgaccagctgcctgcagcccctgcgcttctgctgtgacttccggccctacttcaccatccatgacagcgagttcaaggagttcaccaccaggacccaggccccacccaacgtggtgctgggcgtgaccaaccccttcttcatcaagaccctgcagcactggccccacatcctgcgggtgggggagcccaagatgtctggggacctgcccaagcaggtgaagctgaagaagcccagccggctgaagaccctggacaccaagccaggcctgtacacagcctacacagcccacctgcaccgggacaaggccctgctgaagaggctgctgaagggcgtgcagaagaagaggcccagtgatgtgcagagcgccctgctgcggcggcacctgctggagctgacccagagcttcatcatccccctggagcactacatggccagcctgatgcccctgcagaagagcatcaccccctggaagaccccaccccagatccagcccttcagccaggatgacttcctgcggagcctggagcacgccggcccccagctgacctgcatcctgaagggggactggctgggcctgtaccgccgcttcttcaagagcccccactttgatggctggtaccggcagaggcacaaggagatggccctgaagctggaggccctgcacctggaggccatctgtgaggccaacatcgagacctggatgaaggacaagtctgaggtggaggtggtggacctggtgctgaagctgcgggagaagctggtgcgggcccagggccaccagctgcctgtgaaggaggccaccctgcagagggcccagctgtacattgaaacagtgattggcagcctgcccaaggacctgcaggccgtgctgtgccccccatag

SEQ ID NO: 38390 - DNA, 1362 bp, Artificial Sequence
  Description of Artificial Sequence: Synthetic coding sequence
atggccggggctgctgctgggggccggggcggcggggcctggggccctggccggggcggggccggcggcctgcggcggggctgcagccccccagccccagctggcagccccagggctggcctgcagcccctgcgggccaccatccccttccagctgcagcagccccaccagaggagagatggcggcggccgggccgcctctgtgccctgcagcgtggcccctgagaagtctgtgtgccggccccagcccctgcaggtgcggaggaccttcagcctggacaccatcctgagcagctacctgctgggccagtggcccagagatgctgatggagccttcacctgctgcaccaatgacaaggccacccagacccccctgtcctggcaggagctggagggggagcgggccagcagctgtgcccacaagaggtctgcctcctggggcagcacagaccacaggaaggagatcagcaagctgaagcagcagctgcagaggaccaagctgagccgcagcggcaaggagaaggagcggggcagccccctgctgggggaccatgctgtgcggggggccctgcgggccagcccccccagcttccccagcggcagccctgtgctgcggctgagcccctgcctgcacaggagcctggagggcctgaaccaggagctggaggaggtgtttgtgaaggagcagggcgaggaggagctgctgcgcatcctggacatcccagatggccaccgggccccagccccaccccagagcggcagctgtgaccaccccctgctgctgctggagcccggcaacctggccagcagccccagcatgagcctggccagcccccagccctgtggcctggccagccatgaggagcacagaggagctgctgaggagctggccagcaccccaaatgacaaggccagcagccctggccacccagccttcctggaggatggcagccccagccctgtgctggcctttgctgccagcccccggcccaaccacagctacatcttcaagcgggagcccccagagggctgtgagaaggtgcgggtgtttgaggaggccaccagccctggccctgacctggccttcctgaccagctgcccagacaagaacaaggtgcacttcaaccccactggaagtgccttctgccctgtgaacctgatgaagcccctcttccctggcatgggcttcatcttcaggaactgccccagcaaccctggcagccccctgcccccagccagcccccggcccccacccaggaaggaccctgaggccagcaaggccagccccctgccctttgagccctggcagaggaccccaccttctgaggagcctgtgctcttccagagcagcctgatggtgtag

SEQ ID NO: 38391 - DNA, 1038 bp, Artificial Sequence
  Description of Artificial Sequence: Synthetic coding sequence
atgagggacaaggccacccagacagagagcgcctgggccgaggagtacagcgagaagaagaagggcagccacaagaggtctgcctcctggggcagcacagaccagctgaaggagatcgccaagctgcggcagcagctgcagaggagcaagcacagcagccgccaccaccgggacaaggagcggcagagccccttccacggcaaccacgccgccatcaaccagtgccaggcccctgtgcccaagagcgccctgatccctgtgatccccatcaccaagagcacaggcagccgcttcagaaattctgtggagggcctgaaccaggagattgagatcatcatcaaggagaccggggagaaggaggagcagctgatcccccaggacatcccagatggccaccgggcccccccacccctggtgcagaggagcagcagcaccaggagcattgacacccagaccccaggaggagctgaccggggcagcaacaacagcagccgcagccagagcgtgagccccaccagcttcctgaccatcagcaatgaaggcagcgaggagagcccctgcagcgcagatgacctgctggtggacccccgggacaaggaaaatggaaacaacagccccctgcccaagtatgccaccagccccaagcccaacaacagctacatgttcaagcgggagcccccagagggctgtgagcgggtgaaggtgtttgaggagtgcagccccaagcagctgcacgagatcccagccttctactgcccagacaagaacaaggtgaacttcatccccaagagcggcagcgccttctgcctggtgtccatcctgaagcccctgctgcccaccccagacctgaccctgaagggcagcggccacagcctgactgtgaccaccggcatgaccaccaccctgctgcagcccatcgctgtggccagcctgagcaccaacacagagcaggacagagtgtcccggggcaccagcacagtgatgcccagcgccagcctgctgcccccacctgagcccatcgaggaggccgagggctag

SEQ ID NO: 38392 - DNA, 1770 bp, Artificial Sequence
  Description of Artificial Sequence: Synthetic coding sequence
atgagccagagggtgagaagaaatggcagccccaccccagctggcagcctgggcggcggcgctgtggccacagctgggggccctggcagccggctgcagcccatgagggccaccgtgcccttccagctgaagcagcagcagcagcagcagcacggcagccccaccaggtctgggggcggcggcggcggcaacaacaacggcggctgctgcggcggggccagcggccctgctgggggcggcggcggcggcggccccaggacagccagccgcagcaccagccccacccggggcggcggcaatgctgctgcccggaccagccccaccgtggccacccagacaggagccagcgccaccagcacccggggcaccagccccaccaggtctgctgcccctggggcccggggcagccccccccggcccccacctcctccacccctgctgggcaccgtgagcagccccagcagcagccccacccacctgtggacaggagaggtgtctgctgcccctcctccagcccgggtgcgccacagaagaagaagccctgagcagagccgcagcagccctgagaagaggagccccagcgcccctgtgtgcaaggccggggacaagacccggcagcccagcagcagccccagcagcatcatccggaggaccagcagcctggacaccctggccgccccctacctggccggccactggccccgggacagccacggccaggccgccccctgcatgagggacaaggccacccagacagagagcgcctgggccgaggagtacagcgagaagaagaagggcagccacaagaggtctgcctcctggggcagcacagaccagctgaaggagatcgccaagctgcggcagcagctgcagaggagcaagcacagcagccgccaccaccgggacaaggagcggcagagccccttccacggcaaccacgccgccatcaaccagtgccaggcccctgtgcccaagagcgccctgatccctgtgatccccatcaccaagagcacaggcagccgcttcagaaattctgtggagggcctgaaccaggagattgagatcatcatcaaggagaccggggagaaggaggagcagctgatcccccaggacatcccagatggccaccgggcccccccacccctggtgcagaggagcagcagcaccaggagcattgacacccagaccccaggaggagctgaccggggcagcaacaacagcagccgcagccagagcgtgagccccaccagcttcctgaccatcagcaatgaaggcagcgaggagagcccctgcagcgcagatgacctgctggtggacccccgggacaaggaaaatggaaacaacagccccctgcccaagtatgccaccagccccaagcccaacaacagctacatgttcaagcgggagcccccagagggctgtgagcgggtgaaggtgtttgaggagtgcagccccaagcagctgcacgagatcccagccttctactgcccagacaagaacaaggtgaacttcatccccaagagcggcagcgccttctgcctggtgtccatcctgaagcccctgctgcccaccccagacctgaccctgaagggcagcggccacagcctgactgtgaccaccggcatgaccaccaccctgctgcagcccatcgctgtggccagcctgagcaccaacacagagcaggacagagtgtcccggggcaccagcacagtgatgcccagcgccagcctgctgcccccacctgagcccatcgaggaggccgagggctag

SEQ ID NO: 38393 - DNA, 1056 bp, Artificial Sequence
  Description of Artificial Sequence: Synthetic coding sequence
atggccagcacaggcagccaggccagtgacattgatgagatcttcggcttcttcaatgatggagagccccccaccaagaagcccaggaagctgctgcccagcctgaagaccaagaagccccgggagctggtgctggtgattggaacaggcatctctgctgctgtggccccccaggtgcctgccctgaagtcctggaagggcctcatccaggccctgctggatgctgccatcgactttgacctgctggaggatgaggagagcaagaagttccagaagtgcctgcacgaggacaagaacctggtgcacgtggcccatgacctgatccagaagctgagccccaggaccagcaatgtgcgcagcaccttcttcaaggactgcctgtatgaggtgtttgatgacctggagagcaagatggaggacagcggcaagcagctgctgcagagcgtgctgcacctgatggagaatggagccctggtgctgaccaccaactttgacaacctgctggagctgtatgctgctgaccagggcaagcagctggagagcctggacctgacagatgagaagaaggtgctggagtgggcccaggagaagaggaagctgtctgtgctgcacatccacggcgtgtacaccaaccccagcggcatcgtgctgcaccctgctggctaccagaatgtgctgaggaacacagaggtgatgagggagatccagaagctgtatgagaacaagagcttcctgttcctgggctgcggctggacagtggatgacaccaccttccaggccctcttcctggaggccgtgaagcacaagagtgacctggagcacttcatgctggtgagaagaggagatgtggatgagttcaagaagctgcgggagaacatgctggacaagggcatcaaggtgatctcctatggagatgattatgctgacctgcctgagtacttcaagaggctgacctgtgagatcagcacccggggcaccagcgctggcatggtgcgggagggccagctgaatggcagcagcgctgcccacagcgagatccggggctgcagcacctag

SEQ ID NO: 38394 - DNA, 222 bp, Artificial Sequence
  Description of Artificial Sequence: Synthetic coding sequence
atgaggctcatcctgaacctgtgcagaggagctggctgcaaccggcaggccgtggccggccagctgctgcccagcacctggagcctgcacgcccacggcctggccaaggaggcccccatcctgcctgtgaagaagatcagccgcagctgcagcgtgaacaacaaggtgtccaagaagaccaccaagccacccaccctgcggagcttcctgagccccatctag

SEQ ID NO: 38395 - DNA, 771 bp, Artificial Sequence
  Description of Artificial Sequence: Synthetic coding sequence
atgggcaagaccaaggacattggagatgatgacacagtggccagcgagttctggagcggggccctgagccagcccagctctgtgcccacccggcccaggacccccaacagagacagctggaggcgggcctgggccgcccggggcctgcacccccggcccagcatcctgcagcccggccctgcccggctgagccgggcccgggccggcggcacccgctgcccccagaggagacatggccgggccaccttctgtgccctgggccggggcatcggcgtgagaagaggccctggccccaggcctgcccgcatccctggcctgaccctgacctggaagaggatgtctgcccggaggatgcagtgggccatgcagacaggaggaagaaaccagacctttggaggcggcgtgcccctcttctggacctggctgaccatctgctgtgctgtgtggaggagcctgccctgccgcctgacccacagctgcagccgggccttcagcagcgcccccctgaagaagaccaagagctccatgctgccccccaagcaggccctggccagcgctgccaggaacctgtgccgcggggccggctgcaaccggcaggccgtggccggccagctgctgcccagcacctggagcctgcacgcccacggcctggccaaggaggcccccatcctgcctgtgaagaagatcagccgcagctgcagcgtgaacaacaaggtgtccaagaagaccaccaagccacccaccctgcgctccttcctgagccccatctag

SEQ ID NO: 38396 - DNA, 816 bp, Artificial Sequence
  Description of Artificial Sequence: Synthetic coding sequence
atggcccaggagaagatggagctggacctggagctgcccccaggcaccggcggcagccctgctgagggcggcggcagcggcggcggcggcggcctgcggcgcagcaacagcgcccccctcatccacggcctgagtgacaccagccctgtgttccaggccgaggcccccagcgcccggaggaacagcaccaccttccccagccggctgcaccagatcaagcaggaggagggcatggacctgatcaaccgggagaccgtgcatgagcgggaggtgcagacagccatgcagatcagccacagctgggaggagagcttcagcctgagtgacaatgatgtggagaagagcgccagccccaagagaattgacttcatccctgtgtccccagcccccagccccacccggggcatcggcaagcagtgcttcagccccagcctgcagagctttgtgagcagcaatggcctgccccccagccccatccccagccccaccacccgcttcaccaccaggaggagccagagccccatcaactgcatccggcccagcgtgctgggccccctgaagaggaaatgtgagatggagacagagtaccagcccaagcgcttcttccagggcatcaccaacatgctgagcagtgatgtggcccagctgagtgaccccggggtgtgtgtgtccagtgacaccctggatggcaacagcagcagcgctggcagcagctgcaacagccctgccaaggtgtccaccaccacagacagccctgtgtccccagcccaggccgccagccccttcatccccctggatgagctgagcagcaagtag

SEQ ID NO: 38397 - DNA, 864 bp, Artificial Sequence
  Description of Artificial Sequence: Synthetic coding sequence
atggcccaggagaagatggagctggacctggagctgcccccaggcaccggcggcagccctgctgagggcggcggcagcggcggcggcggcggcctgcggcgcagcaacagcgcccccctcatccacggcctgagtgacaccagccctgtgttccaggccgaggcccccagcgcccggaggaacagcaccaccttccccagcagacatggcctgctgctgcctgccagccctgtgaggatgcacagcagccggctgcaccagatcaagcaggaggagggcatggacctgatcaaccgggagaccgtgcatgagcgggaggtgcagacagccatgcagatcagccacagctgggaggagagcttcagcctgagtgacaatgatgtggagaagagcgccagccccaagagaattgacttcatccctgtgtccccagcccccagccccacccggggcatcggcaagcagtgcttcagccccagcctgcagagctttgtgagcagcaatggcctgccccccagccccatccccagccccaccacccgcttcaccaccaggaggagccagagccccatcaactgcatccggcccagcgtgctgggccccctgaagaggaaatgtgagatggagacagagtaccagcccaagcgcttcttccagggcatcaccaacatgctgagcagtgatgtggcccagctgagtgaccccggggtgtgtgtgtccagtgacaccctggatggcaacagcagcagcgctggcagcagctgcaacagccctgccaaggtgtccaccaccacagacagccctgtgtccccagcccaggccgccagccccttcatccccctggatgagctgagcagcaagtag

SEQ ID NO: 38398 - DNA, 726 bp, Artificial Sequence
  Description of Artificial Sequence: Synthetic coding sequence
atggcccaggagaagatggagctggacctggagccagacaccagctatggaggcaccctgcggcgcagcagcagcgcccccctcatccacggcctgagtgacctgagccaggtgttccagccctacaccctgcggaccaggaggaacagcaccaccatcatgagccgccacagcctgctgctgagcagcagccccaaccgcatccccagcagccggctgcaccagatcaagcgggaggagggcctggacatggtgaaccgggagacagcccacgagcgggagatgcagacagccatgcagatcagccagagctgggatgagagcctgagcctgagtgacagcgactttgacaagccagagaagctgtacagccccaagagaattgacttcacccctgtgtccccagcccccagccccacccggggctttgggaagatgtttgtgagcagcagcggcctgccccccagccctgtgcccagcccccggcgcttcagccgccgcagccagagccctgtgaagtgcatccggcccagcgtgctgggccccctgaagaggaagggggagatggagacagagagccagcccaagaggctcttccagggcaccaccaacatgctgagcccagatgctgcccagctgagtgacctgagctcctggtggtgctaccagggcgaggagatcccagccctgacccgctgtgtggagcacctgcagatgaatgaatag

SEQ ID NO: 38399 - DNA, 801 bp, Artificial Sequence
  Description of Artificial Sequence: Synthetic coding sequence
atggcccaggagaagatggagctggacctggagccagacaccagctatggaggcaccctgcggcgcagcagcagcgcccccctcatccacggcctgagtgacctgagccaggtgttccagccctacaccctgcggaccaggaggaacagcaccaccatcatgagccgccacagcctgctgctgagcagcagccccaaccgcatccccagcagccggctgcaccagatcaagcgggaggagggcctggacatggtgaaccgggagacagcccacgagcgggagatgcagacagccatgcagatcagccagagctgggatgagagcctgagcctgagtgacagcgactttgacaagccagagaagctgtacagccccaagagaattgacttcacccctgtgtccccagcccccagccccacccggggctttgggaagatgtttgtgagcagcagcggcctgccccccagccctgtgcccagcccccggcgcttcagccgccgcagccagagccctgtgaagtgcatccggcccagcgtgctgggccccctgaagaggaagggggagatggagacagagagccagcccaagaggctcttccagggcaccaccaacatgctgagcccagatgctgcccagctgagtgacctgagcagctgcagcgacatcctggatggcagcagcagcagcagcggcctgagcagtgaccccctggccaagggcagcgccacagctgagagccctgtggcctgcagcaacagctgcagcagcttcatcctgatggatgacctgagccccaagtag

SEQ ID NO: 38400 - DNA, 198 bp, Artificial Sequence
  Description of Artificial Sequence: Synthetic coding sequence
atggcccaggagaagatggagctggacctggagccagacaccagctatggaggcaccctgcggcgcagcagcagcgcccccctcatccacggcctgagtgacctgagccaggtgttccagccctacaccctgcggaccaggaggaacagcaccaccatcatgagccgccacagcctgctgcacatctggcacttctag

SEQ ID NO: 38401 - DNA, 744 bp, Artificial Sequence
  Description of Artificial Sequence: Synthetic coding sequence
atggcccaggagaagatggagctggacctggagccagacaccagctatggaggcaccctgcggcgcagcagcagcgcccccctcatccacggcctgagtgacctgagccaggtgttccagccctacaccctgcggaccaggaggaacagcaccaccatcatgagccgccacagcctggaggagggcctggacatggtgaaccgggagacagcccacgagcgggagatgcagacagccatgcagatcagccagagctgggatgagagcctgagcctgagtgacagcgactttgacaagccagagaagctgtacagccccaagagaattgacttcacccctgtgtccccagcccccagccccacccggggctttgggaagatgtttgtgagcagcagcggcctgccccccagccctgtgcccagcccccggcgcttcagcagaagaagccagagccctgtgaagtgcatccggcccagcgtgctgggccccctgaagaggaaaggagagatggagacagagagccagcccaagaggctcttccagggcaccaccaacatgctgagcccagatgctgcccagctgagtgacctgagcagctgcagcgacatcctggatggcagcagcagcagcagcggcctgagcagtgaccccctggccaagggcagcgccacagctgagagccctgtggcctgcagcaacagctgcagcagcttcatcctgatggatgacctgagccccaagtag

SEQ ID NO: 38402 - DNA, 336 bp, Artificial Sequence
  Description of Artificial Sequence: Synthetic coding sequence
atggcccaggagaagatggagctggacctggagccagacaccagctatggaggcaccctgcggcgcagcagcagcgcccccctcatccacggcctgagtgacctgagccaggtgttccagccctacaccctgcggaccaggaggaacagcaccaccatcatgagccgccacagcctgctgctggtgcccaagggctacatggagcgggtggacaagatctacaagaggcaccaggaggagggcctggacatggtgaaccgggagacagcccacgagcgggagatgcagacagccatgcagatcagccagagctgggatgagagcctgagcctgtag

SEQ ID NO: 38403 - DNA, 747 bp, Artificial Sequence
  Description of Artificial Sequence: Synthetic coding sequence
atggcccaggagaagatggagctggacctggagccagacaccagctatggaggcaccctgcggcgcagcagcagcgcccccctcatccacggcctgagtgacctgagccaggtgttccagccctacaccctgcggaccaggaggaacagcaccaccatcatgagccgccacagcctggaggagggcctggacatggtgaaccgggagacagcccacgagcgggagatgcagacagccatgcagatcagccagagctgggatgagagcctgagcctgagtgacagcgactttgacaagccagagaagctgtacagccccaagagaattgacttcacccctgtgtccccagcccccagccccacccggggctttgggaagatgtttgtgagcagcagcggcctgccccccagccctgtgcccagcccccggcgcttcagcagccgccgcagccagagccctgtgaagtgcatccggcccagcgtgctgggccccctgaagaggaagggggagatggagacagagagccagcccaagaggctcttccagggcaccaccaacatgctgagcccagatgctgcccagctgagtgacctgagcagctgcagcgacatcctggatggcagcagcagcagcagcggcctgagcagtgaccccctggccaagggcagcgccacagctgagagccctgtggcctgcagcaacagctgcagcagcttcatcctgatggatgacctgagccccaagtag

SEQ ID NO: 38404 - DNA, 588 bp, Artificial Sequence
  Description of Artificial Sequence: Synthetic coding sequence
atggcccaggagaagatgaagctgggcttcaagagcctgcccagcagcaccacagcagatggcaacatcctgcggcgggtgaacagcgcccccctcatcaatggcctgggcttcaacagccaggtgctgcaggccgacatgctgcgcatccgcaccaacagaaccaccttcaggaacagaagaagcctgctgctgcccccaccacccttccacggcagcatcagccggctgcaccagatcaagcaggaggaggccatggacctgatcaaccgggagaccatgtctgagtggaagctgcagagcgagatccagatcagccacagctgggaggagggcctgaagctggtgaagtggcacttcaacatcaaccagaagcgcttcagcaaggcccagcccacctgcttcctgctgatcctgcccaactgccagaagatcatgtgcatctacttccagctgctgctgatggagaccacagccatgctggacctgctggtgatccggcagctgaagagcgccctgagccagaccctgctgtgccacctgctgatcctggtgctgatctgcagcagccggcagaccttcaactag

SEQ ID NO: 38405 - DNA, 459 bp, Artificial Sequence
  Description of Artificial Sequence: Synthetic coding sequence
atggcccaggagaagatgaagctgggcttcaagagcctgcccagcagcaccacagcagatggcaacatcctgcggcgggtgaacagcgcccccctcatcaatggcctgggcttcaacagccaggtgctgcaggccgacatgctgcgcatccgcaccaacagaaccaccttcaggaacagaagaagcctgctgctgcccccaccacccttccacggcagcatcagccggctgcaccagatcaagcaggaggaggccatggacctgatcaaccgggagaccatgtctgagtggaagctgcagagcgagatccagatcagccacagctgggaggagggcctgaagctgaatgacaatggcctgcagaagagcagcagcctgaagtgcatcgacctgacccctgtgtcctccatggccagcagcatcaagaagacaggcaagagcaccagcagctacttctag

SEQ ID NO: 38406 - DNA, 348 bp, Artificial Sequence
  Description of Artificial Sequence: Synthetic coding sequence
atggcctacttccctggcactggaagaacagaccaggagacccagctggacctgagcctgtgtggccgggagcctgagagcctggagaacctcttcctggaccctgacatggcccaggagaagatgaagctgggcttcaagagcctgcccagcagcaccacagcagatggcaacatcctgcggcgggtgaacagcgcccccctcatcaatggcctgggcttcaacagccaggtgctgcaggccgacatgctgcgcatccgcaccaacagaaccaccttcaggaacagaagaagcctggagatcaccagccccacctctgtggagcagaagcccaaggacctcttctag

SEQ ID NO: 38407 - DNA, 558 bp, Artificial Sequence
  Description of Artificial Sequence: Synthetic coding sequence
atggacctgatcaaccgggagaccatgtctgagtggaagctgcagagcgagatccagatcagccacagctgggaggagggcctgaagctgaatgacaatggcctgcagaagagcagcagcctgaagtgcatcgacctgacccctgtgtcctccatggccagcagcatcaagaagacaggcaagcagtgcttcagccccagcctgcagacctgtgtgtcctgcaccggcagccccagcagccccatccccagccccatgcagcagtacatcatccgcagccagaaccccaccaacatcatccggcccagcatcctgggccccctgaagaggaaaggagagatggccttccagtaccagcccaagaagatcttccagggcaccaccaacatgctgagcagtgacaccagccagctgtctgagaacaacgtgtacctgctgcctgccacctttgatggaaatgacagcaatgccggcagcagcggcaacagcagcgctgagattggaacagtgaccaacagccctgtgagccccagcgacaccggcagccacctgttctag

SEQ ID NO: 38408 - DNA, 1659 bp, Artificial Sequence
  Description of Artificial Sequence: Synthetic coding sequence
atggagaccagccgcagccggggcggcggcggcgctgtgtctgagcggggcggggccggggcctctgtgggcgtgtgcaggaggaaggccgaggccggggccggcaccggcaccctggccgctgacatggacctgcactgtgactgtgccgctgagaccccagctgctgagccccccagcggcaagatcaacaaggccgccttcaagctgttcaagaagaggaagagcggcggcaccatgcccagcatcttcggcgtgaagaacaagggagatggcaagagcagcggccccaccggcctggtgcgcagcaggacccatgatggcctggccgaggtgctggtgctggagagcggcaggaaggaggagccccggggcggcggggacagcggcggcggcggcggcggccggcccaaccctggcccccccagggctgctggccctgggggcggcagcctggccagcagctctgtggccaagagccacagcttcttcagcctgctgaagaagaatggccgctcagaaaatggaaaaggagagcctgtggatgccagcaaggccggcggcaagcagaagaggggcctgcggggcctcttcagcggcatgcgctggcacaggaaggacaagagggccaaggccgaggccgctgagggccgggcccctgggggcggcctcatcctgcccggcagcctgacagccagcctggagtgtgtgaaggaggagaccccccgggccgcccgggagcctgaggagcccagccaggatgccccccgggaccctgctggctgtggggacatcatcgctgaccaggaggaggaggccggccccagctgtgacaagcacgtgcccggccctgggaagccagccctgagcaagaagaaccctggggtggtggcctaccagggcggcggggaggagatggccagcccagatgaggtggatgacacctacctgcaggagttctgggacatgctgagccagacagaggagcagggccctgagccccaggagggcgccgccaaggtggccgccgccctggagaccaaggtggtgcctgagacccccaaggacacccgctgtgtggaggccgccaaggatgccagctctgtgaagagaagaaggctgaaccgcatccccatcgagccccaccccaaggaggagcccaagcaccctgagaaggagcagcaggagggcgtgcccaacagtgatgagggctactgggacagcaccaccccaggccctgaggaggacagcagcagcagcggcaagaaggccggcatcccccgggacagctacagcggagatgccctgtatgacctgtatgctgaccctgatggcagccctgccaccctgcccggcggcaaggacaatgaggagaccagcagcctgagccggctgaagcctgtgtccccaggcaccatcacctgccccctgcggaccccaggcagcctgctgaaggacagcaagatccccatcagcatcaagcacctgaccaacctgcccagcagccaccctgtggtgcaccagcagcccagccgctctgagatgcccaggaccaagatccctgtgtccaaggtgctggtgcggcgggtgagcaacagaggcctggccggcaccaccatccgggccacagcctgccacgacagcgccaagaagctgtag

SEQ ID NO: 38409 - DNA, 1659 bp, Artificial Sequence; identical to SEQ ID NO: 38408
  Description of Artificial Sequence: Synthetic coding sequence

SEQ ID NO: 38410 - DNA, 2016 bp, Artificial Sequence
  Description of Artificial Sequence: Synthetic coding sequence
atggagaccagccgcagccggggcggcggcggcgctgtgtctgagcggggcggggccggggcctctgtgggcgtgtgcaggaggaaggccgaggccggggccggcaccggcaccctggccgctgacatggacctgcactgtgactgtgccgctgagaccccagctgctgagccccccagcggcaagatcaacaaggccgccttcaagctgttcaagaagaggaagagcggcggcaccatgcccagcatcttcggcgtgaagaacaagggagatggcaagagcagcggccccaccggcctggtgcgcagcaggacccatgatggcctggccgaggtgctggtgctggagagcggcaggaaggaggagccccggggcggcggggacagcggcggcggcggcggcggccggcccaaccctggcccccccagggctgctggccctgggggcggcagcctggccagcagctctgtggccaagagccacagcttcttcagcctgctgaagaagaatggccgctcagaaaatggaaaaggagagcctgtggatgccagcaaggccggcggcaagcagaagaggggcctgcggggcctcttcagcggcatgcgctggcacaggaaggacaagagggccaaggccgaggccgctgagggccgggcccctgggggcggcctcatcctgcccggcagcctgacagccagcctggagtgtgtgaaggaggagaccccccgggccgcccgggagcctgaggagcccagccaggatgccccccgggaccctgctggggagcctgctggaggagaggaggtgcctgccccagctgaccgggccccagcccggagctgccgggaggccgagggcctggcccaccctggggacacaggagcccggggggaggatgctgctggccaccggcgggcagagcccggccctggagaggtgaggacagcagaagatgccagcaggactggagctgtgcctgtgaagacagtgcccctggtggacagcgagggcggcagcggccgggccccagctgccccagaccctgcctctgtggaccccccaagtgaccccagcgctgaccgcatctgcctgatgttcagtgatgtgaccagcctgaagagctttgacagcctgaccggctgtggggacatcatcgctgaccaggaggaggaggccggccccagctgtgacaagcacgtgcccggccctgggaagccagccctgagcaagaagaaccctggggtggtggcctaccagggcggcggggaggagatggccagcccagatgaggtggatgacacctacctgcaggagttctgggacatgctgagccagacagaggagcagggccctgagccccaggagggcgccgccaaggtggccgccgccctggagaccaaggtggtgcctgagacccccaaggacacccgctgtgtggaggccgccaaggatgccagctctgtgaagagaagaaggctgaaccgcatccccatcgagccccaccccaaggaggagcccaagcaccctgagaaggagcagcaggagggcgtgcccaacagtgatgagggctactgggacagcaccaccccaggccctgaggaggacagcagcagcagcggcaagaaggccggcatcccccgggacagctacagcggagatgccctgtatgacctgtatgctgaccctgatggcagccctgccaccctgcccggcggcaaggacaatgaggagaccagcagcctgagccggctgaagcctgtgtccccaggcaccatcacctgccccctgcggaccccaggcagcctgctgaaggacagcaagatccccatcagcatcaagcacctgaccaacctgcccagcagccaccctgtggtgcaccagcagcccagccgctctgagatgcccaggaccaagatccctgtgtccaaggtgctggtgagaagagtgagcaacagaggcctggccggcaccaccatccgggccacagcctgccatgattctgccaagaagctgtag

SEQ ID NO: 38411 - DNA, 2586 bp, Artificial Sequence
  Description of Artificial Sequence: Synthetic coding sequence
atggagctgaagaggggcaagaccttcatcaagagcagcctgcaggtgtcccatgagaagcccccagaccctgctgctgtggccgccgcccgggagggcaccggcccctggagcgtgctgcccggcggccagcagaggccccacagcgagaagggcccccaggccagccccagcgcccaggagtatgaccgctgccccaacaagggggcccagctggaccccaagggcggccctgctgccctgtgtggggccaccttcaagcctgtgaggaagtgcaagacccatgacagcatgtctggagctggccgggccacagctgccaccggccagctggtgggcagcgccagcttccctggcagccctggcagcaggaggatgattgactaccgccactttgtgccccagatgccctttgtgcctgctgtggccaagagcatccccaggaagaggatcagcctgaagaggcccaagaagtgcttcaggaacctcttccacatcagaagaaacaagacagaggacctggccagcctggccgctgagggcaagagcctgcccagccctggggaccccagcgaccccggcggccgccgcagcaaggccttcctgcccccaggagagggccctggcctggatggcctgtgccaggacctgctggacagcgagctgctggctgatgccagctttggcctgtgccgggccctgtgtgaagatgtggccagcctgcagagctttgacagcctgaccggctgtggggaggtgtttgctgatgagagctctgtgcccagcctggagctgaatgaaggacctgagagccccacccaggccgcccagggcctggagagcaaggtgccccggggccccctgcagggctctgtggagcagctggccagccctgcccagaatgaggccagtgacttcacccgcttctgggacagcgtgaacagatctgtgcggcagcagcagagggccctgctgggcccctggctgagcggcccccagggcacagaccgggaccagagccggctggacacagctggcctggccgagctgcccctgtgcccctgccgggaccccaggagcggcagcaaggccagcagcattgacaccggcacccccaagtctgagcagcctgagagcgtgtccaccagtgatgagggctactatgacagcttcagccctggcctggaggaggacaagaaggaggccgagagccctggcaccccagctgccaccttcccccgggacagctacagcggagatgccctgtatgagctgttccatgaccccagcgagggccccctgggccccagcccagatgatgacctgtgtgtgtctgagagcctgagcggccctgccctgggcacccccctgagcatctgcagcttccgggtgggcgctgaggagaacctggccccagcccctggccctgacctgctgagccagggcttcctgcagagctcctggaagggcaaggagtgcctgctgaagctgtgtgacacagagctggccatcaccatgggcatcgtgtcctggctgcggcggggccccaccccccgggccccacccaccccaggccagcctgctgcccctcctggcagccagggcgccccccgggcccccacagagaagctgggcggccgggagggcctggccagtgatgctgggggcgccaccgtgtgcagcgcccccagccggcaggagctgtgggcccaccctggcaccaccggcctgctggccggggagagcaaggccctgggcggggccacccagggcaccggcaccctgagcagagatgccagccgggaggaggagacccggggccacagcgagggcctcttcagctccatggagagcgctgccaccagcaccacagacaccagcggcaagaacaaggcccctgtgcccagcacctggccctgcagccagaaggagcccggccccccaggagtgctgggctgcttccggggcccctggaggcctggccacggcggggacaccctggatgctgagcccatgctggccggctgtgtggcccgggtggccgccctgaagatcagcagcaatgagcagcccccagctgcctggccaccccggcaggacatgggcagcggcctgtttggccagcgctgggcccggggccctgacatgctggagcagaagcagagcagcagcagccccagcatgaccaccatccacggcctgccctacagcgccagcacccaggaccagcgctgccgggacagagtgcaggacctgtcctggctgcgggtggagcccaccggcctgggcgtgcaggcctgggcctctgtggaggaccagcccctgcagctgagcacagaagctgtggagcaggtggcccacggcagccagctggacagcgagcccaggtctgccccagctgcccgctggagcagccagggccaccaccctgagagcctgggcctgaccctgaacagccagcaggagggcggcgtgtctgccagcgccccagaatgtcgctgcagcctgctggcccgggagggcctgctgtgtggccagcctgaggtgggcgccagcggccctgccatggccgagccccacctgtag

SEQ ID NO: 38412 - DNA, 2586 bp, Artificial Sequence; identical to SEQ ID NO: 38411
  Description of Artificial Sequence: Synthetic coding sequence

SEQ ID NO: 38413 - DNA, 429 bp, Artificial Sequence
  Description of Artificial Sequence: Synthetic coding sequence
atggagctgaagaggggcaagaccttcatcaagagcagcctgcaggtgtcccatgagaagcccccagaccctgctgctgtggccgccgcccgggagggcaccggcccctggagcgtgctgcccggcggccagcagaggccccacagcgagaagggcccccaggccagccccagcgcccaggagtatgaccgctgccccaacaagggggcccagctggaccccaagggcggccctgctgccctgtgtggggccaccttcaagcctgtgaggaagtgcaagacccatgacagcatgtctggagctggccgggccacagctgccaccggccagctggtgggcagcgccagcttccctggcagccctggcagcaggaggatgattgactaccgccactttgtgccccagatgccctttgtgcctgctgtgtag

SEQ ID NO: 38414 - DNA, 543 bp, Artificial Sequence
  Description of Artificial Sequence: Synthetic coding sequence
atggagctgaagaggggcaagaccttcatcaagagcagcctgcaggtgtcccatgagaagcccccagaccctgctgctgtggccgccgcccgggagggcaccggcccctggagcgtgctgcccggcggccagcagaggccccacagcgagaagggcccccaggccagccccagcgcccaggagtatgaccgctgccccaacaagggggcccagctggaccccaagggcggccctgctgccctgtgtggggccaccttcaagcctgtgaggaagtgcaagacccatgacagcatgtctggagctggccgggccacagctgccaccggccagctggtgggcagcgccagcttccctggcagccctggcagcaggaggatgattgactaccgccactttgtgccccagatgccctttgtgcctgctgtggccaagagcatccccaggaagaggatcagcctgaagaggcccaagaagtgcttcaggaacctcttccacatcagaagaaacaagacagaggacctggccagcctggccgctgagtag

SEQ ID NO: 38415 - DNA, 1749 bp, Artificial Sequence
  Description of Artificial Sequence: Synthetic coding sequence
atggaccccaaggccggcggcggcggggaggaggatgactgtgtggacagcggggctgagactggaggcagtgactacagccacctgagcagcaccagcaatggcttcagcacctggaggatgccctgctgcctcttcctgtactgcacccatggagacaaggagaagggccgctggagcctgcaggtggagcacacctggcccagcggggagctgtctgtggaggaggcccaggaccccttcctggtgtccatccacatcatcgctgaccctggagagagccagcccctgcaggaggccatcgacaacgtgctggcctggatccacccagacctgcccctcttccgggtgtctgagcggcgggccagcagaagaagaaggaagccacccaagggggcccagcctgccctggccgtggtgctcttcctgcaggaggagtatggagaggagcagatcctgcagctgcacaggaccctgcagcagcccccctggaggcaccaccacacagagcaggtgcacggccgcttcctgccctacctgccctgcagccaggacttcttcaccctggcccctggcacccccctgtgggccatccggcctgtgcactacggcaaggagatcgtgcgcttcaccgtgtactgccgctatgacaactatgctgacagcctgcgcttctaccagctgatcctgcggcgcagccccagccagaagaaggctgacttctgcatcttccccatcttcagcaacctggatgtggacatccagttcagcctgaagaggctgccctgtgaccagtgccctgtgcccacagacagctctgtgctggagttccgggtgcgggacatcggggagctggtgcccctgctgcccaacccctgcagccccatcagcgagggccgctggcagacagaggaccatgatggcaacaagatcctgctgcaggcccagagggtgcacaagaagttccccaagccaggccgggtgcaccacgccagcgagaagaagaggcacagcacccccctgcccagcacagctgtgcccagccacaccccaggcagcagccagcagagccccctgaacagcccccaccctggccccatcagaacaggcctgcccccaggccaccagcaggagtttgctggccgggccaacagcacccccaaccccccctggagcttccagaggagcaagagcctcttctgcctgcccaccggcggccccagcctggccagcagcgctgagccccagtggttcagcaacacaggagcccctggccaccgggccagcgagtggaggcatggccacctgctgagcattgatgacctggagggcgcccaggagacagatgtggacaccggcctgcggctgagcagcagtgacctgtctgtggtgtctgcctacagcgcccccagccgcttctgcagcacagtggagacccccctgcccagcgagcgctgcagcagccactgggccgcccacaaggacagccgggagggccccctgcccaccgtgtcccgggtgaccacagaggcctcctgggccagcctgcccttcttcaccaagaggagcagcagcagcagcgccacagcccgggccgcccccccagcccccagcaccagcaccctgacagacagcagcccccagctgccctgtgacacccccaaggtgaagcagacagatggagacatgcctcctcctcctggcagcgctggccctggggacaatgacatggaggagttctacatctag

SEQ ID NO: 38416 - DNA, 1641 bp, Artificial Sequence
  Description of Artificial Sequence: Synthetic coding sequence
atggaccccaaggccggcggcggcggggaggaggatgactgtgtggacagcggggctgagactggaggcagtgactacagccacctgagcagcaccagcagcgagctgtctgtggaggaggcccaggaccccttcctggtgtccatccacatcatcgctgaccctggagagagccagcccctgcaggaggccatcgacaacgtgctggcctggatccacccagacctgcccctcttccgggtgtctgagcggcgggccagcagaagaagaaggaagccacccaagggggcccagcctgccctggccgtggtgctcttcctgcaggaggagtatggagaggagcagatcctgcagctgcacaggaccctgcagcagcccccctggaggcaccaccacacagagcaggtgcacggccgcttcctgccctacctgccctgcagccaggacttcttcaccctggcccctggcacccccctgtgggccatccggcctgtgcactacggcaaggagatcgtgcgcttcaccgtgtactgccgctatgacaactatgctgacagcctgcgcttctaccagctgatcctgcggcgcagccccagccagaagaaggctgacttctgcatcttccccatcttcagcaacctggatgtggacatccagttcagcctgaagaggctgccctgtgaccagtgccctgtgcccacagacagctctgtgctggagttccgggtgcgggacatcggggagctggtgcccctgctgcccaacccctgcagccccatcagcgagggccgctggcagacagaggaccatgatggcaacaagatcctgctgcaggcccagagggtgcacaagaagttccccaagccaggccgggtgcaccacgccagcgagaagaagaggcacagcacccccctgcccagcacagctgtgcccagccacaccccaggcagcagccagcagagccccctgaacagcccccaccctggccccatcagaacaggcctgcccccaggccaccagcaggagtttgctggccgggccaacagcacccccaaccccccctggagcttccagaggagcaagagcctcttctgcctgcccaccggcggccccagcctggccagcagcgctgagccccagtggttcagcaacacaggagcccctggccaccgggccagcgagtggaggcatggccacctgctgagcattgatgacctggagggcgcccaggagacagatgtggacaccggcctgcggctgagcagcagtgacctgtctgtggtgtctgcctacagcgcccccagccgcttctgcagcacagtggagacccccctgcccagcgagcgctgcagcagccactgggccgcccacaaggacagccgggagggccccctgcccaccgtgtcccgggtgaccacagaggcctcctgggccagcctgcccttcttcaccaagaggagcagcagcagcagcgccacagcccgggccgcccccccagcccccagcaccagcaccctgacagacagcagcccccagctgccctgtgacacccccaaggtgaagcagacagatggagacatgcctcctcctcctggcagcgctggccctggggacaatgacatggaggagttctacatctag

SEQ ID NO: 38417 - DNA, 819 bp, Artificial Sequence
  Description of Artificial Sequence: Synthetic coding sequence
atggatgagacccagggccccctggccatgacagtgcacctgctggccaacagcggccacggcagcctgctgcagaggaccctggaccagctgctggactgcatctgcccagaggtgcggctcttccaggtgtctgagcgggccagccctgtgaagtactgtgagaagagccacagcaagaggagccgcttccctggcatgtctgtgctgctcttcctgcacgagagccctggagaagatagactcttccgggtgctggacagcctgcagcacagcccctggcagtgctaccccacccaggacacccggggccgcctgtgcccctacttctttgccaaccaggagttctacagcctggacagccagctgcccatctggggcgtgcggcaggtgcactgcggcagcgagatcctgcgggtgaccctgtactgcagctttgacaactatgaagatgccatccggctgtatgagatgatcctgcagcgggaggccaccctgcagaagagcaacttctgcttctttgtgctgtatgccagcaagagctttgccctgcagctgagcctgaagcagctgcccccaggcatgtctgtggaccccaaggagagctctgtgctgcagttcaaggtgcaggagatcggccagctggtgcccctgctgcccaacccctgcatgcccatcagcagcacccgctggcagacccaggactatgatggcaacaagatcctgctgcagcgctgggagagcagctctgtggcccagaccagggtgcgctggtgccaccacagcagcctgcggagcagccccagcggcttcaagtag

SEQ ID NO: 38418 - DNA, 819 bp, Artificial Sequence; identical to SEQ ID NO: 38417
  Description of Artificial Sequence: Synthetic coding sequence

SEQ ID NO: 38419 - DNA, 1368 bp, Artificial Sequence
  Description of Artificial Sequence: Synthetic coding sequence
atggatgagacccagggccccctggccatgacagtgcacctgctggccaacagcggccacggcagcctgctgcagaggaccctggaccagctgctggactgcatctgcccagaggtgcggctcttccaggtgtctgagcgggccagccctgtgaagtactgtgagaagagccacagcaagaggagccgcttccctggcatgtctgtgctgctcttcctgcacgagagccctggagaagatagactcttccgggtgctggacagcctgcagcacagcccctggcagtgctaccccacccaggacacccggggccgcctgtgcccctacttctttgccaaccaggagttctacagcctggacagccagctgcccatctggggcgtgcggcaggtgcactgcggcagcgagatcctgcgggtgaccctgtactgcagctttgacaactatgaagatgccatccggctgtatgagatgatcctgcagcgggaggccaccctgcagaagagcaacttctgcttctttgtgctgtatgccagcaagagctttgccctgcagctgagcctgaagcagctgcccccaggcatgtctgtggaccccaaggagagctctgtgctgcagttcaaggtgcaggagatcggccagctggtgcccctgctgcccaacccctgcatgcccatcagcagcacccgctggcagacccaggactatgatggcaacaagatcctgctgcaggtgcagctgaaccctgagctgggcgtgaagaatggcatcctgggcgccggcatgctgcccctgggcagccggctgacctctgtgtctgccaagaggaccagcgagcccaggagccagaggaaccagggcaagaggagccagggccacagcctggagctgcctgagcccagcggcagccccaccagtgacagatgtgccggcacctcctggaagagccctggccgctccttccaggtgagcagccctgccatgggcgcccacctgcacctgagcagccaccacctggagagcggggccaggatgaaggtgctgaacagagaaaattccttccagaagctggaggccgagaccaacgtggacaccggcctgaccatcatcaacagcgagccccggcagacctactttggaggcttcccccgggacctgcagaccagccagccccccttctgcctgcctgccagcagcctgggcgtggccaccagcaagaacaacagcgtgctgaaggagcgggtgagccccctgcccctggccggccagagggacctgggcaccaggaagaccatcagcgagtgcctgctgcacctgcaggtgcagggcgaggagaaggaggaggatgaggaggagttcttcatctag

SEQ ID NO: 38420 - DNA, 1593 bp, Artificial Sequence
  Description of Artificial Sequence: Synthetic coding sequence
atgctgggcacagacagatgtgtggtggaggagtggctgtctgagttcaaggccctgcctgacacccagatcaccagctatgctgccaccctgcacaggaagaagaccctggtgcctgccctgtacaaggtgatccaggacagcaacaatgagctgctggagcctgtgtgccaccagctgtttgagctgtaccgcagcagcgaggtgcggctgaagcgcttcaccctgcagttcctgcctgagctgatgtgggtgtacctgcggctgactgtgtcccgggaccggcagagcaatggctgcatcgaggccctgctgctgggcatctacaacctggagattgctgacaaggatggcaacaacaaggtgctgtccttcaccatccccagcctgagcaagcccagcatctaccacgagcccagcaccatcggctccatggccctgacagagggcgccctgtgccagcacgacctgatccgggtggtgtacagcgacctgcacccccagcgggagaccttcaccgcccagaacagatttgaggtgctgtccttcctgatgctgtgctacaacagcgccatcgtgtacatgcctgccagcagctaccagagcctgtgcaggatgggcagccgggtgtgtgtgtctggcttcccccggcagcacgagaagcactggaaggagctgtgtggccgcatcgtgctggaccctgagttcatggtgcagctgctgactggagtgtactatgccatgtacaacggccagtgggacctgggccaggaggtgctggatgacatcatctaccgggcccagctggagctgttcagccagcccctgctggtggccaatgccatgaagaacagcctgccctttgatgccccagacagcacccaggagggccagaaggtgctgaaggtggaggtgacccccaccgtgccccgcatcagcaggacagccatcaccacagccagcatcagaagacaccgctggaggcgggagggcgctgagggcgtgaatggaggagaggagagcgtgaacctgaatgatgctgatgagggcttcagcagcggggccagcctgagcagccagcccatcggcaccaagcccagcagcagcagccagaggggcagcctgaggaaggtggccaccggccgcagcgccaaggacaaggagacagccagcgccatcaagagcagcgagagcccccgggacagcgtggtgaggaagcagtatgtgcagcagcccacagacctgtctgtggacagcgtggagctgacccccatgaagaagcacctgagcctgcctgctggccaggtggtgcccaagatcaacagcctgagcctcatcagaacagccagcgccagcagcagcaagagctttgattatgtgaatggcagccaggccagcaccagcattggagtgggcacagaaggaggcaccaacctggccgccaacaatgccaaccgctacagcacagtgtccctgcaggaggaccggctgggccaggccggggagggcaaggagctgctgagccctggggcccccctgaccaagcagagccgcagccccagcttcaacatgcagctgatcagccaggtgtag

SEQ ID NO: 38421 - DNA, 627 bp, Artificial Sequence
  Description of Artificial Sequence: Synthetic coding sequence
atgctgggcacagacagatgtgtggtggaggagtggctgtctgagttcaaggccctgcctgacacccagatcaccagctatgctgccaccctgcacaggaagaagaccctggtgcctgccctgtacaaggtgatccaggacagcaacaatgagctgctggagcctgtgtgccaccagctgtttgagctgtaccgcagcagcgaggtgcggctgaagcgcttcaccctgcagttcctgcctgagctgatgtgggtgtacctgcggctgactgtgtcccgggaccggcagagcaatggctgcatcgaggccctgctgctgggcatctacaacctggagattgctgacaaggatggcaacaacaaggtgctgtccttcaccatccccagcctgagcaagcccagcatctaccacgagcccagcaccatcggctccatggccctgacagagggcgccctgtgccagcacgacctgatccgggtggtgtacagcgacctgcacccccagcgggagaccttcaccgcccagaacagatttgaggtgctgtccttcctgatgctgtgctacaacagcgccatcgtgtacatgcctgccagcagctaccagagcctgtgcaggatgggcagctag

SEQ ID NO: 38422 - DNA, 264 bp, Artificial Sequence
  Description of Artificial Sequence: Synthetic coding sequence
atgctgggcacagacagatgtgtggtggaggagtggctgtctgagttcaaggccctgcctgacacccagatcaccagctatgctgccaccctgcacaggaagaagaccctggtgcctgccctgtacaaggtgatccaggacagcaacaatgagctgctggagcctgtgtgccaccagctgtttgagctgtaccgcagcagcgaggtgcggctgaagcgcttcaccctgcagttcctgcctgagctgatgtgggtgtacctgtag

SEQ ID NO: 38423 - DNA, 342 bp, Artificial Sequence
  Description of Artificial Sequence: Synthetic coding sequence
atggatggccgggtgcagctgatgaaggccctgctggccggccccctgcggcctgctgcccggcgctggaggaaccccatccccttccctgagacctttgatggagacacagaccggctgcctgagttcatcgtgcagaccagcagctacatgtttgtggatgagaacaccttcagcaatgatgccctgaaggtgaccttcctgatcacccggctgactggacctgccctgcagtgggtgatcccctacatcaggaaggagagccccctgctgaatgactaccggggcttcctggccgagatgaagagggtgtttggctgggaggaggatgaggacttctag

SEQ ID NO: 38424 - DNA, 342 bp, Artificial Sequence
  Description of Artificial Sequence: Synthetic coding sequence
atggagggccgggtgcagctgatgaaggccctgctggcccggcccctgcggcctgctgcccggcgctggaggaaccccatccccttccctgagacctttgatggagacacagaccggctgcctgagttcatcgtgcagaccagcagctacatgtttgtggatgagaacaccttcagcaatgatgccctgaaggtgaccttcctgatcacccggctgactggacctgccctgcagtgggtgatcccctacatcaagaaggagagccccctgctgagtgactaccggggcttcctggccgagatgaagagggtgtttggctgggaggaggatgaggacttctag

SEQ ID NO: 38425 - DNA, 627 bp, Artificial Sequence
  Description of Artificial Sequence: Synthetic coding sequence
atgggcggcggccggggcctgctgggccgggagaccctgggccctggggaccgctgcagcggcaagggccccctgtgctactggcccccacctggcagccccccagcccccagcctgcgggccagcctgcccctggagcccccacgctgccccctgcggagctgccccctgcccaggtctgcctgcctgtgcagcaggaacagcgcccctggcagctgctgccggccctgggccagcctgtggagcggcctgcccccacccagccgggccagcagcgccccacccatgcacatctggaccctgagctgtgcccctgtggcccaggccgagctgctgctgcacacagaccggcccctgccccccctgcccacccccctgctgctgacccggctgcctgatgactacatcatgctgcccacagacctgcgctgccactgccaccgccaccccagccacagcacagaccggctgctgctgctggtgatctgcacccacctgggcggcatctgggccggccacagcccctggaccatgatccagacagctggctgccccagccgggacctgctgcccagcgcccggcccatcagcagccccatccctgagaccttctgtgccccagcctag

SEQ ID NO: 38426 - DNA, 1782 bp, Artificial Sequence
  Description of Artificial Sequence: Synthetic coding sequence
atgggccctgacaggaaggaggtgcccctgagccggggcacccaggccgtggtggtgggcaagggccgcggggcccctggagatgacagctccatgggcggccggcccagcagccccctggacaagcagcagaggcagcacctgcggggccaggtggacaccctgctgaggaacttcctgccctgctaccggggccagctggccgcctctgtgctgcggcagatcagccgggagctgggcccccaggagcccaccggcagccagctgctgcggagcaagaagctgccccgggtgcgggagcaccggggccccctgacccagctgcggggccaccccccacgctggcagcccatcttctgtgtgctgcggggagatggccgcctggagtggttcagccacaaggaggagtatgaaaatggaggccactgcctgggcagcacagccctgaccggctacaccctgctgaccagccagcgggagtacctgcggctgctggatgccctgtgcccagagagcctgggggaccacacccaggaggagccagacagcctgctggaggtgcctgtgtccttccccctcttcctgcagcaccccttccgccgccacctgtgcttctctgctgccacccgggaggcccagcacgcctggaggctggccctgcagggcggcatccggctgcagggcatcgtgctgcagaggagccaggccccagctgcccgggccttcctggatgctgtgcggctgtaccggcagcaccagggccactttggagatgatgatgtgaccctgggcagtgatgctgaggtgctgacagctgtgctgatgagggagcagctgcctgccctgcgggcccagaccctgcccggcctgcggggagctggccgggcccgggcctgggcctggacagagctgctggatgctgtgcacgccgctgtgctggccggggccagcgctggcctgtgtgccttccagcctgagaaggatgagctgctggccagcctggagaagaccatccggccagatgtggaccagctgctgcggcagagggcccgggtggccggccgcctgaggacagacatccggggccccctggagagctgcctgcggcgggaggtggacccccagctgccccgggtggtgcagaccctgctgaggacagtggaggccagcctggaggccgtgaggaccctgctggcccagggcatggaccggctgagccaccggctgcggcagagccccagcggcacccggctgcggcgggaggtgtacagctttggagagatgccctgggacctggccctgatgcagacctgctaccgggaggccgagaggagccggggccgcctgggccagctggccgcccccttcggcttcctgggcatgcagagcctggtgtttggagcccaggacctggcccagcagctgatggctgatgctgtggccaccttcctgcagctggccgaccagtgcctgaccacagccctgaactgtgaccaggccgcccagaggctggagcgggtgcggggccgggtgctgaagaagttcaagagtgacagcggcctggcccagaggcgcttcatccggggctggggcctgtgcatcttcctgccctttgtgctgagccagctggagcccggctgcaagaagacagagagccacagcgtggcccaggccgtggtgcagtggtgtgacctgggcagcctgcagcccccaccaccccgcttcaagaggagcagccacctgagcctgcccagctcctgggactaccgccaccccctgtag

SEQ ID NO: 38427 - DNA, 1956 bp, Artificial Sequence
  Description of Artificial Sequence: Synthetic coding sequence
atgggccctgacaggaaggaggtgcccctgagccggggcacccaggccgtggtggtgggcaagggccgcggggcccctggagatgacagctccatgggcggccggcccagcagccccctggacaagcagcagaggcagcacctgcggggccaggtggacaccctgctgaggaacttcctgccctgctaccggggccagctggccgcctctgtgctgcggcagatcagccgggagctgggcccccaggagcccaccggcagccagctgctgcggagcaagaagctgccccgggtgcgggagcaccggggccccctgacccagctgcggggccaccccccacgctggcagcccatcttctgtgtgctgcggggagatggccgcctggagtggttcagccacaaggaggagtatgaaaatggaggccactgcctgggcagcacagccctgaccggctacaccctgctgaccagccagcgggagtacctgcggctgctggatgccctgtgcccagagagcctgggggaccacacccaggaggagccagacagcctgctggaggtgcctgtgtccttccccctcttcctgcagcaccccttccgccgccacctgtgcttctctgctgccacccgggaggcccagcacgcctggaggctggccctgcagggcggcatccggctgcagggcatcgtgctgcagaggagccaggccccagctgcccgggccttcctggatgctgtgcggctgtaccggcagcaccagggccactttggagatgatgatgtgaccctgggcagtgatgctgaggtgctgacagctgtgctgatgagggagcagctgcctgccctgcgggcccagaccctgcccggcctgcggggagctggccgggcccgggcctgggcctggacagagctgctggatgctgtgcacgccgctgtgctggccggggccagcgctggcctgtgtgccttccagcctgagaaggatgagctgctggccagcctggagaagaccatccggccagatgtggaccagctgctgcggcagagggcccgggtggccggccgcctgaggacagacatccggggccccctggagagctgcctgcggcgggaggtggacccccagctgccccgggtggtgcagaccctgctgaggacagtggaggccagcctggaggccgtgaggaccctgctggcccagggcatggaccggctgagccaccggctgcggcagagccccagcggcacccggctgcggcgggaggtgtacagctttggagagatgccctgggacctggccctgatgcagacctgctaccgggaggccgagaggagccggggccgcctgggccagctggccgcccccttcggcttcctgggcatgcagagcctggtgtttggagcccaggacctggcccagcagctgatggctgatgctgtggccaccttcctgcagctggccgaccagtgcctgaccacagccctgaactgtgaccaggccgcccagaggctggagcgggtgcggggccgggtgctgaagaagttcaagagtgacagcggcctggcccagaggcgcttcatccggggctggggcctgtgcatcttcctgccctttgtgctgagccagctggagcccggctgcaagaaggagctgcctgagtttgaaggagatgtgctggccgtgggcagccaggccctgaccacagagggcatctatgaagatgtgatccggggctgcctgctgcagagaattgaccaggagctgaagaagaccctgggcgccaatgatgtgtcctgcaccctggatggctgcctggaggtgccctgggagcaggagggcgcagatgaggagacagaggccgagcgggagggcggggcctgcccccggcagccagattctggggcccagatccagcccctgtgccccccacccagccctggcaccttccgctcctag

SEQ ID NO: 38428 - DNA, 2094 bp, Artificial Sequence
  Description of Artificial Sequence: Synthetic coding sequence
atgggccctgacaggaaggaggtgcccctgagccggggcacccaggccgtggtggtgggcaagggccgcggggcccctggagatgacagctccatgggcggccggcccagcagccccctggacaagcagcagaggcagcacctgcggggccaggtggacaccctgctgaggaacttcctgccctgctaccggggccagctggccgcctctgtgctgcggcagatcagccgggagctgggcccccaggagcccaccggcagccagctgctgcggagcaagaagctgccccgggtgcgggagcaccggggccccctgacccagctgcggggccaccccccacgctggcagcccatcttctgtgtgctgcggggagatggccgcctggagtggttcagccacaaggaggagtatgaaaatggaggccactgcctgggcagcacagccctgaccggctacaccctgctgaccagccagcgggagtacctgcggctgctggatgccctgtgcccagagagcctgggggaccacacccaggaggagccagacagcctgctggaggtgcctgtgtccttccccctcttcctgcagcaccccttccgccgccacctgtgcttctctgctgccacccgggaggcccagcacgcctggaggctggccctgcagggcggcatccggctgcagggcatcgtgctgcagaggagccaggccccagctgcccgggccttcctggatgctgtgcggctgtaccggcagcaccagggccactttggagatgatgatgtgaccctgggcagtgatgctgaggtgctgacagctgtgctgatgagggagcagctgcctgccctgcgggcccagaccctgcccggcctgcggggagctggccgggcccgggcctgggcctggacagagctgctggatgctgtgcacgccgctgtgctggccggggccagcgctggcctgtgtgccttccagcctgagaaggatgagctgctggccagcctggagaagaccatccggccagatgtggaccagctgctgcggcagagggcccgggtggccggccgcctgaggacagacatccggggccccctggagagctgcctgcggcgggaggtggacccccagctgccccgggtggtgcagaccctgctgaggacagtggaggccagcctggaggccgtgaggaccctgctggcccagggcatggaccggctgagccaccggctgcggcagagccccagcggcacccggctgcggcgggaggtgtacagctttggagagatgccctgggacctggccctgatgcagacctgctaccgggaggccgagaggagccggggccgcctgggccagctggccgcccccttcggcttcctgggcatgcagagcctggtgtttggagcccaggacctggcccagcagctgatggctgatgctgtggccaccttcctgcagctggccgaccagtgcctgaccacagccctgaactgtgaccaggccgcccagaggctggagcgggtgcggggccgggtgctgaagaagttcaagagtgacagcggcctggcccagaggcgcttcatccggggctggggcctgtgcatcttcctgccctttgtgctgagccagctggagcccggctgcaagaaggagctgcctgagtttgaaggagatgtgctggccgtgggcagccaggccctgaccacagagggcatctatgaagatgtgatccggggctgcctgctgcagagaattgaccaggagctgaagaagaccctgggcgccaatgatgtgtcctgcaccctggatggctgcctggaggtgccctgggagcaggagggcgccgcccccaacctgaacctggtgtcctccttcctggccggccggcaggccttcacagacttcctgtgcctgcctgccaagagcagcgccaactggatcctggccgccagcctgctgagctgcagctgcttccgcagcggcttccaccgggacagcagggtcttcctggtgcagctggccgagggcctgagccacagcctggagaccgtgagcagccacagcgtgtggagcttccggcccaccccccggcagtag

SEQ ID NO: 38429 - DNA, 1848 bp, Artificial Sequence
  Description of Artificial Sequence: Synthetic coding sequence
atgggccctgacaggaaggaggtgcccctgagccggggcacccaggccgtggtggtgggcaagggccgcggggcccctggagatgacagctccatgggcggccggcccagcagccccctggacaagcagcagaggcagcacctgcggggccaggtggacaccctgctgaggaacttcctgccctgctaccggggccagctggccgcctctgtgctgcggcagatcagccgggagctgggcccccaggagcccaccggcagccagctgctgcggagcaagaagctgccccgggtgcgggagcaccggggccccctgacccagctgcggggccaccccccacgctggcagcccatcttctgtgtgctgcggggagatggccgcctggagtggttcagccacaaggaggagtatgaaaatggaggccactgcctgggcagcacagccctgaccggctacaccctgctgaccagccagcgggagtacctgcggctgctggatgccctgtgcccagagagcctgggggaccacacccaggaggagccagacagcctgctggaggtgcctgtgtccttccccctcttcctgcagcaccccttccgccgccacctgtgcttctctgctgccacccgggaggcccagcacgcctggaggctggccctgcagggcggcatccggctgcagggcatcgtgctgcagaggagccaggccccagctgcccgggccttcctggatgctgtgcggctgtaccggcagcaccagggccactttggagatgatgatgtgaccctgggcagtgatgctgaggtgctgacagctgtgctgatgagggagcagctgcctgccctgcgggcccagaccctgcccggcctgcggggagctggccgggcccgggcctgggcctggacagagctgctggatgctgtgcacgccgctgtgctggccggggccagcgctggcctgtgtgccttccagcctgagaaggatgagctgctggccagcctggagaagaccatccggccagatgtggaccagctgctgcggcagagggcccgggtggccggccgcctgaggacagacatccggggccccctggagagctgcctgcggcgggaggtggacccccagctgccccgggtggtgcagaccctgctgaggacagtggaggccagcctggaggccgtgaggaccctgctggcccagggcatggaccggctgagccaccggctgcggcagagccccagcggcacccggctgcggcgggaggtgtacagctttggagagatgccctgggacctggccctgatgcagacctgctaccgggaggccgagaggagccggggccgcctgggccagctggccgcccccttcggcttcctgggcatgcagagcctggtgtttggagcccaggacctggcccagcagctgatggctgatgctgtggccaccttcctgcagctggccgaccagtgcctgaccacagccctgaactgtgaccaggccgcccagaggctggagcgggtgcggggccgggtgctgaaggagctgcctgagtttgaaggagatgtgctggccgtgggcagccaggccctgaccacagagggcatctatgaagatgtgatccggggctgcctgctgcagagaattgaccaggagctgaagaagaccctgggcgccaatgatgtgtcctgcaccctggatggctgcctggaggtgccctgggagcaggagggcgcagatgaggagacagaggccgagcgggagggcggggcctgcccccggcagccagattctggggcccagatccagcccctgtgccccccacccagccctggcaccttccgctcctag

SEQ ID NO: 38430 - DNA, 1710 bp, Artificial Sequence
  Description of Artificial Sequence: Synthetic coding sequence
atgggcggccggcccagcagccccctggacaagcagcagaggcagcacctgcggggccaggtggacaccctgctgaggaacttcctgccctgctaccggggccagctggccgcctctgtgctgccccgggtgcgggagcaccggggccccctgacccagctgcggggccaccccccacgctggcagcccatcttctgtgtgctgcggggagatggccgcctggagtggttcagccacaaggaggagtatgaaaatggaggccactgcctgggcagcacagccctgaccggctacaccctgctgaccagccagcgggagtacctgcggctgctggatgccctgtgcccagagagcctgggggaccacacccaggaggagccagacagcctgctggaggtgcctgtgtccttccccctcttcctgcagcaccccttccgccgccacctgtgcttctctgctgccacccgggaggcccagcacgcctggaggctggccctgcagggcggcatccggctgcagggcatcgtgctgcagaggagccaggccccagctgcccgggccttcctggatgctgtgcggctgtaccggcagcaccagggccactttggagatgatgatgtgaccctgggcagtgatgctgaggtgctgacagctgtgctgatgagggagcagctgcctgccctgcgggcccagaccctgcccggcctgcggggagctggccgggcccgggcctgggcctggacagagctgctggatgctgtgcacgccgctgtgctggccggggccagcgctggcctgtgtgccttccagcctgagaaggatgagctgctggccagcctggagaagaccatccggccagatgtggaccagctgctgcggcagagggcccgggtggccggccgcctgaggacagacatccggggccccctggagagctgcctgcggcgggaggtggacccccagctgccccgggtggtgcagaccctgctgaggacagtggaggccagcctggaggccgtgaggaccctgctggcccagggcatggaccggctgagccaccggctgcggcagagccccagcggcacccggctgcggcgggaggtgtacagctttggagagatgccctgggacctggccctgatgcagacctgctaccgggaggccgagaggagccggggccgcctgggccagctggccgcccccttcggcttcctgggcatgcagagcctggtgtttggagcccaggacctggcccagcagctgatggctgatgctgtggccaccttcctgcagctggccgaccagtgcctgaccacagccctgaactgtgaccaggccgcccagaggctggagcgggtgcggggccgggtgctgaagaagttcaagagtgacagcggcctggcccagaggcgcttcatccggggctggggcctgtgcatcttcctgccctttgtgctgagccagctggagcccggctgcaagaaggagctgcctgagtttgaaggagatgtgctggccgtgggcagccaggccctgaccacagagggcatctatgaagatgtgatccggggctgcctgctgcagagaattgaccaggatgaggagacagaggccgagcgggagggcggggcctgcccccggcagccagattctggggcccagatccagcccctgtgccccccacccagccctggcaccttccgctcctag

SEQ ID NO: 38431 - DNA, 1272 bp, Artificial Sequence
  Description of Artificial Sequence: Synthetic coding sequence
atgagggagcagctgcctgccctgcgggcccagaccctgcccggcctgcggggagctggccgggcccgggcctgggcctggacagagctgctggatgctgtgcacgccgctgtgctggccggggccagcgctggcctgtgtgccttccagcctgagaaggatgagctgctggccagcctggagaagaccatccggccagatgtggaccagctgctgcggcagagggcccgggtggccggccgcctgaggacagacatccggggccccctggagagctgcctgcggcgggaggtggacccccagctgccccgggtggtgcagaccctgctgaggacagtggaggccagcctggaggccgtgaggaccctgctggcccagggcatggaccggctgagccaccggctgcggcagagccccagcggcacccggctgcggcgggaggtgtacagctttggagagatgccctgggacctggccctgatgcagacctgctaccgggaggccgagaggagccggggccgcctgggccagctggccgcccccttcggcttcctgggcatgcagagcctggtgtttggagcccaggacctggcccagcagctgatggctgatgctgtggccaccttcctgcagctggccgaccagtgcctgaccacagccctgaactgtgaccaggccgcccagaggctggagcgggtgcggggccgggtgctgaagaagttcaagagtgacagcggcctggcccagaggcgcttcatccggggctggggcctgtgcatcttcctgccctttgtgctgagccagctggagcccggctgcaagaaggagctgcctgagtttgaaggagatgtgctggccgtgggcagccaggccctgaccacagagggcatctatgaagatgtgatccggggctgcctgctgcagagaattgaccaggagctgaagaagaccctgggcgccaatgatgtgtcctgcaccctggatggctgcctggaggtgccctgggagcaggagggcgccgcccccaacctgaacctggtgtcctccttcctggccggccggcaggccttcacagacttcctgtgcctgcctgccaagagcagcgccaactggatcctggccgccagcctgctgagctgcagctgcttccgcagcggcttccaccgggacagcagggtcttcctggtgcagctggccgagggcctgagccacagcctggagaccgtgagcagccacagcgtgtggagcttccggcccaccccccggcagtag

SEQ ID NO: 38432 - DNA, 2748 bp, Artificial Sequence
  Description of Artificial Sequence: Synthetic coding sequence
atgaggaagagcagcagccccagcctgagcaactgcaacagcgtgctggccaacaagatcttcggcatccccctggatgagctgcagcagggcggccacccagacaatgaggtgcccttcatcgtgcgccacgtggtggactacatcgaggagcacggcggcctggagcagcagggcctcttccaggtgaatggaaatgctgagaccgtggagtggctgcggcagagatatgattctggagaggaggtggacctggtgaaggaggctgatgtgcccagcgccatcagcctgctgcgcttcttcctgcaggagctgcctgagcccgtcatccctggcagcctgcacatccacctgatgcagctgagccaggactacaacaatgaagatgaatttggaaggaagctgcgcttcctgctgcagcagctgccccctgtgaactacagcctgctgaagttcctgtgccgcttcctggccaacgtggccagccaccacgaggagatctggagcgccaacagcctggccgctgtgtttggaccagatgtgttccacatctacacagatgtggaggacatgaaggagcaggagatcgtgagccgcatcatggccggcctgctggagaactactatgagttctttgaaaatgaggaggaggacttcagcagcaatgacctgagcagcatcacagagcaggtgaatgagctgtctgaggaggaggaggaggatgagaagctggagcacatcgaggagctgcctgaggagggcgctgagaagagcaatgacatgcctgaggtggtgcagctgaggatgacagagaacatcctggagagcaacagcgtgacagccaccagcacccacatcagccccatcagcatcctgcctgccagcacagacatcctggagaggaccatccgggctgctgtggagcagcacctgtttgacctgcagagcagcattgaccatgacctgaagaacctgcagcagcagagcgtggtgtgcaacaatgaggccgagagcatccactgtgatggagagggcagcaacaaccagattgatattgctgatgacatcatcaatgccagcgagagcaacagagactgcagcaagcctgtggccagcaccaacctggacaatgaggccatgcagcaggactgtgtgtttgaaaatgaggagaacacccagagcgtgggcatcctgctggagccctgcagcgacagaggagacagtgaagatggctgcctggagcgggaggagtacctgctgtttgacagcgacaagctgagccacctgatcctggacagcagcagcaagatctgtgacctgaatgccaacacagagagcgaggtgcctgggggccagagcgtgggcgtgcagggcgaggccgcctgtgtgtccatcccccacctggacctgaagaatgtgtctgatggagacaagtgggaggagcccttccctgccttcaagtcctggcaggaggacagcgagagcggggaggcccagctgagcccccaggccggccgcatgaaccaccaccccctggaggaggactgcccccctgtgctgagccacaggagcctggactttggccagagccagcgcttcctgcatgaccctgagaagctggacagcagcagcaaggccctgtccttcacccgcatcagaagaagcagcttcagcagcaaggatgagaagcgggaggacaggaccccctaccagctggtgaagaagctgcagaagaagatccggcagtttgaggagcagtttgagcgggagaggaacagcaagcccagctacagcgacattgctgccaaccccaaggtgctgaagtggatgacagagctgaccaagctgaggaagcagatcaaggatgccaagcacaagaacagtgatggagaatttgtgccccagacccggcccaggagcaacaccctgcccaagagctttggcagcagcctggaccatgaagatgaagaaaatgaagatgagcccaaggtgatccagaaggagaagaagcccagcaaggaggccaccctggagctgatcctgaagaggctgaaggagaagagaattgagcgctgcctgcctgaggacatcaagaagatgaccaaggaccacctggtggaggagaaggccagcctgcagaagagcctgctgtactatgagagccagcacggccggcctgtgaccaaggaggagcggcacatcgtgaagcccctgtatgaccgctaccgcctggtgaagcagatgctgacccgggccagcatcacccctgtgctgggcagccccagcaccaagagaagaggccagatgctgcagcccatcatcgagggggagacagcccacttctttgaggagatcaaggaggaggaggaggatggagtgaacctgagcagcgagctgggggacatgctgaagacagctgtgcaggtgcagagcagcctggagaacagcgagagtgatgtggaggagaaccaggagaagctggccctggacctgcggctgagcagcagccgggccgcctccatgcctgagctgctggagcagctgtggaaggcccgggcagagaagaagaagctgaggaagaccctgcgggagtttgaggaggccttctaccagcagaatggaagaaatgcccagaaggaggacagagtgcctgtgctggaggagtaccgggagtacaagaagatcaaggccaagctgcggctgctggaggtgctgatcagcaagcaggacagcagcaagagcatctag

SEQ ID NO: 38433 - DNA, 2664 bp, Artificial Sequence
  Description of Artificial Sequence: Synthetic coding sequence
atgaggaagagcagcagccccagcctgagcaactgcaacagcgtgctggccaacaagatcttcggcatccccctggatgagctgcagcagggcggccacccagacaatgaggtgcccttcatcgtgcgccacgtggtggactacatcgaggagcacggcggcctggagcagcagggcctcttccaggtgaatggaaatgctgagaccgtggagtggctgcggcagagatatgattctggagaggaggtggacctggtgaaggaggctgatgtgcccagcgccatcagcctgctgcgcttcttcctgcaggagctgcctgagcccgtcatccctggcagcctgcacatccacctgatgcagctgagccaggactacaacaatgaagatgaatttggaaggaagctgcgcttcctgctgcagcagctgccccctgtgaactacagcctgctgaagttcctgtgccgcttcctggccaacgtggccagccaccacgaggagatctggagcgccaacagcctggccgctgtgtttggaccagatgtgttccacatctacacagatgtggaggacatgaaggagcaggagatcgtgagccgcatcatggccggcctgctggagaactactatgagttctttgaaaatgaggaggaggacttcagcagcaatgacctgagcagcatcacagagcaggtgaatgagctgtctgaggaggaggaggaggatgagaagctggagcacatcgaggagctgcctgaggagggcgctgagaagagcaatgacatgcctgaggtggtgcagctgaggatgacagagaacatcctggagagcaacagcgtgacagccaccagcacccacatcagccccatcagcatcctgcctgccagcacagacatcctggagaggaccatccgggctgctgtggagcagcacctgtttgacctgcagagcagcattgaccatgacctgaagaacctgcagcagcagagcgtggtgtgcaacaatgaggccgagagcatccactgtgatggagagggcagcaacaaccagattgatattgctgatgacatcatcaatgccagcgagagcaacagagactgcagcaagcctgtggccagcaccaacctggacaatgaggccatgcagcaggactgtgtgtttgaaaatgaggagaacacccagagcgtgggcatcctgctggagccctgcagcgacagaggagacagtgaagatggctgcctggagcgggaggagtacctgctgtttgacagcgacaagctgagccacctgatcctggacagcagcagcaagatctgtgacctgaatgccaacacagagagcgaggtgcctgggggccagagcgtgggcgtgcagggcgaggccgcctgtgtgtccatcccccacctggacctgaagaatgtgtctgatggagacaagtgggaggagcccttccctgccttcaagtcctggcaggaggacagcgagagcggggaggcccagctgagcccccaggccggccgcatgaaccaccaccccctggaggaggactgcccccctgtgctgagccacaggagcctggactttggccagagccagcgcttcctgcatgaccctgagaagctggacagcagcagcaaggccctgtccttcacccgcatcagaagaagcagcttcagcagcaaggatgagaagcgggaggacaggaccccctaccagctggtgaagaagctgcagaagaagatccggcagtttgaggagcagtttgagcgggagaggaacagcaagcccagctacagcgacattgctgccaaccccaaggtgctgaagtggatgacagagctgaccaagctgaggaagcagatcaaggatgccaagcacaagaacagtgatggagaatttgtgccccagacccggcccaggagcaacaccctgcccaagagctttggcagcagcctggaccatgaagatgaagaaaatgaagatgagcccaaggtgatccagaaggagaagaagcccagcaaggaggccaccctggagctgatcctgaagaggctgaaggagaagagaattgagcgctgcctgcctgaggacatcaaggtgaccaaggaggagcggcacatcgtgaagcccctgtatgaccgctaccgcctggtgaagcagatgctgacccgggccagcatcacccctgtgctgggcagccccagcaccaagagaagaggccagatgctgcagcccatcatcgagggggagacagcccacttctttgaggagatcaaggaggaggaggaggatggagtgaacctgagcagcgagctgggggacatgctgaagacagctgtgcaggtgcagagcagcctggagaacagcgagagtgatgtggaggagaaccaggagaagctggccctggacctgcggctgagcagcagccgggccgcctccatgcctgagctgctggagcagctgtggaaggcccgggcagagaagaagaagctgaggaagaccctgcgggagtttgaggaggccttctaccagcagaatggaagaaatgcccagaaggaggacagagtgcctgtgctggaggagtaccgggagtacaagaagatcaaggccaagctgcggctgctggaggtgctgatcagcaagcaggacagcagcaagagcatctag

SEQ ID NO: 38434 - DNA, 2376 bp, Artificial Sequence
  Description of Artificial Sequence: Synthetic coding sequence
atgcagctgagccaggactacaacaatgaagatgaatttggaaggaagctgcgcttcctgctgcagcagctgccccctgtgaactacagcctgctgaagttcctgtgccgcttcctggccaacgtggccagccaccacgaggagatctggagcgccaacagcctggccgctgtgtttggaccagatgtgttccacatctacacagatgtggaggacatgaaggagcaggagatcgtgagccgcatcatggccggcctgctggagaactactatgagttctttgaaaatgaggaggaggacttcagcagcaatgacctgagcagcatcacagagcaggtgaatgagctgtctgaggaggaggaggaggatgagaagctggagcacatcgaggagctgcctgaggagggcgctgagaagagcaatgacatgcctgaggtggtgcagctgaggatgacagagaacatcctggagagcaacagcgtgacagccaccagcacccacatcagccccatcagcatcctgcctgccagcacagacatcctggagaggaccatccgggctgctgtggagcagcacctgtttgacctgcagagcagcattgaccatgacctgaagaacctgcagcagcagagcgtggtgtgcaacaatgaggccgagagcatccactgtgatggagagggcagcaacaaccagattgatattgctgatgacatcatcaatgccagcgagagcaacagagactgcagcaagcctgtggccagcaccaacctggacaatgaggccatgcagcaggactgtgtgtttgaaaatgaggagaacacccagagcgtgggcatcctgctggagccctgcagcgacagaggagacagtgaagatggctgcctggagcgggaggagtacctgctgtttgacagcgacaagctgagccacctgatcctggacagcagcagcaagatctgtgacctgaatgccaacacagagagcgaggtgcctgggggccagagcgtgggcgtgcagggcgaggccgcctgtgtgtccatcccccacctggacctgaagaatgtgtctgatggagacaagtgggaggccagctgccccatcaccttccccctgattgacttcaagaccatgcacctgcagagagatggagaggagcccttccctgccttcaagtcctggcaggaggacagcgagagcggggaggcccagctgagcccccaggccggccgcatgaaccaccaccccctggaggaggactgcccccctgtgctgagccacaggagcctggactttggccagagccagcgcttcctgcatgaccctgagaagctggacagcagcagcaaggccctgtccttcacccgcatcagaagaagcagcttcagcagcaaggatgagaagcgggaggacaggaccccctaccagctggtgaagaagctgcagaagaagatccggcagtttgaggagcagtttgagcgggagaggaacagcaagcccagctacagcgacattgctgccaaccccaaggtgctgaagtggatgacagagctgaccaagctgaggaagcagatcaaggatgccaagcacaagaacagtgatggagaatttgtgccccagacccggcccaggagcaacaccctgcccaagagctttggcagcagcctggaccatgaagatgaagaaaatgaagatgagcccaaggtgatccagaaggagaagaagcccagcaaggaggccaccctggagctgatcctgaagaggctgaaggagaagagaattgagcgctgcctgcctgaggacatcaaggtgaccaaggaggagcggcacatcgtgaagcccctgtatgaccgctaccgcctggtgaagcagatgctgacccgggccagcatcacccctgtgctgggcagccccagcaccaagagaagaggccagatgctgcagcccatcatcgagggggagacagcccacttctttgaggagatcaaggaggaggaggaggatggagtgaacctgagcagcgagctgggggacatgctgaagacagctgtgcaggtgcagagcagcctggagaacagcgagagtgatgtggaggagaaccaggagaagctggccctggacctgcggctgagcagcagccgggccgcctccatgcctgagctgctggagcagctgtggaaggcccgggcagagaagaagaagctgaggaagaccctgcgggagtttgaggaggccttctaccagcagaatggaagaaatgcccagaaggaggacagagtgcctgtgctggaggagtaccgggagtacaagaagatcaaggccaagctgcggctgctggaggtgctgatcagcaagcaggacagcagcaagagcatctag

SEQ ID NO: 38435 - DNA, 288 bp, Artificial Sequence
  Description of Artificial Sequence: Synthetic coding sequence
atgaggaagagcagcagccccagcctgagcaactgcaacagcgtgctggccaacaagatcttcggcatccccctggatgagctgcagcagggcggccacccagacaatgaggtgcccttcatcgtgcgccacgtggtggactacatcgaggagcacggcggcctggagcagcagggcctcttccaggtgaatggaaatgctgagaccgtggagtggctgcggcagagatatgattctggagaggaggtggacctggtgaaggaggctgatgtgcccagcgccatctag

SEQ ID NO: 38436 - DNA, 159 bp, Artificial Sequence
  Description of Artificial Sequence: Synthetic coding sequence
atgaggaagagcagcagccccagcctgagcaactgcaacagcgtgctggccaacaagatcttcggcatccccctggatgagctgcagcagggcggccacccagacaatgaggtgcccttcatcgtgcgccacgtggtggactacatcgaggagcactag

SEQ ID NO: 38437 - DNA, 195 bp, Artificial Sequence
  Description of Artificial Sequence: Synthetic coding sequence
atgaggaagagcagcagccccagcctgagcaactgcaacagcgtgctggccaacaagatcttcggcatccccctggatgagctgcagcagggcggccacccagacaatgaggtgcccttcatcgtgcgccacgtggtggactacatcgaggagcacggcggcctggagcagcagggcctcttccaggtgaactag

SEQ ID NO: 38438 - DNA, 264 bp, Artificial Sequence
  Description of Artificial Sequence: Synthetic coding sequence
atgaggaagagcagcagccccagcctgagcaactgcaacagcgtgctggccaacaagatcttcggcatccccctggatgagctgcagcagggcggccacccagacaatgaggtgcccttcatcgtgcgccacgtggtggactacatcgaggagcacggcggcctggagcagcagggcctcttccaggtgaatggaaatgctgagaccgtggagtggctgcggcagagatatgattctggagaggaggtggacctggtgaagtag

SEQ ID NO: 38439 - DNA, 429 bp, Artificial Sequence
  Description of Artificial Sequence: Synthetic coding sequence
atgaggaagagcagcagccccagcctgagcaactgcaacagcgtgctggccaacaagatcttcggcatccccctggatgagctgcagcagggcggccacccagacaatgaggtgcccttcatcgtgcgccacgtggtggactacatcgaggagcacggcggcctggagcagcagggcctcttccaggtgaatggaaatgctgagaccgtggagtggctgcggcagagatatgattctggagaggaggtggacctggtgaaggaggctgatgtgcccagcgccatcagcctgctgcgcttcttcctgcaggagctgcctgagcccgtcatccctggcagcctgcacatccacctgatgcagctgagccaggactacaacaatgaagatgaatttggaaggaagctgcgcttcctgctgcagcagctgtag

SEQ ID NO: 38440 - DNA, 1506 bp, Artificial Sequence
  Description of Artificial Sequence: Synthetic coding sequence
atgggcaacttcaagagcaggaagcccaagagcatcttcaaggccgagagcggccgcagccatggagagagccaggagacagaacatgtggtgagcagccagagcgagtgccaggtgcgggccggcaccccagcccacgagagcccccagaacaatgccttcaagtgccaggagaccgtgcggctgcagcccagaattgaccagaggacagccatcagccccaaggatgcctttgagacccggcaggacctgaatgaggaggaggccgcccaggtgcatggagtgaaggaccctgccccagccagcacccagagcgtgctggctgatggaacagattctgctgaccccagccctgtgcacaaggatggccagaatgaagctgacagcgcccctgaggacctgcacagcgtgggcaccagccggctgctgtaccacatcacagatggagacaaccccctgctgagcccccgctgcagcatcttcagccagagccagcgcttcaacctggaccctgagagcgcccccagcccccccagcacccagcagttcatgatgcccaggagcagcagccgctgcagctgtggagatggcaaggagccccagaccatcacccagctgaccaagcacatccagagcctgaagaggaagatcaggaagtttgaggagaagtttgagcaggagaagaagtaccggcccagccacggggacaagaccagcaaccctgaggtgctgaagtggatgaatgacctggccaagggcaggaagcagctgaaggagctgaagctgaagctgtctgaggagcagggcagcgcccccaagggccccccaagaaacctgctgtgtgagcagcccaccgtgcccagagaaaatggcaagccagaggccgccggccctgagcccagcagcagtggagaggagaccccagatgctgccctgacctgcctgaaggagcggcgggagcagctgcccccccaggaggacagcaaggtgaccaagcaggacaagaacctgatcaagcccctgtatgaccgctaccgcatcatcaagcagatcctgagcacccccagcctcatccccaccatcgaggaggaggacagtgatgaggaccggccccagggcagccagcagcccagcctggccgaccctgccagccacctgcctgtgggggaccacctgacctacagcaatgaaacagagcctgtgcgggccctgctgcctgatgagaagaaggaggtgaagcccccagccctgtccatgagcaacctgcacgaggccaccatgcctgtgctgctggaccacctgcgggagaccagggctgacaagaagaggctgaggaaggccctgcgggagtttgaggagcagttcttcaagcagacaggccgcagcccccagaaggaggaccgcatccccatggctgatgagtactatgagtacaagcacatcaaggccaagctgcggctgctggaggtgctgatcagcaagcaggatgtggccaagaccatctag

SEQ ID NO: 38441 - DNA, 1758 bp, Artificial Sequence
  Description of Artificial Sequence: Synthetic coding sequence
atgttcagctgcttctgcttcagcctgcaggacaacagcttcagcagcaccaccgtgacagaatgtgatgaggaccctgtgtccctgcacgaggaccagacagactgcagcagcctgagagatgagaacaacaaggagaactacccagatgctggggccctggtggaggagcacgccccacccagctgggagccccagcagcagaatgtggaggccaccgtgctggtggacagcgtgctgcggcccagcatgggcaacttcaagagcaggaagcccaagagcatcttcaaggccgagagcggccgcagccacggggagagccaggagacagagcacgtggtgagcagccagagcgagtgccaggtgcgggccggcaccccagcccacgagagcccccagaacaatgccttcaagtgccaggagaccgtgcggctgcagcccagaattgaccagaggacagccatcagccccaaggatgcctttgagacccggcaggacctgaatgaggaggaggccgcccaggtgcacggcgtgaaggaccctgccccagccagcacccagagcgtgctggctgatggaacagacagcgctgaccccagccctgtgcacaaggatggccagaatgaggccgacagcgcccctgaggacctgcacagcgtgggcaccagccggctgctgtaccacatcacagatggagacaaccccctgctgagcccccgctgcagcatcttcagccagagccagcgcttcaacctggaccctgagagcgcccccagcccccccagcacccagcagttcatgatgcccaggagcagcagccgctgcagctgtggagatggcaaggagccccagaccatcacccagctgaccaagcacatccagagcctgaagaggaagatcaggaagtttgaggagaagtttgagcaggagaagaagtaccggcccagccatggagacaagaccagcaaccctgaggtgctgaagtggatgaatgacctggccaagggcaggaagcagctgaaggagctgaagctgaagctgtctgaggagcagggcagcgcccccaagggcccccccaggaacctgctgtgtgagcagcccaccgtgccccgggagaatggcaagccagaggccgccggccctgagcccagcagcagcggggaggagaccccagatgctgccctgacctgcctgaaggagcggcgggagcagctgcccccccaggaggacagcaaggtgaccaagcaggacaagaacctgatcaagcccctgtatgaccgctaccgcatcatcaagcagatcctgagcacccccagcctcatccccaccatccaggaggaggaggacagtgatgaggaccggccccagggcagccagcagcccagcctggccgaccctgccagccacctgcctgtgggggaccacctgacctacagcaatgaaacagagcctgtgcgggccctgctgcctgatgagaagaaggaggtgaagcccccagccctgtccatgagcaacctgcacgaggccaccatgcctgtgctgctggaccacctgcgggagaccagggctgacaagaagaggctgaggaaggccctgcgggagtttgaggagcagttcttcaagcagacaggccgcagcccccagaaggaggaccgcatccccatggctgatgagtactatgagtacaagcacatcaaggccaagctgcggctgctggaggtgctgatcagcaagcaggatgtggccaagaccatctag

SEQ ID NO: 38442 - DNA, 1464 bp, Artificial Sequence
  Description of Artificial Sequence: Synthetic coding sequence
atgttcagctgcttctgcttcagcctgcaggacaacagcttcagcagcaccaccgtgacagaatgtgatgaggaccctgtgtccctgcacgaggaccagacagactgcagcagcctgagagatgagaacaacaaggagaactacccagatgctggggccctggtggaggagcacgccccacccagctgggagccccagcagcagaatgtggaggccaccgtgctggtggacagcgtgctgcggcccagcatgggcaacttcaagagcaggaagcccaagagcatcttcaaggccgagagcggccgcagccacggggagagccaggagacagagcacgtggtgagcagccagagcgagtgccaggtgcgggccggcaccccagcccacgagagcccccagaacaatgccttcaagtgccaggagaccgtgcggctgcagcccagaattgaccagaggacagccatcagccccaaggatgcctttgagacccggcaggacctgaatgaggaggaggccgcccaggtgcacggcgtgaaggaccctgccccagccagcacccagagcgtgctggctgatggaacagacagcgctgaccccagccctgtgcacaaggatggccagaatgaggccgacagcgcccctgaggacctgcacagcgtgggcaccagccggctgctgtaccacatcacagatggagacaaccccctgctgagcccccgctgcagcatcttcagccagagccagcgcttcaacctggaccctgagagcgcccccagcccccccagcacccagcagttcatgatgcccaggagcagcagccgctgcagctgtggagatggcaaggagccccagaccatcacccagctgaccaagcacatccagagcctgaagaggaagatcaggaagtttgaggagaagtttgagcaggagaagaagtacagagtgaccaagcaggacaagaacctgatcaagcccctgtatgaccgctaccgcatcatcaagcagatcctgagcacccccagcctcatccccaccatccaggaggaggaggacagtgatgaggaccggccccagggcagccagcagcccagcctggccgaccctgccagccacctgcctgtgggggaccacctgacctacagcaatgaaacagagcctgtgcgggccctgctgcctgatgagaagaaggaggtgaagcccccagccctgtccatgagcaacctgcacgaggccaccatgcctgtgctgctggaccacctgcgggagaccagggctgacaagaagaggctgaggaaggccctgcgggagtttgaggagcagttcttcaagcagacaggccgcagcccccagaaggaggaccgcatccccatggctgatgagtactatgagtacaagcacatcaaggccaagctgcggctgctggaggtgctgatcagcaagcaggatgtggccaagaccatctag

SEQ ID NO: 38443 - DNA, 1377 bp, Artificial Sequence
  Description of Artificial Sequence: Synthetic coding sequence
atgttcagctgcttctgcttcagcctgcaggacaacagcttcagcagcaccaccgtgacagaatgtgatgaggaccctgtgtccctgcacgaggaccagacagactgcagcagcctgagagatgagaacaacaaggagaactacccagatgctggggccctggtggaggagcacgccccacccagctgggagccccagcagcagaatgtggaggccaccgtgctggtggacagcgtgctgcggcccagcatgggcaacttcaagagcaggaagcccaagagcatcttcaaggccgagagcggccgcagccacggggagagccaggagacagagcacgtggtgagcagccagagcgagtgccaggtgcgggccggcaccccagcccacgagagcccccagaacaatgccttcaagtgccaggagaccgtgcggctgcagcccagaattgaccagaggacagccatcagccccaaggatgcctttgagacccggcaggacctgaatgaggaggaggccgcccaggtgcacggcgtgaaggaccctgccccagccagcacccagagcgtgctggctgatggaacagacagcgctgaccccagccctgtgcacaaggatggccagaatgaggccgacagcgcccctgaggacctgcacagcgtgggcaccagccggctgctgtaccacatcacagatggagacaaccccctgctgagcccccgctgcagcatcttcagccagagccagcgcttcaacctggaccctgagagcgcccccagcccccccagcacccagcagttcatgatgcccaggagcagcagccgctgcagctgtggagatggcaaggagccccagaccatcacccagctgaccaagcacatccagagcctgaagaggaagatcaggaagtttgaggagaagtttgagcaggagaagaagtaccggcccagccatggagacaagaccagcaaccctgaggtgctgaagtggatgaatgacctggccaagggcaggaagcagctgaaggagctgaagctgaagctgtctgaggagcagggcagcgcccccaagggcccccccaggaacctgctgtgtgagcagcccaccgtgccccgggagaatggcaagccagaggccgccggccctgagcccagcagcagcggggaggagaccccagatgctgccctgacctgcctgaaggagcggcgggagcagctgcccccccaggaggacagcaaggtgaccaagcaggacaagaacctgatcaagcccctgtatgaccgctaccgcatcatcaagcagatcctgagcacccccagcctcatccccaccatcgtgtcccaggacacctgcatgctgctgctgtgcacagatgtgtag

SEQ ID NO: 38444 - DNA, 1509 bp, Artificial Sequence
  Description of Artificial Sequence: Synthetic coding sequence
atgggcaacttcaagagcaggaagcccaagagcatcttcaaggccgagagcggccgcagccatggagagagccaggagacagaacatgtggtgagcagccagagcgagtgccaggtgcgggccggcaccccagcccacgagagcccccagaacaatgccttcaagtgccaggagaccgtgcggctgcagcccagaattgaccagaggacagccatcagccccaaggatgcctttgagacccggcaggacctgaatgaggaggaggccgcccaggtgcatggagtgaaggaccctgccccagccagcacccagagcgtgctggctgatggaacagattctgctgaccccagccctgtgcacaaggatggccagaatgaagctgacagcgcccctgaggacctgcacagcgtgggcaccagccggctgctgtaccacatcacagatggagacaaccccctgctgagcccccgctgcagcatcttcagccagagccagcgcttcaacctggaccctgagagcgcccccagcccccccagcacccagcagttcatgatgcccaggagcagcagccgctgcagctgtggagatggcaaggagccccagaccatcacccagctgaccaagcacatccagagcctgaagaggaagatcaggaagtttgaggagaagtttgagcaggagaagaagtaccggcccagccacggggacaagaccagcaaccctgaggtgctgaagtggatgaatgacctggccaagggcaggaagcagctgaaggagctgaagctgaagctgtctgaggagcagggcagcgcccccaagggccccccaagaaacctgctgtgtgagcagcccaccgtgcccagagaaaatggcaagccagaggccgccggccctgagcccagcagcagtggagaggagaccccagatgctgccctgacctgcctgaaggagcggcgggagcagctgcccccccaggaggacagcaaggtgaccaagcaggacaagaacctgatcaagcccctgtatgaccgctaccgcatcatcaagcagatcctgagcacccccagcctcatccccaccatccaggaggaggaggacagtgatgaagatcggccccagggcagccagcagcccagcctggccgaccctgccagccacctgcctgtgggggaccacctgacctacagcaatgaaacagagcctgtgcgggccctgctgcctgatgagaagaaggaggtgaagcccccagccctgtccatgagcaacctgcacgaggccaccatgcctgtgctgctggaccacctgcgggagaccagggctgacaagaagaggctgaggaaggccctgcgggagtttgaggagcagttcttcaagcagacaggccgcagcccccagaaggaggaccgcatccccatggctgatgagtactatgagtacaagcacatcaaggccaagctgcggctgctggaggtgctgatcagcaagcaggatgtggccaagaccatctag

SEQ ID NO: 38445 - DNA, 18 bp, Artificial Sequence
  Description of Artificial Sequence: Synthetic coding sequence
atgggcaacttcaagtag

SEQ ID NO: 38446 - DNA, 78 bp, Artificial Sequence
  Description of Artificial Sequence: Synthetic coding sequence
atgggcaacttcaagagcaggaagcccaagagcatcttcaaggccgagagcggccgcagccatggagagagccagtag

SEQ ID NO: 38447 - DNA, 999 bp, Artificial Sequence
  Description of Artificial Sequence: Synthetic coding sequence
atggacagcaccagcagcctgcacggcagcagcctgcaccggcccagcacagagcagaccaggacagacttctcctgggatggcatcaacctgtccatggaggacaccaccagcatcctgcccaagctgaagaggaacagcaatgcctacggcatcggggccctggccaagagcagcttcagcggcatcagccgctccatgaaggaccacgtgaccaagcccacagccatgggccagggccgggtggcccacatgattgagtggcagggctggggcaagaccccagctgtgcagccccagcacagccatgaatctgtgagaagagacacagatgcctacagcgacctgagtgatggagagaaggaggcccgcttcctggccggcgtgatggagcagtttgccatcagcgaggccaccctgatggcctggagctccatggatggagaggacatgtctgtgaacagcacccaggagcccctgggctgcaactacagcgacaactaccaggagctgatggacagccaggatgccctggcccaggcccccatggatggctggccccacagctatgtgtcccagggcatgtactgcctgggcagcagtgatgcctgggaggccagtgaccagagcctcatcgccagccctgccaccggcagctacctgggccctgcctttgatgacagccagcccagcctgcacgagatgggccccagccagcctgccagcggctacagcgccctggagcccccacccctgctgggcggggacacagactgggcccctggggtgggcgctgtggacctggcccggggccctgctgaggaggagaagaggcccctggcccctgaggaggaggaggatgctggctgccgggacctggagagcctgagcccccgggaggaccctgagatgagcacagccctgagcaggaaggtgtctgatgtgaccagcagcggcgtgcagagctttgatgaggaggagggggaggccaacaactag

SEQ ID NO: 38448 - DNA, 999 bp, Artificial Sequence; identical to SEQ ID NO: 38447
  Description of Artificial Sequence: Synthetic coding sequence

SEQ ID NO: 38449 - DNA, 999 bp, Artificial Sequence; identical to SEQ ID NO: 38447
  Description of Artificial Sequence: Synthetic coding sequence

SEQ ID NO: 38450 - DNA, 1083 bp, Artificial Sequence
  Description of Artificial Sequence: Synthetic coding sequence
atgggctgcatcggcagcaggacagtgggcaatgaggtgattgctgtggactggaagggcctgaaggatgtggaccagatcaacatggacagcaccagcagcctgcacggcagcagcctgcaccggcccagcacagagcagaccaggacagacttctcctgggatggcatcaacctgtccatggaggacaccaccagcatcctgcccaagctgaagaggaacagcaatgcctacggcatcggggccctggccaagagcagcttcagcggcatcagccgctccatgaaggaccacgtgaccaagcccacagccatgggccagggccgggtggcccacatgattgagtggcagggctggggcaagaccccagctgtgcagccccagcacagccatgaatctgtgagaagagacacagatgcctacagcgacctgagtgatggagagaaggaggcccgcttcctggccggcgtgatggagcagtttgccatcagcgaggccaccctgatggcctggagctccatggatggagaggacatgtctgtgaacagcacccaggagcccctgggctgcaactacagcgacaactaccaggagctgatggacagccaggatgccctggcccaggcccccatggatggctggccccacagctatgtgtcccagggcatgtactgcctgggcagcagtgatgcctgggaggccagtgaccagagcctcatcgccagccctgccaccggcagctacctgggccctgcctttgatgacagccagcccagcctgcacgagatgggccccagccagcctgccagcggctacagcgccctggagcccccacccctgctgggcggggacacagactgggcccctggggtgggcgctgtggacctggcccggggccctgctgaggaggagaagaggcccctggcccctgaggaggaggaggatgctggctgccgggacctggagagcctgagcccccgggaggaccctgagatgagcacagccctgagcaggaaggtgtctgatgtgaccagcagcggcgtgcagagctttgatgaggaggagggggaggccaacaactag

SEQ ID NO: 38451 - DNA, 1011 bp, Artificial Sequence
  Description of Artificial Sequence: Synthetic coding sequence
ttcctgctgggccgccaccagaggacagtgtccacccacgtgctgaacctgtgccccagcttccctgagcactggggctacatccccccctgggacagctggctgtccatggaggacaccaccagcatcctgcccaagctgaagaggaacagcaatgcctacggcatcggggccctggccaagagcagcttcagcggcatcagccgctccatgaaggaccacgtgaccaagcccacagccatgggccagggccgggtggcccacatgattgagtggcagggctggggcaagaccccagctgtgcagccccagcacagccatgaatctgtgagaagagacacagatgcctacagcgacctgagtgatggagagaaggaggcccgcttcctggccggcgtgatggagcagtttgccatcagcgaggccaccctgatggcctggagctccatggatggagaggacatgtctgtgaacagcacccaggagcccctgggctgcaactacagcgacaactaccaggagctgatggacagccaggatgccctggcccaggcccccatggatggctggccccacagctatgtgtcccagggcatgtactgcctgggcagcagtgatgcctgggaggccagtgaccagagcctcatcgccagccctgccaccggcagctacctgggccctgcctttgatgacagccagcccagcctgcacgagatgggccccagccagcctgccagcggctacagcgccctggagcccccacccctgctgggcggggacacagactgggcccctggggtgggcgctgtggacctggcccggggccctgctgaggaggagaagaggcccctggcccctgaggaggaggaggatgctggctgccgggacctggagagcctgagcccccgggaggaccctgagatgagcacagccctgagcaggaaggtgtctgatgtgaccagcagcggcgtgcagagctttgatgaggaggagggggaggccaacaactag

SEQ ID NO: 38452 - DNA, 843 bp, Artificial Sequence
  Description of Artificial Sequence: Synthetic coding sequence
atgggcagctgtgtgtcccgggacctcttcaccagcgcccacaagaactgccccatgccccagggcgctgaccccctgaacccagacctgcccagcggccgcacccccaccgtggccccagactgtgtgattggcaaggacaagcagatggacttctgctgggacccctggcagcgctgcttccagaccaccaacggctacctgagtgacagccgcagcaggcctggcaactacaacgtggccgccctggccaccagcagcctggtgggcgtggtgcagagcatcaaggaccacatcaccaagcccacagccatggcccggggccgggtggcccacctgattgagtggaagggctggagcgcccagcctgctggctgggagctgagccctgcagaagatgagcactactgctgcctgcctgatgagctgcgggaggccaggtttgctgctggggtggccgagcagtttgccatcacagaggccaccctgagcgcctggagcagcctggatgaggaggagctgcaccctgagaacagcccccagggcatcgtgcagctgcaggacctggagagcatctacctgcaggacagcctgcccagcggccccagccaggatgacagcctgcaggccttcagcagccccagccccagcccagacagctgccccagccctgaggagccccccagcacagctggcatcccccagccccccagccctgagctgcagcacagaagaaggctgcccggggcccagggccctgagggcggcacccaccccccaggcagcctgcccagcatggacagcggcagcctgtgggaggaggatgaggtgttctacaactag

SEQ ID NO: 38453 - DNA, 747 bp, Artificial Sequence
  Description of Artificial Sequence: Synthetic coding sequence
atgggcaagagggacaacagagtggcctacatgaaccccatcgccatggcccgctggaggggccccacccagagcgtgggccccaccatccaggactacctgaaccggccccggcccacctgggaggaggtgaagaagcagctggagaacaagaagacaggcagcaaggccctggccgagtttgaggagaagatgaatgaaaactggaagaaggagctggagaagagccgggagaagctgctgtctggaaatgaaagcagcagcaagaagcgggagaggaagaagaagaggaagaagaagagctgccgcagcagcagcagcagcagcagcagtgacagcagcagcagcagcagtgacagtgaagatgaggagaagaagcagggcaagaggaggaagaagaagaagaacagaagctacaagagcagccagagcagcacccatgaaagtgaaagtgagagcaaggagagcgtgaagaagaagaagaagagcaaggatgaaacagagaaggagaaggatgtgcgcagcctgagcaagaagaggaagaagagctacccagatgacaagcccctgagcagcgagagcagcagcgagagtgactatgaggaggatgtgcaggccaagaagaagaggcgctgtgaggagcgggagcaggccaaggagaaggtgaagaagaagaagaagaagcagcacaagaagcacagcaagaagaagaagaagaagagcggcagcagccacaagagcaggtag

SEQ ID NO: 38454 - DNA, 747 bp, Artificial Sequence; identical to SEQ ID NO: 38453
  Description of Artificial Sequence: Synthetic coding sequence

SEQ ID NO: 38455 - DNA, 747 bp, Artificial Sequence; identical to SEQ ID NO: 38453
  Description of Artificial Sequence: Synthetic coding sequence

SEQ ID NO: 38456 - DNA, 747 bp, Artificial Sequence; identical to SEQ ID NO: 38453
  Description of Artificial Sequence: Synthetic coding sequence

SEQ ID NO: 38457 - DNA, 714 bp, Artificial Sequence
  Description of Artificial Sequence: Synthetic coding sequence
atgaaccccatcgccatggcccggagccggggccccatccagagcagcggccccaccatccaggactacctgaaccggccccggcccacctgggaggaggtgaaggagcagctggagaagaagaagaagggcagcaaggccctggccgagtttgaggagaagatgaatgaaaactggaagaaggagctggagaagcaccgggagaagctgctgagcggcagcgagagcagcagcaagaagaggcagaggaagaagaaggagaagaagaagagcggccgctacagcagcagcagcagcagcagcagtgacagcagcagcagcagcagtgacagtgaagatgaggacaagaagcagggcaagaggaggaagaagaagaagaacagaagccacaagagcagcgagagctccatgtctgaaacagaaagtgacagcaaggacagcctgaagaagaagaagaagagcaaggatggaacagagaaggagaaggacatcaagggcctgagcaagaagaggaagatgtacagcgaggacaagcccctgagcagcgagagcctgtctgagagcgagtacatcgaggaggtgcgggccaagaagaagaagagcagcgaggagcgggagaaggccacagagaagaccaagaagaagaagaagcacaagaagcacagcaagaagaagaagaagaaggccgccagcagcagcccagacagcccctag

SEQ ID NO: 38458 - DNA, 714 bp, Artificial Sequence; identical to SEQ ID NO: 38457
  Description of Artificial Sequence: Synthetic coding sequence

SEQ ID NO: 38459 - DNA, 744 bp, Artificial Sequence
  Description of Artificial Sequence: Synthetic coding sequence
atgggcaagagggacaacagagtggcctacatgaaccccatcgccatggcccggagccggggccccatccagagcagcggccccaccatccaggactacctgaaccggccccggcccacctgggaggaggtgaaggagcagctggagaagaagaagaagggcagcaaggccctggccgagtttgaggagaagatgaatgaaaactggaagaaggagctggagaagcaccgggagaagctgctgagcggcagcgagagcagcagcaagaagaggcagaggaagaagaaggagaagaagaagagcggccgctacagcagcagcagcagcagcagcagtgacagcagcagcagcagcagtgacagtgaagatgaggacaagaagcagggcaagaggaggaagaagaagaagaacagaagccacaagagcagcgagagctccatgtctgaaacagaaagtgacagcaaggacagcctgaagaagaagaagaagagcaaggatggaacagagaaggagaaggacatcaagggcctgagcaagaagaggaagatgtacagcgaggacaagcccctgagcagcgagagcctgtctgagagcgagtacatcgaggaggtgcgggccaagaagaagaagagcagcgaggagcgggagaaggccacagagaagaccaagaagaagaagaagcacaagaagcacagcaagaagaagaagaagaaggccgccagcagcagcccagacagcccctag

SEQ ID NO: 38460 - DNA, 93 bp, Artificial Sequence
  Description of Artificial Sequence: Synthetic coding sequence
atgaaccccatcgccatggcccggagccggggccccatccagagcagcggccccaccatccaggactacctgaaccggccccggcccacctag

SEQ ID NO: 38461 - DNA, 258 bp, Artificial Sequence
  Description of Artificial Sequence: Synthetic coding sequence
atgctgctgaccatcgagaccaagagccactacgtggcccaggccggcctggagctgctggccagcagtgacccccccaccagcgccagccagagcgtgggcatcatcgacatgagccactgcacctggcccaccctgggcaagttcctgaaccccagcaagccccacttcagccccatcaccaagggcaaggatggcaacatcttccccaccaagttcctgagtgatgccctgacagagctgcggctgtgcacctag

SEQ ID NO: 38462 - DNA, 225 bp, Artificial Sequence
  Description of Artificial Sequence: Synthetic coding sequence
atgctgctgaccatcgagaccaagagccactacgtggcccaggccggcctggagctgctggccagcagtgacccccccaccagcgccagccagagcgtgggcatcatcgacatgagccactgcacctggcccaccctgggcaagttcctgaaccccagcaagccccacttcagccccatcaccaagggcaaggatggcaacatcttccccaccaagttcctgtag

SEQ ID NO: 38463 - DNA, 258 bp, Artificial Sequence; identical to SEQ ID NO: 38461
  Description of Artificial Sequence: Synthetic coding sequence

SEQ ID NO: 38464 - DNA, 258 bp, Artificial Sequence; identical to SEQ ID NO: 38461
  Description of Artificial Sequence: Synthetic coding sequence

SEQ ID NO: 38465 - DNA, 1287 bp, Artificial Sequence
  Description of Artificial Sequence: Synthetic coding sequence
atgaaccggcagggcaacaggaagaccaccaaggagggcagcaatgacctgaagttccagaacttcagcctgcccaagaacagatcctggccccgcatcaacagcgccaccggccagtaccagaggatgaacaagcccctgctggactgggagaggaactttgctgctgtgctggatggagccaagggccacagtgatgatgattatgatgatcctgagctgaggatggaggagacctggcagagcatcaagatcctgcctgcccggcccatcaaggagagtgaatatgctgacacccactacttcaaggtggccatggacacccccctgcccctggacaccaggaccagcatcagcatcggccagcccacctggaacacccagacccggctggagcgggtggacaagcccatcagcaaggatgtgcgcagccagaacatcaagggagatgcctctgtgaggaagaacaagatccccctgcccccaccccggcccctcatcaccctgcccaagaagtaccagcccctgcccccagagcctgagagcagcaggcctcccctgagccagaggcacaccttccctgaggtgcagaggatgcccagccagatcagcctgcgggacctgtctgaggtgctggaggccgagaaggtgccccacaaccagaggaagccagagagcacccacctgctggagaaccagaacacccaggagatccccctggccatcagcagcagcagcttcaccaccagcaaccacagcgtgcagaacagagaccacagaggaggcatgcagccctgcagcccccagcgctgccagcccccagccagctgcagcccccatgagaacatcctgccctacaagtacacctcctggaggcctcccttccccaagagaagtgacaggaaggatgtgcagcacaatgagtggtacatcggggagtacagccggcaggccgtggaggaggccttcatgaaggagaacaaggatggcagcttcctggtgcgggactgcagcaccaagagcaaggaggagccctacgtgctggccgtgttctatgagaacaaggtgtacaacgtgaagatccgcttcctggagaggaaccagcagtttgccctgggcaccggcctgcggggagatgagaagtttgacagcgtggaggacatcatcgagcactacaagaacttccccatcatcctgattgatggcaaggacaagacaggagtgcacaggaagcagtgccacctgacccagcccctgcccctgaccaggcacctgctgcccctgtag

SEQ ID NO: 38466 - DNA, 2322 bp, Artificial Sequence
  Description of Artificial Sequence: Synthetic coding sequence
atgaaggctgctgtgctggacctgggcagcctgctggccaagctgtttgagaccagcacagcccccccagctggccccagcagccggcccagcggcggcgctgctgctgctggcagcggcggcagccgggccggcacccccctgggcacagcccccaccctgctgcgggccctggccccagacagccccagcgccagcagaagaagccctgcccccctgctgagcagcccctacagccggggcagcgctgccagcagagctgctggagctgtgggcaccctgctgtcctggcccagcagccccagggctgggaaggccccaccccagccccccacccccagcggcggcggctgcagccctgcccggctggtggtgcctgcccggcccccatctggccctggaggagtgtgggccgccctgcccaggaaccccctgcagcccggccctggagagcgggagctgggcgcctgtgtggcccctggggccggccccaggaccctcttcctgaccctgcctgacatcggggaggagggcgccagtgatggagacagcggagatggagaggcccggggcctgtctgagggcagaagaagacatggcttcaccgtgcgcagcaaggacagcctgcccacccacttcaccagaaatgtgcagaaggccatcgacaagtacacctgcaagagcctgagcagcttcagcagcagcggcagccacacccccactggagcccacacctcctggagcggcagcgccacccagagcagcaccaccggcagcagcacagagcggggctctgtgtacagctggagagatgatgaatttgatgaggccagcagccagagcgtgcagaggctgctgtgggaggtggaggagatgctgtttgagggcaaggtgaacccccagacccagagcctgctggccgagtgtggggagtggacccggcgcagcctgcacctgcgggtgctgggccggcagctgatcctgcccacagacaagggcgtgcagcacttccagggcagcaccccagccagcgctgtgcacaggcctcccctgagcgcctgtggccacagcagcaacatccgggagctgtgcatcagcggcagccagatcgtgcctgctgccctgagcgccagcgccctgcccggcccagatgacaccggggtggccgacctgacagcccggagcagcctggaggaggaggtgtaccacgtggatggcaagattgaggagtactttgcctttgacaggaaggaggatgatgatgagtgcctggagcagaagccagcccagcccggcaggaagtggaggaagctgggcctgccccctgtgagcccccgggactgtgtgaaggatgctgtggccgctgaggtgtttgaccacgtgtggaccaacatggtggagctgctggaggagctgatcaggaagcactgggagaccaccctgacagagggcaagaagcagcgggagaccctgaaggtggccggcaaccgcttcccccacgtgctggtgccccacgcccacgcagatggagccagcggcccccccagcggccatgctgaggcccacggcatcagcctggccagccggctgaaccccccccagatccaccacttcagcagcagcttctacagcgacatgaatggagtgatgaccatccaggccaagcccctgcagaggaggcctgcctactttgctgacaggacccagaatgagaaggaggacaaggccagcggcggcggggccggggccctgagcagcgccccccaccggctgggccgggccagtgacacccacggcctgagccccagcgccaagaagacccctgtgccctggaggctgcccagcctggccagtgacagccagaggctgaagacccccaacatctacagtgatgaggtgctgcggggcaccaagctgcccactggagtggaccacatggccagccccctggtgcagaccagccgcagccgcttcccccccctggtgacagagacccggggccagaacacagctgtgcccggctgccgcctggtgtcctaccggggccgccacctgcagaacagagtgctgagcgccatgccagatggaacagagaggagccggctgcgggagaggacagccaccctggagcggctgagccggcccagcaccacccacaccttccggcagagcgacacccccaggaagagcagcctgacccagatggagtttgctgcccacacctggacaggccagagcatcctgaccggcagccagtatgtgcccaagagcttccagaggaccaccctgaccttcaagaggcgcttccaggtgaccagctag

SEQ ID NO: 38467 - DNA, 1449 bp, Artificial Sequence
  Description of Artificial Sequence: Synthetic coding sequence
atgctgtttgagggcaaggtgaacccccagacccagagcctgctggctgaatgtggggagtggaccaggaggagcctgcacctgcgggtgctgggccggcagctgatcctgcccacagacaagggcgtgcagcacttccagggcagcaccccagccagcgctgtgcaccggccccccctgagcgcctgtggccacagcagcaacatccgggagctgtgcatcagcggcagccagatcgtgcctgctgccctgagcgccagcgccctgcccggcccagatgacacaggagtggccgacctgacagcccggagcagcctggaggaggaggtgtaccacgtggatggcaagattgaggagtactttgcctttgacagaaaagaagatgatgatgaatgtctggagcagaagccagcccagcccggcaggaagtggaggaagctgggcctgccccctgtgagcccccgggactgtgtgaaggatgctgtggccgctgaggtgtttgaccacgtgtggaccaacatggtggagctgctggaggagctgatcaggaagcactgggagaccaccctgacagagggcaagaagcagcgggagaccctgaaggtggccggcaaccgcttcccccacgtgctggtgccccacgcccatgctgatggagccagcggccccccatctggccacgccgaggcccacggcatcagcctggccagccggctgaaccccccccagatccaccacttcagcagcagcttctacagcgacatgaatggagtgatgaccatccaggccaagcccctgcagaggaggcctgcctactttgctgacaggacccagaatgagaaggaggacaaggccagcggcggcggggccggggccctgagcagcgccccccaccggctgggccgggccagtgacacccacggcctgagccccagcgccaagaagacccctgtgccctggaggctgcccagcctggccagtgacagccagaggctgaagacccccaacatctacagtgatgaggtgctgcggggcaccaagctgcccaccggggtggaccacatggccagccccctggtgcagaccagccgcagccgcttcccccccctggtgacagagacccggggccagaacacagctgtgcccggctgccgcctggtgtcctaccggggccgccacctgcagaacagagtgctgagcgccatgccagatggaacagagaggagccggctgcgggagaggacagccaccctggagcggctgagccggcccagcaccacccacaccttccggcagagcgacacccccaggaagagcagcctgacccagatggagtttgctgcccacacctggacaggccagagcatcctgaccggcagccagtatgtgcccaagagcttccagaggaccaccctgaccttcaagaggcgcttccaggtgaccagctag

SEQ ID NO: 38468 - DNA, 1449 bp, Artificial Sequence; identical to SEQ ID NO: 38467
  Description of Artificial Sequence: Synthetic coding sequence

SEQ ID NO: 38469 - DNA, 186 bp, Artificial Sequence
  Description of Artificial Sequence: Synthetic coding sequence
atgctgtttgagggcaaggtgaacccccagacccagagcctgctggctgaatgtggggagtggaccaggaggagcctgcacctgcgggtgctgggccggcagctgatcctgcccacagacaagggcgtgcagcacttccagggcagcaccccagccagcgctgtgcaccggccccccctgtcctag

SEQ ID NO: 38470 - DNA, 1749 bp, Artificial Sequence
  Description of Artificial Sequence: Synthetic coding sequence
atgatcagccgctacaccaggaaggctgtgccccagagcctggagctgaagggcatcaccaagcacgccctgaaccaccaccccccacctgagaagctggaggagatcagccccaccagtgacagccatgagaaggacaccagcagccagagcaagagtgacatcacccgggagagcagcttcaccagcgctgacaccggcaacagcctgagcgccttccccagctacacaggagctggcatcagcacagagggcagcagtgacttctcctggggctatggagagctggaccagaatgccacagagaaggtgcagaccatgttcaccgccattgatgagctgctgtatgagcagaagctgtctgtgcacaccaagagcctgcaggaggagtgccagcagtggacagccagcttcccccacctgcgcatcctgggccggcagatcatcacccccagcgagggctaccgcctgtaccccaggagccccagcgctgtgtctgccagctatgagaccaccctgagccaggagcgggacagcaccatcttcggcatccggggcaagaagctgcacttcagcagcagctatgcccacaaggccagcagcatcgccaagagcagcagcttctgcagcatggagagagatgaggaggacagcatcatcgtgtctgagggcatcatcgaggagtacctggcctttgaccacattgatattgaggagggcttccacggcaagaagtctgaggccgccacagagaagcagaagctgggctacccacccatcgcccccttctactgcatgaaggaggatgtgctggcctacgtgtttgattctgtgtggtgcaaggtggtgtcctgcatggagcagctgaccaggagccactgggagggctttgccagtgatgatgagagcaatgtggccgtgaccaggccagacagcgagagcagctgtgtgctgtctgagctgcaccccctggtgctgccccgggtgccccagagcaaggtgctgtacatcaccagcaaccccatgagcctgtgccaggccagccgccaccagcccaacgtgaatgacctgctggtgcacggcatgcccctgcagcccaggaacctgagcctgatggacaagctgctggacctggatgacaagctgctgatgaggcctggcagcagcaccatcctgagcaccaggaactggcccaacagagctgtggagttcagcaccagcagcctgagctacacagtgcagagcaccaggagaagaaatcctccacccaggaccctgcaccccatcagcaccagccacagctgtgccgagacccccaggtctgtggaggagatcctgcggggggcccgggtgcctgtggccccagacagcctgagcagccccagccccacccccctgagcaggaacaacctgctgccccccatcggcacagctgaggtggagcacgtgtccacagtgggcccccagaggcagatgaagccccatggagacagcagccgggcccagagcgctgtggtggatgagcccaactaccagcagccccaggagcggctgctgctgcctgacttcttcccccggcccaacaccacccagagcttcctgctggacacccagtaccgccgcagctgtgctgtggagtacccccaccaggcccggcccggccggggcagcgctggcccccagctgcacggcagcaccaagagccagagcggcggccggcctgtgtccaggacccggcagggcccctag

SEQ ID NO: 38471 - DNA, 1410 bp, Artificial Sequence
  Description of Artificial Sequence: Synthetic coding sequence
tgattcaccagcgctgacaccggcaacagcctgagcgccttccccagctacaccggggccggcatcagcacagagggcagcagtgacttctcctggggctacggggagctggaccagaatgccacagagaaggtgcagaccatgttcaccgccattgatgagctgctgtatgagcagaagctgtctgtgcacaccaagagcctgcaggaggagtgccagcagtggacagccagcttcccccacctgcgcatcctgggccggcagatcatcaccccatctgagggctaccgcctgtaccccaggagccccagcgctgtgtctgccagctatgagaccaccctgagccaggagcgggacagcaccatcttcggcatccggggcaagaagctgcacttcagcagcagctatgcccacaaggccagcagcatcgccaagagcagcagcttctgcagcatggagagagatgaagaagattccatcatcgtgtctgagggcatcatcgaggagtacctggcctttgaccacatcgacatcgaggagggcttccacggcaagaagtctgaggccgccacagagaagcagaagctgggctacccacccatcgcccccttctactgcatgaaggaggatgtgctggcctacgtgtttgacagcgtgtggtgcaaggtggtgtcctgcatggagcagctgaccaggagccactgggagggctttgccagtgatgatgagagcaatgtggccgtgaccaggccagattctgagagcagctgtgtgctgtctgagctgcaccccctggtgctgccccgggtgccccagagcaagatgagcctgtgccaggccagccgccaccagcccaacgtgaatgacctgctggtgcacggcatgcccctgcagcccaggaacctgagcctgatggacaagctgctggacctggatgacaagctgctgatgaggcctggcagcagcaccatcctgagcaccaggaactggcccaacagagctgtggagttcagcaccagcagcctgagctacacagtgcagagcaccaggagaagaaaccccccacccaggaccctgcaccccatcagcaccagccacagctgtgccgagacccccaggtctgtggaggagatcctgcggggggcccgggtgcctgtggccccagacagcctgagcagccccagccccacccccctgagcaggaacaacctgctgccccccatcggcacagctgaggtggagcacgtgtccacagtgggcccccagaggcagatgaagccccacggggacagcagccgggcccagagcgctgtggtggatgagcccaactaccagcagccccaggagcggctgctgctgcctgacttcttcccccggcccaacaccacccagagcttcctggtggagtag

SEQ ID NO: 38472 - DNA, 993 bp, Artificial Sequence
  Description of Artificial Sequence: Synthetic coding sequence
atggagagagatgaggaggacagcatcatcgtgtctgagggcatcatcgaggagtacctggcctttgaccacattgatattgaggagggcttccacggcaagaagtctgaggccgccacagagaagcagaagctgggctacccacccatcgcccccttctactgcatgaaggaggatgtgctggcctacgtgtttgattctgtgtggtgcaaggtggtgtcctgcatggagcagctgaccaggagccactgggagggctttgccagtgatgatgagagcaatgtggccgtgaccaggccagacagcgagagcagctgtgtgctgtctgagctgcaccccctggtgctgccccgggtgccccagagcaaggtgctgtacatcaccagcaaccccatgagcctgtgccaggccagccgccaccagcccaacgtgaatgacctgctggtgcacggcatgcccctgcagcccaggaacctgagcctgatggacaagctgctggacctggatgacaagctgctgatgaggcctggcagcagcaccatcctgagcaccaggaactggcccaacagagctgtggagttcagcaccagcagcctgagctacacagtgcagagcaccaggagaagaaatcctccacccaggaccctgcaccccatcagcaccagccacagctgtgccgagacccccaggtctgtggaggagatcctgcggggggcccgggtgcctgtggccccagacagcctgagcagccccagccccacccccctgagcaggaacaacctgctgccccccatcggcacagctgaggtggagcacgtgtccacagtgggcccccagaggcagatgctggacacccagtaccgccgcagctgtgctgtggagtacccccaccaggcccggcccggccggggcagcgctggcccccagctgcacggcagcaccaagagccagagcggcggccggcctgtgtccaggacccggcagggcccctag

SEQ ID NO: 38473 - DNA, 1008 bp, Artificial Sequence
  Description of Artificial Sequence: Synthetic coding sequence
agcagcttctgcagcatggagagagatgaagaagattccatcatcgtgtctgagggcatcatcgaggagtacctggcctttgaccacatcgacatcgaggagggcttccacggcaagaagtctgaggccgccacagagaagcagaagctgggctacccacccatcgcccccttctactgcatgaaggaggatgtgctggcctacgtgtttgacagcgtgtggtgcaaggtggtgtcctgcatggagcagctgaccaggagccactgggagggctttgccagtgatgatgagagcaatgtggccgtgaccaggccagattctgagagcagctgtgtgctgtctgagctgcaccccctggtgctgccccgggtgccccagagcaaggtgctgtacatcaccagcaaccccatgagcctgtgccaggccagccgccaccagcccaacgtgaatgacctgctggtgcacggcatgcccctgcagcccaggaacctgagcctgatggacaagctgctggacctggatgacaagctgctgatgaggcctggcagcagcaccatcctgagcaccaggaactggcccaacagagctgtggagttcagcaccagcagcctgagctacacagtgcagagcaccaggagaagaaaccccccacccaggaccctgcaccccatcagcaccagccacagctgtgccgagacccccaggtctgtggaggagatcctgcggggggcccgggtgcctgtggccccagacagcctgagcagccccagccccacccccctgagcaggaacaacctgctgccccccatcggcacagctgaggtggagcacgtgtccacagtgggcccccagaggcagatgctggacacccagtacagaagaagctgtgctgtggagtacccccaccaggcccggcccggccggggcagcgctggcccccagctgcacggcagcaccaagagccagagcggcggccggcctgtgtccaggacccggcagggcccctag

SEQ ID NO: 38474 - DNA, 831 bp, Artificial Sequence
  Description of Artificial Sequence: Synthetic coding sequence
atggccgccagcgctgggggccctggctcctggagcgagaacatcctggagtacttcctgaggaacagccagatcacagcagaagatggagctgagatcacctggtaccacgccgccaaccacaaggcccagaccaatgaggccctgaagagcacagcccacatgattgaagcagatgtgctgctgcccagtgatggcagcgagcacagccagcccatcatggcccaccccccagagaccaacagcgacaacaccctgcaggagtggctgacagaggtgatgaagagcaacaagggcatcaagctggacttcaagagcctggccgtggtggagcccagcatgatgctgctggagaatgtgaagaggcacctgaagaggcctgtgtggatcaatgctgacatcctgcccggccccaatggaaacagcaaggtgattgatgccaagcccttcctggacaccgtcatctccttcttcccagatgtgaccttcagcctgggctggaccaccggctggcaccctgagaaggtgaatgaaggctacagctggaccatggtgaaggagatggagtacatctgcaatgagctgagccagcctgtgaccttccctgtgcgggccgccctggtgcggcagagctgcagccagctgctgtggctgctgaagaagagcaaccgctacagcctgaccatctggacaggcaagaatgacaactacagcgtggaggacctgctgtacatccgggaccactttgacaagaagcaggtgttctatgacatcctggagccccagaaccacgagttcaagcaggccatcggcatcaaggtgaacctgtag

SEQ ID NO: 38475 - DNA, 435 bp, Artificial Sequence
  Description of Artificial Sequence: Synthetic coding sequence
atggtggacaaggacacagagcgggacatcgagatgaagaggcagctgcggcggctgcgggagctgcacctgtacagcacctggaagaagtaccaggaggccatgaagaccagcctgggcgtgccccagagaggagacctggaggacctggaggagcacgtgcccggccagacagtgtctgaggaggccaccggggtgcacatgatgcaggtggaccctgccaccctggccaagcagctggaggacagcaccatcaccggcagccaccagcagatgtctgccagccccagcagcgccccagctgaggaggccacagagaagaccaaggtggaggaggaggtgaagaccaggaagcccaagaagaagaccaggaagcccagcaagaagagccgctggaatgtgctgaagtgctgggacatcttcaacatcttctag

SEQ ID NO: 38476 - DNA, 1164 bp, Artificial Sequence
  Description of Artificial Sequence: Synthetic coding sequence
atgggctgtgtgtacagctgctgcctggaggtgtgctgcggagaagatgagatcgtgtaccccaggatgcctggagagagcacagtgtgccaccgggagcgggagaagcccatcacctaccactggtaccactggcaccctggccacatctacccccgcatcgcctccatggaggactatgatgaggacctggtgcaggaggccagcagtgaagatgtgctgggcgtgcacatggtggacaaggacacagagcgggacatcgagatgaagaggcagctgcggcggctgcgggagctgcacctgtacagcacctggaagaagtaccaggaggccatgaagaccagcctgggcgtgccccagtgtgaaagagatgagggcagcctgggcaagcccctgtgccccccagagatcctgtctgagaccctgcccggctctgtgaagaagagggtgtgcttccccagcgaggaccacctggaggagttcatcgccgagcacctgcctgaggccagcaaccagagcctgctgactgtggcccacagcgagcggggcatctccttcagctgtgacctggaggacctggaggagcacggccctggccagacagtgtctgaggaggccacagaggtgcacaccatggagggggaccctgacaccctggccgagttcctgatcagagatgtgctgcaggagctgagcagctacaatggagaggaggaggaccctgaggaggtgaagaccagcctgggcgtgccccagagaggagacctggaggacctggaggagcacgtgcccggccagacagtgtctgaggaggccactggagtgcacatgatgcaggtggaccctgccaccctggccaagagtgacctggaggacctggaggagcacgtgcctgagcagacagtgtctgaggaggccactggagtgcacatgatgcaggtggaccctgccaccctggccaagcagctggaggacagcaccatcaccggcagccaccagcagatgtctgccagccccagcagcgccccagctgaggaggccacagagaagaccaaggtggaggaggaggtgaagaccaggaagcccaagaagaagaccaggaagcccagcaagaagagccgctggaatgtgctgaagtgctgggacatcttcaacatcttctag

SEQ ID NO: 38477 - DNA, 1164 bp, Artificial Sequence
  Description of Artificial Sequence: Synthetic coding sequence
atgggctgtgcctacagctgctgcctggaggtgtgctgcggagaagatgagatcgtgtaccccaggatgcctggagagagcacagtgtgccaccgggagcgggagaagcccatcacctaccactggtaccactggcaccctggccacatctacccccgggtggcctccatggaggactatgatgaggacctggtgcaggaggccagcagtgaagatgtgctgggcgtgcacatggtggacaaggacacagagcgggacatcgagatgaagaggcagctgcggcggctgcgggagctgcacctgtacagcacctggaagaagtaccaggaggccatgaagaccagcctgggcgtgccccagtgtgaaagagatgagggcagcctgggcaagcccctgtgccccccagagatcctgtctgagaccctgcccggctctgtgaagaagagggtgtgcttccccagcgaggaccacctggaggagttcatcgccgagcacctgcctgaggccagcaaccagagcctgctgactgtggcccacgccgacaccggcatccagaccaatggagacctggaggacctggaggagcacggccctggccagacagtgtctgaggaggccacagaggtgcacatgatggagggggaccctgacaccctggccgagctgctgatcagagatgtgctgcaggagctgagcagctacaatggagaggaggaggaccctgaggaggtgaagaccagcctgggcgtgccccagagaggagacctggaggacctggaggagcacgtgcccggccagacagtgtctgaggaggccactggagtgcacatgatgcaggtggaccctgccaccccagccaagagtgacctggaggacctggaggagcacgtgcccggccagacagtgtctgaggaggccactggagtgcacatgatgcaggtggaccctgccaccctggccaagcagctggaggacagcaccatcaccggcagccaccagcagatgtctgccagccccagcagcgccccagctgaggaggccacagagaagaccaaggtggaggaggaggtgaagaccaggaagcccaagaagaagaccaggaagcccagcaagaagagccgctggaatgtgctgaagtgctgggacatcttcaacatcttctag

SEQ ID NO: 38478 - DNA, 933 bp, Artificial Sequence
  Description of Artificial Sequence: Synthetic coding sequence
atggtggacaaggacacagagcgggacatcgagatgaagaggcagctgcggcggctgcgggagctgcacctgtacagcacctggaagaagtaccaggaggccatgaagaccagcctgggcgtgccccagtgtgaaagagatgagggcagcctgggcaagcccctgtgccccccagagatcctgtctgagaccctgcccggctctgtgaagaagagggtgtgcttccccagcgaggaccacctggaggagttcatcgccgagcacctgcctgaggccagcaaccagagcctgctgactgtggcccatgctgacaccggcatccagaccaacggggacctggaggacctggaggagcacggccctggccagacagtgtctgaggaggccacagaggtgcacatgatggagggggaccctgacaccctggccgagctgctgatcagagatgtgctgcaggagctgagcagctacaacggggaggaggaggaccctgaggaggtgaagaccagcctgggcgtgccccagagaggagacctggaggacctggaggagcacgtgcccggccagacagtgtctgaggaggccaccggggtgcacatgatgcaggtggaccctgccaccccagccaagagtgacctggaggacctggaggagcacgtgcccggccagacagtgtctgaggaggccaccggggtgcacatgatgcaggtggaccctgccaccctggccaagcagctggaggacagcaccatcaccggcagccaccagcagatgtctgccagccccagcagcgccccagctgaggaggccacagagaagaccaaggtggaggaggaggtgaagaccaggaagcccaagaagaagaccaggaagcccagcaagaagagccgctggaatgtgctgaagtgctgggacatcttcaacatcttctag

SEQ ID NO: 38479 - DNA, 933 bp, Artificial Sequence; identical to SEQ ID NO: 38478
  Description of Artificial Sequence: Synthetic coding sequence

SEQ ID NO: 38480 - DNA, 345 bp, Artificial Sequence
  Description of Artificial Sequence: Synthetic coding sequence
atggtggacaaggacacagagcgggacatcgagatgaagaggcagctgcggcggctgcgggagctgcacctgtacagcacctggaagaagtaccaggaggccatgaagaccagcctgggcgtgccccagagaggagacctggaggacctggaggagcacctgcccggccagacagtgtctgaggaggccaccggggtgcacatgatgcaggtggaccctgccaccccagccaagaagctggaggacagcaccatcaccggcagccaccagcagatgtctgccagccccagcagcgccccagctgaggaggccacagagaagaccaaggtggaggaggaggtgtag

SEQ ID NO: 38481 - DNA, 120 bp, Artificial Sequence
  Description of Artificial Sequence: Synthetic coding sequence
atggtggacaaggacacagagcgggacatcgagatgaagaggcagctgcggcggctgcgggagctgcacctgtacagcacctggaagaagtaccaggaggccatgaagaccagcctgtag

SEQ ID NO: 38482 - DNA, 435 bp, Artificial Sequence
  Description of Artificial Sequence: Synthetic coding sequence
atggtggacaaggacacagagcgggacatcgagatgaagaggcagctgcggcggctgcgggagctgcacctgtacagcacctggaagaagtaccaggaggccatgaagaccagcctgggcgtgccccagagaggagacctggaggacctggaggagcacctgcccggccagacagtgtctgaggaggccaccggggtgcacatgatgcaggtggaccctgccaccccagccaagaagctggaggacagcaccatcaccggcagccaccagcagatgtctgccagccccagcagcgccccagctgaggaggccacagagaagaccaaggtggaggaggaggtgaagaccaggaagcccaagaagaagaccaggaagcccagcaagaagagccgctggaatgtgctgaagtgctgggacatcttcaacatcttctag

SEQ ID NO: 38483 - DNA, 1425 bp, Artificial Sequence
  Description of Artificial Sequence: Synthetic coding sequence
atgaagaccaagtgcatctgtgagctgtgcagctgtggccgccaccactgcccccacctgcccaccaagatctatgacaagacagagaagccctgcctgctgtctgagtacacagagaactaccccttctaccacagctacctgccccgggagagcttcaagccccggcgggagtaccagaagggccccatccccatggagggcctgaccaccagcagaagagactttggcccccacaaggtggcccctgtgaaggtgcaccagtatgaccagtttgtgcccagcgaggagaacatggacctgctgaccacctacaagaaggactacaacccctaccctgtgtgccgggtggaccccatcaagccccgggacagcaagtacccctgcagcgacaagatggagtgcctgcccacctacaaggctgactacctgccctggaaccagccccggcgggagcccctgcggctggagcacaagtaccagcctgcctctgtgcgctttgacaacagaaccacccaccaggatgactaccccatcaagggcctggtgaagaccatcagctgcaagcccctggccatgcccaagctgtgcaacatccccctggaggatgtgaccaactacaagatgtcctatgtggcccaccctgtggagaagagatttgtgcatgaggccgagaagttccggccctgtgagatcccctttgagagcctgaccacccagaagcagagctaccggggcctgatgggagagcccgccaagagcctgaagcccctggcccggcccccaggcctggacatgcccttctgcaacaccacagagttccgggacaagtaccaggcctggcccatgcccaggatgttcagcaaggcccccatcacctacgtgcccccagaggacaggatggacctgctgaccaccgtgcaggcccactacacctgccccaagggggccccagcccagagctgcaggcctgccctgcagatcaagaagtgtggccgctttgagggcagcagcaccaccaaggatgactacaagcagtggagctccatgaggacagagcctgtgaagcctgtgccccagctggacctgcccacagagcccctggactgcctgaccaccacccgggcccactacgtgccccacctgcccatcaacaccaagagctgcaagccccactggagcggccccagaggaaatgtgcctgtggagagccagaccacctacaccatctccttcacccccaaggagatgggccgctgcctggccagctacccagagcccccaggctacacctttgaggaggtggatgccctgggccaccgcatctacaagcctgtgtcccaggccggcagccagcagagcagccacctgtctgtggatgacagcgagaaccccaaccagcgggagctggaggtgctggcctag

SEQ ID NO: 38484 - DNA, 849 bp, Artificial Sequence
  Description of Artificial Sequence: Synthetic coding sequence
atgcccaagctgtgcaacatccccctggaggatgtgaccaactacaagatgtcctatgtggcccaccctgtggagaagagatttgtgcatgaggccgagaagttccggccctgtgagatcccctttgagagcctgaccacccagaagcagagctaccggggcctgatgggagagcccgccaagagcctgaagcccctggcccggcccccaggcctggacatgcccttctgcaacaccacagagttccgggacaagtaccaggcctggcccatgcccaggatgttcagcaaggcccccatcacctacgtgcccccagaggacaggatggacctgctgaccaccgtgcaggcccactacacctgccccaagggggccccagcccagagctgcaggcctgccctgcagatcaagaagtgtggccgctttgagggcagcagcaccaccaaggatgactacaagcagtggagctccatgaggacagagcctgtgaagcctgtgccccagctggacctgcccacagagcccctggactgcctgaccaccacccgggcccactacgtgccccacctgcccatcaacaccaagagctgcaagccccactggagcggccccagaggaaatgtgcctgtggagagccagaccacctacaccatctccttcacccccaaggagatgggccgctgcctggccagctacccagagcccccaggctacacctttgaggaggtggatgccctgggccaccgcatctacaagcctgtgtcccaggccggcagccagcagagcagccacctgtctgtggatgacagcgagaaccccaaccagcgggagctggaggtgctggcctag

SEQ ID NO: 38485 - DNA, 1197 bp, Artificial Sequence
  Description of Artificial Sequence: Synthetic coding sequence
atgggcgccaagtccatgaggtcctggtgcctgtgccagatctgcagctgtggcagtgactactgcccctatgagatcgtgaagcagcccaggcatgtgcctgaggagtacaagcccaagcagggcaagattgacctgggcaccacctacaagagggacctgaacagctacaaggtgcagcctgtggccatcgtgcggcccctggagcggcaggtgaagaagggcaagctggacacagtgcccacctacaaggatgactaccgggcctgggacctgcacaagtctgagctgtacaagccagagcagacctaccacccccccaccgtgaagtttggaaacagcaccaccttccaggatgactttgtgccccaggagatcaagccccggcagagcttcaagcccagctctgtggtgaagaggagcacagcccccttcaacggcatcaccagccaccggctggactacatcccccaccagctggagctgaagtttgagcggcccaaggaggtgtacaagcccacagaccagagatttgaggacctgaccacccaccgctgtgacttccagggcctcatcggggagacagccaagctgtgcaggcctgtgcacaccagggtgacccagaatgccctgtttgagggcagcacagagttccgggagagcttccagccctgggagatccccccacctgaggtgaagaaggtgcctgaatatgtgccccccaccggctccatgctgctgaacagcaccagccacctggactatgtgccctaccaggccaaccacgtggtgcccatccggcctgtgtcccagaagaggagcaacaacttccccttccagggcaagagcatcatgaaggaggacttccctgcctgggagagctgccggcagggcctcatcaagaagcagcagcagatccccaaccccagcggcaagtttgatggcctgagcaccttccgcagccactacgtgccccatgagctgatccccacagagagctgcaagcccctgaacatcgccttcaagagctctgtgccctttgatgatgtgaccatgtacagcgtggagtacacccccaagaggcaggagatctgcccagccagctaccccagccccccaggctacatctttgacaacaccaacagccagggccacaagttcttcaggaagatcatcccagctgtgaaggccttctag

SEQ ID NO: 38486 - DNA, 1152 bp, Artificial Sequence
  Description of Artificial Sequence: Synthetic coding sequence
atgccctggagcgactactgcccctatgaaattgtgaagcagcccaggcatgtgcctgaggagtacaagcccaagcagggcaagattgacctgggcaccacctacaagagggacctgaacagctacaaggtgcagcctgtggccatcgtgcggcccctggagcggcaggtgaagaagggcaagctggacacagtgcccacctacaaggatgactaccgggcctgggacctgcacaagtctgagctgtacaagccagagcagacctaccaccccccaacagtgaagtttggaaacagcaccaccttccaggatgactttgtgccccaggagatcaagccccggcagagcttcaagcccagctctgtggtgaagaggagcacagcccccttcaacggcatcaccagccaccggctggactacatcccccaccagctggagctgaagtttgagcggcccaaggaggtgtacaagcccacagaccagagatttgaggacctgaccacccaccgctgtgacttccagggcctgattggagaaacagccaagctgtgcaggcctgtgcacaccagggtgacccagaatgccctgtttgagggcagcacagagttccgggagagcttccagccctgggagatccccccacctgaggtgaagaaggtgcctgaatatgtgcccccaacaggctccatgctgctgaacagcaccagccacctggactatgtgccctaccaggccaaccacgtggtgcccatccggcctgtgtcccagaagaggagcaacaacttccccttccagggcaagagcatcatgaaggaggacttccctgcctgggagagctgccggcagggcctcatcaagaagcagcagcagatccccaaccccagcggcaagtttgatggcctgagcaccttccgcagccactacgtgccccatgagctgatccccacagagagctgcaagcccctgaacatcgccttcaagagctctgtgccctttgatgatgtgaccatgtacagcgtggagtacacccccaagaggcaggagatctgcccagccagctaccccagccccccaggctacatctttgacaacaccaacagccagggccacaagttcttcaggaagatcatcccagctgtgaaggccttctag

SEQ ID NO: 38487 - DNA, 1152 bp, Artificial Sequence
  Description of Artificial Sequence: Synthetic coding sequence
atgggccccctcttcaccaccatccctggggcccacagcggccccatgaggcccctgcccaagaagcacgtggagcccatggctgtgcggcagctgctgctgggcaacagcaccatgatccgccacacctgccccatgtctgtgcccctgagccggcaggtgaaggaggtggccgcccagaagcccagcgaggacatctacaagaactggcagcagcagcagcagcagcagcagcagcagcagcagcagcagctggacctgctcttccaccagaggatccagatcagcctgtggcccaggaagcagaagaggaggaagacagagcagcacagccacccctttgtgaagaaggccttccgcttctctgctggcagcggctgcggccggcccagcagcaacaagatgctgcgctccatgggcggcggccagaggcccaccggcctgggcagcgagttcttccggctgctgcatgacctgcacctgctggcctttgccatgaagaggatctggatccacagaagaggagaggccacagcccggccccgggcccctgagcacccagcccccccagccacagctgtgcggggcagagatgctgccagccagaacctgaagaggcggcccggcagcggcacagatggcctgcggctgcagggcgctgagcccagccggctgctgcggacctacgccggcggcgctgtgatccccaccggcaccccagagcgggcccagcccccaccaccccaggaccccctgggcagaagacgctggctgagcaggaacacctggggcccctggccaggcaccacccagccccccagcccccagctgctgagaaatgactggggcagctgtggcttcatggtgcctgaggccgcccggggcaaggtgttccaggacagccaggagggcgcccacatccggcgggagaccgtgtccaagtctgtgtgtgccgagccctggaggcaccagagggcccgggaccctgcccccaccaacttccccctgcgctgccagaagcagagaggagccagcgccagcagcggccagcacgagggccgggtgaacctggtgttcttcatcggcagccccaccgtgattgctgtgcctgacctgcagtgccccaccaagtacagcggcatgctgtactag

SEQ ID NO: 38488 - DNA, 954 bp, Artificial Sequence
  Description of Artificial Sequence: Synthetic coding sequence
atgttccaggccgctgagcggccccaggagtgggccatggagggccccagagatggcctgaagaaggagcggctgctggatgacagacatgacagcggcctggacagcatgaaggatgaggagtatgagcagatggtgaaggagctgcaggagatccggctggagccccaggaggtgccccggggcagcgagccctggaagcagcagctgacagaagatggagacagcttcctgcacctggccatcatccacgaggagaaggccctgaccatggaggtgatccggcaggtgaagggggacctggccttcctgaacttccagaacaacctgcagcagacccccctgcacctggccgtcatcaccaaccagcctgagattgctgaggccctgctgggcgccggctgtgaccctgagctgcgggacttccggggcaacacccccctgcacctggcctgtgagcagggctgcctggcctctgtgggcgtgctgacccagagctgcaccaccccccacctgcacagcatcctgaaggccaccaactacaacggccacacctgcctgcacctggccagcatccacggctacctgggcatcgtggagctgctggtgtccctgggcgcagatgtgaatgcccaggagccctgcaatggccgcacagccctgcacctggccgtggacctgcagaacccagacctggtgtccctgctgctgaagtgtggggctgatgtgaacagagtgacctaccagggctacagcccctaccagctgacctggggccggcccagcacccgcatccagcagcagctgggccagctgaccctggagaacctgcagatgctgcctgagagtgaagatgaggagagctatgacacagaaagtgagttcacagagttcacagaagatgagctgccctatgatgactgtgtgtttggaggccagaggctgaccctgtag

SEQ ID NO: 38489 - DNA, 627 bp, Artificial Sequence
  Description of Artificial Sequence: Synthetic coding sequence
atgggagaggtggagatcagcgccctggcctacgtgaagatgtgcctgcacgccgcccgctacccccacgccgctgtgaatggcctcttcctggccccagcccccaggtctggagaatgtctgtgcctgacagactgtgtgcccctcttccacagccacctggccctgtctgtgatgctggaggtggccctgaaccaggtggatgtgtggggcgcccaggccggcctggtggtggccggctactaccacgccaatgctgctgtgaatgaccagagccctggccccctggccctgaagattgctggaagaattgctgagttcttcccagatgctgtgctgatcatgctggacaaccagaagctggtgccccagccccgggtgccccctgtgattgtgctggagaaccagggcctgcgctgggtgcccaaggacaagaacctggtgatgtggagggactgggaggagagccggcagatggtgggcgccctgctggaggaccgggcccaccagcacctggtggactttgactgccacctggatgacatccggcaggactggaccaaccagaggctgaacacccagatcacccagtgggtgggccccaccaatggaaatggaaatgcctag

SEQ ID NO: 38490 - DNA, 483 bp, Artificial Sequence
  Description of Artificial Sequence: Synthetic coding sequence
atgtctgaggccagccggctgtgcagcggctactacagcctgaaccagagctttgtggagcccttccagtgcccccggcggggggagggcgccgccctgcagtactgctgcggctttgctgacctgaagtactgctgcagcgagcccggcagctacttcccctacaagcacagctacatgtggagcctgagcattggagccctgattggcctgggcattgctgccctggtgctgctggcctttgtgatctctgtgtgtgtgctgtgctacctgttcctgtacaccaagccccagaggctggacaccggcctgaagctgcagcacctggaggccagcagcacccaggagggcaagagcaatggcaagaccaaggccctgaacagcaatgctgccagcaatgccaccaatgagacctactatgaagcagatgacatcatccaggagaagaccatggatgccacccagatccacatcgcctactag

SEQ ID NO: 38491 - DNA, 3123 bp, Artificial Sequence
  Description of Artificial Sequence: Synthetic coding sequence
atgatgagctctgtgtccacagagagcaagctgcagcaggccgtgtccctgcagggcgtggaccctgagacctgcatgattgtgttcaagaaccactgggcccaggtggtgaagatcctggagaagcatgaccccctgaagaacacccaggccaagtatggcagcatccccccagatgaggccagcgctgtgcagaactacgtggagcacatgctgttcctgctgattgaggagcaggccaaggatgctgccatgggccccatcctggagtttgtggtgtctgagaacatcatggagaagctgttcctgtggagcctgcggcgggagttcacagatgagaccaagattgagcagctgaagatgtatgagatgctggtgacccagagccaccagcccctgctgcaccacaagcccatcctgaagcccctgatgatgctgctgagcagctgcagcggcaccaccacccccaccgtggaggagaagctggtggtgctgctgaaccagctgtgcagcatcctggccaaggaccccagcatcctggagctgttcttccacaccagcgaggaccagggcgccgccaacttcctgatcttcagcctgctgatccccttcatccaccgggagggctctgtgggccagcaggccagagatgccctgctcttcatcatgagcctgtctgctgagaacaccatggtggcccaccacatcgtggagaacacctacttctgccctgtgctggccaccggcctgagcggcctgtacagcagcctgcccaccaagctggaggagaagggggaggagtggcactgcctgctgaaggatgactggctgctgctgcccagcctggtgcagttcatgaacagcctggagttctgcaatgctgtgatccaggtggcccaccccctcatccggaaccagctggtgaactacatctacaacggcttcctggtgcctgtgctggccccagccctgcacaaggtgacagtggaggaggtgatgaccaccacagcctacctggacctcttcctgcggagcatcagcgagcccgccctgctggagatcttcctgcgcttcatcctgctgcaccagcatgaaaatgtgcacatcctggacaccctgaccagccgcatcaacacccccttccggctgtgtgtggtgtccctggccctcttccgcaccctgattggcctgcactgtgaagatgtgatgctgcagctggtgctgcgctacctgatcccctgcaaccacatgatgctgagccagcgctgggccgtgaaggagcgggactgctacagcgtgtctgctgccaagctgctggccctgacccctgtgtgctgcagcagcggcatcaccctgaccctgggcaaccaggagcgggactacatcctgtggagcaagtgcatgcatgacaccagcggccctgtggagcggcccttccctgaggccttcagcgagagcgcctgcatcgtggagtatggcaaggccctggacatctcctacctgcagtacctgtgggaggcccacaccaacatcctgcgctgcatgagggactgccgggtgtggagcgccctgtatgatggagacagcccagaccctgagatgttcctgcagagcctgacagaggagggctctgtgtcctctgcctgccctgtgtttggcctgccccagcagctgcccaggaagacaggcccccagctggcccccaggaaggacaagagccagacagagctggagtgggatgacagctatgacaccggcatcagcagtggagcagatgtgggcagccctggcccctatgatgacctggaggtgtctggccccccagcccccattgatcctcccaagcacatccaggagatgaagaagaatgccctgctgctcttcaagggcagctacatcgaggagagtgacttccaggatgatgtgatggtgtaccgcctgtgtgccgagaaggacagcgaggacatgaaggacagccaggaggaggccgcccggcccccagctgaggcccaggccgaggtgcagagcgtgcccatcaacaacggccccctgctgagcacccagcctgagacagattctgaggaggagtggaacagagacaacagcgaccccttccacagcgagcccaaggagcccaagcaggagcgggagcctgaggccgcccctgagagcaacagcgagctggccagccctgcccctgaggccgagcacagcagcaacctgacagctgcccaccctgagagcgaggagctgattgcccagtatgaccagatcatcaaggagctggacagcggggctgagggcctgatggagcagaactaccccaccccagaccccctgctgctgaccaaggaggaggagggcaaggaggagagcaaaggagagaaggagaaggagggcaagaaggagctggaggatgaggaggatgactttgacagcttcatcgccgagatgcctgctgtggagaccgtgcccagcccctttgtgggcagagatgaggccgcctttgccagccgccaccctgtgaggacccagagcacccccttcaccggccccttcatctctgtggtgctgagcaagctggagaacatgctggagaacagcctgcacgtgaacctgctgctgattggcatcatcacccagctggccagctacccccagcccctgctgcggagcttcctgctgaacaccaacatggtgttccagcccagcgtgcgcagcctgtaccaggtgctggcctctgtgaagaacaagattgagcagtttgcctctgtggagcgggacttccctggcctgctgatccaggcccagcagtacctgctcttccgggtggacatgtctgacatgaccccagctgccctgaccaaggaccccatccaggaggccagcaggactggaagtggcaagaacctgctggatggccccccccgggtgctgcagcccttcctgacccacaggaccaaggtggccgaggccccacccaacctgcccctgcctgtgaggaaccccatgctggccgccgccctcttccctgagttcctgaaggagctggccgccctggcccaggagcacagcatcctgtgctacaagatcctgggggactttgaggacagctgctgctag

SEQ ID NO: 38492 - DNA, 123 bp, Artificial Sequence
  Description of Artificial Sequence: Synthetic coding sequence
atgatgagctctgtgtccacagagagcaagctgcagcaggccgtgtccctgcagggcgtggaccctgagacctgcatgattgtgttcaagaaccactgggcccaggtggtgaagatcctgtag

SEQ ID NO: 38493 - DNA, 3123 bp, Artificial Sequence; identical to SEQ ID NO: 38491
  Description of Artificial Sequence: Synthetic coding sequence

SEQ ID NO: 38494 - DNA, 183 bp, Artificial Sequence
  Description of Artificial Sequence: Synthetic coding sequence
atgatgagctctgtgtccacagagagcaagctgcagcaggccgtgtccctgcagggcgtggaccctgagacctgcatgattgtgttcaagaaccactgggcccaggtggtgaagatcctggagaagcatgaccccctgaagaacacccaggccaagtatggcagcatccccccagatgaatag

SEQ ID NO: 38495 - DNA, 42 bp, Artificial Sequence
  Description of Artificial Sequence: Synthetic coding sequence
atgatgagctctgtgtccacagagagcaagctgcagcagtag

SEQ ID NO: 38496 - DNA, 129 bp, Artificial Sequence
  Description of Artificial Sequence: Synthetic coding sequence
atgatgagctctgtgtccacagagagcaagctgcagcaggccgtgtccctgcagggcgtggaccctgagacctgcatgattgtgttcaagaaccactgggcccaggtggtgaagatcctggagaagtag

SEQ ID NO: 38497 - DNA, 306 bp, Artificial Sequence
  Description of Artificial Sequence: Synthetic coding sequence
atgttcagcaagttcaccagcatcctgcagcacgctgtggaggccctggcccccagcctgcccctgcaggaggactttgtgtaccactggaaggccatcacccactactacatcgagaccagtgatgacaaggcccctgtgacagacaccaacatccccagccacctggagcagatgctggacatcctggtgcaggaggagaatgaaagagagagcggggagaccggcccctgcatggagtacctgctgcaccacaagatcctggagaccctgtacaccctgggcaaggcagatgtgagcagctag

SEQ ID NO: 38498 - DNA, 2298 bp, Artificial Sequence
  Description of Artificial Sequence: Synthetic coding sequence
atgttcagcaagttcaccagcatcctgcagcacgctgtggaggccctggcccccagcctgcccctgcaggaggactttgtgtaccactggaaggccatcacccactactacatcgagaccagtgatgacaaggcccctgtgacagacaccaacatccccagccacctggagcagatgctggacatcctggtgcaggaggagaatgaaagagagagcggggagaccggcccctgcatggagtacctgctgcaccacaagatcctggagaccctgtacaccctgggcaaggctgactgccccccaggcatgaagcagcaggtgctggtgttctacaccaagctgctgggccgcatccggcagcccctgctgccccacatcaacgtgcacaggcctgtgcagaagctgatccggctgtgtggggaggtgctggccacccccacagaaaatgaggagatccagttcctgtgcatcgtgtgtgccaagctgaagcaggacccctacctggtgaacttcttcctggagaacaagatgaagagcctggccagcaaaggagtgcccaacgtcatcagcgaggacaccctgaagggccaggacagcctgagcacagacaccggccagagccggcagcctgaggagctgagcggggccaccggcatggagcagacagagctggaggatgagcccccccaccagatggaccacctgagcaccagcctggacaacctgtctgtgaccagcctgcctgaggcctctgtggtgtgccccaaccaggactacaacctggtgaacagcctgctgaacctgaccaggagcccagatggaagaattgctgtgaaggcctgtgagggcctgatgctgctggtgtccctgcctgagcctgctgctgccaagtgcctgacccagagcacctgcctgtgtgagctgctgacagaccggctggccagcctgtacaaggccctgccccagagcgtggaccccctggacattgaaacagtggaggccatcaactggggcctggacagctacagccacaaggaggatgccagcgccttccctgggaagagggccctgatctccttcctgtcctggtttgactactgtgaccagctgatcaaggaggcccagaagacagctgctgtggccctggccaaggctgtgcatgagcgcttcttcatcggcgtgatggagccccagctgatgcagaccagcgagatgggcatcctgaccagcacagccctgctgcacagaattgtgcggcaggtgaccagtgatgtgctgctgcaggagatggtgttcttcatcctgggggagcagcgggagcctgagaccctggccgagatcagccgccaccccctgcggcaccggctgattgagcactgtgaccacatcagtgatgagatcagcatcatgaccctgaggatgtttgagcacctgctgcagaagcccaatgagcacatcctgtacaacctggtgctgaggaacctggaggagaggaactacacagagtacaagcccctgtgcccagaggacaaggatgtggtggagaatggcctgattgctggagctgtggacctggaggaggaccccctcttcacagacatcagccctgagaacaccctgcccaaccaggagtggctgagcagcagccccccagccaccccagaccaccccaagaatgatggcaagacagaggtgcacaagatcgtgaacagcttcctgtgcctggtgcctgatgatgccaagagcagctaccacgtggagggcaccggctatgacacctacctgagagatgcccaccggcagttccgggactactgtgccatctgcctgcgctgggagtggccaggcagccccaaggccctggagaagtgcaacctggaggccgccttctttgagggccacttcctgaaggtgctgtttgacaggatgggccgcatcctggaccagccctatgatgtgaacctgcaggtgacctctgtgctgagccggctgagcctcttcccccacccccacatccacgagtacctgctggacccctacgtgaacctggcccctggctgccgcagcctcttcagcgtcatcgtgcgggtggtgggggacctgatgctgcgcatccagaggatccaggacttcacccccaagctgctgctggtgaggaagaggctgctgggcctggagcctgagggccccatcatcgaccacatcaccctgctggagggcgtcatcgtgctggaggagttctgcaaggagctggccgccatcgcctttgtgaagtaccacgccagcagcaccccctag

SEQ ID NO: 38499 - DNA, 2217 bp, Artificial Sequence
  Description of Artificial Sequence: Synthetic coding sequence
atgttcagcaagttcaccagcatcctgcagcacgctgtggaggccctggcccccagcctgcccctgcaggaggactttgtgtaccactggaaggccatcacccactactacatcgagaccagtgatgacaaggcccctgtgacagacaccaacatccccagccacctggagcagatgctggacatcctggtgcaggaggagaatgaaagagagagcggggagaccggcccctgcatggagtacctgctgcaccacaagatcctggagaccctgtacaccctgggcaaggctgactgccccccaggcatgaagcagcaggtgctggtgttctacaccaagctgctgggccgcatccggcagcccctgctgccccacatcaacgtgcacaggcctgtgcagaagctgatccggctgtgtggggaggtgctggccacccccacagaaaatgaggagatccagttcctgtgcatcgtgtgtgccaagctgaagcaggacccctacctggtgaacttcttcctggagaacaagatgaagagcctggccagcaaaggagtgcccaacgtcatcagcgaggacaccctgaagggccaggacagcctgagcacagacaccggccagagccggcagcctgaggagctgagcggggccaccggcatggagcagacagagctggaggatgagcccccccaccagatggaccacctgagcaccagcctggacaacctgtctgtgaccagcctgcctgaggcctctgtggtgtgccccaaccaggactacaacctggtgaacagcctgctgaacctgaccaggagcccagatggaagaattgctgtgaaggcctgtgagggcctgatgctgctggtgtccctgcctgagcctgctgctgccaagtgcctgacccagagcacctgcctgtgtgagctgctgacagaccggctggccagcctgtacaaggccctgccccagagcgtggaccccctggacattgaaacagtggaggccatcaactggggcctggacagctacagccacaaggaggatgccagcgccttccctgggaagagggccctgatctccttcctgtcctggtttgactactgtgaccagctgatcaaggaggcccagaagacagctgctgtggccctggccaaggctgtgcatgagcgcttcttcatcggcgtgatggagccccagctgatgcagaccagcgagatgggcatcctgaccagcacagccctgctgcacagaattgtgcggcaggtgaccagtgatgtgctgctgcaggagatggtgttcttcatcctgggggagcagcgggagcctgagaccctggccgagatcagccgccaccccctgcggcaccggctgattgagcactgtgaccacatcagtgatgagatcagcatcatgaccctgaggatgtttgagcacctgctgcagaagcccaatgagcacatcctgtacaacctggtgctgaggaacctggaggagaggaactacacagagtacaagcccctgtgcccagaggacaaggatgtggtggagaatggcctgattgctggagctgtggacctggaggaggaccccctcttcacagacatcagccctgagaacaccctgcccaaccaggagtggctgagcagcagccccccagccaccccagaccaccccaagaatgatggcaagacagaggtgcacaagatcgtgaacagcttcctgtgcctggtgcctgatgatgccaagagcagctaccacgtggagggcaccggctatgacacctacctgagagatgcccaccggcagttccgggactactgtgccatctgcctgcgctgggagtggccaggcagccccaaggccctggagaagtgcaacctggaggccgccttctttgagggccacttcctgaaggtgctgtttgacaggatgggccgcatcctggaccagccctatgatgtgaacctgcaggtgacctctgtgctgagccggctgagcctcttcccccacccccacatccacgagtacctgctggacccctacgtgaacctggcccctggctgccgcagcctcttcagcgtcatcgtgcgggtggtgggggacctgatgctgcgcatccagaggatccaggacttcacccccaagctgctgctggtgaggaagaggctgctgggcctggagcctgagggccccatgcagaccctgcccagctggtggtag

SEQ ID NO: 38500 - DNA, 252 bp, Artificial Sequence
  Description of Artificial Sequence: Synthetic coding sequence
ctgagcctcttcccccacccccacatccacgagtacctgctggacccctacgtgaacctggcccctggctgccgcagcctcttctctgtgattgtgcgggtggtgggggacctgatgctgcgcatccagaggatccaggacttcacccccaagctgctgctggtgaggaagaggctgctgggcctggagcctgagggccccatcagtgacctggagcctgtggaggccctgactgtgagcagcatctgctag

SEQ ID NO: 38501 - DNA, 2232 bp, Artificial Sequence
  Description of Artificial Sequence: Synthetic coding sequence
atgctgagccggctgggcgccctgctgcaggaggccgtgggcgcccgggagcccagcattgacctgctgcaggcctttgtggagcactggaagggcatcacccactactacatcgagagcacagatgagagcaccccagccaagaagacagacatcccctggaggctgaagcagatgctggacatcctggtgtatgaggagcagcagcaggccgctgctggggaggccggcccctgcctggagtacctgctgcagcacaagatcctggagaccctgtgcaccctgggcaaggccgagtacccacctggcatgaggcagcaggtgttccagttcttcagcaaggtgctggcccaggtgcagcaccccctgctgcactacctgtctgtgcacaggcctgtgcagaagctgctgcggctgggcggcacagccagcggctctgtgacagagaaggaggaggtgcagttcaccaccgtgctgtgcagcaagatccagcaggaccctgagctgctggcctacatcctggagggcaagaagatcgtgggcaggaagaaggcctgtggggagcccacagccctgcccaaggacaccaccagccatggagacaaggactgcagccatgatggagccccagcccggccccagctggatggagagagctgtggggcccaggccctgaacagccacatgcctgctgagacagaggagctggatggcggcaccacagagagcaacctgatcaccagcctgctgggcctgtgccagagcaagaagagccgggtggccctgaaggcccaggagaacctgctgctgctggtgtccatggccagccctgctgctgccacctacctggtgcagagcagcgcctgctgcccagccatcgtgcgccacctgtgccagctgtaccgctccatgcctgtgttcctggaccctgctgacatcgccaccctggagggcatctcctggaggctgcccagcgcccccagtgatgaggccagcttccctgggaaggaggccctggccgccttcctgggctggtttgactactgtgaccacctgatcacagaggcccacacagtggtggctgatgccctggccaaggctgtggccgagaacttctttgtggagaccctgcagccccagctgctgcacgtgtctgagcagagcatcctgaccagcacagccctgctgacagccatgctgcggcagctgcggagccctgccctgctgcgggaggccgtggccttcctgctgggcacagaccggcagcctgaggcccctggggacaacccccacaccctgtatgcccacctgattggccactgtgaccacctgagtgatgagatcagcatcaccaccctgcggctgtttgaggagctgctgcagaagccccatgagggcatcatccacagcctggtgctgaggaacctggagggccggccctacgtggcctggggcagccctgagcctgagagctatgaggacaccctggacctggaggaggacccctacttcacagacagcttcctggacagcggcttccagaccccagccaagccccggctggccccagccaccagctatgatggcaagacagctgtgacagagatcgtgaacagcttcctgtgcctggtgcctgaggaggccaagaccagcgccttcctggaggagaccggctatgacacctacgtgcatgatgcctacggcctcttccaggagtgcagcagccgggtggcctcctggggctggcccctgacccccacccccctggacccccatgagcctgagcggcccttctttgagggccacttcctgcgggtgctgtttgacaggatgagccgcatcctggaccagccctacagcctgaacctgcaggtgacctctgtgctgagccggctggccctcttcccccacccccacatccacgagtacctgctggacccctacatcagcctggcccctggctgccgcagcctcttctctgtgctggtgcgggtcatcggggacctgatgcagaggatccagagggtgccccagtttcctgggaagctgctgctggtgaggaagcagctgaccggccaggcccctggagagcagctggaccaccagaccctgctgcagggcgtggtggtgctggaggagttctgcaaggagctggccgccatcgcctttgtgaagtttcctcctcatgacccccggcagaatgtgtccccagcccctgagggccaggtgtag

SEQ ID NO: 38502 - DNA, 486 bp, Artificial Sequence
  Description of Artificial Sequence: Synthetic coding sequence
atgctgagccggctgggcgccctgctgcacgagcctgagcggcccttctttgagggccacttcctgcgggtgctgtttgacaggatgagccgcatcctggaccagccctacagcctgaacctgcaggtgacctctgtgctgagccggctggccctcttcccccacccccacatccacgagtacctgctggacccctacatcagcctggcccctggctgccgcagcctcttctctgtgctggtgcgggtcatcggggacctgatgcagaggatccagagggtgccccagtttcctgggaagctgctgctggtgaggaagcagctgaccggccaggcccctggagagcagctggaccaccagaccctgctgcagggcgtggtggtgctggaggagttctgcaaggagctggccgccatcgcctttgtgaagtttcctcctcatgacccccggcagaatgtgtccccagcccctgagggccaggtgtag

SEQ ID NO: 38503 - DNA, 2133 bp, Artificial Sequence
  Description of Artificial Sequence: Synthetic coding sequence
atgagaggagagaaccggcccatcggcaagaggaccctgccccccagggctggctggattggaggctgccccggcagccagccagatgccaaggccaggaagggctggaccctggccccccacagcagccgctgccaccgctgctgccactaccgctgccactgccgctgctgcctgtgcccagctgagatgacagtgggccggcctgagggcgcccctggaggagctgagggcagccggcagatcttccccccagagagctttgctgacacagaagctggggaggagctgtctggagatggcctggtgctgccccgggccagcaagctggatgagttcctgagccctgaggaggagattgacagcaccagtgacagcacaggcagcatctaccagaacctgcaggagctgaagcagaagggccgctggtgcctgctggagagcctcttccagagcgaccctgagagtgatgagaacctgtctgaagatgaggaggacctggagagcttcttccaggacaaggaccggggcatggtgcaggtgcagtgcccccaggccctgcgctgtggcagcacccggcgctgcagcagcctgaacaacctgcccagcaacatcccccggccccagacccagccccccagcggcagccggccccccagccagcacaggtctgtgtcctcctgggccagcagcatcaccgtgccccggcccttcaggatgaccctgcgggaggccaggaagaaggccgagtggctgggcagccctgccagctttgagcaggagcggcagagggcccagaggcagggcgaggaggaggccgagtgccaccggcagttccgggcccagcctgtgcctgcccacgtgtacctgcccctgtaccaggagatcatggagaggtctgaggcccggcggcaggccggcatccagaagaggaaggagctgctgctgagcagcctgaagcccttctccttcctggagaaggaggagcagctgaaggaggccgcccggcagagggacctggccgccacagctgaggccaagatcagcaagcagaaggccacccggcgcatccccaagagcatcctggagcccgccctgggggacaagctgcaggaggccgagctgttcaggaagatccgcatccagatgagggccctggacatgctgcagatggccagcagccccatcgccagcagcagcaacagagccaacccccagcccaggacagccaccaggacccagcaggagaagctgggcttcctgcacaccaacttccgcttccagccccgggtgaaccctgtggtgcctgactatgagggcctgtacaaggccttccagaggagagctgccaagaggcgggagacccaggaggccaccaggaacaagcccttcctgctgaggacagccaacctgcggcacccccagaggccctgtgatgctgccaccactggaagacggcaggacagcccccagcccccagccacccccctgcccaggagccgcagcctgagcggcctggccagcctgagcgccaacaccctgcctgtgcacatcacagatgccaccaggaagcgggagagcgctgtgcgcagcgccctggagaagaagaacaaggcagatgagagcatccagtggctggagatccacaagaagaagagccaggccatgagcaagtctgtgaccctgcgggccaaggccatggacccccacaagagcctggaggaggtgttcaaggccaagctgaaggaaaatagaaataatgacaggaagagggccaaggagtacaagaaggagctggaggagatgaagcagaggatccagacccggccctacctgtttgagcaggtggccaaggacctggccaagaaggaggccgagcagtggtacctggacaccctgaagcaggccggcctggaggaggactttgtgaggaacaagggccagggcaccagggctgtgcaggagaaggagaccaagatcaaggacttcccccgcttccaggagaccaccaagctgagcatccgggaccctgagcagggcctggagggcagcctggagcagcctgccagccccaggaaggtgctggaggagctgagccaccagagccctgagaacctggtgtccctggcctag

SEQ ID NO: 38504 - DNA, 1944 bp, Artificial Sequence
  Description of Artificial Sequence: Synthetic coding sequence
atgacagtgggccggcctgagggcgcccctgggggcgctgagggcagccggcagatcttccccccagagagctttgctgacacagaggccggggaggagctgtctggagatggcctggtgctgccccgggccagcaagctggatgagttcctgagccctgaggaggagattgacagcaccagtgacagcacaggcagcatctaccagaacctgcaggagctgaagcagaagggccgctggtgcctgctggagagcctcttccagagcgaccctgagagtgatgagaacctgtctgaagatgaggaggacctggagagcttcttccaggacaaggaccggggcatggtgcaggtgcagtgcccccaggccctgcgctgtggcagcacccggcgctgcagcagcctgaacaacctgcccagcaacatcccccggccccagacccagcccccatctggcagcaggcctcccagccagcacaggtctgtgtcctcctgggccagcagcatcaccgtgccccggcccttcaggatgaccctgcgggaggccaggaagaaggccgagtggctgggcagccctgccagctttgagcaggagcggcagagggcccagaggcagggcgaggaggaggccgagtgccaccggcagttccgggcccagcctgtgcctgcccacgtgtacctgcccctgtaccaggagatcatggagaggtctgaggcccggcggcaggccggcatccagaagaggaaggagctgctgctgagcagcctgaagcccttctccttcctggagaaggaggagcagctgaaggaggccgcccggcagagggacctggccgccacagctgaggccaagatcagcaagcagaaggccacccggcgcatccccaagagcatcctggagcccgccctgggggacaagctgcaggaggccgagctgttcaggaagatccgcatccagatgagggccctggacatgctgcagatggccagcagccccatcgccagcagcagcaacagagccaacccccagcccaggacagccaccaggacccagcaggagaagctgggcttcctgcacaccaacttccgcttccagccccgggtgaaccctgtggtgcctgactatgagggcctgtacaaggccttccagaggcgggccgccaagagaagagagacccaggaggccaccaggaacaagcccttcctgctgaggacagccaacctgcggcacccccagaggccctgtgatgctgccaccaccggccggcggcaggacagcccccagcccccagccacccccctgcccaggagccgcagcctgagcggcctggccagcctgagcgccaacaccctgcctgtgcacatcacagatgccaccaggaagcgggagagcgctgtgcgcagcgccctggagaagaagaacaaggcagatgagagcatccagtggctggagatccacaagaagaagagccaggccatgagcaagtctgtgaccctgcgggccaaggccatggacccccacaagagcctggaggaggtgttcaaggccaagctgaaggagaacagaaataatgacaggaagagggccaaggagtacaagaaggagctggaggagatgaagcagaggatccagacccggccctacctgtttgagcaggtggccaaggacctggccaagaaggaggccgagcagtggtacctggacaccctgaagcaggccggcctggaggaggactttgtgagaaataaaggccagggcaccagggctgtgcaggagaaggagaccaagatcaaggacttcccccgcttccaggagaccaccaagctgagcatccgggaccctgagcagggcctggagggcagcctggagcagcctgccagccccaggaaggtgctggaggagctgagccaccagagccctgagaacctggtgtccctggcctag

SEQ ID NO: 38505 - DNA, 978 bp, Artificial Sequence
  Description of Artificial Sequence: Synthetic coding sequence
atggagggcctggaggagaatggaggagtggtgcaggtgggggagctgctgccctgcaagatctgtggccgcaccttcttccctgtggccctgaagaagcacggccccatctgccagaagacagccaccaagaagaggaagacctttgacagcagccggcagagagctgagggcacagacatccccaccgtgaagcccctgaagcccaggcctgagccccccaagaagcccagcaactggaggaggaagcatgaggagttcatcgccaccatccgggccgccaagggcctggaccaggccctgaaggagggcggcaagctgcccccacctcctccacccagctatgaccctgactacatccagtgcccctactgccagaggcgcttcaatgaaaatgctgctgacagacacatcaacttctgcaaggagcaggccgcccgcatcagcaacaagggcaagttcagcacagacaccaagggcaagcccaccagcaggacccaggtgtacaagcccccagccctgaagaagagcaacagccctggaacagccagcagcggcagcagccggctgccccagcccagcggggccggcaagacagtggtgggcgtgcccagcggcaaggtgagcagcagcagcagcagcctgggcaacaagctgcagaccctgagccccagccacaagggcattgctgcccctcatgctggggccaacgtgaagcccaggaacagcaccccacccagcctggccaggaacccagcccctggggtgctgaccaacaagaggaagacctacacagagagctacatcgcccggccagatggagactgtgccagcagcctgaatggaggcaacatcaagggcatcgagggccacagccctggcaacctgcccaagttctgccatgaatgtggcaccaagtaccctgtggagtgggccaagttctgctgtgaatgtggcatccggaggatgatcctgtag

SEQ ID NO: 38506 - DNA, 828 bp, Artificial Sequence
  Description of Artificial Sequence: Synthetic coding sequence
atggccggcctgcagaggctggccagccacctgcctgtgggcgtgatgctgccccacaacaccacagaggcccctggcccccacagcgccaagcaggacagctatgagcagggcgacagcagccagcagagcctgaagggccacctgaggaacaacttccagaagcagctgctgagcaacaaggagctgatcctggacaaggtgtacacccaccccaagtggaacacccagaccaaggcccggagctacagctacccccactgcaccggcatcagccagcaggaccctgagagtgacagccagggccagggcaatggcctcttctacagcagcggcccccagagctggtaccccaaggccaacaaccaggacttcatccccttcaccaagaagagggtgggcgtggaccgggccttccccctgaagcccatggtgcacaggaagagctgcagcactggagaggccggcacagatggagaccacaacgtgtaccccaggcctcctgagccccgggagttcagcagcaggaactttggagtgaggaaccagggcaacttctctgtggtgggcaccgtgctggccgccacccaggccgagaaggctgtggccaactttgacagaacagagtgggtgcagatccggcggctggaggccgccggggagagcctggaggaggagatccggaggaagcagatcctgctgcggggcaagctgaagaagacagaggaggagctgcggcgcatccagacccagaaggagcaggccaaggaaaatgaaaatggagagctgcagaagatcatcctgcccaggagccgggtgaagggctag

SEQ ID NO: 38507 - DNA, 1371 bp, Artificial Sequence
  Description of Artificial Sequence: Synthetic coding sequence
atggccggcctgcagaggctggccagccacctgcctgtgggcgtgatgctgccccacaacaccacagaggcccctggcccccacagcgccaagcaggacagctatgagcagggcgacagcagccagcagagcctgaagggccacctgaggaacaacttccagaagcagctgctgagcaacaaggagctgatcctggacaaggtgtacacccaccccaagtggaacacccagaccaaggcccggagctacagctacccccactgcaccggcatcagccagcaggaccctgagagtgacagccagggccagggcaatggcctcttctacagcagcggcccccagagctggtaccccaaggccaacaaccaggacttcatccccttcaccaagaagagggtgggcgtggaccgggccttccccctgaagcccatggtgcacaggaagagctgcagcactggagaggccggcacagatggagaccacaacgtgtaccccaggcctcctgagccccgggagttcagcagcaggaactttggagtgaggaaccagggcaacttctctgtggtgggcaccgtgctggccgccacccaggccgagaaggctgtggccaactttgacagaacagagtgggtgcagatccggcggctggaggccgccggggagagcctggaggaggagatccggaggaagcagatcctgctgcggggcaagctgaagaagacagaggaggagctgcggcgcatccagacccagaaggagcaggccaaggaaaatgaaaatggagagctgcagaagatcatcctgcccaggagccgggtgaagggcaacaagagcaacaccatgtacaagcccatcttcagccctgagtttgaatttgaggaggagttcagccgggaccggcgggaggatgagacctggggccgcagccagcagaacagcggccccttccagttcagtgactaccgcatccagaggctgaagcgggagcggctggtggccagcaacaacaagatccgggaccctgtgtctgagcccagcgtggagaagttcagcccccccagcgagacccctgtgggcgccctgcagggcagcgccaggaacagcagcctgtccatggccccagacagcagcggcagcagcggcagcattgaggagccccagctgggggagtgcagccactgcggcaggaagttcctgtccttccggctggagcggcacagcaacatctgcagcaggatgaggggcagcaagaggaaggtgtttgacagcagccgggcccgggccaagggcacagagctggagcagtacctgaactggaagggccctgccagcgccaaggccgagcccccccagaagagcaactggaggtag

SEQ ID NO: 38508 - DNA, 279 bp, Artificial Sequence
  Description of Artificial Sequence: Synthetic coding sequence
atggccggcctgcagaggctggccagccacctgcctgtgggcgtgatgctgccccacaacaccacagaggcccctggcccccacagcgccaagcaggacagctatgagcagggcgacagcagccagcagagcctgaagggccacctgaggaacaacttccagaagcagctgctgagcaacaaggagctgatcctggacaaggtgtacacccaccccaagtggaacacccagaccaaggcccggagctacagctacccccactgcaccggcatctcctag

SEQ ID NO: 38509 - DNA, 516 bp, Artificial Sequence
  Description of Artificial Sequence: Synthetic coding sequence
atggccggcctgcagaggctggccagccacctgcctgtgggcgtgatgctgccccacaacaccacagaggcccctggcccccacagcgccaagcaggacagctatgagcagggcgacagcagccagcagagcctgaagggccacctgaggaacaacttccagaagcagctgctgagcaacaaggagctgatcctggacaaggtgtacacccaccccaagtggaacacccagaccaaggcccggagctacagctacccccactgcaccggcatcagccagcaggaccctgagagtgacagccagggccagggcaatggcctcttctacagcagcggcccccagagctggtaccccaaggccaacaaccaggacttcatccccttcaccaagaagagggtgggcgtggaccgggccttccccctgaagcccatggtgcacaggaagagctgcagcactggagaggccggcacagatggagaccacaacgtgtaccccaggcctcctgagcccaggtag

SEQ ID NO: 38510 - DNA, 282 bp, Artificial Sequence
  Description of Artificial Sequence: Synthetic coding sequence
atggccggcctgcagaggctggccagccacctgcctgtgggcgtgatgctgccccacaacaccacagaggcccctggcccccacagcgccaagcaggacagctatgagcagggcgacagcagccagcagagcctgaagggccacctgaggaacaacttccagaagcagctgctgagcaacaaggagctgatcctggacaaggtgtacacccaccccaagtggaacacccagaccaaggcccggagctacagctacccccactgcaccggcatcagccagtag

SEQ ID NO: 38511 - DNA, 486 bp, Artificial Sequence
  Description of Artificial Sequence: Synthetic coding sequence
atggccggcctgcagaggctggccagccacctgcctgtgggcgtgatgctgccccacaacaccacagaggcccctggcccccacagcgccaagcaggacagctatgagcagggcgacagcagccagcagagcctgaagggccacctgaggaacaacttccagaagcagctgctgagcaacaaggagctgatcctggacaaggtgtacacccaccccaagtggaacacccagaccaaggcccggagctacagctacccccactgcaccggcatcagccagcaggaccctgagagtgacagccagggccagggcaatggcctcttctacagcagcggcccccagagctggtaccccaaggccaacaaccaggacttcatccccttcaccaagaagagggtgggcgtggaccgggccttccccctgaagcccatggtgcacaggaagagctgcagcactggagaggccggcacagatggagaccactag

SEQ ID NO: 38512 - DNA, 828 bp, Artificial Sequence
  Description of Artificial Sequence: Synthetic coding sequence
atggctgtggccagcaccttcatccctggcctgaacccccagaacccccactacatccctggctacacaggccactgccccctgctgcgcttctctgtgggccagacctacggccaggtgacaggccagctgctgcggggccccccaggcctggcctggccccctgtgcacaggaccctgctgccccccatccggccccccaggagccctgaggtgccccgggagagcctgcctgtgcggcggggccaggagcggctgagcagctccatgatccctggctacacaggctttgtgccccgggcccagttcatctttgccaagaactgcagccaggtgtgggccgaggccctgagtgacttcacccacctgcacgagaagcagggcagcgaggagctgcccaaggaggccaagggcaggaaggacacagagaaggaccaggtgcctgagcctgagggccagctggaggagcccaccctggaggtggtggagcaggccagcccctacagcatggatgaccgggaccccaggaagttcttcatgagcggcttcaccggctacgtgccctgtgcccgcttcctgtttggcagcagcttccctgtgctgaccaaccaggccctgcaggagtttggccagaagcacagccctggcagcgcccaggaccccaagcacctgccccccctgcccaggacctacccccagaacctgggcctgctgcccaactatggaggctacgtgcccggctacaagttccagtttggccacaccttcggccacctgacccatgatgccctgggcctgagcaccttccagaagcagctgctggcctag

SEQ ID NO: 38513 - DNA, 651 bp, Artificial Sequence
  Description of Artificial Sequence: Synthetic coding sequence
atggctgtggccagcaccttcatccctggcctgaacccccagaacccccactacatccctggctacacaggccactgccccctgctgcgcttctctgtgggccagacctacggccaggtgacaggccagctgctgcggggccccccaggcctggcctggccccctgtgcacaggaccctgctgccccccatccggccccccaggagccctgaggtgccccgggagagcctgcctgtgcggcggggccaggagcggctgagcagctccatgatccctggctacacaggctttgtgccccgggcccagttcatctttgccaagaactgcagccaggtgtgggccgaggccctgagtgacttcacccacctgcacgagaagcagggcagcgaggagctgcccaaggaggccaagggcaggaaggacacagagaaggaccaggtgcctgagcctgagggccagctggaggagcccaccctggaggtggtggagcaggccagcccctacagcatggatgaccgggaccccaggaagttcttcatgtctggaacagctggcatctgggccgaggccctgacccggcagtgccccggcccccagaccagcccccccaccagccagaacatccccagcgagcccggcagcttcacctag

SEQ ID NO: 38514 - DNA, 954 bp, Artificial Sequence
  Description of Artificial Sequence: Synthetic coding sequence
atgaccaccacccagaagcatgacctcttcaccccagagccccactacgtgcccggctacgccggcttcttcccccagctgcgctaccaggtgggcaacacctacggccgcaccaccggccagctgctgacagaccccagcgtgcagaagagcccctgcagcgtgctgagccccatgagcaagcccaagttcatcgaggacttcagccagagcaagccaccccgggtgccctgccaggacctgacagagccctacatcccccactacaccagcctgaagcccagcaagaactttgagatcctgggccagctgccccccctggaggtggatgcccaggagcccccaggagtggagaacatcccccggcagatcctgctgcctgctggcttcaccccagacaccccccaccccccctgccccccaggcaggaagggggacagccgggacctgggccaccctgtgtatggagaggaggcctggaagagcgccacccctgtgtgtgaggccccccggcagcaccagctgtaccactgccagagagatgagtacccacctccagcccggcggcagcaggagaccctggatgtgggcagcttccagaggctgccccagctggaccaccccaacctgatccagaggaaggccatcagcggctacgccggcttcatcccccgcttcacctgggtgatgggcctgaactacagagatggagtgatgcaggccatggatgaatttgacaagagccagttcctgttcaggaacccccactgtgacctgggggagaagctgcccggcacccactggcccagcaaccacatctacagcagccagggcctcatccccttctacatgggcttcatcccagccatgcaggacaactatgccctgaccttcggcaacagcacccggcgggcctactggaaggagtgggccaagaggaaccacaccctgtag

SEQ ID NO: 38515 - DNA, 816 bp, Artificial Sequence
  Description of Artificial Sequence: Synthetic coding sequence
atgaccaccacccagaagcatgacctcttcaccccagagccccactacgtgcccggctacgccggcttcttcccccagctgcgctaccaggtgggcaacacctacggccgcaccaccggccagctgctgacagaccccagcgtgcagaagagcccctgcagcgtgctgagccccatgagcaagcccaagttcatcgaggacttcagccagagcaagccaccccgggtgccctgccaggacctgacagagccctacatcccccactacaccagcctgaagcccagcaagaactttgagatcctgggccagctgccccccctggaggtggatgcccaggagcccccaggagtggagaacatcccccggcagatcctgctgcctgctggcttcaccccagacaccccccaccccccctgccccccaggcaggaagggggacagccgggacctgggccaccctgtgtatggagaggaggcctggaagagcgccacccctgtgtgtgaggccccccggcagcaccagctgtaccactgccagagagatgagtacccacctccagcccggcggcagcaggagaccctggatgtgggcagcttccagaggctgccccagctggaccaccccaacctgatccagaggaaggccatcagcgagcaggccagcggcctgggcggcccccccctgccccccagctgcttccaggagcccagcttcagccaggatgaagctgtgccctgcctgcctgtgcccatctggccccaccagacagtggccaacgtgcagggcaccaagggcagcctggcctggctgccctag

SEQ ID NO: 38516 - DNA, 780 bp, Artificial Sequence
  Description of Artificial Sequence: Synthetic coding sequence
atggctgtggccagcaccttcatccctggcctgaacccccagaacccccactacatccctggctacacaggccactgccccctgctgcgcttctctgtgggccagacctacggccaggtgacaggccagctgctgcggggccccccaggcctggcctggccccctgtgcacaggaccctgctgccccccatccggccccccaggagccctgaggtgccccgggagagcctgcctgtgcggcggggccaggagcggctgagcagctccatgatccctggctacacaggctttgtgccccgggcccagttcatctttgccaagaactgcagccaggtgtgggccgaggccctgagtgacttcacccacctgcacgagaagcagggcagcgaggagctgcccaaggaggccaagggcaggaaggacacagagaaggaccaggtgcctgagcctgagggccagctggaggagcccaccctggaggtggtggagcaggccagcccctacagcatggatgaccgggaccccaggaagttcttcatgtctgccttcctgtgcagccccaccaggcactgcaggaacctgggccgcagcacccaccaggccgtgcccaggacccccaacatcagcccccacttccctgagcacaccctgcggacctgggtgttctacaactatggaggctacgtgcccggctacaagttccagtttggccacaccttcggccacctgacccatgatgccctgggcctgagcaccttccagaagcagctgctggcctag

SEQ ID NO: 38517 - DNA, 492 bp, Artificial Sequence
  Description of Artificial Sequence: Synthetic coding sequence
atgagcctgggcctgctgaagttccaggccgtgggggaggaggatgaagaagatgaggagggggagagcctggacagcgtgaaggccctgacagccaagctgcagctgcagacccggcggcccagctacctggagtggacagcccaggtgcagagccaggcctggaggcgggcccaggccaagccaggccctgggggccctggggacatctgtggctttgacagcatggacagcgccctggagtggctgcggcgggagctgcgggagatgcaggcccaggaccggcagctggccggccagctgctgcggctgcgggcccagctgcaccggctgaagatggaccaggcctgccacctgcaccaggagctgctggatgaagctgagctggagctggagctggagcctggagctggcctggccctggcccccctgctgcggcacctgggcctgaccaggatgaacatcagcgcccggcgcttcaccctgtgctag

SEQ ID NO: 38518 - DNA, 735 bp, Artificial Sequence
  Description of Artificial Sequence: Synthetic coding sequence
atgaaccctgtgtacagccctgtgcagcccggggccccctacggcaaccccaagaacatggcctacacaggctaccccacagcctacccagctgctgccccagcctacaaccccagcctgtaccccaccaacagccccagctatgcccctgagttccagttcctgcacagcgcctatgccaccctgctgatgaagcaggcctggccccagaacagcagcagctgtggcacagagggcaccttccacctgcctgtggacacaggaacagagaacagaacctaccaggccagcagcgctgccttccgctacacagctggcaccccctacaaggtgccccccacccagagcaacacagcccccccaccctacagccccagccccaacccctaccagacagccatgtaccccatccgcagcgcctacccccagcagaacctgtatgcccagggcgcctactacacccagcctgtgtatgctgcccagccccacgtgatccaccacaccaccgtggtgcagcccaacagcatccccagcgccatctacccagcccctgtggccgcccccaggaccaatggagtggccatgggcatggtggccggcaccaccatggccatgtctgctggcaccctgctgaccaccccccagcacacagccatcggggcccaccctgtgtccatgcccacctaccgggcccagggcaccccagcctacagctatgtgcccccccactggtag

SEQ ID NO: 38519 - DNA, 708 bp, Artificial Sequence
  Description of Artificial Sequence: Synthetic coding sequence
atgaaccctgtgtacagccctgtgcagcccggggccccctacggcaaccccaagaacatggcctacacaggctaccccacagcctacccagctgctgccccagcctacaaccccagcctgtaccccaccaacagccccagctatgccccagccaccctgctgatgaagcaggcctggccccagaacagcagcagctgtggcacagagggcaccttccacctgcctgtggacaccggcacagaaaatagaacctaccaggccagcagcgctgccttccgctacacagctggcaccccctacaaggtgccccccacccagagcaacacagcccccccaccctacagccccagccccaacccctaccagacagccatgtaccccatccgcagcgcctacccccagcagaacctgtatgcccagggcgcctactacacccagcctgtgtatgctgcccagccccacgtgatccaccacaccaccgtggtgcagcccaacagcatccccagcgccatctacccagcccctgtggccgcccccaggaccaacggggtggccatgggcatggtggccggcaccaccatggccatgtctgctggcaccctgctgaccaccccccagcacacagccatcggggcccaccctgtgtccatgcccacctaccgggcccagggcaccccagcctacagctatgtgcccccccactggtag

SEQ ID NO: 38520 - DNA, 390 bp, Artificial Sequence
  Description of Artificial Sequence: Synthetic coding sequence
atgaaccctgtgtacagccctgtgcagcccggggccccctacggcaaccccaagaacatggcctacacaggctaccccacagcctacccagctgctgccccagcctacaaccccagcctgtaccccaccaacagccccagctatgccccagccaccctgctgatgaagcaggcctggccccagaacagcagcagctgtggcacagagggcaccttccacctgcctgtggacaccggcacagaaaatagaacctaccaggccagcagcgctgccttcagcaccctgctgaccaccccccagcacacagccatcggggcccaccctgtgtccatgcccacctaccgggcccagggcaccccagcctacagctatgtgcccccccactggtag

SEQ ID NO: 38521 - DNA, 372 bp, Artificial Sequence
  Description of Artificial Sequence: Synthetic coding sequence
atgaaccctgtgtacagccctggcagcagcggcgtgccctatgccaatgccaagggcatcggctacccagctggcttccccatgggctatgctgctgctgccccagcctacagccccaacatgtacccaggggccaaccccaccttccagacaggctacaccccaggcaccccctacaaggtgtcctgcagccccaccagcggggctgtgcccccctacagcagcagccccaatgctgtgcccatgagcccctgtgccgaccagtgggcccggcagctgggccagatcagcggccagccctttgtgctgctggccggcctgctgtgctggccccacggggaggccctggagagcctgatggactgcaactag

SEQ ID NO: 38522 - DNA, 588 bp, Artificial Sequence
  Description of Artificial Sequence: Synthetic coding sequence
atgaaccctgtgtacagccctggcagcagcggcgtgccctatgccaatgccaagggcatcggctacccagctggcttccccatgggctatgctgctgctgccccagcctacagccccaacatgtacccaggggccaaccccaccttccagacaggctacaccccaggcaccccctacaaggtgtcctgcagccccaccagcggggctgtgcccccctacagcagcagccccaacccctaccagacagctgtgtaccctgtgcgcagcgcctacccccagcagagcccctatgcccagcagggcacctactacacccagcccctgtatgctgccccaccccacgtgatccaccacaccaccgtggtgcagcccaacggcatgcctgccaccgtgtacccagcccccatccccccaccaagaggaaatggagtgaccatgggcatggtggccggcaccaccatggccatgtctgctggcaccctgctgacagcccacagccccacccctgtggccccccaccctgtgacagtgcccacctaccgggcccctggcacccccacctacagctatgtgcccccccagtggtag

SEQ ID NO: 38523 - DNA, 588 bp, Artificial Sequence; identical to SEQ ID NO: 38522
  Description of Artificial Sequence: Synthetic coding sequence

SEQ ID NO: 38524 - DNA, 384 bp, Artificial Sequence
  Description of Artificial Sequence: Synthetic coding sequence
atggccttccctgtggacatgctggagaactgcagccatgaggagctggagaacagcgctgaggactacatgtctgacctgcgctgtggggaccctgaaaatcctgagtgcttcagcctgctgaacatcaccatccccatcagcctgagcaatgtgggctttgtgcccctgtatggaggagaccagacccagaagatcctggccctgtttgcccctgaggacagcctgacagctgtggccctgtacctggccgaccagtggtgggccattgatgacatcgtgaagacctctgtgcccagccgggagggcctgaagcaggaggcctacgtgcccctcttcctgcccaaggtgaccaactgccagttcctgatccagtgcttctag

SEQ ID NO: 38525 - DNA, 2013 bp, Artificial Sequence
  Description of Artificial Sequence: Synthetic coding sequence
atggccttccctgtggacatgctggagaactgcagccatgaggagctggagaacagcgctgaggactacatgtctgacctgcgctgtggggaccctgaaaatcctgagtgcttcagcctgctgaacatcaccatccccatcagcctgagcaatgtgggctttgtgcccctgtatggaggagaccagacccagaagatcctggccctgtttgcccctgaggacagcctgacagctgtggccctgtacctggccgaccagtggtgggccattgatgacatcgtgaagacctctgtgcccagccgggagggcctgaagcaggtgtccaccctgggggagcgggtggtgctgtatgtgctgaaccgcatcatctacaggaagcaggagatggagagaaatgagatccccttcctgtgccacagcagcacagattatgccaagatcctgtggaagaagggggaggccatcggcttctacagcgtgaagcccaccggcagcatctgtgccagcttcctgacccagagctaccagctgcctgtgctggacaccatgttcctgaggaagaagtaccggggcaaggactttggcctgcacatgctggaggactttgtggacagcttcacagaagatgccctgggcctgcgctaccccctgagcagcctgatgtacacagcctgcaagcagtactttgagaagtacccaggggaccacgagctgctgtgggaggtggagggcgtgggccactggtaccagagaattcctgtgacccgggccctgcagcgggaggccctgaagatcctggccctgagccagaatgagcccaagaggcccatgtctggagaatatggccctgcctctgtgcctgaatatgaggccaggacagaggacaaccagagcagcgagatgcagctgaccatcgacagcctgaaggatgcctttgccagcaccagcgagggccatgacaagacctctgtgtccacccacaccaggagcggcaacctgaagaggcccaagattggcaagcgcttccaggacagcgagttcagcagcagccagggagaagatgagaagaccagccagaccagcctgacagccagcatcaacaagctggagagcacagcccggcccagcgagagcagcgaggagttcctggaggaggagcctgagcagaggggcatcgagtttgaagatgagagcagtgacagagatgcccggcctgccctggagacccagccccagcaggagaagcaggatggagagaaggagagcgagctggagcccatgaatggagagatcatggatgacagcctgaagaccagcctcatcacagaggaggaggacagcaccagcgaggtgctggatgaggagctgaagctgcagcccttcaacagcagcgaggacagcaccaacctggtgcccctggtggtggagagcagcaagcccccagaggtggatgccccagacaagaccccccgcatcccagattctgagatgctgatggatgagggcaccagtgatgagaagggccacatggaggagaagctgagcctgctgcccaggaagaaggcccacctgggcagcagtgacaacgtggccaccatgagcaatgaggagaggagtgatggcggcttccccaacagcgtgattgctgagttcagcgaggagcctgtgtctgagaacctgagccccaacaccaccagcagcctggaggaccagggcgaggagggcgtgtctgagccccaggagaccagcacagccctgccccagagcagcctcatcgaggtggagctggaggatgtgcccttcagccagaatgccggccagaagaaccagagcgaggagcagagcgaggccagcagcgagcagctggaccagttcacccagagcgctgagaaggctgtggacagcagcagcgaggagattgaggtggaggtgcctgtggtggacagaagaaacctgcggaggaaggccaagggccacaagggccctgccaagaagaaggccaagctgacctag

SEQ ID NO: 38526 - DNA, 261 bp, Artificial Sequence
  Description of Artificial Sequence: Synthetic coding sequence
atggccttccctgtggacatgctggagaactgcagccatgaggagctggagaacagcgctgaggactacatgtctgacctgcgctgtggggaccctgaaaatcctgagtgcttcagcctgctgaacatcaccatccccatcagcctgagcaatgtgggctttgtgcccctgtatggaggagaccagacccagaagatcctggccctgtttgcccctgaggacagcctgacagctgtggccctgtacctggccgaccagtag

SEQ ID NO: 38527 - DNA, 672 bp, Artificial Sequence
  Description of Artificial Sequence: Synthetic coding sequence
atggccttccctgtggacatgctggagaactgcagccatgaggagctggagaacagcgctgaggactacatgtctgacctgcgctgtggggaccctgaaaatcctgagtgcttcagcctgctgaacatcaccatccccatcagcctgagcaatgtgggctttgtgcccctgtatggaggagaccagacccagaagatcctggccctgtttgcccctgaggacagcctgacagctgtggccctgtacctggccgaccagtggtgggccattgatgacatcgtgaagacctctgtgcccagccgggagggcctgaagcaggtgtccaccctgggggagcgggtggtgctgtatgtgctgaaccgcatcatctacaggaagcaggagatggagagaaatgagatccccttcctgtgccacagcagcacagattatgccaagatcctgtggaagaagggggaggccatcggcttctacagcgtgaagcccaccggcagcatctgtgccagcttcctgacccagagctaccagctgcctgtgctggacaccatgttcctgaggaagaagtaccggggcaaggactttggcctgcacatgctggaggactttgtggacagcttcacagaagatgccctgggcctgcgctaccccctgagcagcctgatgtacacctag

SEQ ID NO: 38528 - DNA, 528 bp, Artificial Sequence
  Description of Artificial Sequence: Synthetic coding sequence
atggccttccctgtggacatgctggagaactgcagccatgaggagctggagaacagcgctgaggactacatgtctgacctgcgctgtggggaccctgaaaatcctgagtgcttcagcctgctgaacatcaccatccccatcagcctgagcaatgtgggctttgtgcccctgtatggaggagaccagacccagaagatcctggccctgtttgcccctgaggacagcctgacagctgtggccctgtacctggccgaccagtggtgggccattgatgacatcgtgaagacctctgtgcccagccgggagggcctgaagcaggtgtccaccctgggggagcgggtggtgctgtatgtgctgaaccgcatcatctacaggaagcaggagatggagagaaatgagatccccttcctgtgccacagcagcacagattatgccaagatcctgtggaagaagggggaggccatcggcttctacagcgtgaagcccaccggcagcatctgtgccagcttcctgacccagagctactag

SEQ ID NO: 38529 - DNA, 579 bp, Artificial Sequence
  Description of Artificial Sequence: Synthetic coding sequence
atgaaggtgcagagctttggagagcgggtggtgctcttcatcctgaatgccatcatcttcggccgcctggagaggaacctggatgatgatgacatgttcttcctgccccacagcgtgaaggagcaggccaagatcctgtggaggagaggagctgctgtgggcttctacaccaccaagatgaagggccgcctgtgtggagatggcactggagcctgctacctgctgcctgtgtttgacaccgtcttcatccggaggaagcactggcaccggggcctgggcacagccatgctgcgggacttctgtgagaccttcccagaagatgaggccctgggcgtgtcctgcagcatgagccctgccatgtaccaggcccaccctggcaacagtgaagatgtgtccagacatgcccggaccagccagaatgaccggccccggcagcctgcccctggagatggcagcaaggagaggatgtgtggggaggagctggaggacaccaaggatgatcctgaatgtggggtggaggaggaggatgctggcctggccggccagcccccaggcaagctgaccaggagcagcccctag

SEQ ID NO: 38530 - DNA, 579 bp, Artificial Sequence; identical to SEQ ID NO: 38529
  Description of Artificial Sequence: Synthetic coding sequence

SEQ ID NO: 38531 - DNA, 990 bp, Artificial Sequence
  Description of Artificial Sequence: Synthetic coding sequence
atgaagaggcggcagaagaggaagcacctggagaatgaggagagccaggagacagctgagaagggcggcggcatgagcaagagccaggaggatgccctgcagcccggcagcaccagggtggccaagggctggagccagggcgtgggggaggtgaccagcaccagcgagtactgcagctgtgtgagcagcagcaggaagctgatccacagcggcatccagaggatccaccgggacagcccccagccccagagccccctggcccaggtgcaggagcggggggagaccccacccaggagccagcacgtgtccctgagcagctacagcagctacaagacctgtgtgagcagcctgtgtgtgaacaaggaggagcggggcatgaagatctactacatgcaggtgcagatgaacaagggcgtggccgtgtcctgggagacagaggagaccctggagagcctggagaagcagcccaggatggaggaggtgaccctgtctgaggtggtgcgggtgggcaccccacccagtgatgtgtccaccaggaacctgctgagtgacagcgagcccagcggggaggagaaggagcacgaggagaggacagaaagtgacagcctgcccggcagccccaccgtggaggacaccccccgggccaagaccccagactggctggtgaccatggagaatggcttccgctgcatggcctgctgcagggtcttcaccaccatggaggccctgcaggagcacgtgcagtttggcatccgggagggcttcagctgccacgtgttccacctgaccatggcccagctgaccggcaacatggagagcgagagcacccaggatgagcaggaggaggagaatggaaatgagaaggaggaggaggagaagccagaggccaaggaggaggagggccagcccacagaggaggacctgggcctgcggcgctcctggagccagtgccccggctgtgtgttccacagccccaaggacaggaactag

SEQ ID NO: 38532 - DNA, 849 bp, Artificial Sequence
  Description of Artificial Sequence: Synthetic coding sequence
atgaagaggcggcagaagaggaagcacctggagaatgaggagagccaggagacagctgagaagggcggcggcatccagaggatccaccgggacagcccccagccccagagccccctggcccaggtgcaggagcggggggagaccccacccaggagccagcacgtgtccctgagcagctacagcagctacaagacctgtgtgagcagcctgtgtgtgaacaaggaggagcggggcatgaagatctactacatgcaggtgcagatgaacaagggcgtggccgtgtcctgggagacagaggagaccctggagagcctggagaagcagcccaggatggaggaggtgaccctgtctgaggtggtgcgggtgggcaccccacccagtgatgtgtccaccaggaacctgctgagtgacagcgagcccagcggggaggagaaggagcacgaggagaggacagaaagtgacagcctgcccggcagccccaccgtggaggacaccccccgggccaagaccccagactggctggtgaccatggagaatggcttccgctgcatggcctgctgcagggtcttcaccaccatggaggccctgcaggagcacgtgcagtttggcatccgggagggcttcagctgccacgtgttccacctgaccatggcccagctgactggaaacatggagagcgagagcacccaggatgagcaggaggaggagaatggaaatgagaaggaggaggaggagaagccagaggccaaggaggaggagggccagcccacagaggaggacctgggcctgcggcgctcctggagccagtgccccggctgtgtgttccacagccccaaggacagaaattag

SEQ ID NO: 38533 - DNA, 735 bp, Artificial Sequence
  Description of Artificial Sequence: Synthetic coding sequence
atgaagaggcggcagaagaggaagcacctggagaatgaggagagccaggagacagctgagaagggcggcggcatccagaggatccaccgggacagcccccagccccagagccccctggcccaggtgcaggagcggggggagaccccacccaggagccagcacgtgtccctgagcagctacagcagctacaagacctgtgtgagcagcctgtgtgtgaacaaggaggagcggggcatgaagatctactacatgcaggtgcagatgaacaagggcgtggccgtgtcctgggagacagaggagaccctggagagcctggagaagcagcccaggatggaggaggtgaccctgtctgaggtggtgcgggtgggcaccccacccagtgatgtgtccaccaggaacctgctgagtgacagcgagcccagcggggaggagaaggagcacgaggagaggacagaaagtgacagcctgcccggcagccccaccgtggaggacaccccccgggccaagaccccagactggctggtgaccatggagaatggcttccgctgcatggcctgctgcagggtcttcaccaccatggaggccctgcaggagcacgtgcagtttggcatccgggagggcttcagctgccccaagatgagcagaagaaggaagatggagatgagaagaagaaggaagaggaaccagaagcagaggagaagaagaggcagcccccagaagaagaccctggcctag

SEQ ID NO: 38534 - DNA, 993 bp, Artificial Sequence
  Description of Artificial Sequence: Synthetic coding sequence
atgaagaggcggcagaagaggaagcacctggagaatgaggagagccaggagacagctgagaagggcggcggcatgagcaagagccaggaggatgccctgcagcccggcagcaccagggtggccaagggctggagccagggcgtgggggaggtgaccagcaccagcgagtactgcagctgtgtgagcagcagcaggaagctgatccacagcggcatccagaggatccaccgggacagcccccagccccagagccccctggcccaggtgcaggagcggggggagaccccacccaggagccagcacgtgtccctgagcagctacagcagctacaagacctgtgtgagcagcctgtgtgtgaacaaggaggagcggggcatgaagatctactacatgcaggtgcagatgaacaagggcgtggccgtgtcctgggagacagaggagaccctggagagcctggagaagcagcccaggatggaggaggtgaccctgtctgaggtggtgcgggtgggcaccccacccagtgatgtgtccaccaggaacctgctgagtgacagcgagcccagcggggaggagaaggagcacgaggagaggacagaaagtgacagcctgcccggcagccccaccgtggaggacaccccccgggccaagaccccagactggctggtgaccatggagaatggcttccgctgcatggcctgctgcagggtcttcaccaccatggaggccctgcaggagcacgtgcagtttggcatccgggagggcttcagctgccacgtgttccacctgaccatggcccagctgaccggcaacatggagagcgagagcacccaggatgagcaggaggaggagaatggaaatgagaaggaggaggaggagaagccagaggccaaggaggaggagggccagcccacagaggaggacctgggcctgcggcgctcctggagccagtgccccggctgtgtgttccacagccccaaggacaggaacagctag

SEQ ID NO: 38535 - DNA, 852 bp, Artificial Sequence
  Description of Artificial Sequence: Synthetic coding sequence
atgaagtgctacttcacagaccacagaggagagcagagccccacagatggcaccaccctgagcctgaccagccctgagagcacagaggagagcgtggaggtgttctggccaggcaccatccagcgggagggcagcagccccaggcctggccctgccatcccccgggaggagggcctgtactttgctgcccgggaccggggcatgagggactggagcagcagccccagcagcgagagcagcgagtaccagagctacagccagtaccagagctgctgcagctgcatgtgtgatgaggacaatgctgccccccagagcgtgtgtgccttctacacccacgtgcagacagtgcggggcgtggccgtggcctgggagacagaagctggctttgagcctgtgaccaggaagccccgcatccacgaggcccagttcatcaagaggcagcgctggaatggcagcagctttgagatggccagcaacacagacatgcgctgggacctggaggcctgcaagagcaactgcagccctgagcctgaggacatcgacctgctggagtgctgcctgcaggagctgcgggagcccccagactggctggtgaccaccaactacggcgtgcgctgtgtggcctgctgccgggtgctgcccagcctggatgccctgctggagcacgcccagcacggcatccgggagggcttcagctgccagatcttctttgaggagatgctggagcggcggcgggcccagggccaggcccatgaccagcagctggaggaggagcagagccccagcgacaacagcgagtgcagccggccccagggcgaggtgctgagcgcccagcagcaggagaagcagtag

SEQ ID NO: 38536 - DNA, 498 bp, Artificial Sequence
  Description of Artificial Sequence: Synthetic coding sequence
atggatgccccccggcgggacatggagctgctgagcaacagcctggccgcctatgcccacatccgggccaaccctgagagctttggcctgtactttgtgctgggcgtgtgcttcggcctgctgctgaccctgtgcctgctggtgatcagcatctcctgggccccccggccccggccccggggccctgcccagaggcgggaccccaggagcagcaccctggagccagaagatgatgatgaagatgaagaagatactgtgacccggctgggcccagatgacaccctgcccggccctgagctgtctgctgagccagatggccccctgaatgtgaatgtgttcaccagcgctgaggagctggagcgggcccagaggctggaggagcgggagcgcatcctgcgggagatctggaggacaggccagcctgacctgctgggcaccggcaccctgggccccagccccacagccaccggcaccctgggccgcatgcactactactag

SEQ ID NO: 38537 - DNA, 711 bp, Artificial Sequence
  Description of Artificial Sequence: Synthetic coding sequence
atggaggtgggcctgcctgccatcaccctcttcctgaccagcgccagcagccctgtggtggccaccaccatggaccaggagcctgtgggcggcgtggagcggggggaggccgtggccgccagcggggctgctgctgctgctgcctttggagagagcgctggccagatgagcaatgaaagaggatttgaaaatgtggagctgggcgtcatcggcaagaagaagaaggtgccccggcgggtcatccactttgtgtctggagagaccatggaggagtacagcacagatgaagatgaggtggatggcctggagaagaaggatgtgctgcccaccgtggaccccaccaagctgacctggggcccctacctgtggttctacatgctgcgggccgccaccagcaccctgtctgtgtgtgacttcctgggggagaagatcgcctctgtgctgggcatcagcacccccaagtaccagtatgccattgatgagtactacaggatgaagaaggaggaggaggaggaggaggaggagaacaggatgtctgaggaggccgagaagcagtaccagcagaacaagctgcagacagacagcatcgtgcagacagaccagcctgagaccgtcatcagcagcagctttgtgaatgtgaactttgagatggagggggacagcgaggtgatcatggagagcaagcagaaccctgtgtctgtgcccccatag

SEQ ID NO: 38538 - DNA, 642 bp, Artificial Sequence
  Description of Artificial Sequence: Synthetic coding sequence
atggaccaggagcctgtgggcggcgtggagcggggggaggccgtggccgccagcggggctgctgctgctgctgccttcggggagagcgctggccagatgagcaatgaaagaggatttgaaaatgtggagctgggcgtgattggcaagaagaagaaggtgcccaggagggtcatccactttgtgtctggagagaccatggaggagtacagcacagatgaagatgaggtggatggcctggagaagaaggatgtgctgcccaccgtggaccccaccaagctgacctggggcccctacctgtggttctacatgctgcgggccgccaccagcaccctgtctgtgtgtgacttcctgggggagaagatcgcctctgtgctgggcatcagcacccccaagtaccagtatgccattgatgagtactacaggatgaagaaggaggaggaggaggaggaggaggagaacaggatgtctgaggaggccgagaagcagtaccagcagaacaagctgcagacagacagcatcgtgcagacagaccagcctgagaccgtcatcagcagcagctttgtgaatgtgaactttgagatggagggggacagcgaggtgatcatggagagcaagcagaaccctgtgtctgtgcccccatag

SEQ ID NO: 38539 - DNA, 642 bp, Artificial Sequence; identical to SEQ ID NO: 38538
  Description of Artificial Sequence: Synthetic coding sequence

SEQ ID NO: 38540 - DNA, 231 bp, Artificial Sequence
  Description of Artificial Sequence: Synthetic coding sequence
atggaccaggagcctgtgggcggcgtggagcggggggaggccgtggccgccagcggggctgctgctgctgctgccttcggggagagcgctggccagatgagcaatgaaagaggatttgaaaatgtggagctgggcgtgattggcaagaagaagaaggtgcccaggagggtcatccactttgtgtctggagagaccatggaggagtacagcacagatgaagatgaggtgtag

SEQ ID NO: 38541 - DNA, 477 bp, Artificial Sequence
  Description of Artificial Sequence: Synthetic coding sequence
atggagattgatggcttccagcagctggacctggagaagtctgtgcccagcaagaagaccacccccaagaggatcatccactttgtggatggagacatcatggaggagtacagcacagaggaggaggaggaggaggagaaggaggagcagagcaccaacagcaccctggaccccagcaagctgtcctggggcccctacctgcgcttctgggccggccgcatcgccagcaccagcttcagcacctgtgagttcctgggcggccgctttgctgtgttcttcggcctgacccagcccaagtaccagtatgtgctgaatgagttctaccgcatccagaacaagaagagtgacaacaagtcagaaagaagaggcagcaaggcccaggccgctgaggtgcccaatgagaagtgccacctggaggccggcgtgcaggagtatggcaccatccagcaggatgtgacagaggccatcccccagtag

SEQ ID NO: 38542 - DNA, 303 bp, Artificial Sequence
  Description of Artificial Sequence: Synthetic coding sequence
atggagattgatggcttccagcagctggacctggagaagtctgtgcccagcaagaagaccacccccaagaggatcatccactttgtggatggagacatcatggaggagtacagcacagaggaggaggaggaggaggagaaggaggagcagagcaccaacagcaccctggaccccagcaagctgtcctggggcccctacctgcgcttctgggccggccgcatcgccagcaccagcttcagcacctgtgagttcctgggcggccgctttgctgtgttcttcggcctgacccagcccaagtactag

SEQ ID NO: 38543 - DNA, 477 bp, Artificial Sequence; identical to SEQ ID NO: 38541
  Description of Artificial Sequence: Synthetic coding sequence

SEQ ID NO: 38544 - DNA, 300 bp, Artificial Sequence
  Description of Artificial Sequence: Synthetic coding sequence
atggagattgatggcttccagcagctggacctggagaagtctgtgcccagcaagaagaccacccccaagaggatcatccactttgtggatggagacatcatggaggagtacagcacagaggaggaggaggaggaggagaaggaggagcagagcaccaacagcaccctggaccccagcaagctgtcctggggcccctacctgcgcttctgggccggccgcatcgccagcaccagcttcagcacctgtgagttcctgggcggccgctttgctgtgttcttcggcctgacccagcccaagtag

SEQ ID NO: 38545 - DNA, 1944 bp, Artificial Sequence
  Description of Artificial Sequence: Synthetic coding sequence
atggccggcccccaggagaccgtgctggccctgcccctgcgggagggcgtgcaggccgccgccaccgtgcccatcctgctgtacaacctggaggatggcctgagtgaccaccccctggaccagggcccccgctgcccagcccggcggccctgcagccctgccagcgccccagcccccaccagccccaagaagcccaagatccaggcccctggagagaccttccccacagactggagccccccacctgtggagttcctgaacccccgggtgctgcaggccagccgggaggccccagcccagcgctgggtgggcgtggtgggcccccagggcctgcggcggctggccggggagctgcctgaggagctggagcaggagcacctggacctggaccccaagaggggcctggccctgcctgagaagctgttctggaacaccagcggcctgagccagcaggccgccgcccctgagttctcctggggcggcagcggcagctacttcaacaacctggactacctgctgcaggagaagcgggagcaggccctggagcaggagcgggagcggctgctgctgcaggagtgcctgaacctgaacagcctggacctggatgaggaggaggtgcccctgaccccagagcacaggatgctggtggagaagtacagcgtgtccctgcagaccatcccccctgtgcaccctggagagaccgtcttcctgccccgctgccaccccctgccctgcatcctggacagcagcctgctgaagcccaggagccacctggagggcctcttcctgagcagccccccagcccagcagctgtccttcctgcggagcggcctgctgaacatcctgtacctgcacatgccagactgccctgtgtccctgctgcagtggctgttccagctgctgacctggcccccagagaccagcctgggcgccttcggcctgctgtgggacctgattgtggatggcatcttcctgcagccagatgaggacaagcacctgtggtgccccagcctgcaggaggtgcgggaggccttccacagcctgggcgcccacagccctgccctgtaccccctgggccccttctggcatggaggccgggtgctgcctggagaggccggcctgaatgaaaatgaggagcaggatgccccccaggagatcgccctggacatcagcctgggccacatctacaagttcctggccctgtgtgcccaggcccagcccggggcctacacagatgagaacctgatgggcctgattgagctgctgtgcaggaccagcctggatgtgggcctgcggctgctgcccaaggtggacctgcagcagctgctgctgctgctgctggagaacatccgggagtggccaggcaagctgcaggagctgtgctgcaccctgtcctgggtgtctgaccaccaccacaacctgctggccctggtgcagttcttcccagacatgaccagccgcagccggcggctgcggagccagctgagcctggtggtgattgccaggatgctgggccagcaggagatgctgcccctgtggcaggagaagacccagctgagcagcctgagccggctgctgggcctgatgaggcccagcagcctgcggcagtacctggacagcgtgcccctgcccccctgccaggagcagcagcccaaggccagcgctgagctggaccacaaggcctgctacctgtgccacagcctgctgatgctggccggcgtggtggtgtcctgccaggacatcaccccagaccagtggggcgagctgcagctgctgtgcatgcagctggacagacacatcagcacccagatccgggagagcccccaggccatgcacaggaccatgctgaaggacctggccacccagacctacatccgctggcaggagctgctgacccactgccagccccaggcccagtacttcagcccctggaaggacatctag

SEQ ID NO: 38546 - DNA, 360 bp, Artificial Sequence
  Description of Artificial Sequence: Synthetic coding sequence
atgaggcccagcagcctgcggcagtacctggacagcgtgcccctgcccccctgccaggagcagcagcccaaggccagcgctgagctggaccacaaggcctgctacctgtgccacagcctgctgatgctggccggcgtggtggtgtcctgccaggacatcaccccagaccagtggggcgagctgcagctgctgtgcatgcagctggacagacacatcagcacccagatccgggagagcccccaggccatgcacaggaccatgctgaaggacctggccacccagacctacatccgctggcaggagctgctgacccactgccagccccaggcccagtacttcagcccctggaaggacatctag

SEQ ID NO: 38547 - DNA, 2484 bp, Artificial Sequence
  Description of Artificial Sequence: Synthetic coding sequence
atggcccacgagcgggagatcctgaagggcatgtatgaggagctgaaggagaagagccacaagccagatgtggagctgatccagcaccgggcctggagaattgacatggtgtccacagagctggagagcttcaggaaggccagctacatcgagagcggccctgaggagttctaccagcgcttcaagaagtgcttcagcgccacccacatcttcatcagcatcaagggcaaggacagccagaacacagcccacggctacctgatcctgaacagaaccctgcaccagcagctgaagatcaagaaccccttcctggcccccagcagcgaggccgtgcgcatcccagccaccctgccccaccctggggccctgcccttccccccctacgtggccaaggccagcagtgatgagctgctgaacctgcagaagcccctgcagagcgccctgggcttcgtcatcctgcggagcagccagaactggaacagcaagaaccggcagcgctggagcaggaccaaggccggccagatgagccacggcctgcagatggccggcccccaggagaccgtgctggccctgcccctgcgggagggcgtgcaggccgccgccaccgtgcccatcctgctgtacaacctggaggatggcctgagtgaccaccccctggaccagggcccccgctgcccagcccggcggccctgcagccctgccagcgccccagcccccaccagccccaagaagcccaagatccaggcccctggagagaccttccccacagactggagccccccacctgtggagttcctgaacccccgggtgctgcaggccagccgggaggccccagcccagcgctgggtgggcgtggtgggcccccagggcctgcggcggctggccggggagctgcctgaggagctggagcaggagcacctggacctggaccccaagaggggcctggccctgcctgagaagctgttctggaacaccagcggcctgagccagcaggccgccgcccctgagttctcctggggcggcagcggcagctacttcaacaacctggactacctgctgcaggagaagcgggagcaggccctggagcaggagcgggagcggctgctgctgcaggagtgcctgaacctgaacagcctggacctggatgaggaggaggtgcccctgaccccagagcacaggatgctggtggagaagtacagcgtgtccctgcagaccatcccccctgtgcaccctggagagaccgtcttcctgccccgctgccaccccctgccctgcatcctggacagcagcctgctgaagcccaggagccacctggagggcctcttcctgagcagccccccagcccagcagctgtccttcctgcggagcggcctgctgaacatcctgtacctgcacatgccagactgccctgtgtccctgctgcagtggctgttccagctgctgacctggcccccagagaccagcctgggcgccttcggcctgctgtgggacctgattgtggatggcatcttcctgcagccagatgaggacaagcacctgtggtgccccagcctgcaggaggtgcgggaggccttccacagcctgggcgcccacagccctgccctgtaccccctgggccccttctggcatggaggccgggtgctgcctggagaggccggcctgaatgaaaatgaggagcaggatgccccccaggagatcgccctggacatcagcctgggccacatctacaagttcctggccctgtgtgcccaggcccagcccggggcctacacagatgagaacctgatgggcctgattgagctgctgtgcaggaccagcctggatgtgggcctgcggctgctgcccaaggtggacctgcagcagctgctgctgctgctgctggagaacatccgggagtggccaggcaagctgcaggagctgtgctgcaccctgtcctgggtgtctgaccaccaccacaacctgctggccctggtgcagttcttcccagacatgaccagccgcagccggcggctgcggagccagctgagcctggtggtgattgccaggatgctgggccagcaggagatgctgcccctgtggcaggagaagacccagctgagcagcctgagccggctgctgggcctgatgaggcccagcagcctgcggcagtacctggacagcgtgcccctgcccccctgccaggagcagcagcccaaggccagcgctgagctggaccacaaggcctgctacctgtgccacagcctgctgatgctggccggcgtggtggtgtcctgccaggacatcaccccagaccagtggggcgagctgcagctgctgtgcatgcagctggacagacacatcagcacccagatccgggagagcccccaggccatgcacaggaccatgctgaaggacctggccacccagacctacatccgctggcaggagctgctgacccactgccagccccaggcccagtacttcagcccctggaaggacatctag

SEQ ID NO: 38548 - DNA, 2040 bp, Artificial Sequence
  Description of Artificial Sequence: Synthetic coding sequence
atgtggccccggctgcccggggccggcctggccccccagctgcggcggcaggaccagaggctgcacttcaccggccagatgagccacggcctgcagatggccggcccccaggagaccgtgctggccctgcccctgcgggagggcgtgcaggccgccgccaccgtgcccatcctgctgtacaacctggaggatggcctgagtgaccaccccctggaccagggcccccgctgcccagcccggcggccctgcagccctgccagcgccccagcccccaccagccccaagaagcccaagatccaggcccctggagagaccttccccacagactggagccccccacctgtggagttcctgaacccccgggtgctgcaggccagccgggaggccccagcccagcgctgggtgggcgtggtgggcccccagggcctgcggcggctggccggggagctgcctgaggagctggagcaggagcacctggacctggaccccaagaggggcctggccctgcctgagaagctgttctggaacaccagcggcctgagccagcaggccgccgcccctgagttctcctggggcggcagcggcagctacttcaacaacctggactacctgctgcaggagaagcgggagcaggccctggagcaggagcgggagcggctgctgctgcaggagtgcctgaacctgaacagcctggacctggatgaggaggaggtgcccctgaccccagagcacaggatgctggtggagaagtacagcgtgtccctgcagaccatcccccctgtgcaccctggagagaccgtcttcctgccccgctgccaccccctgccctgcatcctggacagcagcctgctgaagcccaggagccacctggagggcctcttcctgagcagccccccagcccagcagctgtccttcctgcggagcggcctgctgaacatcctgtacctgcacatgccagactgccctgtgtccctgctgcagtggctgttccagctgctgacctggcccccagagaccagcctgggcgccttcggcctgctgtgggacctgattgtggatggcatcttcctgcagccagatgaggacaagcacctgtggtgccccagcctgcaggaggtgcgggaggccttccacagcctgggcgcccacagccctgccctgtaccccctgggccccttctggcatggaggccgggtgctgcctggagaggccggcctgaatgaaaatgaggagcaggatgccccccaggagatcgccctggacatcagcctgggccacatctacaagttcctggccctgtgtgcccaggcccagcccggggcctacacagatgagaacctgatgggcctgattgagctgctgtgcaggaccagcctggatgtgggcctgcggctgctgcccaaggtggacctgcagcagctgctgctgctgctgctggagaacatccgggagtggccaggcaagctgcaggagctgtgctgcaccctgtcctgggtgtctgaccaccaccacaacctgctggccctggtgcagttcttcccagacatgaccagccgcagccggcggctgcggagccagctgagcctggtggtgattgccaggatgctgggccagcaggagatgctgcccctgtggcaggagaagacccagctgagcagcctgagccggctgctgggcctgatgaggcccagcagcctgcggcagtacctggacagcgtgcccctgcccccctgccaggagcagcagcccaaggccagcgctgagctggaccacaaggcctgctacctgtgccacagcctgctgatgctggccggcgtggtggtgtcctgccaggacatcaccccagaccagtggggcgagctgcagctgctgtgcatgcagctggacagacacatcagcacccagatccgggagagcccccaggccatgcacaggaccatgctgaaggacctggccacccagacctacatccgctggcaggagctgctgacccactgccagccccaggcccagtacttcagcccctggaaggacatctag

SEQ ID NO: 38549 - DNA, 3060 bp, Artificial Sequence
  Description of Artificial Sequence: Synthetic coding sequence
atgggcaccagagatgatgtgcctgaggccaaggtgctggtgcctgtggccgtgtactgcggcagcatccccaggaccagcgctggcccccgggtgctgcccccaggcagcatcaacagcagcctgccccacggggagggcagcctgcagcctgagccccgggccctgctgaacaatgaggagcccagccagctgctgcggggcctgggccagctgggcggcctgaagctggacacccccagcaagggctggcaggccagaaatggccaccccaggaacctgcgggccctgagcctgggggaccagcccctggtgctgctgcccagccctgagagcgaggccaacagcgtggcccgggacaccatccagatcaaggacaagctgaagaagaggcggctgtctgagggcctggccgccagcagccgggccagcctggaccccggcggcggcccccagggcgtgcccctgcacagcaccatcccccgggccaccagccagaggctgctgcgggtgccccggcccatgcccctcatccagagcatccccaccaccccagaggccagcggcgtgaaggagaagggcctggacctgcccggcagcatccctggcccccatgagctgcggcctggggcccaggaggcccagatctcctggcagtacctgcactgcaatgatgagaagatgcagaagagcctgggcgccatcgtcatcccccccatccccaaggccaggacagtggccgccacccccagccgggtgcccggcagcctgcccagccccctgcccccaggccagggcgtgctgaccggcctgcgggcccccaggacccggctggcccggggcagcggcccccgggagaagaccccagccagcctggagcccaagcccctggccagccccatccgggacaggcctgctgctgccaagaagccagccctgcccttcagccagagcgcccccaccctgacagccttctcctttgactgtgcccgggaggcctgcccccccctgaaggaggaggaccagaaggagatcggcaccaagatccaggtgaccatcagcaagagcgcccgggagaagatgcagctgaagcagatgaaggagatggagctgctgcggcggctggaggagcccaggacaggccaggagctgaccagccagtgcctgggcagccagagggccttcatgaaggagggcctgctgcccctgcggggcagcggcaccctgtctgtgcccacccggctgagcggcccctgcagaaatgatgtgtccatcatcctgaggaagtgggccagccgggccagcctgcccagcatccccatcagccggcaggagcccaggtttgcccggcatgccagcgccaacagcctgcctgctgtgctgaccctgggcagccctgagtgggaggaggaggaggagatggacctgcgggcctgcaaggagctgcggcccttcagcaaccctgagctgggcctgagagatgccctgcagtgcctgaacagcagtgactggcagatgaaggagaagggcctggtgtccatccagaggctggccgcctgccacagcgaggtgctgaccgggaagctgcatgatgtgtgcctggtggtgactggagaggtgaccaacctgcggagcaaggtgagccacctggccatcagcaccctgggggacctcttccaggccctgaagaagaacatggaccaggaggccgaggagatcgcccgctgcctgctgcagaagatggctgacaccaatgagttcatccagagagctgctggccagagcctgcgggccatggtggagaatgtgaccctggcccggagcctggtggtgctgaccagcgctggggtgtaccacaggaaccccctcatcagaaaatatgctgctgagcacctgtctgctgtgctggagcagattggagctgagaagctgctgagcggcacccgggacagcacagacatgctggtgcacaacctggtgcggctggcccaggacagcaaccaggacacccgcttctacggcaggaagatggtgaacatcctgatggccaacaccaagtttgatgccttcctgaagcagagcctgcccagctatgacctgcagaaggtgatggccgccatcaagcagcagggcattgaagataatgatgagctgcccagcgccaagggcaggaaggtgctgcggagcctggtggtgtgtgaaaatggcctgcccatcaaggagggcctgagctgcaatggcccccggctggtgggcctgcggagcaccctgcagggccgcggggagatggtggagcagctgcgggagctgacccggctgctggaggccaaggacttccgcagcaggatggagggcgtgggccagctgctggagctgtgcaaggccaagacagagctggtgacagcccacctggtgcaggtgtttgatgccttcaccccccggctgcaggacagcaacaagaaggtgaaccagtgggccctggagagctttgccaagatgatccccctgctgcgggagagcctgcaccccatgctgctgagcatcatcatcaccgtggccgacaacctgaacagcaagaacagcggcatctatgctgctgctgtggccgtgctggatgccatggtggagagcctggacaacctgtgcctgctgcctgccctggccggccgggtgcgcttcctgagcggccgggctgtgctggatgtgacagaccggctggccgtgctggtggcctctgtgtaccccaggaagccccaggccgtggagcggcacgtgctgcccatcctgtggcacttcctgaacacagccaccagaaatggcaccctgcccggccccagcggcaacatccggggcgtggtgtgccgcctgagccgcagcctgcaggagcacatgggcagccggctgctggactttgctgccagccagcccaagcacgtgctgaagaccctgcaggagctgctggacagcgagagcctgggcggcagcaggaaggccacagaccggggcgtggccccagacagcaagaccaccggcagcagctaccccttccagctggactag

SEQ ID NO: 38550 - DNA, 2895 bp, Artificial Sequence
  Description of Artificial Sequence: Synthetic coding sequence
atgggcaccagagatgatgtgcctgaggccaaggtgctggtgcctgtggccgtgtactgcggcagcatccccaggaccagcgctggcccccgggtgctgcccccaggcagcatcaacagcagcctgccccacggggagggcagcctgcagcctgagccccgggccctgctgaacaatgaggagcccagccagctgctgcggggcctgggccagctgggcggcctgaagctggacacccccagcaagggctggcaggccagaaatggccaccccaggaacctgcgggccctgagcctgggggaccagcccctggtgctgctgcccagccctgagagcgaggccaacagcgtggcccgggacaccatccagatcaaggacaagctgaagaagaggcggctgtctgagggcctggccgccagcagccgggccagcctggaccccggcggcggcccccagggcgtgcccctgcacagcaccatcccccgggccaccagccagaggctgctgcgggtgccccggcccatgcccctcatccagagcatccccaccaccccagaggccagcggcgtgaaggagaagggcctggacctgcccggcagcatccctggcccccatgagctgcggcctggggcccaggaggcccagatctcctggcagtacctgcactgcaatgatgagaagatgcagaagagcctgggcgccatcgtcatcccccccatccccaaggccaggacagtggccgccacccccagccgggtgcccggcagcctgcccagccccctgcccccaggccagggcgtgctgaccggcctgcgggcccccaggacccggctggcccggggcagcggcccccgggagaagaccccagccagcctggagcccaagcccctggccagccccatccgggacaggcctgctgctgccaagaagccagccctgcccttcagccagagcgcccccaccctgacagccttctcctttgactgtgcccgggaggcctgcccccccctgaaggaggaggaccagaaggagatcggcaccaagatccaggtgaccatcagcaagagcgcccgggagaagatgcagctgaagcagatgaaggagatggagctgctgcggcggctggaggagcccaggacaggccaggagctgaccagccagtgcctgggcagccagagggccttcatgaaggaggccaacagcctgcctgctgtgctgaccctgggcagccctgagtgggaggaggaggaggagatggacctgcgggcctgcaaggagctgcggcccttcagcaaccctgagctgggcctgagagatgccctgcagtgcctgaacagcagtgactggcagatgaaggagaagggcctggtgtccatccagaggctggccgcctgccacagcgaggtgctgaccgggaagctgcatgatgtgtgcctggtggtgactggagaggtgaccaacctgcggagcaaggtgagccacctggccatcagcaccctgggggacctcttccaggccctgaagaagaacatggaccaggaggccgaggagatcgcccgctgcctgctgcagaagatggctgacaccaatgagttcatccagagagctgctggccagagcctgcgggccatggtggagaatgtgaccctggcccggagcctggtggtgctgaccagcgctggggtgtaccacaggaaccccctcatcagaaaatatgctgctgagcacctgtctgctgtgctggagcagatcggggctgagaagctgctgagcggcacccgggacagcacagacatgctggtgcacaacctggtgcggctggcccaggacagcaaccaggacacccgcttctacggcaggaagatggtgaacatcctgatggccaacaccaagtttgatgccttcctgaagcagagcctgcccagctatgacctgcagaaggtgatggccgccatcaagcagcagggcatcgaggacaatgatgagctgcccagcgccaagggcaggaaggtgctgcggagcctggtggtgtgtgaaaatggcctgcccatcaaggagggcctgagctgcaatggcccccggctggtgggcctgcggagcaccctgcagggccgcggggagatggtggagcagctgcgggagctgacccggctgctggaggccaaggacttccgcagcaggatggagggcgtgggccagctgctggagctgtgcaaggccaagacagagctggtgacagcccacctggtgcaggtgtttgatgccttcaccccccggctgcaggacagcaacaagaaggtgaaccagtgggccctggagagctttgccaagatgatccccctgctgcgggagagcctgcaccccatgctgctgagcatcatcatcaccgtggccgacaacctgaacagcaagaacagcggcatctatgctgctgctgtggccgtgctggatgccatggtggagagcctggacaacctgtgcctgctgcctgccctggccggccgggtgcgcttcctgagcggccgggctgtgctggatgtgacagaccggctggccgtgctggtggcctctgtgtaccccaggaagccccaggccgtggagagacatgtgctgcccatcctgtggcacttcctgaacacagccaccagaaatggcaccctgcccggccccagcggcaacatccggggcgtggtgtgccgcctgagccgcagcctgcaggagcacatgggcagccggctgctggactttgctgccagccagcccaagcacgtgctgaagaccctgcaggagctgctggacagcgagagcctgggcggcagcaggaaggccacagacagaggagtggccccagacagcaagaccaccggcagcagctaccccttccagctggactag

SEQ ID NO: 38551 - DNA, 210 bp, Artificial Sequence
  Description of Artificial Sequence: Synthetic coding sequence
atgggcaccagagatgatgtgcctgaggccaaggtgctggtgcctgtggccgtgtactgcggcagcatccccaggaccagcgctggcccccgggtgctgcccccaggcagcatcaacagcagcctgccccacggggagggcagcctgcagcctgagccccgggccctgctgaacaatgaggagcccagccagctgctgcggggcctgtag

SEQ ID NO: 38552 - DNA, 5163 bp, Artificial Sequence
  Description of Artificial Sequence: Synthetic coding sequence
atggctgctgcccccagcgccctgctgctgctgccccccttccctgtgctgagcacctaccgcctgcagagccgcagccggcccagcgcccctgagacagatgacagccgggtgggcggcatcatgagaggagagaagaactactacttcagaggagctgctggggaccacggcagctgccccaccaccaccagccccctggccagcgccctgctgatgcccagcgaggccgtgagcagctcctggagcgagagcggcggcggcctgtctggaggagatgaggaggacacccggctgctgcagctgctgaggacagcccgggaccccagcgaggccttccaggccctgcaggccgccctgccccggcggggcggccgcctgggcttccccaggaggaaggaggccctgtaccgggccctgggccgggtgctggtggagggcggcagtgatgagaagaggctgtgcctgcagctgctgagtgatgtgctgcggggccagggcgaggccggccagctggaggaggccttcagcctggccctgctgccccagctggtggtgtccctgcgggaggagaacccagccctgaggaaggatgccctgcagatcctgcacatctgcctgaagaggagccctggagaggtgctgcggaccctcatccagcagggcctggagagcacagatgcccggctgcgggccagcacagccctgctgctgcccatcctgctgaccacagaggacctgctgctgggcctggacctgacagaggtgatcatcagcctggccaggaagctgggggaccaggagacagaggaggagagcgagacagccttcagcgccctgcagcagattggagagcggctgggccaggaccgcttccagagctacatcagccggctgcccagcgccctgcggcggcactacaacagaaggctggagagccagtttggcagccaggtgccctactacctggagctggaggccagcggcttccctgaggaccccctgccctgtgctgtgaccctgagcaacagcaacctgaagtttggcatcatcccccaggagctgcacagccggctgctggaccaggaggactacaagaacagaacccaggccgtggaggagctgaagcaggtgctgggcaagttcaaccccagcagcaccccccacagcagcctggtgggcttcatcagcctgctgtacaacctgctggatgacagcaacttcaaggtggtgcacggcaccctggaggtgctgcacctgctggtgatccggctgggggagcaggtgcagcagttcctgggccctgtgattgctgcctctgtgaaggtgctggccgacaacaagctggtgatcaagcaggagtacatgaagatcttcctgaagctgatgaaggaggtgggcccccagcaggtgctgtgcctgctgctggagcacctgaagcacaagcacagccgggtgcgggaggaggtggtgaacatctgcatctgcagcctgctgacctaccccagcgaggactttgacctgcccaagctgagctttgacctggccccagccctggtggacagcaagagaagagtgcggcaggccgccctggaggcctttgctgtgctggccagctccatgggcagcggcaagaccagcatcctcttcaaggctgtggacacagtggagctgcaggacaatggagatggagtgatgaatgctgtgcaggcccggctggccaggaagaccctgccccggctgacagagcagggctttgtggagtatgctgtgctgatgcccagcagcgctgggggccgcagcaaccacctggcccacggggctgacacagactggctgctggccggcaacagaacccagagcgcccactgccactgtggggaccacgtgcgggacagcatgcacatctacggcagctacagccccaccatctgcaccaggagagtgctgtctgctgggaagggcaagaacaagctgccctgggagaatgagcagcccggcatcatgggagagaaccagaccagcaccagcaaggacatcgagcagttcagcacctatgacttcatccccagcgccaagctgaagctgagccagggcatgcctgtgaatgatgacctgtgcttcagcaggaagagggtgtccaggaacctcttccagaacagccgggacttcaacccagactgcctgcccctgtgtgccgccggcaccaccggcacccaccagaccaacctgtctggaaaatgtgcccagctgggcttcagccagatctgtgggaagacaggctctgtgggcagtgacctgcagttcctgggcaccaccagcagccaccaggagaaggtgtatgccagcctgaactttggcagcaagacccagcagaccttcggcagccagacagaatgtaccagcagcaatggccagaaccccagccctggggcctacatcctgcccagctaccctgtgagcagccccaggaccagccccaagcacaccagccccctcatcatcagccccaagaagagccaggacaacagcgtgaacttcagcaacagctggcccctgaagagctttgagggcctgagcaagcccagcccccagaagaagctggtgtcccagaagagcagtgaccccactggaagaaatcatggagagaacagccaggagaagccccctgtgcagctgaccccagccctggtgcgcagccccagcagccggcggggcctgaatggcaccaagcctgtgccccccatcccccggggcatcagcctgctgcctgacaaggctgacctgagcacagtgggccacaagaagaaggagccagatgacatctggaagtgtgagaaggacagcctgcccatcgacctgtctgagctgaacttcaaggacaaggacctggaccaggaggagatgcacagcagcctgcggagcctgagaaattctgctgccaagaagagggccaagctgagcggcagcaccagtgacctggagagcccagattctgccatgaagctggacctgaccatggacagccccagcctgagcagcagccccaacatcaacagctacagcgagagcggcgtgtacagccaggagagcctgaccagcagcctgagcaccaccccccagggcaagaggatcatgtctgacatcttccccaccttcggcagcaagccctgccccacccggctgagcagcgccaagaagaagatcagccacatcgccgagcagagccccagcgctggcagcagcagcaacccccagcagatcagcagctttgacttcaccaccaccaaggccctgtctgaagattctgtggtggtggtgggcaaaggagtgtttggcagcctgagcagcgccccagccacctgcagccagagcgtcatcagctctgtggagaatggagacaccttcagcatcaagcagagcattgagccccccagcggcatctacggccgctctgtgcagcagaacatcagcagctacctggatgtggagaatgagaaggatgccaaggtgtccatcagcaagagcacctacaacaagatgaggcagaagaggaaggaggagaaggagctgttccacaacaaggactgtgagaagaaggagaagaacagctgggagaggatgaggcacactggaacagagaagatggccagcgagagcgagacccccaccggggccatcagccagtacaaggagaggatgcccagcgtgacccacagccctgagatcatggacctgtctgagctgcggcccttcagcaagccagaaattgccctgacagaggccctgcggctgctggctgatgaggactgggagaagaagattgagggcctgaacttcatccgctgcctggccgccttccacagcgagatcctgaacaccaagctgcacgagaccaactttgctgtggtgcaggaggtgaagaacctgcggtctggagtgtccagagctgctgtggtgtgcctgagtgacctcttcacctacctgaagaagtccatggaccaggagctggacaccaccgtgaaggtgctgctgcacaaggccggggagagcaacaccttcatcagagaagatgtggacaaggccctgcgggccatggtgaacaacgtgaccccagcccgggctgtggtgtccctcatcaatggaggccagcgctactacggcaggaagatgctgttcttcatgatgtgccaccccaactttgagaagatgctggagaagtatgtgcccagcaaggacctgccctacatcaaggacagcgtgaggaacctgcagcagaagggcctgggggagatccccctggacacccccagcgccaagggccgccgcagccacacaggctctgtgggcaacaccaggagcagctctgtgtccagagatgccttcaacagcgctgagagagctgtgacagaggtgcgggaggtgaccaggaagtctgtgcccaggaacagcctggagagcgctgagtacctgaagctgatcaccggcctgctgaatgccaaggacttccgggaccgcatcaatggcatcaagcagctgctgagtgacacagagaacaaccaggacctggtggtgggcaacatcgtgaagatctttgatgccttcaagagccggctgcatgacagcaacagcaaggtgaacctggtggccctggagaccatgcacaagatgatccccctgctgcgggaccacctgagccccatcatcaacatgctgatcccagccatcgtggacaacaacctgaacagcaagaaccctggcatctatgctgctgccaccaacgtggtgcaggccctgagccagcacgtggacaactacctgctgctgcagcccttctgcaccaaggcccagttcctgaatggcaaggccaagcaggacatgacagagaagctggccgacatcgtgacagagctgtaccagaggaagccccacgccacagagcagaaggtgctggtggtgctgtggcacctgctgggcaacatgaccaacagcggcagcctgcccggggccggcggcaacatcagaacagccacagccaagctgagcaaggccctgtttgcccagatgggccagaacctgctgaaccaggccgccagccagcccccccacatcaagaagagcctggaggagctgctggacatgaccatcctgaatgagctgtag

SEQ ID NO: 38553 - DNA, 2988 bp, Artificial Sequence
  Description of Artificial Sequence: Synthetic coding sequence
atggctgctgcccccagcgccctgctgctgctgccccccttccctgtgctgagcacctaccgcctgcagagccgcagccggcccagcgcccctgagacagatgacagccgggtgggcggcatcatgagaggagagaagaactactacttcagaggagctgctggggaccacggcagctgccccaccaccaccagccccctggccagcgccctgctgatgcccagcgaggccgtgagcagctcctggagcgagagcggcggcggcctgtctggaggagatgaggaggacacccggctgctgcagctgctgaggacagcccgggaccccagcgaggccttccaggccctgcaggccgccctgccccggcggggcggccgcctgggcttccccaggaggaaggaggccctgtaccgggccctgggccgggtgctggtggagggcggcagtgatgagaagaggctgtgcctgcagctgctgagtgatgtgctgcggggccagggcgaggccggccagctggaggaggccttcagcctggccctgctgccccagctggtggtgtccctgcgggaggagaacccagccctgaggaaggatgccctgcagatcctgcacatctgcctgaagaggagccctggagaggtgctgcggaccctcatccagcagggcctggagagcacagatgcccggctgcgggccagcacagccctgctgctgcccatcctgctgaccacagaggacctgctgctgggcctggacctgacagaggtgatcatcagcctggccaggaagctgggggaccaggagacagaggaggagagcgagacagccttcagcgccctgcagcagattggagagcggctgggccaggaccgcttccagagctacatcagccggctgcccagcgccctgcggcggcactacaacagaaggctggagagccagtttggcagccaggtgccctactacctggagctggaggccagcggcttccctgaggaccccctgccctgtgctgtgaccctgagcaacagcaacctgaagtttggcatcatcccccaggagctgcacagccggctgctggaccaggaggactacaagaacagaacccaggccgtggaggagctgaagcaggtgctgggcaagttcaaccccagcagcaccccccacagcagcctggtgggcttcatcagcctgctgtacaacctgctggatgacagcaacttcaaggtggtgcacggcaccctggaggtgctgcacctgctggtgatccggctgggggagcaggtgcagcagttcctgggccctgtgattgctgcctctgtgaaggtgctggccgacaacaagctggtgatcaagcaggagtacatgaagatcttcctgaagctgatgaaggaggtgggcccccagcaggtgctgtgcctgctgctggagcacctgaagcacaagcacagccgggtgcgggaggaggtggtgaacatctgcatctgcagcctgctgacctaccccagcgaggactttgacctgcccaagctgagctttgacctggccccagccctggtggacagcaagagaagagtgcggcaggccgccctggaggcctttgctgtgctggccagctccatgggcagcggcaagaccagcatcctcttcaaggctgtggacacagtggagctgcaggacaatggagatggagtgatgaatgctgtgcaggcccggctggccaggaagaccctgccccggctgacagagcagggctttgtggagtatgctgtgctgatgcccagcagcgctgggggccgcagcaaccacctggcccacggggctgacacagactggctgctggccggcaacagaacccagagcgcccactgccactgtggggaccacgtgcgggacagcatgcacatctacggcagctacagccccaccatctgcaccaggagagtgctgtctgctgggaagggcaagaacaagctgccctgggagaatgagcagcccggcatcatgggagagaaccagaccagcaccagcaaggacatcgagcagttcagcacctatgacttcatccccagcgccaagctgaagctgagccagggcatgcctgtgaatgatgacctgtgcttcagcaggaagagggtgtccaggaacctcttccagaacagccgggacttcaacccagactgcctgcccctgtgtgccgccggcaccaccggcacccaccagaccaacctgtctggaaaatgtgcccagctgggcttcagccagatctgtgggaagacaggctctgtgggcagtgacctgcagttcctgggcaccaccagcagccaccaggagaaggtgtatgccagcctgaactttggcagcaagacccagcagaccttcggcagccagacagaatgtaccagcagcaatggccagaaccccagccctggggcctacatcctgcccagctaccctgtgagcagccccaggaccagccccaagcacaccagccccctcatcatcagccccaagaagagccaggacaacagcgtgaacttcagcaacagctggcccctgaagagctttgagggcctgagcaagcccagcccccagaagaagctggtgtcccagaagagcagtgaccccactggaagaaatcatggagagaacagccaggagaagccccctgtgcagctgaccccagccctggtgcgcagccccagcagccggcggggcctgaatggcaccaagcctgtgccccccatcccccggggcatcagcctgctgcctgacaaggctgacctgagcacagtgggccacaagaagaaggagccagatgacatctggaagtgtgagaaggacagcctgcccatcgacctgtctgagctgaacttcaaggacaaggacctggaccaggaggaggtgcgccacatcagcaacatctgggtgaagaccctgagcaacaagaccttcttctgcaaggagaagaacttctcctactgctag

SEQ ID NO: 38554 - DNA, 3483 bp, Artificial Sequence
  Description of Artificial Sequence: Synthetic coding sequence
atggctgctgcccccagcgccctgctgctgctgccccccttccctgtgctgagcacctaccgcctgcagagccgcagccggcccagcgcccctgagacagatgacagccgggtgggcggcatcatgagaggagagaagaactactacttcagaggagctgctggggaccacggcagctgccccaccaccaccagccccctggccagcgccctgctgatgcccagcgaggccgtgagcagctcctggagcgagagcggcggcggcctgtctggaggagatgaggaggacacccggctgctgcagctgctgaggacagcccgggaccccagcgaggccttccaggccctgcaggccgccctgccccggcggggcggccgcctgggcttccccaggaggaaggaggccctgtaccgggccctgggccgggtgctggtggagggcggcagtgatgagaagaggctgtgcctgcagctgctgagtgatgtgctgcggggccagggcgaggccggccagctggaggaggccttcagcctggccctgctgccccagctggtggtgtccctgcgggaggagaacccagccctgaggaaggatgccctgcagatcctgcacatctgcctgaagaggagccctggagaggtgctgcggaccctcatccagcagggcctggagagcacagatgcccggctgcgggccagcacagccctgctgctgcccatcctgctgaccacagaggacctgctgctgggcctggacctgacagaggtgatcatcagcctggccaggaagctgggggaccaggagacagaggaggagagcgagacagccttcagcgccctgcagcagattggagagcggctgggccaggaccgcttccagagctacatcagccggctgcccagcgccctgcggcggcactacaacagaaggctggagagccagtttggcagccaggtgccctactacctggagctggaggccagcggcttccctgaggaccccctgccctgtgctgtgaccctgagcaacagcaacctgaagtttggcatcatcccccaggagctgcacagccggctgctggaccaggaggactacaagaacagaacccaggccgtggaggagctgaagcaggtgctgggcaagttcaaccccagcagcaccccccacagcagcctggtgggcttcatcagcctgctgtacaacctgctggatgacagcaacttcaaggtggtgcacggcaccctggaggtgctgcacctgctggtgatccggctgggggagcaggtgcagcagttcctgggccctgtgattgctgcctctgtgaaggtgctggccgacaacaagctggtgatcaagcaggagtacatgaagatcttcctgaagctgatgaaggaggtgggcccccagcaggtgctgtgcctgctgctggagcacctgaagcacaagcacagccgggtgcgggaggaggtggtgaacatctgcatctgcagcctgctgacctaccccagcgaggactttgacctgcccaagctgagctttgacctggccccagccctggtggacagcaagagaagagtgcggcaggccgccctggaggcctttgctgtgctggccagctccatgggcagcggcaagaccagcatcctcttcaaggctgtggacacagtggagctgcaggacaatggagatggagtgatgaatgctgtgcaggcccggctggccaggaagaccctgccccggctgacagagcagggctttgtggagtatgctgtgctgatgcccagcagcgctgggggccgcagcaaccacctggcccacggggctgacacagactggctgctggccggcaacagaacccagagcgcccactgccactgtggggaccacgtgcgggacagcatgcacatctacggcagctacagccccaccatctgcaccaggagagtgctgtctgctgggaagggcaagaacaagctgccctgggagaatgagcagcccggcatcatgggagagaaccagaccagcaccagcaaggacatcgagcagttcagcacctatgacttcatccccagcgccaagctgaagctgagccagggcatgcctgtgaatgatgacctgtgcttcagcaggaagagggtgtccaggaacctcttccagaacagccgggacttcaacccagactgcctgcccctgtgtgccgccggcaccaccggcacccaccagaccaacctgtctggaaaatgtgcccagctgggcttcagccagatctgtgggaagacaggctctgtgggcagtgacctgcagttcctgggcaccaccagcagccaccaggagaaggtgtatgccagcctgaactttggcagcaagacccagcagaccttcggcagccagacagaatgtaccagcagcaatggccagaaccccagccctggggcctacatcctgcccagctaccctgtgagcagccccaggaccagccccaagcacaccagccccctcatcatcagccccaagaagagccaggacaacagcgtgaacttcagcaacagctggcccctgaagagctttgagggcctgagcaagcccagcccccagaagaagctggtgtcccagaagagcagtgaccccactggaagaaatcatggagagaacagccaggagaagccccctgtgcagctgaccccagccctggtgcgcagccccagcagccggcggggcctgaatggcaccaagcctgtgccccccatcccccggggcatcagcctgctgcctgacaaggctgacctgagcacagtgggccacaagaagaaggagccagatgacatctggaagtgtgagaaggacagcctgcccatcgacctgtctgagctgaacttcaaggacaaggacctggaccaggaggagatgcacagcagcctgcggagcctgagaaattctgctgccaagaagagggccaagctgagcggcagcaccagtgacctggagagcccagattctgccatgaagctggacctgaccatggacagccccagcctgagcagcagccccaacatcaacagctacagcgagagcggcgtgtacagccaggagagcctgaccagcagcctgagcaccaccccccagggcaagaggatcatgtctgacatcttccccaccttcggcagcaagccctgccccacccggctgagcagcgccaagaagaagatcagccacatcgccgagcagagccccagcgctggcagcagcagcaacccccagcagatcagcagctttgacttcaccaccaccaaggccctgtctgaagattctgtggtggtggtgggcaaaggagtgtttggcagcctgagcagcgccccagccacctgcagccagagcgtcatcagctctgtggagaatggagacaccttcagcatcaagcagagcattgagccccccagcggcatctacggccgctctgtgcagcagaacttcatcatctcctag

SEQ ID NO: 38555 - DNA, 1032 bp, Artificial Sequence
  Description of Artificial Sequence: Synthetic coding sequence
atgaagctgctgcagatgctgctgcggggcaacccctgctgcccccagcctgagatcagcccccagggcagctctgtgcccttcctgggcgccgccggccaccagcagagcctgcccagctcctggaaggccagctgcagcggccccctggtgatggccagtgacagtgatgtgaagatgctgctgaactttgtgaacctggccagcagtgacatcaaggccgccctggacaagagcgccccctgcagaagatctgtggaccacaggaagtacctgcagaagcagctgaagcgcttcagccagaagtacagccggctgccccggggcctgcccggccgggctgctgagccctacctgaagaggggcagcgaggaccggccccggcggctgctgctggacctgggccctgacagcagccctgggggcggcggcggctgcaaggagaaggtgctgaggaacccctaccgggaggagtgcctggccaaggagcagctgccccagaggcagcaccctgaggccgcccagcccggccaggtgcccatgaggaagaggcagctgcctgccagcttctgggaggagccccggcccacccacagctaccacgtgggcctggagggcggcctgggcccccgggagggccccccctatgagggcaagaagaactgcaagggcctggagcccctgggccctgagaccaccctggtgtccatgagcccccgggccctggccgagaaggagcccctgaagatgcctggggtgtccctggtgggccgggtgaatgcctggagctgctgccccttccagtaccacggccagcccatctacccaggccccctgggcgccctgccccagagccctgtgcccagcctgggcctgtggaggaagagccctgccttccctggagagctggcccacctgtgcaaggatgtggatggcctgggccagaaggtgtgcaggcctgtggtgctgaagcccatccccaccaagccagctgtgcccccacccatcttcaacgtgtttggctacctgtag

SEQ ID NO: 38556 - DNA, 1065 bp, Artificial Sequence
  Description of Artificial Sequence: Synthetic coding sequence
atgcccctggaggagcggcgcagcagtggagagagaaatgatgctgcccccaccaaccacagaagacctggagagaagagggccagcacagccaagcaggtgtcctctgtgcccttcctgggcgctgctggccaccagcagagcctgcccagctcctggaaggccagctgcagcggccccctggtgatggccagtgacagtgatgtgaagatgctgctgaactttgtgaacctggccagcagtgacatcaaggccgccctggacaagagcgccccctgccgccgctctgtggaccacaggaagtacctgcagaagcagctgaagcgcttcagccagaagtacagccggctgccccggggcctgcccggccgggctgctgagccctacctgaagaggggctctgaagatcggccccggcggctgctgctggacctgggccctgacagcagccctgggggcggcggcggctgcaaggagaaggtgctgaggaacccctaccgggaggagtgcctggccaaggagcagctgccccagaggcagcaccctgaggccgcccagcccggccaggtgcccatgaggaagaggcagctgcctgccagcttctgggaggagccccggcccacccacagctaccacgtgggcctggagggcggcctgggcccccgggagggccccccctatgagggcaagaagaactgcaagggcctggagcccctgggccctgagaccaccctggtgtccatgagcccccgggccctggccgagaaggagcccctgaagatgcctggggtgtccctggtgggccgggtgaatgcctggagctgctgccccttccagtaccacggccagcccatctacccaggccccctgggcgccctgccccagagccctgtgcccagcctgggcctgtggaggaagagccctgccttccctggagagctggcccacctgtgcaaggatgtggatggcctgggccagaaggtgtgcaggcctgtggtgctgaagcccatccccaccaagccagctgtgcccccacccatcttcaacgtgtttggctacctgtag

SEQ ID NO: 38557 - DNA, 699 bp, Artificial Sequence
  Description of Artificial Sequence: Synthetic coding sequence
atggccagtgacagtgatgtgaagatgctgctgaactttgtgaacctggccagcagtgacatcaaggccgccctggacaagagcgccccctgccgccgctctgtggaccacaggaagtacctgcagaagcagctgaagcgcttcagccagaagtacagccggctgccccggggcctgcccggccgggctgctgagccctacctgaagaggggctctgaagatcggccccggcggctgctgctggacctgggccctgacagcagccctgggggcggcggcggctgcaaggagaaggtgctgaggaacccctaccgggaggagtgcctggccaaggagcagctgccccagaggcagcaccctgaggccgcccagcccggccaggtgcccatgaggaagaggcagctgcctgccagcttctgggaggagccccggcccacccacagctaccacgtgggcctggagggcggcctgggcccccgggagggccccccctatgagggcaagaagaactgcaagggcctggagcccctgggccctgagaccaccctggtgtccatgagcccccgggccctggccgagaaggagcccctgaagatgcctggggtgtccctggtgggccgggtgaatgcctggagctgctgccccttccagtaccacggccagcccatctacccaggccccctgggcgccctgccctag

SEQ ID NO: 38558 - DNA, 879 bp, Artificial Sequence
  Description of Artificial Sequence: Synthetic coding sequence
atggccagtgacagtgatgtgaagatgctgctgaactttgtgaacctggccagcagtgacatcaaggccgccctggacaagagcgccccctgccgccgctctgtggaccacaggaagtacctgcagaagcagctgaagcgcttcagccagaagtacagccggctgccccggggcctgcccggccgggctgctgagccctacctgaagaggggctctgaagatcggccccggcggctgctgctggacctgggccctgacagcagccctgggggcggcggcggctgcaaggagaaggtgctgaggaacccctaccgggaggagtgcctggccaaggagcagctgccccagaggcagcaccctgaggccgcccagcccggccaggtgcccatgaggaagaggcagctgcctgccagcttctgggaggagccccggcccacccacagctaccacgtgggcctggagggcggcctgggcccccgggagggccccccctatgagggcaagaagaactgcaagggcctggagcccctgggccctgagaccaccctggtgtccatgagcccccgggccctggccgagaaggagcccctgaagatgcctggggtgtccctggtgggccgggtgaatgcctggagctgctgccccttccagtaccacggccagcccatctacccaggccccctgggcgccctgccccagagccctgtgcccagcctgggcctgtggaggaagagccctgccttccctggagagctggcccacctgtgcaaggatgtggatggcctgggccagaaggtgtgcaggcctgtggtgctgaagcccatccccaccaagccagctgtgcccccacccatcttcaacgtgtttggctacctgtag

SEQ ID NO: 38559 - DNA, 879 bp, Artificial Sequence; identical to SEQ ID NO: 38558
  Description of Artificial Sequence: Synthetic coding sequence

SEQ ID NO: 38560 - DNA, 1281 bp, Artificial Sequence
  Description of Artificial Sequence: Synthetic coding sequence
atggctgtgcaggccgccctgctgagcacccacccctttgtgcccttcggctttggaggcagcccagatggcctgggcggggcctttggagccctggacaagggctgctgctttgaagatgatgaaacaggagccccagctggggccctgctgagcggggctgagggcggagatgtgcgggaggccacccgggacctgctgtccttcatcgacagcgccagcagcaacatcaagctggccctggacaagccaggcaagagcaagaggaaggtgaaccacaggaagtacctgcagaagcagatcaagcgctgcagcggcctgatgggcgccgcccctcctggcccccccagccccagcgctgctgacaccccagccaagaggcccctggccgcccccagcgcccccaccgtggccgccccagcccacggcaaggccgccccccggcgggaggccagccaggccgctgctgctgccagcctgcagagccgcagcctggccgccctgtttgacagcctgcggcacgtgcctgggggcgctgagcctgctggaggagaggtggccgccccagctgctggcctgggcggggccggcaccggcggcgctggaggagatgtggccggccctgctggggccacagccatccctggggccaggaaggtgcccctgcgggccaggaacctgccccccagcttcttcacagagcccagccgggccggcggcggcggctgcggccccagcggcccagatgtgtccctgggggacctggagaagggagctgaggccgtggagttctttgagctgctgggccctgactatggagctggaacagaggccgctgtgctgctggccgctgagcccctggatgtgtttcctgctggggcctctgtgctgcggggccccccagagctggagcccggcctgtttgagcccccacctgctgtggtgggcaacctgctgtacccagagccctggagcgtgcccggctgcagccccaccaagaagagccccctgacagccccccggggcggcctgaccctgaatgagcccctgagccccctgtacccagctgctgctgacagccctggaggagaagatggccggggccacctggccagctttgcccccttcttcccagactgtgccctgcccccacctcctccaccccaccaggtgtcctatgactacagcgctggctacagcaggacagcctacagcagcctgtggaggagtgatggagtgtgggagggcgcccctggagaggagggcgcccaccgggactag

SEQ ID NO: 38561 - DNA, 465 bp, Artificial Sequence
  Description of Artificial Sequence: Synthetic coding sequence
atgcagggcatcgaccgctggatccccagcatcccccccctgcagaaccacagcgctgtgaacagaagacacttcagcgccccccagaagctgcatgctgactgtgagaaggagatgctggatggaggagtgcccggcaccaccgtgcgggtgtcctttgacttcagctgcctggagatggtgcgggagctgtggatgtggaatgtggaggaggaggagcacgaggtgggcatcagcacctggggcggccagcactgcggctgcccagccaagagcctgcccggcccccaccctgggggcgtgtctgccccccagagcgccagccagctgatggtgaagctgctggtgtggcagaagtctgtgcacaagctgaggaagattgctgcccagagcgaggagtggagctgtgtgctgaacaagatcagcacccacccctttgtgtccaaggagcatgatggcacctag

SEQ ID NO: 38562 - DNA, 234 bp, Artificial Sequence
  Description of Artificial Sequence: Synthetic coding sequence
atggtgcgggagctgtggatgtggaatgtggaggaggaggagcacgaggtgggcatcagcacctggggcggccagcactgcggctgcccagccaagagcctgcccggcccccaccctggaggagtgtctgccccccagagcgccagccagctgatggtgaagctgctggtgtggcagaagtctgtgcacaagctgaggaagaacagaaatgcctacagctgtggccccctgtag

SEQ ID NO: 38563 - DNA, 234 bp, Artificial Sequence
  Description of Artificial Sequence: Synthetic coding sequence
atggtgcgggagctgtggatgtggaatgtggaggaggaggagcacgaggtgggcatctgcacctggggcggccagcactgcggctgcccagccaagagcctgcccggcccccaccctggaggagtgtctgccccccagagcgccagccagctgatggtgaagctgctggtgtggcagaagtctgtgcacaagctgaggaagaacagaaatgcctacagctgtggccccctgtag

SEQ ID NO: 38564 - DNA, 405 bp, Artificial Sequence
  Description of Artificial Sequence: Synthetic coding sequence
atggccggccaccccaaggagaaggtgatcccagatgaggtgcaccagaaccagatcctgcgggagctgtacctgaaggagctgcggacccagaagctgtacacccagtaccacgtgaaccccctgaggaagatccacacagtgaccaggaagcccatgtcctggcatgacaacctggaggagccagcagatgcccgcttcctgaacctgatccaccacgccgcccagggccccaggaagaagtacccagagacccagacagagaaccaggaggtgggctgggacctggagcccctcatcaaccctgagagacatgaccggcggctgaaccacttccgggtgtgcagcgacatcaccctgtacaaggccaagacctggggcctgggagatgaccaccacaagtag

SEQ ID NO: 38565 - DNA, 3423 bp, Artificial Sequence
  Description of Artificial Sequence: Synthetic coding sequence
atggccaccccaggcatgtcctggcagcagcactactatggaggcagcgctgccaagtttgcccccagccctgccacagcccagctggccggccacagcatggactacagccaggagatgcacctgaagatgagcaagaagatcgcccagctgaccaaggtgatctatgccctgaacaccaagaatgatgaacatgaaagtgccatccaggccctgaaggatgcccacgaggaggagatccagcagatcctggccgagacccgggagaagatcctgcagtacaagagcaaggtgacagaggagctggacctgcggaggaagatccaggtgctggagagcagcctggaggaccacatcaagatgaagcagcaggccctgacagaatttgaggcctacaagcaccgggtggaggacatgcagctgtgtgccgaggcccagcacgtgcagagaattgtgaccatgagccgggaggtggaggagatccggaggaagtttgaggagaagctgcggagctttggccagctgcaggtgcagtttgagaaggacaagaggctggccctggaggacctgcaggccgcccacagaagagagatccaggagctgctgaagagccagcaggaccacagcgcctctgtgaacaagggccaggagaaggccgaggagctgcacaggatggaggtggagagcctgaacaagatgctggaggagctgcggctggagaggaagaagctgattgaggactatgagggcaagctgaacaaggcccagagcttctatgagcgggagctggacaccctgaagaggagccagctgttcaccgctgagagcctgcaggccagcaaggagaaggaggccgacctgaggaaggagttccagggccaggaggccatcctgaggaagaccatcggcaagctgaagacagagctgcagatggtgcaggatgaggccggcagcctgctggacaagtgccagaagctgcagacagccctggccatcgccgagaacaacgtgcaggtgctgcagaagcagctggatgatgccaaggagggggagatggccctgctgagcaagcacaaggaggtggagagcgagctggccgccgcccgggagcggctgcagcagcaggccagtgacctggtgctgaaggccagccacatcggcatgctgcaggccacccagatgacccaggaggtgaccatcaaggacctggagagcgagaagagccgggtgaatgaaaggctgagccagctggaggaggagcgggccttcctgcggagcaagacccagagcctggatgaggagcagaagcagcagatcctggagctggagaagaaggtgaatgaggccaagaggacccagcaggagtactatgagcgggagctgaagaacctgcagagccggctggaggaggaggtgacccagctgaatgaggcccacagcaagaccctggaggagctggcctggaagcaccacatggccatcgaggccgtgcacagcaatgccatccgggacaagaagaagctgcagatggacctggaggagcagcacaacaaggacaagctgaacctggaggaggacaagaaccagctgcagcaggagctggagaacctgaaggaggtgctggaggacaagctgaacacagccaaccaggagatcggccacctgcaggacatggtgaggaagtctgagcagggcctgggcagcgctgagggcctgattgccagcctgcaggacagccaggagcggctgcagaatgagctggacctgaccaaggacagcctgaaggagaccaaggatgccctgctgaatgtggagggggagctggagcaggagcggcagcagcacgaggagaccatcgccgccatgaaggaggaggagaagctgaaggtggacaagatggcccatgacctggagatcaagtggacagagaacctgcggcaggagtgcagcaagctgcgggaggagctgcggctgcagcacgaggaggacaagaagagcgccatgagccagctgctgcagctgaaggaccgggagaagaatgctgcccgggacagctggcagaagaaggtggaggacctgctgaaccagatcagcctgctgaagcagaacctggagatccagctgagccagagccagaccagcctgcagcagctgcaggcccagttcacccaggagcggcagaggctgacccaggagctggaggagctggaggagcagcaccagcagaggcacaagagcctgaaggaggcccacgtgctggccttccagaccatggaggaggagaaggagaaggagcagagggccctggagaaccacctgcagcagaagcacagcgctgagctgcagagcctgaaggatgcccaccgggagagcatggagggcttcagaattgagatggagcaggagctgcagaccctgcgctttgagctggaggatgagggcaaggccatgctggccagcctgcggtctgagctgaaccaccagcacgccgccgccatcgacctgctgcggcacaaccaccaccaggagctggccgccgccaagatggagctggagaggagcattgacatcagccggcggcagagcaaggagcacatctgccgcatcacagacctgcaggaggagctgcggcaccgggagcaccacatcagcgagctggacaaggaggtgcagcacctgcacgagaacatcagcgccctgaccaaggagctggagttcaagggcaaggagatcctgcgcatccgctctgagagcaaccagcagatccggctgcacgagcaggacctgaacaagaggctggagaaggagctggatgtgatgacagctgaccacctgcgggagaagaacatcatgagagctgacttcaacaagaccaatgagctgctgaaggagatcaatgctgccctgcaggtgtccctggaggagatggaggagaagtacctgatgagggagagcaagccagaggacatccagatgatcacagagctgaaggccatgctgacagagcgggaccagatcatcaagaagctgattgaggacaacaagttctaccagctggagctggtgaaccgggagaccaacttcaacaaggtgttcaacagcagccccaccgtgggcgtcatcaaccccctggccaagcagaagaagaagaatgacaagagccccaccaacagatttgtgtctgtgcccaacctgagcgccctggagagcggcggcgtgggcaatggccaccccaaccggctggaccccatccccaacagccctgtgcatgacatcgagttcaacagcagcaagcccctgccccagcctgtgccccccaagggccccaagaccttcctgagccctgcccagagcgaggccagccctgtggccagcccagacccccagaggcaggagtggtttgcccgctacttcaccttctag

SEQ ID NO: 38566 - DNA, 2916 bp, Artificial Sequence
  Description of Artificial Sequence: Synthetic coding sequence
atgaagcagcaggccctgacagaatttgaggcctacaagcaccgggtggaggacatgcagctgtgtgccgaggcccagcacgtgcagagaattgtgaccatgagccgggaggtggaggagatccggaggaagtttgaggagaagctgcggagctttggccagctgcaggtgcagtttgagaaggacaagaggctggccctggaggacctgcaggccgcccacagaagagagatccaggagctgctgaagagccagcaggaccacagcgcctctgtgaacaagggccaggagaaggccgaggagctgcacaggatggaggtggagagcctgaacaagatgctggaggagctgcggctggagaggaagaagctgattgaggactatgagggcaagctgaacaaggcccagagcttctatgagcgggagctggacaccctgaagaggagccagctgttcaccgctgagagcctgcaggccagcaaggagaaggaggccgacctgaggaaggagttccagggccaggaggccatcctgaggaagaccatcggcaagctgaagacagagctgcagatggtgcaggatgaggccggcagcctgctggacaagtgccagaagctgcagacagccctggccatcgccgagaacaacgtgcaggtgctgcagaagcagctggatgatgccaaggagggggagatggccctgctgagcaagcacaaggaggtggagagcgagctggccgccgcccgggagcggctgcagcagcaggccagtgacctggtgctgaaggccagccacatcggcatgctgcaggccacccagatgacccaggaggtgaccatcaaggacctggagagcgagaagagccgggtgaatgaaaggctgagccagctggaggaggagcgggccttcctgcggagcaagacccagagcctggatgaggagcagaagcagcagatcctggagctggagaagaaggtgaatgaggccaagaggacccagcaggagtactatgagcgggagctgaagaacctgcagagccggctggaggaggaggtgacccagctgaatgaggcccacagcaagaccctggaggagctggcctggaagcaccacatggccatcgaggccgtgcacagcaatgccatccgggacaagaagaagctgcagatggacctggaggagcagcacaacaaggacaagctgaacctggaggaggacaagaaccagctgcagcaggagctggagaacctgaaggaggtgctggaggacaagctgaacacagccaaccaggagatcggccacctgcaggacatggtgaggaagtctgagcagggcctgggcagcgctgagggcctgattgccagcctgcaggacagccaggagcggctgcagaatgagctggacctgaccaaggacagcctgaaggagaccaaggatgccctgctgaatgtggagggggagctggagcaggagcggcagcagcacgaggagaccatcgccgccatgaaggaggaggagaagctgaaggtggacaagatggcccatgacctggagatcaagtggacagagaacctgcggcaggagtgcagcaagctgcgggaggagctgcggctgcagcacgaggaggacaagaagagcgccatgagccagctgctgcagctgaaggaccgggagaagaatgctgcccgggacagctggcagaagaaggtggaggacctgctgaaccagatcagcctgctgaagcagaacctggagatccagctgagccagagccagaccagcctgcagcagctgcaggcccagttcacccaggagcggcagaggctgacccaggagctggaggagctggaggagcagcaccagcagaggcacaagagcctgaaggaggcccacgtgctggccttccagaccatggaggaggagaaggagaaggagcagagggccctggagaaccacctgcagcagaagcacagcgctgagctgcagagcctgaaggatgcccaccgggagagcatggagggcttcagaattgagatggagcaggagctgcagaccctgcgctttgagctggaggatgagggcaaggccatgctggccagcctgcggtctgagctgaaccaccagcacgccgccgccatcgacctgctgcggcacaaccaccaccaggagctggccgccgccaagatggagctggagaggagcattgacatcagccggcggcagagcaaggagcacatctgccgcatcacagacctgcaggaggagctgcggcaccgggagcaccacatcagcgagctggacaaggaggtgcagcacctgcacgagaacatcagcgccctgaccaaggagctggagttcaagggcaaggagatcctgcgcatccgctctgagagcaaccagcagatccggctggaggagatggaggagaagtacctgatgagggagagcaagccagaggacatccagatgatcacagagctgaaggccatgctgacagagcgggaccagatcatcaagaagctgattgaggacaacaagttctaccagctggagctggtgaaccgggagaccaacttcaacaaggtgttcaacagcagccccaccgtgggcgtcatcaaccccctggccaagcagaagaagaagaatgacaagagccccaccaacagatttgtgtctgtgcccaacctgagcgccctggagagcggaggagtgggcaatggccaccccaaccggctggaccccatccccaacagccctgtgcatgacatcgagttcaacagcagcaagcccctgccccagcctgtgccccccaagggccccaagaccttcctgagccctgcccagagcgaggccagccctgtggccagcccagacccccagaggcaggagtggtttgcccgctacttcaccttctag

SEQ ID NO: 38567 - DNA, 3183 bp, Artificial Sequence
  Description of Artificial Sequence: Synthetic coding sequence
atggccagcgccctgaacagcaagatcaaccccccaggcacctgccagggcagcaaggcagatggaggagctggctggaggatggactgtgacccccagatgcacgtgaagatgtgcaagaagatcgcccagctgaccaaggtgatctatgccctgaacacccggcaggatgaagctgaggcctccatggaggccctgcgggaggcccaccaggaggagctgcagaatgctgtggccgagaccaaggcccggctgctgcaggagcagggctgtgccgaggaggaggccctgctgcagaggatccaggccctggagagcgccctggagctgcagaagaggctgacagaggaggccctggccgagagcgccagctgccgcctggagaccaaggagcgggagctgcgggtggaggccgagcacgccgagcgggtgctgaccctgagccgggagatgctggagctgaaggctgactatgaaagaaggctgcagcacctgaccagccatgaggccaccccccagggccgcctgccccaggagagccctgagaccaagtctgagcccggccagggccctgagatgcaggaggtgctgctggaggtgcagaggctgcgggtggagaaccagcagctgagcaaggactatgccaggaaggccgaggagctgcaggccacctatgagcgggagaatgaggccatccggcaggccatgcagcagagcgtgtcccaggccctgtggcagtggcaggagaaggagagtgacctgaggaagaacttccaggtgcaggagagcgccctgcaggcccaggtgaggaagctggagggggacctggagcaccggggcaggaagatcagtgacctgaagaagtatgcccagaagctgaaggagcgcatccaggacctggatgtgcagctgaaggaggcccggcaggagaacagcgagctgaagggcacagccaagaagctgggggagaagctggccgtggccaaggacaggatgatgctgcaggagtgccggggcacccagcagacagatgccatgaagacagagctggtgtctgagaacaaggtgctgcgggaggagaatgacctggaggccggcaacctgcacccccagcaggaccagagctgcctgaaggaatgtccctgcatgaagggcggcacagacatgcagaccaagaaggaggccagcgctgagacagagtacatgaagcagcagtatgaggaggacctgaggaagatcaagcaccagacagaggaggagaagaagcacctgaaggaccagctggtgaagaggctggaggacctggtgaagaagcacacagtggagatcaagtctgtgcgcagctctgtggaggccgagaggaagaagctgcagcgggaggtggaggcccagctggaggaggtgaggaagaagtctgagaaggagatcaagcagctggaggaggagaaggccgccctgaatgtgaagctgcagaacagcctgctggaggtgctgcggctggaggagttcatccagcagaacaagacccggcccaccggggctgaggagagcccccaggagctgggccggcagcactgcagcatcctggagacccaggacccctgcctgaagctggatgagaccagccccagaggagaggagtaccaggacaagctggccgctgaggagggcaccagcagtgatgaggaggagaggaccaaggtgctgctgaaggagggcagtgacccccagccccccctgggcagcctgctgaaggagaagaccagcaagatccagaggctggaggaggactggcagagccagaaggccaagctgcaggcccaggtgtcccagatgcagcaggccctggagcagtgcaccagcaactaccgggaggacctgcaggccctgaagcagctgagtgacctggagcgggagaagctgcagcgggagctgcaggagaccacccagcagaaccacgccatgaaggcccagctggaggccagccaccagagggccctgaggatgctggagaaggcccggcaccaggagctgaaggccacagaggagcggctgaagaaggagagcagccacagcctgcagatccagcaccagacccaccggctggagctgcaggccctggaggagaaggcccggcaggagctgcaggaggagcgggagaggatgcaggcccagcaggccctgctgctggagagcctgcggcaggagctgtctgagcagcaggccgcctgcagcggccaccagaaggacctggaggccctgcaggccgagctgcgggccctgggccggcagcaggccagcagccagtgccctggggacagcaaggaccacatcatcgccacagaggagcggggcggccctggccaggccggcagccccccaggagctgctggccagggcagcggggagggctgcggcctgtgggaggagaatgcccagctgcaggatgctgtgcggcggctgcgggcagaggtggagcagcaccagcaggaggcccagaagctgcgggaccagaggcgcttcctggaggagacccagcaggcccagagggcccgggaggtggagaccctgcggcaggagcacaggaaggagatgcaggccatggtggccgacttcagcagcgcccaggcccagctgcaggcccggctggccgccctggaggccgagctgaaggacagcggggagaagccaggaaaaggagccagcaggcctgaggacctgcagctgattggccgcctgcagacccggctgaaggagcgggaggacatcatcaagcagctgacagaggagcggcgcttccactacgccgccttccccagcgccatgagccacaggaacagaagcttctccttcaacccccaccctggctacctgacccccagcatgaagaagaagaaggtggaggatgtgcccagccgggtggtgtctgtgcccaacctggccagctatgccaagaacttcctgagcggggacctgagcagccgcatcaatgccccacccatcaccaccagccccagcctggaccccagccccagctgtggccgcacctacaagcccaaccagagcacagatgccaagacagccaccaggaccccagatggagaaacagcccaggccaaggaggtgcagcagaagcagggcagcccccaccaggagtggttcaccaagtacttctccttctag

SEQ ID NO: 38568 - DNA, 828 bp, Artificial Sequence
  Description of Artificial Sequence: Synthetic coding sequence
atgctggccccctgcagcggctgggagctgggctgcttccggctgtgcctgcggcaggtgcggctgtgggccggggccggccgctgggcctgctgggcctgccaggcccggccctacagcagcggcggcagcgagcgctggccaggcagcgagacagaggtgcccccacctggccctggaagaaggaccctgaaggagtggaccctgcagggccagaagctgcacgtgcagaccaagggcggcaaggtgatctgcctgggcaccgtgtatggcaacatcgacatccacgccagtgacaagtctgctgtgaccatcgacaagctgcagggcagctctgtgacagtgtccacagaagatggcctgctgaaggccaagtacctgtacacagagagcagcttcctgagcagcgctgctggggacatcaccctgggctctgtgcacggcaacatcaccctgcagagcaagatgggcaacatcaccgtggacagcagcagcggctgcctgaaggccagcaccaaccagggcgccattgatgtgtatgtgtcccagctgggcaaggtggagctgaagagccacaagggcagcatcatcgtgaaggtgcccagcagcctgcaggcccacctgcagctgagcggcaaggaggtggatgtgaacagcgaggtgcacgtgcaggagatggccgaggtgaggaaggatgatgtggtgacagtgacaggcctgatgaaccaggccagcaagcgggagaagtggatcaaggcagatgcccccaagggcaccgtgtccttccggcggcagagctggttccagagcctgaagctgcaggactag

SEQ ID NO: 38569 - DNA, 1179 bp, Artificial Sequence
  Description of Artificial Sequence: Synthetic coding sequence
atgctggccccctgcagcggctgggagctgggctgcttccggctgtgcctgcggcaggtgcggctgtgggccggggccggccgctgggcctgctgggcctgccaggcccggccctacagcagcggcggcagcgagcgctggccaggcagcgagacagaggtgcccccacctggccctggaagaaggaccctgaaggagtggaccctgcaggtgagccccttcggccgcctgcgggcccggctgccctgccacctggccgtgcggcccctggaccccctgacctacccagatggagacagagtgctggtggccgtgtgtggggtggagggcggcgtgcggggcctggatggcctgcaggtgaagtatgatgaggacctggaggagatggccatcgtgtctgacaccatccacccccaggcctctgtggaggtgaatgcccccctgaagtttggcctggacatcaagagcagcggcagcggctgtgtgaaggtgcagagcattgaaggagacaactgcaagattgaaacagagcacggcaccagcatcctgcagagcgtgaagggccagaagctgcacgtgcagaccaagggcggcaaggtgatctgcctgggcaccgtgtatggcaacatcgacatccacgccagtgacaagtctgctgtgaccatcgacaagctgcagggcagctctgtgacagtgtccacagaagatggcctgctgaaggccaagtacctgtacacagagagcagcttcctgagcagcgctgctggggacatcaccctgggctctgtgcacggcaacatcaccctgcagagcaagatgggcaacatcaccgtggacagcagcagcggctgcctgaaggccagcaccaaccagggcgccattgatgtgtatgtgtcccagctgggcaaggtggagctgaagagccacaagggcagcatcatcgtgaaggtgcccagcagcctgcaggcccacctgcagctgagcggcaaggaggtggatgtgaacagcgaggtgcacgtgcaggagatggccgaggtgaggaaggatgatgtggtgacagtgacaggcctgatgaaccaggccagcaagcgggagaagtggatcaaggcagatgcccccaagggcaccgtgtccttccggcggcagagctggttccagagcctgaagctgcaggactag

SEQ ID NO: 38570 - DNA, 900 bp, Artificial Sequence
  Description of Artificial Sequence: Synthetic coding sequence
atgttccgcacccccagccaggccaaccggctggccctggtgtctgccaacccagacctgcggctgctgtttgacctgcggcggcacagcggccaggtggactggccctggcaggtgaccctgcctgtggccgagggcgtggacacagctggcctggacatcaagagcagcggcagcggctgtgtgaaggtgcagagcattgaaggagacaactgcaagattgaaacagagcacggcaccagcatcctgcagagcgtgaagggccagaagctgcacgtgcagaccaagggcggcaaggtgatctgcctgggcaccgtgtatggcaacatcgacatccacgccagtgacaagtctgctgtgaccatcgacaagctgcagggcagctctgtgacagtgtccacagaagatggcctgctgaaggccaagtacctgtacacagagagcagcttcctgagcagcgctgctggggacatcaccctgggctctgtgcacggcaacatcaccctgcagagcaagatgggcaacatcaccgtggacagcagcagcggctgcctgaaggccagcaccaaccagggcgccattgatgtgtatgtgtcccagctgggcaaggtggagctgaagagccacaagggcagcatcatcgtgaaggtgcccagcagcctgcaggcccacctgcagctgagcggcaaggaggtggatgtgaacagcgaggtgcacgtgcaggagatggccgaggtgaggaaggatgatgtggtgacagtgacaggcctgatgaaccaggccagcaagcgggagaagtggatcaaggcagatgcccccaagggcacagagtggagccgcagccacatcctgctgagccaggccagccgctgcctggccgccagcaccttcagcccctag

SEQ ID NO: 38571 - DNA, 7056 bp, Artificial Sequence
  Description of Artificial Sequence: Synthetic coding sequence
atgttcttcaagatgaagaatgaaattgacaatgaccctgagagcgagaagtgcatcaaggacagcaccatcatgaggcgggagccccagaacatcctgagccccctgatgctgcccaacctggagatccccttctctgtgaaggacatcatcagccgcatcgagcgggcccagctgcaccgggcccgggaggacatcgacatgcagctgtctgagatcatgaacaacgtgcaccgcatcatgacccgctacaccctggtgttcaacagcagcagcgagagaaatgtgtccctgacagagcacaagaagaagcagaggaccaacttcctggagaagatggccacctacgccaagaccatcgagatccgggagaagaccctggccaacatcctggcctggctggaggagtggaatgatgtgctgtctgagatgaccctgatggatgtggatgagcaccaccactggatcgcccagatggagctgctgcctgacaccctgaaggccatcgagaacaacgtgaagatcctgagccgcttcagcaccagcttcctggatgagaagaagaagcagaagaagaagatcctgagccggggcaccctgtggaagtcctggaaggagagggtcatcaagaggcccagcacagcccgggccctgcggccagaccagatgatcagtgaccagctggccaccaacaccaaggtgtctgagatccagggcatgctgcaggagctgattggcaccaccatgttcagcaccctggagaacaatgccatcaagtacatcagcagcaccatcgtgaacctgagcacagccctgtccatgctgaatgatgagctgaagtgtgtgaacttccagagcagcacagtgtatgcccacgagaccagcgaggccgagaaggagctgagcctgaagatcatccgggacctgagcaatgaaaatgagatgctgcagcagaagctgcaggatgctgaggagaagtgtgagcagctgatccgcagcaagatcgtgattgagcagctgtatgccaagctgagcaccagcagcaccctgaaggtgctgcccggccccagcccccagagcagccgggccatcatcaaggtgggggacacagaggacaacatggacaacatcctggacaaggagctggagaacatcgtggatgaggtgcagaggaaggagaccaaggacagcggcatcaagtgggacagcaccatctcctacacagcccaggccgagaggaccccagacctgacagagctgcggcagcagcctgtggccagcgaggacatcagcgaggacagcaccaaggacaacgtgtccctgaagaagggggacttctaccaggaggatgaaacagatgagtaccagagctggaagaggagccacaagaaggccacctacgtgtatgagaccagcggccccaacctgagtgacaacaagagcggccagaaggtgtctgaggccaagcccagccagtactatgagctgcaggtgctgaagaagaagaggaaggagatgaagagcttcagcgaggacaagagcaagagccccacagaggccaagaggaagcacctgagcctgacagagaccaagagccagggcggcaagagcggcacctccatgatgatgctggagcagttcaggaaggtgaagcgggagagcccctttgacaagaggcccacagctgctgagatcaaggtggagcccaccacagagagcctggacaaggagggcaaaggagagatccgcagcctggtggagcccctgtccatgatccagtttgatgacacagctgagccccagaagggcaagatcaagggcaagaagcaccacatcagcagcggcaccatcaccagcaaggaggagaagacagaggagaaggaggagctgaccaagcaggtgaagagccaccagctggtgaagagcctgagccgggtggccaaggagaccagcgagagcaccagggtgctggagagcccagatggcaagtctgagcagagcaacctggaggagttccaggaggccatcatggccttcctgaagcagaagattgacaacatcggcaaggcctttgacaagaagacagtgcccaaggaggaggagctgctgaagagagctgaggccgagaagctgggcatcatcaaggccaagatggaggagtacttccagaaggtggccgagaccgtgaccaagatcctgaggaagtacaaggacaccaagaaggaggagcaggtgggggagaagcccatcaagcagaagaaggtggtgtccttcatgcctggcctgcacttccagaagagccccatcagcgccaagtctgagagcagcaccctgctgtcctatgagagcacagaccccgtcatcaacaacctgatccagatgatcctggccgagattgaaagtgagcgggacatccccaccgtgtccacagtgcagaaggaccacaaggagaaggagaagcagaggcaggagcagtacctgcaggagggccaggagcagatgagcggcatgagcctgaagcagcagctgctgggggagaggaacctgctgaaggagcactatgagaagatcagcgagaactgggaggagaagaaggcctggctgcagatgaaggagggcaagcaggagcagcagagccagaagcagtggcaggaggaggagatgtggaaggaggagcagaagcaggccacccccaagcaggccgagcaggaggagaagcagaagcagaggggccaggaggaggaggagctgcccaagagcagcctgcagaggctggaggagggcacccagaagatgaagacccagggcctgctgctggagaaggaaaatggccagatgaggcagatccagaaggaggccaagcacctgggcccccacagaagaagagagaagggcaaggagaagcagaagccagagcggggcctggaggacctggagcggcagatcaagaccaaggaccagatgcagatgaaggagacccagcccaaggagctggagaagatggtgatccagacccccatgaccctgagcccccgctggaagtctgtgctgaaggatgtgcagaggagctatgagggcaaggagttccagaggaacctgaagaccctggagaacctgcctgatgagaaggagcccatcagcatcaccccaccacccagcctgcagtacagcctgcccggggccctgcccatcagcggccagcccctgaccaagtgcatccacctgaccccccagcaggcccaggaggtgggcatcaccctgaccccccagcaggcccaggcccagggcatcaccctgaccctgcagcaggcccaggagctgggcatccccctgaccccccagcaggcccaggccctggagatcctcttcaccccccagcaggcccaggccctgggcatccccctgaccccccagcagacccaggtgcagggcatcaccctgaccccccagcaggaccaggcccctggcatcagcctgaccacccagcaggcccagaagctgggcatccccctgaccccccagcaggcccaggccctgggcatccccctgaccccccagcaggcccaggagctgggcatccccctgaccccccagcaggcccaggccctgcgggtgtccctgaccccccagcaggcccaggagctgggcatccccctgaccccccagcaggcccaggccctgggcatcaccctgaccctgcagcaggcccagcagctgggcatccccctgaccccccagcaggcccaggccctgggcatcaccctgacccccaagcaggtgcaggagctgggcatccccctgaccccccagcaggcccaggccctgggcatcaccctgacccccaagcaggcccaggagctgggcatccccctgaacccccagcaggcccagaccctgggcatccccctgacccccaagcaggcccaggccctgggcatccccttcaccccccagcaggcccaggccctgggcatccccctgaccccccagcaggcccagacccaggagatcaccctgaccccccagcaggcccaggccctgggcatgcccctgaccacccagcaggcccaggagctgggcatccccctgaccccccagcacgcccaggccctgggcatgcccctgaccacccagcaggcccaggagctgggcatccccctgaccccccagcaggcccaggccctgggcatgcccctgaccacccagcaggcccaggagctgggcatccccctgaccccccagcaggcccaggagctgggcatccccttcaccccccagcaggcccaggcccaggagatcaccctgaccccccagcaggcccaggccctgggcatgcccctgacagcccagcaggcccaggagctgggcatcaccctgaccccccagcaggcccaggagctgggcatccccctgaccccccagcaggcccaggccctgggcatccccctcatccccccccaggcccaggagctgggcatccccctgaccccccagcaggcccaggccctgggcatcctgctgatccccccccaggcccaggagctgggcatccccctgaccccccagcaggcccaggccctgggcatccccctcatccccccccaggcccaggagctgggcatccccctgaccccccagcaggtgcaggccctgggcatccccctcatccccccccaggcccaggagctggagatccccctgaccccccagcaggcccaggccctgggcatccccctgaccccccagcaggcccaggagctgggcatccccctgaccccccagcaggcccaggagctgggcatccccctgaccccccagcaggcccaggcccagggcatccccctgaccccccagcaggcccaggccctgggcatcagcctgaccccccagcaggcccaggcccagggcatcaccctgaccccccagcaggcccaggccctgggcgtgcccatcacccctgtgaatgcctgggtgtctgctgtgaccctgaccagcgagcagacccacgccctggagagccccatgaacctggagcaggcccaggagcagctgctgaagctgggcgtgcccctgaccctggacaaggcccacaccctgggcagccccctgaccctgaagcaggtgcagtggagccaccggcccttccagaagagcaaggccagcctgcccaccggccagagcatcatcagccggctgagccccagcctgcggctgagcctggccagcagcgcccccacagctgagaagagcagcatctttggagtgagcagcacccccctgcagatcagccgggtgcccctgaaccagggcccctttgcccctgggaagcccctggagatgggcatcctgtctgagcccgggaagctgggcgccccccagaccctgcggagcagcggccagaccctggtgtatggaggccagagcaccagcgcccagtttcctgccccccaggccccacccagccctggccagctgcccatcagccgggccccacccaccccaggccagcccttcatcgccggcgtgccccccaccagcggccagatccccagcctgtgggcccccctgagccctggccagcccctggtgcctgaggccagcagcatccctggggacctgctggagagcggccccctgaccttcagcgagcagctgcaggagttccagcccccagccacagctgagcagagcccctacctgcaggcccccagcaccccaggccagcacctggccacctggaccctgcccggccgggccagcagcctgtggatcccccccaccagccgccacccccccaccctgtggcccagccctgcccctgggaagccccagaagtcctggagccccagcgtggccaagaagaggctggccatcatcagcagcctgaagagcaagtctgtgctgatccaccccagcgccccagacttcaaggtggcccaggtgcccttcaccaccaagaagttccagatgtctgaggtgtctgacaccagcgaggagacccagatcctgcgggacacctttgccatcgagagcttccgcaccttccagagccacttcaccaagtaccgcacccctgtgtaccagaccccctacacagatgagcgggccctgctgaccctgatgaagcccaccaccagccccagcagcctgaccaccctgctgcggaccagccagatcagccccctggagtggtaccagaagagccgcttcccccccatcgacaagccctggatcctgagctctgtgtctgacaccaagaagcccaaggtgatggtgccccccagcagcccccaggagctggaggagaagcgctactttgtggatgtggaggcccagaagaagaacctgatcctgctgaaccaggccatcaagacctgtggcctgcccagccagctgcacaccatggcccggaccctcatcatcgagatcctgcacatggacacagtgcagctgggctacctgttcaggaagtacatcgcctaccgcctcatccagcacgccaggaacaacatcatgaagaggctgaaggccatccagaacacaggcaagggctatgaggccaggaacctgcacatgatgctgagccggctggatgattatggcaagaaggtgatgcaggtgtggacagagaagcagaagagcctgggccagaagaggaaccagtgcctgaagaagatgatccacgtgttcaaccagctgaagaagatccacgagctgaacctgagccagcccatccccctcatcatcgaggagaagcagatcccagccagcaccacctttgtgcagaagcccttcctgaagctgctgatggaggaggacaggaccagtgacatctgcaagaagttccggcagcaggaggaccagacagaggccatctggaatgtggacctgagcaccagcagctaccccatcgccgagaagacctccatgcacagcctgtgggcccagctgggcggctacccagacatcccccggctgctgcagctggaggtgcagagcaccttcaggaagagcctggccagcctgcagagccgggtgaagaagatccccaagtag

SEQ ID NO: 38572 - DNA, 1080 bp, Artificial Sequence
  Description of Artificial Sequence: Synthetic coding sequence
atgtctgaggtgtctgacaccagcgaggagacccagatcctgcgggacacctttgccatcgagagcttccgcaccttccagagccacttcaccaagtaccgcacccctgtgtaccagaccccctacacagatgagcgggccctgctgaccctgatgaagcccaccaccagccccagcagcctgaccaccctgctgcggaccagccagatcagccccctggagtggtaccagaagagccgcttcccccccatcgacaagccctggatcctgagctctgtgtctgacaccaagaagcccaaggtgatggtgccccccagcagcccccaggagctggaggagaagcgctactttgtggatgtggaggcccagaagaagaacctgatcctgctgaaccaggccatcaagacctgtggcctgcccagccagctgcacaccatggcccggaccctcatcatcgagatcctgcacatggacacagtgcagctgggctacctgttcaggaagtacatcgcctaccgcctcatccagcacgccaggaacaacatcatgaagaggctgaaggccatccagaacacaggcaagggctatgaggccaggaacctgcacatgatgctgagccggctggatgattatggcaagaaggtgatgcaggtgtggacagagaagcagaagagcctgggccagaagaggaaccagtgcctgaagaagatgattcatgtgttcaaccagctgaagaagatccacgagctgaacctgagccagcccatccccctcatcatcgaggagaagcagatcccagccagcaccacctttgtgcagaagcccttcctgaagctgctgatggaggaggacaggaccagtgacatctgcaagaagttccggcagcaggaggaccagacagaggccatctggaatgtggacctgagcaccagcagctaccccatcgccgagaagacctccatgcacagcctgtgggcccagctgggcggctacccagacatcccccggctgctgcagctggaggtgcagagcaccttcaggaagagcctggccagcctgcagagccgcagcagcggctag

SEQ ID NO: 38573 - DNA, 2682 bp, Artificial Sequence
  Description of Artificial Sequence: Synthetic coding sequence
atggagaaggatgaccccccccagctggtgacccccacctctgtgaaggccatcatcctgcgcatcgaggccgcccagctgacccgggcccaggaggacatcagcacccagctgagtgacatcctggacaacgtgaactgtgtgatcaaccgcttccaggaggagctgggctatgacctgaaggaaaatgccaagagccagcagagggaccccaagggcaagaagcgcttcatcctgctggagaagatcgccagcttcagcaaggatgccatgatgaaggagaagcacctgtatgacatcctgcgctggctgggggactggggagacaccctgacctatgaaattggccccaggaagtctgaggaggaggccgccgccctggatgagtggattgaggtgacagagaaggtgctgcccctgagcctgattgccaccaagaggggcatcgagagcctgacagccctgtgcagcaccctcatcgagggccagaagaagaggagccaggtgtccaagaggaccttctggcagggctggcagggccgcagcccccagaccagccccagccacccccagcccctgagccctgagcagatgctgcaggaccagcacaccatgaacaccaaggccagcgaggtgacctccatgctgcaggagctgctggacagcaccatgttcagcaaaggagaggtgcgggccatccgctacatggccaccgtggtggagaacctgaacaaggccctgatcctgcagcacaaggaaaatagaagcctggagaccaagtaccgccacctgcagatgcaggccaccaaggagctgagcagccagaggctgcacttccagcagttcatggaggtgctggagagcagaagagatgccctgctgaagcaggtggagatcctgggcggccgctaccatgacctgctgctgatgaagcaggccctggagttccagctgaagaaggcccagaatgccaccggccaggccgaggacctggccgaggtgtctgtggacagccctggccccagcgagcgggagaccctgcccaggaaggagaccgtgatggaggagagccagcaggagcccatgaaggaggagcagctgttcagccccctgccccccagccccatggccatgatccgggacagcggggccatcgctgctggccaccagcccctgagcaccatgacagtgcgcagccgggtggctgatgtgtttggcagcaaggacacagagagcctggagcctgtgctgctgcccctggtggaccggcgcttccccaagaagtgggagaggcctgtggccgagagcctgggccacaaggacaaggaccaggaggactacttccagaagggcggcctgcagatcaagttccactgcagcaagcagctgagcctggagagcagccggcaggtgaccagcgagagccaggaggagccctgggaggaggagtttggccgggagatgaggcggcagctgtggctggaggaggaggagatgtggcagcagaggcagaagaagtgggccctgctggagcaggagcaccaggagaagctgcggcagtggaacctggaggacctggcccgggagcagcagaggcgctgggtgcagctggagaaggagcaggagagcccccggcgggagcctgagcagctgggagaagatgtggagcggcgcatcttcacccccaccagccgctggagggacctggagaaggccgagctgagcctggtgcctgcccccagcaggacccagagcgcccaccagagccggcggccccacctgcccatgagccccagcacccagcagcctgccctgggcaagcagaggcccatgagctctgtggagttcacctaccggcccaggaccaggagagtgcccaccaagcccaagaagagcgccagcttccctgtgacaggcaccagcatccggcggctgacctggcccagcctgcagatcagccctgccaacatcaagaagaaggtgtaccacatggacatggaggcccagaggaagaacctgcagctgctgtctgaggagagcgagctgcggctgccccactacctgcggagcaaggccctggagctgaccaccaccaccatggagctgggcgccctgcggctgcagtacctgtgccacaagtacatcttctaccgccgcctgcagagcctgcggcaggaggccatcaaccacgtgcagatcatgaaggagacagaggccagctacaaggcccagaacctgtacatcttcctggagaacatcgaccggctgcagagcctgcggctgcaggcctggacagacaagcagaagggcctggaggagaagcacagagaatgtctgagctccatggtgaccatgttccccaagctgcagctggagtggaatgtgcacctgaacatccctgaggtgaccagccccaagcccaagaagtgcaagctgcctgctgccagccccaggcacatccggcccagcggccccacctacaagcagcccttcctgagccgccaccgggcctgtgtgcccctgcagatggcccggcagcagggcaagcagatggaggccgtgtggaagacagaggtggccagcagcagctatgccatcgagaagaagaccccagccagcctgccccgggaccagctgcggggccacccagacatcccccggctgctgaccctggatgtgtag

SEQ ID NO: 38574 - DNA, 1521 bp, Artificial Sequence
  Description of Artificial Sequence: Synthetic coding sequence
ggccaccagcccctgagcaccatgacagtgcgcagccgggtggctgatgtgtttggcagcaaggacacagagagcctggagcctgtgctgctgcccctggtggaccggcgcttccccaagaagtgggagaggcctgtggccgagagcctgggccacaaggacaaggaccaggaggactacttccagaagggcggcctgcagatcaagttccactgcagcaagcagctgagcctggagagcagccggcaggtgaccagcgagagccaggaggagccctgggaggaggagtttggccgggagatgaggcggcagctgtggctggaggaggaggagatgtggcagcagaggcagaagaagtgggccctgctggagcaggagcaccaggagaagctgcggcagtggaacctggaggacctggcccgggagcagcagaggcgctgggtgcagctggagaaggagcaggagagcccccggcgggagcctgagcagctgggggaggatgtggagcggcgcatcttcacccccaccagccgctggagggacctggagaaggccgagctgagcctggtgcctgcccccagcaggacccagagcgcccaccagagcagaagaccccacctgcccatgagccccagcacccagcagcctgccctgggcaagcagaggcccatgagctctgtggagttcacctaccggcccaggacccggcgggtgcccaccaagcccaagaagagcgccagcttccctgtgacaggcaccagcatccggcggctgacctggcccagcctgcagatcagccctgccaacatcaagaagaaggtgtaccacatggacatggaggcccagaggaagaacctgcagctgctgtctgaggagagcgagctgcggctgccccactacctgcggagcaaggccctggagctgaccaccaccaccatggagctgggcgccctgcggctgcagtacctgtgccacaagtacatcttctacagaaggctgcagagcctgcggcaggaggccatcaaccacgtgcagatcatgaaggagacagaggccagctacaaggcccagaacctgtacatcttcctggagaacatcgaccggctgcagagcctgcggctgcaggcctggacagacaagcagaagggcctggaggagaagcaccgggagtgcctgagctccatggtgaccatgttccccaagctgcagctggagtggaatgtgcacctgaacatccctgaggtgaccagccccaagcccaagaagtgcaagctgcctgctgccagccccaggcacatccggcccagcggccccacctacaagcagcccttcctgagccgccaccgggcctgtgtgcccctgcagatggcccggcagcagggcaagcagatggaggccgtgtggaagacagaggtggccagcagcagctatgccatcgagaagaagaccccagccagcctgccccgggaccagctgcggggccacccagacatcccccggctgctgaccctggatgtgtag

SEQ ID NO: 38575 - DNA, 2346 bp, Artificial Sequence
  Description of Artificial Sequence: Synthetic coding sequence
atgatgaaggagaagcacctgtatgacatcctgcgctggctgggggactggggagacaccctgacctatgaaattggccccaggaagtctgaggaggaggccgccgccctggatgagtggattgaggtgacagagaaggtgctgcccctgagcctgattgccaccaagaggggcatcgagagcctgacagccctgtgcagcaccctcatcgagggccagaagaagaggagccaggtgtccaagaggaccttctggcagggctggcagggccgcagcccccagaccagccccagccacccccagcccctgagccctgagcagatgctgcaggaccagcacaccatgaacaccaaggccagcgaggtgacctccatgctgcaggagctgctggacagcaccatgttcagcaaaggagaggtgcgggccatccgctacatggccaccgtggtggagaacctgaacaaggccctgatcctgcagcacaaggaaaatagaagcctggagaccaagtaccgccacctgcagatgcaggccaccaaggagctgagcagccagaggctgcacttccagcagttcatggaggtgctggagagcagaagagatgccctgctgaagcaggtggagatcctgggcggccgctaccatgacctgctgctgatgaagcaggccctggagttccagctgaagaaggcccagaatgccaccggccaggccgaggacctggccgaggtgtctgtggacagccctggccccagcgagcgggagaccctgcccaggaaggagaccgtgatggaggagagccagcaggagcccatgaaggaggagcagctgttcagccccctgccccccagccccatggccatgatccgggacagcggggccatcgctgctggccaccagcccctgagcaccatgacagtgcgcagccgggtggctgatgtgtttggcagcaaggacacagagagcctggagcctgtgctgctgcccctggtggaccggcgcttccccaagaagtgggagaggcctgtggccgagagcctgggccacaaggacaaggaccaggaggactacttccagaagggcggcctgcagatcaagttccactgcagcaagcagctgagcctggagagcagccggcaggtgaccagcgagagccaggaggagccctgggaggaggagtttggccgggagatgaggcggcagctgtggctggaggaggaggagatgtggcagcagaggcagaagaagtgggccctgctggagcaggagcaccaggagaagctgcggcagtggaacctggaggacctggcccgggagcagcagaggcgctgggtgcagctggagaaggagcaggagagcccccggcgggagcctgagcagctgggagaagatgtggagcggcgcatcttcacccccaccagccgctggagggacctggagaaggccgagctgagcctggtgcctgcccccagcaggacccagagcgcccaccagagccggcggccccacctgcccatgagccccagcacccagcagcctgccctgggcaagcagaggcccatgagctctgtggagttcacctaccggcccaggaccaggagagtgcccaccaagcccaagaagagcgccagcttccctgtgacaggcaccagcatccggcggctgacctggcccagcctgcagatcagccctgccaacatcaagaagaaggtgtaccacatggacatggaggcccagaggaagaacctgcagctgctgtctgaggagagcgagctgcggctgccccactacctgcggagcaaggccctggagctgaccaccaccaccatggagctgggcgccctgcggctgcagtacctgtgccacaagtacatcttctaccgccgcctgcagagcctgcggcaggaggccatcaaccacgtgcagatcatgaaggagacagaggccagctacaaggcccagaacctgtacatcttcctggagaacatcgaccggctgcagagcctgcggctgcaggcctggacagacaagcagaagggcctggaggagaagcacagagaatgtctgagctccatggtgaccatgttccccaagctgcagctggagtggaatgtgcacctgaacatccctgaggtgaccagccccaagcccaagaagtgcaagctgcctgctgccagccccaggcacatccggcccagcggccccacctacaagcagcccttcctgagccgccaccgggcctgtgtgcccctgcagatggcccggctgctggccctgtgcctgcggggcctggtggccgagctggccctggtgatggaggactttgacctgctgcacgtgctgtag

SEQ ID NO: 38576 - DNA, 354 bp, Artificial Sequence
  Description of Artificial Sequence: Synthetic coding sequence
tgatgcctgagctccatggtgaccatgttccccaagctgcagctggagtggaatgtgcacctgaacatccctgaggtgaccagccccaagcccaagaagtgcaagctgcctgctgccagccccaggcacatccggcccagcggccccacctacaagcagcccttcctgagccgccaccgggcctgtgtgcccctgcagatggcccggcagcagggcaagcagatggaggccgtgtggaagacagaggtggccagcagcagctatgccatcgagaagaagaccccagccagcctgccccgggaccagctgcggggccacccagacatcccccggctgctgaccctggatgtgtag

SEQ ID NO: 38577 - DNA, 1242 bp, Artificial Sequence
  Description of Artificial Sequence: Synthetic coding sequence
atgcacctggccctgaccaccgtgctgctgtgggcctggggcctgcaggcctttgagatcgtggagaaggagaacatcttccagaggaccccctgcccagccttcctgatgtttgaaaatgctgcctacctggccgacatgagctttgagctgccctgccactgcaagccagaggaggtgcctgctgtggtgtggttctaccagaagcacctgggcagcagccacaccaaggtgctgacagactttgatggccgggtgctgacagaggccgcccaggtgcgggtgggcagtgacatgctgacccgcttcagcatccgcatgttcagcctgctggtgttccgggcccagagcgaggacagcggcctgtacttctgtggcaccaggaaaggagactacttctacgcctatgatgtggacatccagaacagcgagggcatggtggccaccttccaggacaagggccaggagccctttgctgatgagtactacggccacctgcacgtgttcaccaccttctgggagtggaccccctgtgacagatgtggggtgcggggggagcagtggagaattggcctgtgctacctgcagagcccagacctgagcccccgctacctgaaggctgtgcctgatgtggtgtcctgtggcagcagagctgtgcccaggaagctgcggaccaaggcccgggaccacaccccagaggtgctggtgcgcagctgcctggtgccctgtgagaagaccaagaccatccgggagggcgtgctggccatcatcaactacgtgtccaaggtgggcagccggccctgggtgccccaggtgcccatccagttccaccagcagaggctgggccacggcctcatcatcagctgccctggggcccggcctgagcacgctgtggcctgggacaaggaccggcagcacctgtaccgcacccagtacctgaagggcgtgaacagatccatgagggtcttcatcgaccacggcaaccagctgcacatccgcttcacccagctggatgaccggggcatctactactgctggaggcagggcgtgctggtggccggcttccggctgggcgtgaccagccacggccactacccagccagcttcagtgaccctgagaccaggtctgctgtggagctgaccctgattggctacctgctgatcacagctgtgtttgtgaccatccacttctgccgctgctgctgctacctgttccactgctgccccagcttcagcccctag

SEQ ID NO: 38578 - DNA, 1242 bp, Artificial Sequence; identical to SEQ ID NO: 38577
  Description of Artificial Sequence: Synthetic coding sequence

SEQ ID NO: 38579 - DNA, 2274 bp, Artificial Sequence
  Description of Artificial Sequence: Synthetic coding sequence
atggacagcctgtttgtggaggaggtggccgccagcctggtgcgggagttcctgagcaggaagggcctgaagaagacctgtgtgaccatggaccaggagcggcccaggagtgacctgagcatcaacaacagaaatgacctgaggaaggtgctgcacctggagttcctgtacaaggagaacaaggccaaggagaaccccctgaagaccagcctggagctgatcacccgctacttcctggaccacttcggcaacacagccaacaacttcacccaggacacccccatcccagccctgtctgtgcccaagaagaacaacaaggtgcccagccgctgcagcgagaccaccctggtgaacatctatgacctgagtgatgaagatgctggctggaggaccagcctgtctgagaccagcaaggcccggcatgacaacctggatggagatgtgctgggcaactttgtgagcagcaagaggcctccccacaagagcaagcccatgcagacagtgcctggagagacccctgtgctgaccagcgcctgggagaagattgacaagctgcacagcgagcccagcctggatgtgaagaggatgggagagaacagccggcccaagagcggcctgattgtgcggggcatgatgagcggccccatcgccagcagcccccaggacagcttccaccgccactacctgcggcgcagcagccccagcagcagcagcacccagccccaggaggagagcaggaaggtgcctgagctgtttgtgtgcacccagcaggacatcctggccagcagcaacagcagccccagcaggaccagcctgggccagctgtctgagctgactgtggagcggcagaagaccacagccagcagccccccccacctgcccagcaagaggctgcccccctgggaccgggcccggccccgggaccccagcgaggacaccccagctgtggatggcagcacagacacagacaggatgcccctgaagctgtacctgcccggcggcaacagcaggatgacccaggagcggctggagcgggccttcaagaggcagggcagccagcctgcccctgtgaggaagaaccagctgctgcccagcgacaaggtggatggagagctgggcgccctgcggctggaggatgtggaggatgagctgatccgggaggaggtgatcctgagccctgtgcccagcgtgctgaagctgcagacagccagcaagcccatcgacctgtctgtggccaaggagatcaagaccctgctgtttggcagcagcttctgctgcttcaatgaggagtggaagctgcagagcttctccttcagcaacacagccagcctgaagtatggcatcgtgcagaacaagggcggcccctgtggggtgctggccgctgtgcagggctgtgtgctgcagaagctgctgtttgaaggagacagcaaggctgactgtgcccagggcctgcagcccagtgatgcccacaggacccgctgcctggtgctggccctggccgacatcgtgtggagggctgggggccgggagagagctgtggtggccctggccagcaggacccagcagttcagccccaccgggaagtacaaggcagatggagtgctggagaccctgaccctgcacagcctgacctgctatgaggacctggtgaccttcctgcagcagagcatccaccagtttgaggtgggcccctacggctgcatcctgctgaccctgagcgccatcctgagccgcagcacagagctgatccggcaggactttgatgtgcccaccagccacctgattggagcccacggctactgcacccaggagctggtgaacctgctgctgaccgggaaggctgtgtccaatgtgttcaatgatgtggtggagctggacagcggagatggcaacatcaccctgctgcggggcattgctgcccggagtgacatcggcttcctgagcctgtttgagcactacaacatgtgccaggtgggctgcttcctgaagaccccccgcttccccatctgggtggtgtgcagcgagagccacttcagcatcctcttcagcctgcagcccggcctgctgcgggactggaggacagagcggctgtttgacctgtactactatgatggcctggccaaccagcaggagcagatccggctgaccatcgacaccacccagaccatcagcgaggacacagacaatgacctggtgccccccctggagctgtgcatccgcaccaagtggaagggggcctctgtgaactggaatggaagtgaccccatcctgtag

SEQ ID NO: 38580 - DNA, 1953 bp, Artificial Sequence
  Description of Artificial Sequence: Synthetic coding sequence
atgatgcccagccccagcgacagcagccgcagcctgaccagccggcccagcacccggggcctgacccacctgcggctgcaccggccctggctgcaggccctgctgaccctgggcctggtgcaggtgctgctgggcatcctggtggtgaccttctccatggtggccagctctgtgaccaccacagagagcatcaagaggagctgccccagctgggccggcttcagcatctccttcttcagcctgctgtctgtgctgtgtgtgatgctgtccatggccggctctgtgctgagctgcaagaatgcccagctggcccgggacttccagcagtgcagcctggagggcaaggtgtgtgtgtgctgccccagcgtgcccctgctgcggccctgcccagagagcggccaggagctgaaggtggcccccaacagcacctgtgatgaggcccggggggccctgaagaacctgctcttctctgtgtgtggcctgaccatctgtgccgccatcatctgcaccctgagcgccatcgtgtgctgcatccagatcttcagcctggacctggtgcacacccagctggcccctgagaggtctgtgtctggccccctgggccccctgggctgcaccagccccccaccagcccccctgctgcacaccatgctggacctggaggagtttgtgccccctgtgcccccaccaccctactacccacctgagtacacctgcagcagcgagacagatgcccagagcatcacctacaacggctccatggacagccctgtgcccctgtaccccacagactgcccccccagctatgaagctgtgatgggcctgcggggggacagccaggccaccctgtttgacccccagctgcatgatggcagctgcatctgtgagcgggtggccagcatcgtggatgtgtccatggacagcggcagcctggtgctgagcgccatcggggacctgcccggcggcagcagccccagcgaggacagctgcctgctggagctgcagggctctgtgcgctctgtggactatgtgctcttccgcagcatccagaggagccgggccggctactgcctgagcctggactgtggcctgcggggcccctttgaggagagccccctgcccaggaggcctccccgggccgcccggagctacagctgcagcgcccctgaggcccccccacccctgggcgcccccacagctgcccggagctgccaccggctggagggctggccaccctgggtgggcccctgcttccctgagctgcggaggagagtgccccggggcggcggccggcctgctgctgccccacccacccgggcccccacccggcgcttcagtgacagcagcggcagcctgaccccacctggccacaggcctccccacccagccagccccccacccctgctgctgcccaggagccacagcgaccccggcatcaccaccagcagtgacacagctgacttccgggacctgtacaccaaggtgctggaggaggaggccgcctctgtgtcctctgctgacaccggcctgtgcagcgaggcctgcctcttccggctggcccgctgccccagccccaagctgctgcgggcccggtctgctgagaagaggaggcctgtgcccaccttccagaaggtgcccctgcccagcggccctgccccagcccacagcctgggggacctgaagggctcctggccaggccggggcctggtgacccgcttcctgcagatcagcaggaaggccccagaccccagcggcaccggggcccacggccacaagcaggtgcccaggagcctgtggggccggcccggccgggagagcctgcacctgcggagctgtggggacctgagcagcagcagcagcctgcggcggctgctgagcggccggcggctggagcggggcacccggccccacagcctgagcctgaatggaggcagccgggagaccggcctgtag

SEQ ID NO: 38581 - DNA, 2703 bp, Artificial Sequence
  Description of Artificial Sequence: Synthetic coding sequence
atgggagacagcggcagcagaagaagcaccctggtgtcccggctgcccatcttcagaagaagcatcaacagaagacatgacagcctgcccagcagccccagcagcagcaacacagtgggcgtgcacagcagcagccccagcagcaccaacagcagcagcggcagcacaggcaagagaagaagcatcttccgcacccccagcatctccttccaccacaagaagggcagcgagcccaagcaggagcccaccaaccagaacctgagcatcagcaatggagcccagcccggccacagcaacatgcagaagctgagcctggaggagcacatcaagacccggggccgccacagcgtgggcttcagcagcagcaggaacaagaagatcaccaggagcctgacagaagattttgagcgggagaaggagcacagcaccaacaagaatgtgttcatcaactgcctgagcagcggcaagtcagaaggagatgacagcggcttcacagaggaccagacccggcgctctgtgaagcagagcaccaggaagctgctgcccaagagcttcagcagccactacaagttcagcaagcctgtgctgcagagccagagcatcagcctggtgcagcagagcgagttcagcctggaggtgacccagtaccaggagcgggagcctgtgctggtgcgggccagccccagctgcagcgtggatgtgacagagcgggccggcagcagcctgcagagccccctgctgtctgctgacctgaccacagcccagacccccagcgagttcctggccctgacagaagattctgtgtctgagatggatgccttcagcaagagcggctccatggccagccactgtgacaactttggccacaatgacagcaccagccagatgagcctgaacagcgctgctgtgaccaagaccaccacagagctgactggaacagtgccctgtgccatcatgagccctgggaagtaccgcctggagggccagtgcagcacagagagcaacagcctgcctgagaccagcgctgccaaccagaaggaggtgctgctgcagattgctgagctgcctgccacctctgtgagccacagcgagagcaacctgcctgctgacagcgagcgggaggagaacatcggcctgcagaatggagagaccatgctgggcaccaacagccccaggaagctgggcttctatgagcagcacaaggccatcgccgagcacgtgaagggcatccaccccatcagtgacagcaagatcatccccaccagcggggaccaccacatcttcaacaagaccagccacggctatgaggccaacccagccaaggtgctggccagcagcctgagccccttccgggagggccgcttcatcgagcggcggctgcggagcagcagcgagggcacagctggcagcagcaggatgatcctgaagcccaaggatggcaacatcgaggaggtgaacagcctgaggaagcagagagctggcagcagcagcagcaagatgaacagcctggatgtgctgaacaacctgggcagctgtgagctggatgaagatgacctgatgctggacctggagttcctggaggagcagagcctgcaccccagcgtgtgccgggaggacagctaccacagcgtggtgtcctgtgccgctgtggtgctgacccccatggagcccatgattgagatgaagaagcgggaggagcctgagttccctgagcccagcaagcagaacctgagcctgaagctgaccaaggatgtggaccaggaggcccgctgcagccacatcagcaggatgcccaacagccccagcgctgactggcccctgcagggcgtggaggagaatggaggcatcgacagcctgcccttccggctgatgctgcaggactgcacagctgtgaagaccctgctgctgaagatgaagagggtgctgcaggagagcgctgacatgagccctgccagcagcaccaccagcctgcctgtgagccccctgacagaggagcctgtgcccttcaaggacatcatgaaggatgagtgcagcatgctgaagctgcagctgaaggagaaggatgagctgatcagccagctgcaggaggagctgggcaaggtgcgccacctgcagaaggcctttgccagccgggtggacaagagcacccagacagagctgctgtgctatgatggcctgaacctgaagaggctggagaccgtgcagggcggccgggaggccacctacagaaaccgcatcgtgtcccagaacctgagcacccgggacaggaaggccatccacacccccacagaggaccgcttccgctacagcgctgctgaccagaccagcccctacaagaacaagacctgccagctgcccagcctgtgcctgagcaacttcctgaaggacaaggagctggccgaggtgatcaagcacagccggggcacctatgagaccctgaccagtgatgtgacccagaacctgcgggccaccgtgggccagagcagcctgaagcccacagccaagacagagggcctgagcaccttcctggagaagcccaaggaccaggtggccacagcccggcagcacagcaccttcaccggccgcttcggccagcccccccggggccccatcagcctgcacatgtacagcaggaagaatgtgttcctgcaccacaacctgcacagcacagagctgcagaccctgggccagcaggatggatag

SEQ ID NO: 38582 - DNA, 2034 bp, Artificial Sequence
  Description of Artificial Sequence: Synthetic coding sequence
atgggagacagcggcagcagaagaagcaccctggtgtcccggctgcccatcttcagaagaagcatcaacagaagacatgacagcctgcccagcagccccagcagcagcaacacagtgggcgtgcacagcagcagccccagcagcaccaacagcagcagcggcagcacaggcaagagaagaagcatcttccgcacccccagcatctccttccaccacaagaagggcagcgagcccaagcaggagcccaccaaccagaacctgagcatcagcaatggagcccagcccggccacagcaacatgcagaagctgagcctggaggagcacatcaagacccggggccgccacagcgtgggcttcagcagcagcaggaacaagaagatcaccaggagcctgacagaagattttgagcgggagaaggagcacagcaccaacaagaatgtgttcatcaactgcctgagcagcggcaagtcagaaggagatgacagcggcttcacagaggaccagacccggcgctctgtgaagcagagcaccaggaagctgctgcccaagagcttcagcagccactacaagttcagcaagcctgtgctgcagagccagagcatcagcctggtgcagcagagcgagttcagcctggaggtgacccagtaccaggagcgggagcctgtgctggtgcgggccagccccagctgcagcgtggatgtgacagagcgggccggcagcagcctgcagagccccctgctgtctgctgacctgaccacagcccagacccccagcgagttcctggccctgacagaagattctgtgtctgagatggatgccttcagcaagagcggctccatggccagccactgtgacaactttggccacaatgacagcaccagccagatgagcctgaacagcgctgctgtgaccaagaccaccacagagctgactggaacagtgccctgtgccatcatgagccctgggaagtaccgcctggagggccagtgcagcacagagagcaacagcctgcctgagaccagcgctgccaaccagaaggaggtgctgctgcagattgctgagctgcctgccacctctgtgagccacagcgagagcaacctgcctgctgacagcgagcgggaggagaacatcggcctgcagaatggagagaccatgctgggcaccaacagccccaggaagctgggcttctatgagcagcacaaggccatcgccgagcacgtgaagggcatccaccccatcagtgacagcaagatcatccccaccagcggggaccaccacatcttcaacaagaccagccacggctatgaggccaacccagccaaggtgctggccagcagcctgagccccttccgggagggccgcttcatcgagcggcggctgcggagcagcagcgagggcacagctggcagcagcaggatgatcctgaagcccaaggatggcaacatcgaggaggtgaacagcctgaggaagcagagagctggcagcagcagcagcaagatgaacagcctggatgtgctgaacaacctgggcagctgtgagctggatgaagatgacctgatgctggacctggagttcctggaggagcagagcctgcaccccagcgtgtgccgggaggacagctaccacagcgtggtgtcctgtgccgctgtggtgctgacccccatggagcccatgattgagatgaagaagcgggaggagcctgagttccctgagcccagcaagcagaacctgagcctgaagctgaccaaggatgtggaccaggaggcccgctgcagccacatcagcaggatgcccaacagccccagcgctgactggcccctgcagggcgtggaggagaatggaggcatcgacagcctgcccttccggctgatgctgcaggactgcacagctgtgaagaccctgctgctgaagatgaagagggtgctgcaggagagcgctgacatgagccctgccagcagcaccaccagcctgcctgtgagccccctgacagaggagcctgtgcccttcaagaccacctacccccgggagttctag

SEQ ID NO: 38583 - DNA, 2034 bp, Artificial Sequence
  Description of Artificial Sequence: Synthetic coding sequence
atgggagacagcggcagcagaagaagcaccctggtgtcccggctgcccatcttcagaagaagcatcaacagaagacatgacagcctgcccagcagccccagcagcagcaacacagtgggcgtgcacagcagcagccccagcagcaccaacagcagcagcggcagcacaggcaagagaagaagcatcttccgcacccccagcatctccttccaccacaagaagggcagcgagcccaagcaggagcccaccaaccagaacctgagcatcagcaatggagcccagcccggccacagcaacatgcagaagctgagcctggaggagcacatcaagacccggggccgccacagcgtgggcttcagcagcagcaggaacaagaagatcaccaggagcctgacagaagattttgagcgggagaaggagcacagcaccaacaagaatgtgttcatcaactgcctgagcagcggcaagtcagaaggagatgacagcggcttcacagaggaccagacccggcgctctgtgaagcagagcaccaggaagctgctgcccaagagcttcagcagccactacaagttcagcaagcctgtgctgcagagccagagcatcagcctggtgcagcagagcgagttcagcctggaggtgacccagtaccaggagcgggagcctgtgctggtgcgggccagccccagctgcagcgtggatgtgacagagcgggccggcagcagcctgcagagccccctgctgtctgctgacctgaccacagcccagacccccagcgagttcctggccctgacagaagattctgtgtctgagatggatgccttcagcaagagcggctccatggccagccactgtgacaactttggccacaatgacagcaccagccagatgagcctgaacagcgctgctgtgaccaagaccaccacagagctgactggaacagtgccctgtgccatcatgagccctgggaagtaccgcctggagggccagtgcagcacagagagcaacagcctgcctgagaccagcgctgccaaccagaaggaggtgctgctgcagattgctgagctgcctgccacctctgtgagccacagcgagagcaacctgcctgctgacagcgagcgggaggagaacatcggcctgcagaatggagagaccatgctgggcaccaacagccccaggaagctgggcttctatgagcagcacaaggccatcgccgagcacgtgaagggcatccaccccatcagtgacagcaagatcatccccaccagcggggaccaccacatcttcaacaagaccagccacggctatgaggccaacccagccaaggtgctggccagcagcctgagccccttccgggagggccgcttcatcgagcggcggctgcggagcagcagcgagggcacagctggcagcagcaggatgatcctgaagcccaaggatggcaacatcgaggaggtgaacagcctgaggaagcagagagctggcagcagcagcagcaagatgaacagcctggatgtgctgaacaacctgggcagctgtgagctggatgaagatgacctgatgctggacctggagttcctggaggagcagagcctgcaccccagcgtgtgccgggaggacagctaccacagcgtggtgtcctgtgccgctgtggtgctgacccccatggagcccatgattgagatgaagaagcgggaggagcctgagttccctgagcccagcaagcagaacctgagcctgaagctgaccaaggatgtggaccaggaggcccgctgcagccacatcagcaggatgcccaacagccccagcgctgactggcccctgcagggcgtggaggagaatggaggcatcgacagcctgcccttccggctgatgctgcaggactgcacagctgtgaagaccctgctgctgaagatgaagagggtgctgcaggagagcgctgacatgagccctgccagcagcaccaccagcctgcctgtgagccccctgacagaggagcctgtgcccttcaaggactactacaagaggcccttctag

SEQ ID NO: 38584 - DNA, 2703 bp, Artificial Sequence; identical to SEQ ID NO: 38581
  Description of Artificial Sequence: Synthetic coding sequence

SEQ ID NO: 38585 - DNA, 10074 bp, Artificial Sequence
  Description of Artificial Sequence: Synthetic coding sequence
atgggccgccacgtggccaccagctgccacgtggcctggctgctggtgctgatcagcggctgctggggccaggtgaaccggctgcccttcttcaccaaccacttctttgacacctacctgctgatcagcgaggacacccctgtgggcagctctgtgacccagctgctggcccaggacatggacaatgaccccctggtgtttggagtgtctggagaggaggccagccgcttctttgctgtggagccagacaccggggtggtgtggctgcggcagcccctggaccgggagaccaagtctgagttcaccgtggagttctctgtgtctgaccaccagggcgtcatcaccaggaaggtgaacatccaggtgggagatgtgaatgacaatgcccccaccttccacaaccagccctacagcgtgcgcatccctgaggtgggcgccactggaaacacccctgtgggcacccccatcttcatcgtgaatgccacagatcctgacctgggcgctgggggctctgtgctgtacagcttccagccccccagccagttctttgccattgattctgcccggggcatcgtgaccgtcatccgggagctggactatgagaccacccaggcctaccagctgactgtgaatgccacagaccaggacaagacccggcccctgagcaccctggccaacctggccatcatcatcacagatgtgcaggacatggaccccatcttcatcaacctgccctacagcaccaacatctatgagcacagccccccaggcaccaccgtgcgcatcatcacagccatcgaccaggacaagggccggccccggggcatcggctacaccatcgtgtctggcaacaccaacagcatctttgccctggactacatctctggagtgctgaccctgaatggcctgctggaccgggagaaccccctgtacagccacggcttcatcctgactgtgaagggcacagagctgaatgatgacaggacccccagtgatgccaccgtgaccaccaccttcaacatcctggtgattgacatcaatgacaatgcccctgagttcaacagcagcgagtacagcgtggccatcacagagctggcccaggtgggctttgccctgcccctcttcatccaggtggtggacaaggatgagggcctgaacagcatgtttgaggtgtacctggtgggcaacaacagccaccacttcatcatcagccccacctctgtgcagggcaaggctgacatccgcatccgggtggccatccccctggactatgagaccgtggacagatatgactttgacctgtttgccaatgaatctgtgcctgaccacgtgggctacgccaaggtgaagatcaccctcatcaatgaaaatgacaaccggcccatcttcagccagcccctgtacaacatcagcctgtatgaaaatgtgacagtgggcacctctgtgctgactgtgctggccacagacaatgatgctggcacctttggagaggtgtcctacttcttcagtgatgatcctgaccgcttcagcctggacaaggacaccggcctcatcatgctgattgcccggctggactatgagctgatccagcgcttcaccctgaccatcatcgccagagatggcggcggggaggagaccaccggccgggtgcgcatcaacgtgctggatgtgaatgacaacgtgcccaccttccagaaggatgcctacgtgggcgccctgagagaaaatgagcccagcgtgacccagctggtgcggctgcgggccacagatgaggacagcccccccaacaaccagatcacctacagcatcgtgtctgccagcgccttcggcagctactttgacatcagcctgtatgagggctatggagtcatctctgtgtcccggcccctggactatgagcagatcagcaatggcctcatctacctgactgtgatggccatggatgctggcaacccccccctgaacagcacagtgcctgtgaccatcgaggtgtttgatgaaaatgacaacccccccaccttcagcaagccagcctactttgtgtctgtggtggagaacatcatggccggggccaccgtgctcttcctgaatgccacagacctggacaggagccgggagtatggccaggagagcatcatctacagcctggagggcagcacccagttccgcatcaatgcccggagcggggagatcaccaccaccagcctgctggaccgggagaccaagtctgagtacatcctgattgtgcgggctgtggatggaggagtgggccacaaccagaagacaggcatcgccaccgtgaacatcaccctgctggacatcaatgacaaccaccccacctggaaggatgccccctactacatcaacctggtggagatgaccccaccagacagtgatgtgaccaccgtggtggccgtggaccctgacctgggggagaatggcaccctggtgtacagcatccagccccccaacaagttctacagcctgaacagcaccaccgggaagatccgcaccacccacgccatgctggaccgggagaacccagacccccatgaagctgagctgatgaggaagatcgtggtgtctgtgacagactgtggccggccccccctgaaggccaccagcagcgccaccgtgtttgtgaacctgctggacctgaatgacaatgaccccaccttccagaacctgccctttgtggccgaggtgctggagggcatcccagctggggtgtccatctaccaggtggtggccatcgacctggatgagggcctgaatggcctggtgtcctacaggatgcctgtgggcatgcccaggatggacttcctgatcaacagcagcagtggagtggtggtgaccaccacagagctggaccgggagagaattgctgagtaccagctgcgggtggtggccagtgatgctggcacccccaccaagagcagcaccagcaccctgaccatccacgtgctggatgtgaatgatgagacccccaccttcttccctgctgtgtacaacgtgtctgtgtctgaagatgtgccccgggagttccgggtggtgtggctgaactgcacagacaatgatgtgggcctgaatgctgagctgagctacttcatcaccggcggcaatgtggatggcaagttctctgtgggctacagagatgctgtggtgaggacagtggtgggcctggaccgggagaccacagctgcctacatgctgatcctggaggccatcgacaatggacctgtgggcaagaggcacactggaacagccaccgtgtttgtgacagtgctggatgtgaatgacaaccggcccatcttcctgcagagcagctatgaggcctctgtgcctgaggacatccctgagggccacagcatcctgcagctgaaggccacagatgctgatgaaggagaatttggccgggtgtggtaccgcatcctgcacggcaaccacggcaacaacttccgcatccacgtgtccaatggcctgctgatgaggggcccccggcccctggaccgggagaggaacagcagccacgtgctgattgtggaggcctacaaccacgacctgggccccatgaggagctctgtgcgggtcatcgtgtatgtggaggacatcaatgatgaggcccctgtgttcacccagcagcagtacagccggctgggcctgcgggagacagctggcatcggcaccagcgtcatcgtggtgcaggccacagaccgggacagcggagatggcggcctggtgaactaccgcatcctgtctggagctgagggcaagtttgaaattgatgagagcacaggcctcatcatcaccgtgaactacctggactatgagaccaagaccagctacatgatgaatgtgtctgccacagaccaggccccacccttcaaccagggcttctgcagcgtgtacatcaccctgctgaatgagctggatgaagctgtgcagttcagcaatgccagctatgaagctgccatcctggagaacctggccctgggcacagaaattgtgcgggtgcaggcctacagcattgacaacctgaaccagatcacctaccgcttcaatgcctacaccagcacccaggccaaggccctcttcaagattgatgccatcactggagtcatcaccgtgcagggcctggtggaccgggagaagggggacttctacaccctgactgtggtggctgatgatggcggccccaaggtggacagcacagtgaaggtgtacatcaccgtgctggatgaaaatgacaacagccccaggtttgacttcaccagtgacagcgctgtgtccatccctgaggactgccctgtgggccagagggtggccaccgtgaaggcctgggaccctgatgctggcagcaatggccaggtggtgttcagcctggccagcggcaacattgctggggcctttgagatcgtgaccaccaatgacagcattggagaggtgtttgtggcccggcccctggaccgggaggagctggaccactacatcctgcaggtggtggccagtgaccggggcaccccacccaggaagaaggaccacatcctgcaggtgaccatcctggacatcaatgacaacccccctgtgattgagagccccttcggctacaacgtgtctgtgaatgaaaatgtgggcggcggcacagctgtggtgcaggtgcgggccacagaccgggacatcggcatcaacagcgtgctgagctactacatcacagagggcaacaaggacatggccttcaggatggaccgcatctctggagagatcgccaccaggcctgcccccccagaccgggagcggcagagcttctaccacctggtggccaccgtggaggatgagggcacccccaccctgagcgccaccacccacgtgtatgtgaccatcgtggatgaaaatgacaatgcccccatgttccagcagccccactatgaggtgctgctggatgagggccctgacaccctgaacaccagcctcatcaccatccaggccctggacctggatgagggccccaacggcaccgtgacctacgccatcgtggccggcaacatcgtgaacaccttcagaattgacagacacatgggcgtcatcacagctgccaaggagctggactatgagatcagccacggccgctacaccctgattgtgacagccacagaccagtgccccatcctgagccaccggctgaccagcaccaccaccgtgctggtgaatgtgaatgacatcaatgacaacgtgcccaccttcccccgggactatgagggcccctttgaggtgacagagggccagcccggcccccgggtgtggaccttcctggcccatgaccgggacagcggccccaacggccaggtggagtacagcatcatggatggagaccccctgggggagtttgtgatcagccctgtggagggcgtgctgcgggtgaggaaggatgtggagctggaccgggagaccatcgccttctacaacctgaccatctgtgcccgggaccggggcatgccacccctgagcagcaccatgctggtgggcatccgggtgctggacatcaatgacaatgaccctgtgctgctgaacctgcccatgaacatcaccatcagcgagaacagccctgtgtcctcctttgtggcccacgtgctggccagtgatgctgacagcggctgcaatgcccggctgaccttcaacatcacagctggcaaccgggagcgggccttcttcatcaatgccaccaccggcatcgtgacagtgaaccggcccctggaccgggagcgcatccctgagtacaagctgaccatctctgtgaaggacaaccctgagaacccccgcatcgcccggcgggactatgacctgctgctgatcttcctgagtgatgaaaatgacaaccaccccctcttcaccaagagcacctaccaggccgaggtgatggagaacagccctgctggcacccccctgactgtgctgaatggccccatcctggccctggatgctgaccaggacatctatgctgtggtgacctaccagctgctgggcgcccagagcggcctgtttgacatcaacagcagcactggagtggtgacagtgcgcagcggggtcatcatcgaccgggaggccttcagcccccccatcctggagctgctgctgctggctgaagatattggcctgctgaacagcacagcccacctgctgatcaccatcctggatgacaatgacaaccggcccaccttcagccctgccaccctgactgtgcacctgctggagaactgccccccaggcttctctgtgctgcaggtgacagccacagatgaagattctggcctgaatggagagctggtgtacagaattgaagctggggcccaggaccgcttcctgatccacctggtgactggagtcatccgggtgggcaatgccaccatcgaccgggaggagcaggagagctaccgcctgactgtggtggccacagaccggggcaccgtgcccctgagcggcacagccatcgtgaccatcctgattgatgacatcaatgacagcaggcctgagttcctgaaccccatccagacagtgtctgtgctggagagcgctgagcccggcaccgtcatcgccaacatcacagccatcgaccatgacctgaaccccaagctggagtaccacatcgtgggcatcgtggccaaggatgacacagaccggctggtgcccaaccaggaggatgcctttgctgtgaacatcaacacaggctctgtgatggtgaagagccccatgaaccgggagctggtggccacctatgaggtgaccctgagcgtcatcgacaatgccagtgacctgcctgagaggtctgtgtctgtgcccaatgccaagctgactgtgaatgtgctggatgtgaatgacaacaccccccagttcaagcccttcggcatcacctactacatggagcgcatcctggagggcgccaccccaggcaccaccctgattgctgtggccgctgtggaccctgacaagggcctgaatggcctggtgacctacaccctgctggacctggtgcccccaggctacgtgcagctggaggacagcagcgctgggaaggtgattgccaacagaacagtggactatgaggaggtgcactggctgaacttcaccgtgcgggccagtgacaatggcagcccccccagggctgctgagatccctgtgtacctggagatcgtggacatcaatgacaacaaccccatctttgaccagcccagctaccaggaggccgtgtttgaagatgtgcctgtgggcaccatcatcctgactgtgacagccacagatgctgacagcggcaactttgccctgattgagtacagcctgggagatggagagagcaagtttgccatcaaccccaccactggagacatctacgtgctgagcagcctggaccgggagaagaaggaccactacatcctgacagccctggccaaggacaaccctggagatgtggccagcaacagaagagaaaattctgtgcaggtggtgatccaggtgctggatgtgaatgactgccggccccagttcagcaagccccagttcagcacctctgtgtatgaaaatgaacctgctggcaccagcgtcatcaccatgatggccacagaccaggatgagggccccaacggggagctgacctacagcctggagggccctggggtggaggccttccacgtggacatggattctggcctggtgaccacccagaggcccctgcagagctatgagaagttcagcctgactgtggtggccacagatggaggagagccccccctgtggggcaccaccatgctgctggtggaggtgattgatgtgaatgacaacagacctgtgtttgtgcggcccccaaatggcaccatcctgcacatccgggaggagatccccctgcggagcaatgtgtatgaggtgtatgccacagacaaggatgagggcctgaatggagctgtgcgctacagcttcctgaagacagctggcaacagagactgggagttcttcatcatcgaccccatcagcggcctcatccagacagcccagaggctggaccgggagagccaggccgtgtacagcctcatcctggtggccagtgacctgggccagcctgtgccctatgagaccatgcagcccctgcaggtggccctggaggacattgatgacaatgagcccctgtttgtgcggccccccaagggcagcccccagtaccagctgctgactgtgcctgagcacagcccccggggcaccctggtgggcaatgtgactggagctgtggatgctgatgagggccccaatgccatcgtgtactacttcatcgctgctggaaatgaggagaagaacttccacctgcagccagatggctgcctgctggtgctgcgggacctggaccgggagcgggaggccatcttctccttcatcgtgaaggccagcagcaacagatcctggaccccaccccggggccccagccccaccctggacctggtggccgacctgaccctgcaggaggtgcgggtggtgctggaggacatcaatgaccagcccccacgcttcaccaaggccgagtacacagctggggtggccacagatgccaaggtgggcagcgagctgatccaggtgctggccctggatgctgacatcggcaacaacagcctggtgttctacagcatcctggccatccactacttccgggccctggccaatgattctgaagatgtgggccaggtgttcaccatgggctccatggatggcatcctgcggacctttgacctcttcatggcctacagccctggctactttgtggtggacatcgtggcccgggacctggccggccacaatgacacagccatcatcggcatctacatcctgagagatgaccagagggtgaagatcgtcatcaatgagatcccagacagagtgcggggctttgaggaggagttcatccacctgctgagcaacatcaccggggccatcgtgaacacagacaacgtgcagttccacgtggacaagaagggccgggtgaactttgcccagacagagctgctgattcatgtggtgaacagagacaccaaccgcatcctggatgtggacagagtcatccagatgattgatgagaacaaggagcagctgaggaacctcttcaggaactacaacgtgctggatgtgcagcctgccatctctgtgcggctgcctgatgacatgtctgccctgcagatggccatcatcgtgctggccatcctgctcttcctggccgccatgctgtttgtgctgatgaactggtactacagaacagtgcacaagaggaagctgaaggccatcgtggccggcagcgctggcaacagaggcttcatcgacatcatggacatgcccaacaccaacaagtacagctttgatggagccaaccctgtgtggctggaccccttctgcaggaacctggagctggccgcccaggccgagcatgaagatgacctgcctgagaacctgtctgaaattgctgacctgtggaacagccccaccaggacccacggcaccttcggccgggagcctgctgctgtgaagccagatgatgaccgctacctgcgggccgccatccaggagtatgacaacatcgccaagctgggccagatcatccgggagggccccatcaagggcagcctgctgaaggtggtgctggaggactacctgcggctgaagaagctgtttgcccagaggatggtgcagaaggccagcagctgccacagcagcatcagcgagctgatccagacagagctggatgaggagcccggggaccacagccctggccagggcagcctgcgcttccgccacaagccccctgtggagctgaagggcccagatggcatccacgtggtgcacggcagcacaggcaccctgctggccacagacctgaacagcctgcctgaggaggaccagaagggcctgggccgcagcctggagaccctgacagctgctgaggccacagcctttgaaagaaatgccaggacagagagcgccaagagcacccccctgcacaagctgagagatgtgatcatggagacccccctggagatcacagagctgtag

SEQ ID NO: 38586 - DNA, 3144 bp, Artificial Sequence
  Description of Artificial Sequence: Synthetic coding sequence
atggaggagaagacccagatcaagaccttcctgggcagcaagctgcccaagtatggcaccaagtctgtgcgcagcaccctgcagcccatgcccaacggcacccctgtgaacctgctgggcaccagcaagaacagcaatgtgaagagctacatcaagaacaacggcagtgactgccccagcagccacagcttcaactggaggaaggccaacaagtaccagctgtgtgcccagggcgtggaggagcccaacaacacccagaacagccatgacaagatcattgatcctgagaagagggtgcccacccagggcatgtttgacaagaatggcatcaagggcggcctgaagtctgtgtccctcttcaccagcaagctggccaagcccagcaccatgtttgtgagcagcacagaggagctgaaccagaagagcttcagcggccccagcaacctgggcaagttcaccaagggcaccctgctgggccgcaccagctacagcagcatcaacacccccaagagccagctgaatggcttctacggcaacagatctgctggctccatgcagaggccccgggccaacagctgtgccaccaggagcagcagtggagagagcctggcccagagcccagacagcagcaagagcatcaactgtgagaagatggtgcgcagccagagcttcagccacagcatccagaacagcttcctgccccccagcagcatcaccaggagccacagcttcaacagagctgtggacctgaccaagccctaccagaaccagcagctgagcatccgggtgcccctgcggagctccatgctgaccaggaacagccggcagcctgaggtgctgaatggaaatgagcacctgggctacggcttcaaccggccctatgctgctgggggcaagaagctggccctgcccaatggacctggggtgaccagcaccctgggctacaggatggtgcaccccagcctgctgaagagcagccgcagccccttcagcggcaccatgacagtggatggcaacaagaacagccctgctgacacctgtgtggaggaggatgccaccgtgctggccaaggaccgggccgccaacaaggaccaggagctgattgaaaatgaaagctaccgcaccaagaacaaccagaccatgaagcatgatgccaagatgagatacctgagtgatgatgtggatgacatcagcctgagcagcctgagcagcagtgacaagaatgacctgtctgaggacttcagtgatgacttcattgatattgaggacagcaacagaacccgcatcaccccagaggagatgagcctgaaggaggagaagcatgaaaatggaccaccccaggacatgtttgacagccccaaggaaaatgagaaggccttcagcaagacagatgagtggattgacatctctgtgtctgacagaagtgagtgcaccaagcacaccagcggcaacaacctggtgtccccagacacagactacagagctggcagcagctttgagctgagccccagcgacagcagtgatggcacctacatgtgggatgaggagggcctggagcccatcggaaatgtgcaccctgtgggcagctatgagagcagcgagatgaacagcattgacatcctgaacaacctggagagctgtgacctggaggatgatgacctgatgctggatgtggacctgcctgaagatgcccccctggagaatgtggagtgtgacaacatgaacagatttgacagaccagacagaaatgtgcggcagccccaggagggcttctggaagaggcctccccagcgctggagcggccaggagcactaccacctgagccacccagaccactaccaccaccacggcaagagtgacctgagccggggcagcccctaccgggagagccccctgggccactttgagagctatggaggcatgcccttcttccaggcccagaagatgtttgtggatgtgcctgaaaatacagtcatcctggatgagatgaccctgcggcacatggtgcaggactgcacagctgtgaagacccagctgctgaagctgaagaggctgctgcaccagcatgatggcagcggcagcctgcatgacatccagctgagcctgcccagcagccctgagccagaagatggagacaaggtgtacaagaatgaagacctgctgaatgagatcaagcagctgaaggatgagatcaagaagaaggatgagaagatccagctgctggagctgcagctggccacccagcacatctgccaccagaagtgcaaggaggagaagtgcacctatgctgacaagtacacccagaccccctggaggcgcatccccccccaggtgctgcagcccagcagcagcctgccccggcccacagaccacacccagggcaagctgatcaagccccagagaattgaggcccggagtgaatgttccatccaggacatgcaccagggcggggcccaccctgaggagagcttcacccacgtgctgcaccaggagagcaactacggcctggaggagcagcccttcagcagcggcccccagctgaccatggatgtggccaagagcaccccatctgaggccaacctgaacatcaccgtgaatgcccaggagccctaccacctggccaacaaccagatcagtgacatgcagttcatccccaccagcctgcagaccccacctgagagcagcacagtggaccaggccaagagggtgggcaggaaccagagcccccctgtgggctacatgagccagcccaagagcctgcagctgctgaagcccagcatcctgagcagcctggtgcccccacctgtgtctgagagcagccccagcaggacccccacctgcaagaagagccccatcatcaccacctgcaacagcgccaagctgcagcccaccagcagccagaccaacctggccaacaaccagaacctgaaggccagcaagctgcggcccccatctggcagcttcaagcagaagcagaccaacagcccccagctggagccccagagcttccaggccaagaccagcatcccccggcccctgacccagaggaaggagatcatgcagaaccccaacggcaacctgcacagcggggactgcctggccagcaaccgctacagccggctgcccaagcccaagatccactag

SEQ ID NO: 38587 - DNA, 786 bp, Artificial Sequence
  Description of Artificial Sequence: Synthetic coding sequence
atgaacagatttgacagaccagacagaaatgtgcggcagccccaggagggcttctggaagaggcctccccagcgctggagcggccaggagcactaccacctgagccacccagaccactaccaccaccacggcaagagtgacctgagccggggcagcccctaccgggagagccccctgggccactttgagagctatggaggcatgcccttcttccaggcccagaagatgtttgtggatgtgcctgagaacacagtcatcctggatgagatgaccctgcggcacatggtgcaggactgcacagctgtgaagacccagctgctgaagctgaagaggctgctgcaccagcatgatggcagcggcagcctgcatgacatccagctgagcctgcccagcagccctgagccagaagatggagacaaggtgtacaagaatgaagacctgctgaatgagatcaagcagctgaaggatgagatcaagaagaaggatgagaagatccagctgctggagctgcagctggccacccagcacatctgccaccagaagtgcaaggaggagaagtgcacctacgccgacaagtacacccagaccccctggaggcgcatccctgggggctacagcgcccccagcttcagcccctggcagggcagcttccagggcatccccaggacagtgcccccccaccggcggcagaccagcagcaccacagccttccagcagcccagccagacccacaggagccaccctgggaagaccaacaaggccaccacctaccggggcccccagtag

SEQ ID NO: 38588 - DNA, 3741 bp, Artificial Sequence
  Description of Artificial Sequence: Synthetic coding sequence
atgaaggtgcggctgctgcggcagctgtctgctgctgccaaggtgaaggcccccagcggcctgcagggccccccccaggcccaccagttcatcagcctgctgctggaggagtatggagccctgtgccaggccgcccggagcatcagcaccttcctgggcaccctggagaatgagcacctgaagaagttccaggtgacctgggagctgcacaacaagcacctgtttgagaacctggtgttttctgagcccctgctgcagagcaacctgcctgccctggtgtcccagatccggctgggcaccaccacccatgacacctgcagcgaggacacctacagcaccctgctgcagcgctaccagaggtctgaggaggagctgcggcgggtggccgaggagtggctggagtgccagaagagaattgatgcctacgtggatgagcaggacctgcagacctctgtgaacaagagcattgacaccggcaccctggtgcagagctggctgcggggagctgccatgaccatgaagaccaagcagaggatgctgacagaggactgggagctgttcaagcagaggcgcttcatcgaggagcagctgaccaacaagaaggctgtgactggagagaacaacttcacagacaccatgaggcacatgctgagcagccggctgtccatgccagactgccccaactgcaactacagaagaagatgtgcctgtgatgactgcagcctgagccacatcctgacctgtggcatcatggacccccctgtgacagatgacatccacatccaccagctgcccctgcaggtggaccctgccccagactacctggccgagaggagcccccccagcgtgtcctctgccagcagcggcagcggcagcagcagccccatcaccatccagcagcaccccaggctcatcctgacagattctggcagcgcccccacctttgatgatgaagatgtggcccccctgagcgccaagtttgctgacatctaccccctgagcaactatgatgacacagaggtggtggccaacatgaatggcatccacagcgagctgaatggaggaggagagaacatggccctgaaggatgagagcccccagatcagcagcaccagcagcagcagcagcgaggctgatgatgaggaggctgatggagagagcagcggggagcccccaggggcccccaaggaggatggagtgctgggcagccgcagccccaggacagaggagagcaaggctgacagccccccacccagctaccccacccagcaggccgagcaggcccccaacacctgtgaatgtcatgtgtgcaagcaggaggccagcggcctgaccccatctgccatgacagctggggccctgcccccaggccaccagttcctgagccctgagaagcccacccacccagccctgcacctgtacccccacatccacggccacgtgcccctgcacacagtgccccacctgccccggcccctcatccaccccaccctgtatgccaccccacccttcacccacagcaaggccctgcccccagcccctgtgcagaaccacaccaacaagcaccaggtgttcaatgccagcctgcaggaccacatctaccccagctgcttcggcaacaccccagagtggaacagcagcaagttcatcagcctgtggggcagcgaggtgatgaatgacaagaactggaaccctggcaccttcctgcctgacaccatcagcggcagcgagatcctgggccccaccctgtctgagaccaggcctgaggccctgcccccacccagcagcaatgagaccccagctgtgtctgacagcaaggagaagaagaatgctgccaagaagaagtgcctgtacaacttccaggatgccttcatggaggccaacaaggtggtgatggccaccagcagcgccaccagctctgtgtcctgcacagccaccaccgtgcagagcagcaacagccagttccgggtgagcagcaagaggcctcccagcgtgggagatgtgttccacggcatcagcaaagaagaccaccgccacagcgccccagctgcccccaggaacagccccaccggcctggcccccctgcctgccctgagccctgctgccctgagccctgctgccctgagccctgccagcaccccccacctggccaacctggccgcccccagcttccccaagacagccaccaccaccccaggctttgtggacaccaggaagagcttctgcccagcccccctgcccccagccacagatggcagcatcagcgcccctccttctgtgtgcagcgaccctgactgtgagggccaccgctgtgaaaatggagtgtatgacccccagcaggatgatggagatgagagcgcagatgaggacagctgcagcgagcacagcagcagcaccagcaccagcaccaaccagaaggagggcaagtactgtgactgctgctactgtgagttctttggacatggaggccccccagctgcccccaccagcagaaattatgcagagatgagggagaagctgcggctgcggctgaccaagaggaaggaggagcagcccaagaagatggaccagatcagcgagcgggagagcgtggtggaccaccggcgggtggaggacctgctgcagttcatcaacagcagcgagaccaagcctgtgagcagcacccgggccgccaagagggcccggcacaagcagaggaagctggaggagaaggcccggctggaggccgaggcccgggcccgggagcacctgcacctgcaggaggagcagaggagaagagaggaggaggaggatgaggaggaggaggaggaccgcttcaaggaggagttccagaggctgcaggagctgcagaagctgcgggctgtgaagaagaagaagaaggagcggcccagcaaggactgccccaagctggacatgctgaccaggaacttccaggccgccacagaatctgtgcccaacagcggcaacatccacaacggcagcctggagcagacagaggagcctgagaccagcagccacagccccagccgccacatgaaccacagcgagcccaggcctggcctgggcgcagatggagatgctgctgaccctgtggacacccgggacagcaagttcctgctgcccaaggaggtgaatggcaagcagcacgagcccctgtccttcttctttgacatcatgcagcaccacaaggagggcaatggcaagcagaagctgcggcagaccagcaaggccagcagcgagcccgcccggcggcccacagagccccccaaggccacagagggccagagcaagccccgggcccagacagagagcaaggccaaggtggtggacctgatgagcatcacagagcagaagcgggaggagaggaaggtgaacagcaacaacaacaacaagaagcagctgaaccacatcaaggatgagaagagcaaccccacccccatggagcccaccagccctggagagcaccagcagaacagcaagctggtgctggccgagagcccccagcccaagggcaagaacaagaagaacaagaagaagaagggggacagagtgaacaacagcattgatgatgtgttcctgcccaaggacatcgacctggacagcgtggacatggatgaaacagagcgggaggtggagtacttcaagcgcttctgcctggacagcgcccggcagacccggcagaggctgagcatcaactggagcaacttcagcctgaagaaggccacctttgctgcccactag

SEQ ID NO: 38589 - DNA, 3636 bp, Artificial Sequence
  Description of Artificial Sequence: Synthetic coding sequence
atgaaggtgcggctgctgcggcagctgtctgctgctgccaaggtgaaggcccccagcggcctgcagggccccccccaggcccaccagttcatcagcctgctgctggaggagtatggagccctgtgccaggccgcccggagcatcagcaccttcctgggcaccctggagaatgagcacctgaagaagttccaggtgacctgggagctgcacaacaagcacctgtttgagaacctggtgttttctgagcccctgctgcagagcaacctgcctgccctggtgtcccagatccggctgggcaccaccacccatgacacctgcagcgaggacacctacagcaccctgctgcagcgctaccagaggtctgaggaggagctgcggcgggtggccgaggagtggctggagtgccagaagagaattgatgcctacgtggatgagcagatgaccatgaagaccaagcagaggatgctgacagaggactgggagctgttcaagcagaggcgcttcatcgaggagcagctgaccaacaagaaggctgtgactggagagaacaacttcacagacaccatgaggcacatgctgagcagccggctgtccatgccagactgccccaactgcaactacagaagaagatgtgcctgtgatgactgcagcctgagccacatcctgacctgtggcatcatggacccccctgtgacagatgacatccacatccaccagctgcccctgcaggtggaccctgccccagactacctggccgagaggagcccccccagcgtgtcctctgccagcagcggcagcggcagcagcagccccatcaccatccagcagcaccccaggctcatcctgacagattctggcagcgcccccaccttctgcagtgatgatgaagatgtggcccccctgagcgccaagtttgctgacatctaccccctgagcaactatgatgacacagaggtggtggccaacatgaatggcatccacagcgagctgaatggaggaggagagaacatggccctgaaggatgagagcccccagatcagcagcaccagcagcagcagcagcgaggctgatgatgaggaggctgatggagagagcagcggggagcccccaggggcccccaaggaggatggagtgctgggcagccgcagccccaggacagaggagagcaaggctgacagccccccacccagctaccccacccagcaggccgagcaggcccccaacacctgtgaatgtcatgtgtgcaagcaggaggccagcggcctgaccccatctgccatgacagctggggccctgcccccaggccaccagttcctgagccctgagaagcccacccacccagccctgcacctgtacccccacatccacggccacgtgcccctgcacacagtgccccacctgccccggcccctcatccaccccaccctgtatgccaccccacccttcacccacagcaaggccctgcccccagcccctgtgcagaaccacaccaacaagcaccaggtgttcaatgccagcctgcaggaccacatctaccccagctgcttcggcaacaccccagagtggaacagcagcaagttcatcagcctgtggggcagcgaggtgatgaatgacaagaactggaaccctggcaccttcctgcctgacaccatcagcggcagcgagatcctgggccccaccctgtctgagaccaggcctgaggccctgcccccacccagcagcaatgagaccccagctgtgtctgacagcaaggagaagaagaatgctgccaagaagaagtgcctgtacaacttccaggatgccttcatggaggccaacaaggtggtgatggccaccagcagcgccaccagctctgtgtcctgcacagccaccaccgtgcagagcagcaacagccagttccgggtgagcagcaagaggcctcccagcgtgggagatgtgttccacggcatcagcaaagaagaccaccgccacagcgccccagctgcccccaggaacagccccaccggcctggcccccctgcctgccctgagccctgctgccctgagccctgctgccctgagccctgccagcaccccccacctggccaacctggccgcccccagcttccccaagacagccaccaccaccccaggctttgtggacaccaggaagagcttctgcccagcccccctgcccccagccacagatggcagcatcagcgcccctccttctgtgtgcagcgaccctgactgtgagggccaccgctgtgaaaatggagtgtatgacccccagcaggatgatggagatgagagcgcagatgaggacagctgcagcgagcacagcagcagcaccagcaccagcaccaaccagaaggagggcaagtactgtgactgctgctactgtgagttctttggacatggaggccccccagctgcccccaccagcagaaattatgcagagatgagggagaagctgcggctgcggctgaccaagaggaaggaggagcagcccaagaagatggaccagatcagcgagcgggagagcgtggtggaccaccggcgggtggaggacctgctgcagttcatcaacagcagcgagaccaagcctgtgagcagcacccgggccgccaagagggcccggcacaagcagaggaagctggaggagaaggcccggctggaggccgaggcccgggcccgggagcacctgcacctgcaggaggagcagaggagaagagaggaggaggaggatgaggaggaggaggaggaccgcttcaaggaggagttccagaggctgcaggagctgcagaagctgcgggctgtgaagaagaagaagaaggagcggcccagcaaggactgccccaagctggacatgctgaccaggaacttccaggccgccacagaatctgtgcccaacagcggcaacatccacaacggcagcctggagcagacagaggagcctgagaccagcagccacagccccagccgccacatgaaccacagcgagcccaggcctggcctgggcgcagatggagatgctgctgaccctgtggacacccgggacagcaagttcctgctgcccaaggaggtgaatggcaagcagcacgagcccctgtccttcttctttgacatcatgcagcaccacaaggagggcaatggcaagcagaagctgcggcagaccagcaaggccagcagcgagcccgcccggcggcccacagagccccccaaggccacagagggccagagcaagccccgggcccagacagagagcaaggccaaggtggtggacctgatgagcatcacagagcagaagcgggaggagaggaaggtgaacagcaacaacaacaacaagaagcagctgaaccacatcaaggatgagaagagcaaccccacccccatggagcccaccagccctggagagcaccagcagaacagcaagctggtgctggccgagagcccccagcccaagggcaagaacaagaagaacaagaagaagaagggggacagagtgaacaacagcattgatgatgtgttcctgcccaaggacatcgacctggacagcgtggacatggatgaaacagagcgggaggtggagtacttcaagagagatggagtgagcccccactgccccggctggagcaggaccccaggcctgaagtag

SEQ ID NO: 38590 - DNA, 2469 bp, Artificial Sequence
  Description of Artificial Sequence: Synthetic coding sequence
atgacccggcggcgcagccggcccagcggcggggccggccggcgggagcgggcccgggctgctggcccccagaagccccaggcccctgagcccccacctccacccagcctggaggccggggccggggccggccccccagaggccccagctgagccagaccatgatggccccagagaagatgatgagcccaacctggtgcccggcccccaggtgcccccagccagcagccagcctgtgcagacctgctgcctgctgtgccaccgggagaggaagggctgggaggagggccccagccagaatggcctggtgctgcagggcgagaagctgcccccagacttcatgcccaagctggtgaagaacctgctgggggagatgcccctgtgggtgtgccagagctgcaggaagtccatggaggaggatgagcggcagacaggccgggagcacgctgtggccatcagcctgagccacaccagctgcaagagccagagctgtggagatgacagccacagcagcagcagcagcagcagcagcagcagcagcagcagcagcagcagctgccccggcaacagcggggactgggaccccagcagcttcctgagcgcccacaagctgagcggcctgtggaacagcccccacagcagcggggccatgcctggcagcagcctgggcagcccccccaccatccctggagaggccttccctgtgtctgagcaccaccagcacagcgacctgacagccccacccaacagccccaccggccaccacccccagcctgccagcctcatccccagccaccccagcagctttggcagccccccccacccccacctgctgcccaccaccccagctgcccccttccctgcccaggccagcgagtgccctgtggccgccgccacagccccccacaccccaggcccctgccagagcagccacctgcccagcacctccatgcccctgctgaagatgcccccacccttcagcggctgcagccacccctgcagcggccactgcggcggccactgcagcggccccctgctgcccccacccagcagccagcccctgcccagcacccaccgggaccccggctgcaagggccacaagtttgcccacagcggcctggcctgccagctgccccagccctgtgaggctgatgagggcctgggggaggaggaggacagcagcagcgagaggagcagctgcaccagcagcagcacccaccagagagatggcaagttctgtgactgctgctactgtgagttcttcggccacaatgctgagaaggagaaggcccagctggccgctgaggccctgaagcaggccaacagagtgtctggcagccgggagcccaggcctgcccgggagcggctgctggagtggccagaccgggagctggacagagtgaacagcttcctgagcagccggctgcaggagatcaagaacacagtgaaggacagcatccgggccagcttctctgtgtgtgagctgtccatggacagcaatggcttcagcaaggagggcgctgctgagcctgagccccagagcctgccccccagcaacctgagcggcagcagcgagcagcagcctgacatcaacctggacctgagccccctgaccctgggcagcccccagaaccacaccctgcaggcccctggagagcccgccccaccctgggccgagatgaggggcccccaccccccctggacagaggtgcggggccccccacctggcatcgtgcctgaaaatggcctggtgcggcggctgaacacagtgcccaacctgagcagggtcatctgggtgaagacccccaagccaggctaccccagcagcgaggagcccagcagcaaggaggtgcccagctgcaagcaggagctgcctgagcctgtgagcagcggcggcaagccccagaagggcaagaggcagggcagccaggccaagaagtctgaggccagccctgccccccggcccccagccagcctggaggtgcccagcgccaagggccaggtggccggccccaagcagcccggccgggtgctggagctgcccaaggtgggcagctgtgccgaggccggggagggcagccggggcagccggcccggccctggctgggccggcagccccaagacagagaaggagaagggcagctcctggaggaactggccaggagaggccaaggcccggccccaggagcaggagagcgtgcagcccagcggccctgcccggccccagagcctgccccagggcaagggccgcagccgccgcagcaggaacaagcaggagaagccagccagcagcctggatgatgtgttcctgcccaaggacatggatggagtggagatggatgaaacagaccgggaggtggagtacttcaagcgcttctgcctggacagcgccaagcagacccggcagaaggtggccgtgaactggaccaacttcagcctgaagaagaccacccccagcacagcccagtag

SEQ ID NO: 38591 - DNA, 3798 bp, Artificial Sequence
  Description of Artificial Sequence: Synthetic coding sequence
atgaaggtgcggctgctgcggcagctgtctgctgctgccaaggtgaaggcccccagcggcctgcagggccccccccaggcccaccagttcatcagcctgctgctggaggagtatggagccctgtgccaggccgcccggagcatcagcaccttcctgggcaccctggagaatgagcacctgaagaagttccaggtgacctgggagctgcacaacaagcacctgtttgagaacctggtgttttctgagcccctgctgcagagcaacctgcctgccctggtgtcccagatccggctgggcaccaccacccatgacacctgcagcgaggacacctacagcaccctgctgcagcgctaccagaggtctgaggaggagctgcggcgggtggccgaggagtggctggagtgccagaagagaattgatgcctacgtggatgagcagatgaccatgaagaccaagcagaggatgctgacagaggactgggagctgttcaagcagaggcgcttcatcgaggagcagctgaccaacaagaaggctgtgactggagagaacaacttcacagacaccatgaggcacatgctgagcagccggctgtccatgccagactgccccaactgcaactacagaagaagatgtgcctgtgatgactgcagcctgagccacatcctgacctgtggcatcatggacccccctgtgacagatgacatccacatccaccagctgcccctgcaggtggaccctgccccagactacctggccgagaggagcccccccagcgtgtcctctgccagcagcggcagcggcagcagcagccccatcaccatccagcagcaccccaggctcatcctgacagattctggcagcgcccccaccttctgcagtgatgatgaagatgtggcccccctgagcgccaagtttgctgacatctaccccctgagcaactatgatgacacagaggtggtggccaacatgaatggcatccacagcgagctgaatggaggaggagagaacatggccctgaaggatgagagcccccagatcagcagcaccagcagcagcagcagcgaggctgatgatgaggaggctgatggagagagcagcggggagcccccaggggcccccaaggaggatggagtgctgggcagccgcagccccaggacagaggagagcaaggctgacagccccccacccagctaccccacccagcaggccgagcaggcccccaacacctgtgaatgtcatgtgtgcaagcaggaggccagcggcctgaccccatctgccatgacagctggggccctgcccccaggccaccagttcctgagccctgagaagcccacccacccagccctgcacctgtacccccacatccacggccacgtgcccctgcacacagtgccccacctgccccggcccctcatccaccccaccctgtatgccaccccacccttcacccacagcaaggccctgcccccagcccctgtgcagaaccacaccaacaagcaccaggtgttcaatgccagcctgcaggaccacatctaccccagctgcttcggcaacaccccagagtggaacagcagcaagttcatcagcctgtggggcagcgaggtgatgaatgacaagaactggaaccctggcaccttcctgcctgacaccatcagcggcagcgagatcctgggccccaccctgtctgagaccaggcctgaggccctgcccccacccagcagcaatgagaccccagctgtgtctgacagcaaggagaagaagaatgctgccaagaagaagtgcctgtacaacttccaggatgccttcatggaggccaacaaggtggtgatggccaccagcagcgccaccagctctgtgtcctgcacagccaccaccgtgcagagcagcaacagccagttccgggtgagcagcaagaggcctcccagcgtgggagatgtgttccacggcatcagcaaagaagaccaccgccacagcgccccagctgcccccaggaacagccccaccggcctggcccccctgcctgccctgagccctgctgccctgagccctgctgccctgagccctgccagcaccccccacctggccaacctggccgcccccagcttccccaagacagccaccaccaccccaggctttgtggacaccaggaagagcttctgcccagcccccctgcccccagccacagatggcagcatcagcgcccctccttctgtgtgcagcgaccctgactgtgagggccaccgctgtgaaaatggagtgtatgacccccagcaggatgatggagatgagagcgcagatgaggacagctgcagcgagcacagcagcagcaccagcaccagcaccaaccagaaggagggcaagtactgtgactgctgctactgtgagttctttggacatggaggccccccagctgcccccaccagcagaaattatgcagagatgagggagaagctgcggctgcggctgaccaagaggaaggaggagcagcccaagaagatggaccagatcagcgagcgggagagcgtggtggaccaccggcgggtggaggacctgctgcagttcatcaacagcagcgagaccaagcctgtgagcagcacccgggccgccaagagggcccggcacaagcagaggaagctggaggagaaggcccggctggaggccgaggcccgggcccgggagcacctgcacctgcaggaggagcagaggagaagagaggaggaggaggatgaggaggaggaggaggaccgcttcaaggaggagttccagaggctgcaggagctgcagaagctgcgggctgtgaagaagaagaagaaggagcggcccagcaaggactgccccaagctggacatgctgaccaggaacttccaggccgccacagaatctgtgcccaacagcggcaacatccacaacggcagcctggagcagacagaggagcctgagaccagcagccacagccccagccgccacatgaaccacagcgagcccaggcctggcctgggcgcagatggagatgctgctgaccctgtggacacccgggacagcaagttcctgctgcccaaggaggtgaatggcaagcagcacgagcccctgtccttcttctttgacatcatgcagcaccacaaggagggcaatggcaagcagaagctgcggcagaccagcaaggccagcagcgagcccgcccggcggcccacagagccccccaaggccacagagggccagagcaagccccgggcccagacagagagcaaggccaaggtggtggacctgatgagcatcacagagcagaagcgggaggagaggaaggtgaacagcaacaacaacaacaagaagcagctgaaccacatcaaggatgagaagagcaaccccacccccatggagcccaccagccctggagagcaccagcagaacagcaagctggtgctggccgagagcccccagcccaagggcaagaacaagaagaacaagaagaagaagggggacagagtgaacaacagcattgatggagtgtccctgctgctgcccagcctgggctacaatggagccatcctggcccactgcaacctgcggctgcccggcagcagtgactgtgccgccagcgccagccaggtggtgggcatcacagatgatgtgttcctgcccaaggacatcgacctggacagcgtggacatggatgaaacagagcgggaggtggagtacttcaagcgcttctgcctggacagcgcccggcagacccggcagaggctgagcatcaactggagcaacttcagcctgaagaaggccacctttgctgcccactag

SEQ ID NO: 38592 - DNA, 3675 bp, Artificial Sequence
  Description of Artificial Sequence: Synthetic coding sequence
atgaaggtgcggctgctgcggcagctgtctgctgctgccaaggtgaaggcccccagcggcctgcagggccccccccaggcccaccagttcatcagcctgctgctggaggagtatggagccctgtgccaggccgcccggagcatcagcaccttcctgggcaccctggagaatgagcacctgaagaagttccaggtgacctgggagctgcacaacaagcacctgtttgagaacctggtgttttctgagcccctgctgcagagcaacctgcctgccctggtgtcccagatccggctgggcaccaccacccatgacacctgcagcgaggacacctacagcaccctgctgcagcgctaccagaggtctgaggaggagctgcggcgggtggccgaggagtggctggagtgccagaagagaattgatgcctacgtggatgagcagatgaccatgaagaccaagcagaggatgctgacagaggactgggagctgttcaagcagaggcgcttcatcgaggagcagctgaccaacaagaaggctgtgactggagagaacaacttcacagacaccatgaggcacatgctgagcagccggctgtccatgccagactgccccaactgcaactacagaagaagatgtgcctgtgatgactgcagcctgagccacatcctgacctgtggcatcatggacccccctgtgacagatgacatccacatccaccagctgcccctgcaggtggaccctgccccagactacctggccgagaggagcccccccagcgtgtcctctgccagcagcggcagcggcagcagcagccccatcaccatccagcagcaccccaggctcatcctgacagattctggcagcgcccccaccttctgcagtgatgatgaagatgtggcccccctgagcgccaagtttgctgacatctaccccctgagcaactatgatgacacagaggtggtggccaacatgaatggcatccacagcgagctgaatggaggaggagagaacatggccctgaaggatgagagcccccagatcagcagcaccagcagcagcagcagcgaggctgatgatgaggaggctgatggagagagcagcggggagcccccaggggcccccaaggaggatggagtgctgggcagccgcagccccaggacagaggagagcaaggctgacagccccccacccagctaccccacccagcaggccgagcaggcccccaacacctgtgaatgtcatgtgtgcaagcaggaggccagcggcctgaccccatctgccatgacagctggggccctgcccccaggccaccagttcctgagccctgagaagcccacccacccagccctgcacctgtacccccacatccacggccacgtgcccctgcacacagtgccccacctgccccggcccctcatccaccccaccctgtatgccaccccacccttcacccacagcaaggccctgcccccagcccctgtgcagaaccacaccaacaagcaccaggtgttcaatgccagcctgcaggaccacatctaccccagctgcttcggcaacaccccagagtggaacagcagcaagttcatcagcctgtggggcagcgaggtgatgaatgacaagaactggaaccctggcaccttcctgcctgacaccatcagcggcagcgagatcctgggccccaccctgtctgagaccaggcctgaggccctgcccccacccagcagcaatgagaccccagctgtgtctgacagcaaggagaagaagaatgctgccaagaagaagtgcctgtacaacttccaggatgccttcatggaggccaacaaggtggtgatggccaccagcagcgccaccagctctgtgtcctgcacagccaccaccgtgcagagcagcaacagccagttccgggtgagcagcaagaggcctcccagcgtgggagatgtgttccacggcatcagcaaagaagaccaccgccacagcgccccagctgcccccaggaacagccccaccggcctggcccccctgcctgccctgagccctgctgccctgagccctgctgccctgagccctgccagcaccccccacctggccaacctggccgcccccagcttccccaagacagccaccaccaccccaggctttgtggacaccaggaagagcttctgcccagcccccctgcccccagccacagatggcagcatcagcgcccctccttctgtgtgcagcgaccctgactgtgagggccaccgctgtgaaaatggagtgtatgacccccagcaggatgatggagatgagagcgcagatgaggacagctgcagcgagcacagcagcagcaccagcaccagcaccaaccagaaggagggcaagtactgtgactgctgctactgtgagttctttggacatggaggccccccagctgcccccaccagcagaaattatgcagagatgagggagaagctgcggctgcggctgaccaagaggaaggaggagcagcccaagaagatggaccagatcagcgagcgggagagcgtggtggaccaccggcgggtggaggacctgctgcagttcatcaacagcagcgagaccaagcctgtgagcagcacccgggccgccaagagggcccggcacaagcagaggaagctggaggagaaggcccggctggaggccgaggcccgggcccgggagcacctgcacctgcaggaggagcagaggagaagagaggaggaggaggatgaggaggaggaggaggaccgcttcaaggaggagttccagaggctgcaggagctgcagaagctgcgggctgtgaagaagaagaagaaggagcggcccagcaaggactgccccaagctggacatgctgaccaggaacttccaggccgccacagaatctgtgcccaacagcggcaacatccacaacggcagcctggagcagacagaggagcctgagaccagcagccacagccccagccgccacatgaaccacagcgagcccaggcctggcctgggcgcagatggagatgctgctgaccctgtggacacccgggacagcaagttcctgctgcccaaggaggtgaatggcaagcagcacgagcccctgtccttcttctttgacatcatgcagcaccacaaggagggcaatggcaagcagaagctgcggcagaccagcaaggccagcagcgagcccgcccggcggcccacagagccccccaaggccacagagggccagagcaagccccgggcccagacagagagcaaggccaaggtggtggacctgatgagcatcacagagcagaagcgggaggagaggaaggtgaacagcaacaacaacaacaagaagcagctgaaccacatcaaggatgagaagagcaaccccacccccatggagcccaccagccctggagagcaccagcagaacagcaagctggtgctggccgagagcccccagcccaagggcaagaacaagaagaacaagaagaagaagggggacagagtgaacaacagcattgatgatgtgttcctgcccaaggacatcgacctggacagcgtggacatggatgaaacagagcgggaggtggagtacttcaagcgcttctgcctggacagcgcccggcagacccggcagaggctgagcatcaactggagcaacttcagcctgaagaaggccacctttgctgcccactag

SEQ ID NO: 38593 - DNA, 132 bp, Artificial Sequence
  Description of Artificial Sequence: Synthetic coding sequence
atgaaggtgcggctgctgcggcagctgtctgctgctgccaaggtgaaggcccccagcggcctgcagggccccccccaggcccaccagttcatcagcctgctgctggaggagtatggagccctgtgccagtag

SEQ ID NO: 38594 - DNA, 3021 bp, Artificial Sequence
  Description of Artificial Sequence: Synthetic coding sequence
atgaccatgaagaccaagcagaggatgctgacagaggactgggagctgttcaagcagaggcgcttcatcgaggagcagctgaccaacaagaaggctgtgactggagagaacaacttcacagacaccatgaggcacatgctgagcagccggctgtccatgccagactgccccaactgcaactacagaagaagatgtgcctgtgatgactgcagcctgagccacatcctgacctgtggcatcatggacccccctgtgacagatgacatccacatccaccagctgcccctgcaggtggaccctgccccagactacctggccgagaggagcccccccagcgtgtcctctgccagcagcggcagcggcagcagcagccccatcaccatccagcagcaccccaggctcatcctgacagattctggcagcgcccccaccttctgcagtgatgatgaagatgtggcccccctgagcgccaagtttgctgacatctaccccctgagcaactatgatgacacagaggtggtggccaacatgaatggcatccacagcgagctgaatggaggaggagagaacatggccctgaaggatgagagcccccagatcagcagcaccagcagcagcagcagcgaggctgatgatgaggaggctgatggagagagcagcggggagcccccaggggcccccaaggaggatggagtgctgggcagccgcagccccaggacagaggagagcaaggctgacagccccccacccagctaccccacccagcaggccgagcaggcccccaacacctgtgaatgtcatgtgtgcaagcaggaggccagcggcctgaccccatctgccatgacagctggggccctgcccccaggccaccagttcctgagccctgagaagcccacccacccagccctgcacctgtacccccacatccacggccacgtgcccctgcacacagtgccccacctgccccggcccctcatccaccccaccctgtatgccaccccacccttcacccacagcaaggccctgcccccagcccctgtgcagaaccacaccaacaagcaccaggtgttcaatgccagcctgcaggaccacatctaccccagctgcttcggcaacaccccagagtggaacagcagcaagttcatcagcctgtggggcagcgaggtgatgaatgacaagaactggaaccctggcaccttcctgcctgacaccatcagcggcagcgagatcctgggccccaccctgtctgagaccaggcctgaggccctgcccccacccagcagcaatgagaccccagctgtgtctgacagcaaggagaagaagaatgctgccaagaagaagtgcctgtacaacttccaggatgccttcatggaggccaacaaggtggtgatggccaccagcagcgccaccagctctgtgtcctgcacagccaccaccgtgcagagcagcaacagccagttccgggtgagcagcaagaggcctcccagcgtgggagatgtgttccacggcatcagcaaagaagaccaccgccacagcgccccagctgcccccaggaacagccccaccggcctggcccccctgcctgccctgagccctgctgccctgagccctgctgccctgagccctgccagcaccccccacctggccaacctggccgcccccagcttccccaagacagccaccaccaccccaggctttgtggacaccaggaagagcttctgcccagcccccctgcccccagccacagatggcagcatcagcgcccctccttctgtgtgcagcgaccctgactgtgagggccaccgctgtgaaaatggagtgtatgacccccagcaggatgatggagatgagagcgcagatgaggacagctgcagcgagcacagcagcagcaccagcaccagcaccaaccagaaggagggcaagtactgtgactgctgctactgtgagttctttggacatggaggccccccagctgcccccaccagcagaaattatgcagagatgagggagaagctgcggctgcggctgaccaagaggaaggaggagcagcccaagaagatggaccagatcagcgagcgggagagcgtggtggaccaccggcgggtggaggacctgctgcagttcatcaacagcagcgagaccaagcctgtgagcagcacccgggccgccaagagggcccggcacaagcagaggaagctggaggagaaggcccggctggaggccgaggcccgggcccgggagcacctgcacctgcaggaggagcagaggagaagagaggaggaggaggatgaggaggaggaggaggaccgcttcaaggaggagttccagaggctgcaggagctgcagaagctgcgggctgtgaagaagaagaagaaggagcggcccagcaaggactgccccaagctggacatgctgaccaggaacttccaggccgccacagaatctgtgcccaacagcggcaacatccacaacggcagcctggagcagacagaggagcctgagaccagcagccacagccccagccgccacatgaaccacagcgagcccaggcctggcctgggcgcagatggagatgctgctgaccctgtggacacccgggacagcaagttcctgctgcccaaggaggtgaatggcaagcagcacgagcccctgtccttcttctttgacatcatgcagcaccacaaggagggcaatggcaagcagaagctgcggcagaccagcaaggccagcagcgagcccgcccggcggcccacagagccccccaaggccacagagggccagagcaagccccgggcccagacagagagcaaggccaaggtggtggacctgatgagcatcacagagcagaagcgggaggagaggaaggtgaacagcaacaacaacaacaagaagcagctgaaccacatcaaggatgagaagagcaaccccacccccatggagcccaccagccctggagagcaccagcagaacagcaagctggtgctggccgagagcccccagcccaagggcaagaacaagtag

SEQ ID NO: 38595 - DNA, 3636 bp, Artificial Sequence; identical to SEQ ID NO: 38589
  Description of Artificial Sequence: Synthetic coding sequence

SEQ ID NO: 38596 - DNA, 1347 bp, Artificial Sequence
  Description of Artificial Sequence: Synthetic coding sequence
atgaagggcggcaccctgggcggcatccctggagagcctgctgtggaccacagagatgtggatgagctgctggagttcatcaacagcacagagcccaaggtgcccaacagcgcccgggccgccaagagggcccggcacaagctgaagaagaaggagaaggagaaggcccagctggccgctgaggccctgaagcaggccaacagagtgtctggcagccgggagcccaggcctgcccgggagcggctgctggagtggccagaccgggagctggacagagtgaacagcttcctgagcagccggctgcaggagatcaagaacacagtgaaggacagcatccgggccagcttctctgtgtgtgagctgtccatggacagcaatggcttcagcaaggagggcgctgctgagcctgagccccagagcctgccccccagcaacctgagcggcagcagcgagcagcagcctgacatcaacctggacctgagccccctgaccctgggcagcccccagaaccacaccctgcaggcccctggagagcccgccccaccctgggccgagatgaggggcccccaccccccctggacagaggtgcggggccccccacctggcatcgtgcctgaaaatggcctggtgcggcggctgaacacagtgcccaacctgagcagggtcatctgggtgaagacccccaagccaggctaccccagcagcgaggagcccagcagcaaggaggtgcccagctgcaagcaggagctgcctgagcctgtgagcagcggcggcaagccccagaagggcaagaggcagggcagccaggccaagaagtctgaggccagccctgccccccggcccccagccagcctggaggtgcccagcgccaagggccaggtggccggccccaagcagcccggccgggtgctggagctgcccaaggtgggcagctgtgccgaggccggggagggcagccggggcagccggcccggccctggctgggccggcagccccaagacagagaaggagaagggcagctcctggaggaactggccaggagaggccaaggcccggccccaggagcaggagagcgtgcagcccagcggccctgcccggccccagagcctgccccagggcaagggccgcagccgccgcagcaggaacaagcaggagaagccagccagcagcctggatgatgtgttcctgcccaaggacatggatggagtggagatggatgaaacagaccgggaggtggagtacttcaagcgcttctgcctggacagcgccaagcagacccggcagaaggtggccgtgaactggaccaacttcagcctgaagaagaccacccccagcacagcccagtag

SEQ ID NO: 38597 - DNA, 2370 bp, Artificial Sequence
  Description of Artificial Sequence: Synthetic coding sequence
atgcccaagctggtgaagaacctgctgggggagatgcccctgtgggtgtgccagagctgcaggaagtccatggaggaggatgagcggcagacaggccgggagcacgctgtggccatcagcctgagccacaccagctgcaagagccagagctgtggagatgacagccacagcagcagcagcagcagcagcagcagcagcagcagcagcagcagcagctgccccggcaacagcggggactgggaccccagcagcttcctgagcgcccacaagctgagcggcctgtggaacagcccccacagcagcggggccatgcctggcagcagcctgggcagcccccccaccatccctggagaggccttccctgtgtctgagcaccaccagcacagcgacctgacagccccacccaacagccccaccggccaccacccccagcctgccagcctcatccccagccaccccagcagctttggcagccccccccacccccacctgctgcccaccaccccagctgcccccttccctgcccaggcctctgaatgtcctgtggccgccgccacagccccccacaccccaggcccctgccagagcagccacctgcccagcacctccatgcccctgctgaagatgcccccacccttcagcggctgcagccacccctgcagcggccactgcggcggccactgcagcggccccctgctgcccccacccagcagccagcccctgcccagcacccaccgggaccccggctgcaagggccacaagtttgcccacagcggcctggcctgccagctgccccagccctgtgaggctgatgagggcctgggggaggaggaggacagcagcagcgagaggagcagctgcaccagcagcagcacccaccagagagatggcaagttctgtgactgctgctactgtgagttcttcggccacaatgcccctcctgctgcccccaccagcaggaactacacagagatccgggagaagctgcggagccggctgaccaggaggaaggaggagctgcccatgaagggcggcaccctgggcggcatccctggagagcctgctgtggaccacagagatgtggatgagctgctggagttcatcaacagcacagagcccaaggtgcccaacagcgcccgggccgccaagagggcccggcacaagctgaagaagaaggagaaggagaaggcccagctggccgctgaggccctgaagcaggccaacagagtgtctggcagccgggagcccaggcctgcccgggagcggctgctggagtggccagaccgggagctggacagagtgaacagcttcctgagcagccggctgcaggagatcaagaacacagtgaaggacagcatccgggccagcttctctgtgtgtgagctgtccatggacagcaatggcttcagcaaggagggcgctgctgagcctgagccccagagcctgccccccagcaacctgagcggcagcagcgagcagcagcctgacatcaacctggacctgagccccctgaccctgggcagcccccagaaccacaccctgcaggcccctggagagcccgccccaccctgggccgagatgaggggcccccaccccccctggacagaggtgcggggccccccacctggcatcgtgcctgaaaatggcctggtgcggcggctgaacacagtgcccaacctgagcagggtcatctgggtgaagacccccaagccaggctaccccagcagcgaggagcccagcagcaaggaggtgcccagctgcaagcaggagctgcctgagcctgtgtcctctgggggcaagccccagaagggcaagaggcagggcagccaggccaagaagtctgaggccagccctgccccccggcccccagccagcctggaggtgcccagcgccaagggccaggtggccggccccaagcagcccggccgggtgctggagctgcccaaggtgggcagctgtgccgaggccggggagggcagccggggcagcaggcctggccctggctgggccggcagccccaagacagagaaggagaagggcagctcctggaggaactggccaggagaggccaaggcccggccccaggagcaggagagcgtgcagcccagcggccctgcccggccccagagcctgccccagggcaagggccgcagcagaagaagcaggaacaagcaggagaagccagccagcagcctggatgatgtgttcctgcccaaggacatggatggagtggagatggatgaaacagaccgggaggtggagtacttcaagcgcttctgcctggacagcgccaagcagacccggcagaaggtggccgtgaactggaccaacttcagcctgaagaagaccacccccagcacagcccagtag

SEQ ID NO: 38598 - DNA, 1992 bp, Artificial Sequence
  Description of Artificial Sequence: Synthetic coding sequence
atggcccacctgcggagccccagcggctttggagaccccgggaagaaggaccagaaggagagcgaggaggagctggaggaggaggaggaggaggaggaggtggaggaggaggaggaggaggtggaggaggaggaggaggaggtggaggaggaggaggaggaggtggtggaggaggagctggtgggggaggagcaggagctggaggcccctgagaccttcagcgaggagtacctgtggaaggtgacagacatcggggactatgatgatgacttcccagatgtgcggccccggctggccagcatcgtgagccccagcctgaccagcacctttgtgcccagccagagcgccaccagcacagagaccccatctgccagcccccccagcagcaccagcagccacaagagcttccccaagatcttccagaccttcaggaaggacatgtctgagatgagcattgacaggaacatccacaggaacctgagccctggcatccctgtgtctgtgcagacagaggagagctggctgcaggacctgagtgacaaggtgcagagcaggaagaaggccagcaaggagaaggccgagcctgagtgcctggccagcaagctgcgggagaagtgggtgatcaaccctgaggagagcaagctgaacatcctgtatgagctggagttcaaggaggacttcatcaccctgtttgagcccagcctgcggaccctgcccagcatcggccccccatccatcctggcctacaaggaggagagcagcaacctgggcatcaacttcaaggatgaggaggaggagaccagccccaagtgtgagttctgtggcagtgacctgcgggccttcttcagcaatgtggatgtgtcctctgagcccaagggccacgccagctgctgcatcgccttccagaacctgattgactacatctatgaggagcagatcaagaccaagccacccaaggccgagctgattgccatcgacccccatgctgcccacggcagcgaggtggaccggctgaaggccaaggagaaggccctgcagaggaagcaggagcagaggatggcccggcactttgccatcatcagccgggagcagacccacttctctgaagatgacagcaagaggctgaagaccatctcctaccagctgtctgtggacatccctgagaagcagatcattgatgacatcgtgtttgacttccagctgaggaacagcaacatgagcatcatctgctgtgacagcagaattgcctgtgggaaggtggtgagaaatgagctgctggagaagcactacaagcacggcagcaagttcctgaccagcttcccagatggcaccacccagatcttctaccccagcggcaacctggccatcatccgggtgcccaacaaggtgaatggcttcacctgcatcgtgcaggaggacatgcccaccaacccagccatcctggccgtgctggacagcagcggccgcagcagctgctaccaccccaatggaaatgtgtgggtgtacatcaacatcctgggcggccagtacagcgaccaggccggcaaccgcatccgggcctggaactggagcaacagcatcaccagcagcccctttgtgtccttcaagcctgtgttcctggccctgaaccgctacatcggcgtgcgcatcctggagcaggacaagatcagcatcaccttcctggccatgggccagcaggcccgcatctctgtgggcaccaaggtgaagctgcccaaccctgaggagatccccatcctgcgctacgtgtctggagatgacctgctgctgctggccagcctcatcaagatccggcggctcttccacaagctggagggctgtgtgaacttccccagcagccaggtgtgggagaagctgaagcagcccagctacctgagcagcctgagcctgaagctgattgccctgtgccacagcagcggcatcaagcaggacatcatgaagaccatccggaacatcatcaatgaggagatctag

SEQ ID NO: 38599 - DNA, 1866 bp, Artificial Sequence
  Description of Artificial Sequence: Synthetic coding sequence
atggcccacctgcggagccccagcggctttggagaccccgggaagaaggaccagaaggagagcgagcaggagctggaggcccctgagaccttcagcgaggagtacctgtggaaggtgacagacatcggggactatgatgatgacttcccagatgtgcggccccggctggccagcatcgtgagccccagcctgaccagcacctttgtgcccagccagagcgccaccagcacagagaccccatctgccagcccccccagcagcaccagcagccacaagagcttccccaagatcttccagaccttcaggaaggacatgtctgagatgagcattgacaggaacatccacaggaacctgagccctggcatccctgtgtctgtgcagacagaggagagctggctgcaggacctgagtgacaaggtgcagagcaggaagaaggccagcaaggagaaggccgagcctgagtgcctggccagcaagctgcgggagaagtgggtgatcaaccctgaggagagcaagctgaacatcctgtatgagctggagttcaaggaggacttcatcaccctgtttgagcccagcctgcggaccctgcccagcatcggccccccatccatcctggcctacaaggaggagagcagcaacctgggcatcaacttcaaggatgaggaggaggagaccagccccaagtgtgagttctgtggcagtgacctgcgggccttcttcagcaatgtggatgtgtcctctgagcccaagggccacgccagctgctgcatcgccttccagaacctgattgactacatctatgaggagcagatcaagaccaagccacccaaggccgagctgattgccatcgacccccatgctgcccacggcagcgaggtggaccggctgaaggccaaggagaaggccctgcagaggaagcaggagcagaggatggcccggcactttgccatcatcagccgggagcagacccacttctctgaagatgacagcaagaggctgaagaccatctcctaccagctgtctgtggacatccctgagaagcagatcattgatgacatcgtgtttgacttccagctgaggaacagcaacatgagcatcatctgctgtgacagcagaattgcctgtgggaaggtggtgagaaatgagctgctggagaagcactacaagcacggcagcaagttcctgaccagcttcccagatggcaccacccagatcttctaccccagcggcaacctggccatcatccgggtgcccaacaaggtgaatggcttcacctgcatcgtgcaggaggacatgcccaccaacccagccatcctggccgtgctggacagcagcggccgcagcagctgctaccaccccaatggaaatgtgtgggtgtacatcaacatcctgggcggccagtacagcgaccaggccggcaaccgcatccgggcctggaactggagcaacagcatcaccagcagcccctttgtgtccttcaagcctgtgttcctggccctgaaccgctacatcggcgtgcgcatcctggagcaggacaagatcagcatcaccttcctggccatgggccagcaggcccgcatctctgtgggcaccaaggtgaagctgcccaaccctgaggagatccccatcctgcgctacgtgtctggagatgacctgctgctgctggccagcctcatcaagatccggcggctcttccacaagctggagggctgtgtgaacttccccagcagccaggtgtgggagaagctgaagcagcccagctacctgagcagcctgagcctgaagctgattgccctgtgccacagcagcggcatcaagcaggacatcatgaagaccatccggaacatcatcaatgaggagatctag

SEQ ID NO: 38600 - DNA, 2091 bp, Artificial Sequence
  Description of Artificial Sequence: Synthetic coding sequence
atgtctgctgagaacaaccagctgagcggggccagccccccccacccccccaccaccccccagtacagcacccagaacctgcccagcgagaaggaggacacagaggtggagctggatgaggagagcctgcaggatgagagccccttcagccctgagggggagagcctggaggacaaggagtacctggaggaggaggaggacctggaggaggaggagtacctgggcaaggaggagtacctgaaggaggaggagtacctgggcaaggaggagcacctggaggaggaggagtacctggagaaggccggctacctggaggaggaggagtacatcgaggaggaggagtacctgggcaaggagggctacctggaggaggaggagtacctgggcaaggaggagcacctggaggaggaggagtacctgggcaaggagggctacctggagaaggaggactacatcgaggaggtggactacctgggcaagaaggcctacctggaggaggaggagtacctgggcaagaagagctacctggaggaggagaaggccctggagaaggaggagaacctggaggaggaggaggccctggagaaggaggagaacctggatggcaaggagaacctgtacaagaagtacctgaaggagcccaaggccagctacagcagccagaccatgctgctgagagatgcccggagcccagatgctggccccagccaggtgaccaccttcctgactgtgcccctgacctttgccacccccagccctgtgtctgagagcgccacagagagcagcgagctgctgctgaccctgtaccgccgcagccaggccagccagacagactggtgctatgacagaacagctgtgaagagcctgaagagcaagtcagaaacagagcaggagaccaccaccaagctggcccctgaggagcacgtgaacaccaaggtgcagcagaagaaggaggagaatgtgctggagtttgccagcaaggagaacttctgggatggcatcacagatgagagcattgacaagctggaggtggaggacctggatgagaacttcctgaacagcagctaccagaccgtcttcaagaccatcatcaaggagatggccgcccacaatgagctggaggaggactttgacatccccctgaccaagctgctggagagcgagaaccgctggaagctggtgatcatgctgaagaagaactatgagaagttcaaggagaccatcctgcgcatcaagagaagaagagaggcccagaagctgacagagatgaccagcttcaccttccacctgatgagcaagcccaccccagagaagccagagacagaggagatccagaagccccagagggtggtgcaccacaggaagaagctggagcgggacaaggagtggatccagaagaagacagtggtgcaccagggagatggcaagctgatcctgtaccccaacaagaatgtgtaccagatcctcttcccagatggcaccggccagatccactaccccagcggcaacctggccatgctgatcctgtatgccaagatgaagaagttcacctacatcatcctggaggacagcctggagggccgcatccgggccctgatcaacaacagcggaaatgccaccttctatgatgagaacagcgacatctggctgaacctgagcagcaacctgggctactacttccccaaggacaagaggcagaaggcctggaactggtggaacctgaacatccacgtgcacgcccctcctgtgcagcccatcagcctgaagatcaatgagtacatccaggtgcagatccgcagccaggacaagatcatcttctgcttcacctatgagcagaagcagatctgcctgaacctgggcacccgctacaagtttgtgattcctgaggtgctgtctgagatgaagaagaagaccatcctggaggccgagcccggccccacagcccagaagatccgggtgctgctgggcaagatgaaccggctgctgaactatgccaccaccccagacctggagaacttcatcgaggccgtgtccatcagcctgatggacaacaagtacctgaagaagatgctgagcaagctgtggttctag

SEQ ID NO: 38601 - DNA, 483 bp, Artificial Sequence
  Description of Artificial Sequence: Synthetic coding sequence
atgtacaccatcaccaagggccccagcaagctggtggcccagaggagaacaggccccacccagcagcaggtggagggccgcctgggggagctgctgaagtgccggcagcctgccccacccaccagccagcccccccgggcccagccctttgcccagcccccaggcccctggcccctgagcagccctggcccccggctggtgttcaacagagtgaatggccggcgggcccccagcaccagccccagctttgagggcacccaggagacctacacagtggcccacgaggagaatgtgcgctttgtgtctgaggcctggcagcaggtgcagcagcagctggatggcggccctgctggggagggcggccccaggcctgtgcagtatgtggagaggacccccaacccccggctgcagaactttgtgcccatcgacctggatgagtggtgggcccagcagttcctggcccgcatcaccagctgcagctag

SEQ ID NO: 38602 - DNA, 585 bp, Artificial Sequence
  Description of Artificial Sequence: Synthetic coding sequence
atgtacaccatcaccaagggccccagcaagctggtggcccagaggagaacaggccccacccagcagcaggtggagggccgcctgggggagctgctgaagtgccggcagcctgccccacccaccagccagcccccccgggcccagccctttgcccagcccccaggcccctggcccctgagcagccctggcccccggctggtgttcaacagagtgaatggccggcgggcccccagcaccagccccagctttgagggcacccaggagacctacacagtggcccacgaggagaatgtgcgctttgtgtctgaggcctggcagcaggtgcagcagcagctggatggcggccctgctggggagggcggccccaggcctgtgcagtatgtggagaggacccccaacccccggctgcagaactttgtgcccatcgacctggatgagtggtgggccgctgtgcctggagagaaccaccagctgttcctggtggccgccggccggggccgctgctacacagctgacctgagccctggagagaagcatggagccctgcccacccactgtgcctggctgggcgccggccacacctag

SEQ ID NO: 38603 - DNA, 294 bp, Artificial Sequence
  Description of Artificial Sequence: Synthetic coding sequence
atgaccagcagccctgtgtcccgggtggtgtacaacgggaagaggaccagcagccccaggagcccccccagcagcagcgagatcttcaccccagcccatgaagaaaatgtgcgcttcatctatgaggcctggcagggcgtggagcgggacctgcggggccaggtgcctggaggagagcggggcctggtggaggagtatgtggagaaggtgcccaaccccagcctgaagaccttcaagcccatcgacctgagtgacctgaagaggaggagcacccaggatgccaagaagagctag

SEQ ID NO: 38604 - DNA, 294 bp, Artificial Sequence; identical to SEQ ID NO: 38603
  Description of Artificial Sequence: Synthetic coding sequence

SEQ ID NO: 38605 - DNA, 1440 bp, Artificial Sequence
  Description of Artificial Sequence: Synthetic coding sequence
atggtgtccaaggacaccgggaagtgcatcctgaccaccagcgagagcgaggtggagcctgctgcctgcctggccctggagatgaagtatgccctggaccccaaccggcagatcaagaagaggaacaaggccctgcaggtgcgcttcaaggacatctgtgaggcccagaatgagcagagggacacccagctgagcagcggccagctgggggagaagcgggaggccaagcctgtgtcctgccgggccgcctacaggaagtacatgacagtgcctgcccggcgcagcatccccaacgtgaccaagagcactggagtgcagaccagcccagacctgaagaagtgctaccagaccttccccctggacaggaagaagggcaacctgaagagcctgcctgctgctgaccccttcaagagccagaacaacggcttcctgacagatgccaaggagaagaatgaagctggccccatggaggaggcccggccctgtggggccggccgggtgcacaagaccacagccctggtgttccacagcaaccagcacatgaacacagtggaccagcccctgggcgtgaactgcacagagccctgcaagagccctgagcccctgtcctatggagaggccgccctgcagaacagcaccaggcctccttctgaggagccagactaccagctgctgggccgggccaagcaggaccggggccggcccaacagcgaggagcccgcccccccagccctgcggcgggtcttcaagacagaggtggccaccgtgtatgccccagccctgagcgcccgggcccctgagcccggcctgagtgacagcgctgctgccagccagtggagcctgtgcccagcagatgatgagaggagaagagccacccacctgaatggcctgcaggcccccagcgagacagccctggcctgcagcccccccatgcagtgcctgagcccagaatgttctgagcagcccagccagacccacaccccacctggcctgggcaaccagcccagccccacagctgtggccgccggggaggagtgccagagaattgtgccccacacagaggtggtggacctgaaggcccagctgcagatgatggagaacctgatcagcagcagccaggagaccatcaaggtgctgctgggcgtcatccaggagctggagaagggggaggcccaccgggagggcctgagctacagaacaggccaggacacagccaactgtgacacctgcagaaattctgcctgcatcatctacagcgtggagctggacttcaagcagcaggaggacaagctgcagcctgtgctgaggaagctgcaccccatcgaggagacccaggtgatccccagcccctacagccaggagacctacagcagcacccccaagcagaagagcaagacagagagcaagaagcacggccgctggaagctgtggttcctgtag

SEQ ID NO: 38606 - DNA, 1608 bp, Artificial Sequence
  Description of Artificial Sequence: Synthetic coding sequence
atggcccagcagaacatgaaggtgcggcctgtgctgctgaagaggaacagcctggagagcgtggagtttgtgaagcagccccaccaccggcgcagcaagagccagcaggtgcgcttcaaggaggatggcaccaccaagaaccccaccggcctggccgaggtggatgtgcagaccccagaggaccctgctgtgatgggcaagacccaggccaccaggcaccacctgccccccacctacagcctgtccttccccaggagccagaaggccggcggcttcagaaatattgccatccagaccagccccagcctgaggaagcacttccctgtgttcaagaggaagaggctgacagccagcaagagcctggtggagatgcccacagccagccagagcgccatccaggtgaatggaaacctgtctgagcaggacatcgtgtccagtgacctggcctacctgcggctggcccagcacctggaggatggcccccggcgggtgaaggtgagccacgccttcctgccccgggtgcccaaggtgcagagcaatggacctgtgtccatctgcctggaggccggcacctggaggagcctggagaaggccacagctgccatccaggtgcctgatgacatctaccacagccccagctgggaggcccgggagagcgccctgagcccagacagatctgctgaggtgagcaacagcatccaccccctggatgacaccaggcctggagatggaagaagagtgacccccctggacagcgagaagagcaccagctgcctgaatgccacctctgtggccagccacaccccaggcacagaggagctgaagccagagctgctgctgcccaaggacaacagtgatgacaaggacctgggcagcctgagcagccagagcaaggagacctgtgtgcccagcagccccaggacccacagcagccccagccagggcagccacagccagcctgcccaccctggccgggccagtgactgccccagcagcagcaacaaccaccagaacctggtgtccctgaagaccaacagcgccagcaagagcgcccctggctgccaggagcagacagccaacaaccccacagaaagtgacaccctggagttccccaactgccccggcagcaaccacctgcccagcagcctgagccgctctgagaccaagctgcagagcaaccgggagatcagtgacatcaaccagatccacctggcccggggggagctgtgtgacctgcagggccgcctgcagagcgtggaggagagcctgcacagcaaccaggagaagatcaaggtgctgctgaatgtcatccaggacctggagaaggcccgggccctgacagagggcaggaacttctacagaacaggccaggacctgaacaactgcagcacctgccagaacacagcctgcatcatctacagcgtggagtatgacttccggcagcaggagggccgcttccacgaggtgctgcagagcctggaggaggccgagcctgtggaggaggccagccccccacccaagagccctgctgagcccccagcccctgagaagcaggacctgcggaggaagaccaagaaggtgaagaagaagtgcttctggtggatctag

SEQ ID NO: 38607 - DNA, 1167 bp, Artificial Sequence
  Description of Artificial Sequence: Synthetic coding sequence
atgtctgatgaggccagcgccatcaccagctatgagaagttcctgaccccagaggagcccttccccctgctgggccccccccggggcgtgggcacctgccccagcgaggagcccggctgcctggacatcagtgactttggctgccagctgagcagctgccacaggacagaccccctgcaccgcttccacaccaaccgctggaacctgaccagctgtggcacctctgtggccagcagcgagggcagcgaggagctgttcagctctgtgtctgtgggggaccaggatgactgctacagcctgctggatgaccaggacttcaccagctttgacctcttccctgagggctctgtgtgcagtgatgtgagcagcagcatcagcacctactgggactggagcgacagcgagtttgagtggcagctgcccggcagtgacatcgccagcggcagtgatgtgctgagtgatgtgatccccagcatccccagcagcccctgcctgctgcccaagaagaagaacaagcacaggaacctggatgagctgccctggagcgccatgaccaatgatgagcaggtggagtacatcgagtacctgagcaggaaggtgtccacagagatgggcctgcgggagcagctggacatcatcaagatcatcgaccccagcgcccagatcagccccacagattctgagttcatcatcgagctgaactgcctgacagatgagaagctgaagcaggtgaggaactacatcaaggagcacagcccccggcagaggcctgcccgggaggcctggaagaggagcaacttcagctgtgccagcaccagcggcgtgtctggggccagcgccagcgccagcagcagcagcgcctccatggtgagcagcgccagcagcagcggcagctctgtgggcaacagcgccagcaacagcagcgccaacatgagccgggcccacagcgacagcaacctgagcgccagcgctgctgagcgcatccgggacagcaagaagaggagcaagcagaggaagctgcagcagaaggccttcaggaagaggcagctgaaggagcagaggcaggccaggaaggagcggctgagcggcctcttcctgaatgaggaggtgctgagcctgaaggtgacagaggaggaccacgaggctgatgtggatgtgctgatgtag

SEQ ID NO: 38608 - DNA, 1974 bp, Artificial Sequence
  Description of Artificial Sequence: Synthetic coding sequence
atggaccacttcttcatcaagaggaagaggaacagcgaggtgaagtacacagaggcctgcagcagcagctctgtggagagcggcatcgtgaacagcgacaacatcgagaagaacacagacagcaacctgcagaccagcaccagctttgagccccacttcaagaagaagaaggtgtctgcccggcgctacaatgaagactacctgaagtatggcttcatcaagtgtgagaagccctttgaaaatgaccggccccagtgtgtgatctgcaacaacatcctggccaatgaaagcctgaagcccagcaagctgaagaggcacctggagacccagcacgccgagctgattgacaagcccctggagtacttccagaggaagaagaaggacatcaagctgagcacccagttcctgagctgcagcacagctgtgtctgagaaggccctgctgagcagctacctggtggcctacagagtggccaaggagaagatcgccaacacagctgctgagaagatcatcctgcctgcctgcctggacatggtgaggaccatctttgatgacaagtctgctgacaagctgaagaccatccccaatgacaacacagtgtccctgcgcatctgcaccatcgccgagcacctggagaccatgctgatcacccggctgcagagcggcatcgactttgccatccagctggatgagagcacagacatcggcagctgcaccaccctgctggtgtatgtgcgctatgcctggcaggatgacttcctggaggacttcctgtgcttcctgaacctgaccagccacctgagcggcctggacatcttcacagagctggagcggcgcatcgtgggccagtacaagctgaactggaagaactgcaagggcatcaccagtgatggaacagccaccatgaccgggaagcacagcagggtcatcaagaagctgctggaggtgaccaacaatggagctgtgtggaaccactgcttcatccaccgggagggcctggccagccgggagatcccccagaacctgatggaggtgctgaagaatgctgtgaaggtggtgaacttcatcaagggcagcagcctgaacagccggctgctggagaccttctgcagcgagatcggcaccaaccacacccacctgctgtaccacaccaagatccgctggctgagccagggcaagatcctgagccgggtgtatgagctgagaaatgagatccacttcttcctgattgagaagaagagccacctggccagcatctttgaagatgacacctgggtgaccaagctggcctacctgacagacatcttcagcatcctgaatgagctgagcctgaagctgcagggcaagaacagtgatgtgttccagcacgtggagcgcatccagggcttcaggaagaccctgctgctgtggcaggtgcggctgaagagcaaccggcccagctactacatgttcccccgcttcctgcagcacatcgaggagaacatcatcaatgaaaacatcctgaaggagatcaagctggagatcctgctgcacctgaccagcctgagccagaccttcaaccacttcttccctgaggagaagtttgagaccctgagagaaaattcctgggtgaaggacccctttgccttccgccaccctgagagcatcatcgagctgaacctggtgcctgaggaggagaatgagctgctgcagctgagcagcagctacaccctgaagaatgactatgagaccctgagcctgagcgccttctggatgaaggtgaaggaggacttccccctgctgagcaggaagtctgtgctgctgctgctgcccttcaccaccaccagcctgtgtgagctgggcttcagcatcctgacccagctgaagaccaaggagagaaatggcctgaactgtgccgctgtgatgagggtggccctgagcagctgtgtgcctgactggaatgagctgatgaaccggcaggcccaccccagctag

SEQ ID NO: 38609 - DNA, 468 bp, Artificial Sequence
  Description of Artificial Sequence: Synthetic coding sequence
atgggcctgcgggccggcagccgctgcagagctgaccacctggcccagccccagccccagggccacctggcccctgtgctgcgctgtggggagtgctggagggcccggggcctgcccggcggctgctgcctgcacacagagggcggctgcagcctgggcgcccaggccggctggaggacagctggctgggaggcccggggccggcgggacctgggcctggagaccaccagcgcccacagccgcagcctgctgcacctgagctcctggaggaggccagatgtgggggaggccgccggggctgagctgctgcagagggcccccctgcagcagcctgaccctgcccaggccgctgtggagggcggcctgctggcccggctgccccggccccaggaccagggctgcggccagcaccggccccacagcccccggctggtggacatcgccctgcccggcggcggctggacctag

SEQ ID NO: 38610 - DNA, 1173 bp, Artificial Sequence
  Description of Artificial Sequence: Synthetic coding sequence
atgggagaggccggggccggggccggggccagcggcggccctgaggccagccctgaggccgaggtggtgaagctgctgcccttcctggcccctggggcccgggctgacctgcaggccgctgctgtgcgccacgtgctggccctgaccggctgcggccctggccgggccctgctggccggccaggccgccctgctgcaggccctgatggagctggccccagccagcgccccagccagagatgctgcccgggccctggtgaacctggccgctgaccccggcctgcacgagaccctgctggccgctgaccccggcctgcctgcccggctgatgggccgggccctggacccccagtggccctgggccgaggaggccgccgccgccctggccaacctgagccgggagcccgccccctgtgccgccctgatggccgccctggccgctgctgagcctgctgacagcggcctggagcggctggtgcgggccctgtgcaccccaggctacaatgcccgggcccccctgcactacctggcccccctgctgagcaacctgagccagaggcctgctgcccgggccttcctgctggaccctgacagatgtgtggtgcagaggctgctgcccctgacccagtacccagacagctctgtgcggcggggcggcgtggtgggcaccctgaggaactgctgctttgagcaccgccaccacgagtggctgctgggccctgaggtggacatcctgcccttcctgctgctgcccctggccggccctgaggacttcagcgaggaggagatggagcggctgcctgtggacctgcagtacctgcccccagacaagcagcgggagccagatgctgacatcaggaagatgctggtggaggccatcatgctgctgacagccacagcccctggccggcagcaggtgcgggaccagggcgcctacctgatcctgcgggagctgcacagctgggagcctgagccagatgtgaggacagcctgtgagaagctgatccaggtgctgattggagatgagcctgagcggggcatggagaacctgctggaggtgcaggtgcctgaagatgtggagcagcagctgcagcagctggactgccgggagcaggagcagctggagcgggagctggcccctgagccctgggtggagcgggccacccccacctag

SEQ ID NO: 38611 - DNA, 1173 bp, Artificial Sequence
  Description of Artificial Sequence: Synthetic coding sequence
atgggagaggccggggccggggccggggccagcggcggccctgaggccagccctgaggccgaggtggtgaagctgctgcccttcctggcccctggggcccgggctgacctgcaggccgctgctgtgcgccacgtgctggccctgaccggctgcggccctggccgggccctgctggccggccaggccgccctgctgcaggccctgatggagctggccccagccagcgccccagccagagatgctgcccgggccctggtgaacctggccgctgaccccggcctgcacgagaccctgctggccgctgaccccggcctgcctgcccggctgatgggccgggccctggacccccagtggccctgggccgaggaggccgccgccgccctggccaacctgagccgggagcccgccccctgtgccgccctgatggccgccctggccgctgctgagcctgctgacagcggcctggagcggctggtgcgggccctgtgcaccccaggctacaatgcccgggcccccctgcactacctggcccccctgctgagcaacctgagccagaggcctgctgcccgggccttcctgctggaccctgacagatgtgtggtgcagaggctgctgcccctgacccagtacccagacagctctgtgcggcggggcggcgtggtgggcaccctgaggaactgctgctttgagcaccgccaccacgagtggctgctgggccctgaggtggacatcctgcccttcctgctgctgcccctggccggccctgaggacttcagcgaggaggagatgcagaggctgcctgtggacctgcagtacctgcccccagacaagcagcgggagccagatgctgacatcaggaagatgctggtggaggccatcatgctgctgacagccacagcccctggccggcagcaggtgcgggaccagggcgcctacctgatcctgcgggagctgcacagctgggagcctgagccagatgtgaggacagcctgtgagaagctgatccaggtgctgattggagatgagcctgagcggggcatggagaacctgctggaggtgcaggtgcctgaagatgtggagcagcagctgcagcagctggactgccgggagcaggagcagctggagcgggagctggcccctgagccctgggtggagcgggccacccccacctag

SEQ ID NO: 38612 - DNA, 456 bp, Artificial Sequence
  Description of Artificial Sequence: Synthetic coding sequence
atgtggagcggcctgctgcccccaggcctgaatgaaagtgatgctgagagcaacagtgaagatgaggccaccctggagaacagcggcctgaacctgcaggaggacaaggaggatgagagcatcaggaagacagagatcatcgacttcagcacagatgagcccaagacagaaacagagagcaatgtgaatgcctatgaagaatgtcccagcggcatccccatcgacatgtggaacaagttccaggagctgcacaagaagcacagcgagcagaagagcaccaccagccgcttccggggcaagaggaggaagaggagcaggaaggacaagctgaagaatgagaaggagctgcacagcgagcccagcagcaatgagacccagtggaaggagctgacccagtactttggagtgaatgacagatttgacccccctgtgaagaggaagaaggtggagaagtag

SEQ ID NO: 38613 - DNA, 702 bp, Artificial Sequence
  Description of Artificial Sequence: Synthetic coding sequence
atgtggagcggcctgctgcccccaggcctgaatgaaagtgatgctgagagcaacagtgaagatgaggccaccctggagaacagcggcctgaacctgcaggaggacaaggaggatgagagcatcaggaagacagagatcatcgacttcagcacagatgagcccaagacagaaacagagagcaatgtgaatgcctatgaagaatgtcccagcggcatccccatcgacatgtggaacaagttccaggagctgcacaagaagcacagcgagcagaagagcaccaccagccgcttccggggcaagaggaggaagaggagcaggaaggacaagctgaagaatgagaaggagctgcacagcgagcccagcagcaatgagacccagtggaaggagctgacccagtactttggagtgaatgacagatttgacccccctgtgaagaggaagaaggtggagaagagcggcctggagaagagaattgaccaggccgtggaggagtggaacatcgagaaggccgaggagctgagcaaccagctggccacccgggagctgggcgtgaagatcgccaaggctgtggcctgccacaactttgtgaaggccaagaaggaggtggagaacagccaggccgccaggaagaagaagaagctggcctggggctttgaggccaagaagcgctgggagaccaagagcaacatgggctacatgtag

SEQ ID NO: 38614 - DNA, 702 bp, Artificial Sequence; identical to SEQ ID NO: 38613
  Description of Artificial Sequence: Synthetic coding sequence

SEQ ID NO: 38615 - DNA, 417 bp, Artificial Sequence
  Description of Artificial Sequence: Synthetic coding sequence
atgctgagccccacctttgtgctgtgggatgtgggctaccccctgtacacctacggcagcatcttcatcgtgattgtcatcatctggcaggtgaagaggagccaccacgagctgaacctggaggtggagaggagctgctgctggaggcaccagaaggtgcggcagagggccagagatgctgccagcacagcccggcggctgagccaggaggaggaccagaagccccaggagctgttctctgtgatgaagagagctggcttcccccagcgggaggtgtgtggggagagctatgtgcagatccctgtggccaagtttgccatgctgtggctgtggaggttcagcagctgctggaggatgaggatgaccaggagcccccagctgtgccggggcgtgcaccacaggagccccctggcctag

SEQ ID NO: 38616 - DNA, 693 bp, Artificial Sequence
  Description of Artificial Sequence: Synthetic coding sequence
atgggcaaggtgcggggcctgcgggcccgggtgcaccaggccgctgtgcggcccaagggggaggccgcccctggccctgcccccccagcccctgaggccaccccacctccagccagcgctgctgggaaggactgggccttcatcaacaccaacatctttgcccggaccaagattgaccccagcgccctggtgcagaagctggagctggatgtgcgctctgtgacctctgtgcggcggggggaggccggcagcagcgcccggtctgtgcccagcatcagaagaggagctgaggccaagacagtgctgcccaagaaggagaagatgaagctgcggcgggagcagtggctgcagaagattgaggccatcaagctggccgagcagaagcaccgggaggagaggagaagaagagccaccgtggtggtgggggacctgcaccccctgagagatgccctgcctgagctgctgggcctggaggccggcagccggcggcaggcccggagccgggagagcaacaagccccggcccagcgagctgagcaggatgtctgctgcccagaggcagcagctgctggaggaggagaggacccgcttccaggagctgctggccagccctgcctaccgggccagccccctggtggccatcggccagaccctggcccggcagatgcagctggaggatggcggccagctgtag

SEQ ID NO: 38617 - DNA, 648 bp, Artificial Sequence
  Description of Artificial Sequence: Synthetic coding sequence
atgggcaaggtgcggggcctgcgggcccgggtgcaccaggccgctgtgcggcccaagggggaggccgcccctggccctgcccccccagcccctgaggccaccccacctccagccagcgctgctgggaaggactgggccttcatcaacaccaacatctttgcccggaccaagattgaccccagcgccctggtgcagaagctggagctggatgtgcgctctgtgacctctgtgagaagaggagctgaggccaagacagtgctgcccaagaaggagaagatgaagctgcggcgggagcagtggctgcagaagattgaggccatcaagctggccgagcagaagcaccgggaggagaggagaagaagagccaccgtggtggtgggggacctgcaccccctgagagatgccctgcctgagctgctgggcctggaggccggcagccggcggcaggcccggagccgggagagcaacaagccccggcccagcgagctgagcaggatgtctgctgcccagaggcagcagctgctggaggaggagaggacccgcttccaggagctgctggccagccctgcctaccgggccagccccctggtggccatcggccagaccctggcccggcagatgcagctggaggatggcggccagctgtag

SEQ ID NO: 38618 - DNA, 4539 bp, Artificial Sequence
  Description of Artificial Sequence: Synthetic coding sequence
atggccacagctgtggagacagaggcctgccagcccacagatgcctcctgggagagcggcggcggcggagatgatgagatgaagcaggccctgcctgagctggagagcagccagcagaatggaggcggcggcggcctgaacattgctgagcccagcggcggggccggccgggaggagaatgctggagctgaggccgcccagagcctgagccatgagcagccccaggacagcagcgaggccggggctgctgccctgccccggggccctgaggagcctgagaggcctgtgagaagaagcttccagatccccaggaagagccgggagaagaaggccctcttccagcccctgaccccaggcagccgggagtttgaagatgtggtgaacatcctgcacagcagctacctggagcccacctctgtgaccaacttcaactaccgccgggcctgcctggtgcacaatgagctgctggagaaggagttcacagagaagaggcgggagctgaagtttgatggccgcctggacaaggagctgtctgagagctatgccttcctgatggtggaccgctaccaggtgcagaccatctgtgagaagggcctgcacgtgggccagagcaagatcaccatcctgggcagccccagcatgggcgtgtacctgagccgctatgctgacctgctgcaggccaaccccctggacaccggggccatgggagatgtggtgatcttcaagatcatgaagggcaagatcaagagcatctatgaccccatgggcgtgaagagcctggagagcatgctgaacaagagcgccctggaccccacccccaagcatgagtgccacgtgtccaagaatgccaaccgcatcaccagcctgctggcctaccgggcctatgagctgacccagtactacttctatgaatatggctttgatgagctgcggcggcggcccaggcatgtgtgcccctatgctgtggtgtccttcacctacaaggatgacatccagacccccaagtttgtgcccagcagccgcagcaacagcttcaacacagacagaaatattgacaagtacaactacaccctgtggaagggccagctgctgaacaagggcaagctgctgtgctacatcagcctgcggagcgccacccgggccttcctgcccatcaagctgcctgagaagctggatgtggagaccgtgatgagcattgaccacctgaagcagaagatccccccagccctcttctacaaggagacctacctgggccccaatgaggtgctgaagaatggcatgtactgcagcctgtatgaggtggtggagaagacccgcatcggcagcaacatggagagcctgctgcagaagctggaccgggagaagctggtgctggtgaagcccctgggggaccggggctacctgttcctgctgagcccctaccagatggtgcccccctatgagtaccagacagccaagagccgggtgctgcacgccctcttcctgttccaggagcccaggagcatcgtgaccagccagaagggcagcaccaatgctgccccccaggagagacatgagagcatgccagatgtgctgaagatcgcccagttcctgcagttcagcctcatccagtgcaggaaggagttcaagaacatcagcgccatcaacttccacagcgtggtggagaagtatgtgtctgagttcttcaagaggggcttcggcagcggcaagcgggagttcatcatgttcccctatgacagccggctggatgacaagaagttcctgtacagcgcccccaggaacaagagccacatcgacacctgcctgcacgcctacatcttccggcctgaggtgtaccagctgcccatctgcaagctgaaggagctgtttgaagaaaataggaagctgcagcagttcagccccctgagtgactatgagggccaggaggaggagatgaatggcaccaagatgaagtttgggaagaggaacaacagcagaggagaggccatcatcagcggcaagcagaggagcagccacagcctggactatgacaaggacagagtgaaggagctgatcaacctgatccagtgcaggaagaagtctgtgggcggggacagcgacacagaggacatgaggagcaagacagtgctgaagaggaagctggaggacctgcctgagaacatgaggaagctggccaagaccagcaacctgtctgagaactgccacctgtatgaggagagcccccagcccatcggcagcctgggccatgatgctgacctgcggcggcagcagcaggacacctgcaacagcggcattgctgacatccacaggctcttcaactggctgtctgagaccctggccaatgcccggcacagtgatgccagcctgacagacacagtgaacaaggccctgggcctgagcacagatgatgcctatgaggagctgcggcagaagcatgaatatgagctgaacagcaccccagacaagaaggactatgagcagcccacctgtgccaaggtggagaatgcccagttcaagggcacccagagcctgctgctggaggtggatgccaccagcaagtacagcgtggccatcagcaccagcgaggtgggcacagaccacaagctgcacctgaaggaggaccccaacctgatctctgtgaacaactttgaggactgcagcctgtgccccagcgtgcccatcgagcacggcttccggcggcagcagagcaagagcaacaacgtggaggagacagagatccactggaagctgatccccatcactggaggaaatgcccggagccctgaggaccagctgggcaagcatggagagaagcagaccccaggcatgaagagccctgaggagcagctggtgtgtgtgcccccccaggaggccttccccaatgaccccagggtcatcaaccggcagaggagcagtgactaccagttccccagcagccccttcacagacaccctgaagggcaccacagaagatgatgtgctgaccggccaggtggaggagcagtgtgtgcctgctgctgaggccgagcccccagctgtgtctgagaccacagagaggacagtgctgggggagtacaacctcttcagcaggaagattgaggagatcctgaagcagaagaatgtgtcctatgtgtccacagtgtccacccccatcttcagcacccaggagaagatgaagaggctgtctgagttcatctacagcaagaccagcaaggccggcgtgcaggagtttgtggatggcctgcacgagaagctgaacaccatcatcatcaaggccagcgccaagggcggcaacctgccccctgtgagccccaatgattctggggccaagatcgccagcaaccccctggagagacatgtgattcctgtgagcagcagtgacttcaacaacaagcacctgctggagcccctgtgcagcgaccccctgaaggacaccaacagtgatgagcagcacagcaccagcgccctgacagaggtggagatgaaccagccccagcacgccacagagctgatggtgaccagtgaccacatcgtgcctggggacatggcccgggagcctgtggaggagaccaccaagagccccagtgatgtgaacatcagcgcccagcctgccctgagcaacttcatcagccagctggagcctgaggtgttcaacagcctggtgaagatcatgaaggatgtgcagaagaacacagtgaagttctacatccacgaggaggaggagagcgtgctgtgcaaggagatcaaggagtacctgatcaagctgggcaacacagagtgccaccctgagcagttcctggagcggcgcagcaagctggacaagctgctgatcatcatccagaatgaagatattgctggcttcatccacaagatccctggcctggtgaccctgaagaagctgccctgtgtgtcctttgctggggtggacagcctggatgatgtgaagaaccacacctacaatgagctgtttgtgtctgggggcttcatcgtgtctgatgagagcatcctgaaccctgaggtggtgacagtggagaacctgaagaacttcctgaccttcctggaggagctgagcaccccagagggcaagtggcagtggaaggtgcactgcaagttccagaagaagctgaaggagctgggccgcctgaatgccaaggccctgagcctgctgaccctgctgaatgtgtaccagaagaagcacctggtggagatcctgagctaccacaactgtgacagccagaccagaaatgcccctgagctggactgcctgatccggctgcaggcccagaacatccagcagaggcacatcgtgttcctgacagagaagaacatcaagatgctgagcagctacacagacaatggcatcgtggtggccacagctgaggacttcatgcagaacttcaagaacctggtgggctaccacaacagcatcacagaggagaacctgccccagctgggcgccaatgaaaacctggagagccagagtgatgctgtgctgaccctgacccccctggagctgggcgtgggcatcagccagcactag

SEQ ID NO: 38619 - DNA, 4830 bp, Artificial Sequence
  Description of Artificial Sequence: Synthetic coding sequence
atggccacagctgtggagacagaggcctgccagcccacagatgcctcctgggagagcggcggcggcggagatgatgagatgaagcaggccctgcctgagctggagagcagccagcagaatggaggcggcggcggcctgaacattgctgagcccagcggcggggccggccgggaggagaatgctggagctgaggccgcccagagcctgagccatgagcagccccaggacagcagcgaggccggggctgctgccctgccccggggccctgaggagcctgagaggcctgtgagaagaagcttccagatccccaggaagagccgggagaagaaggccctcttccagcccctgaccccaggcagccgggagtttgaagatgtggtgaacatcctgcacagcagctacctggagcccacctctgtgaccaacttcaactaccgccgggcctgcctggtgcacaatgagctgctggagaaggagttcacagagaagaggcgggagctgaagtttgatggccgcctggacaaggagctgtctgagagctatgccttcctgatggtggaccgctaccaggtgcagaccatctgtgagaagggcctgcacgtgggccagagcaagatcaccatcctgggcagccccagcatgggcgtgtacctgagccgctatgctgacctgctgcaggccaaccccctggacaccggggccatgggagatgtggtgatcttcaagatcatgaagggcaagatcaagagcatctatgaccccatgggcgtgaagagcctggagagcatgctgaacaagagcgccctggaccccacccccaagcatgagtgccacgtgtccaagaatgccaaccgcatcaccagcctgctggcctaccgggcctatgagctgacccagtactacttctatgaatatggctttgatgagctgcggcggcggcccaggcatgtgtgcccctatgctgtggtgtccttcacctacaaggatgacatccagacccccaagtttgtgcccagcagccgcagcaacagcttcaacacagacagaaatattgacaagtacaactacaccctgtggaagggccagctgctgaacaagggcaagctgctgtgctacatcagcctgcggagcgccacccgggccttcctgcccatcaagctgcctgagaagctggatgtggagaccgtgatgagcattgaccacctgaagcagaagatccccccagccctcttctacaaggagacctacctgggccccaatgaggtgctgaagaatggcatgtactgcagcctgtatgaggtggtggagaagacccgcatcggcagcaacatggagagcctgctgcagaagctggaccgggagaagctggtgctggtgaagcccctgggggaccggggctacctgttcctgctgagcccctaccagatggtgcccccctatgagtaccagacagccaagagccgggtgctgcacgccctcttcctgttccaggagcccaggagcatcgtgaccagccagaagggcagcaccaatgctgccccccaggagagacatgagagcatgccagatgtgctgaagatcgcccagttcctgcagttcagcctcatccagtgcaggaaggagttcaagaacatcagcgccatcaacttccacagcgtggtggagaagtatgtgtctgagttcttcaagaggggcttcggcagcggcaagcgggagttcatcatgttcccctatgacagccggctggatgacaagaagttcctgtacagcgcccccaggaacaagagccacatcgacacctgcctgcacgcctacatcttccggcctgaggtgtaccagctgcccatctgcaagctgaaggagctgtttgaagaaaataggaagctgcagcagttcagccccctgagtgactatgagggccaggaggaggagatgaatggcaccaagatgaagtttgggaagaggaacaacagcagaggagaggccatcatcagcggcaagcagaggagcagccacagcctggactatgacaaggacagagtgaaggagctgatcaacctgatccagtgcaggaagaagtctgtgggcggggacagcgacacagaggacatgaggagcaagacagtgctgaagaggaagctggaggacctgcctgagaacatgaggaagctggccaagaccagcaacctgtctgagaactgccacctgtatgaggagagcccccagcccatcggcagcctgggccatgatgctgacctgcggcggcagcagcaggacacctgcaacagcggcattgctgacatccacaggctcttcaactggctgtctgagaccctggccaatgcccggcacagtgatgccagcctgacagacacagtgaacaaggccctgggcctgagcacagatgatgcctatgaggagctgcggcagaagcatgaatatgagctgaacagcaccccagacaagaaggactatgagcagcccacctgtgccaaggtggagaatgcccagttcaagggcacccagagcctgctgctggaggtggatgccaccagcaagtacagcgtggccatcagcaccagcgaggtgggcacagaccacaagctgcacctgaaggaggaccccaacctgatctctgtgaacaactttgaggactgcagcctgtgccccagcgtgcccatcgagcacggcttccggcggcagcagagcaagagcaacaacgtggaggagacagagatccactggaagctgatccccatcacagacaccctgaagggcaccacagaagatgatgtgctgaccggccaggtggaggagcagtgtgtgcctgctgctgaggccgagcccccagctgtgtctgagaccacagagaggacagtgctgggggagtacaacctcttcagcaggaagattgaggagatcctgaagcagaagaatgtgtcctatgtgtccacagtgtccacccccatcttcagcacccaggagaagatgaagaggctgtctgagttcatctacagcaagaccagcaaggccggcgtgcaggagtttgtggatggcctgcacgagaagctgaacaccatcatcatcaaggccagcgccaagggcggcaacctgccccctgtgagccccaatgacagcggggccaagatcgccagcaaccccctggagcggcacgtgattcctgtgagcagcagtgacttcaacaacaagcacctgctggagcccctgtgcagcgaccccctgaaggacaccaacagtgatgagcagcacagcaccagcgccctgacagaggtggagatgaaccagccccagcacgccacagagctgatggtgaccagtgaccacatcgtgcctggggacatggcccgggagcctgtggaggagaccaccaagagccccagtgatgtgaacatcagcgcccagcctgccctgagcaacttcatcagccagctggagcctgaggtgttcaacagcctggtgaagatcatgaaggatgtgcagaagaacacagtgaagttctacatccacgaggaggaggagagcgtgctgtgcaaggagatcaaggagtacctgatcaagctgggcaacacagagtgccaccctgagcagttcctggagaggaggagcaagctggacaagctgctgatcatcatccagaatgaagatattgctggcttcatccacaagatccctggcctggtgaccctgaagaagctgccctgtgtgtcctttgctggggtggacagcctggatgatgtgaagaaccacacctacaatgagctgtttgtgtctgggggcttcatcgtgtctgatgagagcatcctgaaccctgaggtggtgacagtggagaacctgaagaacttcctgaccttcctggaggagctgagcaccccagagggcaagtggcagtggaaggtgcactgcaagttccagaagaagctgaaggagctgggccgcctgaatgccaaggccctgagcctgctgaccctgctgaatgtgtaccagaagaagcacctggtggagatcctgagctaccacaactgtgacagccagaccagaaatgcccctgagctggactgcctgatccggctgcaggcccagaacatccagcagaggcacatcgtgttcctgacagagaagaacatcaagatgctgagcagctacacagacaatggaattgtggtggccacagctgaggacttcatgcagaacttcaagaacctggtgggctaccacaacagcatcacagaggagaacctgccccagctgggcgccaatgaaaacctggagagccagagcgccctgctggagaatgatgagaaggatgaggaggacatgagcctggacagcggagatgagatcagccacatcgaggtgtgcagcaacttccacagcgagatctgggagaaggagaccaagggcagccggggcacagaccagaagaagaacacccagatcgagctgcagagcagcccagatgtgcagaacagcctgctggaggacaagacctacctggacagcgaggagaggaccagcattgatattgtgtgcagtgaaggagagaacagcaacagcacagagcaggacagctacagcaacttccaggtgtaccacagccagctgaacatgagccaccagttcagccacttcaacgtgctgacccaccagaccttcctgggcaccccctatgccctgagcagcagccagagccaggagaatgaaaactacttcctgagcgcctacacagagagcctggaccgggacaagagccccccacccctgtcctggggcaagagtgacagcagccggccctacagccaggagaagtag

SEQ ID NO: 38620 - DNA, 3702 bp, Artificial Sequence
  Description of Artificial Sequence: Synthetic coding sequence
atgagcattgaccacctgaagcagaagatccccccagccctcttctacaaggagacctacctgggccccaatgaggtgctgaagaatggcatgtactgcagcctgtatgaggtggtggagaagacccgcatcggcagcaacatggagagcctgctgcagaagctggaccgggagaagctggtgctggtgaagcccctgggggaccggggctacctgttcctgctgagcccctaccagatggtgcccccctatgagtaccagacagccaagagccgggtgctgcacgccctcttcctgttccaggagcccaggagcatcgtgaccagccagaagggcagcaccaatgctgccccccaggagagacatgagagcatgccagatgtgctgaagatcgcccagttcctgcagttcagcctcatccagtgcaggaaggagttcaagaacatcagcgccatcaacttccacagcgtggtggagaagtatgtgtctgagttcttcaagaggggcttcggcagcggcaagcgggagttcatcatgttcccctatgacagccggctggatgacaagaagttcctgtacagcgcccccaggaacaagagccacatcgacacctgcctgcacgcctacatcttccggcctgaggtgtaccagctgcccatctgcaagctgaaggagctgtttgaagaaaataggaagctgcagcagttcagccccctgagtgactatgagggccaggaggaggagatgaatggcaccaagatgaagtttgggaagaggaacaacagcagaggagaggccatcatcagcggcaagcagaggagcagccacagcctggactatgacaaggacagagtgaaggagctgatcaacctgatccagtgcaggaagaagtctgtgggcggggacagcgacacagaggacatgaggagcaagacagtgctgaagaggaagctggaggacctgcctgagaacatgaggaagctggccaagaccagcaacctgtctgagaactgccacctgtatgaggagagcccccagcccatcggcagcctgggccatgatgctgacctgcggcggcagcagcaggacacctgcaacagcggcattgctgacatccacaggctcttcaactggctgtctgagaccctggccaatgcccggcacagtgatgccagcctgacagacacagtgaacaaggccctgggcctgagcacagatgatgcctatgaggagctgcggcagaagcatgaatatgagctgaacagcaccccagacaagaaggactatgagcagcccacctgtgccaaggtggagaatgcccagttcaagggcacccagagcctgctgctggaggtggatgccaccagcaagtacagcgtggccatcagcaccagcgaggtgggcacagaccacaagctgcacctgaaggaggaccccaacctgatctctgtgaacaactttgaggactgcagcctgtgccccagcgtgcccatcgagcacggcttccggcggcagcagagcaagagcaacaacgtggaggagacagagatccactggaagctgatccccatcactggaggaaatgcccggagccctgaggaccagctgggcaagcatggagagaagcagaccccagacaccctgaagggcaccacagaagatgatgtgctgaccggccaggtggaggagcagtgtgtgcctgctgctgaggccgagcccccagctgtgtctgagaccacagagaggacagtgctgggggagtacaacctcttcagcaggaagattgaggagatcctgaagcagaagaatgtgtcctatgtgtccacagtgtccacccccatcttcagcacccaggagaagatgaagaggctgtctgagttcatctacagcaagaccagcaaggccggcgtgcaggagtttgtggatggcctgcacgagaagctgaacaccatcatcatcaaggccagcgccaagggcggcaacctgccccctgtgagccccaatgacagcggggccaagatcgccagcaaccccctggagcggcacgtgattcctgtgagcagcagtgacttcaacaacaagcacctgctggagcccctgtgcagcgaccccctgaaggacaccaacagtgatgagcagcacagcaccagcgccctgacagaggtggagatgaaccagccccagcacgccacagagctgatggtgaccagtgaccacatcgtgcctggggacatggcccgggagcctgtggaggagaccaccaagagccccagtgatgtgaacatcagcgcccagcctgccctgagcaacttcatcagccagctggagcctgaggtgttcaacagcctggtgaagatcatgaaggatgtgcagaagaacacagtgaagttctacatccacgaggaggaggagagcgtgctgtgcaaggagatcaaggagtacctgatcaagctgggcaacacagagtgccaccctgagcagttcctggagaggaggagcaagctggacaagctgctgatcatcatccagaatgaagatattgctggcttcatccacaagatccctggcctggtgaccctgaagaagctgccctgtgtgtcctttgctggggtggacagcctggatgatgtgaagaaccacacctacaatgagctgtttgtgtctgggggcttcatcgtgtctgatgagagcatcctgaaccctgaggtggtgacagtggagaacctgaagaacttcctgaccttcctggaggagctgagcaccccagagggcaagtggcagtggaaggtgcactgcaagttccagaagaagctgaaggagctgggccgcctgaatgccaaggccctgagcctgctgaccctgctgaatgtgtaccagaagaagcacctggtggagatcctgagctaccacaactgtgacagccagaccagaaatgcccctgagctggactgcctgatccggctgcaggcccagaacatccagcagaggcacatcgtgttcctgacagagaagaacatcaagatgctgagcagctacacagacaatggaattgtggtggccacagctgaggacttcatgcagaacttcaagaacctggtgggctaccacaacagcatcacagaggagaacctgccccagctgggcgccaatgaaaacctggagagccagagcgccctgctggagaatgatgagaaggatgaggaggacatgagcctggacagcggagatgagatcagccacatcgaggtgtgcagcaacttccacagcgagatctgggagaaggagaccaagggcagccggggcacagaccagaagaagaacacccagatcgagctgcagagcagcccagatgtgcagaacagcctgctggaggacaagacctacctggacagcgaggagaggaccagcattgatattgtgtgcagtgaaggagagaacagcaacagcacagagcaggacagctacagcaacttccaggtgtaccacagccagctgaacatgagccaccagttcagccacttcaacgtgctgacccaccagaccttcctgggcaccccctatgccctgagcagcagccagagccaggagaatgaaaactacttcctgagcgcctacacagagagcctggaccgggacaagagccccccacccctgtcctggggcaagagtgacagcagccggccctacagccaggagaagtag

SEQ ID NO: 38621 - DNA, 7293 bp, Artificial Sequence
  Description of Artificial Sequence: Synthetic coding sequence
atggcccccccagcccacaagagcatcctggagaggagtgaaaatgtgctgatgagcccctggaagggcaagctgattgtgcaggacaggatgctgtgtgacatcgccctgtggagcacctatggagccatgatccccacccagctgccccaggagctggacttcaagtatgtgatgaaggtgagcagcctgaagaagaggctgcctgaggccgccttcaggaagcagaactacctggaggagaaggtgtgcttccaggacctgtgcttcaacctgtatgaggtggagctgagcaaccggcagggagaaaatattgacaagctgacagagtgcatcaagaacaagcagctggccatcatcaagtgcctggaggaccggggcttcttcatcctgctgaccagcagcgccctgctgtctgagccagactttggaggcaagcagatgggcctgcacggcctgcacctgttccgcagccccctgagcactggagtgaaggacctgaaggtggaggatgacatctccatgaaggtgatccccatcctgagcaccctgaactgtgccctgctggagaccaagaagagcctgcctgaggagcgcatccaccccaacaccctggtgaagaggcacttccaggagctgtacaaggctgacaggagccccagcctgtctgtggccccccaggacaggatgaaggaccccaccttcctgggcaagctgcccagcggctttgacctgatccccccagctgagaagtgccccagcgagagcctgacccagctgaacagctacttcagtgaccccagcgcctacatcctggaggtgtccacagccctggacctgctggccgagcacccccagagcccctgtgtgtctgatggcatctgtgatgctggcttcagcctggtgatgaccccagaccctgagttcctggtgtctgaggccgaggtgaggaaggagacagagaccaagaaggacagcgaggagatgctgaaggccaagaagagggtcttccccctgagccctgccagcaacctgcgggtgcagcccaagaggaaggcctccatgccccacatggtgcagagcaagaaggtgaacctgtgccggcccttccccaagaggacagccagcagagctgacaacagcagtgacagccccaccaccctgaagctggtgaagggccagttcccccagaagaggaagagaggagctgaggtgctgacagcccagtttgtgcagaagaccaagctggacaggaagaaccaggaggcccccatcagcaaggatgtgcctgtgcccaccaatgccaagagggccaggaagcaggagaagagccctgtgaagacagtgccccgggccaagccccctgtgaagaagagcccccagaagcagagggtgaacatcgtgaagggaaatgaaaaccccaggaacaggaagcagctgcagcctgtgaagggggagacagccagcaagctgcagagcgagatcagccggggctgccaggaggatggcatcagcatcaacagcgtgcagcctgagaacaccacagctgcccacaatgacctgcctgaaaattccatcgtgaactatgacagccaggccctgaacatgctggccgacctggccctgagcagcgccaccagcagcacccctgtgtctgaggccaggaacctgcactgcagcagcgagctgccccagaatgatgtgctgctgagcaaagaaaacagcctgcggggcaccagtgaccacgagtaccacagaggagtgaagacccagaagggggagctgctgcccaaccccagcagtgacaggaagagcaacagcggcagtgacctgactgtgtcccaggatgaggagagcctggtgccctgcagccaggccccagccaaggcccagagcgccctgacagaggagatgctggagagcagtgatgccagccagagcagctctgtgtctgtggagcacagctatgccctgctgctgacagagcacagcaagaagcacctgcaggagcgggagatcctgagccccctcttccccagaaatggcaccaagagccctgaggccgccacccctgtgggcaaggtgatgcccttccgccaccagcccggcctgctgctgcagcagaagcccccagatgatcctgtggtgaagcccaaggaccggccccccagcgcccgggtgaagaagagcagctgcagcagaattgtgctgagctgtgatgacagcgtgaagatcaccttcaagtgtgaaacagaatatgccttcagcctggacagcaagtacaccaacaaccccctggagaagacagtggtgcgggccctgcacggcccctggaacacagacctgcctgacaacgtggaggaggtgaagctgctgctgcacatgtgggtggccctcttctacagcaaccagaacaagatcatccgcagcagcaggaaggtggtggagcacagcaacccagccaagtatgtgtccatcaacagcaccctggagagctgtgagctgcgggagattgaggagagcctgggcctggagaagtgcagcgctgacagcctgctggagaccaatgagatcagccgggcccatgctgctgaggtgtccttccgggaccccaactgcctgctgcccttcatcaagacccccctgacccagggcctggagctgtgtgtgcagaatgagcagaagaagacctttgccagagaatgtgaccctgacacccaggaggaccagaacttcatctgcagctacaacaatgaggtgactggagaggaggccaagcaggagagcctggagaccagcaacctggtgctgagcggcatcggcagcacccagaccaacggccccagcgtgcccagcgaggaggagatcgtgcagcccctggacagcaccagggtggccagctacagcggcaccgtgacccaggccaccttcaccaggacctatgatggccctggcagccagcccgtcatctgccagagctctgtgtatggcaccctggagaacaaggtggacatcctggatgctgctgtgcagaccaagacaggcaccctgcaggacctgatccagcacggcagccccatcaacaatgaatgccaccccagcctggagaggaaggatgacaacatgggctgtgctgtgatcaaccctgagcccatcaccctgacctttgagaagaatgcccacgtgcccatccagacagagggcgtgaacacagcagatgagaggaccaccttcaagaaggagctgatcaagcaggtgtccccagctgccagcctgcggcaccctgtgtccaccagtgaaaatgcccggacccagggcctgcgggacatccccagcctggtggtggccggccagaagggcaccaagtacctgtgtgccagctctgtgggcggggagaccctggacaaggctgtgtgcagcctgcagaaggagacccccctgcctgtgtccctgcccagcgacaagaccatggtgatggaggccctgagcctggccaagagcagcagccacctgagccccagcgaggaggtgcgctgcacccaggacttcctgagccagacccagagcctgctgggcctgagcagcgagggcctgctggagctgacccaggtggaggtggacagcagcagcgccagcaccaccctgggccggcagtgcagcctgaactgcatcagcagcggctgccacaccagcggggacagcctggagctgaggaagaaccacaagaatggccccaacacagagaacatgaacctggaggcctttgattctgtgttcatcaagcagaccagcctgtctgtgtcccgggaggtgtccctggagctgtctgaggaggacagcgacatcgacctggccctgaccatcagcccccccaccagcccccgggaggagatgcctgctggggagattgagcagtttgaggaggcccccttcagcaacctggagctgcaggatgtggccgaggagattggagagcctgaggaggtggccctgacagagagccgggaggtgtcctctgctgacaacgtgtctgtgtaccccagcgtgtctgaggagcctgtggagaacaaggagaggaagggggacaacctgcagcctgtgaccctcatcctgagcaaggagaactgcaccctggagattgctgaggagatcaacgtgaccagtgacttcccctttgacagcgtcatcgaggaggtgtccccagccagcagccctgagccccctgtgcctgtgaaggagacccggccctaccaggccgtgaccccctgcatcctgaagctgcacggcacccagtgtgagaagagcaaccagatcagccagtgtgagagcgaggacctgggcatcacagagaaggaaaatgtgtttgtgggccccacccaccctgtgggccaggacaacttcacccaggtgcagcagatgcaggtgtctgctgagatgcccctcatcctgacagaccaccctggccgcacaggccggcccaccctgcccgggaaggtgacagaggagatcgtgagcagcgagcatgatgagggcctgtccttcagcggcaaggtgcagtgctacggccgggagctgaaccagcctgccagcgctgccaagtgcacaggagacttcagccccagccctgagaagctggtgaagagcggcaaccccctgcagcctgtgtccattgagaacagaaacctggacctgaagcacctggtgctggagagcagcgagccccccttcggccccagaaatgtgattgagaacaagagcctgagtgacaccctggtgtccaccacagcccccagcggcatcgtgaatgtgtctgtgaagcagcagaccagccccaagagcagccagaaccacctgtttcctggggacctgaagacagatgagggcatctacctgcaggtgaagagcctgacagctgcctctgtggatggagcctacagcacccagggctgcatgtgcagcgtggtgcccaccctgtgcagcagcagtgacaatgccaccctgacccactacgtgcggcccatcaatgctgagcccgtcttccaggcccaggagatcccagctggccgcatggccagcctgctgaagaatggagagcctgaggccgagctgcacaaggagaccaccggccctggaacagctggcccccagagcaacaccaccagcagcctgaagggggagaggaaggccatccacaccctgcaggatgtgtccacctgtgagaccaaggagctgctgaatgtgggcgtgagcagcctgtgtgccggcccctaccagaacacagctgacaccaaggagaacctgagcaaggagcccctggccagctttgtgtctgagagctttgacacctctgtgtgtggcatcgccacagaacatgtggagattgaaaattctggagagggcctgcgggcagaggccggcagcgagaccctgggcagagatggagaggtgggcgtgaacagcgacatgcactatgagctgagcggggacagcgacctggacctgctgggggactgcaggaacccccggctggacctggaggacagctacaccctgcggggcagctacaccaggaagaaggatgtgcccacagatggctatgagagcagcctgaacttccacaacaacaaccaggaggactggggctgcagctcctgggtgcccggcatggagaccagcctgcccccaggccactggacagctgctgtgaagaaggaggagaagtgtgtgcccccctacgtgcagatccgggacctgcacggcatcctgcggacctacgccaacttcagcatcaccaaggagctgaaggacaccatgaggaccagccacggcctgcggcggcaccccagcttcagcgccaactgtggcctgcccagctcctggaccagcacctggcaggtggctgatgacctgacccagaacaccctggacctggagtacctgcgctttgcccacaagctgaagcagaccatcaagaatggagacagccagcacagcgccagcagcgccaacgtgttccccaaggagagccccacccagatcagcattggagccttccccagcaccaagatcagcgaggcccccttcctgcacccagcccccaggagccgcagccccctgctggtgacagtggtggagagtgacccccggccccagggccagccccggcggggctacacagccagcagcctggacagcagcagctcctggagggagcgctgcagccacaacagagacctgaggaacagccagaggaaccacacagtgtccttccacctgaacaagctgaagtacaacagcacagtgaaggagagcagaaatgacatcagcctcatcctgaatgaatatgcagagttcaacaaggtgatgaagaacagcaaccagttcatcttccaggacaaggagctgaatgatgtgtctggagaggccacagcccaggagatgtacctgcccttccctggccgcagcgccagctatgaggacatcatcattgatgtgtgcaccaacctgcacgtgaagctgcggtctgtggtgaaggaggcctgcaagagcaccttcctgttctacctggtggagacagaggacaagagcttctttgtgaggaccaagaacctgctgaggaaaggaggccacacagaaattgagccccagcacttctgccaggccttccacagagaaaatgacaccctcatcatcatcatcagaaatgaagacatcagcagccacctgcaccagatccccagcctgctgaagctgaagcacttccccagcgtcatctttgctggggtggacagccctggagatgtgctggaccacacctaccaggagctgttccgggccggcggcttcgtcatcagtgatgacaagatcctggaggccgtgaccctggtgcagctgaaggagatcatcaagatcctggagaagctgaatggaaatggccgctggaagtggctgctgcactaccgggagaacaagaagctgaaggaggatgagcgggtggacagcacagcccacaagaagaacatcatgctgaagagcttccagagcgccaacatcatcgagctgctgcactaccaccagtgtgacagccgcagcagcaccaaggccgagatcctgaagtgcctgctgaacctgcagatccagcacattgatgccaggtttgctgtgctgctgacagacaagcccaccatcccccgggaggtgtttgagaacagcggcatcctggtgacagatgtgaacaacttcatcgagaacatcgagaagattgctgcccccttccgcagcagctactggtag

SEQ ID NO: 38622 - DNA, 4878 bp, Artificial Sequence
  Description of Artificial Sequence: Synthetic coding sequence
atggcccccccagcccacaagagcatcctggagaggagtgaaaatgtgctgatgagcccctggaagggcaagctgattgtgcaggacaggatgctgtgtgacatcgccctgtggagcacctatggagccatgatccccacccagctgccccaggagctggacttcaagtatgtgatgaaggtgagcagcctgaagaagaggctgcctgaggccgccttcaggaagcagaactacctggaggagaaggtgtgcttccaggacctgtgcttcaacctgtatgaggtggagctgagcaaccggcagggagaaaatattgacaagctgacagagtgcatcaagaacaagcagctggccatcatcaagtgcctggaggaccggggcttcttcatcctgctgaccagcagcgccctgctgtctgagccagactttggaggcaagcagatgggcctgcacggcctgcacctgttccgcagccccctgagcactggagtgaaggacctgaaggtggaggatgacatctccatgaaggtgatccccatcctgagcaccctgaactgtgccctgctggagaccaagaagagcctgcctgaggagcgcatccaccccaacaccctggtgaagaggcacttccaggagctgtacaaggctgacaggagccccagcctgtctgtggccccccaggacaggatgaaggaccccaccttcctgggcaagctgcccagcggctttgacctgatccccccagctgagaagtgccccagcgagagcctgacccagctgaacagctacttcagtgaccccagcgcctacatcctggaggtgtccacagccctggacctgctggccgagcacccccagagcccctgtgtgtctgatggcatctgtgatgctggcttcagcctggtgatgaccccagaccctgagttcctggtgtctgaggccgaggtgaggaaggagacagagaccaagaaggacagcgaggagatgctgaaggctgtgtgcagcctgcagaaggagacccccctgcctgtgtccctgcccagcgacaagaccatggtgatggaggccctgagcctggccaagagcagcagccacctgagccccagcgaggaggtgcgctgcacccaggacttcctgagccagacccagagcctgctgggcctgagcagcgagggcctgctggagctgacccaggtggaggtggacagcagcagcgccagcaccaccctgggccggcagtgcagcctgaactgcatcagcagcggctgccacaccagcggggacagcctggagctgaggaagaaccacaagaatggccccaacacagagaacatgaacctggaggcctttgacagcgtcttcatcaagcagaccagcctgtctgtgtcccgggaggtgtccctggagctgtctgaagaagattctgacatcgacctggccctgaccatcagcccccccaccagcccccgggaggagatgcctgctggggagattgagcagtttgaggaggcccccttcagcaacctggagctgcaggatgtggccgaggagatcggggagcctgaggaggtggccctgacagagagccgggaggtgagcagcgctgacaacgtgtctgtgtaccccagcgtgtctgaggagcctgtggagaacaaggagaggaaaggagacaacctgcagcctgtgaccctcatcctgagcaaagaaaactgcaccctggagattgctgaggagatcaacgtgaccagtgacttcccctttgattctgtgattgaggaggtgtccccagccagcagccctgagccccctgtgcctgtgaaggagacccggccctaccaggccgtgaccccctgcatcctgaagctgcacggcacccagtgtgagaagagcaaccagatcagccagtgtgagagcgaggacctgggcatcacagagaaggaaaatgtgtttgtgggccccacccaccctgtgggccaggacaacttcacccaggtgcagcagatgcaggtgtctgctgagatgcccctcatcctgacagaccaccctggccgcacaggccggcccaccctgcccgggaaggtgacagaggagatcgtgtccagtgaacatgatgagggcctgtccttcagcggcaaggtgcagtgctacggccgggagctgaaccagcctgccagcgctgccaagtgcaccggggacttcagccccagccctgagaagctggtgaagagcggcaaccccctgcagcctgtgtccattgaaaatagaaacctggacctgaagcacctggtgctggagagcagcgagcccccatttggccccagaaatgtgattgagaacaagagcctgagtgacaccctggtgtccaccacagcccccagcggcatcgtgaatgtgtctgtgaagcagcagaccagccccaagagcagccagaaccacctgtttcctggggacctgaagacagatgagggcatctacctgcaggtgaagagcctgacagctgcctctgtggatggagcctacagcacccagggctgcatgtgcagcgtggtgcccaccctgtgcagcagcagtgacaatgccaccctgacccactacgtgcggcccatcaatgctgagcctgtgttccaggcccaggagatcccagctggccgcatggccagcctgctgaagaatggagagcctgaggccgagctgcacaaggagaccactggacctggaacagctggcccccagagcaacaccaccagcagcctgaagggggagaggaaggccatccacaccctgcaggatgtgtccacctgtgagaccaaggagctgctgaatgtgggcgtgagcagcctgtgtgccggcccctaccagaacacagctgacaccaaggagaacctgagcaaggagcccctggccagctttgtgtctgagagctttgacacctctgtgtgtggcatcgccacagagcacgtggagattgagaacagcggggagggcctgcgggcagaggccggcagcgagaccctgggcagagatggagaggtgggcgtgaacagcgacatgcactatgagctgagcggggacagcgacctggacctgctgggggactgcaggaacccccggctggacctggaggacagctacaccctgcggggcagctacaccaggaagaaggatgtgcccacagatggctatgagagcagcctgaacttccacaacaacaaccaggaggactggggctgcagctcctgggtgcccggcatggagaccagcctgcccccaggccactggacagctgctgtgaagaaggaggagaagtgtgtgcccccctacgtgcagatccgggacctgcacggcatcctgcggacctacgccaacttcagcatcaccaaggagctgaaggacaccatgaggaccagccacggcctgcggcggcaccccagcttcagcgccaactgtggcctgcccagctcctggaccagcacctggcaggtggctgatgacctgacccagaacaccctggacctggagtacctgcgctttgcccacaagctgaagcagaccatcaagaatggagacagccagcacagcgccagcagcgccaacgtgttccccaaggagagccccacccagatcagcatcggggccttccccagcaccaagatcagcgaggcccccttcctgcacccagcccccaggagccgcagccccctgctggtgacagtggtggagagtgacccccggccccagggccagccccggcggggctacacagccagcagcctggacagcagcagctcctggagggagcgctgcagccacaacagagacctgaggaacagccagaggaaccacacagtgtccttccacctgaacaagctgaagtacaacagcacagtgaaggagagcagaaatgacatcagcctcatcctgaatgaatatgcagagttcaacaaggtgatgaagaacagcaaccagttcatcttccaggacaaggagctgaatgatgtgtctggagaggccacagcccaggagatgtacctgcccttccctggccgcagcgccagctatgaggacatcatcattgatgtgtgcaccaacctgcacgtgaagctgcggtctgtggtgaaggaggcctgcaagagcaccttcctgttctacctggtggagacagaggacaagagcttctttgtgaggaccaagaacctgctgaggaagggcggccacacagaaattgagccccagcacttctgccaggccttccaccgggagaatgacaccctcatcatcatcatcagaaatgaagacatcagcagccacctgcaccagatccccagcctgctgaagctgaagcacttccccagcgtcatctttgctggggtggacagccctggagatgtgctggaccacacctaccaggagctgttccgggccggcggctttgtgatcagtgatgacaagatcctggaggccgtgaccctggtgcagctgaaggagatcatcaagatcctggagaagctgaatggaaatggccgctggaagtggctgctgcactaccgggagaacaagaagctgaaggaggatgagcgggtggacagcacagcccacaagaagaacatcatgctgaagagcttccagagcgccaacatcatcgagctgctgcactaccaccagtgtgacagccgcagcagcaccaaggccgagatcctgaagtgcctgctgaacctgcagatccagcacattgatgccaggtttgctgtgctgctgacagacaagcccaccatcccccgggaggtgtttgaaaattctggcatcctggtgacagatgtgaacaacttcattgaaaatattgagaagattgctgcccccttccgcagcagctactggtag

SEQ ID NO: 38623 - DNA, 27 bp, Artificial Sequence
  Description of Artificial Sequence: Synthetic coding sequence
atggcccccccagcccacaagagctag

SEQ ID NO: 38624 - DNA, 639 bp, Artificial Sequence
  Description of Artificial Sequence: Synthetic coding sequence
atgggcacccggcagaccaagggcagcctggccgagcgggccagccctggggccgcccctggcccccggcgggagaggccagacttctgggccagcctgctgctgcgggccggggacaaggccggccgggccggggccggcatgccaccctaccacagaagagtgggcatggtgcaggagctgctgaggatggtgcggcagggcagaagagaggaggccggcaccctgctgcagcacctgcggcaggacctgggcatggagagcaccagcctggatgatgtgctgtaccgctatgccagcttcaggaacctggtggaccccatcacccatgacctgatcatcagcctggcccgctacatccactgccccaagccaccccagggctgccccggcaggaagccaccccggcagcacagcggccctgtgggcaaccccacagacctgcccaggcctggagctggggaccagctgcccacagccctgtggggcgccggccggcagagaggagctggcctgcaccggccccacggcagacatggccctgctgctgctgccagcacccagcacccagccccaccccaccacacaggcacccagtggcagcctgtggaccccggccgggccgcccggccccactag

SEQ ID NO: 38625 - DNA, 1035 bp, Artificial Sequence
  Description of Artificial Sequence: Synthetic coding sequence
atgggcacccggcagaccaagggcagcctggccgagcgggccagccctggggccgcccctggcccccggcgggagaggccagacttctgggccagcctgctgctgcgggccggggacaaggccggccgggccggggccggcatgccaccctaccacagaagagtgggcatggtgcaggagctgctgaggatggtgcggcagggcagaagagaggaggccggcaccctgctgcagcacctgcggcaggacctgggcatggagagcaccagcctggatgatgtgctgtaccgctatgccagcttcaggaacctggtggaccccatcacccatgacctgatcatcagcctggcccgctacatccactgccccaagccagaaggagatgccctgggcgccatggagaagctgtgccggcagctgacctaccacctgagcccccacagccagtggaggaggcaccggggcctggtgaagaggaagccccaggcctgcctgaaggctgtgctggccggcagccccccagacaacacagtggacctgagcggcatccccctgaccagccgggacctggagcgggtgaccagctacctgcagagatgtggggagcaggtggacagcgtggagctgggcttcaccggcctgacagatgacatggtgctgcagctgctgcctgccctgagcaccctgccccggctgaccaccctggccctgaatggaaaccggctgaccagggctgtgctgcgggacctgacagacatcctgaaggaccccagcaagttccccaacgtgacctggattgacctgggcaacaacgtggacatcttcagcctgccccagcccttcctgctgagcctgaggaagaggagccccaagcagggccacctgcccaccatcctggagctgggggagggccctggcagcggggaggaggtgcgggagggcaccgtgggccaggaggaccccggcggcggccctgtggccccagctgaggaccaccacgagggcaaggagaccgtggccgccgcccagacctag

SEQ ID NO: 38626 - DNA, 948 bp, Artificial Sequence
  Description of Artificial Sequence: Synthetic coding sequence
atgggcgcccggctgggcagaagagctggccctgaggccggcagcgaggccggggctgctgctggctgcggccctgccccctatgaaagaagagtgcgctggctgcgggagatccagagcaccctgcgggagaggaggcctgagcgggcccggcagctgctgcggctgctgcggcaggacctgggcctggagaggaccctgctgcctgacatcctgtacagagatgtggccttcctgaaccctgtggaccccatcagccatgacctgctggtgaacctggcccgggacctgcagtgccccaagaaggactatgagctgtggaagagcagtgacaagatctgccggcagctgatctaccacctgaccccccacagcaagcagcagcagggcagcagcctgcggcagaggaagacccagagctgcctgaagagcagcctgcagaagaccctgctggccggggagaccgtggacctgagcggcatccccctgagcacccaggatgtgcagcacatcacccgctacctgagcagccacggggctgtgctggccgtgctggacctgtccttcaccggcctgagtgatgagctgctgcacctgctgctgcccagcctgtgggccctgccccggctgacccagctgctgctgaatggaaaccggctgacccgggccacagccaggaagctgacagatgccatcaaggacaccaccaagtttcctgccctggcctgggtggacctgggcaacaacgtggatgtggccagcctgccccagcccctgctggtgggcctgcggcggcggctgagccagaggaccagcctgcccaccatctatgagggcctggacctggagcctgagggcagcgctgctggggccaccaccccagccagcacctgggacagcacagctgctggcctgggccctgagccccaggcctgctgtgccaggtag

SEQ ID NO: 38627 - DNA, 864 bp, Artificial Sequence
  Description of Artificial Sequence: Synthetic coding sequence
atggacatgcacagcgcccggctggacagcttcctgagccagctgcgctgggagctgctgtgtggccgggacaccggcagccccagcatgcctggccccctgcagcccaccagccagacaggcccagatgtgcagcccagccaccagctgcgggccagcggggccctggaggaggacagcgtgtgctgcgtggaggaggaggaggaggaggaggaggaggccgtggtgacagaggacagagatgctgccctgggcggcccccgggagcacgccctggactgggacagcggcttcagcgaggtgtctggcagcacctggagggaggaggagctgcctgtgtcccagaggcctgcccccagcgcccagcccctgcggcggcagtgcctgtctgtgtctggcctgcccatgcccagccgggcccctgtggcctctgtgccccctgtgcaccacccccggcccaagagcaccccagatgcctgcctggagcactggcagggcctggaggccgaggactggacagctgccctgctgaacagaggccgcagccggcagcccctggtgctgggggacaactgctttgctgacctggtgcacaactggatggagctgcctgagaccggcagcgagggcggagatggcggcggccaccgggcccgggcccggcccccccagttcctgctgggcctgtctgagcagctgcggcggcggctggcccgggccaggagaacagccatggccggcaagaggctgagctgcccccccaggcctgagcctgagctgcctgcagatgtgtccagatttgctgccctgatgagctgccgcagccggcagcccatcatctgcaatgatgtgtcctacctgtag

SEQ ID NO: 38628 - DNA, 894 bp, Artificial Sequence
  Description of Artificial Sequence: Synthetic coding sequence
atgaccatggagagccgggagatggactgctacctgcggcggctgaagcaggagctgatgtccatgaaggaggtgggagatggcctgcaggaccagatgaactgcatgatgggcgccctgcaggagctgaagctgctgcaggtgcagacagccctggagcagctggagatcagcggcggcggccctgtgcccggcagccctgagggccccaggacccagtgtgagcacccctgctgggagggcggccggggccctgcccggcccaccgtgtgcagccccagcagccagcccagcctgggcagcagcaccaagttccccagccacaggtctgtgtgtggccgggacctggcccccctgcccaggacccagccccaccagagctgtgcccagcagggccctgagcgggtggagccagatgactggaccagcaccctgatgagccggggcaggaaccggcagcccctggtgctgggggacaacgtgtttgctgacctggtgggcaactggctggacctgcctgagctggagaagggcggggagaagggggagaccggcggggcccgggagcccaagggggagaagggccagccccaggagctgggccgccgctttgccctgacagccaacatcttcaagaagttcctgcggtctgtgcggccagaccgggaccggctgctgaaggagaagccaggctgggtgacccccatggtgcctgagagcaggacaggccgcagccagaaggtgaagaagaggagcctgagcaaaggaagtggccacttccccttccctggcactggagagcacagaagaggagagaacccccccaccagctgccccaaggccctggagcacagccccagcggctttgacatcaacacagctgtgtgggtgtag

SEQ ID NO: 38629 - DNA, 849 bp, Artificial Sequence
  Description of Artificial Sequence: Synthetic coding sequence
atgaggcagctgatgtccatgaaggaggtgggagatggcctgcaggaccagatgaactgcatgatgggcgccctgcaggagctgaagctgctgcaggtgcagacagccctggagcagctggagatcagcggcggcggccctgtgcccggcagccctgagggccccaggacccagtgtgagcacccctgctgggagggcggccggggccctgcccggcccaccgtgtgcagccccagcagccagcccagcctgggcagcagcaccaagttccccagccacaggtctgtgtgtggccgggacctggcccccctgcccaggacccagccccaccagagctgtgcccagcagggccctgagcgggtggagccagatgactggaccagcaccctgatgagccggggcaggaaccggcagcccctggtgctgggggacaacgtgtttgctgacctggtgggcaactggctggacctgcctgagctggagaagggcggggagaagggggagactggaggagcccgggagcccaagggggagaagggccagccccaggagctgggcagaagatttgccctgacagccaacatcttcaagaagttcctgcggtctgtgcggccagaccgggaccggctgctgaaggagaagccaggctgggtgacccccatggtgcctgagagcaggacaggccgcagccagaaggtgaagaagaggagcctgagcaagggcagcggccacttccccttccctggcaccggggagcacagaagaggagaaaatccacccaccagctgccccaaggccctggagcacagccccagcggctttgacatcaacacagctgtgtgggtgtag

SEQ ID NO: 38630 - DNA, 3231 bp, Artificial Sequence
  Description of Artificial Sequence: Synthetic coding sequence
atgaagccagaccgggacaccctggatgagtactttgaatatgatgctgaggagttcctggtgtccctggccctgctgatcacagagggccgcaccccagagtgcagcgtgaagggccgcacagagagcttccactgccccccagcccagagctgctaccctgtgaccaccaagcatgagtgcagcgacaagctggcccagtgccggcaggcccggaggaccaggtctgaggtgaccctgctgtggaagaacaacctgcccatcatggtggagatgatgctgctgcctgactgctgctacagtgatgatggccccaccacagagggcatcgacctgaatgaccctgccatcaagcaggatgccctgctgctggagcgctggatcctggagcctgtgccccggcagaatggagaccgcttcatcgaggagaagaccctgctgctggccgtgcgcagctttgtgttcttcagccagctgagcgcctggctgtctgtgtcccatggagccatccccaggaacatcctgtaccgcatctctgctgctgatgtggacctgcagtggaacttcagccagacccccatcgagcacgtgtttcctgtgcccaacgtgagccacaacgtggccctgaaggtgtctgtgcagagcctgccccggcagagcaactaccctgtgctgacctgcagcatccacaccaacatcggcctgtatgagaagaggatccagcagcacaagctgaagacccaccagcaccacaaccccaatgaggccgagcagtgtggcaccaacagcagccagaggctgtgcagcaagcagacctggaccatggcccctgagagcgtgctgcacgccaagagcggccccagccctgagtacacagctgctgtgaagaacatcaagctgtacccaggcaccggcagcaagagtgaccacggcaccagccaggccaacatcctgggcttctctggaattggagacatcaagagccaggagacctctgtgaggaccctgaagagcttctccatggtggacagcagcatcagcaaccggcagagcttctggcagagcgctggggagaccaaccccctgattggcagcctcatccaggagcggcaggagatcatcgccagaattgcccagcacctgatccactgtgaccccagcaccagccacgtgtctggccggcccttcaacacccaggagagcagcagcctgcacagcaagctgttccgggtgtcccaggagaatgaaaatgtgggcaagggcaaggaggccttctccatgaccttcggcagccctgagttcagcagccctgaggacaccaatgaaggcaagatccggctgaagccagagacccccaggtctgagacctgcatcagcaatgacttctacagccacatgcctgtgggggagaccaaccccctgattggcagcctgctgcaggagcggcaggacgtcatcgccagaattgcccagcacctggagcacatcgaccccacagccagccacatcccccggcagagcttcaacatgcatgacagcagctctgtggccagcaaggtgttccgcagcagctatgaggacaagaacctgctgaagaagaacaaggatgagagctctgtgtccatcagccacaccaagtgcagcctgctgggggacatcagtgatggcaagaacctggtgcccaacaagtgcttcaccagcttcaagaacaacagcaaggagaagtgcagcctgaagcaccagaccaggaaccagtgccagaacaaccccagcgagatcatccagagcacctaccaggagacccagaacaagagcagcagcctgagcaccagcagcatcctgagccagcacaaggagaacaacctggacctgaccagccgcttcaaggagcaggagatgagcaatggaattgacaagcagtacagcaactgcaccaccatcgacaagcagatctgcaccaacaagtacaaggagaagatcatcaatgaaaactacaaccccaagttcttcggcaacctgcagagtgatgacagcaagaagaatgacagcaagatcaaggtgacagtgctggagatgtctgagtacctgaacaagtatgaatccatgagcagcaacaaggacagcaagaggcccaagacctgtgagcagaacacccagctgaacagcattgagaactacctgaacaaggacaatgaaggcttcaagtgcaagaagagtgaccagctgaagaatgagcaggacaagcaggaggaccccaccaatgagaagagccagaactacagccagaggaggagcatcaaggactgcctgagcacctgtgagcagcccaagaacacagaggtgctgcggaccaccctgaagcacagcaatgtgtggaggaagcacaacttccacagcctggatggcaccagcacccgggccttccacccccagacaggcctgcccctgctgagcagccctgtgccccagaggaagacccagagcggctgctttgacctggacagcagcctgctgcacctgaagagcttcagcagccgcagcccccggccctgcctgaacattgaagatgatcctgacatccacgagaagcccttcctgagcagcagcgccccacccatcaccagcctgagcctgctgggcaactttgaggagagcgtgctgaactacagatttgaccccctgggcatcgtggatggcttcaccgctgaggtgggcgccagcggggccttctgccccacccacctgaccctgcctgtggaggtgtccttctacagcgtgtctgatgacaatgcccccagcccctacatgggcgtcatcaccctggagagcctgggcaagaggggctacagagtgccccccagcggcaccatccaggtgaccctcttcaaccccaacaagacagtggtgaagatgtttgtggtgatctatgacctgcgggacatgcctgccaaccaccagaccttcctgcggcagaggaccttctctgtgcctgtgaagcaggaggtgaagaggtctgtgaacaaggagaacatccgccacacagaggagcggctgctgcgctacctgatccacctgcgcttccagagcagcaagagcggcaagatctacctgcacagagatgtgcggctgctcttcagcaggaagtccatggaggtggacagcggggccgcctatgagctgaagagctacacagagagccccaccaacccccagttcagcccccgctgctag

SEQ ID NO: 38631 - DNA, 3231 bp, Artificial Sequence
  Description of Artificial Sequence: Synthetic coding sequence
atccggcccaggagtgacaccctggatgagtactttgaatatgatgctgaggagttcctggtgtccctggccctgctgatcacagagggccgcaccccagagtgcagcgtgaagggccgcacagagagcttccactgccccccagcccagagctgctaccctgtgaccaccaagcatgagtgcagcgacaagctggcccagtgccggcaggcccggaggaccaggtctgaggtgaccctgctgtggaagaacaacctgcccatcatggtggagatgatgctgctgcctgactgctgctacagtgatgatggccccaccacagagggcatcgacctgaatgaccctgccatcaagcaggatgccctgctgctggagcgctggatcctggagcctgtgccccggcagaatggagaccgcttcatcgaggagaagaccctgctgctggccgtgcgcagctttgtgttcttcagccagctgagcgcctggctgtctgtgtcccatggagccatccccaggaacatcctgtaccgcatctctgctgctgatgtggacctgcagtggaacttcagccagacccccatcgagcacgtgtttcctgtgcccaacgtgagccacaacgtggccctgaaggtgtctgtgcagagcctgccccggcagagcaactaccctgtgctgacctgcagcatccacaccaacatcggcctgtatgagaagaggatccagcagcacaagctgaagacccaccagcaccacaaccccaatgaggccgagcagtgtggcaccaacagcagccagaggctgtgcagcaagcagacctggaccatggcccctgagagcgtgctgcacgccaagagcggccccagccctgagtacacagctgctgtgaagaacatcaagctgtacccaggcaccggcagcaagagtgaccacggcaccagccaggccaacatcctgggcttctctggaattggagacatcaagagccaggagacctctgtgaggaccctgaagagcttctccatggtggacagcagcatcagcaaccggcagagcttctggcagagcgctggggagaccaaccccctgattggcagcctcatccaggagcggcaggagatcatcgccagaattgcccagcacctgatccactgtgaccccagcaccagccacgtgtctggccggcccttcaacacccaggagagcagcagcctgcacagcaagctgttccgggtgtcccaggagaatgaaaatgtgggcaagggcaaggaggccttctccatgaccttcggcagccctgagttcagcagccctgaggacaccaatgaaggcaagatccggctgaagccagagacccccaggtctgagacctgcatcagcaatgacttctacagccacatgcctgtgggggagaccaaccccctgattggcagcctgctgcaggagcggcaggacgtcatcgccagaattgcccagcacctggagcacatcgaccccacagccagccacatcccccggcagagcttcaacatgcatgacagcagctctgtggccagcaaggtgttccgcagcagctatgaggacaagaacctgctgaagaagaacaaggatgagagctctgtgtccatcagccacaccaagtgcagcctgctgggggacatcagtgatggcaagaacctggtgcccaacaagtgcttcaccagcttcaagaacaacagcaaggagaagtgcagcctgaagcaccagaccaggaaccagtgccagaacaaccccagcgagatcatccagagcacctaccaggagacccagaacaagagcagcagcctgagcaccagcagcatcctgagccagcacaaggagaacaacctggacctgaccagccgcttcaaggagcaggagatgagcaatggaattgacaagcagtacagcaactgcaccaccatcgacaagcagatctgcaccaacaagtacaaggagaagatcatcaatgaaaactacaaccccaagttcttcggcaacctgcagagtgatgacagcaagaagaatgacagcaagatcaaggtgacagtgctggagatgtctgagtacctgaacaagtatgaatccatgagcagcaacaaggacagcaagaggcccaagacctgtgagcagaacacccagctgaacagcattgagaactacctgaacaaggacaatgaaggcttcaagtgcaagaagagtgaccagctgaagaatgagcaggacaagcaggaggaccccaccaatgagaagagccagaactacagccagaggaggagcatcaaggactgcctgagcacctgtgagcagcccaagaacacagaggtgctgcggaccaccctgaagcacagcaatgtgtggaggaagcacaacttccacagcctggatggcaccagcacccgggccttccacccccagacaggcctgcccctgctgagcagccctgtgccccagaggaagacccagagcggctgctttgacctggacagcagcctgctgcacctgaagagcttcagcagccgcagcccccggccctgcctgaacattgaagatgatcctgacatccacgagaagcccttcctgagcagcagcgccccacccatcaccagcctgagcctgctgggcaactttgaggagagcgtgctgaactacagatttgaccccctgggcatcgtggatggcttcaccgctgaggtgggcgccagcggggccttctgccccacccacctgaccctgcctgtggaggtgtccttctacagcgtgtctgatgacaatgcccccagcccctacatgggcgtcatcaccctggagagcctgggcaagaggggctacagagtgccccccagcggcaccatccaggtgaccctcttcaaccccaacaagacagtggtgaagatgtttgtggtgatctatgacctgcgggacatgcctgccaaccaccagaccttcctgcggcagaggaccttctctgtgcctgtgaagcaggaggtgaagaggtctgtgaacaaggagaacatccgccacacagaggagcggctgctgcgctacctgatccacctgcgcttccagagcagcaagagcggcaagatctacctgcacagagatgtgcggctgctcttcagcaggaagtccatggaggtggacagcggggccgcctatgagctgaagagctacacagagagccccaccaacccccagttcagcccccgctgctag

SEQ ID NO: 38632 - DNA, 2877 bp, Artificial Sequence
  Description of Artificial Sequence: Synthetic coding sequence
cggccagatgctgacaccctggatgagtactttgaatatgatgctgaggagttcctggtgtccctggccctgctgatcacagagggccgcaccccagaatgttctgtgaagggccgcacagagagcttccactgccccccagcccagagctgctaccctgtgaccaccaagcatgaatgtagtgacaagctggcccagtgccggcaggcccggaggaccaggtctgaggtgaccctgctgtggaagaacaacctgcccatcatggtggagatgatgctgctgcctgactgctgctacagtgatgatggccccaccacagagggcatcgacctgaatgaccctgccatcaagcaggatgccctgctgctggagcgctggatcctggagcctgtgccccggcagaatggagaccgcttcatcgaggagaagaccctgctgctggccgtgcgcagctttgtgttcttcagccagctgagcgcctggctgtctgtgagccacggggccatccccaggaacatcctgtaccgcatctctgctgctgatgtggacctgcagtggaacttcagccagacccccattgaacatgtgtttcctgtgcccaacgtgagccacaacgtggccctgaaggtgtctgtgcagagcctgccccggcagagcaactaccctgtgctgacctgcagcatccacaccaacatcggcctgtatgagaagaggatccagcagcacaagctgaagacccaccagcaccacaaccccaatgaagctgagcagtgtggcaccaacagcagccagaggctgtgcagcaagcagacctggaccatggcccctgagagcgtgctgcacgccaagagcggccccagccctgagtacacagctgctgtgaagaacatcaagctgtacccaggcaccggcagcaagagtgaccacggcaccagccaggccaacatcctgggcttcagcggcatcggggacatcaagagccaggagacctctgtgaggaccctgaagagcttctccatggtggacagcagcatcagcaaccggcagagcttctggcagagcgctggggagaccaaccccctcatcggcagcctcatccaggagcggcaggagatcatcgcccgcatcgcccagcacctgatccactgtgaccccagcaccagccacgtgtctggccggcccttcaacacccaggagagcagcagcctgcacagcaagctgttccgggtgtcccaggagaatgaaaatgtgggcaagggcaaggaggccttctccatgaccttcggcagccctgagttcagcagccctgaggacaccaatgaaggcaagatccggctgaagccagagacccccaggtctgagacctgcatcagcaatgacttctacagccacatgcctgtgggggagaccaaccccctcatcggcagcctgctgcaggagcggcaggatgtgattgcccgcatcgcccagcacctggagcacatcgaccccacagccagccacatcccccggcagagcttcaacatgcatgacagcagctctgtggccagcaaggtgttccgcagcagctatgaggacaagaacctgctgaagaagaacaaggatgagagctctgtgtccatcagccacaccaagtgcagcctgctgggggacatcagtgatggcaagaacctggtgcccaacaagtgcttcaccagcttcaagaacaacagcaaggagaagtgcagcctgaagcaccagaccaggaaccagtgccagaacaaccccagcgagatcatccagagcacctaccaggagacccagaacaagagcagcagcctgagcaccagcagcatcctgagccagcacaaggagaacaacctggacctgaccagccgcttcaaggagcaggagatgagcaatggcatcgacaagcagtacagcaactgcaccaccatcgacaagcagatctgcaccaacaagtacaaggagaagatcatcaatgaaaactacaaccccaagttctttggaaacctgcagagtgatgacagcaagaagaatgacagcaagatcaaggtgacagtgctggagatgtctgagtacctgaacaagtatgagagcatgagcagcaacaaggacagcaagaggcccaagacctgtgagcagaacacccagctgaacagcattgagaactacctgaacaaggacaatgaaggcttcaagtgcaagaagagtgaccagctgaagaatgagcaggacaagcaggaggaccccaccaatgagaagagccagaactacagccagaggaggagcatcaaggactgcctgagcacctgtgagcagcccaagaacacagaggtgctgcggaccaccctgaagcacagcaatgtgtggaggaagcacaacttccacagcctggatggcaccagcacccgggccttccacccccagacaggcctgcccctgctgagcagccctgtgccccagaggaagacccagagcggctgctttgacctggacagcagcctgctgcacctgaagagcttcagcagccgcagcccccggccctgcctgaacattgaagatgatcctgacatccacgagaagcccttcctgagcagcagcgccccacccatcaccagcctgagcctgctgggcaactttgaggagagcgtgctgaactacagatttgaccccctgggcatcgtggatggcttcaccgctgaggtgggcgccagcggggccttctgccccacccacctgaccctgcctgtggaggtgtccttctacagcgtgtctgatgacaatgcccccagcccctacatgggcgtcatcaccctggagagcctgggcaagaggggctacagagtgcccccatctggcaccatccaggtgtag

SEQ ID NO: 38633 - DNA, 3252 bp, Artificial Sequence
  Description of Artificial Sequence: Synthetic coding sequence
atggtgttcagcggcaacaagggcctgcaccgggaggacaccctggatgagtactttgaatatgatgctgaggagttcctggtgtccctggccctgctgatcacagagggccgcaccccagaatgttctgtgaagggccgcacagagagcttccactgccccccagcccagagctgctaccctgtgaccaccaagcatgaatgtagtgacaagctggcccagtgccggcaggcccggaggaccaggtctgaggtgaccctgctgtggaagaacaacctgcccatcatggtggagatgatgctgctgcctgactgctgctacagtgatgatggccccaccacagagggcatcgacctgaatgaccctgccatcaagcaggatgccctgctgctggagcgctggatcctggagcctgtgccccggcagaatggagaccgcttcatcgaggagaagaccctgctgctggccgtgcgcagctttgtgttcttcagccagctgagcgcctggctgtctgtgagccacggggccatccccaggaacatcctgtaccgcatctctgctgctgatgtggacctgcagtggaacttcagccagacccccattgaacatgtgtttcctgtgcccaacgtgagccacaacgtggccctgaaggtgtctgtgcagagcctgccccggcagagcaactaccctgtgctgacctgcagcatccacaccaacatcggcctgtatgagaagaggatccagcagcacaagctgaagacccaccagcaccacaaccccaatgaagctgagcagtgtggcaccaacagcagccagaggctgtgcagcaagcagacctggaccatggcccctgagagcgtgctgcacgccaagagcggccccagccctgagtacacagctgctgtgaagaacatcaagctgtacccaggcaccggcagcaagagtgaccacggcaccagccaggccaacatcctgggcttcagcggcatcggggacatcaagagccaggagacctctgtgaggaccctgaagagcttctccatggtggacagcagcatcagcaaccggcagagcttctggcagagcgctggggagaccaaccccctcatcggcagcctcatccaggagcggcaggagatcatcgcccgcatcgcccagcacctgatccactgtgaccccagcaccagccacgtgtctggccggcccttcaacacccaggagagcagcagcctgcacagcaagctgttccgggtgtcccaggagaatgaaaatgtgggcaagggcaaggaggccttctccatgaccttcggcagccctgagttcagcagccctgaggacaccaatgaaggcaagatccggctgaagccagagacccccaggtctgagacctgcatcagcaatgacttctacagccacatgcctgtgggggagaccaaccccctcatcggcagcctgctgcaggagcggcaggatgtgattgcccgcatcgcccagcacctggagcacatcgaccccacagccagccacatcccccggcagagcttcaacatgcatgacagcagctctgtggccagcaaggtgttccgcagcagctatgaggacaagaacctgctgaagaagaacaaggatgagagctctgtgtccatcagccacaccaagtgcagcctgctgggggacatcagtgatggcaagaacctggtgcccaacaagtgcttcaccagcttcaagaacaacagcaaggagaagtgcagcctgaagcaccagaccaggaaccagtgccagaacaaccccagcgagatcatccagagcacctaccaggagacccagaacaagagcagcagcctgagcaccagcagcatcctgagccagcacaaggagaacaacctggacctgaccagccgcttcaaggagcaggagatgagcaatggcatcgacaagcagtacagcaactgcaccaccatcgacaagcagatctgcaccaacaagtacaaggagaagatcatcaatgaaaactacaaccccaagttctttggaaacctgcagagtgatgacagcaagaagaatgacagcaagatcaaggtgacagtgctggagatgtctgagtacctgaacaagtatgagagcatgagcagcaacaaggacagcaagaggcccaagacctgtgagcagaacacccagctgaacagcattgagaactacctgaacaaggacaatgaaggcttcaagtgcaagaagagtgaccagctgaagaatgagcaggacaagcaggaggaccccaccaatgagaagagccagaactacagccagaggaggagcatcaaggactgcctgagcacctgtgagcagcccaagaacacagaggtgctgcggaccaccctgaagcacagcaatgtgtggaggaagcacaacttccacagcctggatggcaccagcacccgggccttccacccccagacaggcctgcccctgctgagcagccctgtgccccagaggaagacccagagcggctgctttgacctggacagcagcctgctgcacctgaagagcttcagcagccgcagcccccggccctgcctgaacattgaagatgatcctgacatccacgagaagcccttcctgagcagcagcgccccacccatcaccagcctgagcctgctgggcaactttgaggagagcgtgctgaactacagatttgaccccctgggcatcgtggatggcttcaccgctgaggtgggcgccagcggggccttctgccccacccacctgaccctgcctgtggaggtgtccttctacagcgtgtctgatgacaatgcccccagcccctacatgggcgtcatcaccctggagagcctgggcaagaggggctacagagtgcccccatctggcaccatccaggtgaccctcttcaaccccaacaagacagtggtgaagatgtttgtggtgatctatgacctgcgggacatgcctgccaaccaccagaccttcctgcggcagaggaccttctctgtgcctgtgaagcaggaggtgaagaggtctgtgaacaaggagaacatccgccacacagaggagcggctgctgcgctacctgatccacctgcgcttccagagcagcaagagcggcaagatctacctgcacagagatgtgcggctgctcttcagcaggaagtccatggaggtggacagcggggccgcctatgagctgaagagctacacagagagccccaccaacccccagttcagcccccgctgctag

SEQ ID NO: 38634 - DNA, 1890 bp, Artificial Sequence
  Description of Artificial Sequence: Synthetic coding sequence
atggaggtgaagggccccagcggccgctccttctgctgtgagagcgagggccagttcaagagctgcctgaagaggcacacccccagcctgctgctgcccagctcctggaagggcaacagcggcagctgcctgatggccaaggccctgcacaggatgagccccacccccaacagctgccccctgcccctgcccctgtgcaggatgtctggagtgctgtgcagcaggaacctcttcaccttcaagttcagcctcttccagctggacagcggggccagcggggagcccggccacagcctgggcctgaccctgggcttcagccactgcggcaactgccagacagctgtggtgtctgcccagcctgagggcatggccagcaatggagcctacccagccctgggccctggggtgacagccaaccctggcaccagcctgtctgtgttcaccgccctgcccttcaccaccccagcccctggccctgcccacggccccctgctggtgacagctggggcccctcctgggggccccctggtgctgagcaccctgcccagcacccccctggtgacagagcaggacggctgcggccccagcggggccggggccagcaatgtgtttgtgcagatgaggacagaggtgggccctgtgaaggccgcccaggcccagaccctggtgctgacccaggcccccctggtgtggcaggcccctggggccctgtgtggcggcgtggtgtgccccccacccctgctgctggccgccgcccctgtggtgcctgtgatggccgcccaggtggtgggcggcacccaggcctgtgagggcggctggagccagggcctgcccctgcccccacctcctcctcctgctgcccagctgccccccatcgtgtcccagggcaatgccggcccctggccccagggcgcccacggggagggcagcctggccagcagccaggccaaggcccccccagatgacagctgcaaccccaggtctgtgtatgagaacttccggctgtggcagcactacaagcccctggcccggcggcacctgccccagagcccagacacagaggccctgagctgcttcctgatccctgtgctgcggagcctggcccggaggaagcccaccatgaccctggaggagggcctgtggagggccatgagggagtggcagcacaccagcaactttgacaggatgatcttctatgagatggccgagaagttcctggagtttgaggccgaggaggagatgcagatccagaagagccagtggatgaagggcccccagtgcctgcccccaccagccaccccccggctggagccccggggccccccagcccctgaggtggtgaagcagcctgtgtacctgcccagcaaggccggccccaaggcccccacagcctgcctgcccccaccccggccccagaggcctgtgaccaaggcccggcggcccccaccccggccccacagaagagctgagaccaaggcccggctgcccccaccccggccccagaggcctgctgagaccaaggtgcctgaggagatccccccagaggtggtgcaggagtatgtggacatcatggaggagctgctgggccccagcctgggcgccactggagagcctgagaagcagcgggaggagggggaggtgaagcagccccaggaggaggactggaccccaccagaccccggcctgctgagctacacagacaagctgtgcagccagaaggactttgtgaccaaggtggaggccgtcatccacccccagttcctggaggagctgctgagcccagacccccagatggacttcctggccctgagccaggagctggagcaggaggagggcctgaccctggcccagggcgcccccagtgatgcccctggaacagaccgctgctag

SEQ ID NO: 38635 - DNA, 2637 bp, Artificial Sequence
  Description of Artificial Sequence: Synthetic coding sequence
atggaggtgaagggccccagcggccgctccttctgctgtgagagcgagggccagttcaagagctgcctgaagaggcacacccccagcctgctgctgcccagctcctggaagggcaacagcggcagctgcctgatggccaaggccctgcacaggatgagccccacccccaacagctgccccctgcccctgcccctgtgcaggatgtctggagtgctgtgcagcaggaacctcttcaccttcaagttcagcctcttccagctggacagcggggccagcggggagcccggccacagcctgggcctgaccctgggcttcagccactgcggcaactgccagacagctgtggtgtctgcccagcctgagggcatggccagcaatggagcctacccagccctgggccctggggtgacagccaaccctggcaccagcctgtctgtgttcaccgccctgcccttcaccaccccagcccctggccctgcccacggccccctgctggtgacagctggggcccctcctgggggccccctggtgctgagcaccctgcccagcacccccctggtgacagagcaggacggctgcggccccagcggggccggggccagcaatgtgtttgtgcagatgaggacagaggtgggccctgtgaaggccgcccaggcccagaccctggtgctgacccaggcccccctggtgtggcaggcccctggggccctgtgtggcggcgtggtgtgccccccacccctgctgctggccgccgcccctgtggtgcctgtgatggccgcccaggtggtgggcggcacccaggcctgtgagggcggctggagccagggcctgcccctgcccccacctcctcctcctgctgcccagctgccccccatcgtgtcccagggcaatgccggcccctggccccagggcgcccacggggagggcagcctggccagcagccaggccaaggcccccccagatgacagctgcaaccccaggtctgtgtatgagaacttccggctgtggcagcactacaagcccctggcccggcggcacctgccccagagcccagacacagaggccctgagctgcttcctgatccctgtgctgcggagcctggcccggaggaagcccaccatgaccctggaggagggcctgtggagggccatgagggagtggcagcacaccagcaactttgacaggatgatcttctatgagatggccgagaagttcctggagtttgaggccgaggaggagatgcagatccagaagagccagtggatgaagggcccccagtgcctgcccccaccagccaccccccggctggagccccggggccccccagcccctgaggtggtgaagcagcctgtgtacctgcccagcaaggccggccccaaggcccccacagcctgcctgcccccaccccggccccagaggcctgtgaccaaggcccggcggcccccaccccggccccacagaagagctgagaccaaggcccggctgcccccaccccggccccagaggcctgctgagaccaaggtgcctgaggagatccccccagaggtggtgcaggagtatgtggacatcatggaggagctgctgggccccagcctgggcgccactggagagcctgagaagcagcgggaggagggggaggtgaagcagccccaggaggaggactggaccccaccagaccccggcctgctgagctacacagacaagctgtgcagccagaaggactttgtgaccaaggtggaggccgtcatccacccccagttcctggaggagctgctgagcccagacccccagatggacttcctggccctgagccaggagctggagcaggaggagggcctgaccctggcccagctggtggagaagaggctgctgcccctgaaggagaagcagcacgcccgggccgcccccagccggggcacagcccggctggacagcagcagcagcaagtttgctgctggccagggcgctgagagagatgtgcctgtgccccagcagggcgtgggcatggagacctgccccccccagaccacagcccgggacagccagggccggggccgggcccacacaggcatggcccggagcaaggacagcgtggtgctgctgggctgccaggacagccctggcctgcgggccgcccggcccaccagccccccccaggaccaccggcccacctgccctggggtgggcaccaaggatgccctggacctgcccggcggcagccctgtgcgggagagccacggcctggcccagggcagcagcgaggaggaggagctgcccagcctggccttcctgctgggcagccagcacaagctgctgccctggtggctgccccagagccctgtgcctgccagcggcctgctgagccctgagaagtggggcccccagggcacccaccagttccccagcgctgagcggcggggcctgaacctggcccccagccctgccaacaaggccaagaagaggcccctgtttggcagcctgagccctgctgagaagaccccccaccctggccctggcctgcgggtgtctggagagcagagcctgacctggggcctgggcggccccagccagagccagaagaggaagggggaccccctggtgtccaggaaggagaagaagcagcgctgcagccagtag

SEQ ID NO: 38636 - DNA, 2418 bp, Artificial Sequence
  Description of Artificial Sequence: Synthetic coding sequence
atgttccaggagcctgtgtacttccagatcttcttccagctggacagcggggccagcggggagcccggccacagcctgggcctgaccctgggcttcagccactgcggcaactgccagacagctgtggtgtctgcccagcctgagggcatggccagcaatggagcctacccagccctgggccctggggtgacagccaaccctggcaccagcctgagcgtcttcaccgccctgcccttcaccaccccagcccctggccctgcccacggccccctgctggtgacagctggggcccctcctgggggccccctggtgctgagcaccctgcccagcacccccctggtgacagagcaggacggctgcggccccagcggggccggggccagcaatgtgtttgtgcagatgaggacagaggtgggccctgtgaaggccgcccaggcccagaccctggtgctgacccaggcccccctggtgtggcaggcccctggggccctgtgtggcggcgtggtgtgccccccacccctgctgctggccgccgcccctgtggtgcctgtgatggccgcccaggtggtgggcggcacccaggcctgtgagggcggctggagccagggcctgcccctgcccccacctcctcctcctgctgcccagctgccccccatcgtgtcccagggcaatgccggcccctggccccagggcgcccatggagagggcagcctggccagcagccaggccaaggcccccccagatgacagctgcaaccccaggtctgtgtatgagaacttccggctgtggcagcactacaagcccctggcccggcggcacctgccccagagcccagacacagaggccctgagctgcttcctgatccctgtgctgcggagcctggcccggaggaagcccaccatgaccctggaggagggcctgtggagggccatgagggagtggcagcacaccagcaactttgacaggatgatcttctatgagatggccgagaagttcctggagtttgaagctgaggaggagatgcagatccagaagagccagtggatgaagggcccccagtgcctgcccccaccagccaccccccggctggagccccggggccccccagcccctgaggtggtgaagcagcctgtgtacctgcccagcaaggccggccccaaggcccccacagcctgcctgcccccaccccggccccagaggcctgtgaccaaggcccggcggcccccaccccggccccaccggcgggcagagaccaaggcccggctgcccccaccccggccccagaggcctgctgagaccaaggtgcctgaggagatccccccagaggtggtgcaggagtatgtggacatcatggaggagctgctgggccccagcctgggcgccaccggggagcctgagaagcagcgggaggagggggaggtgaagcagccccaggaggaggactggaccccaccagaccccggcctgctgagctacacagacaagctgtgcagccagaaggactttgtgaccaaggtggaggccgtcatccacccccagttcctggaggagctgctgagcccagacccccagatggacttcctggccctgagccaggagctggagcaggaggagggcctgaccctggcccagctggtggagaagaggctgctgcccctgaaggagaagcagcacgcccgggccgcccccagccggggcacagcccggctggacagcagcagcagcaagtttgctgctggccagggcgctgagagagatgtgcctgtgccccagcagggcgtgggcatggagacctgccccccccagaccacagcccgggacagccagggccggggccgggcccacacaggcatggcccggagcaaggacagcgtggtgctgctgggctgccaggacagccctggcctgcgggccgcccggcccaccagccccccccaggaccaccggcccacctgccctggggtgggcaccaaggatgccctggacctgcccggcggcagccctgtgcgggagagccacggcctggcccagggcagcagcgaggaggaggagctgcccagcctggccttcctgctgggcagccagcacaagctgctgccctggtggctgccccagagccctgtgcctgccagcggcctgctgagccctgagaagtggggcccccagggcacccaccagttccccagcgctgagcggcggggcctgaacctggcccccagccctgccaacaaggccaagaagaggcccctgtttggcagcctgagccctgctgagaagaccccccaccctggccctggcctgcgggtgtctggagagcagagcctgacctggggcctgggcggccccagccagagccagaagaggaaaggagaccccctggtgtccaggaaggagaagaagcagcgctgcagccagtag

SEQ ID NO: 38637 - DNA, 789 bp, Artificial Sequence
  Description of Artificial Sequence: Synthetic coding sequence
atggaggagctgctgggccccagcctgggcgccaccggggagcctgagaagcagcgggaggagggggaggtgaagcagccccaggaggaggactggaccccaccagaccccggcctgctgagctacacagacaagctgtgcagccagaaggactttgtgaccaaggtggaggccgtcatccacccccagttcctggaggagctgctgagcccagacccccagatggacttcctggccctgagccaggagctggagcaggaggagggcctgaccctggcccagctggtggagaagaggctgctgcccctgaaggagaagcagcacgcccgggccgcccccagccggggcacagcccggctggacagcagcagcagcaagtttgctgctggccagggcgctgagagagatgtgcctgtgccccagcagggcgtgggcatggagacctgccccccccagaccacagcccgggacagccagggccggggccgggcccacacagccagcggcctgctgagccctgagaagtggggcccccagggcacccaccagttccccagcgctgagcggcggggcctgaacctggcccccagccctgccaacaaggccaagaagaggcccctgtttggcagcctgagccctgctgagaagaccccccaccctggccctggcctgcgggtgtctggagagcagagcctgacctggggcctgggcggccccagccagagccagaagaggaagggggaccccctggtgtccaggaaggagaagaagcagcgctgcagccagtag

SEQ ID NO: 38638 - DNA, 1971 bp, Artificial Sequence
  Description of Artificial Sequence: Synthetic coding sequence
tgactgacccaggcccccctggtgtggcaggcccctggggccctgtgtggcggcgtggtgtgccccccacccctgctgctggccgccgcccctgtggtgcctgtgatggccgcccaggtggtgggcggcacccaggcctgtgagggcggctggagccagggcctgcccctgcccccacctcctcctcctgctgcccagctgccccccatcgtgtcccagggcaatgccggcccctggccccagggcgcccacggggagggcagcctggccagcagccaggccaaggcccccccagatgacagctgcaaccccaggtctgtgtatgagaacttccggctgtggcagcactacaagcccctggcccggcggcacctgccccagagcccagacacagaggccctgagctgcttcctgatccctgtgctgcggagcctggcccggaggaagcccaccatgaccctggaggagggcctgtggagggccatgagggagtggcagcacaccagcaactttgacaggatgatcttctatgagatggccgagaagttcctggagtttgaggccgaggaggagatgcagatccagaagagccagtggatgaagggcccccagtgcctgcccccaccagccaccccccggctggagccccggggccccccagcccctgaggtggtgaagcagcctgtgtacctgcccagcaaggccggccccaaggcccccacagcctgcctgcccccaccccggccccagaggcctgtgaccaaggcccggcggcccccaccccggccccacagaagagctgagaccaaggcccggctgcccccaccccggccccagaggcctgctgagaccaaggtgcctgaggagatccccccagaggtggtgcaggagtatgtggacatcatggaggagctgctgggccccagcctgggcgccactggagagcctgagaagcagcgggaggagggggaggtgaagcagccccaggaggaggactggaccccaccagaccccggcctgctgagctacacagacaagctgtgcagccagaaggactttgtgaccaaggtggaggccgtcatccacccccagttcctggaggagctgctgagcccagacccccagatggacttcctggccctgagccaggagctggagcaggaggagggcctgaccctggcccagctggtggagaagaggctgctgcccctgaaggagaagcagcacgcccgggccgcccccagccggggcacagcccggctggacagcagcagcagcaagtttgctgctggccagggcgctgagagagatgtgcctgtgccccagcagggcgtgggcatggagacctgccccccccagaccacagcccgggacagccagggccggggccgggcccacacaggcatggcccggagcaaggacagcgtggtgctgctgggctgccaggacagccctggcctgcgggccgcccggcccaccagccccccccaggaccaccggcccacctgccctggggtgggcaccaaggatgccctggacctgcccggcggcagccctgtgcgggagagccacggcctggcccagggcagcagcgaggaggaggagctgcccagcctggccttcctgctgggcagccagcacaagctgctgccctggtggctgccccagagccctgtgcctgccagcggcctgctgagccctgagaagtggggcccccagggcacccaccagttccccagcgctgagcggcggggcctgaacctggcccccagccctgccaacaaggccaagaagaggcccctgtttggcagcctgagccctgctgagaagaccccccaccctggccctggcctgcgggtgtctggagagcagagcctgacctggggcctgggcggccccagccagagccagaagaggaagggggaccccctggtgtccaggaaggagaagaagcagcgctgcagccagtag

SEQ ID NO: 38639 - DNA, 1866 bp, Artificial Sequence
  Description of Artificial Sequence: Synthetic coding sequence
atggccgcccaggtggtgggcggcacccaggcctgtgagggcggctggagccagggcctgcccctgcccccacctcctcctcctgctgcccagctgccccccatcgtgtcccagggcaatgccggcccctggccccagggcgcccatggagagagcagcctggccagcagccaggccaaggcccccccagatgacagctgcaaccccaggtctgtgtatgagaacttccggctgtggcagcactacaagcccctggcccggcggcacctgccccagagcccagacacagaggccctgagctgcttcctgatccctgtgctgcggagcctggcccggaggaagcccaccatgaccctggaggagggcctgtggagggccatgagggagtggcagcacaccagcaactttgacaggatgatcttctatgagatggccgagaagttcctggagtttgaagctgaggaggagatgcagatccagaagagccagtggatgaagggcccccagtgcctgcccccaccagccaccccccggctggagccccggggccccccagcccctgaggtggtgaagcagcctgtgtacctgcccagcaaggccggccccaaggcccccacagcctgcctgcccccaccccggccccagaggcctgtgaccaaggcccggcggcccccaccccggccccaccggcgggcagagaccaaggcccggctgcccccaccccggccccagaggcctgctgagaccaaggtgcctgaggagatccccccagaggtggtgcaggagtatgtggacatcatggaggagctgctgggccccagcctgggcgccaccggggagcctgagaagcagcgggaggagggcaaggtgaagcagccccaggaggaggactggaccccaccagaccccggcctgctgagctacatcgacaagctgtgcagccagaaggactttgtgaccaaggtggaggccgtcatccacccccagttcctggaggagctgctgagcccagacccccagatggacttcctggccctgagccaggacctggagcaggaggagggcctgaccctggcccagctggtggagaagaggctgccccccctgaaggagaagcagcacgcccgggccgcccccagccggggcacagcccggctggacagcagcagcagcaagtttgctgctggccagggcgctgagagagatgtgcctgacccccagcagggcgtgggcatggagacctgccccccccagatgacagcccgggacagccagggccggggccgggcccacacaggcatggcccggtctgaggacagcgtggtgctgctgggctgccaggacagccctggcctgcgggccgcctggcccaccagccccccccaggaccaccggcccacctgccctggggtgggcaccaaggatgccctggacctgcccggcggcagccctgtgcgggagagccacggcctggcccagggcagcagcgaggaggaggagctgcccagcctggccttcctgctgggcagccagcacaagctgctgccctggtggctgccccagagccctgtgcctgccagcggcctgctgagccctgagaagtggggcccccagggcacccaccagagccccagcgctgagcggcggggcctgaacctggcccccagccctgccaacaaggccaagaagaggcccctgtttggcagcctgagccctgctgagaagaccccctacccaggccctggcctgcgggtgtctggagagcagagcctgacctggggcctgggcggccccagccagagccagaagaggaaaggagaccccctggtgtccaggaaggagaagaagcagcactgcagccagtag

SEQ ID NO: 38640 - DNA, 1689 bp, Artificial Sequence
  Description of Artificial Sequence: Synthetic coding sequence
atgtctggagtgctgtgcagcaggaacctcttcaccttcaagttcagcctcttccagctggacagcggggccagcggggagcccggccacagcctgggcctgaccctgggcttctcctactgcggcaactgccagacagctgtggtgtctgcccagcctgagggcatggccagcaatggagcctaccctgtgctgggccctggggtgacagccaaccctggcaccagcctgagcgtcttcaccgccctgcccttcaccaccccagcccctggccctgcccacggccccctgctggtgacagctggggcccctcctgggggccccctggtgctgagcaccttccccagcacccccctggtgacagagcaggacggctgcggccccagcggggccggggccagcaatgtgtttgtgcagatgaggacagaggtgggccctgtgaaggccgcccaggcccagaccctggtgctgacccaggcccccctggtgtggcaggcccctggggccctgtgtggcggcgtggtgtgccccccacccctgctgctggccgccgcccctgtggtgcctgtgatggccgcccaggtggtgggcggcacccaggcctgtgagggcggctggagccagggcctgcccctgcccccacctcctcctcctgctgcccagctgccccccatcgtgtcccagggcaatgccggcccctggccccagggcgcccatggagagagcagcctggccagcagccaggccaaggcccccccagatgacagctgcaaccccaggtctgtgtatgagaacttccggctgtggcagcactacaagcccctggcccggcggcacctgccccagagcccagacacagaggccctgagctgcttcctgatccctgtgctgcggagcctggcccggaggaagcccaccatgaccctggaggagggcctgtggagggccatgagggagtggcagcacaccagcaactttgacaggatgatcttctatgagatggccgagaagttcctggagtttgaagctgaggaggagatgcagatccagaagagccagtggatgaagggcccccagtgcctgcccccaccagccaccccccggctggagccccggggccccccagcccctgaggtggtgaagcagcctgtgtacctgcccagcaaggccggccccaaggcccccacagcctgcctgcccccaccccggccccagaggcctgtgaccaaggcccggcggcccccaccccggccccaccggcgggcagagaccaaggcccggctgcccccaccccggccccagaggcctgctgagaccaaggtgcctgaggagatccccccagaggtggtgcaggagtatgtggacatcatggaggagctgctgggccccagcctgggcgccaccggggagcctgagaagcagcgggaggagggcaaggtgaagcagccccaggaggaggactggaccccaccagaccccggcctgctgagctacatcgacaagctgtgcagccagaaggactttgtgaccaaggtggaggccgtcatccacccccagttcctggaggagctgctgagcccagacccccagatggacttcctggccctgagccaggacctggagcaggaggagggcctgaccctggcccagggcgcccccagtgatgcccctggaacagaccgctgctag

SEQ ID NO: 38641 - DNA, 2637 bp, Artificial Sequence
  Description of Artificial Sequence: Synthetic coding sequence
atggaggtgaagggccccagcggccgctccttctgctgtgagagcgagggccagttcaagagctgcctgaagaggcacacccccagcctgctgctgcccagctcctggaagggcaacagcggcagctgcctgatggccgaggccctgcacaggaccagccccacccccaacagctgccccctgcccctgcccctgtgcaggatgtctggagtgctgtgcagcaggaacctcttcaccttcaagttcagcctcttccagctggacagcggggccagcggggagcccggccacagcctgggcctgaccctgggcttctcctactgcggcaactgccagacagctgtggtgtctgcccagcctgagggcatggccagcaatggagcctaccctgtgctgggccctggggtgacagccaaccctggcaccagcctgtctgtgttcaccgccctgcccttcaccaccccagcccctggccctgcccacggccccctgctggtgacagctggggcccctcctgggggccccctggtgctgagcaccttccccagcacccccctggtgacagagcaggacggctgcggccccagcggggccggggccagcaatgtgtttgtgcagatgaggacagaggtgggccctgtgaaggccgcccaggcccagaccctggtgctgacccaggcccccctggtgtggcaggcccctggggccctgtgtggcggcgtggtgtgccccccacccctgctgctggccgccgcccctgtggtgcctgtgatggccgcccaggtggtgggcggcacccaggcctgtgagggcggctggagccagggcctgcccctgcccccacctcctcctcctgctgcccagctgccccccatcgtgtcccagggcaatgccggcccctggccccagggcgcccacggggagagcagcctggccagcagccaggccaaggcccccccagatgacagctgcaaccccaggtctgtgtatgagaacttccggctgtggcagcactacaagcccctggcccggcggcacctgccccagagcccagacacagaggccctgagctgcttcctgatccctgtgctgcggagcctggcccggaggaagcccaccatgaccctggaggagggcctgtggagggccatgagggagtggcagcacaccagcaactttgacaggatgatcttctatgagatggccgagaagttcctggagtttgaggccgaggaggagatgcagatccagaagagccagtggatgaagggcccccagtgcctgcccccaccagccaccccccggctggagccccggggccccccagcccctgaggtggtgaagcagcctgtgtacctgcccagcaaggccggccccaaggcccccacagcctgcctgcccccaccccggccccagaggcctgtgaccaaggcccggcggcccccaccccggccccacagaagagctgagaccaaggcccggctgcccccaccccggccccagaggcctgctgagaccaaggtgcctgaggagatccccccagaggtggtgcaggagtatgtggacatcatggaggagctgctgggccccagcctgggcgccactggagagcctgagaagcagcgggaggagggcaaggtgaagcagccccaggaggaggactggaccccaccagaccccggcctgctgagctacatcgacaagctgtgcagccagaaggactttgtgaccaaggtggaggccgtcatccacccccagttcctggaggagctgctgagcccagacccccagatggacttcctggccctgagccaggacctggagcaggaggagggcctgaccctggcccagctggtggagaagaggctgccccccctgaaggagaagcagcacgcccgggccgcccccagccggggcacagcccggctggacagcagcagcagcaagtttgctgctggccagggcgctgagagagatgtgcctgacccccagcagggcgtgggcatggagacctgccccccccagatgacagcccgggacagccagggccggggccgggcccacacaggcatggcccggagtgaagattctgtggtgctgctgggctgccaggacagccctggcctgcgggccgcctggcccaccagccccccccaggaccaccggcccacctgccctggggtgggcaccaaggatgccctggacctgcccggcggcagccctgtgcgggagagccacggcctggcccagggcagcagcgaggaggaggagctgcccagcctggccttcctgctgggcagccagcacaagctgctgccctggtggctgccccagagccctgtgcctgccagcggcctgctgagccctgagaagtggggcccccagggcacccaccagagccccagcgctgagcggcggggcctgaacctggcccccagccctgccaacaaggccaagaagaggcccctgtttggcagcctgagccctgctgagaagaccccctacccaggccctggcctgcgggtgtctggagagcagagcctgacctggggcctgggcggccccagccagagccagaagaggaagggggaccccctggtgtccaggaaggagaagaagcagcactgcagccagtag

SEQ ID NO: 38642 - DNA, 1890 bp, Artificial Sequence
  Description of Artificial Sequence: Synthetic coding sequence
atggaggtgaagggccccagcggccgctccttctgctgtgagagcgagggccagttcaagagctgcctgaagaggcacacccccagcctgctgctgcccagctcctggaagggcaacagcggcagctgcctgatggccgaggccctgcacaggaccagccccacccccaacagctgccccctgcccctgcccctgtgcaggatgtctggagtgctgtgcagcaggaacctcttcaccttcaagttcagcctcttccagctggacagcggggccagcggggagcccggccacagcctgggcctgaccctgggcttctcctactgcggcaactgccagacagctgtggtgtctgcccagcctgagggcatggccagcaatggagcctaccctgtgctgggccctggggtgacagccaaccctggcaccagcctgtctgtgttcaccgccctgcccttcaccaccccagcccctggccctgcccacggccccctgctggtgacagctggggcccctcctgggggccccctggtgctgagcaccttccccagcacccccctggtgacagagcaggacggctgcggccccagcggggccggggccagcaatgtgtttgtgcagatgaggacagaggtgggccctgtgaaggccgcccaggcccagaccctggtgctgacccaggcccccctggtgtggcaggcccctggggccctgtgtggcggcgtggtgtgccccccacccctgctgctggccgccgcccctgtggtgcctgtgatggccgcccaggtggtgggcggcacccaggcctgtgagggcggctggagccagggcctgcccctgcccccacctcctcctcctgctgcccagctgccccccatcgtgtcccagggcaatgccggcccctggccccagggcgcccacggggagagcagcctggccagcagccaggccaaggcccccccagatgacagctgcaaccccaggtctgtgtatgagaacttccggctgtggcagcactacaagcccctggcccggcggcacctgccccagagcccagacacagaggccctgagctgcttcctgatccctgtgctgcggagcctggcccggaggaagcccaccatgaccctggaggagggcctgtggagggccatgagggagtggcagcacaccagcaactttgacaggatgatcttctatgagatggccgagaagttcctggagtttgaggccgaggaggagatgcagatccagaagagccagtggatgaagggcccccagtgcctgcccccaccagccaccccccggctggagccccggggccccccagcccctgaggtggtgaagcagcctgtgtacctgcccagcaaggccggccccaaggcccccacagcctgcctgcccccaccccggccccagaggcctgtgaccaaggcccggcggcccccaccccggccccacagaagagctgagaccaaggcccggctgcccccaccccggccccagaggcctgctgagaccaaggtgcctgaggagatccccccagaggtggtgcaggagtatgtggacatcatggaggagctgctgggccccagcctgggcgccactggagagcctgagaagcagcgggaggagggcaaggtgaagcagccccaggaggaggactggaccccaccagaccccggcctgctgagctacatcgacaagctgtgcagccagaaggactttgtgaccaaggtggaggccgtcatccacccccagttcctggaggagctgctgagcccagacccccagatggacttcctggccctgagccaggacctggagcaggaggagggcctgaccctggcccagggcgcccccagtgatgcccctggaacagaccgctgctag

SEQ ID NO: 38643 - DNA, 2634 bp, Artificial Sequence
  Description of Artificial Sequence: Synthetic coding sequence
atggaggtgaagggccccagcggccgctccttctgctgtgagagcgagggccagttcaagagctgcctgaagaggcacacccccagcctgctgctgcccagctcctggaagggcaacagcggcagctgcctgatggccgaggccctgcacaggatgagccccacccccaacagctgccccctgcccctgcccctgtgcaggatgtctggagtgctgtgcagcaggaacctcttcaccttcaagttctccttccagctggacagcggggccagcggggagcccggccacagcctgggcctgaccctgggcttcagccactgcggcaactgccagacagctgtggtgtctgcccagcctgagggcatggccagcaatggagcctacccagccctgggccctggggtgacagccaaccctggcaccagcctgagcgtcttcaccgccctgcccttcaccaccccagcccctggccctgcccacggccccctgctggtgacagctggggcccctcctgggggccccctggtgctgagcaacttccccagcacccccctggtgacagagcaggacggctgcggccccagcggggccggggccagcaatgtgtttgtgcagatgaggacagaggtgggccctgtgaaggccgcccaggcccagaccctggtgctgacccagacccccctggtgtggcaggcccctggggccctgtgtggcggcgtggtgtgccccccacccctgctgctggccgccgcccctgtggtgcctgtgatggccgcccaggtggtgggcggcacccaggcctgtgagggcggctggagccagggcctgcccctgcccccacctcctcctcctgctgcccagctgccccccatcgtgtcccagggcaatgccggcccctggccccagggcgcccatggagagggcagcctggccagcagccaggccaaggcccccccagatgacagctgcaaccccaggtctgtgtatgagaacttccggctgtggcagcactacaagcccctggcccggcggcacctgccccagagcccagacacagaggccctgagctgcttcctgatccctgtgctgcggagcctggcccggaggaagcccaccatgaccctggaggagggcctgtggagggccatgagggagtggcagcacaccagcaactttgacaggatgatcttctatgagatggccgagaagttcctggagtttgaagctgaggaggagatgcagatccagaagagccagtggatgaagggcccccagtgcctgcccccaccagccaccccccggctggagccccggggccccccagcccctgaggtggtgaagcagcctgtgtacctgcccagcaaggccggccccaaggcccccacagcctgcctgcccccaccccggccccagaggcctgtgaccaaggcccggcggcccccaccccggccccaccggcgggcagagaccaaggcccggctgcccccaccccggccccagaggcctgctgagaccaaggtgcctgaggagatccccccagaggtggtgcaggagtatgtggacatcatggaggagctgctgggccccagcctgggcgccaccggggagcctgagaagcagcgggaggagggggaggtgaagcagccccaggaggaggactggaccccaccagaccccggcctgctgagctacacagacaagctgtgcagccagaaggactttgtgaccaaggtggaggccgtcatccacccccagttcctggaggagctgctgagcccagacccccagatggacttcctggccctgagccaggagctggagcaggaggagggcctgaccctggcccagctggtggagaagaggctgctgcccctgaaggagaagcagcacgcccgggccgcccccagccggggcacagcccggctggacagcagcagcagcaagtttgctgctggccagggcgctgagagagatgtgcctgacccccagcagggcgtgggcatggagacctgccccccccagaccacagcccgggacagccagggccggggccgggcccacacaggcatggcccggagcaaggacagcgtggtgctgctgggctgccaggacagccctggcctgcgggccgcccggcccaccagccccccccaggaccaccggcccacctgccctggggtgggcaccaaggatgccctggacctgcccggcggcagccctgtgcgggagagccacggcctggcccagggcagcagcgaggaggaggagctgcccagcctggccttcctgctgggcagccagcacaagctgctgccctggtggctgccccagagccctgtgcctgccagcggcctgctgagccctgagaagtggggcccccagggcacccaccagagccccagcgctgagcggcggggcctgaacctggcccccagccctgccaacaaggccaagaagaggcccctgtttggcagcctgagccctgctgagaagaccccccaccctggccctggcctgcgggtgtctggagagcagagcctgacctggggcctgggcggccccagccagagccagaagaggaaaggagaccccctggtgtccaggaaggagaagaagcagcgctgcagccagtag

SEQ ID NO: 38644 - DNA, 789 bp, Artificial Sequence
  Description of Artificial Sequence: Synthetic coding sequence
atggaggagctgctgggccccagcctgggcgccaccggggagcctgagaagcagcgggaggagggggaggtgaagcagccccaggaggaggactggaccccaccagaccccggcctgctgagctacacagacaagctgtgcagccagaaggactttgtgaccaaggtggaggccgtcatccacccccagttcctggaggagctgctgagcccagacccccagatggacttcctggccctgagccaggagctggagcaggaggagggcctgaccctggcccagctggtggagaagaggctgctgcccctgaaggagaagcagcacgcccgggccgcccccagccggggcacagcccggctggacagcagcagcagcaagtttgctgctggccagggcgctgagagagatgtgcctgacccccagcagggcgtgggcatggagacctgccccccccagaccacagcccgggacagccagggccggggccgggcccacacagccagcggcctgctgagccctgagaagtggggcccccagggcacccaccagagccccagcgctgagcggcggggcctgaacctggcccccagccctgccaacaaggccaagaagaggcccctgtttggcagcctgagccctgctgagaagaccccccaccctggccctggcctgcgggtgtctggagagcagagcctgacctggggcctgggcggccccagccagagccagaagaggaagggggaccccctggtgtccaggaaggagaagaagcagcgctgcagccagtag

SEQ ID NO: 38645 - DNA, 2421 bp, Artificial Sequence
  Description of Artificial Sequence: Synthetic coding sequence
atgttccaggagcctgtgtacttccagatcttcctgttccagctggacagcggggccagcggggagcccggccacagcctgggcctgaccctgggcttcagccactgcggcaactgccagacagctgtggtgtctgcccagcctgagggcatggccagcaatggagcctacccagccctgggccctggggtgacagccaaccctggcaccagcctgtctgtgttcaccgccctgcccttcaccaccccagcccctggccctgcccacggccccctgctggtgacagctggggcccctcctgggggccccctggtgctgagcaacttccccagcacccccctggtgacagagcaggacggctgcggccccagcggggccggggccagcaatgtgtttgtgcagatgaggacagaggtgggccctgtgaaggccgcccaggcccagaccctggtgctgacccagacccccctggtgtggcaggcccctggggccctgtgtggcggcgtggtgtgccccccacccctgctgctggccgccgcccctgtggtgcctgtgatggccgcccaggtggtgggcggcacccaggcctgtgagggcggctggagccagggcctgcccctgcccccacctcctcctcctgctgcccagctgccccccatcgtgtcccagggcaatgccggcccctggccccagggcgcccacggggagggcagcctggccagcagccaggccaaggcccccccagatgacagctgcaaccccaggtctgtgtatgagaacttccggctgtggcagcactacaagcccctggcccggcggcacctgccccagagcccagacacagaggccctgagctgcttcctgatccctgtgctgcggagcctggcccggaggaagcccaccatgaccctggaggagggcctgtggagggccatgagggagtggcagcacaccagcaactttgacaggatgatcttctatgagatggccgagaagttcctggagtttgaggccgaggaggagatgcagatccagaagagccagtggatgaagggcccccagtgcctgcccccaccagccaccccccggctggagccccggggccccccagcccctgaggtggtgaagcagcctgtgtacctgcccagcaaggccggccccaaggcccccacagcctgcctgcccccaccccggccccagaggcctgtgaccaaggcccggcggcccccaccccggccccacagaagagctgagaccaaggcccggctgcccccaccccggccccagaggcctgctgagaccaaggtgcctgaggagatccccccagaggtggtgcaggagtatgtggacatcatggaggagctgctgggccccagcctgggcgccactggagagcctgagaagcagcgggaggagggggaggtgaagcagccccaggaggaggactggaccccaccagaccccggcctgctgagctacacagacaagctgtgcagccagaaggactttgtgaccaaggtggaggccgtcatccacccccagttcctggaggagctgctgagcccagacccccagatggacttcctggccctgagccaggagctggagcaggaggagggcctgaccctggcccagctggtggagaagaggctgctgcccctgaaggagaagcagcacgcccgggccgcccccagccggggcacagcccggctggacagcagcagcagcaagtttgctgctggccagggcgctgagagagatgtgcctgacccccagcagggcgtgggcatggagacctgccccccccagaccacagcccgggacagccagggccggggccgggcccacacaggcatggcccggagcaaggacagcgtggtgctgctgggctgccaggacagccctggcctgcgggccgcccggcccaccagccccccccaggaccaccggcccacctgccctggggtgggcaccaaggatgccctggacctgcccggcggcagccctgtgcgggagagccacggcctggcccagggcagcagcgaggaggaggagctgcccagcctggccttcctgctgggcagccagcacaagctgctgccctggtggctgccccagagccctgtgcctgccagcggcctgctgagccctgagaagtggggcccccagggcacccaccagagccccagcgctgagcggcggggcctgaacctggcccccagccctgccaacaaggccaagaagaggcccctgtttggcagcctgagccctgctgagaagaccccccaccctggccctggcctgcgggtgtctggagagcagagcctgacctggggcctgggcggccccagccagagccagaagaggaagggggaccccctggtgtccaggaaggagaagaagcagcgctgcagccagtag

SEQ ID NO: 38646 - DNA, 1674 bp, Artificial Sequence
  Description of Artificial Sequence: Synthetic coding sequence
atgttccaggagcctgtgtacttccagatcttcctgttccagctggacagcggggccagcggggagcccggccacagcctgggcctgaccctgggcttcagccactgcggcaactgccagacagctgtggtgtctgcccagcctgagggcatggccagcaatggagcctacccagccctgggccctggggtgacagccaaccctggcaccagcctgtctgtgttcaccgccctgcccttcaccaccccagcccctggccctgcccacggccccctgctggtgacagctggggcccctcctgggggccccctggtgctgagcaacttccccagcacccccctggtgacagagcaggacggctgcggccccagcggggccggggccagcaatgtgtttgtgcagatgaggacagaggtgggccctgtgaaggccgcccaggcccagaccctggtgctgacccagacccccctggtgtggcaggcccctggggccctgtgtggcggcgtggtgtgccccccacccctgctgctggccgccgcccctgtggtgcctgtgatggccgcccaggtggtgggcggcacccaggcctgtgagggcggctggagccagggcctgcccctgcccccacctcctcctcctgctgcccagctgccccccatcgtgtcccagggcaatgccggcccctggccccagggcgcccacggggagggcagcctggccagcagccaggccaaggcccccccagatgacagctgcaaccccaggtctgtgtatgagaacttccggctgtggcagcactacaagcccctggcccggcggcacctgccccagagcccagacacagaggccctgagctgcttcctgatccctgtgctgcggagcctggcccggaggaagcccaccatgaccctggaggagggcctgtggagggccatgagggagtggcagcacaccagcaactttgacaggatgatcttctatgagatggccgagaagttcctggagtttgaggccgaggaggagatgcagatccagaagagccagtggatgaagggcccccagtgcctgcccccaccagccaccccccggctggagccccggggccccccagcccctgaggtggtgaagcagcctgtgtacctgcccagcaaggccggccccaaggcccccacagcctgcctgcccccaccccggccccagaggcctgtgaccaaggcccggcggcccccaccccggccccacagaagagctgagaccaaggcccggctgcccccaccccggccccagaggcctgctgagaccaaggtgcctgaggagatccccccagaggtggtgcaggagtatgtggacatcatggaggagctgctgggccccagcctgggcgccactggagagcctgagaagcagcgggaggagggggaggtgaagcagccccaggaggaggactggaccccaccagaccccggcctgctgagctacacagacaagctgtgcagccagaaggactttgtgaccaaggtggaggccgtcatccacccccagttcctggaggagctgctgagcccagacccccagatggacttcctggccctgagccaggagctggagcaggaggagggcctgaccctggcccagggcgcccccagtgatgcccctggaacagaccgctgctag

SEQ ID NO: 38647 - DNA, 759 bp, Artificial Sequence
  Description of Artificial Sequence: Synthetic coding sequence
tgaacaggagagcctgagaagcagcgggaggagggggaggtgaagcagccccaggaggaggactggaccccaccagaccccggcctgctgagctacacagacaagctgtgcagccagaaggactttgtgaccaaggtggaggccgtcatccacccccagttcctggaggagctgctgagcccagacccccagatggacttcctggccctgagccaggagctggagcaggaggagggcctgaccctggcccagctggtggagaagaggctgctgcccctgaaggagaagcagcacgcccgggccgcccccagccggggcacagcccggctggacagcagcagcagcaagtttgctgctggccagggcgctgagagagatgtgcctgacccccagcagggcgtgggcatggagacctgccccccccagaccacagcccgggacagccagggccggggccgggcccacacagccagcggcctgctgagccctgagaagtggggcccccagggcacccaccagagccccagcgctgagcggcggggcctgaacctggcccccagccctgccaacaaggccaagaagaggcccctgtttggcagcctgagccctgctgagaagaccccccaccctggccctggcctgcgggtgtctggagagcagagcctgacctggggcctgggcggccccagccagagccagaagaggaagggggaccccctggtgtccaggaaggagaagaagcagcgctgcagccagtag

SEQ ID NO: 38648 - DNA, 2637 bp, Artificial Sequence
  Description of Artificial Sequence: Synthetic coding sequence
atggaggtgaagggccccagcggccgctccttctgctgtgagagcgagggccagttcaagagctgcctgaagaggcacacccccagcctgctgctgcccagctcctggaagggcaacagcggcagctgcctgatggccgaggccctgcacaggaccagccccacccccaacagctgccccctgcccctgcccctgtgcaggatgtctggagtgctgtgcagcaggaacctcttcaccttcaagttcagcctcttccagctggacagcggggccagcggggagcccggccacagcctgggcctgaccctgggcttctcctactgcggcaactgccagacagctgtggtgtctgcccagcctgagggcatggccagcaatggagcctaccctgtgctgggccctggggtgacagccaaccctggcaccagcctgtctgtgttcaccgccctgcccttcaccaccccagcccctggccctgcccacggccccctgctggtgacagctggggcccctcctgggggccccctggtgctgagcaccttccccagcacccccctggtgacagagcaggacggctgcagccccagcggggccggggccagcaatgtgtttgtgcagatgaggacagaggtgggccctgtgaaggccgcccaggcccagaccctggtgctgacccaggcccccctggtgtggcaggcccctggggccctgtgtggcggcgtggtgtgccccccacccctgctgctggccgccgcccctgtggtgcctgtgatggccgcccaggtggtgggcggcacccaggcctgtgagggcggctggagccagggcctgcccctgcccccacctcctcctcctgctgcccagctgccccccatcgtgtcccagggcaatgccggcccctggccccagggcgcccacggggagagcagcctggccagcagccaggccaaggcccccccagatgacagctgcaaccccaggtctgtgtatgagaacttccggctgtggcagcactacaagcccctggcccggcggcacctgccccagagcccagacacagaggccctgagctgcttcctgatccctgtgctgcggagcctggcccggaggaagcccaccatgaccctggaggagggcctgtggagggccatgagggagtggcagcacaccagcaactttgacaggatgatcttctatgagatggccgagaagttcctggagtttgaggccgaggaggagatgcagatccagaagagccagtggatgaagggcccccagtgcctgcccccaccagccaccccccggctggagccccggggccccccagcccctgaggtggtgaagcagcctgtgtacctgcccagcaaggccggccccaaggcccagacagcctgcctgcccccaccccggccccagaggcctgtgaccaaggcccggcggcccccaccccagccccacagaagagctgagaccaaggcccggctgcccccaccccggccccagaggcctgctgagaccaaggtgcctgaggagatccccccagaggtggtgcaggagtatgtggacatcatggaggagctgctgggccccagcctgggcgccactggagagcctgagaagcagcgggaggagggcaaggtgaagcagccccaggaggaggactggaccccaccagaccccggcctgctgagctacatcgacaagctgtgcagccagaaggactttgtgaccaaggtggaggccgtcatccacccccagttcctggaggagctgctgagcccagacccccagatggacttcctggccctgagccaggacctggagcaggaggagggcctgaccctggcccagctggtggagaagaggctgccccccctgaaggagaagcagcacagccgggccgcccccagccggggcacagcccggctggacagcagcagcagcaagtttgctgctggccagggcgctgagagagatgtgcctgacccccaggagggcgtgggcatggagacctgccccccccagaccacagcccgggacagccagggccggggccgggcccacacaggcatggcccggagtgaagattctgtggtgctgctgggctgccaggacagccctggcctgcgggccgcccggcccaccagccccccccaggaccaccggcccacctgccctggggtgggcaccaaggatgccctggacctgcccggcggcagccctgtgcgggagagccacggcctggcccagggcagcagcgaggaggaggagctgcccagcctggccttcctgctgggcagccagcacaagctgctgccctggtggctgccccagagccctgtgcctgccagcggcctgctgagccctgagaagtggggcccccagggcacccaccagagccccagcgctgagcggcggggcctgaacctggcccccagccctgccaacaaggccaagaagcagcccctgtttggcagcctgagccctgctgagaagaccccccaccggggccctggcctgcgggtgtctggagagcagagcctgacctggggcctgggcggccccagccagagccagaagaggaagggggaccccctggtgtccaggaaggagaagaagcagcactgcagccagtag

SEQ ID NO: 38649 - DNA, 2271 bp, Artificial Sequence
  Description of Artificial Sequence: Synthetic coding sequence
atggccagcaatggagcctaccctgtgctgggccctggggtgacagtgaaccctggcaccagcctgtctgtgttcaccgccctgccctttgccaccccagcccctggccctgcccacaggcctcccctggtgacagctgtggtgcccccagctggccccctggtgctgagcgccttccccagcacccccctggtggccggccaggacggccggggccccagcggggccggggccagcaatgtgtttgtgcagatgaggacagaggtgggccctgtgaagccaccccaggcccagaccctcatcctgacccaggcccccctggtgtggcaggcccctggcaccctgtgtggcggcgtgatgtgccccccacccctgctgctggccgccgcccctggggtgcctgtgaccagcgcccaggtggtgggcggcacccaggcctgtgagggcggctggagccacggcctgcccctgcccccacctcctcctgctgcccaggtggcccccatcgtgtccccaggaaatgcccggccctggccccagggcgcccatggagagggcagcctggcccccagccaggccaaggcccggccagatgacagctgcaagcccaagtctgtgtatgagaacttccggctgtggcagcactacaagcccctggcccggcggcacctgccccagagcccagacacagaggccctgagctgcttcctgatccctgtgctgcggagcctggcccggaggaagcccaccatgaccctggaggagggcctgtggcaggccatgagggagtggcagcacaccagcaactttgacaggatgatcttctatgagatggccgagaagttcctggagtttgaagctgaggaggagatgcagatccagaagagccagtggatgaagggcccccagagcctgcccccaccagccccaccccggctggagccccggggccccccagcccctgaggtggtgaagcagcctgtgtacctgcccagcaaggatggccccaaggcccccacagcctgcctgcccccaccccggccccagaggcctgctgagaccaaggcccacctgcccccaccccggccccagaggcctgctgagaccaatgcccacctgcccccaccccggccccagaggcctgctgagaccaaggtgcctgaggagatccccccagaggtggtgcaggagtatgtggacatcatggaggagctgctgggcagccaccctggggacacaggagagcctgagggccagcgggagaagggcaaggtggagcagccccaggaggaggatggcatcaccagtgaccccggcctgctgagctacatcgacaagctgtgcagccaggaggactttgtgaccaaggtggaggccgtcatccacccccgcttcctggaggagctgctgagcccagacccccagatggacttcctggccctgagccaggagctggagcaggaggagggcctgaccctggcccagctggtggagaagaggctgctgagcctgaaggagaagggctgcggccgggccgcccccaggcatggaacagcccggctggacagcagccccagcgagtttgctgctggccaggaggccgcccgggaggtgcctgacccccagcagagggtgtctgtggagaccagccccccccagacagctgcccaggacccccagggccagggccgggtgaggacaggcatggcccggagtgaagatcctgctgtgctgctgggctgccaggacagcccccggctgaaggctgtgcggcccaccagccccccccaggaccaccggcccacctgccccggcctgggcaccaaggatgccctgggcctgcctggagagagccctgtgaaggagagccacggcctggccaagggcagcagcgaggagacagagctgcccggcatggtgtatgtggtgggcagccaccaccggctgcggccctggaggctgagccagagccctgtgcccagcagcggcctgctgagccctgggggccggggcccccagggcgccctgcagagccccagcgcccagaagaggggcctgagccccagccccagccctgccagcaagagcaagaagaggcccctgtttggcagccccagccctgctgagaagaccccccaccctggccctggcctgcgggtgtctggagagcagagcctggcctggggcctgggcggccccagccagagccagaagaggaagggggaccccctggccagcaggaggaagaagaagaggcactgcagccagtag

SEQ ID NO: 38650 - DNA, 1479 bp, Artificial Sequence
  Description of Artificial Sequence: Synthetic coding sequence
atggccagcaatggagcctaccctgtgctgggccctggggtgacagtgaaccctggcaccagcctgtctgtgttcaccgccctgccctttgccaccccagcccctggccctgcccacaggcctcccctggtgacagctgtggtgcccccagctggccccctggtgctgagcgccttccccagcacccccctggtggccggccaggacggccggggccccagcggggccggggccagcaatgtgtttgtgcagatgaggacagaggtgggccctgtgaagccaccccaggcccagaccctcatcctgacccaggcccccctggtgtggcaggcccctggcaccctgtgtggcggcgtgatgtgccccccacccctgctgctggccgccgcccctggggtgcctgtgaccagcgcccaggtggtgggcggcacccaggcctgtgagggcggctggagccacggcctgcccctgcccccacctcctcctgctgcccaggtggcccccatcgtgtccccaggaaatgcccggccctggccccagggcgcccatggagagggcagcctggcccccagccaggccaaggcccggccagatgacagctgcaagcccaagtctgtgtatgagaacttccggctgtggcagcactacaagcccctggcccggcggcacctgccccagagcccagacacagaggccctgagctgcttcctgatccctgtgctgcggagcctggcccggaggaagcccaccatgaccctggaggagggcctgtggcaggccatgagggagtggcagcacaccagcaactttgacaggatgatcttctatgagatggccgagaagttcctggagtttgaagctgaggaggagatgcagatccagaagagccagtggatgaagggcccccagagcctgcccccaccagccccaccccggctggagccccggggccccccagcccctgaggtggtgaagcagcctgtgtacctgcccagcaaggatggccccaaggcccccacagcctgcctgcccccaccccggccccagaggcctgctgagaccaaggcccacctgcccccaccccggccccagaggcctgctgagaccaaggtgcctgaggagatccccccagaggtggtgcaggagtatgtggacatcatggaggagctgctgggcagccaccctggggacaccggggagcctgagggccagcgggagaagggcaaggtggagcagccccaggaggaggatggcatcaccagtgaccccggcctgctgagctacatcgacaagctgtgcagccaggaggactttgtgaccaaggtggaggccgtcatccacccccgcttcctggaggagctgctgagcccagacccccagatggacttcctggccctgagccaggagctggagcaggaggagggcctgaccctggcccagggcgcccccagtgatgccctgggcacagaccgctgctag

SEQ ID NO: 38651 - DNA, 2226 bp, Artificial Sequence
  Description of Artificial Sequence: Synthetic coding sequence
atggccagcaatggagcctaccctgtgctgggccctggggtgacagtgaaccctggcaccagcctgtctgtgttcaccgccctgccctttgccaccccagcccctggccctgcccacaggcctcccctggtgacagctgtggtgcccccagctggccccctggtgctgagcgccttccccagcacccccctggtggccggccaggacggccggggccccagcggggccggggccagcaatgtgtttgtgcagatgaggacagaggtgggccctgtgaagccaccccaggcccagaccctcatcctgacccaggcccccctggtgtggcaggcccctggcaccctgtgtggcggcgtgatgtgccccccacccctgctgctggccgccgcccctggggtgcctgtgaccagcgcccaggtggtgggcggcacccaggcctgtgagggcggctggagccacggcctgcccctgcccccacctcctcctgctgcccaggtggcccccatcgtgtccccaggaaatgcccggccctggccccagggcgcccatggagagggcagcctggcccccagccaggccaaggcccggccagatgacagctgcaagcccaagtctgtgtatgagaacttccggctgtggcagcactacaagcccctggcccggcggcacctgccccagagcccagacacagaggccctgagctgcttcctgatccctgtgctgcggagcctggcccggaggaagcccaccatgaccctggaggagggcctgtggcaggccatgagggagtggcagcacaccagcaactttgacaggatgatcttctatgagatggccgagaagttcctggagtttgaagctgaggaggagatgcagatccagaagagccagtggatgaagggcccccagagcctgcccccaccagccccaccccggctggagccccggggccccccagcccctgaggtggtgaagcagcctgtgtacctgcccagcaaggatggccccaaggcccccacagcctgcctgcccccaccccggccccagaggcctgctgagaccaaggcccacctgcccccaccccggccccagaggcctgctgagaccaaggtgcctgaggagatccccccagaggtggtgcaggagtatgtggacatcatggaggagctgctgggcagccaccctggggacaccggggagcctgagggccagcgggagaagggcaaggtggagcagccccaggaggaggatggcatcaccagtgaccccggcctgctgagctacatcgacaagctgtgcagccaggaggactttgtgaccaaggtggaggccgtcatccacccccgcttcctggaggagctgctgagcccagacccccagatggacttcctggccctgagccaggagctggagcaggaggagggcctgaccctggcccagctggtggagaagaggctgctgagcctgaaggagaagggctgcggccgggccgcccccaggcatggaacagcccggctggacagcagccccagcgagtttgctgctggccaggaggccgcccgggaggtgcctgacccccagcagagggtgtctgtggagaccagccccccccagacagctgcccaggacccccagggccagggccgggtgaggacaggcatggcccggtctgaggaccctgctgtgctgctgggctgccaggacagcccccggctgaaggctgtgcggcccaccagccccccccaggaccaccggcccacctgccccggcctgggcaccaaggatgccctgggcctgcccggggagagccctgtgaaggagagccacggcctggccaagggcagcagcgaggagacagagctgcccggcatggtgtatgtggtgggcagccaccaccggctgcggccctggaggctgagccagagccctgtgcccagcagcggcctgctgagccctgggggccggggcccccagggcgccctgcagagccccagcgcccagaagaggggcctgagccccagccccagccctgccagcaagagcaagaagaggcccctgtttggcagccccagccctgctgagaagaccccccaccctggccctggcctgcgggtgtctggagagcagagcctggcctggggcctgggcggccccagccagagccagaagaggaaaggagaccccctggccagcaggaggaagaagaagaggcactgcagccagtag

SEQ ID NO: 38652 - DNA, 1773 bp, Artificial Sequence
  Description of Artificial Sequence: Synthetic coding sequence
atggccagcaatggagcctaccctgtgctgggccctggggtgacagtgaaccctggcaccagcctgtctgtgttcaccgccctgccctttgccaccccagcccctggccctgcccacaggcctcccctggtgacagctgtggtgcccccagctggccccctggtgctgagcgccttccccagcacccccctggtggccggccaggacggccggggccccagcggggccggggccagcaatgtgtttgtgcagatgaggacagaggtgggccctgtgaagccaccccaggcccagaccctcatcctgacccaggcccccctggtgtggcaggcccctggcaccctgtgtggcggcgtgatgtgccccccacccctgctgctggccgccgcccctggggtgcctgtgaccagcgcccaggtggtgggcggcacccaggcctgtgagggcggctggagccacggcctgcccctgcccccacctcctcctgctgcccaggtggcccccatcgtgtccccaggaaatgcccggccctggccccagggcgcccatggagagggcagcctggcccccagccaggccaaggcccggccagatgacagctgcaagcccaagtctgtgtatgagaacttccggctgtggcagcactacaagcccctggcccggcggcacctgccccagaaggtggtgcaggagtatgtggacatcatggaggagctgctgggcagccaccctggggacacaggagagcctgagggccagcgggagaagggcaaggtggagcagccccaggaggaggatggcatcaccagtgaccccggcctgctgagctacatcgacaagctgtgcagccaggaggactttgtgaccaaggtggaggccgtcatccacccccgcttcctggaggagctgctgagcccagacccccagatggacttcctggccctgagccaggagctggagcaggaggagggcctgaccctggcccagctggtggagaagaggctgctgagcctgaaggagaagggctgcggccgggccgcccccaggcatggaacagcccggctggacagcagccccagcgagtttgctgctggccaggaggccgcccgggaggtgcctgacccccagcagagggtgtctgtggagaccagccccccccagacagctgcccaggacccccagggccagggccgggtgaggacaggcatggcccggagtgaagatcctgctgtgctgctgggctgccaggacagcccccggctgaaggctgtgcggcccaccagccccccccaggaccaccggcccacctgccccggcctgggcaccaaggatgccctgggcctgcctggagagagccctgtgaaggagagccacggcctggccaagggcagcagcgaggagacagagctgcccggcatggtgtatgtggtgggcagccaccaccggctgcggccctggaggctgagccagagccctgtgcccagcagcggcctgctgagccctgggggccggggcccccagggcgccctgcagagccccagcgcccagaagaggggcctgagccccagccccagccctgccagcaagagcaagaagaggcccctgtttggcagccccagccctgctgagaagaccccccaccctggccctggcctgcgggtgtctggagagcagagcctggcctggggcctgggcggccccagccagagccagaagaggaagggggaccccctggccagcaggaggaagaagaagaggcactgcagccagtag

SEQ ID NO: 38653 - DNA, 1479 bp, Artificial Sequence
  Description of Artificial Sequence: Synthetic coding sequence
atggccagcaatggagcctaccctgtgctgggccctggggtgacagtgaaccctggcaccagcctgtctgtgttcaccgccctgccctttgccacccccagccctggccccacccacaggcctcccctggtgacagctgtggtgcccccagctggccccctggtgctgagcgccttccccagcacccccctggtggccggccaggacggccggggccccagcggggccggggccagcaatgtgtttgtgcagatgaggacagaggtgggccctgtgaagccaccccaggcccagaccctcatcctgacccaggcccccctggtgtggcaggcccctggcaccctgtgtggcggcgtgatgtgccccccacccctgctgctggccgccgcccctggggtgcctgtgaccagcgcccaggtggtgggcggcacccaggcctgtgagggcggctggagccacggcctgcccctgcccccacctcctcctgctgcccaggtggcccccatcgtgtccccaggaaatgccggcccctggccccagggcgcccatggagagggcagcctggcccccagccaggccaaggcccggccagatgacagctgcaagcccaagtctgtgtatgagaacttccggctgtggcagcactacaagcccctggcccggcggcacctgccccagagcccagacacagaggccctgagctgcttcctgatccctgtgctgcggagcctggcccggaggaagcccaccatgaccctggaggagggcctgtggagggccatgagggagtggcagcacaccagcaactttgacaggatgatcttctatgagatggccgccaagttcctggagtttgaagctgaggaggagatgcagatccagaagagccagtggatgaagggcccccagagcctgcccccaccagccccaccccggctggagccccggggccccccagcccctgaggtggtgaagcagcctgtgtacctgcccagcaaggatggccccaaggcccccacagcctgcctgcccccaccccggccccagaggcctgctgagaccaaggcccacctgcccccacccaggcctcccaggcctgctgagaccaaggtgcctgaggagatccccccagaggtggtgcaggagtatgtggacatcatggaggagctgctgggcagccaccctggggacaccggggagcctgagggccagcgggagaagggcaaggtggagcagccccaggaggaggatggcatgaccagtgaccccggcctgctgagctacatcgacaagctgtgcagccaggaggactttgtgaccaaggtggaggccgtcatccacccccgcttcctggaggagctgctgagcccagacccccagatggacttcctggccctgagccaggagctggagcaggaggagggcctgaccctggcccagggcgcccccagtgatgccctgggcacagaccgctgctag

SEQ ID NO: 38654 - DNA, 2226 bp, Artificial Sequence
  Description of Artificial Sequence: Synthetic coding sequence
atggccagcaatggagcctaccctgtgctgggccctggggtgacagtgaaccctggcaccagcctgtctgtgttcaccgccctgccctttgccacccccagccctggccccacccacaggcctcccctggtgacagctgtggtgcccccagctggccccctggtgctgagcgccttccccagcacccccctggtggccggccaggacggccggggccccagcggggccggggccagcaatgtgtttgtgcagatgaggacagaggtgggccctgtgaagccaccccaggcccagaccctcatcctgacccaggcccccctggtgtggcaggcccctggcaccctgtgtggcggcgtgatgtgccccccacccctgctgctggccgccgcccctggggtgcctgtgaccagcgcccaggtggtgggcggcacccaggcctgtgagggcggctggagccacggcctgcccctgcccccacctcctcctgctgcccaggtggcccccatcgtgtccccaggaaatgccggcccctggccccagggcgcccatggagagggcagcctggcccccagccaggccaaggcccggccagatgacagctgcaagcccaagtctgtgtatgagaacttccggctgtggcagcactacaagcccctggcccggcggcacctgccccagagcccagacacagaggccctgagctgcttcctgatccctgtgctgcggagcctggcccggaggaagcccaccatgaccctggaggagggcctgtggagggccatgagggagtggcagcacaccagcaactttgacaggatgatcttctatgagatggccgccaagttcctggagtttgaagctgaggaggagatgcagatccagaagagccagtggatgaagggcccccagagcctgcccccaccagccccaccccggctggagccccggggccccccagcccctgaggtggtgaagcagcctgtgtacctgcccagcaaggatggccccaaggcccccacagcctgcctgcccccaccccggccccagaggcctgctgagaccaaggcccacctgcccccacccaggcctcccaggcctgctgagaccaaggtgcctgaggagatccccccagaggtggtgcaggagtatgtggacatcatggaggagctgctgggcagccaccctggggacaccggggagcctgagggccagcgggagaagggcaaggtggagcagccccaggaggaggatggcatgaccagtgaccccggcctgctgagctacatcgacaagctgtgcagccaggaggactttgtgaccaaggtggaggccgtcatccacccccgcttcctggaggagctgctgagcccagacccccagatggacttcctggccctgagccaggagctggagcaggaggagggcctgaccctggcccagctggtggagaagaggctgctgagcctgaaggagaagggctgcggccgggccgcccccaggcatggaacagcccggctggacagcagccccagcgagtttgctgctggccaggaggccgcccgggaggtgcctgacccccagcagagggtgtctgtggagaccagccccccccagacagctgcccaggacccccagggccagggccgggtgaggacaggcatggcccggtctgaggaccctgctgtgctgctgggctgccaggacagcccccggctgaaggctgtgcggcccaccagccccccccaggaccaccggcccacctgccccggcctgggcaccaaggatgccctgggcctgcccggggagagccctgtgaaggagagccacggcctggccaagggcagcagcgaggagacagagctgcccggcatggtgtatgtggtgggcagccaccaccggctgcggccctggaggctgagccagagccctgtgcccagcagcggcctgctgagccctgggggccggggcccccagggcgccctgcagagccccagcgcccagaagaggggcctgagccccagccccagccctgccagcaagagcaagaagaggcccctgtttggcagccccagccctgctgagaagaccccccaccctggccctggcctgcgggtgtctggagagcagagcctggcctggggcctgggcggccccagccagagccagaagaggaaaggagaccccctggccagcaggaggaagaagaagaggcactgcagccagtag

SEQ ID NO: 38655 - DNA, 1869 bp, Artificial Sequence
  Description of Artificial Sequence: Synthetic coding sequence
atgtgccccccacccctgctgctggccgccgcccctggggtgcctgtgaccagcgcccaggtggtgggcggcacccaggcctgtgagggcggctggagccacggcctgcccctgcccccacctcctcctgctgcccaggtggcccccatcgtgtccccaggaaatgccggcccctggccccagggcgcccacggggagggcagcctggcccccagccaggccaaggcccggccagatgacagctgcaagcccaagtctgtgtatgagaacttccggctgtggcagcactacaagcccctggcccggcggcacctgccccagagcccagacacagaggccctgagctgcttcctgatccctgtgctgcggagcctggcccggaggaagcccaccatgaccctggaggagggcctgtggagggccatgagggagtggcagcacaccagcaactttgacaggatgatcttctatgagatggccgccaagttcctggagtttgaggccgaggaggagatgcagatccagaagagccagtggatgaagggcccccagagcctgcccccaccagccccaccccggctggagccccggggccccccagcccctgaggtggtgaagcagcctgtgtacctgcccagcaaggatggccccaaggcccccacagcctgcctgcccccaccccggccccagaggcctgctgagaccaaggcccacctgcccccaccccggccccccaggcctgctgagaccaaggtgcctgaggagatccccccagaggtggtgcaggagtatgtggacatcatggaggagctgctgggcagccaccctggggacacaggagagcctgagggccagcgggagaagggcaaggtggagcagccccaggaggaggatggcatgaccagtgaccccggcctgctgagctacatcgacaagctgtgcagccaggaggactttgtgaccaaggtggaggccgtcatccacccccgcttcctggaggagctgctgagcccagacccccagatggacttcctggccctgagccaggagctggagcaggaggagggcctgaccctggcccagctggtggagaagaggctgctgagcctgaaggagaagggctgcggccgggccgcccccaggcatggaacagcccggctggacagcagccccagcgagtttgctgctggccaggaggccgcccgggaggtgcctgacccccagcagagggtgtctgtggagaccagccccccccagacagctgcccaggacccccagggccagggccgggtgaggacaggcatggcccggagtgaagatcctgctgtgctgctgggctgccaggacagcccccggctgaaggctgtgcggcccaccagccccccccaggaccaccggcccacctgccccggcctgggcaccaaggatgccctgggcctgcctggagagagccctgtgaaggagagccacggcctggccaagggcagcagcgaggagacagagctgcccggcatggtgtatgtggtgggcagccaccaccggctgcggccctggaggctgagccagagccctgtgcccagcagcggcctgctgagccctgggggccggggcccccagggcgccctgcagagccccagcgcccagaagaggggcctgagccccagccccagccctgccagcaagagcaagaagaggcccctgtttggcagccccagccctgctgagaagaccccccaccctggccctggcctgcgggtgtctggagagcagagcctggcctggggcctgggcggccccagccagagccagaagaggaagggggaccccctggccagcaggaggaagaagaagaggcactgcagccagtag

SEQ ID NO: 38656 - DNA, 1773 bp, Artificial Sequence
  Description of Artificial Sequence: Synthetic coding sequence
atggccagcaatggagcctaccctgtgctgggccctggggtgacagtgaaccctggcaccagcctgtctgtgttcaccgccctgccctttgccacccccagccctggccccacccacaggcctcccctggtgacagctgtggtgcccccagctggccccctggtgctgagcgccttccccagcacccccctggtggccggccaggacggccggggccccagcggggccggggccagcaatgtgtttgtgcagatgaggacagaggtgggccctgtgaagccaccccaggcccagaccctcatcctgacccaggcccccctggtgtggcaggcccctggcaccctgtgtggcggcgtgatgtgccccccacccctgctgctggccgccgcccctggggtgcctgtgaccagcgcccaggtggtgggcggcacccaggcctgtgagggcggctggagccacggcctgcccctgcccccacctcctcctgctgcccaggtggcccccatcgtgtccccaggaaatgccggcccctggccccagggcgcccatggagagggcagcctggcccccagccaggccaaggcccggccagatgacagctgcaagcccaagtctgtgtatgagaacttccggctgtggcagcactacaagcccctggcccggcggcacctgccccagaaggtggtgcaggagtatgtggacatcatggaggagctgctgggcagccaccctggggacacaggagagcctgagggccagcgggagaagggcaaggtggagcagccccaggaggaggatggcatgaccagtgaccccggcctgctgagctacatcgacaagctgtgcagccaggaggactttgtgaccaaggtggaggccgtcatccacccccgcttcctggaggagctgctgagcccagacccccagatggacttcctggccctgagccaggagctggagcaggaggagggcctgaccctggcccagctggtggagaagaggctgctgagcctgaaggagaagggctgcggccgggccgcccccaggcatggaacagcccggctggacagcagccccagcgagtttgctgctggccaggaggccgcccgggaggtgcctgacccccagcagagggtgtctgtggagaccagccccccccagacagctgcccaggacccccagggccagggccgggtgaggacaggcatggcccggagtgaagatcctgctgtgctgctgggctgccaggacagcccccggctgaaggctgtgcggcccaccagccccccccaggaccaccggcccacctgccccggcctgggcaccaaggatgccctgggcctgcctggagagagccctgtgaaggagagccacggcctggccaagggcagcagcgaggagacagagctgcccggcatggtgtatgtggtgggcagccaccaccggctgcggccctggaggctgagccagagccctgtgcccagcagcggcctgctgagccctgggggccggggcccccagggcgccctgcagagccccagcgcccagaagaggggcctgagccccagccccagccctgccagcaagagcaagaagaggcccctgtttggcagccccagccctgctgagaagaccccccaccctggccctggcctgcgggtgtctggagagcagagcctggcctggggcctgggcggccccagccagagccagaagaggaagggggaccccctggccagcaggaggaagaagaagaggcactgcagccagtag

SEQ ID NO: 38657 - DNA, 1689 bp, Artificial Sequence; identical to SEQ ID NO: 36513
  Description of Artificial Sequence: Synthetic coding sequence

SEQ ID NO: 38658 - DNA, 960 bp, Artificial Sequence
  Description of Artificial Sequence: Synthetic coding sequence
atgaagaatgtggacagtgatgacctggtgacaggcaccctgcccaagctgaagagcagcaaggagtggctggagcccaagcccctgtgcttcatggaggtgctggccaaggaggacacagaggccgccatccagagcatcctgtacaaggaaaattctgtcatcaaggagctggacaagtacctgcagcaccacgccttcctgaatgcccggaggaaggagatgctgtacaagcgctgggtggactgtgtggccgaccccctgcagaagaagatcatcgagaaggtgtgcagccacaagaagatcaagaagaggcggcagggcgagctggatggcttcctgaagcacgtgaacaagaagggaaatgccttcatcgagcactatgaccccaaggagtatgaccccttctacatgagcaagaaggaccccaacttcctgaaggtgaccatcccccccttccatgaccccctgaagaaggcccagtatgacaaggacaatgagaagaggaccctgctgcagtgtgagaccgggaagatctacagcatcaaggagttcaaggaggtggagaaggtgcagctgcacagccgcttcccccagatcagcaacagccgccacttcatcaccccaaatgagtggctgaagctgcccacccgctacatcgagagcgagttctgcagaagaagaaggctgaaggtgaaggtgaacttcaatgactgcagctttgacctgaagcccctggcccgggccccctacctgctggagagccaggaggaggagaagacagtcatctacaagaacaagggcagcagcttcctggagcgggagcccctgtgctaccaggagggcaacaaccccagcgccaaggaggccatcagcgagggctacttcagcagcctgagcctgagcagaaatggaaggaagaccaggatgggcctgcccccccgggtgtggggctgctag

SEQ ID NO: 38659 - DNA, 318 bp, Artificial Sequence
  Description of Artificial Sequence: Synthetic coding sequence
atggccaagatgtttgacctgcggaccaagatcatgattggaattggcagcagcctgctggtggccgccatggtgctgctgtctgtggtgttctgcctgtacttcaaggtggccaaggccctgaaggccgccaaggaccctgatgctgtggccgtgaagaaccacaacccagacaaggtgtgctgggccaccaacagccaggccaaggccaccaccatggagagctgccccagcctgcagtgctgtgagggctgcaggatgcacgccagcagtgacagcctgcccccctgctgctgtgacatcaatgaaggcctgtag

SEQ ID NO: 38660 - DNA, 291 bp, Artificial Sequence
  Description of Artificial Sequence: Synthetic coding sequence
tgaacagtgtgctgccacaccatgctgggcggcctgggcaagctggccgctgagggcctggcccacaggacagagaaggccacagagggcgccatccatgctgtggaggaggtggtgaaggaggtggtgggccacgccaaggagactggagagaaggccatcgccgaggccatcaagaaggcccaggagagcggggacaagaagatgaaggagatcacagaaacagtgaccaacacagtgaccaatgccatcacccatgctgctgagagcctggacaagctgggccagtag

SEQ ID NO: 38661 - DNA, 270 bp, Artificial Sequence; identical to SEQ ID NO: 35388
  Description of Artificial Sequence: Synthetic coding sequence

SEQ ID NO: 38662 - DNA, 291 bp, Artificial Sequence; identical to SEQ ID NO: 38660
  Description of Artificial Sequence: Synthetic coding sequence

SEQ ID NO: 38663 - DNA, 291 bp, Artificial Sequence; identical to SEQ ID NO: 38660
  Description of Artificial Sequence: Synthetic coding sequence

SEQ ID NO: 38664 - DNA, 270 bp, Artificial Sequence; identical to SEQ ID NO: 35388
  Description of Artificial Sequence: Synthetic coding sequence

SEQ ID NO: 38665 - DNA, 270 bp, Artificial Sequence; identical to SEQ ID NO: 35388
  Description of Artificial Sequence: Synthetic coding sequence

SEQ ID NO: 38666 - DNA, 291 bp, Artificial Sequence; identical to SEQ ID NO: 38660
  Description of Artificial Sequence: Synthetic coding sequence

SEQ ID NO: 38667 - DNA, 204 bp, Artificial Sequence
  Description of Artificial Sequence: Synthetic coding sequence
atgaggaagccccaggccggcaccggggaggccgcccgggaccccagcctgcggcctgccaggacagtgctggtgggggaccaggatgagtacacagctgctgagaacaagagcccccggggcaccctgtgccccaccggggagcagaggatccacgccagagaagatgcctgcatcttcagccgcctcttcagcgagaagtag

SEQ ID NO: 38668 - DNA, 204 bp, Artificial Sequence; identical to SEQ ID NO: 38667
  Description of Artificial Sequence: Synthetic coding sequence

SEQ ID NO: 38669 - DNA, 378 bp, Artificial Sequence
  Description of Artificial Sequence: Synthetic coding sequence
atgggcatcttccagctgctgcgggaccggcgcatcagcagccggggccctggcctgcacacccccaaggccgagcccaggaggaggaagggcctgaccaccggcctgatgacccaggccgagcggcagaagcaggcccaccagaggcaggccaccatgagggagacagccctgtggtgcaccggccacatccggcccaggacccacatgcacacaggcacccacacccagacagaccgggagcgggagaggaacacccagaggctgcgggaccgggagcggcgggagaatggccgccacacccacatccacacccagacccaccggcagagcctgattgccaaggccctgaaggacacccaccctggcaacccctag

SEQ ID NO: 38670 - DNA, 279 bp, Artificial Sequence
  Description of Artificial Sequence: Synthetic coding sequence
atgaccaagccccaggccgagagcggggaggccgcccggcaccccatcttccggcctgcccggcgggtgtttggcatcaagatgaccaccctgcagccccgcatcaaggccccccaggagctgactgtgctgcaggagaggagccggcccaccagcaagaagatggctgtgtgcttccacggcagcagcctgcggtctgaggccaccccccgctacagcctggaggaggaggccagaaatggccgctggcagcaggccctgtcctggtggcccctgtag

SEQ ID NO: 38671 - DNA, 2508 bp, Artificial Sequence
  Description of Artificial Sequence: Synthetic coding sequence
atgtctgggggcagccaggtgcacatcttctggggcgcccccatcgcccccctgaagatcaccgtgtctgaggacacagccagcctgatgtctgtggccgacccctggaagaagatccagctgctgtacagccagcacagcctgtacctgaaggatgagaagcagcacaagaacctggagaactacaaggtgcctgagagcatcggcagcccagacctgagcggccacttcctggccaactgcatgaacagacatgtgcacgtgaaggatgactttgtgcgctctgtgtctgagacccagaacatcgagagccagaagatccacagcagccggctgagtgacatcaccagcagcaacatgcagatctgtggcttcaagagcacagtgccccacttcacagaggaggagaagtaccagaagctgctgtctgagaacaagatcagagatgagcagcccaagcaccagcctgacatctgtgggaagaacttcaacaccaacctcttccagctgggccacaagtgtgccgctgtgctggacctggtgtgcagcacagagaagatcaacatcggccctgaggtggtgcagagagaatgtgtgcccacagagtaccacgagatccagaaccagtgcctgggcctcttcagcagcaatgctgtggacaagagccgctctgaggccgctgtgaggaaggtgtctgacctgaagatcagcacagacacagagttcctgagcatcatcaccagcagccaggtggccttcctggcccagaagaaggacaagagaagaagccctgtgaacaagggaaatgtgaacatggagacagagcccaaggccagctatggagagatccgcatccctgaggagaacagcatccagctggatggcttcacagaggcctatgagagcggccagaaccaggcctacagcctggagctgttcagccctgtgtgccccaagacagagaacagccgcatccacatcaacagcgacaagggcctggaggagcacacaggcagccaggagctgttcagcagtgaagatgagctgcccccaaatgagatccgcatcgagctgtgcagcagcggcatcctgtgcagccagctgaacaccttccacaagagcgccatcaagaggagctgcaccagcgaggacaaggtgggccagagcgaggccctgagccgggtgctgcaggtggccaagaagatgaagctgatcagcaatggaggagacagcgctgtggagatggacagaagaaatgtgtctgagttcaagagcatcaagaagaccagcctcatcaagaactgtgacagcaagagccagaagtacaactgcctggtgatggtgctgagcccctgccacgtgaaggagatcaacatcaagtttggccccaacagcggcagcaaggtgcccctggccaccgtgacagtgattgaccagagcgagaccaagaagaaggtgttcctgtggaggacagctgccttctgggccttcaccgtcttcctgggggacatcatcctgctgacagatgtggtgattcatgaggaccagtggattggagaaacagtgctgcagagcaccttcagcagccagctgctgaacctgggcagctacagcagcatccagcctgaggagtacagctctgtggtgtctgaggtggtgctgcaggacctgctggcctacgtgagcagcaagcacagctacctgcgggacctgcccccccggcagccccagagggtgaacagcattgactttgtggagctggagcacctgcagccagatgtgctggtgcatgctgtgctgcgggtggtggacttcaccatcctgacagaagctgtgtacagctaccggggccagaagcagaagaaggtgatgctgactgtggagcaggcccaggaccagcactacgccctggtgctgtggggccctggggccgcctggtacccccagctgcagaggaagaagggcgtggtgctgatcaaggcccagatcagcgagctggccttccccatcacagccagccagaagatcgccctgaatgcccacagcagcctgaagagcatcttcagcagcctgcccaacatcgtgtacacaggctgtgccaagtgtggcctggagctggagacagatgagaaccgcatctacaagcagtgcttcagctgcctgcccttcaccatgaagaagatctactacagacctgccctgatgacagccattgatggaagacatgatgtgtgcatccgggtggagagcaagctgattgagaagatcctgctgaacatctctgctgactgcctgaacagagtgattgtgcccagcagcgagatcacctacggcatggtggtggccgacctcttccacagcctgctggccgtgtctgctgagccctgtgtgctgaagatccagagcctgtttgtgctggatgagaacagctaccccctgcagcaggacttcagcctgctggacttctacccagacatcgtgaagcatggagccaatgcccggctgtag

SEQ ID NO: 38672 - DNA, 2715 bp, Artificial Sequence
  Description of Artificial Sequence: Synthetic coding sequence
atgtctgggggcagccaggtgcacatcttctggggcgcccccatcgcccccctgaagatcaccgtgtctgaggacacagccagcctgatgtctgtggccgacccctggaagaagatccagctgctgtacagccagcacagcctgtacctgaaggatgagaagcagcacaagaacctggagaactacaaggtgcctgagagcatcggcagcccagacctgagcggccacttcctggccaactgcatgaacagacatgtgcacgtgaaggatgactttgtgcgctctgtgtctgagacccagaacatcgagagccagaagatccacagcagccggctgagtgacatcaccagcagcaacatgcagatctgtggcttcaagagcacagtgccccacttcacagaggaggagaagtaccagaagctgctgtctgagaacaagatcagagatgagcagcccaagcaccagcctgacatctgtgggaagaacttcaacaccaacctcttccagctgggccacaagtgtgccgctgtgctggacctggtgtgcagcacagagaagatcaacatcggccctgaggtggtgcagagagaatgtgtgcccacagagtaccacgagatccagaaccagtgcctgggcctcttcagcagcaatgctgtggacaagagccgctctgaggccgctgtgaggaaggtgtctgacctgaagatcagcacagacacagagttcctgagcatcatcaccagcagccaggtggccttcctggcccagaagaaggacaagagaagaagccctgtgaacaagggaaatgtgaacatggagacagagcccaaggccagctatggagagatccgcatccctgaggagaacagcatccagctggatggcttcacagaggcctatgagagcggccagaaccaggcctacagcctggagctgttcagccctgtgtgccccaagacagagaacagccgcatccacatcaacagcgacaagggcctggaggagcacacaggcagccaggagctgttcagcagtgaagatgagctgcccccaaatgagatccgcatcgagctgtgcagcagcggcatcctgtgcagccagctgaacaccttccacaagagcgccatcaagaggagctgcaccagcgaggacaaggtgggccagagcgaggccctgagccgggtgctgcaggtggccaagaagatgaagctgatcagcaatggaggagacagcgctgtggagatggacagaagaaatgtgtctgagttcaagagcatcaagaagaccagcctcatcaagaactgtgacagcaagagccagaagtacaactgcctggtgatggtgctgagcccctgccacgtgaaggagatcaacatcaagtttggccccaacagcggcagcaaggtgcccctggccaccgtgacagtgattgaccagagcgagaccaagaagaaggtgttcctgtggaggacagctgccttctgggccttcaccgtcttcctgggggacatcatcctgctgacagatgtggtgattcatgaggaccagtggattggagaaacagtgctgcagagcaccttcagcagccagctgctgaacctgggcagctacagcagcatccagcctgaggagtacagctctgtggtgtctgaggtggtgctgcaggacctgctggcctacgtgagcagcaagcacagctacctgcgggacctgcccccccggcagccccagagggtgaacagcattgactttgtggagctggagcacctgcagccagatgtgctggtgcatgctgtgctgcgggtggtggacttcaccatcctgacagaagctgtgtacagctaccggggccagaagcagaagaaggtgatgctgactgtggagcaggcccaggaccagcactacgccctggtgctgtggggccctggggccgcctggtacccccagctgcagaggaagaagggctacatctgggagttcaagtacctgtttgtgcagtgcaactacaccctggagaacctggagctgcacaccaccccctggagcagctgtgaatgtctgtttgatgatgacatccgggccatcaccttcaaggccaagttccagaagagcgcccccagctttgtgaagatcagtgacctggccacccacctggaggacaagtgcagcggcgtggtgctgatcaaggcccagatcagcgagctggccttccccatcacagccagccagaagatcgccctgaatgcccacagcagcctgaagagcatcttcagcagcctgcccaacatcgtgtacacaggctgtgccaagtgtggcctggagctggagacagatgaaaatcgcatctacaagcagtgcttcagctgcctgcccttcaccatgaagaagatctactacagacctgccctgatgacagccattgatggaagacatgatgtgtgcatccgggtggagagcaagctgattgagaagatcctgctgaacatctctgctgactgcctgaacagagtcatcgtgcccagcagcgagatcacctacggcatggtggtggccgacctcttccacagcctgctggccgtgtctgctgagccctgtgtgctgaagatccagagcctgtttgtgctggatgaaaattcctaccccctgcagcaggacttcagcctgctggacttctacccagacatcgtgaagcacggggccaatgcccggctgtag

SEQ ID NO: 38673 - DNA, 1680 bp, Artificial Sequence
  Description of Artificial Sequence: Synthetic coding sequence
tgagatgagctgcccccaaatgagatcagaattgagctgtgcagcagcggcatcctgtgcagccagctgaacaccttccacaagagcgccatcaagaggagctgcaccagcgaggacaaggtgggccagagcgaggccctgagccgggtgctgcaggtggccaagaagatgaagctgatcagcaatggaggagacagcgctgtggagatggacagaagaaatgtgtctgagttcaagagcatcaagaagaccagcctcatcaagaactgtgacagcaagagccagaagtacaactgcctggtgatggtgctgagcccctgccacgtgaaggagatcaacatcaagtttggccccaacagcggcagcaaggtgcccctggccaccgtgaccgtcatcgaccagagcgagaccaagaagaaggtgttcctgtggaggacagctgccttctgggccttcaccgtcttcctgggggacatcatcctgctgacagatgtggtgattcatgaggaccagtggattggagagaccgtgctgcagagcaccttcagcagccagctgctgaacctgggcagctacagcagcatccagcctgaggagtacagctctgtggtgtctgaggtggtgctgcaggacctgctggcctacgtgagcagcaagcacagctacctgcgggacctgcccccccggcagccccagagggtgaacagcattgactttgtggagctggagcacctgcagccagatgtgctggtgcatgctgtgctgcgggtggtggacttcaccatcctgacagaggccgtgtacagctaccggggccagaagcagaagaaggtgatgctgactgtggagcaggcccaggaccagcactacgccctggtgctgtggggccctggagctgcctggtacccccagctgcagaggaagaagggctacatctgggagttcaagtacctgtttgtgcagtgcaactacaccctggagaacctggagctgcacaccaccccctggagcagctgtgagtgcctgtttgatgatgacatccgggccatcaccttcaaggccaagttccagaagagcgcccccagctttgtgaagatcagtgacctggccacccacctggaggacaagtgcagcggcgtggtgctgatcaaggcccagatcagcgagctggccttccccatcacagccagccagaagatcgccctgaatgcccacagcagcctgaagagcatcttcagcagcctgcccaacatcgtgtacacaggctgtgccaagtgtggcctggagctggagacagatgagaaccgcatctacaagcagtgcttcagctgcctgcccttcaccatgaagaagatctactacagacctgccctgatgacagccattgatggaagacatgatgtgtgcatccgggtggagagcaagctgattgagaagatcctgctgaacatctctgctgactgcctgaacagagtgattgtgcccagcagcgagatcacctacggcatggtggtggccgacctcttccacagcctgctggccgtgtctgctgagccctgtgtgctgaagatccagagcctgtttgtgctggatgagaacagctaccccctgcagcaggacttcagcctgctggacttctacccagacatcgtgaagcatggagccaatgcccggctgtag

SEQ ID NO: 38674 - DNA, 2508 bp, Artificial Sequence; identical to SEQ ID NO: 38671
  Description of Artificial Sequence: Synthetic coding sequence

SEQ ID NO: 38675 - DNA, 732 bp, Artificial Sequence
  Description of Artificial Sequence: Synthetic coding sequence
atgctgactgtggagcaggcccaggaccagcactacgccctggtgctgtggggccctggagctgcctggtacccccagctgcagaggaagaagggctacatctgggagttcaagtacctgtttgtgcagaggaactacaccctggagaacctggagctgcacaccaccccctggagcagctgtgagtgcctgtttgatgatgacatccgggccatcaccttcaaggccaagttccagaagagcgcccccagctttgtgaagatcagtgacctggccacccacctggaggacaagtgcagcggcgtggtgctgatcaaggcccagatcagcgagctggccttccccctgacagctgcccagaagatcgccctgaatgcccacagcagcctgaagagcatcttcagcagcctgcccaacatcatctacacaggctgtgccaagtgtggcctggagctggagacagatgagaaccgcatctacaagcagtgcttcagctgcctgcccttcaccatgaagaagatctactacagacctgccctgatgacagctgtggatggccgccacaacgtgtacatccgggtggagagcaagctgattgagaagatcctgctgaacatcagcgcccactgcctgaacagagtgattggcaacatcagccgcagccccatgggctggctgtggcagacctgcagcaccccctgctggcagagcgcccagaacctggtgtactag

SEQ ID NO: 38676 - DNA, 639 bp, Artificial Sequence
  Description of Artificial Sequence: Synthetic coding sequence
atgctgactgtggagcaggcccaggaccagcactacgccctggtgctgtggggccctggagctgcctggtacccccagctgcagaggaagaagggcgtggtgctgatcaaggcccagatcagcgagctggccttccccctgacagctgcccagaagatcgccctgaatgcccacagcagcctgaagagcatcttcagcagcctgcccaacatcatctacacaggctgtgccaagtgtggcctggagctggagacagatgaaaatcgcatctacaagcagtgcttcagctgcctgcccttcaccatgaagaagatctactacagacctgccctgatgacagctgtggatggccgccacaacgtgtacatccgggtggagagcaagctgattgagaagatcctgctgaacatcagcgcccactgcctgaacagagtcatcgtgcccagcagcgagatcacctacggcatggtggtggccgacctcttccacagcctgctggccgtgtctgctgagccctgtgtgctgaagatccagagcctgtttgtgctggatgaaaattcctaccccctgcagcaggacttcagcctgctggacttctacccagacatggtgaagcacggggccaatgcccggctgtag

SEQ ID NO: 38677 - DNA, 2505 bp, Artificial Sequence
  Description of Artificial Sequence: Synthetic coding sequence
atggaggaccctgctgcccctggcactggaggccccccagccaatggaaatggaaatggaggcggcaagggcaagcaggccgcccccaagggccgggaggccttccgcagccagaggcgggagagcgagggctctgtggactgccccaccctggagtttgaatatggagatgctgatggccacgccgctgagctgtctgagctgtacagctacacagagaacctggagttcaccaacaacagacgctgctttgaggaggacttcaagacccaggtgcagggcaaggagtggctggagctggaggaggatgcccagaaggcctacatcatgggcctgctggaccggctggaggtggtgtcccgggagcggcggctgaaggtggcccgggctgtgctgtacctggcccagggcacctttggagaatgtgacagcgaggtggatgtgctgcactggagccgctacaactgcttcctgctgtaccagatgggcaccttcagcaccttcctggagctgctgcacatggagattgacaacagccaggcctgcagcagcgccctgaggaagccagctgtgtccattgctgacagcacagagctgcgggtgctgctgtctgtgatgtacctgatggtggagaacatccggctggagcgggagacagacccctgtggctggaggacagcccgggagaccttcagaacagagctgtccttctccatgcacaatgaggagccctttgccctgctgctcttctccatggtgaccaagttctgcagcggcctggccccccacttccccatcaagaaggtgctgctgctgctgtggaaggtggtgatgttcaccctgggcggctttgagcacctgcagaccctgaaggtgcagaagagagctgagctgggcctgccccccctggctgaagattccatccaggtggtgaagtccatgagagctgccagccccccatcctacaccctggacctgggggagagccagctggcccccccacccagcaagctgcggggcagaagaggcagccggcggcagctgctgaccaagcaggacagcctggacatctacaatgaaagagacctcttcaagacagaggagcccgccacagaggaggaggaggagagcgctggagatggagagaggaccctggatggagagctggacctgctggagcaggaccccctggtgcccccaccacccagccaggcccccctgtctgctgagcgggtggccttccccaagggcctgccctgggcccccaaggtgcggcagaaggacatcgagcacttcctggagatgagcaggaacaagttcatcggcttcaccctgggccaggacacagacaccctggtgggcctgccccggcccatccacgagagcgtgaagaccctgaagcagcacaagtacatcagcattgctgatgtgcagatcaagaatgaggaggagctggagaagtgccccatgagcctgggggaggaggtggtgcctgagaccccctgtgagatcctgtaccagggcatgctgtacagcctgccccagtacatgattgccctgctgaagatcctgctggccgccgcccccaccagcaaggccaagacagacagcatcaacatcctggctgatgtgctgcctgaggagatgcccatcaccgtgctgcagagcatgaagctgggcattgatgtgaacagacacaaggagatcatcgtgaagagcatcagcaccctgctgctgctgctgctgaagcacttcaagctgaaccacatctaccagtttgaatatgtgtcccagcacctggtgtttgccaactgcatccccctcatcctgaagttcttcaaccagaacatcctgagctacatcacagccaagaacagcatctctgtgctggactacccctgctgcaccatccaggacctgcctgagctgaccacagagagcctggaggccggggacaacagccagttctgctggaggaacctcttcagctgcatcaacctgctgcggctgctgaacaagctgaccaagtggaagcacagcaggaccatgatgctggtggtgttcaagagcgcccccatcctgaagagggccctgaaggtgaagcaggccatgctgcagctgtatgtgctgaagctgctgaagctgcagaccaagtacctgggccggcagtggaggaagagcaacatgaagaccatgtctgccatctaccagaaggtgcgccacaggatgaatgatgactgggcctatggaaatgacattgatgcccggccctgggacttccaggccgaggagtgcaccctgcgggccaacatcgaggccttcaacagcagaagatatgaccggccccaggacagcgagttcagccctgtggacaactgcctgcagagcgtgctgggccagaggctggacctgcctgaggacttccactacagctatgagctgtggctggagcgggaggtgttcagccagcccatctgctgggaggagctgctgcagaaccactag

SEQ ID NO: 38678 - DNA, 2277 bp, Artificial Sequence
  Description of Artificial Sequence: Synthetic coding sequence
atggaggaccctgctgcccctggcactggaggccccccagccaatggaaatggaaatggaggcggcaagggcaagcaggccgcccccaagggccgggaggccttccgcagccagaggcgggagagcgagggctctgtggactgccccaccctggagtttgaatatggagatgctgatggccacgccgctgagctgtctgagctgtacagctacacagagaacctggagttcaccaacaacagacgctgctttgaggaggacttcaagacccaggtgcagggcaaggagtggctggagctggaggaggatgcccagaaggcctacatcatgggcctgctggaccggctggaggtggtgtcccgggagcggcggctgaaggtggcccgggctgtgctgtacctggcccagggcacctttggagaatgtgacagcgaggtggatgtgctgcactggagccgctacaactgcttcctgctgtaccagatgggcaccttcagcaccttcctggagctgctgcacatggagattgacaacagccaggcctgcagcagcgccctgaggaagccagctgtgtccattgctgacagcacagagctgcgggtgctgctgtctgtgatgtacctgatggtggagaacatccggctggagcgggagacagacccctgtggctggaggacagcccgggagaccttcagaacagagctgtccttctccatgcacaatgaggagccctttgccctgctgctcttctccatggtgaccaagttctgcagcggcctggccccccacttccccatcaagaaggtgctgctgctgctgtggaaggtggtgatgttcaccctgggcggctttgagcacctgcagaccctgaaggtgcagaagagagctgagctgggcctgccccccctggctgaagattccatccaggtggtgaagtccatgagagctgccagccccccatcctacaccctggacctgggggagagccagctggcccccccacccagcaagctgcggggcagaagaggcagccggcggcagctgctgaccaagcaggacagcctggacatctacaatgaaagagacctcttcaagacagaggagcccgccacagaggaggaggaggagagcgctggagatggagagaggaccctggatggagagctggacctgctggagcaggaccccctggtgcccccaccacccagccaggcccccctgtctgctgagcgggtggccttccccaagggcctgccctgggcccccaaggtgcggcagaaggacatcgagcacttcctggagatgagcaggaacaagttcatcggcttcaccctgggccaggacacagacaccctggtgggcctgccccggcccatccacgagagcgtgaagaccctgaagcagcacaagtacatcagcattgctgatgtgcagatcaagaatgaggaggagctggagaagtgccccatgagcctgggggaggaggtggtgcctgagaccccctgtgagatcctgtaccagggcatgctgtacagcctgccccagtacatgattgccctgctgaagatcctgctggccgccgcccccaccagcaaggccaagacagacagcatcaacatcctggctgatgtgctgcctgaggagatgcccatcaccgtgctgcagagcatgaagctgggcattgatgtgaacagacacaaggagatcatcgtgaagagcatcagcaccctgctgctgctgctgctgaagcacttcaagctgaaccacatctaccagtttgaatatgtgtcccagcacctggtgtttgccaactgcatccccctcatcctgaagttcttcaaccagaacatcctgagctacatcacagccaagaacagcatctctgtgctggactacccctgctgcaccatccaggacctgcctgagctgaccacagagagcctggaggccggggacaacagccagttctgctggaggaacctcttcagctgcatcaacctgctgcggctgctgaacaagctgaccaagtggaagcacagcaggaccatgatgctggtggtgttcaagagcgcccccatcctgaagagggccctgaaggtgaagcaggccatgctgcagctgtatgtgctgaagctgctgaagctgcagaccaagtacctgggccggcagtggaggaagagcaacatgaagaccatgtctgccatctaccagaaggtgcgccacaggatgaatgatgactgggcctatggaaatggagagagcagccagagcagctag

SEQ ID NO: 38679 - DNA, 636 bp, Artificial Sequence
  Description of Artificial Sequence: Synthetic coding sequence
atgttcagccagggcctgtgcagcgacagcatgtttcctgagatgtggaggcctgtggacatgggctggccccagaccaggatgccccgggtgcgcagcctgcacgcctacccacccttcttccccctgcagcagctgctgaccaagcaggacagcctggacatctacaatgaaagagacctcttcaagacagaggagcccgccacagaggaggaggaggagagcgctggagatggagagaggaccctggatggagagctggacctgccctgggcccccaaggtgcggcagaaggacatcgagcacttcctggagatgagcaggaacaagttcatcggcttcaccctgggccaggacacagacaccctggtgggcctgccccggcccatccatgaatctgtgaagaccctgaagcagcacaagtacatcagcattgctgatgtgcagatcaagaatgaggaggagctggagaagtgccccatgagcctggtgtcccagggcagccccacccaggaggagagcaggaggaagcctgtgttttctgtggtgacagagcacgtgtgcatgcacagcttcagcatcctgggctgcaactgtgtgcctgggggccggggcggcaccagagatgccatgtag

SEQ ID NO: 38680 - DNA, 1272 bp, Artificial Sequence
  Description of Artificial Sequence: Synthetic coding sequence
atgctgccctggaagaagcacaagtttgagctgctggccgaggccccaccccggcaggccagcaagcccaagggctatgctgtgtccctgcactacagcgccctgagcagcctggcccgggcctgcccagagggcgccctgagccgggtgggctccatgttccgcagcaagaggaagaagctgcacatcaccagcgaggaccccacctacacagtgctgtacctgggcaatgccaccaccatccaggcccggggagatggctgcacagacctggccgtgggcaagatctggagcaagtctgaggccggccggcagggcaccaagatgaagctgactgtgtctgcccagggcatccgcatggtgcatgctgaggagcgggccctgcggcggcccggccacctgtacctgctgcaccgggtgacctactgtgtggctgatgcccggctgcccaaggtgtttgcctgggtgtacagacatgagctgaagcacaaggctgtgatgctgcgctgccacgctgtgctggtgtccaagccagagaaggcccaggccatggccctgctgctgtaccagaccagcgccaatgccctggccgagttcaagaggctgaagagaagagatgatgcccggcaccagcagcaggagctggtgggcgcccacaccatccccctggtgcccctgaggaagctgctgctgcacggcccctgctgctacaagccccctgtggagaggagccgcagcgcccccaagctgggcagcatcacagaggacctgctgggggagcagctggagcaggagctgcaggaggaggaggaggaggagcagcctgagggctgcccagaggaggaggagaacagagctgctgagggggaccctgctgaggaggaggccgaggcccagagggccctggtggtggccatgcactttgaatgtggggacctgctggacaccctggagaatggccgcggggaggccctgggcggcggcggcggcagcctgggccctggggccggccccccacccctgctgctgggcagcgccagtgacatgaaggccgagctgagccagctgatcagtgacctgggggagctgagctttggaaatgatgtgaggaccctgcaggccgacctgcgggtgacccggctgctgagcggggacagcactggaagtgagagcagcattgaaggaggcggcccagatgccaccagcgccacagctggggacagcagccggcaggctgatggagccagcgcagatgagccccacagcggctag

SEQ ID NO: 38681 - DNA, 990 bp, Artificial Sequence
  Description of Artificial Sequence: Synthetic coding sequence
atgctgccctggaggaggaacaagtttgtgctggtggaggatgaggccaagtgcaaggccaagagcctgagccctggcctggcctacaccagcctgctgagcagcttcctgcggagctgcccagacctgctgcctgactggcccctggagcggctgggccgggtcttccgcagccggcggcagaaggtggagctgaacaaggaggaccccacctacacagtgtggtacctgggcaatgctgtgaccctgcacgccaagggagatggctgcacagatgatgctgtgggcaagatctgggcccgctgtggccctgggggcggcaccaagatgaagctgaccctgggcccccacggcatccgcatgcagccctgtgagaggtctgctgctgggggcagcggcggcagaagacctgcccacgcctacctgctgccccgcatcacctactgcacagcagatggccgccacccccgggtgtttgcctgggtgtaccgccaccaggcccggcacaaggctgtggtgctgcgctgccacgctgtgctgctggcccgggcccacaaggcccgggccctggcccggctgctgcggcagacagccctggccgccttcagtgacttcaagaggctgcagaggcagagtgatgcccggcacgtgcggcagcagcacctgcgggccggcggggccgccgcctctgtgccccgggcccccctgcggcggctgctgaatgccaagtgtgcctaccggcccccaccttctgagaggagcagaggagccccccggctgagcagcatccaggaggaggatgaggaggaggaggaggatgatgctgaggagcaggagggcggcgtgccccagcgggagaggcctgaggtgctgagcctggcccgggagctgcggacctgcagcctgcggggggccccagcccctcctcctccagcccagccccggcgctggaaggccggcccccgggagagagctggccaggccaggtag

SEQ ID NO: 38682 - DNA, 1074 bp, Artificial Sequence
  Description of Artificial Sequence: Synthetic coding sequence
atggctgctgctgaggtggccgacacccagctgatgctgggcgtgggcctcatcgagaaggacaccaatggagaggtgctgtgggtgtggtgctaccccagcaccacagccaccctgaggaacctgctgctgaggaagtgctgcctgacagatgagaacaagctgctgcacccctttgtgtttggccagtacagaaggacctggttctacatcaccaccatcgaggtgcctgacagcagcatcctgaagaaggtgacccacttcagcatcgtgctgacagccaaggacttcaaccctgagaagtatgctgccttcacccgcatcctgtgcaggatgtacctgaagcacggcagccctgtgaagatgatggagagctacatcgctgtgctgaccaagggcatctgccagagtgaagaaaatggcagcttcctgagcaaggactttgatgccaggaaggcctacctggccggcagcatcaaggacatcgtgtcccagtttggcatggagaccgtcatcctgcacacagccctgatgctgaagaagagaattgtggtgtaccaccccaagattgaggccgtgcaggagttcaccaggaccctgcctgccctggtgtggcaccggcaggactggaccatcctgcacagctatgtgcacctgaatgctgatgagctggaggccctgcagatgtgcaccggctacgtggccggctttgtggacctggaggtgagcaacagaccagacctgtatgatgtgtttgtgaacctggccgagagcgagatcaccatcgcccccctggccaaggaggccatggccatgggcaagctgcacaaggagatgggccagctgattgtgcagagcgctgaggaccctgagaagtctgagagccacgtgatccaggacatcgccctgaagacccgggagatcttcaccaacctggcccccttcagcgaggtgtctgcagatggagagaagagggtgctgaacctggaggccctgaagcagaagcgcttccccccagccacagagaacttcctgtaccacctggccgctgctgagcagatgctgaagatctag

SEQ ID NO: 38683 - DNA, 603 bp, Artificial Sequence
  Description of Artificial Sequence: Synthetic coding sequence
atggctgctgctgaggtggccgacacccagctgatgctgggcgtgggcctcatcgagaaggacaccaatggagaggtgctgtgggtgtggtgctaccccagcaccacagccaccctgaggaacctgctgctgaggaagtgctgcctgacagatgagaacaagctgctgcacccctttgtgtttggccagtacagaaggacctggttctacatcaccaccatcgaggtgcctgacagcagcatcctgaagaaggtgacccacttcagcatcgtgctgacagccaaggacttcaaccctgagaagtatgctgccttcacccgcatcctgtgcaggatgtacctgaagcacggcagccctgtgaagatgatggagagctacatcgctgtgctgaccaagggcatctgccagagtgaagaaaatggcagcttcctgagcaaggactttgatgccaggaaggcctacctggccggcagcatcaagggcctgtgcctgccctggtgtggcacagacagaacaggccccagcttcaccctgacctgcaccagcacccccatgtcctggaagccctgccgctgtgcccaggtgaccagcctggacctgtag

SEQ ID NO: 38684 - DNA, 621 bp, Artificial Sequence
  Description of Artificial Sequence: Synthetic coding sequence
atgctgcccagcctgggctactgtgtggacatcgtgtcccagtttggcatggagaccgtcatcctgcacacagccctgatgctgaagaagagaattgtggtgtaccaccccaagattgaagctgtgcaggagttcaccaggaccctgcctgccctggtgtggcaccggcaggactggaccatcctgcacagctatgtgcacctgaatgctgatgagctggaggccctgcagatgtgcaccggctacgtggccggctttgtggacctggaggtgagcaacagaccagacctgtatgatgtgtttgtgaacctggccgagagcgagatcaccatcgcccccctggccaaggaggccatggccatgggcaagctgcacaaggagatgggccagctgattgtgcagagcgcagaagatcctgagaagtctgagagccacgtgatccaggacatcgccctgaagacccgggagatcttcaccaacctggcccccttcagcgaggtgtctgcagatggagagaagagggtgctgaacctggaggccctgaagcagaagcgcttccccccagccacagagaacttcctgtaccacctggccgctgctgagcagatgctgaagatctag

SEQ ID NO: 38685 - DNA, 666 bp, Artificial Sequence
  Description of Artificial Sequence: Synthetic coding sequence
atggctgctgctgaggtggccgacacccagctgatgctgggcgtgggcctcatcgagaaggacaccaatggagaggtgctgtgggtgtggtgctaccccagcaccacagccaccctgaggaacctgctgctgaggaagtgctgcctgacagatgagaacaagctgctgcacccctttgtgtttggccagtacagaaggacctggttctacatcaccaccatcgaggtgcctgacagcagcatcctgaagaaggtgacccacttcagcatcgtgctgacagccaaggacttcaaccctgagaagtatgctgccttcacccgcatcctgtgcaggatgtacctgaagcacggcagccctgtgaagatgatggagagctacatcgctgtgctgaccaagggcatctgccagagtgaagaaaatggcagcttcctgagcaaggactttgatgccaggaaggcctacctggccggcagcatcaaggacatcgtgtcccagtttggcatgaactgctacctgacccacagcacagatgccaaggagaagaactgtggggtgagcccccaggacagaagtggccctggggtgcaccaggacagcgcctgccctggggtggcccccaccggcctggaccaccccagcctgctgcgggccccccagaggaggtag

SEQ ID NO: 38686 - DNA, 1386 bp, Artificial Sequence
  Description of Artificial Sequence: Synthetic coding sequence
atgcaccagcgctacttctggacagaccagggccaggtggccctgggcggccactacatggccgagggggagggctactttgccatgtctgaagatgagctggcctgcagcccctacatccccctgggcggggactttggaggaggagactttggaggaggagactttggaggaggagactttggaggcggcggcagctttggaggccactgcctggactactgtgagagccccacagcccactgcaatgtgctgaactgggagcaggtgcagaggctggatggcatcctgtctgagaccatccccatccacggccggggcaacttccccaccctggagctgcagcccagcctgattgtgaaggtggtgagaagaaggctggccgagaagagaattggagtgagagatgtgcggctgaatggcagcgctgccagccacgtgctgcaccaggacagcggcctgggctacaaggacctggacctgatcttctgtgccgacctgcggggggagggggagttccagacagtgaaggatgtggtgctggactgcctgctggacttcctgcctgagggcgtgaacaaggagaagatcacccccctgaccctgaaggaggcctacgtgcagaagatggtgaaggtgtgcaatgacagcgaccgctggagcctcatcagcctgagcaacaacagcggcaagaatgtggagctgaagtttgtggacagcctgcggcggcagtttgagttctctgtggacagcttccagatcaagctggacagcctgctgctcttctatgagtgcagcgagaaccccatgacagagaccttccaccccaccatcattggagagagcgtgtatggagacttccaggaggcctttgaccacctgtgcaacaagatcatcgccaccaggaaccctgaggagatccggggcggcggcctgctgaagtactgcaacctgctggtgcggggcttccggcctgccagtgatgagatcaagaccctgcagcgctacatgtgcagccgcttcttcatcgacttcagtgacatcggggagcagcagaggaagctggagagctacctgcagaaccactttgtgggcctggaggacagaaaatatgagtacctgatgaccctgcacggcgtggtgaatgaaagcacagtgtgcctgatgggccatgaaagacggcagaccctgaacctgatcaccatgctggccatccgggtgctggccgaccagaatgtcatccccaacgtggccaacgtgacctgctactaccagcctgccccctacgtggctgatgccaacttcagcaactactacatcgcccaggtgcagcctgtgttcacctgccagcagcagacctacagcacctggctgccctgcaactag

SEQ ID NO: 38687 - DNA, 1572 bp, Artificial Sequence
  Description of Artificial Sequence: Synthetic coding sequence
atgcagatgagaagagtgtggaggacctgccgcagcggccccaggaagagaagagaggcccgctacaagaagagcacagaggacatcttccctgcccagctgctgaagctgcagagacatgagcgggtgtggcagcaggagccccctgtgcgggaccaccgctcctggggcggcagcggggccggcggcgtggccggccgggagtggacagaccagggccaggtggccctgggcggccactacatggccgagggggagggctactttgccatgtctgaagatgagctggcctgcagcccctacatccccctgggcggggactttggaggaggagactttggaggaggagactttggaggaggagactttggaggcggcggcagctttggaggccactgcctggactactgtgagagccccacagcccactgcaatgtgctgaactgggagcaggtgcagaggctggatggcatcctgtctgagaccatccccatccacggccggggcaacttccccaccctggagctgcagcccagcctgattgtgaaggtggtgagaagaaggctggccgagaagagaattggagtgagagatgtgcggctgaatggcagcgctgccagccacgtgctgcaccaggacagcggcctgggctacaaggacctggacctgatcttctgtgccgacctgcggggggagggggagttccagacagtgaaggatgtggtgctggactgcctgctggacttcctgcctgagggcgtgaacaaggagaagatcacccccctgaccctgaaggaggcctacgtgcagaagatggtgaaggtgtgcaatgacagcgaccgctggagcctcatcagcctgagcaacaacagcggcaagaatgtggagctgaagtttgtggacagcctgcggcggcagtttgagttctctgtggacagcttccagatcaagctggacagcctgctgctcttctatgagtgcagcgagaaccccatgacagagaccttccaccccaccatcattggagagagcgtgtatggagacttccaggaggcctttgaccacctgtgcaacaagatcatcgccaccaggaaccctgaggagatccggggcggcggcctgctgaagtactgcaacctgctggtgcggggcttccggcctgccagtgatgagatcaagaccctgcagcgctacatgtgcagccgcttcttcatcgacttcagtgacatcggggagcagcagaggaagctggagagctacctgcagaaccactttgtgggcctggaggacagaaaatatgagtacctgatgaccctgcacggcgtggtgaatgaaagcacagtgtgcctgatgggccatgaaagacggcagaccctgaacctgatcaccatgctggccatccgggtgctggccgaccagaatgtcatccccaacgtggccaacgtgacctgctactaccagcctgccccctacgtggctgatgccaacttcagcaactactacatcgcccaggtgcagcctgtgttcacctgccagcagcagacctacagcacctggctgccctgcaactag

SEQ ID NO: 38688 - DNA, 267 bp, Artificial Sequence
  Description of Artificial Sequence: Synthetic coding sequence
tgaaaaagaattggagtgagagatgtgcggctgaatggcagcgctgccagccacgtgctgcaccaggacagcggcctgggctacaaggacctggacctgatcttctgtgccgacctgcggggggagggggagttccagacagtgaaggatgtggtgctggactgcctgctggacttcctgcctgagggcgtgaacaaggagaagatcacccccctgaccctgaaggaggagagccacaccaccacctacttcctgaacatctcctag

SEQ ID NO: 38689 - DNA, 261 bp, Artificial Sequence
  Description of Artificial Sequence: Synthetic coding sequence
tgacaggacagcggcctgggctacaaggacctggacctgatcttctgtgccgacctgcggggggagggggagttccagacagtgaaggatgtggtgctggactgcctgctggacttcctgcctgagggcgtgaacaaggagaagatcacccccctgaccctgaaggtgttccaccggctgctgcggcactggagggctgctgagaagacaggagtgctgtttgctgagcccctgtgtggcatcggccggccccaggtgtag

SEQ ID NO: 38690 - DNA, 1278 bp, Artificial Sequence
  Description of Artificial Sequence: Synthetic coding sequence
atgatgcccagcgagagcggggctgagcggcgggacagagctgctgcccaggtgggcacagctgctgccacagctgtggccacagctgccccagctgggggcggccctgaccctgaggccctgagcgccttccctggccgccacctgagcggcctgtcctggccccaggtgaagaggctggatgccctgctgtctgagcccatccccatccacggccggggcaacttccccaccctgtctgtgcagccccggcagatcgtgcaggtggtgcgcagcaccctggaggagcagggcctgcacgtgcacagcgtgcggctgcacggcagcgctgccagccacgtgctgcaccctgagagcggcctgggctacaaggacctggacctggtgttccgggtggacctgcggtctgaggccagcttccagctgaccaaggctgtggtgctggcctgcctgctggacttcctgcctgctggggtgtcccgggccaagatcacccccctgaccctgaaggaggcctacgtgcagaagctggtgaaggtgtgcacagacagcgaccgctggagcctcatcagcctgagcaacaagagcggcaagaatgtggagctgaagtttgtggacagcgtgcggcggcagtttgagttcagcattgacagcttccagatcatcctggacagcctgctgctgtttggccagtgcagcagcacccccatgtctgaggccttccaccccaccgtgactggagagagcctgtatggagacttcacagaggccctggagcacctgcggcacagggtcatcgccaccaggagccctgaggagatccggggcggcggcctgctgaagtactgccacctgctggtgcggggcttccggccccggcccagcacagatgtgcgggccctgcagcgctacatgtgcagccgcttcttcatcgacttcccagacctggtggagcagaggaggaccctggagcgctacctggaggcccactttggaggagcagatgctgcccggcgctatgcctgcctggtgaccctgcaccgggtggtgaatgaaagcacagtgtgcctgatgaaccacgagcggcggcagaccctggacctgattgctgccctggccctgcaggccctggccgagcagggccctgctgccacagctgccctggcctggaggcctcctggaacagatggagtggtgcctgccaccgtgaactactacgtgacccctgtgcagcccctgctggcccacgcctaccccacctggctgccctgcaactag

SEQ ID NO: 38691 - DNA, 1170 bp, Artificial Sequence
  Description of Artificial Sequence: Synthetic coding sequence
atgtctgagatccgcttcaccaacctgacctgggaccaggtgatcaccctggaccaggtgctggatgaggtgatccccatccacggcaagggcaacttccccaccatggaggtgaagcccaaggacatcatccacgtggtgaaggaccagctgattggccagggcatcatcgtgaaggatgcccggctgaatggatctgtggccagctacatcctggccagccacaacggcatctcctacaaggacctggatgtgatctttggagtggagctgcctggaaatgaggagttccaggtggtgaaggatgctgtgctggactgcctgctggacttcctgcccaaggatgtgaagaaggagaagctgagcccagacatcatgaaggatgcctacgtgcagaagctggtgaaggtgtgcaatggacatgactgctggagcctcatcagcctgagcaacaacacaggcaagaacctggagctgaagtttgtgagcagcctgcggcggcagtttgagttctctgtggacagcttccagatcgtgctggaccccatgctggacttctacagcgacaagaatgccaagctgaccaaggagagctaccctgtggtggtggccgagagcatgtacggggacttccaggaggccatgacccacctgcagcacaagctgatctgcaccaggaagccagaggagatccggggcggcggcctgctgaagtactgcagcctgctggtgcacggcttcaagccagcctgcatgtctgagatcaagaacctggagcgctacatgtgcagccgcttcttcatcgacttcccccacatcgaggagcagcagaagaagattgagagctacctgcacaaccacttcatcggggagggcatgaccaagtatgactacctgatgaccctgcatggagtggtgaatgaaagcacagtgtgcctgatgtcctatgaaagacggcagatcctgcacctgatcaccatgatggccctgaaggtgctgggggagctgaacatcctgcccaacacccagaaggtgacctgcttctaccagcctgccccctactttgctgctgaggcccgctaccccatctacgtgattcctgagcccccacctgtgtccttccagccctaccaccccctgcacttccggggcagcaatggcatgtcctag

SEQ ID NO: 38692 - DNA, 1170 bp, Artificial Sequence; identical to SEQ ID NO: 38691
  Description of Artificial Sequence: Synthetic coding sequence

SEQ ID NO: 38693 - DNA, 888 bp, Artificial Sequence
  Description of Artificial Sequence: Synthetic coding sequence
atgcagatgtctgtgccctgtgtgctgagcagcctgcagaaccacgagcccaacaagcccctcttcaccacccagagccagctgctgagcaaggtgctggaggtgctggaccctgacaggaagctggaggacacctgggcctactgccaggacaccaggaagggcatgaaggagcccaccaagctgctgaagaagcacagcacccaggtgtacctgggccccagcaagaagacctctgtgtccaatgccggccagtggctgtatgaggagaagccccacaagatggacctgctgcatgaaaatggccccaggcctggcctgcatgaaaatgtgtgcaaggctgtgtctgacttctgcaagtgggtgaccaccttcggcatcagtgacattgatgaggagttcatcctgaagcagtttgatattgattatgagaccaagcccagccatgatgccctgcacaccatgaagctgaaccaggtgcccctggagctgaagaggtctgtgggcctgagcaagctgcaggagacagagttcttccagaagctgggctatgaaaggaagctgcagaagccccagaacccctacaagcccaagtgggtgaagatgagatatggagcctggtacctgaaccccaagctgtggaagaagcagagggtggatgagcccctggtggaccctgaggtgagccacaaggcccaggaggagaacttcaagaaggagctgcaggagcaggaggagctgctggccgacctgcacggcaccgtggccttcaaggacttcatcctgagccggggctaccgcaccccccgcttcctggagaacatgtacatcggcaaggagtgcaagagggcctgcaacaagacccccatcaagaggacccaggcctag

SEQ ID NO: 38694 - DNA, 1056 bp, Artificial Sequence
  Description of Artificial Sequence: Synthetic coding sequence
atggctgacagaagaagaaggctgcggcccggcaccctggcccctgtgcgggagggcgtgaactgccgcagccgctgcttcaccaagcacaagaatggcctgaagttccccaccagcctgcacagccggcagctggtgttccccaggaagggcctggatgacttcaggaagggctgccccccctgcaccggcctggtgacccaggtgcctgtggagggcttcctgccccagatctaccaccgggccccccagctggcccccaagaagaggcagatcaagctgctgaaggaggctgatgtgctgagcaagctgagccctgcccagcaggccaggaaggccttcctggaggatgtggaggcccacctgaccccccaccccctggccctgtacctgaacctggaggaggccatgcccatcgagctgctgagcaaggtgctggaggtgctggaccctgacaggaagctggaggacacctgggcctactgccaggacaccaggaagggcatgaaggagcccaccaagctgctgaagaagcacagcacccaggtgtacctgggccccagcaagaagacctctgtgtccaatgccggccagtggctgtatgaggagaagccccacaagatggacctgctgcatgaaaatggcccccggcccggcctgcatgaaaatggcatcagtgacattgatgaggagttcatcctgaagcagtttgatattgattatgagaccaagcccagccatgatgccctgcacaccatgaagctgaaccaggtgcccctggagctgaagaggtctgtgggcctgagcaagctgcaggagacagagttcttccagaagctgggctatgaaaggaagctgcagaagccccagaacccctacaagcccaagtgggtgaagatgagatatggagcctggtacctgaaccccaagctgtggaagaagcagagggtggatgagcccctggtggaccctgaggtgagccacaaggcccaggaggagaacttcaagaaggagctgcaggagcagagcatcttcaagaaggccatggacatctag

SEQ ID NO: 38695 - DNA, 2376 bp, Artificial Sequence
  Description of Artificial Sequence: Synthetic coding sequence
atgggagaccagaggctgcaggactggctgcggagccctggcatggacagcaagccctggtactgcaacaagaggcccagcaagtgctttgccaagtgcaagcaccggcggctgcgcttcccccccatggacacccagaactgggtgtttgtgaaggagggcatggatgacttccgctatggctgccccagccctgaggacaccctggtgtgcagaagagatgagttcctgctgcccaagatcagcctgcggggcccccaggccgaccccaagagcggccagaagaagctgctgaagaaggccgccctcttcagcaagctgagccctgcccagctggccaggaaggcctttgtggagcaggtggaggcccagctgatggccaagcaccccctggccatgtaccccaacctgggggaggacatgcccccagacctgctgctgcaggtgctgaagcacctggaccctgagcgggagctggaggatgcctgggcctgctgtgagacccaggagaagaccacagaggtgcccacagagcccgggaagcacccctgtggggagttctgcctgaagcccccagagacccctgtgagccacctgctgcctgagcccccagagaccggggtgagccacctgagccctgagccccccaagacccctgtgagcagcctgcggcctgagcccccagagaccggggtgagccacctgcggcctgagcccccagagaccggggtgagccacatccggcccggcccccccatcacccggcggcgcagcagcctgctgcggcagctgctgaagctggacagcgagaggaagctggaggatgcccgggccccctgtgagggccgggagaagaccacagatgagcccacagagcccgggaagtacccctgtgggaagttctgcccccggccctttgagacccccctgagccacctgcggcaggagccccccaagacccctgtgagcagcctgcggcctgagcccccagagaccggggagagccacctgcggctggagcacagcaagacccggcggggcagcagcctgcggtctgagcccagcgagactggagtgtcccggctgcggctggccccacccaagacccggcggggcagcagcctgcatgctgagcccagcaagacaggagtgagccacctgagccctgagccccccaagacagaggtgagccacctgcaccctgtgccccccaagacaggagtgtgccacctgcggctggagcccccagacaccagccaggtgagcaacctgctgctgtacatcctgaaggtgctggacagcggccgcaccctgaaggatgtgtgggacagatgtgaggcccgggtgaagaagaccaaggagcccacagagccccacaagagcccctgtggggagccctgcctgcagcccccagagacccaggtgagccacccccaccctgagcaccccaagaccaggagaagaagcagcctgcacagccagccccccaagaccaggaggaccagcagcctgcggtctgagccccccaagaccaggaggaccagcagcctgcggtctgagccccccaagaccaggaggaccagcagcctgggccctgagccccccaagacccggcgggtgagcagcctgcggcctgagctgcccaagagcagaagagtgagcagcctgcaccctgagccccccaaggcccctgagagccaccagttcagcgagccccccaagatccgggccagctacatcaaggagctgctgcaggaggacacccccagcaccaaggaatgtgtgtctgacagcctgcagtaccgctacaccagcgagaagctgcgggagttcttcaagtgggccggggacctgggcgcagatgaggagagcatccggaacctgtttgacttcacccccaagtaccgggccacccatgaggaccagaagttcaagaaggtgaaggaatgtagcagcgagctgaagtacagcatggagctggatgagaaggatgaggacaagttcttcagccaggagaagtactggggcaggaagttccacacccccagcaacagctacacagcccagagggtgaagatgaagtatggagcctggtacctgaagcccaagctgtggaagaagctgcggagtgatgagcccctgattgaccccaagctgctgctgaagaagccagatgagccagatgtgctggatgacctgtatggccccatcgccttcaaggacttcatcctgagcaagggctatgagatgcctggcatcatccagaggctgtttgcccggcggggctggacctatgattctgtgaagacccccatccagagggccatgatcttctacaagtacaaggagatcgtggaggccagcgaggaggactag

SEQ ID NO: 38696 - DNA, 1938 bp, Artificial Sequence
  Description of Artificial Sequence: Synthetic coding sequence
atgggagaccggcggccccaggaccggcccaggagccagggcatggacagcaagccctggtactgtgacaagccacccagcaagtactttgccaagaggaagcaccggcggctgcgcttcccccctgtggacacccagaactgggtgtttgtgacagagggcatggatgacttccgctatgcctgccagagccctgaggacaccctggtgtgcagaagagatgagttcctgctgcccaagatcagcctgcggggcccccaggccgacaggaagagcaggaagaagaagctgctgaagaaggccgccctcttcagcgagctgagccctgtgcagcctgccaggaaggcctttgtggaggaggtggaggcccagctgatgaccaagcaccccctggccatgtaccccaacctgggcaaggacatgcccccagacctgctgctgcaggtgctgaagcagctggaccctgagaggaagctggaggatgcctgggcccgctgtgaggcccgggagaagaccacagaggtgcccacagaaagtggcaagtacccctgtggggagagctgccccaggcctcctgagacccctgtgtcccggctgcggccccagctgcccaagacccctgtgagcagcagaagacctgagccccccaagaccagggtgagcagcctgcggcctgagccccccaagaccagggtgagcagcctgcaccctgagcccccagagacccgggccagccacctgcgggtggaccccccagagaccggggtgagccacctgtgcccagagccccccaagaccctggtgtcctctgtgcaccctgagcccccagacaccggggccagccacctgtgcccagagcccccagagaccagggtgagccacctgcaccctgagcccccagagaccggggtgagccacctgcggcctgagcccagcaagacccaggtgagcagcctgtgcccagagcccccagaggccggcgtgagccacctgtgcctggagccccccaacacccaccgggtgtcctccttcctgctgcaggtgctgaagctggacagcgagaagaagctggaggatgcccgggcccgctgtgagggccaggagatgaccacagaggagctgaccaagccaggcaagtaccacttctgggagagctgcccccggccctttgagagcaggatgccccacctgcggctggtgctgcccatcaccaggaggatggccagcctgtgcctgaagccacccaagacccggcgggtgagcagcctgtgcccagagcccaccaagacaggagccagccacctgaaggagctgttccaggaggacacccccagcaccatggagtgtgtgtctgacagcctgcagaggaggcacaccagcaggaagctgcgggacttcaagtgggccggggacctgggcgtgaatgaggagagcatcagcagcctgtttgacttcaccccagagtgcaggaccacagaccaggaccagaagatcaagaaggccaatgaatgtgccagccggctgatgtatggcatggagctggatgacatggatgaggtggagttcctgcgcatcaagtactgggacagaagaagaagagctgccccccacagctacagcgcccagaggggccgcatccgctatggcccctggtactttgagcccaagctgggcaagaagctgcggagtgatgagcccctgattgaccccaagcctgtgctggagaagccagatgagccagacatcctggatggcctgtatggccccatcgccttcaaggacttcatcctgagcaagggctacaggatgcctggggtgattgagaagctgtttgccaagaagggctggacctatgacagcgtgaagacccccatccagagagctgtgcaggtgtacaagtacaaggaggatgtgacagatgccagcaaggaggactag

SEQ ID NO: 38697 - DNA, 3108 bp, Artificial Sequence
  Description of Artificial Sequence: Synthetic coding sequence
atgggagaccagaggccccaggaccggcccagcagccctggcatggacagcaccccctggtactgtgacaagccacccagcaagtactttgccaagaggaagcaccggcggctgcgcttcccccctgtggacacccagaactgggtgtttgtgacagagggcatggatgacttccgctatggctgccagagccctgaggacaccctggtgtgcagaagagatgagttcctgctgcccaagatcagcctgcggggcccccaggccgaccccaagagcaggaagaagaagctgctgaagaaggccgccctcttcagcaagctgagccctgcccagcctgccaggaaggcctttgtggaggaggtggaggcccagctgatgaccaagcaccccctggccatgtaccccaacctgggggaggacatgcccccagacctgctgctgcaggtgctgaagcccctggaccctgagaggaagctggaggatgctggcagctgtgagggccaggagaagaccacagatgagcccacagagcccgggaagtacccctgtggggagttcagcccccggcccccagagaccagggtgtcctgcctgcccccagagccccccaagacccctgtgagcagcctgcggcctgagcccccagagactggagtgagccacctgcggccccagccccccaagacccaggtgagcagcctgcacctggagcccccagagactggagtgagccacctgcggcctgagccccccaagacccaggtgagcagcctgcacctggagcccccagagactggagtgagccacctgtacctggagcccccaggcactggagtgagccacctgtgcccagagccccccaagaccagggtgagccacctgcaccgggagcccccagagactggagtgcctgacctgtgcctggagccccccaagagccgggtgagccacctgcggcctgagcccagcgagactggagtgagccacctgcaccctgagccccccaagaccctggtgagcagcctgcaccctgagcccccagagactggagtgagccacctgtgcccagagcccccagagaccagggtgagccccctgcggcagctgcccccagaggccggcgtgagccacctgtgcccagagccccccaagaccagggtgccccccctgcggcctgagacccccaagaatggagtgagccccctcttccctgagccccccaagacccgcatcagcaacctgcggtctgagccccccaagattggagtgagccacctgtgcctggagccccccaagacccggggcagccacctgcggcctgagcccccagagactggagtgagccacctgcggcctgagccccccaagaccagggtgagcagcctgcacctggagcccccagagactggagtgagccacctgtgcccagagcccccagagaaggatgtgagccacctgcggcctgagcccccagacacaggagtgagccacctgtgcccagagccccccaagaccagggtgagccacctgcggcctgagcccagcgagactggagtgagccacctgcggcctgagccccccaagatcctggtgagcagcctgcaccaggcccctcctgagagctctgtgagccacctgcggcctgagcccccagagactggagtgagccacctgcggcctgagccccccaagaccaggatgtacagcctgcggcctgagcccccagacacaggagtgagccacctgtgcccagagccccccaagaccagggtgagcagcctgcccccagagcccccagagactggagtgagccacctgtgcccagagcccccagagaccagggtgagccacctgcggcctgagcccccagagactggagtgagccacctgcggcctgagccccccaagaccaggatgtacagcctgcggcctgagccccccaacacaggagtgagccacctgtgcccagagccccccaagaccagggtgagcagcctgcccccagagcccccagagactggagtgagccacctgtgcccagagcccccagagaccagggtgagccacctgcggcctgagcccccagagactggagtgtcccggctgcaccctgagccccccaagaccagggtgagcagcctgcacgccgagcccccagagagccgggtgagccacctgtgcccagagcccccagagactggagtgagccacctgcggcctgagccccccaagccccgggtgagcagcctgcggcctgagcccctggagaccagggtgagccacctgcggcctgagcccccagagactggagtgagccacctgcaccctgagctgcccaagccccgggtgagcagcctgcacctggagccccccaagacccggcgggtgagcagcctgcggctggagccccccaagacaggccgggtgagcagcctgtgcccagagcccaccaagacaggagccagccacctgaaggagctgttccaggagggcaccagcagcaccatggagtgtgtgtctgacagcctgcagaggaggcacaccagcaggaagctgcgggacttcaagtgggccggggacctgggcgtgaatgaggagagcatcagcagcctgtttgacttcaccccagaatgtcgggccacctaccaggaccagaagaacaagaaggccaatgaatgttcttctggcctgaagtacagcatggagctggatgagatggatgaggtgaagttcttcagccaggagaaggacctggatggcaagatccagaatgcccccaacagccacagcgcccagcacgtgaagatgggctacggggcctggtacctgaagcccaagctgggcaagaagctgcggagtgatgagcccctgattgaccccaagctggtgctggagaagccagatgagccagacatcctggatggcctgtatggccccatcgccttcaaggacttcatcctgagcaagggctatgagatgcctggcatcatccagaggctgtttgcccggcggggctggacctatgacagcgtgaagacccccatccagagggccatgcaggtgtacaagtacaaggaggatgtgacagatgccagcgaggaggactag

SEQ ID NO: 38698 - DNA, 888 bp, Artificial Sequence; identical to SEQ ID NO: 38693
  Description of Artificial Sequence: Synthetic coding sequence

SEQ ID NO: 38699 - DNA, 1182 bp, Artificial Sequence
  Description of Artificial Sequence: Synthetic coding sequence
atggctgacagaagaagaaggctgcggcccggcaccctggcccctgtgcgggagggcgtgaactgccgcagccgctgcttcaccaagcacaagaatggcctgaagttccccaccagcctgcacagccggcagctggtgttccccaggaagggcctggatgacttcaggaagggctgccccccctgcaccggcctggtgacccaggtgcctgtggagggcttcctgccccagatctaccaccgggccccccagctggcccccaagaagaggcagatcaagctgctgaaggaggctgatgtgctgagcaagctgagccctgcccagcaggccaggaaggccttcctggaggatgtggaggcccacctgaccccccaccccctggccctgtacctgaacctggaggaggccatgcccatcgagctgctgagcaaggtgctggaggtgctggaccctgacaggaagctggaggacacctgggcctactgccaggacaccaggaagggcatgaaggagcccaccaagctgctgaagaagcacagcacccaggtgtacctgggccccagcaagaagacctctgtgtccaatgccggccagtggctgtatgaggagaagccccacaagatggacctgctgcatgaaaatggcccccggcccggcctgcatgaaaatggcatcagtgacattgatgaggagttcatcctgaagcagtttgatattgattatgagaccaagcccagccatgatgccctgcacaccatgaagctgaaccaggtgcccctggagctgaagaggtctgtgggcctgagcaagctgcaggagacagagttcttccagaagctgggctatgaaaggaagctgcagaagccccagaacccctacaagcccaagtgggtgaagatgagatatggagcctggtacctgaaccccaagctgtggaagaagcagagggtggatgagcccctggtggaccctgaggtgagccacaaggcccaggaggagaacttcaagaaggagctgcaggagcaggaggagctgctggccgacctgcacggcaccgtggccttcaaggacttcatcctgagccggggctaccgcaccccccgcttcctggagaacatgtacatcggcaaggagtgcaagagggcctgcaacaagacccccatcaagaggacccaggcctag

SEQ ID NO: 38700 - DNA, 972 bp, Artificial Sequence
  Description of Artificial Sequence: Synthetic coding sequence
atgggcaacctgctgaaggtgctgacccgggagattgagaactacccccacttcttcctggactttgaaaatgcccagcccacagaaggagagcgggagatctggaaccagatctctgctgtgctgcaggacagcgagagcatcctggccgacctgcaggcctacaagggggccggccctgagatcagagatgccatccagaaccccaatgacatccagctgcaggagaaggcctggaatgctgtgtgccccctggtggtgcggctgaagcgcttctatgagttcagcatccggctggagaaggccctgcagagcctgctggagagcctgacctgccccccctacacccccacccagcacctggagcgggagcaggccctggccaaggagtttgctgagatcctgcacttcaccctgcgctttgatgagctgaagatgagaaatcctgccatccagaatgacttctcctactacagaaggaccatcagcaggaaccgcatcaacaacatgcacctggacattgaaaatgaggtgaacaatgagatggccaacaggatgagcctcttctatgcagaggccacccccatgctgaagaccctgagcaatgccaccatgcactttgtgtctgagaacaagaccctgcccatcgagaacaccacagactgcctgagcaccatgacctctgtgtgcaaggtgatgctggagaccccagagtaccgcagccgcttcaccagcgaggagaccctgatgttctgcatgagggtgatggtgggcgtcatcatcctgtatgaccacgtgcaccctgtgggcgccttctgcaagaccagcaagattgacatgaagggctgcatcaaggtgctgaaggagcaggccccagacagcgtggagggcctgctgaatgccctgcgcttcaccaccaagcacctgaatgatgagagcaccagcaagcagatccgggccatgctgcagtag

SEQ ID NO: 38701 - DNA, 972 bp, Artificial Sequence; identical to SEQ ID NO: 38700
  Description of Artificial Sequence: Synthetic coding sequence

SEQ ID NO: 38702 - DNA, 972 bp, Artificial Sequence; identical to SEQ ID NO: 38700
  Description of Artificial Sequence: Synthetic coding sequence

SEQ ID NO: 38703 - DNA, 285 bp, Artificial Sequence
  Description of Artificial Sequence: Synthetic coding sequence
atgggcaacctgctgaaggtgctgacccgggagattgagaactacccccacttcttcctggactttgaaaatgcccagcccacagaaggagagcgggagatctggaaccagatctctgctgtgctgcaggacagcgagagcatcctggccgacctgcaggcctacaagggggccggccctgagatcagagatgccatccagaaccccaatgacatccagctgcaggagaaggcctggaatgctgtgtgccccctggtggtgcggctgaagcgcttctatgaatag

SEQ ID NO: 38704 - DNA, 264 bp, Artificial Sequence
  Description of Artificial Sequence: Synthetic coding sequence
atgggcaacctgctgaaggtgctgacccgggagattgagaactacccccacttcttcctggactttgaaaatgcccagcccacagaaggagagcgggagatctggaaccagatctctgctgtgctgcaggacagcgagagcatcctggccgacctgcaggcctacaagggggccggccctgagatcagagatgccatccagaaccccaatgacatccagctgcaggagaaggcctggaatgctgtgtgccccctggtggtgtag

SEQ ID NO: 38705 - DNA, 654 bp, Artificial Sequence
  Description of Artificial Sequence: Synthetic coding sequence
atgcagaaggcctcctggaggacctgcagccacacagaggagctggccaccaagtatgagcgggccatccagcacccagcagatgagaagctgcaggagaaggcctggggcgctgtggtgcccctggtgggcaaggagatcctgcgcatcttcagcgaggtgcgcagcagcatcaagaggagcagcggcagcctgaacaagtaccccatcttcagccacccagccagccgggcccggcaggccctggccaagcagtttgctgagatcctgcacttcaccctgcgctttgatgagctgaagatgaccaacccagccatccagaatgacttctcctactacagaaggaccctgagcaggatgaggatcaccatgtacagagctgagggggagaatgaggtgaacaatgagctggccaacaggatgagcctcttctacgccgaggccacccccatgctgaagaccctgagtgatgccaccaccaagtttgtgtctgagaacaagaacctgcccatcgagaacaccacagactgcctgagcaccatggcctctgtgtgccgggtgatgctggagaccccagagtaccgcagccgcttcaccaatgaggagaccgtgtccttcctggagggcaatggaggctgccacaacaccctgtag

SEQ ID NO: 38706 - DNA, 975 bp, Artificial Sequence
  Description of Artificial Sequence: Synthetic coding sequence
atgggcaacctgctgaaggtgctgacctgcacagacctggagcagggccccaacttcttcctggactttgaaaatgcccagcccacagaaagtgagaaggagatctacaaccaggtgaatgtggtgctgaaggatgctgagggcatcctggaggacctgcagagctacagaggagctggccacgagatccgggaggccatccagcacccagcagatgagaagctgcaggagaaggcctggggcgctgtggtgcccctggtgggcaagctgaagaagttctatgagttcagccagaggctggaggccgccctgcggggcctgctgggcgccctgaccagcaccccctacagccccacccagcacctggagcgggagcaggccctggccaagcagtttgctgagatcctgcacttcaccctgcgctttgatgagctgaagatgaccaacccagccatccagaatgacttctcctactacagaaggaccctgagcaggatgaggatcaacaacgtgcctgctgagggggagaatgaggtgaacaatgagctggccaacaggatgagcctcttctacgccgaggccacccccatgctgaagaccctgagtgatgccaccaccaagtttgtgtctgagaacaagaacctgcccatcgagaacaccacagactgcctgagcaccatggcctctgtgtgccgggtgatgctggagaccccagagtaccgcagccgcttcaccaatgaggagaccgtgtccttctgcctgcgggtgatggtgggcgtcatcatcctgtatgaccacgtgcaccctgtgggcgcctttgccaagaccagcaagattgacatgaagggctgcatcaaggtgctgaaggaccagccccccaacagcgtggagggcctgctgaatgccctgcgctacaccaccaagcacctgaatgatgagaccaccagcaagcagatcaagtccatgctgcagtag

SEQ ID NO: 38707 - DNA, 975 bp, Artificial Sequence; identical to SEQ ID NO: 38706
  Description of Artificial Sequence: Synthetic coding sequence

SEQ ID NO: 38708 - DNA, 192 bp, Artificial Sequence
  Description of Artificial Sequence: Synthetic coding sequence
atgggcaacctgctgaaggtgctgacctgcacagacctggagcagggccccaacttcttcctggactttgaaaatgcccagcccacagaaagtgagaaggagatctacaaccaggtgaatgtggtgctgaaggatgctgagggcatcctggaggacctgcagagctacagaggagctggccacgagatctag

SEQ ID NO: 38709 - DNA, 198 bp, Artificial Sequence
  Description of Artificial Sequence: Synthetic coding sequence
atgggcaacctgctgaaggtgctgacctgcacagacctggagcagggccccaacttcttcctggactttgaaaatgcccagcccacagaaagtgagaaggagatctacaaccaggtgaatgtggtgctgaaggatgctgagggcatcctggaggacctgcagagctacagaggagctggccacgagatccgggagtag

SEQ ID NO: 38710 - DNA, 297 bp, Artificial Sequence
  Description of Artificial Sequence: Synthetic coding sequence
atgggcaacctgctgaaggtgctgacctgcacagacctggagcagggccccaacttcttcctggactttgaaaatgcccagcccacagaaagtgagaaggagatctacaaccaggtgaatgtggtgctgaaggatgctgagggcatcctggaggacctgcagagctacagaggagctggccacgagatccgggaggccatccagcacccagcagatgagaagctgcaggagaaggcctggggcgctgtggtgcccctggtgggcaagctgaagaagttctatgagttcagccagtag

SEQ ID NO: 38711 - DNA, 207 bp, Artificial Sequence
  Description of Artificial Sequence: Synthetic coding sequence
atgggcaacctgctgaaggtgctgacctgcacagacctggagcagggccccaacttcttcctggactttgaaaatgcccagcccacagaaagtgagaaggagatctacaaccaggtgaatgtggtgctgaaggatgctgagggcatcctggaggacctgcagagctacagaggagctggccacgagatccgggaggccatccagtag

SEQ ID NO: 38712 - DNA, 147 bp, Artificial Sequence
  Description of Artificial Sequence: Synthetic coding sequence
atgggcaacctgctgaaggtgctgacctgcacagacctggagcagggccccaacttcttcctggactttgaaaatgcccagcccacagaaagtgagaaggagatctacaaccaggtgaatgtggtgctgaaggatgctgagggctag

SEQ ID NO: 38713 - DNA, 975 bp, Artificial Sequence; identical to SEQ ID NO: 38706
  Description of Artificial Sequence: Synthetic coding sequence

SEQ ID NO: 38714 - DNA, 468 bp, Artificial Sequence
  Description of Artificial Sequence: Synthetic coding sequence
atgggcaacctgctgaaggtgctgacctgcacagacctggagcagggccccaacttcttcctggactttgaaaatgcccagcccacagaaagtgagaaggagatctacaaccaggtgaatgtggtgctgaaggatgctgagggcatcctggaggacctgcagagctacagaggagctggccacgagatccgggaggccatccagcacccagcagatgagaagctgcaggagaaggcctggggcgctgtggtgcccctggtgggcaagctgaagaagttctatgagttcagccagaggctggaggccgccctgcggggcctgctgggcgccctgaccagcaccccctacagccccacccagcacctggagcgggagcaggccctggccaagcagtttgctgagatcctgcacttcaccctgcgctttgatgagctgaaggtggagctgagcattggaccagactgctag

SEQ ID NO: 38715 - DNA, 975 bp, Artificial Sequence; identical to SEQ ID NO: 38706
  Description of Artificial Sequence: Synthetic coding sequence

SEQ ID NO: 38716 - DNA, 975 bp, Artificial Sequence; identical to SEQ ID NO: 38706
  Description of Artificial Sequence: Synthetic coding sequence

SEQ ID NO: 38717 - DNA, 303 bp, Artificial Sequence
  Description of Artificial Sequence: Synthetic coding sequence
atgggcaacctgctgaaggtgctgacctgcacagacctggagcagggccccaacttcttcctggactttgaaaatgcccagcccacagaaagtgagaaggagatctacaaccaggtgaatgtggtgctgaaggatgctgagggcatcctggaggacctgcagagctacagaggagctggccacgagatccgggaggccatccagcacccagcagatgagaagctgcaggagaaggcctggggcgctgtggtgcccctggtgggcaagctgaagaagttctatgagttcagccagaggctgtag

SEQ ID NO: 38718 - DNA, 240 bp, Artificial Sequence
  Description of Artificial Sequence: Synthetic coding sequence
atgggcaacctgctgaaggtgctgacctgcacagacctggagcagggccccaacttcttcctggactttgaaaatgcccagcccacagaaagtgagaaggagatctacaaccaggtgaatgtggtgctgaaggatgctgagggcatcctggaggacctgcagagctacagaggagctggccacgagatccgggaggccatccagcacccagcagatgagaagctgcaggagaaggcctag

SEQ ID NO: 38719 - DNA, 141 bp, Artificial Sequence
  Description of Artificial Sequence: Synthetic coding sequence
atgggcaacctgctgaaggtgctgacctgcacagacctggagcagggccccaacttcttcctggactttgaaaatgcccagcccacagaaagtgagaaggagatctacaaccaggtgaatgtggtgctgaaggatgcctag

SEQ ID NO: 38720 - DNA, 975 bp, Artificial Sequence; identical to SEQ ID NO: 38706
  Description of Artificial Sequence: Synthetic coding sequence

SEQ ID NO: 38721 - DNA, 975 bp, Artificial Sequence; identical to SEQ ID NO: 38706
  Description of Artificial Sequence: Synthetic coding sequence

SEQ ID NO: 38722 - DNA, 282 bp, Artificial Sequence
  Description of Artificial Sequence: Synthetic coding sequence
atgggcaacctgctgaaggtgctgacctgcacagacctggagcagggccccaacttcttcctggactttgaaaatgcccagcccacagaaagtgagaaggagatctacaaccaggtgaatgtggtgctgaaggatgctgagggcatcctggaggacctgcagagctacagaggagctggccacgagatccgggaggccatccagcacccagcagatgagaagctgcaggagaaggcctggggcgctgtggtgcccctggtgggcaagctgaagaagttctag

SEQ ID NO: 38723 - DNA, 978 bp, Artificial Sequence
  Description of Artificial Sequence: Synthetic coding sequence
atggcccagtacaagggcaccatgagggaggccggccgggccatgcacctgctgaagaagcgggagcggcagcgggagcagatggaggtgctgaagcagagaattgctgaggagaccatcctgaagagccaggtggacaagcgcttcagcgcccactatgatgctgtggaggccgagctgaagagcagcacagtgggcctggtgaccctgaatgacatgaaggcccggcaggaggccctggtgcgggagcgggagcggcagctggccaagaggcagcacctggaggagcagaggctgcagcaggagcggcagcgggagcaggagcagaggcgggagaggaagaggaagatcagctgcctgagctttgccctggatgacctggatgaccaggctgatgctgctgaggccaggagagctggcaacctgggcaagaacccagatgtggacaccagcttcctgcctgaccgggaccgggaggaggaggagaaccggctgcgggaggagctgcggcaggagtgggaggcccagcgggagaaggtgaaggatgaggagatggaggtgaccttctcctactgggatggcagcggccacagaagaacagtgcgggtgaggaaaggaaacacagtgcagcagttcctgaagaaggccctgcagggcctgaggaaggacttcctggagctgcggtctgctggggtggagcagctgatgttcatcaaggaggacctgatcctgccccactaccacaccttctatgacttcatcatcgcccgggcccggggcaagagcggccccctcttctcctttgatgtgcatgatgatgtgcggctgctgagtgatgccaccatggagaaggatgagagccatgctgggaaggtggtgctgcgctcctggtatgagaagaacaagcacatcttccctgccagccgctgggaggcctatgaccctgagaagaagtgggacaagtacaccatcagatag

SEQ ID NO: 38724 - DNA, 978 bp, Artificial Sequence; identical to SEQ ID NO: 38723
  Description of Artificial Sequence: Synthetic coding sequence

SEQ ID NO: 38725 - DNA, 1269 bp, Artificial Sequence
  Description of Artificial Sequence: Synthetic coding sequence
atggtgatggtgctgtctgagagcctgagcaccagaggagctgacagcatcgcctgtggcaccttcagccgggagctgcacacccccaagaagatgagccagggccccaccctcttcagctgtggcatcatggagaatgaccgctggagggacctggacagaaaatgtcccctgcagattgaccagcccagcaccagcatctgggagtgcctgcctgagaaggacagcagcctgtggcaccgggaggccgtgacagcctgtgctgtgaccagcctcatcaaggacctgagcatcagtgaccacaacggcaaccccagcgccccacccagcaagaggcagtgccgcagcctgtccttcagtgatgagatgagcagctgcaggacctcctggaggcccctgggcagcaaggtgtggacccctgtggagaagaggcgctgctacagcggcggctctgtgcagcgctacagcaatggcttcagcaccatgcagaggagcagcagcttcagcctgcccagccgggccaacgtgctgagcagcccctgtgaccaggccggcctgcaccacagatttggaggccagccctgccagggcgtgcccggcagcgccccctgtggccaggccggggacacctggagcccagacctgcaccctgtgggcggcggccgcctggacctgcagaggagcctgagctgcagccatgagcagttctcctttgtggagtactgccccccatctgccaacagcaccccagccagcaccccagagctggcccggcgcagcagcggcctgagccgcagccgcagccagccctgtgtgctgaatgacaagaaggtgggcgtgaagagaagaagacctgaggaggtgcaggagcagaggcccagcctggacctggccaagatggcccagaactgccagaccttcagcagcctgagctgcctgtctgctggaacagaggactgtggcccccagagcccctttgcccggcacgtgagcaacacccgggcctggacagccctgctgagcgccagcggccctgggggccgcaccccagctggcacccctgtgcctgagcccctgccccccagctttgatgaccacctggcctgccaggaggacctgagctgtgaggagagtgacagctgtgccctggatgaggactgtggcagaagagctgagcctgctgctgcctggagggacagaggagcccctggcaacagcctgtgcagcctggatggagagctggacatcgagcagatcgagaagaactag

SEQ ID NO: 38726 - DNA, 1269 bp, Artificial Sequence; identical to SEQ ID NO: 38725
  Description of Artificial Sequence: Synthetic coding sequence

SEQ ID NO: 38727 - DNA, 1179 bp, Artificial Sequence
  Description of Artificial Sequence: Synthetic coding sequence
atgatcaccctcatcacagagcagctgcagaagcagaccctggatgagctgaagtgcacccgcttcagcatcagcctgcccctgcctgaccacgccgacatcagcaactgtggcaacagcttccagctggtgtctgagggcgcctcctggaggggcctgccccactgcagctgtgccgagttccaggacagcctgaacttctcctaccaccccagcggcctgagcctgcacctgcggccccccagccggggcaacagccccaaggagcagcccttcagccaggtgctgcggcctgagcccccagaccctgagaagctgcctgtgcccccagccccacccagcaagaggcactgccgcagcctgtctgtgcctgtggacctgagccgctggcagcctgtgtggaggcctgcccccagcaagctgtggacccccatcaagcaccggggcagcggcggcggcggcggcccccaggtgccccaccagagcccccccaagagggtgagcagcctgcgcttcctgcaggcccccagcgccagcagccagtgtgccccagcccaccggccctacagcccccccttcttcagcctggccctggcccaggacagcagccggccctgtgccgccagcccccagagcggctcctgggagagtgatgctgagagcctgagcccctgccccccccagaggcgcttcagcctgagccccagcctgggcccccaggccagccgcttcctgcccagcgcccggagcagccctgccagcagccctgagctgccctggaggccccggggcctgaggaacctgcccaggagccgcagccagccctgtgacctggatgccaggaagacaggagtgaagagaagacatgaggaggacccccggcggctgcggcccagcctggactttgacaagatgaaccagaagccctacagcggcggcctgtgcctgcaggagacagcccgggagggcagcagcatcagccccccctggttcatggcctgcagccccccacccctgagcgccagctgcagccccaccggcggcagcagccaggtgctgtctgagagcgaggaggaggaggagggcgctgtgcgctggggccggcaggccctgagcaagaggaccctgtgccagagggactttggagacctggacctgaacctgattgaagaaaattag

SEQ ID NO: 38728 - DNA, 1179 bp, Artificial Sequence; identical to SEQ ID NO: 38727
  Description of Artificial Sequence: Synthetic coding sequence

SEQ ID NO: 38729 - DNA, 1158 bp, Artificial Sequence
  Description of Artificial Sequence: Synthetic coding sequence
atgagcctcatcctgaacatcctgcgggagatgctggagtactttggagtgcctgtggagcaggtgctgctgatctgggagaacaaggactatggcagcaccaggagcatcgtgcgcatcatcggcaagatgctgcccctggagccctgcagaagacccaactttgagctgatccccctgctgaacagcgtggacagcgacaactgtggctccatggtgcccagctttgctgacatcctgtatgtggccaatgatgaggaggccagctacctgcgcttcaggaacagcatctggaagaatgaggaggagaaggtggagatcttccaccccctgcggctggtgcgggaccccctgagccctgctgtgcggcagaaggagaccgtgaagaatgacctgcctgtgaatgaagctgccatcaggaagattgctgccctggagaatgagctgaccttcctgcggagccagattgctgccatcgtggagatgcaggagctgaagaacagcaccaacagcagcagctttggcctgagtgatgagcgcatcagcctgggccagctgagcagcagcagagctgcccacctgtctgtggaccctgaccagctgcccggctctgtgctgagccccccacctcctccacccctgcccccccagttcagcagcctgcagcccccctgcttcccccctgtgcagcccggcagcaacaacatctgtgacagcgacaacccagccacagagatgagcaagcagaacccagctgccaacaagaccaactacagccaccacagcaagagccagaggaacaaggacatccccaacatgctggatgtgctgaaggacatgaacaaggtgaagctgcgggccatcgagaggagccctgggggccggcccatccacaagaggaagaggcagaacagccactgggaccctgtgtccctcatcagccacgccctgaagcagaagtttgccttccaggaggatgacagctttgagaaggagaacagatcctgggagagcagccccttcagcagccctgagaccagcagatttggccaccacatcagccagagcgagggccagaggaccaaggaggagatggtgaacaccaaggctgtggaccagggcatcagcaacaccagcctgctgaacagccgcatctag

SEQ ID NO: 38730 - DNA, 1158 bp, Artificial Sequence; identical to SEQ ID NO: 38729
  Description of Artificial Sequence: Synthetic coding sequence

SEQ ID NO: 38731 - DNA, 879 bp, Artificial Sequence
  Description of Artificial Sequence: Synthetic coding sequence
atgagcggcatggaggccaccgtgaccatccccatctggcagaacaagccccacggggccgcccggtctgtggtgcggcgcatcggcaccaacctgcccctgaagccctgtgcccgggccagctttgagaccctgcccaacatcagtgacctgtgcctgagagatgtgccccctgtgcccaccctggccgacatcgcctggattgctgctgatgaggaggagacctacgcccgggtgcggagtgacacccggcccctgcggcacacctggaagcccagccccctcatcgtgatgcagagaaatgcctctgtgcccaacctgcggggcagcgaggagcggctgctggccctgaagaagccagccctgcctgccctgagcaggaccacagagctgcaggatgagctgagccacctgcggagccagatcgccaagatcgtggccgcagatgctgccagcgccagcctgaccccagacttcctgagccctggcagcagcaatgtgagcagccccctgccctgcttcggcagcagcttccacagcaccaccagctttgtgatcagtgacatcacagaggagacagaggtggaggtgcctgagctgcccagcgtgcccctgctgtgcagcgccagccctgagtgctgcaagccagagcacaaggccgcctgcagcagcagtgaagaagatgactgtgtgtccctgagcaaggccagcagctttgctgacatgatgggcatcctgaaggacttccacaggatgaagcagagccaggacctgaacagaagcctgctgaaggaggaggaccctgctgtgctgatcagcgaggtgctgcggaggaagtttgccctgaaggaggaggacatcagcaggaagggcaactag

SEQ ID NO: 38732 - DNA, 879 bp, Artificial Sequence; identical to SEQ ID NO: 38731
  Description of Artificial Sequence: Synthetic coding sequence

SEQ ID NO: 38733 - DNA, 879 bp, Artificial Sequence; identical to SEQ ID NO: 38731
  Description of Artificial Sequence: Synthetic coding sequence

SEQ ID NO: 38734 - DNA, 843 bp, Artificial Sequence
  Description of Artificial Sequence: Synthetic coding sequence
atgagcggcatggaggccaccgtgaccatccccatctggcagaacaagccccacggggccgcccggtctgtggtgcggcgcatcggcaccaacctgcccctgaagccctgtgcccgggccagctttgagaccctgcccaacatcagtgacctgtgcctgagagatgtgccccctgtgcccaccctggccgacatcgcctggattgctgctgatgaggaggagacctacgcccgggtgcggagtgacacccggcccctgcggcacacctggaagcccagccccctcatcgtgatgcagagaaatgcctctgtgcccaacctgcggggcagcgaggagcggctgctggccctgaagaagccagccctgcctgccctgagcaggaccacagagctgcaggatgagctgagccacctgcggagccagatcgccaagatcgtggccgcagatgctggcagcagcaatgtgagcagccccctgccctgcttcggcagcagcttccacagcaccaccagctttgtgatcagtgacatcacagaggagacagaggtggaggtgcctgagctgcccagcgtgcccctgctgtgcagcgccagccctgagtgctgcaagccagagcacaaggccgcctgcagcagcagtgaagaagatgactgtgtgtccctgagcaaggccagcagctttgctgacatgatgggcatcctgaaggacttccacaggatgaagcagagccaggacctgaacagaagcctgctgaaggaggaggaccctgctgtgctgatcagcgaggtgctgcggaggaagtttgccctgaaggaggaggacatcagcaggaagggcaactag

SEQ ID NO: 38735 - DNA, 459 bp, Artificial Sequence
  Description of Artificial Sequence: Synthetic coding sequence
atgagcggcatggaggccaccgtgaccatccccatctggcagaacaagccccacggggccgcccggtctgtggtgcggcgcatcggcaccaacctgcccctgaagccctgtgcccgggccagctttgagaccctgcccaacatcagtgacctgtgcctgagagatgtgccccctgtgcccaccctggccgacatcgcctggattgctgctgatgaggaggagacctacgcccgggtgcggagtgacacccggcccctgcggcacacctggaagcccagccccctcatcgtgatgcagagaaatgcctctgtgcccaacctgcggggcagcgaggagcggctgctggccctgaagaagccagccctgcctgccctgagcaggaccacagagctgcaggatgagctgagccacctgcggagccagatcgccaagatcgtggccgcagatgctgccagctag

SEQ ID NO: 38736 - DNA, 618 bp, Artificial Sequence
  Description of Artificial Sequence: Synthetic coding sequence
atgagcggcatggaggccaccgtgaccatccccatctggcagaacaagccccacggggccgcccggtctgtggtgcggcgcatcggcaccaacctgcccctgaagccctgtgcccgggccagctttgagaccctgcccaacatcagtgacctgtgcctgagagatgtgccccctgtgcccaccctggccgacatcgcctggattgctgctgatgaggaggagacctacgcccgggtgcggagtgacacccggcccctgcggcacacctggaagcccagccccctcatcgtgatgcagagaaatgcctctgtgcccaacctgcggggcagcgaggagcggctgctggccctgaagaagccagccctgcctgccctgagcaggaccacagagctgcaggatgagctgagccacctgcggagccagatcgccaagatcgtggccgcagatgctgtgaccagcccccggcggcagcgctggaggagcctgtccttccaccagagcccctgctttgtgctgcctgccctgaatgtggccaaccagaacaccaagctgcctgctgtgcggctgaagaggatgacagccagcctgtgccccaggcctgctgccctgcagacctag

SEQ ID NO: 38737 - DNA, 618 bp, Artificial Sequence; identical to SEQ ID NO: 38736
  Description of Artificial Sequence: Synthetic coding sequence

SEQ ID NO: 38738 - DNA, 333 bp, Artificial Sequence
  Description of Artificial Sequence: Synthetic coding sequence
atgagcggcatggaggccaccgtgaccatccccatctggcagaacaagccccacggggccgcccggtctgtggtgcggcgcatcggcaccaacctgcccctgaagccctgtgcccgggccagctttgagaccctgcccaacatcagtgacctgtgcctgagagatgtgccccctgtgcccaccctggccgacatcgcctggattgctgctgatgaggaggagacctacgcccgggtgcggagtgacacccggcccctgcggcacacctggaagcccagccccctcatcgtgatgcagagaaatgcctctgtgcccaacctgcggggcagctag

SEQ ID NO: 38739 - DNA, 513 bp, Artificial Sequence
  Description of Artificial Sequence: Synthetic coding sequence
atgagcggcatggaggccaccgtgaccatccccatctggcagaacaagccccacggggccgcccggtctgtggtgcggcgcatcggcaccaacctgcccctgaagccctgtgcccgggccagctttgagaccctgcccaacatcagtgacctgtgcctgagagatgtgccccctgtgcccaccctggccgacatcgcctggattgctgctgatgaggaggagacctacgcccgggtgcggagtgacacccggcccctgcggcacacctggaagcccagccccctcatcgtgatgcagagaaatgcctctgtgcccaacctgcggggcagcgaggagcggctgctggccctgaagaagccagccctgcctgccctgagcaggaccacagagctgcaggatgagctgagccacctgcggagccagatcgccaagatcgtggccgcagatgctgccagcgccagcctgaccccagacttcctgagccctggcagcagcaatgtgagcagcccctag

SEQ ID NO: 38740 - DNA, 348 bp, Artificial Sequence
  Description of Artificial Sequence: Synthetic coding sequence
atgagcggcatggaggccaccgtgaccatccccatctggcagaacaagccccacggggccgcccggtctgtggtgcggcgcatcggcaccaacctgcccctgaagccctgtgcccgggccagctttgagaccctgcccaacatcagtgacctgtgcctgagagatgtgccccctgtgcccaccctggccgacatcgcctggattgctgctgatgaggaggagacctacgcccgggtgcggagtgacacccggcccctgcggcacacctggaagcccagccccctcatcgtgatgcagagaaatgcctctgtgcccaacctgcggggcagcgaggagcggctgctgtag

SEQ ID NO: 38741 - DNA, 1995 bp, Artificial Sequence
  Description of Artificial Sequence: Synthetic coding sequence
atgcacaggatgccagaccccgggaagttcaagctgctggagcaggccagagatgtgcgggagcctgtgcgctacttcagctctgtggaggaggtggccagcgtcttcccagaccgcatctttgtgatggaggccatcaccttctctgtgaaggtggtgtctggagagttctctgaagattctgaggtgtacaacttcaccctgcacgccggagatgagctgaccctgatgggccaggccgagatcctgtgtgccaagaccaccaaggagaggagccgcttcaccaccctgctgaggaagctgggccgggccggggccctggccggcgtgggcggcggcggccctgccagcgctggagctgctgggggcaccggcggcggcggggcccggcctgtgaagggcaagatgccctgcctgatctgcatgaaccacaggaccaatgaaagcctgagcctgcccttccagtgccagggccgcttcagcaccaggagccccctggagctgcagatgcaggagggggagcacacagtgcgggccatcatcgagcgggtgcggctgcctgtgaatgtgctggtgcccagccggccccccaggaacccctatgacctgcaccctgtgcgggagggccactgctacaagctggtgtccatcatcagcaagacagtggtgctgggcctggccctgcggcgggagggccctgcccccctgcacttcctgctgctgacagacacccccaggtttgccctgccccagggcctgctggccggggacccccgggtggagcggctggtgcgggacagcgccagctactgccgggagagatttgatcctgatgagtacagcacagctgtgcgggaggccccagctgagctggccgaggactgtgccagcccccggcgggcccggctgtgcctgcctgccccccgggcccctggcctggcccgggcccctggccccctggccccagccccagctggggagggggaccaggagtatgtgtccccagactgggccgccgcccctgagcctgctgcccccccagctgagatcccctatgaggagctgtgggcccaccagggccctgagggcctggtgcggcccccacctggcctggacctgatcagctttggagctgctggccccccaagaagagagcctgaggcccctcctcctcctgtgccccccaagtctgaggccgtgaaggaggagtgccgcctgctgaatgcccctcctgtgcccccccggggcggcaatggcagcggccgcctgagcagcagcccccctgtgcccccacgcttccccaagctgcagcctgtgcacagccccagcagcagcctgagctactacagcagcggcctgcaggatggagctggcagccgcagcggcagcggcagccccagcccagacacctacagcctgtactgctacccctgcacctggggagactgcaaggagcctgtgctggagccctttgacccctttgagctgggccagggcagcagccctgagcctgagctgctgcggagccaggagcccagggctgtgggcaccccaggccctggcccccggctgagccccctgggccccagcaaggcctttgagcctgagggcctggtgctgcaccaggtgcccacccccctgagccctgctgccctgcagggccctgaggccggcggggccctcttcctgacccagggccgcctggagggccccccagccagccccagagatggagccaccggcttcggcgtgagagatgccagctcctggcagcccccagctgacctgagcgccctgagcctggaggaggtgagccgcagcctgcgcttcatcggcctgtctgaagatgtggtgtccttctttgcccgggagagaattgatggcagcatctttgtgcagctgtctgaggacatcctggctgatgacttccacctgaccaagctgcaggtgaagaagatcatgcagttcatcaagggctggaggcccaagatctag

SEQ ID NO: 38742 - DNA, 2631 bp, Artificial Sequence
  Description of Artificial Sequence: Synthetic coding sequence
atggaccctgcccccagcctgggctgcagcctgaaggatgtgaagtggagctctgtggccgtgcccctggacctgctggtgtccacctaccgcctgccccagatcgcccggctggacaacggggagtgtgtggagggcctgagagaaaatgactacctgctgatccacagctgccggcagtggaccaccatcacagcccacagcctggaggagggccactacgtgattggccccaagattgagatccctgtgcactacgccggccagttcaagctgctggagcaggaccgggacatcaaggagcctgtgcagtacttcaacagcgtggaggaggtggccaaggccttccctgagcgggtgtatgtgatggaggacatcaccttcaacgtgaaggtggccagcggggagtgcaatgaagacacagaggtgtacaacatcaccctgtgcacaggagatgagctgaccctgatgggccaggccgagatcctgtatgccaagaccttcaaggagaagagccggctgaacaccatcttcaagaagattggcaagctgaacagcatcagcaagctgggcaagggcaagatgccctgcctgatctgcatgaaccacaggaccaatgaaagcatcagcctgcccttccagtgcaagggccgcttcagcaccaggagccccctggagctgcagatgcaggagggggagcacaccatcagaaatattgtggagaagacccggctgcctgtgaatgtgacagtgcccagccccccaccaagaaacccctatgacctgcacttcatccgggagggccaccgctacaagtttgtgaacatccagaccaagacagtggtggtgtgctgcgtgctgaggaacaacaagatcctgcccatgcacttccccctgcacctgactgtgcccaagttcagcctgcctgagcacctggtgaagggggagagctggccagagaccctggtgcaccactggctgggcatctgccaggagcagtttgatattgatgagtacagcagagctgtgagagatgtgaagacagactggaatgaggagtgcaagagccccaagaagggccgctgcagcggccacaaccacgtgcccaacagcctgtcctatgccagagatgagctgacccagagcttccaccggctgtctgtgtgtgtgtatggcaacaacctgcacggcaacagcgaggtgaacctgcacggctgccgggacctgggcggggactgggcccccttcccccatgacatcctgccctaccaggacagcggggacagcggcagtgactacctgtttcctgaggccagcgaggagagcgctggcatccctgggaagtctgagctgccctatgaggagctgtggctggaggagggcaagcccagccaccagcccctgaccaggagcctgtctgagaagaacagatgtgaccagttccggggctctgtgcgcagcaaatgtgccaccagccccctgcccatccctggcaccctgggcgctgctgtgaagagcagtgacacagccctgcccccacctcctgtgccccccaagtctgaggccgtgcgggaggagtgccgcctgctgaatgcccctcctgtgccccccaggtctgccaagcccctgagcaccagccccagcatcccccccaggacagtgaagccagcccggcagcagaccaggagccccagccccaccctgagctactacagcagcggcctgcacaacatctctgtgaccaagacagacaccaaccccagcgagagcacccctgtgtcctgctacccctgcaacagagtgaagacagattctgtggacctgaagagccccttcggcagccccagcgctgaggccgtgagcagccggctgtcctggcccaaccactacagcggggccagcgagagccagaccaggagtgacttcctgctggaccccagccgcagctacagctacccccggcagaagaccccaggcacccccaagaggaactgcccagccccctttgattttgatggctgtgagctgctggccagccccaccagccctgtgacagctgagttcagcagctctgtgtctggctgccccaagagcgccagctacagcctggagagcacagatgtgaagagcctggccgccggcgtgaccaagcagagcaccagctgcccagccctgcccccccgggcccccaagctggtggaggagaaggtggccagcgagaccagccccctgcccctgaagattgatggagctgaggaggaccccaagagcggcagcccagacctgtctgaggaccagtactttgtgaagaagggcatgcaggacatcttcagcgccagctaccccttcagcagccccctgcacctgcagctggcccccaggagctgtggagatggcagcccctggcagcccccagctgacctgagcggcctgagcattgaggaggtgtccaagagcctgcgcttcatcggcctgtctgaagatgtgatctccttctttgtgacagagaagattgatggcaacctgctggtgcagctgacagaggagatcctgtctgaggacttcaagctgagcaagctgcaggtgaagaagatcatgcagttcatcaatggctggaggcccaagatctag

SEQ ID NO: 38743 - DNA, 2628 bp, Artificial Sequence
  Description of Artificial Sequence: Synthetic coding sequence
atggaccctgcccccagcctgggctgcagcctgaaggatgtgaagtggagctctgtggccgtgcccctggacctgctggtgtccacctaccgcctgccccagatcgcccggctggacaacggggagtgtgtggagggcctgagagaaaatgactacctgctgatccacagctgccggcagtggaccaccatcacagcccacagcctggaggagggccactacgtgattggccccaagattgagatccctgtgcactacgccggccagttcaagctgctggagcaggaccgggacatcaaggagcctgtgcagtacttcaacagcgtggaggaggtggccaaggccttccctgagcgggtgtatgtgatggaggacatcaccttcaacgtgaaggtggccagcggggagtgcaatgaagacacagaggtgtacaacatcaccctgtgcacaggagatgagctgaccctgatgggccaggccgagatcctgtatgccaagaccttcaaggagaagagccggctgaacaccatcttcaagaagattggcaagctgaacagcatcagcaagctgggcaagggcaagatgccctgcctgatctgcatgaaccacaggaccaatgaaagcatcagcctgcccttccagtgcaagggccgcttcagcaccaggagccccctggagctgcagatgcaggagggggagcacaccatcagaaatattgtggagaagacccggctgcctgtgaatgtgacagtgcccagccccccaccaagaaacccctatgacctgcacttcatccgggagggccaccgctacaagtttgtgaacatccagaccaagacagtggtggtgtgctgcgtgctgaggaacaacaagatcctgcccatgcacttccccctgcacctgactgtgcccaagttcagcctgcctgagcacctggtgaagggggagagctggccagagaccctggtgcaccactggctgggcatctgccaggagcagtttgatattgatgagtacagcagagctgtgagagatgtgaagacagactggaatgaggagtgcaagagccccaagaagggccgctgcagcggccacaaccacgtgcccaacagcctgtcctatgccagagatgagctgacccagagcttccaccggctgtctgtgtgtgtgtatggcaacaacctgcacggcaacagcgaggtgaacctgcacggctgccgggacctgggcggggactgggcccccttcccccatgacatcctgccctaccaggacagcggggacagcggcagtgactacctgtttcctgaggccagcgaggagagcgctggcatccctgggaagtctgagctgccctatgaggagctgtggctggaggagggcaagcccagccaccagcccctgaccaggagcctgtctgagaagaacagatgtgaccagttccggggctctgtgcgcagcaaatgtgccaccagccccctgcccatccctggcaccctgggcgctgctgtgaagagcagtgacacagccctgcccccacctcctgtgccccccaagtctgaggccgtgcgggaggagtgccgcctgctgaatgcccctcctgtgccccccaggtctgccaagcccctgagcaccagccccagcatcccccccaggacagtgaagccagcccggcagcagaccaggagccccagccccaccctgagctactacagcagcggcctgcacaacatcgtgaccaagacagacaccaaccccagcgagagcacccctgtgtcctgctacccctgcaacagagtgaagacagacagcgtggacctgaagagccccttcggcagccccagcgctgaggccgtgagcagccggctgtcctggcccaaccactacagcggggccagcgagagccagaccaggagtgacttcctgctggaccccagccgcagctacagctacccccggcagaagaccccaggcacccccaagaggaactgcccagccccctttgattttgatggctgtgagctgctggccagccccaccagccctgtgacagctgagttcagcagctctgtgtctggctgccccaagagcgccagctacagcctggagagcacagatgtgaagagcctggccgccggcgtgaccaagcagagcaccagctgcccagccctgcccccccgggcccccaagctggtggaggagaaggtggccagcgagaccagccccctgcccctgaagattgatggagctgaggaggaccccaagagcggcagcccagacctgtctgaggaccagtactttgtgaagaagggcatgcaggacatcttcagcgccagctaccccttcagcagccccctgcacctgcagctggcccccaggagctgtggagatggcagcccctggcagcccccagctgacctgagcggcctgagcattgaggaggtgtccaagagcctgcgcttcatcggcctgtctgaagatgtgatctccttctttgtgacagagaagattgatggcaacctgctggtgcagctgacagaggagatcctgtctgaggacttcaagctgagcaagctgcaggtgaagaagatcatgcagttcatcaatggctggaggcccaagatctag

SEQ ID NO: 38744 - DNA, 2625 bp, Artificial Sequence
  Description of Artificial Sequence: Synthetic coding sequence
atggagaagctggccgccggcctggccggcctgcgctggagcatgggcgccttccccctggacctgattgtgagccgctgccgcctgcccaccctggcctgcctgggccctggagaatatgcagagggcgtgtctgagcgggacatcctgctgatccacagctgccggcagtggaccaccgtgacagcccacaccctggaggagggccactacgtgattggccccaagattgacatccccctgcagtacccaggcaagttcaagctgctggagcaggccagagatgtgcgggagcctgtgcgctacttcagctctgtggaggaggtggcctctgtgtttcctgaccgcatctttgtgatggaggccatcaccttctctgtgaaggtggtgtctggagagttcagcgaggacagcgaggtgtacaacttcaccctgcatgctggagatgagctgaccctgatgggccaggccgagatcctgtgtgccaagaccaccaaggagaggagccgcttcaccaccctgctgaggaagctgggccgggccggggccctggccggcgtgggcggcggcggccctgccagcgctggagctgctgggggcactggaggcggcggggcccggcctgtgaagggcaagatgccctgcctgatctgcatgaaccacaggaccaatgaaagcctgagcctgcccttccagtgccagggccgcttcagcaccaggagccccctggagctgcagatgcaggagggggagcacacagtgcgggccatcatcgagcgggtgcggctgcctgtgaatgtgctggtgcccagccggcccccaagaaacccctatgacctgcaccctgtgcgggagggccactgctacaagctggtgtccatcatcagcaagacagtggtgctgggcctggccctgcggcgggagggccctgcccccctgcacttcctgctgctgacagacacccccaggtttgccctgccccagggcctgctggccggggacccccgggtggagcggctggtgcgggacagcgccagctactgccgggagagatttgatcctgatgagtacagcacagctgtgcgggaggccccagctgagctggccgaggactgtgccagcccccggcgggcccggctgtgcctgcctgccccccgggcccctggcctggcccgggcccctggccccctggccccagccccagctggggagggggaccaggagtatgtgtccccagactgggccgccgcccctgagcctgctgcccctcctgctgagatcccctatgaggagctgtgggcccaccagggccctgagggcctggtgcggcccccacctggcctggacctgatcagctttggagctgctggccccccccggcgggagcctgaggcccctcctcctcctgtgccccccaagtctgaggccgtgaaggaggagtgccgcctgctgaatgcccctcctgtgcccccccggggcggcaatggaagtggccgcctgagcagcagcccccctgtgcccccacgcttccccaagctgcagcctgtgcacagccccagcagcagcctgagctactacagcagcggcctgcaggatggagctggcagccgcagcggcagcggcagccccagcccagacacctacagcctgtactgctacccctgcacctggggagactgcaaggtgggggagagcagcagcaggcctgcccctggccccctgcccagcaccacccagcccagccaggccagccgggccctgacagagcccctgagcggccgggccgccagcctgctgggcgctgacacccctgtgaagacctaccacagctgccccccactcttcaagcccagccacccccagaagagatttgccccctttggagccctgaaccccttcagcggccctgcctaccccagcggccccagcgctgccctgagcagcggccccaggaccaccagcggccctgtggccaccagcggccctgcctacagccctggccctgccagccctggccaggcctacagcgctgccccacccagcagctgtgcccccagcagcagcagcagcagcgagtggcaggagcctgtgctggagccctttgacccctttgagctgggccagggcagcagccctgagcctgagctgctgcggagccaggagcccagggctgtgggcaccccaggccctggcccccggctgagccccctgggccccagcaaggcctttgagcctgagggcctggtgctgcaccaggtgcccacccccctgagccctgctgccctgcagggccctgaggccggcggggccctcttcctgacccagggccgcctggagggccccccagccagccccagagatggagccaccggcttcggcgtgagagatgccagctcctggcagcccccagctgacctgagcgccctgagcctggaggaggtgagccgcagcctgcgcttcatcggcctgtctgaagatgtggtgtccttctttgcccgggagagaattgatggcagcatctttgtgcagctgtctgaggacatcctggctgatgacttccacctgaccaagctgcaggtgaagaagatcatgcagttcatcaagggctggaggcccaagatctag

SEQ ID NO: 38745 - DNA, 666 bp, Artificial Sequence
  Description of Artificial Sequence: Synthetic coding sequence
atgtttggcttccacaagcccaagatgtaccgcagcattgagggctgctgcatctgccgggccaagagcagcagcagccgcttcacagacagcaagagatatgagaaggacttccagagctgcttcggcctgcacgagaccaggtctggggacatctgcaatgcctgtgtgctgctggtgaagcgctggaagaagctgcctgctggcagcaagaagaactggaaccacgtggtggatgcccgggccggccccagcctgaagaccaccctgaagcccaagaaggtgaagaccctgagcggcaaccgcatcaagagcaaccagatcagcaagctgcagaaggagttcaagaggcacaacagtgatgcccacagcaccaccagcagcgccagccctgcccagagcccctgctacagcaaccagagtgatgatggcagtgacacagagatggccagcggcagcaacagaacacctgtgttctccttcctggacctgacctactggaagaggcagaagatctgctgcggcatcatctacaagggccgctttggagaggtgctgattgacacccacctgttcaagccctgctgcagcaacaagaaggctgctgctgagaagccagaggagcagggccctgagcccctgcccatcagcacccaggagtggtag

SEQ ID NO: 38746 - DNA, 222 bp, Artificial Sequence
  Description of Artificial Sequence: Synthetic coding sequence
atggccagcggcagcaacagaacacctgtgttctccttcctggacctgacctactggaagaggcagaagatctgctgcggcatcatctacaagggccgctttggagaggtgctgattgacacccacctgttcaagccctgctgcagcaacaagaaggctgctgctgagaagccagaggagcagggccctgagcccctgcccatcagcacccaggagtggtag

SEQ ID NO: 38747 - DNA, 789 bp, Artificial Sequence
  Description of Artificial Sequence: Synthetic coding sequence
atgagctacctgcccaccaaccccccaggcagcatcctggccggcagcgccagcctgtctgctgtgactggagtgcctgagggggaggcccgcttcacagaggactactgcccagaggagaagatgtttggcttccacaagcccaagatgtaccgcagcattgagggctgctgcatctgccgggccaagagcagcagcagccgcttcacagacagcaagagatatgagaaggacttccagagctgcttcggcctgcacgagaccaggtctggggacatctgcaatgcctgtgtgctgctggtgaagcgctggaagaagctgcctgctggcagcaagaagaactggaaccacgtggtggatgcccgggccggccccagcctgaagaccaccctgaagcccaagaaggtgaagaccctgagcggcaaccgcatcaagagcaaccagatcagcaagctgcagaaggagttcaagaggcacaacagtgatgcccacagcaccaccagcagcgccagccctgcccagagcccctgctacagcaaccagagtgatgatggcagtgacacagagatggccagcggcagcaacagaacacctgtgttctccttcctggacctgacctactggaagaggcagaagatctgctgcggcatcatctacaagggccgctttggagaggtgctgattgacacccacctgttcaagccctgctgcagcaacaagaaggctgctgctgagaagccagaggagcagggccctgagcccctgcccatcagcacccaggagtggtag

SEQ ID NO: 38748 - DNA, 666 bp, Artificial Sequence; identical to SEQ ID NO: 38745
  Description of Artificial Sequence: Synthetic coding sequence

SEQ ID NO: 38749 - DNA, 405 bp, Artificial Sequence
  Description of Artificial Sequence: Synthetic coding sequence
atgtttggcttccacaagcccaagatgtaccgcagcattgagggctgctgcatctgccgggccaagagcagcagcagccgcttcacagacagcaagagatatgagaaggacttccagagctgcttcggcctgcacgagaccaggtctggggacatctgcaatgcctgtgtgctgctggtgaagcgctggaagaagctgcctgctggcagcaagaagaactggaaccacgtggtggatgcccgggccggccccagcctgaagaccaccctgaagcccaagaaggtgaagaccctgagcggcaaccgcatcaagagcaaccagatcagcaagctgcagaaggagttcaagaggcacaacagtgatgcccacagcaccaccagcagcgccagccctgcccagagctag

SEQ ID NO: 38750 - DNA, 384 bp, Artificial Sequence
  Description of Artificial Sequence: Synthetic coding sequence
atgtttggcttccacaagcccaagatgtaccgcagcattgagggctgctgcatctgccgggccaagagcagcagcagccgcttcacagacagcaagagatatgagaaggacttccagagctgcttcggcctgcacgagaccaggtctggggacatctgcaatgcctgtgtgctgctggtgaagcgctggaagaagctgcctgctggcagcaagaagaactggaaccacgtggtggatgcccgggccggccccagcctgaagaccaccctgaagcccaagaaggtgaagaccctgagcggcaaccgcatcaagagcaaccagatcagcaagctgcagaaggagttcaagaggcacaacagtgatgcccacagcaccaccagctag

SEQ ID NO: 38751 - DNA, 984 bp, Artificial Sequence
  Description of Artificial Sequence: Synthetic coding sequence
atgaacatcctcttcctgcagtggaaggtgaagctgcccccccagaaggaggtgatcaccagtgatgagctgatggcccacctgggcaactgcctgctgagcatcaagccccaggagaagtctgagggcctgcagctgaacttccagcagaatgtggatgatgccatgacagtgctgcccaagctggccaccggcctggatgtgaatgtgcgcttcaccggggtgtctgactttgagtacaccccagaatgttctgtgtttgacctgctgggcatccccctgtaccacggctggctggtggacccccagagccctgaggccgtgcgggctgtgggcaagctgagctacaaccagctggtggagcgcatcatcacctgcaagcacagcagtgacaccaacctggtgacagagggcctgattgctgagcagttcctggagaccacagctgcccagctgacctaccacggcctgtgtgagctgacagctgctgccaaggagggggagctgagcgtcttcttcaggaacaaccacttcagcaccatgaccaagcacaagagccacctgtacctgctggtgacagaccagggcttcctgcaggaggagcaggtggtgtgggagagcctgcacaacgtggatggagacagctgcttctgtgacagcgacttccacctgagccacagcctgggcaagggccctggagctgagggcggcagcggcagccctgagacccagctgcaggtggaccaggactacctgattgccctgagcctgcagcagcagcagccccggggccccctgggcctgacagacctggagctggcccagcagctgcagcaggaggagtaccagcagcagcaggccgcccagcctgtgaggatgaggaccagggtgctgagcctgcagggccgcggggccaccagcggccggcctgctggggagcggcggcagaggcccaagcatgaaagtgactgcatcctgctgtag

SEQ ID NO: 38752 - DNA, 1554 bp, Artificial Sequence
  Description of Artificial Sequence: Synthetic coding sequence
atgctgctgggccccccacccttcaatgaaagcaccaagcccagccccagcccctgccacagctttgccagccaggcctggctgcggcaggtgcctgaggtgtccaagcacctgcagtgccccagcgccaagagcctgctgaccatggagtaccaccagccagaagatcctgcccctgggaaggccggcacagctgaggccgtcatcccagaaaatcatgaggtgctggccggcccagatgagcacccccaggacacagatgccagagatgctgatggagaggcccgggagcgggagcctgctgaccaggccctgctgcccagccagtgtggggacaacctggagagccccctgcctgaggccagcagcgcccctcctggccccaccctgggcaccctgcctgaggtggagaccatccgggcctgcagcatgccccaggagctgccccagagccccaggacccggcagcctgagccagacttctactgtgtgaagtggatcccctggaagggggagcagacccccatcatcacccagagcaccaacggcccctgccccctgctggccatcatgaacatcctcttcctgcagtggaaggtgaagctgcccccccagaaggaggtgatcaccagtgatgagctgatggcccacctgggcaactgcctgctgagcatcaagccccaggagaagtctgagggcctgcagctgaacttccagcagaatgtggatgatgccatgacagtgctgcccaagctggccaccggcctggatgtgaatgtgcgcttcaccggggtgtctgactttgagtacaccccagaatgttctgtgtttgacctgctgggcatccccctgtaccacggctggctggtggacccccagagccctgaggccgtgcgggctgtgggcaagctgagctacaaccagctggtggagcgcatcatcacctgcaagcacagcagtgacaccaacctggtgacagagggcctgattgctgagcagttcctggagaccacagctgcccagctgacctaccacggcctgtgtgagctgacagctgctgccaaggagggggagctgagcgtcttcttcaggaacaaccacttcagcaccatgaccaagcacaagagccacctgtacctgctggtgacagaccagggcttcctgcaggaggagcaggtggtgtgggagagcctgcacaacgtggatggagacagctgcttctgtgacagcgacttccacctgagccacagcctgggcaagggccctggagctgagggcggcagcggcagccctgagacccagctgcaggtggaccaggactacctgattgccctgagcctgcagcagcagcagccccggggccccctgggcctgacagacctggagctggcccagcagctgcagcaggaggagtaccagcagcagcaggccgcccagcctgtgaggatgaggaccagggtgctgagcctgcagggccgcggggccaccagcggccggcctgctggggagcggcggcagaggcccaagcatgaaagtgactgcatcctgctgtag

SEQ ID NO: 38753 - DNA, 1410 bp, Artificial Sequence
  Description of Artificial Sequence: Synthetic coding sequence
atggagtaccaccagccagaagatcctgcccctgggaaggccggcacagctgaggccgtcatcccagaaaatcatgaggtgctggccggcccagatgagcacccccaggacacagatgccagagatgctgatggagaggcccgggagcgggagcctgctgaccaggccctgctgcccagccagtgtggggacaacctggagagccccctgcctgaggccagcagcgcccctcctggccccaccctgggcaccctgcctgaggtggagaccatccgggcctgcagcatgccccaggagctgccccagagccccaggacccggcagcctgagccagacttctactgtgtgaagtggatcccctggaagggggagcagacccccatcatcacccagagcaccaacggcccctgccccctgctggccatcatgaacatcctcttcctgcagtggaaggtgaagctgcccccccagaaggaggtgatcaccagtgatgagctgatggcccacctgggcaactgcctgctgagcatcaagccccaggagaagtctgagggcctgcagctgaacttccagcagaatgtggatgatgccatgacagtgctgcccaagctggccaccggcctggatgtgaatgtgcgcttcaccggggtgtctgactttgagtacaccccagaatgttctgtgtttgacctgctgggcatccccctgtaccacggctggctggtggacccccagagccctgaggccgtgcgggctgtgggcaagctgagctacaaccagctggtggagcgcatcatcacctgcaagcacagcagtgacaccaacctggtgacagagggcctgattgctgagcagttcctggagaccacagctgcccagctgacctaccacggcctgtgtgagctgacagctgctgccaaggagggggagctgagcgtcttcttcaggaacaaccacttcagcaccatgaccaagcacaagagccacctgtacctgctggtgacagaccagggcttcctgcaggaggagcaggtggtgtgggagagcctgcacaacgtggatggagacagctgcttctgtgacagcgacttccacctgagccacagcctgggcaagggccctggagctgagggcggcagcggcagccctgagacccagctgcaggtggaccaggactacctgattgccctgagcctgcagcagcagcagccccggggccccctgggcctgacagacctggagctggcccagcagctgcagcaggaggagtaccagcagcagcaggccgcccagcctgtgaggatgaggaccagggtgctgagcctgcagggccgcggggccaccagcggccggcctgctggggagcggcggcagaggcccaagcatgaaagtgactgcatcctgctgtag

SEQ ID NO: 38754 - DNA, 1125 bp, Artificial Sequence
  Description of Artificial Sequence: Synthetic coding sequence
atgccccaggagctgccccagagccccaggacccggcagcctgagccagacttctactgtgtgaagtggatcccctggaagggggagcagacccccatcatcacccagagcaccaacggcccctgccccctgctggccatcatgaacatcctcttcctgcagtggaaggtgaagctgcccccccagaaggaggtgatcaccagtgatgagctgatggcccacctgggcaactgcctgctgagcatcaagccccaggagaagtctgagggcctgcagctgaacttccagcagaatgtggatgatgccatgacagtgctgcccaagctggccaccggcctggatgtgaatgtgcgcttcaccggggtgtctgactttgagtacaccccagagtgcagcgtgtttgacctgctgggcatccccctgtaccacggctggctggtggacccccagagccctgaggccgtgcgggctgtgggcaagctgagctacaaccagctggtggagcgcatcatcacctgcaagcacagcagtgacaccaacctggtgacagagggcctgattgctgagcagttcctggagaccacagctgcccagctgacctaccacggcctgtgtgagctgacagctgctgccaaggagggggagctgtctgtgttcttcaggaacaaccacttcagcaccatgaccaagcacaagagccacctgtacctgctggtgacagaccagggcttcctgcaggaggagcaggtggtgtgggagagcctgcacaacgtggatggagacagctgcttctgtgacagcgacttccacctgagccacagcctgggcaaaggacctggagctgagggcggcagcggcagccctgagacccagctgcaggtggaccaggactacctgattgccctgagcctgcagcagcagcagccccggggccccctgggcctgacagacctggagctggcccagcagctgcagcaggaggagtaccagcagcagcaggccgcccagcctgtgaggatgaggaccagggtgctgagcctgcagggccgcggggccaccagcggccggcctgctggggagcggcggcagaggcccaagcatgaaagtgactgcatcctgctgtag

SEQ ID NO: 38755 - DNA, 1863 bp, Artificial Sequence
  Description of Artificial Sequence: Synthetic coding sequence
atggagagcagccctgagagcctgcagcccctggagcacggcgtggccgccggccctgccagcggcaccggcagcagccaggagggcctgcaggagacccggctggccgctggagatggccctggggtgtgggccgctgagaccagcggcggcaatggcctgggcgctgctgctgcccggcgcagcctgcctgacagcgccagccctgctggcagccctgaggtgcccggcccctgcagcagcagcgctggcctggacctgaaggacagcggcctggagagccctgctgctgctgaggcccccctgcggggccagtacaaggtgacagccagccctgagacagctgtggccggcgtgggccacgagctgggcacagctggagatgctggggcccggccagacctggccggcacctgccaggccgagctgacagctgctggcagcgaggagcccagcagcgctgggggcctgagcagcagctgcagcgaccccagccccccaggagagagccccagcctggacagcctggagagcttcagcaacctgcacagcttccccagcagctgtgagttcaacagcgaggagggcgctgagaacagagtgcctgaggaggaggagggcgctgctgtgctgcccggggctgtgcccctgtgcaaggaggaggagggggaggagacagcccaggtgctggccgccagcaaggagcgcttccctggccagagcgtgtaccacatcaagtggatccagtggaaggaggagaacacccccatcatcacccagaatgaaaatggcccctgccccctgctggccatcctgaatgtgctgctgctggcctggaaggtgaagctgccccccatgatggagatcatcacagctgagcagctgatggagtacctgggggactacatgctggatgccaagcccaaggagatcagcgagatccagaggctgaactatgagcagaacatgtctgatgccatggccatcctgcacaagctgcagacaggcctggatgtgaatgtgcgcttcaccggggtgcgggtgtttgagtacaccccagagtgcatcgtgtttgacctgctggacatccccctgtaccacggctggctggtggacccccagattgatgacatcgtgaaggctgtgggcaactgcagctacaaccagctggtggagaagatcatcagctgcaagcagagcgacaacagcgagctggtgtctgagggctttgtggccgagcagttcctgaacaacacagccacccagctgacctaccacggcctgtgtgagctgaccagcacagtgcaggagggggagctgtgtgtgttcttcaggaacaaccacttcagcaccatgaccaagtacaagggccagctgtacctgctggtgacagaccagggcttcctgacagaggagaaggtggtgtgggagagcctgcacaacgtggatggagatggcaacttctgtgacagcgagttccacctgcggcccccaagtgaccctgagaccgtgtacaagggccagcaggaccagattgaccaggactacctgatggccctgagcctgcagcaggagcagcagagccaggagatcaactgggagcagatccctgagggcatcagtgacctggagctggccaagaagctgcaggaggaggaggacagaagagccagccagtactaccaggagcaggagcaggccgctgctgctgctgctgctgccagcacccaggcccagggccagcctgcccaggccagccccagcagcggccggcagagcggcaacagcgagaggaagaggaaggagccccgggagaaggacaaggagaaggagaaggagaagaacagctgtgtgatcctgtag

SEQ ID NO: 38756 - DNA, 1866 bp, Artificial Sequence
  Description of Artificial Sequence: Synthetic coding sequence
atggagagcagccctgagagcctgcagcccctggagcacggcgtggccgccggccctgccagcggcaccggcagcagccaggagggcctgcaggagacccggctggccgctggagatggccctggggtgtgggccgctgagaccagcggcggcaatggcctgggcgctgctgctgcccggcgcagcctgcctgacagcgccagccctgctggcagccctgaggtgcccggcccctgcagcagcagcgctggcctggacctgaaggacagcggcctggagagccctgctgctgctgaggcccccctgcggggccagtacaaggtgacagccagccctgagacagctgtggccggcgtgggccacgagctgggcacagctggagatgctggggcccggccagacctggccggcacctgccaggccgagctgacagctgctggcagcgaggagcccagcagcgctgggggcctgagcagcagctgcagcgaccccagccccccaggagagagccccagcctggacagcctggagagcttcagcaacctgcacagcttccccagcagctgtgagttcaacagcgaggagggcgctgagaacagagtgcctgaggaggaggagggcgctgctgtgctgcccggggctgtgcccctgtgcaaggaggaggagggggaggagacagcccaggtgctggccgccagcaaggagcgcttccctggccagagcgtgtaccacatcaagtggatccagtggaaggaggagaacacccccatcatcacccagaatgaaaatggcccctgccccctgctggccatcctgaatgtgctgctgctggcctggaaggtgaagctgccccccatgatggagatcatcacagctgagcagctgatggagtacctgggggactacatgctggatgccaagcccaaggagatcagcgagatccagaggctgaactatgagcagaacatgtctgatgccatggccatcctgcacaagctgcagacaggcctggatgtgaatgtgcgcttcaccggggtgcgggtgtttgagtacaccccagagtgcatcgtgtttgacctgctggacatccccctgtaccacggctggctggtggacccccagattgatgacatcgtgaaggctgtgggcaactgcagctacaaccagctggtggagaagatcatcagctgcaagcagagcgacaacagcgagctggtgtctgagggctttgtggccgagcagttcctgaacaacacagccacccagctgacctaccacggcctgtgtgagctgaccagcacagtgcaggagggggagctgtgtgtgttcttcaggaacaaccacttcagcaccatgaccaagtacaagggccagctgtacctgctggtgacagaccagggcttcctgacagaggagaaggtggtgtgggagagcctgcacaacgtggatggagatggcaacttctgtgacagcgagttccacctgcggcccccaagtgaccctgagaccgtgtacaagggccagcaggaccagattgaccaggactacctgatggccctgagcctgcagcaggagcagcagagccaggagatcaactgggagcagatccctgagggcatcagtgacctggagctggccaagaagctgcaggaggaggaggacagaagagccagccagtactaccaggagcaggagcaggccgctgctgctgctgctgctgccagcacccaggcccagcagggccagcctgcccaggccagccccagcagcggccggcagagcggcaacagcgagaggaagaggaaggagccccgggagaaggacaaggagaaggagaaggagaagaacagctgtgtgatcctgtag

SEQ ID NO: 38757 - DNA, 2841 bp, Artificial Sequence
  Description of Artificial Sequence: Synthetic coding sequence
atgtctgtgcggctgcgcttcctgagccctggggacacaggagctgtgggcgtggtgggccgcagcgccagctttgctggcttcagcagcgcccagagccgccgcatcgccaagagcatcaacagaaacagcgtgcgcagcaggatgcctgccaagagcagcaagatgtatggcaccctgaggaagggctctgtgtgtgccgaccccaagccccagcaggtgaagaagatctttgaggccctgaagaggggcctgaaggagtacctgtgtgtgcagcaggccgagctggaccacctgagcggccgccacaaggacaccaggaggaacagccggctggccttctactatgacctggacaagcagacccgctgtgtggagcggcacatcaggaagatggagttccacatcagcaaggtggatgagctgtatgaggactactgcatccagtgccgcctgagagatggagccagctccatgcagagggcctttgcccgctgcccccccagcagagctgcccgggagagcctgcaggagctgggccgcagcctgcatgaatgtgccgaggacatgtggctgattgaaggagccctggaggtgcacctgggggagttccacatccgcatgaagggcctggtgggctacgcccggctgtgccctggggaccactatgaggtgctgatgaggctgggccggcagcgctggaagctgaagggccgcatcgagagtgatgacagccagacctgggatgaggaggagaaggccttcatccccaccctgcacgagaacctggacatcaaggtgacagagctgcggggcctgggcagcctggccgtgggcgctgtgacctgtgacattgctgacttcttcaccacccggccccaggtgattgtggtggacatcacagagctgggcaccatcaagctgcagctggaggtgcagtggaacccctttgacacagagagcttcctggtgagccccagccccaccgggaagttctccatgggcagcaggaagggcagcctgtacaactggaccccacccagcacccccagcttccgggagcgctactacctgtctgtgctgcagcagcccacccagcaggccctgctgctgggcggcccccgggccaccagcatcctgagctacctgagtgacagcgacctgcggggccccagcctgcggagccagagccaggagctgcctgagatggacagcttcagcagcgaggacccccgggacacagagaccagcaccagcgccagcaccagtgatgtgggcttcctgcccctgaccttcggcccccacgccagcattgaggaggaggcccgggaggaccccctgcccccaggcctgctgcctgagatggcccacctgagcggcggcccctttgctgagcagcccggctggaggaacctgggcggggagagccccagcctgccccagggcagcctcttccacagcggcacagccagcagcagccagaatggacatgaggagggcgccaccggggaccgggaggatggccctggggtggccctggagggccccctgcaggaggtgctggagctgctgcggcccacagacagcacccagccccagctgcgggagctggagtaccaggtgctgggcttccgggaccggctgaagccctgccgggcccggcaggagcacaccagcgctgagagcctgatggagtgcatcctggagagctttgccttcctgaatgctgactttgccctggatgagctgagcctgtttggaggcagccagggcctgaggaaggaccggcccctgcccccacccagcagcctgaaggccagcagccgggagctgacagctggggcccctgagctggatgtgctgctgatggtgcacctgcaggtgtgcaaggccctgctgcagaagctggccagccccaacctgagccggctggtgcaggagtgcctgctggaggaggtggcccagcagaagcacgtgctggagaccctgtctgtgctggactttgagaaggtgggcaaggccaccagcattgaggagatcatcccccaggccagcaggaccaagggctgcctgaagctgtggaggggctgcaccggccctggccgggtgctgagctgcccagccaccaccctgctgaaccagctgaagaagaccttccagcaccgggtgcggggcaagtacccaggccagctggagatcgcctgccggcggctgctggagcaggtggtgtcctgtggcggcctgctgcccggggccggcctgcctgaggagcagatcatcacctggttccagttccacagctacctgcagaggcagagcgtgtctgacctggagaagcacttcacccagctgaccaaggaggtgaccctgattgaggagctgcactgtgccggccaggccaaggtggtgaggaagctgcagggcaagaggctgggccagctgcagcccctgccccagaccctgcgggcctgggccctgctgcagctggatggcaccccccgggtgtgccgggccgccagcgcccggctggccggggctgtgaggaacagaagcttccgggagaaggccctgctcttctacaccaatgccctggccgagaatgatgcccggctgcagcaggccgcctgcctggccctgaagcacctgaagggcatcgagagcattgaccagacagccagcctgtgccagagcgacctggaggccgtgcgggctgctgcccgggagaccaccctgagctttggagagaagggccgcctggcctttgagaagatggacaagctgtgcagcgagcagcgggaggtgttctgccaggaggctgatgtggagatcaccatcttctag

SEQ ID NO: 38758 - DNA, 2841 bp, Artificial Sequence; identical to SEQ ID NO: 38757
  Description of Artificial Sequence: Synthetic coding sequence

SEQ ID NO: 38759 - DNA, 2853 bp, Artificial Sequence
  Description of Artificial Sequence: Synthetic coding sequence
atggtgaccaccatgtctgtgcggctgcgcttcctgagccctggggacacaggagctgtgggcgtggtgggccgcagcgccagctttgctggcttcagcagcgcccagagccgccgcatcgccaagagcatcaacagaaacagcgtgcgcagcaggatgcctgccaagagcagcaagatgtatggcaccctgaggaagggctctgtgtgtgccgaccccaagccccagcaggtgaagaagatctttgaggccctgaagaggggcctgaaggagtacctgtgtgtgcagcaggccgagctggaccacctgagcggccgccacaaggacaccaggaggaacagccggctggccttctactatgacctggacaagcagacccgctgtgtggagcggcacatcaggaagatggagttccacatcagcaaggtggatgagctgtatgaggactactgcatccagtgccgcctgagagatggagccagctccatgcagagggcctttgcccgctgcccccccagcagagctgcccgggagagcctgcaggagctgggccgcagcctgcatgaatgtgccgaggacatgtggctgattgaaggagccctggaggtgcacctgggggagttccacatccgcatgaagggcctggtgggctacgcccggctgtgccctggggaccactatgaggtgctgatgaggctgggccggcagcgctggaagctgaagggccgcatcgagagtgatgacagccagacctgggatgaggaggagaaggccttcatccccaccctgcacgagaacctggacatcaaggtgacagagctgcggggcctgggcagcctggccgtgggcgctgtgacctgtgacattgctgacttcttcaccacccggccccaggtgattgtggtggacatcacagagctgggcaccatcaagctgcagctggaggtgcagtggaacccctttgacacagagagcttcctggtgagccccagccccaccgggaagttctccatgggcagcaggaagggcagcctgtacaactggaccccacccagcacccccagcttccgggagcgctactacctgtctgtgctgcagcagcccacccagcaggccctgctgctgggcggcccccgggccaccagcatcctgagctacctgagtgacagcgacctgcggggccccagcctgcggagccagagccaggagctgcctgagatggacagcttcagcagcgaggacccccgggacacagagaccagcaccagcgccagcaccagtgatgtgggcttcctgcccctgaccttcggcccccacgccagcattgaggaggaggcccgggaggaccccctgcccccaggcctgctgcctgagatggcccacctgagcggcggcccctttgctgagcagcccggctggaggaacctgggcggggagagccccagcctgccccagggcagcctcttccacagcggcacagccagcagcagccagaatggacatgaggagggcgccaccggggaccgggaggatggccctggggtggccctggagggccccctgcaggaggtgctggagctgctgcggcccacagacagcacccagccccagctgcgggagctggagtaccaggtgctgggcttccgggaccggctgaagccctgccgggcccggcaggagcacaccagcgctgagagcctgatggagtgcatcctggagagctttgccttcctgaatgctgactttgccctggatgagctgagcctgtttggaggcagccagggcctgaggaaggaccggcccctgcccccacccagcagcctgaaggccagcagccgggagctgacagctggggcccctgagctggatgtgctgctgatggtgcacctgcaggtgtgcaaggccctgctgcagaagctggccagccccaacctgagccggctggtgcaggagtgcctgctggaggaggtggcccagcagaagcacgtgctggagaccctgtctgtgctggactttgagaaggtgggcaaggccaccagcattgaggagatcatcccccaggccagcaggaccaagggctgcctgaagctgtggaggggctgcaccggccctggccgggtgctgagctgcccagccaccaccctgctgaaccagctgaagaagaccttccagcaccgggtgcggggcaagtacccaggccagctggagatcgcctgccggcggctgctggagcaggtggtgtcctgtggcggcctgctgcccggggccggcctgcctgaggagcagatcatcacctggttccagttccacagctacctgcagaggcagagcgtgtctgacctggagaagcacttcacccagctgaccaaggaggtgaccctgattgaggagctgcactgtgccggccaggccaaggtggtgaggaagctgcagggcaagaggctgggccagctgcagcccctgccccagaccctgcgggcctgggccctgctgcagctggatggcaccccccgggtgtgccgggccgccagcgcccggctggccggggctgtgaggaacagaagcttccgggagaaggccctgctcttctacaccaatgccctggccgagaatgatgcccggctgcagcaggccgcctgcctggccctgaagcacctgaagggcatcgagagcattgaccagacagccagcctgtgccagagcgacctggaggccgtgcgggctgctgcccgggagaccaccctgagctttggagagaagggccgcctggcctttgagaagatggacaagctgtgcagcgagcagcgggaggtgttctgccaggaggctgatgtggagatcaccatcttctag

SEQ ID NO: 38760 - DNA, 1269 bp, Artificial Sequence
  Description of Artificial Sequence: Synthetic coding sequence
atgaagaagaacaccagcaagaccaccatgaggatcaacaagcaggatgccctgtgcaccccccacagccatgacccccgggacctgcagaacatgctggatggaggagaatatgccccctttgtgagcccccccatgctggagagcaacttcatccaggtgaacagaagaggagagagcatctacctgcacaacagagccaactgggtgacagtgggcatctgcttcagcagcagcacccacaagatccccaacgtgatgctgctggcccacctgacccctggggcccagaaggacacagagaccctcttcaagagcctgctgaccagccccccagctgagaagctggtgctgacccgcttcctgcccctgcagtttgtgaccctgtctgtgcatgatgctgagaacatgagcctgaaggtgaagctggtgtctggccgggcctactacctgcagctgtgcaccagcgcctacaagcaggacaccctcttcagccagtgggtggccctgatcagcctgctgaaccaggagaaggccaaggtgtccaaggtgtctgaggtgagcagcctgagcggcatcaccaacagcacagacatcaccggctccatggatgtgacagatgtgaccaccttcaccgccatcctgaccccctacatgtatgccggcactggacctgagcacgtgcgggacagcattgacttccctgagttcacagacatcacagacatcacagatgtgacagacctgcctgaaaatgaggtgcctgaggtgcctgatgtgcgcatcgtgacagaggtgattgaggtgcgggaggccacagaggtgacagacagcagtgacatcaccaactgcagcggcgtgacagtggtgtttgagaacaatgacctgatccgggccaagcaggaggagaaggagaagctgaagaacatcctgaagccaggctgcctgcaggacaccaagagcaagtctgagctgaaggagagcagcaagcacgtgaccatcagcaacatcaccctgacctttgagggcaagcgctacttccagaccaccctgacccctgtggagagcgaggccaacaccagcaaggagatgaaggacaagaccagcgaggagaagatgccagacttccagagcacagccctgaaggccgaggagagccgcagcctgaggacagagagcaacacctctgtgctgagcccccacatcaagagccccagcaacttcctgaagctggtgccccacctgagcgcccccttcagccgggagtag

SEQ ID NO: 38761 - DNA, 1785 bp, Artificial Sequence
  Description of Artificial Sequence: Synthetic coding sequence
atgaatgctgacttcctgctgccctactacacagcccagagcggcagctccatgtccatgttcaacaccaccatgggcaagctgcagaggcagctgtacaagggggagtatgacatcttcaagtatgcccccatctttgaaagtgacttcatccagatcaccaagagaggagaggtgattgatgtgcacaacagagtgaggatggtgaccatgggcatcgcccggaccagccccatcctgcccctgcctgatgtgatgctgctggcccggcctgccaccggctgtgaggagtatgccggccacggccaggccaccaagaggaagaagaggaaggccgccaagaacctggagctgacccggctgctgcccctgcgctttgtgcgcatctctgtgcaggaccacgagaagcagcagctgcggctgaagtttgccaccggccgcagctgctacctgcagctgtgcccagccctggacaccagagatgacctgtttgcctactgggagaagctgatctacctgctgcggccccccatggagagcaacagcagcacctgtggcatcccagctgaggacatgatgtggatgcctgtgttccaggaggaccggcgcagcctgggcgctgtgaacctgcagggcaaaggagaccaggaccaggtgtccatccagagcctgcacatggtgtctgaggtgtgtggggccaccagcgctgcctatgccggcggggagggcctgcagaatgacttcaacaagcccaccaacgtgctgaatgccagcatccccaagaccagcacagagctggccgaggagcccgccaccggcggcatcaaggaggccgctgctgctggagctgctgctggagctgccactggaacagtggccggggccctgtctgtggccgccgccaacagcgcccctggccaggtgtctgctgccatcgccggggccgccaccatcggggccggcggcaacaagggcaacatggccctggccggcacagcctccatggcccccaacagcaccaaggtggccgtggccggggccgccggcaagagcagcgagcacgtgtcctctgcctccatgagcctgagccgggagggctctgtgtccctggccatcgccggcgtggtgctgaccagcaggacagctgctgaggccgacatggatgctgctgctggcccccctgtgtccacccggcagagcaagagcagcctgagcggccagcacggccgggagaggacccaggccagcgctgagggctgcaaggagggccgggagcggcgggagaaggaccgggccctgggccgcagcagccacagaagaagaactggagagagccgccacaagaccaggggggacaagatcgcccagaagagcagcagccgcagcagcttcagccaccgggccaacagagatgacaagaaggagaagggctgcggcaaccctggcagcagccgccaccgggacagccacaagggcgtgagccacacccccatcagcaaggagagcaggaccagccacaagagcggccgcagcctgtggaccaccagcagcggcagcagcaagggcctgggccgggtgagcagcttcctgagaaatgtgcgggccaacctgaccaccaaggtggtgggcaccccccacggcagagatgtgaatgtgatggccaagatggccgagaggagcaccaacgtggccatcgccgagacagctgagggcggccagggcctggagaccgtgggctccatgaccccagacatcatggagaccgtgacctttgaggcccactag

SEQ ID NO: 38762 - DNA, 1110 bp, Artificial Sequence
  Description of Artificial Sequence: Synthetic coding sequence
atggtgtctgaggtgtgtggggccaccagcgctgcctatgctggaggagagggcctgcagaatgacttcaacaagcccaccaacgtgctgaatgccagcatccccaagaccagcacagagctggccgaggagcccgccactggaggcatcaaggaggccgctgctgctggagctgctgctggggccgccaccggcaccgtggccggggccctgtctgtggccgccgccaacagcgcccctggccaggtgtctgctgccatcgccggggccgccaccatcggggccggcggcaacaagggcaacatggccctggccggcacagcctccatggcccccaacagcaccaaggtggccgtggccggggctgctgggaagagcagcgagcacgtgagcagcgcctccatgagcctgagccgggagggctctgtgtccctggccatcgccggcgtggtgctgaccagcaggacagctgctgaggccgacatggatgctgctgctggcccccctgtgtccacccggcagagcaagagcagcctgagcggccagcacggccgggagaggacccaggccagcgctgagggctgcaaggagggccgggagcggcgggagaaggaccgggccctgggccgcagcagccacagaagaagaactggagagagccgccacaagaccaggggggacaagatcgcccagaagagcagcagccgcagcagcttcagccaccgggccaacagagatgacaagaaggagaagggctgcggcaaccctggcagcagccgccaccgggacagccacaagggcgtgagccacacccccatcagcaaggagagcaggaccagccacaagagcggccgcagcctgtggaccaccagcagcggcagcagcaagggcctgggccgggtgtcctccttcctgagaaatgtgcgggccaacctgaccaccaaggtggtgggcacccctcatggaagagatgtgaatgtgatggccaagatggccgagaggagcaccaacgtggccatcgccgagacagctgagggcggccagggcctggagaccgtgggctccatgaccccagacatcatggagaccgtgacctttgaggcccactag

SEQ ID NO: 38763 - DNA, 726 bp, Artificial Sequence
  Description of Artificial Sequence: Synthetic coding sequence
atggaggactgctgcatgctgccctactacacagcccagagcagccctgccatgggcatgttcaacacctccatgggcaagctgcagaggcagctgtacaagggggagtacaccatcttccgctatgcccccatgtttgaaagtgacttcatccagatcagcaagagaggagaggtgattgatgtgcacaacagagccaggatggtgaccatgggcatcgtgaggaccagcccctgcctgaccctgcctgatgtgatgctgctggcccggcctgctgctgtgtgtgacaatgcccgctgtggccctgccacccagaagcgggagagccccccagctgagatcctggagctgacccggctgctgcccctgatgtttgtgaagatcaccatccacaacagcgtgaagaagcagctgcacctgaagctggccaccggccgctccttctacctgcagctgtgccccccatctgatgccagcgaggacctgtttgtgcactgggagaacctggtgtacatcctgcggccccctgtggaggcctacagcgacacccgggccatcctggccggcaacaccctggacagctctgtgctggaggaggtgcagaggagccctgtgggctacgccatgaagttctgtgaggagaaggagcagttccgcatcagccggctgcacatgaatgctgagatgtttggcagcacctactgtgactacaccatcgagatctag

SEQ ID NO: 38764 - DNA, 696 bp, Artificial Sequence
  Description of Artificial Sequence: Synthetic coding sequence
atgggcccccccctgtggccagacctgcaggagcccccacctcctggcaccagcagccagatccgcagccccctgctgtgtgatgtgatcaagccagccccccaccatgatgtgacagtgcgggtggtgcccccaccccgcttcctgcccctgctgctgcggcccctgcccagtgatggagacatcgccatgagaagagaccggggccccaagccagccctgggcggggccggggaggtggagcccggcggcatggccgccagccccaccggccggccccggcggctgcagcgctacctgcagagcggggagtttgaccagttccgggacttccccatctttgagagcaactttgtgcaggtgacccggctgggggaggtggccaatgaggtgaccatgggcgtggccgccagcagccctgccctggagctgcctgacctgctgctgctggccggccctgccaaggaaaatggccacctgcagctgtttggcctcttccccctgaagtttgtgcagctgtttgtgcatgacaagagccgctgccagctggaggtgaagctgaacaccagcaggaccttctacctgcagctgcgggcccccctgaagacccgggaccgggagtttggccagtgggtgcggctgctgtaccgcctgcgcttcctgagcgccagcgctgtgcccttcacccaggagtag

SEQ ID NO: 38765 - DNA, 744 bp, Artificial Sequence
  Description of Artificial Sequence: Synthetic coding sequence
atgggcccccccctgtggccagacctgcaggagcccccacctcctggcaccagcagccagatccgcagccccctgctgtgtgatgtgatcaagccagccccccaccatgatgtgacagtgcgggtggtgcccccaccccgcttcctgcccctgctgctgcggcccctgcccagtgatggagacatcgccatgagaagagaccggggccccaagccagccctgggcggggccggggaggtggagcccggcggcatggccgccagccccaccggccggccccggcggctgcagcgctacctgcagagcggggagtttgaccagttccgggacttccccatctttgagagcaactttgtgcagttctgcccagacatctacccagcccccaccagtgacctgtggccccaggtgacccggctgggggaggtggccaatgaggtgaccatgggcgtggccgccagcagccctgccctggagctgcctgacctgctgctgctggccggccctgccaaggaaaatggccacctgcagctgtttggcctcttccccctgaagtttgtgcagctgtttgtgcatgacaagagccgctgccagctggaggtgaagctgaacaccagcaggaccttctacctgcagctgcgggcccccctgaagacccgggaccgggagtttggccagtgggtgcggctgctgtaccgcctgcgcttcctgagcgccagcgctgtgcccttcacccaggagtag

SEQ ID NO: 38766 - DNA, 2769 bp, Artificial Sequence
  Description of Artificial Sequence: Synthetic coding sequence
atgatctggctgaggaacagacgctgcctggagcccctgcagggcacccccaagtgggtgcctgtgctgggggagctgcagaagaccctgcagaagggggagtacctgcccctgcggcccctgcccatgtttgagagcaactttgtgcaggtgacccaccagggcggccctgtgtttgtgaaccacaggaccaaccggctggccatgggcgtggccgccagcctgcccggcctggtgctgcctgacatcctgctgattggccagcctgcagaagatcgggactgcagcggcctggtgctgaccaggatgatccccctggacctggtgcacctgtgtgtgcatgacctgagcgcctggaggctgaagctgcggctggtgtctggccggcagtactacctggccctggatgccccagacaatgaggtgggcttcctgttccactgctgggtgcggctcatcaacctgctgcaggagcccgcccccacctggacccccaggaccaccaggacagcccccctggacatgcccctggccgaggccccagccagcacctggcacctgcaggaccagcccatcagcagacatgctgtgcgggtggccgagaggaacttcccccacaagacagtggccgcccagaggcagaggaaggccaaggccctgaagaggagcttcaagagccaggccgtgggggacagcgtgcccctcatctggagccagctggagcacgcagatgtgaggaagaagccagctgagaagaagagccacagcgaccccaggccagacaggacccacacccagatccggctgcctgagaagaccagcatcaccacctggaccatcttcagcatcatcagcagcacagccaaccagacccagagcagccccaaggcctgcaccagcgccagtgatgaggccaccggccagggccacgtggtggagagccccagccactgtgtgtctgctgacagcccagatggcttcttcctgggcagctgcagcagcctggacccctgcctgtggcaccaggacacagaggacctgatggacagcggcggcagcaccctgagcagcgctgccagcggcctggccccctaccccccagctgcctgcctgagcaccccctacagcagcatcccccggggccgggagaaggccggccccatgggcagccaccagggccctggccccccaccctgccagaaggcccccagcggcctggtgaccagctgcaaggcccccttcctggtggaccagagccagaagctgcctgctgtgcctgccagctcctggaagcccccacctggcctggccccaccccagaaggccccagctgccagcgccccacccaggaaggccccagctgtgcctgcccccagccagaaggccccagctgtgcctgcccccagccagaaggccccagccatcccagcccccagcaggaaggccagcgctgccagcgccagccccaggaaggccagcgctgtgcctgccccaccccagaagaccccaccacccagccagaaggcccccagcgtgcccaccatcccccagaaggctgtgagccccacagcccccaagaagaagagcctgctgctgcctgcccccagccagaaggccctgcccaccagccccacagagtaccagatggccctgagccccccagccagccggggcaagctgcccggggactttgatgtgctgcccaccggcatccctggccgggctgtgctggagaggagccagagcggcggcaagccagagcctgtggtgacagtgaggacccaggagacagatgtggtggagatgaccacccaggccaagagccctgagagccccttcaccgtgaccaagaaggagagcaaggacatcctgatcagccagaccaaggaggtgaccctggaggccttccggggccagggcaagctggaggactgggcccactgggccaagctggaggagaggagcccagacctgcccggggtgcgcagcaaggagctggagcagaggaagcgctgggtgaaggccaaggagctggccgtggagggccccagccaggagcacagccggcccttctctgtggaggccctgaccctgaccaagctgatgatcacagccaacagcaaggagcagcccagcaagagcgccctggtgtccctgcccagctggctgctggccaccccccaggccagcgccacctccatgatggcctctgtgcccagccggcccggccagctgagcctgctggagggcaagcctgtggtggtgcgggagcagcctgagagccacacctgggtgaaggagggcaagaggccctggggcgagatgaaggagcagccctggggcgagatgaaggagcccccctgggaccccaagggcccccccaaggtgcccttccgcagcaagcccaccagcgccagcctgaagcgggagggcatcagccaggcccccatccccctgacagccagcccctgggaggacctgcggcccagccccctgtctgagaccctcatcagcaagatggaggccacagcccgggccagccagcagcccaagagggtgtcccaggagcccatgaggatgcctgcccagcaccccctggccaccgtgggcagcagcagcgagatcctgctgcccatgctgctggagctggagaccgtgaggaacacagccaccaaggccgaggagatccaggaggagagcggcgtgctgaacctgctgcccagcctgcagcacagccagcacagcgagtggccagatgctggggcctag

SEQ ID NO: 38767 - DNA, 1035 bp, Artificial Sequence
  Description of Artificial Sequence: Synthetic coding sequence
atgctgagcagcttcccccacaggaagacctggaggaagagcaagaagacagtgaaggtgaccaggagctaccccaccttccccagcctgaatgcctgggaggagttccggggcctgctgcctgtggatggagagcccaaccctggggccggcctgggcgtggaggagggcctgctgtgccgggtggtgcacagccctgagttcaacctcttcctggacagcgtggtgtttgagagcaacttcatccaggtgaagaggggcaggaactggagagatgtgtacaaggccagcaacaccatggccctgggcgtgaccagctctgtgccctgcctgcccctgcccaacatcctgctgatggcctctgtgaagtggcaccagggccagaaccagacctggaaccggcccagcatcgcccccaacatcttcctgaagaggatcctgcccctgcgctttgtggagctgcaggtgtgtgaccactaccagaggatcctgcagctgaggacagtgacagagaagatctactacctgaagctgcacccagaccaccctgagaccgtcttccacttctggatccggctggtgcagatcctgcagaagggcctgagcatcaccaccaaggacccccgcatcctggtgacccactgcctggtgcccaagaactgcagcagccccagcggggacagcaagctggtgcagaagaagctgcaggccagccagcccagcgagagcctcatccagctgatgaccaagggggagagcgaggccctgagccagatctttgctgacctgcaccagcagaaccagctgtccttccgcagcagcaggaaggtggagaccaacaagaacagcagcggcaaggacagcagcagagaagattccatcccctgcacctgtgacctgcgctggagggccagcttcacctacggggagtgggagcgggagaaccccagcggcctgcagcccctgagcctgctgagcaccctggccgccagcacaggcccccagctggccccacccatcggcaacagcatctag

SEQ ID NO: 38768 - DNA, 903 bp, Artificial Sequence
  Description of Artificial Sequence: Synthetic coding sequence
atgagcaagatccggggcctgcccccagaggtgcgggagcccggccctggggtggagctgggcgtggagaatggcctgctgtgccagctgatccacagccctgagttcaacctcttcagcaacagcgtggtgtttgagagcaacttcatccaggtgaccaagccaggcaactggagagatgtgtgtgagggcagcgccaccgtcatcctgggcgtgaccagctctgtgcccagcctgcccctgcccaacgtgctgctgatggccaacgtgacctggccccagggccccttcaccacctggagcaccccaggagatgcccctgtgatcaacctgagccggctgctgcccctgaagtatgtggagctgcgcatctatgaccggctgcagaggatcctgcgggtgaggacagtgacagagaagatctactacctgaagctgcacgagaagcaccctgagatcgtgttccagttctgggtgcggctggtgaagatcctgcagaagggcctgagcatcaccaccaaggacccccgcatcaagttcacccactgcctggtgcccaagatgcccaccaacagcacagagaccaccccagagaacagcctgctgagcagcccccagcccagcgagcccctggtgctgctggccgctgagcagaccagcggcagcttcagccagctgagcggcaagccccagctgacagctgacaggaacaatgacacagccatcgagattgacaactgcagcagctacaagatccccagccctgtggccagccccatcaacctgaacatccccatgagagctgccctgagccacagcctgtgggagcaggaggactggaatgagcacctgctgcaggtgcacatcgccagctacctgggggagcacttcctgggcgcctag

SEQ ID NO: 38769 - DNA, 903 bp, Artificial Sequence; identical to SEQ ID NO: 38768
  Description of Artificial Sequence: Synthetic coding sequence

SEQ ID NO: 38770 - DNA, 903 bp, Artificial Sequence; identical to SEQ ID NO: 38768
  Description of Artificial Sequence: Synthetic coding sequence

SEQ ID NO: 38771 - DNA, 930 bp, Artificial Sequence
  Description of Artificial Sequence: Synthetic coding sequence
atgagcaagatccggggcctgcccccagaggtgcgggagcccggccctggggtggagctgggcgtggagaatggcctgctgtgccagctgatccacagccctgagttcaacctcttcagcaacagcgtggtgtttgagagcaacttcatccagacccacgtgcctgaggccgacttccaggtgaccaagccaggcaactggagagatgtgtgtgagggcagcgccaccgtcatcctgggcgtgaccagctctgtgcccagcctgcccctgcccaacgtgctgctgatggccaacgtgacctggccccagggccccttcaccacctggagcaccccaggagatgcccctgtgatcaacctgagccggctgctgcccctgaagtatgtggagctgcgcatctatgaccggctgcagaggatcctgcgggtgaggacagtgacagagaagatctactacctgaagctgcacgagaagcaccctgagatcgtgttccagttctgggtgcggctggtgaagatcctgcagaagggcctgagcatcaccaccaaggacccccgcatcaagttcacccactgcctggtgcccaagatgcccaccaacagcacagagaccaccccagagaacagcctgctgagcagcccccagcccagcgagcccctggtgctgctggccgctgagcagaccagcggcagcttcagccagctgagcggcaagccccagctgacagctgacagaaataatgacacagccattgaaattgacaactgcagcagctacaagatccccagccctgtggccagccccatcaacctgaacatccccatgagagctgccctgagccacagcctgtgggagcaggaggactggaatgagcacctgctgcaggtgcacatcgccagctacctgggggagcacttcctgggcgcctag

SEQ ID NO: 38772 - DNA, 330 bp, Artificial Sequence
  Description of Artificial Sequence: Synthetic coding sequence
atgagcaccaacatctgcagcttcaaggacagcgctgtggacttcaccggccgctgctacttcaccaagatctgcaagtgcaagctgaaggacatcgcctgcctgaagtgtggcaacatcgtgggctaccacgtgattgtgccctgcagcagctgcctgctgagctgcaacaacggccacttctggatgttccacagccaggccgtgtatgacatcaaccggctggacagcactggagtgaatgtgctgctgtggggcaacctgcctgagattgaggagagcacagatgaagatgtgctgaacatctctgctgaggagtgcatcagatag

SEQ ID NO: 38773 - DNA, 450 bp, Artificial Sequence
  Description of Artificial Sequence: Synthetic coding sequence
atgagcaccaacatctgcagcttcaaggacagatgtgtgtccatcctgtgctgcaagttctgcaagcaggtgctgagcagccggggcatgaaggctgtgctgctggccgacacagaaattgacctcttcagcacagacatcccccccaccaatgctgtggacttcaccggccgctgctacttcaccaagatctgcaagtgcaagctgaaggacatcgcctgcctgaagtgtggcaacatcgtgggctaccacgtgattgtgccctgcagcagctgcctgctgagctgcaacaacggccacttctggatgttccacagccaggccgtgtatgacatcaaccggctggacagcactggagtgaatgtgctgctgtggggcaacctgcctgagattgaggagagcacagatgaagatgtgctgaacatctctgctgaggagtgcatcagatag

SEQ ID NO: 38774 - DNA, 450 bp, Artificial Sequence
  Description of Artificial Sequence: Synthetic coding sequence
atgcccaccaccacagccctgcgctggacagctgctgcccgggtgcggaggaagggccggggcggctgggtgcctgctgccctgcggtctgtgtcccaggatggagtgcccggctgcaccgtgatgggcggggagaccaggagcccagaaaatgctgtggacttcaccggccgctgctacttcaccaagatctgcaagtgcaagctgaaggacatcgcctgcctgaagtgtggcaacatcgtgggctaccacgtgattgtgccctgcagcagctgcctgctgagctgcaacaacggccacttctggatgttccacagccaggccgtgtatgacatcaaccggctggacagcactggagtgaatgtgctgctgtggggcaacctgcctgagattgaggagagcacagatgaagatgtgctgaacatctctgctgaggagtgcatcagatag

SEQ ID NO: 38775 - DNA, 330 bp, Artificial Sequence
  Description of Artificial Sequence: Synthetic coding sequence
atgagcaccaacatctgcagcttcaaggacagcgctgtggacttcaccggccgctgctacttcaccaagatctgcaagtgcaagctgaaggacatcgcctgcctgaagtgtggcaacatcgtgggctaccacgtgattgtgccctgcagcagctgcctgcccagctgcaacaacggccacttctggatgttccacagccaggccgtgtatgacatcaaccggctggacagcactggagtgaacatcctgctgtggggcaacctgcctgagattgaggagagcacagatgaagatgtgctgaacatctctgctgaggagtgcatcagatag

SEQ ID NO: 38776 - DNA, 450 bp, Artificial Sequence
  Description of Artificial Sequence: Synthetic coding sequence
atgagcaccaacatctgcagcttcaaggacagatgtgtgtccatcctgtgctgcaagttctgcaagcaggtgctgagcagccggggcatgaaggctgtgctgctggccgacacagaaattgacctcttcagcacagacatcccccccaccaatgctgtggacttcaccggccgctgctacttcaccaagatctgcaagtgcaagctgaaggacatcgcctgcctgaagtgtggcaacatcgtgggctaccacgtgattgtgccctgcagcagctgcctgcccagctgcaacaacggccacttctggatgttccacagccaggccgtgtatgacatcaaccggctggacagcactggagtgaacatcctgctgtggggcaacctgcctgagattgaggagagcacagatgaagatgtgctgaacatctctgctgaggagtgcatcagatag

SEQ ID NO: 38777 - DNA, 363 bp, Artificial Sequence
  Description of Artificial Sequence: Synthetic coding sequence
atgaaggctgtgctgctggccgacacagaaattgacctcttcagcacagacatcccccccaccaatgctgtggacttcaccggccgctgctacttcaccaagatctgcaagtgcaagctgaaggacatcgcctgcctgaagtgtggcaacatcgtgggctaccacgtgattgtgccctgcagcagctgcctgcccagctgcaacaacggccacttctggatgttccacagccaggccgtgtatgacatcaaccggctggacagcactggagtgaacatcctgctgtggggcaacctgcctgagattgaggagagcacagatgaagatgtgctgaacatctctgctgaggagtgcatcagatag

SEQ ID NO: 38778 - DNA, 363 bp, Artificial Sequence; identical to SEQ ID NO: 38777
  Description of Artificial Sequence: Synthetic coding sequence

SEQ ID NO: 38779 - DNA, 222 bp, Artificial Sequence
  Description of Artificial Sequence: Synthetic coding sequence
tgaggaaacatcgtggtgtaccacgtgattgtgccctgcagcagctgcctgctgagctgcaacaacagacacttctggatgttccacagccaggccgtgtatgacatcaaccggctggacagcactggagtgaatgtgctgctgcggggcaacctgcctgagattgaggagagcacagatgaagatgtgctgaacatctctgctgaggagtgcatcagatag

SEQ ID NO: 38780 - DNA, 450 bp, Artificial Sequence
  Description of Artificial Sequence: Synthetic coding sequence
atgagcaccaacatctgcagcttcaaggacagatgtgtgtccatcctgtgctgcaagttctgcaagcaggtgctgagcagccggggcatgaaggctgtgctgctggccgacacagaaattgacctcttcagcacagacatcccccccaccaatgctgtggacttcaccggccgctgctacttcaccaagatctgcaagtgcaagctgaaggacatcgcctgcctgaagtgtggcaacatcgtgggctaccacgtgattgtgccctgcagcagctgcctgctgagctgcaacaacagacacttctggatgttccacagccaggccgtgtatgacatcaaccggctggacagcactggagtgaatgtgctgctgcggggcaacctgcctgagattgaggagagcacagatgaagatgtgctgaacatctctgctgaggagtgcatcagatag

SEQ ID NO: 38781 - DNA, 549 bp, Artificial Sequence
  Description of Artificial Sequence: Synthetic coding sequence
atgaagccctggtgggcccgggactgggccctgcccagccggggccagtgtgtgtgccctggagagaccaatgcctgcctggatgctgagcgggcctgcagagaatgtccccggggcctggaggagacctgggacctgctgagccagctgcagagcctgctgggcacccacctggacaagggggactttggccagctgagcggccctgagcccccaggagaggtgggcaagagggccccagatggagccagccgcagcagcctggagcccatggaggatgctgcccccatcatctacctgctggccagcccagacccccgcatcaagcacccccaggacctggccagcacccccagccctggccccatgaccacctctgtgagcagcctgagcgccagccagcccccagagcccagcctgctgctggagcggcccagccccaagcccccagccctcttcctgacccaccacacccccctcatcctgtggccagccctgctgctgctgcagaagaccagcctgctgctgccctgtggcacccccctgtag

SEQ ID NO: 38782 - DNA, 1026 bp, Artificial Sequence
  Description of Artificial Sequence: Synthetic coding sequence
atggccgccctgtatgcctgcaccaagtgccaccagcgcttcccctttgaggccctgagccagggccagcagctgtgcaaggagtgcagaattgcccaccctgtggtgaagtgcacctactgcaggacagagtaccagcaggagcggctggagtgcaatggcaccatcagcgcccactgcaacctgcacctgcccggcagcagtgacagccctgccagcagcagccgggtggccggcatcaccggcatcaagaccaacaccatctgcaagaagtgtgcccagaatgtgcagctgtatggcacccccaagccctgccagtactgcaacatcatcgccgccttcatcggcaacaagtgccagcgctgcaccaacagcgagaagaagtatggccccccctacagctgtgagcagtgcaagcagcagtgtgcctttgacaggaaggatgacaggaagaaggtggatggcaagctgctgtgctggctgtgcaccctgagctacaagagggtgctgcagaagaccaaggagcagaggaagcacctgagcagcagcagccgggccggccaccaggagaaggagcagtacagccggctgagcggcggcggccactacaacagccagaagaccctgagcaccagcagcatccagaatgagatccccaagaagaagagcaagtttgagagcatcaccaccaatggagacagcttctccccagacctggccctggacagccctggaacagaccactttgtgatcatcgcccagctgaaggaggaggtggccaccctgaagaagatgctgcaccagaaggaccagatgatcctggagaaggagaagaagatcacagagctgaaggctgacttccagtaccaggagagccagatgagggccaagatgaaccagatggagaagacccacaaggaggtgacagagcagctgcaggccaagaaccgggagctgctgaagcaggccgccgccctgagcaagagcaagaagtctgagaagagcggggccatcaccagcccctag

SEQ ID NO: 38783 - DNA, 2352 bp, Artificial Sequence
  Description of Artificial Sequence: Synthetic coding sequence
atggaggatgagcagcctgacagcctggagggctgggtgcctgtgcgggagggcctgtttgctgagcctgagcggcaccggctgcgcttcctggtggcctggaatggagctgagggcaagtttgctgtgacctgccacgacagaacagcccagcagaggcggctgcgggagggcgcccggctgggccctgagcctgagcccaagccagaggccgctgtgagccccagctcctgggccggcctgctgtctgctgctggcctgcggggggcccaccggcagctggccgccctgtggccacccctggagcgctgcttcccccggctgcccccagagctggatgtgggcggcggcggggcctggggcctgggcctgggcctgtgggccctgctgtggcccaccagggctggccctggagaggccgccctgcaggagctgtgtggccagctggagcgctacctgggcgctgctgctgatggctgcggcggggccaccgtgagagatgccctcttccctgctgagggcggcgctgctgactgtgagagcccccgggagttccgggagcgggccctgcgggcccgctgggtggaggctgatgcccggctgcggcaggtgatccagggccacggcaaggccaacaccatggtggccctgatgaatgtgtaccaggaggaggatgaggcctaccaggagctggtgacagtggccaccatgttcttccagtacctgctgcagcccttccgggccatgagggaggtggccaccctgtgcaagctggacatcctgaagagcctggatgaagatgacctgggcccccggcgggtggtggccctggagaaggaggccgaggagtggacccggcgggcagaggaggccgtggtgtccatccaggacatcaccgtgaactacttcaaggagaccgtgaaggccctggccggcatgcagaaggagatggagcaggatgccaagcgcttcggccaggccgcctgggccacagccatcccccggctggagaagctgcagctgatgctggcccgggagaccctgcagctgatgagggccaaggagctgtgcctgaaccacaagagagctgagatccagggcaagatggaggacctgcctgagcaggagaagaacaccaacgtggtggatgagctggagatccagttctatgagatccagctggagctgtatgaggtgaagtttgagatcctgaagaatgaggagatcctgctgaccacccagctggacagcctgaagaggctcatcaaggagaagcaggatgaggtggtgtactatgacccctgtgagaaccctgaggagctgaaggtgattgactgtgtggtgggcctgcaggatgacaagaacctggaggtgaaggagctgcggcggcagtgccagcagctggagagcaagaggggccgcatctgtgccaagagggccagcctgcggagcaggaaggaccagtgcaaggagaaccaccgcttccggctgcagcaggccgaggagagcatccgctacagccggcagcaccacagcatccagatgaagagggacaagatcaaggaggaggagcagaagaagaaggagtggatcaaccaggagcggcagaagaccctgcagaggctgcggagcttcaaggacaagaggctggcccagagcgtgaggaacaccagcggcagcgagcctgtggcccccaacctgcccagcgacctgagccagcagatgtgcctgcctgccagccatgctgtgtctgtcatccaccccagcagcaggaagacccggggcgtgcccctgtctgaggccggaaatgtgaagagccccaagtgccagaactgccacggcaacatccctgtgcaggtgtttgtgcctgtgggggaccagacccacagcaagagcagcgaggagctgagcctgcccccacctcctcctcctcctcctcctcctcctcctcctcctcctcctcctcctccacccctgcgggccctgagcagcagcagccaggccgccacccaccagaacctgggcttccgggcccctgtgaaggatgaccagccccggcccctggtgtgtgagagccctgctgagcggccccgggacagcctggagagcttcagctgccccggctccatggatgaggtgctggccagcctgcggcacggccgggcccagggcgtgaagctgaagaaggtgcacccagacctgggccccaaccccagcagcaagcccaccagcaacagaaggaccagtgacctggagaggagcatcaaggccgccctgcagaggatcaagagggtgtctgctgacagtgaagaagattctgatgagcaggaccccggccagtgggatggatag

SEQ ID NO: 38784 - DNA, 837 bp, Artificial Sequence
  Description of Artificial Sequence: Synthetic coding sequence
atggccgccctgtatgcctgcaccaagtgccaccagcgcttcccctttgaggccctgagccagggccagcagctgtgcaaggagtgcagaattgcccaccctgtggtgaagtgcacctactgcaggacagagtaccagcaggagagcaagaccaacaccatctgcaagaagtgtgcccagaatgtgcagctgtatggcacccccaagccctgccagtactgcaacatcatcgccgccttcatcggcaacaagtgccagcgctgcaccaacagcgagaagaagtatggccccccctacagctgtgagcagtgcaagcagcagtgtgcctttgacaggaaggatgacaggaagaaggtggatggcaagctgctgtgctggctgtgcaccctgagctacaagagggtgctgcagaagaccaaggagcagaggaagcacctgagcagcagcagccgggccggccaccaggagaaggagcagtacagccggctgagcggcggcggccactacaacagcttctccccagacctggccctggacagccctggaacagaccacttcgtcatcatcgcccagctgaaggaggaggtggccaccctgaagaagatgctgcaccagaaggaccagatgatcctggagaaggagaagaagatcacagagctgaaggctgacttccagtaccaggagagccagatgagggccaagatgaaccagatggagaagacccacaaggaggtgacagagcagctgcaggccaagaaccgggagctgctgaagcaggccgccgccctgagcaagagcaagaagtctgagaagagcggggccatcaccagcccctag

SEQ ID NO: 38785 - DNA, 924 bp, Artificial Sequence
  Description of Artificial Sequence: Synthetic coding sequence
atggccgccctgtatgcctgcaccaagtgccaccagcgcttcccctttgaggccctgagccagggccagcagctgtgcaaggagtgcagaattgcccaccctgtggtgaagtgcacctactgcaggacagagtaccagcaggagagcaagaccaacaccatctgcaagaagtgtgcccagaatgtgcagctgtatggcacccccaagccctgccagtactgcaacatcatcgccgccttcatcggcaacaagtgccagcgctgcaccaacagcgagaagaagtatggccccccctacagctgtgagcagtgcaagcagcagtgtgcctttgacaggaaggatgacaggaagaaggtggatggcaagctgctgtgctggctgtgcaccctgagctacaagagggtgctgcagaagaccaaggagcagaggaagcacctgagcagcagcagccgggccggccaccaggagaaggagcagtacagccggctgagcggcggcggccactacaacagccagaagaccctgagcaccagcagcatccagaatgagatccccaagaagaagagcaagtttgagagcatcaccaccaatggagacagcttctccccagacctggccctggacagccctggaacagaccactttgtgatcatcgcccagctgaaggaggaggtggccaccctgaagaagatgctgcaccagaaggaccagatgatcctggagaaggagaagaagatcacagagctgaaggctgacttccagtaccaggagagccagatgagggccaagatgaaccagatggagaagacccacaaggaggtgacagagcagctgcaggccaagaaccgggagctgctgaagcaggccgccgccctgagcaagagcaagaagtctgagaagagcggggccatcaccagcccctag

SEQ ID NO: 38786 - DNA, 684 bp, Artificial Sequence
  Description of Artificial Sequence: Synthetic coding sequence
atggccgccctgtatgcctgcaccaagtgccaccagcgcttcccctttgaggccctgagccagggccagcagctgtgcaaggagtgcagaattgcccaccctgtggtgaagtgcacctactgcaggacagagtaccagcaggagagcaagaccaacaccatctgcaagaagtgtgcccagaatgtgcagctgtatggaacagtggatggcaagctgctgtgctggctgtgcaccctgagctacaagagggtgctgcagaagaccaaggagcagaggaagcacctgagcagcagcagcagagctggccaccaggagaaggagcagtacagccggctgagcggcggcggccactacaacagcttctccccagacctggccctggacagccctggaacagaccactttgtgatcatcgcccagctgaaggaggaggtggccaccctgaagaagatgctgcaccagaaggaccagatgatcctggagaaggagaagaagatcacagagctgaaggctgacttccagtaccaggagagccagatgagggccaagatgaaccagatggagaagacccacaaggaggtgacagagcagctgcaggccaagaaccgggagctgctgaagcaggccgccgccctgagcaagagcaagaagtctgagaagagcggggccatcaccagcccctag

SEQ ID NO: 38787 - DNA, 1020 bp, Artificial Sequence
  Description of Artificial Sequence: Synthetic coding sequence
atggccgccagcgccctgtatgcctgcaccaagtgcacccagcgctacccctttgaggagctgagccagggccagcagctgtgcaaggagtgcagaattgcccaccccatcgtgaagtgcacctactgccgctctgagttccagcaggagagcaagaccaacaccatctgcaagaagtgtgcccagaatgtgaagcagtttggcacccccaagccctgccagtactgcaacatcatcgccgccttcatcggcaccaagtgccagcgctgcaccaacagcgagaagaagtatggccccccccagacctgtgagcagtgcaagcagcagtgtgcctttgacaggaaggaggagggccgcaggaaggtggatggcaagctgctgtgctggctgtgcaccctgagctacaagagggtgctgcagaagaccaaggagcagaggaagagcctgggcagcagccacagcaacagcagcagcagcagcctgacagagaaggaccagcaccaccccaagcaccaccaccaccaccaccaccaccaccaccgccacagcagcagccaccacaagatcagcaacctgagccctgaggaggagcagggcctgtggaagcagagccacaagagcagcgccaccatccagaatgagacccccaagaagaagcccaagctggagagcaagcccagcaatggagacagcagcagcatcaaccagagcgctgacagcggcggcacagacaactttgtgctgatcagccagctgaaggaggaggtgatgagcctgaagaggctgctgcagcagagggaccagaccatcctggagaaggacaagaagctgacagagctgaaggctgacttccagtaccaggagagcaacctgcggaccaagatgaacagcatggagaaggcccacaaggagaccgtggagcagctgcaggccaagaaccgggagctgctgaagcaggtggccgccctgagcaagggcaagaagtttgacaagagcggcagcatcctgaccagcccctag

SEQ ID NO: 38788 - DNA, 843 bp, Artificial Sequence
  Description of Artificial Sequence: Synthetic coding sequence
atgaccagctacatcctgatcagctttgtgctgctgattggagtgggctgcatcgagaaggaccagagctgccctgtgtttggaggcaggaagaggctgcacctgctgtttgtgggcggccagctgcggcaggtgaggatgctgcggggcagccctgaggccagcacagactgctgctggctgcaccaggccactggaagtggctctgtgacccaggccggcgtgcagtggtatgacctgggcagcctgcagcccctgcccccacgcttcaagcgcttcagctgcctgagcctgcccagctcctgggactaccgcagctcctgggagctgcctgacctgcaggagggcaagatccaggccatcagtgacagtgatggagtgaactacccctggtacggcaacaccacagagacctgcaccatcgtgggccccaccaagagggacagcaagttcatcatctccatgaatgacaacttctaccccagcgtgacctgggccgtgcctgtgtctgagagcaatgtggccaagctgaccaacatctacagagaccagagcttcaccacctggctggtggccaccaacaccagcaccaatgacatgatcatcctgcagaccctgcactggaggatgcagctgagcattgaggtgaaccccaaccggcccctgggccagagggcccggctgcgggagcccatcgcccaggaccagcccaagatcctgagcaagaatgagcccatccccccatctgccctggtgaagcccaatgccaatgatgcccaggtgctgatgtggaggcccaagtatggccagcccctggtggtgatcccccccaagcacaggtag

SEQ ID NO: 38789 - DNA, 852 bp, Artificial Sequence
  Description of Artificial Sequence: Synthetic coding sequence
atgcctggcttcttctgtgactgctggcccagcctggagatccgggccctgctgtatgccatgggctgcatccagagcattggaggcaaggcccgggtcttccgggagggcatcaccgtgattgatgtgaaggccagcattgatcctgtgcccaccagcattgatgagagcagctctgtggtgctgcgctaccgcaccccccacttccgggccagcgcccaggtggtgatgccacccatccccaagaaggagacctgggtggtgggctggatccaggcctgcagccacatggagttctacaaccagtatggagagcagggcatgagctcctgggagctgcctgacctgcaggagggcaagatccaggccatcagtgacagtgatggagtgaactacccctggtacggcaacaccacagagacctgcaccatcgtgggccccaccaagagggacagcaagttcatcatctccatgaatgacaacttctaccccagcgtgacctgggccgtgcctgtgtctgagagcaatgtggccaagctgaccaacatctacagagaccagagcttcaccacctggctggtggccaccaacaccagcaccaatgacatgatcatcctgcagaccctgcactggaggatgcagctgagcattgaggtgaaccccaaccggcccctgggccagagggcccggctgcgggagcccatcgcccaggaccagcccaagatcctgagcaagaatgagcccatcccccccagcgccctggtgaagcccaatgccaatgatgcccaggtgctgatgtggaggcccaagtatggccagcccctggtggtgattcctcccaagcacaggtag

SEQ ID NO: 38790 - DNA, 759 bp, Artificial Sequence
  Description of Artificial Sequence: Synthetic coding sequence
ggccagggcattgctgctgccctgatccacctgcccagcacaggcaacaagcactggaggcccaggagccctgaggccagcacagactgctgctggctgcaccaggccactggaagtggctctgtgacccaggccggcgtgcagtggtatgacctgggcagcctgcagcccctgcccccacgcttcaagcgcttcagctgcctgagcctgcccagctcctgggactaccgcagctcctgggagctgcctgacctgcaggagggcaagatccaggccatcagtgacagtgatggagtgaactacccctggtacggcaacaccacagagacctgcaccatcgtgggccccaccaagagggacagcaagttcatcatctccatgaatgacaacttctaccccagcgtgacctgggccgtgcctgtgtctgagagcaatgtggccaagctgaccaacatctacagagaccagagcttcaccacctggctggtggccaccaacaccagcaccaatgacatgatcatcctgcagaccctgcactggaggatgcagctgagcattgaggtgaaccccaaccggcccctgggccagagggcccggctgcgggagcccatcgcccaggaccagcccaagatcctgagcaagaatgagcccatccccccatctgccctggtgaagcccaatgccaatgatgcccaggtgctgatgtggaggcccaagtatggccagcccctggtggtgatcccccccaagcacaggtag

SEQ ID NO: 38791 - DNA, 786 bp, Artificial Sequence
  Description of Artificial Sequence: Synthetic coding sequence
atgggctgcatccagagcatcacctgcaaggcccgcatccggcgggagaacatcgtggtgtatgatgtgtgtgccaccatcgaccagtgccccacccgcatcgaggagaccagccccatcgtgctgcgctacaagaccccctacttcaaggccagcgcccgggtggtgatgccacccatccccaggcatgagacctgggtggtgggctggatccaggcctgcaaccagatggagttcttcaacacctacagcgacctgggcatgagctcctgggagctgcctgacctgcgggagggccgggtgaaggccatcagtgacagtgatggagtgtcctacccctggtacggcaacaccacagaaacagtgaccctggtgggccccaccaacaagatcagccgcttctctgtgtccatgaatgacaacttctaccccagcgtgacctgggccgtgcctgtgtctgacagcaatgtgcccctgctgacccgcatcaagagggaccagagcttcaccacctggctggtggccatgaacaccaccaccaaggagaagatcatcctgcagaccatcaagtggaggatgagggtggacatcgaggtggaccccctgcagctgctgggccagagggcccggctggtgggccgcacccagcaggagcagccccgcatcctgagcaggatggagcccatccccccaaatgccctggtgaagcccaatgccaatgatgcccaggtgctgatgtggaggcccaagaggggcccccccctggtggtgattcctcccaagtag

SEQ ID NO: 38792 - DNA, 786 bp, Artificial Sequence; identical to SEQ ID NO: 38791
  Description of Artificial Sequence: Synthetic coding sequence

SEQ ID NO: 38793 - DNA, 1107 bp, Artificial Sequence
  Description of Artificial Sequence: Synthetic coding sequence
atggagaacatgcacctgcggcgggtgaggaccatgcccaggcacagccagagcctgaccatggccccctacagctctgtgtccctggtggagcagctggaggaccgcatcctgtgccacgagaagaccacagctgccctggtggagcacgccttccgcatcaaggatgacatcgtgaacagcctgcagaagatgcagaacaagggcggcggggaccggctggcccggctcttcctggaggagcacatccggaacatcacagccatcgtgaagcagctgaacagagacatcgaggtgctgcaggagcagatccgggcccgggacaacatctcctatggcaccaacagcgccctgaagaccctggagatgaggcagctgagcggcctgggggacctgcggggccgggtggcccgctgtgatgccagcatcgcccggctgtctgctgagcacaagaccacctatgagggcctgcagcacctgaacaaggagcagcaggccgccaagctgatcctggagaccaagatcaaggatgctgagggccagatcagccagctgctgaacagagtggacctgagcatcagcgagcagagcaccaagctgaagatgagccaccgggacagcaaccaccagctgcagctgctggacaccaagttcaagggcaccgtggaggagctgagcaaccagatcctgagcgcccgctcctggctgcagcaggagcaggagagaattgagaaggagctgctgcagaagattgaccagctgagcctgattgtgaaggagaacagcggggccagcgagcgggacatggagaagaagctgagccagatgtctgcccggctggacaagattgaggagggccagaagaagacctttgatggccagaggacccggcaggaggaggagaagatgcacggccgcatcaccaagctggagctgcagatgaaccagaacatcaaggagatgaaggccgaggtgaatgccggcttcaccgctgtgtatgagagcatcggcagcctgcggcaggtgctggaggccaagatgaagctggaccgggaccagctgcagaagcagatccagctgatgcagaagccagagacccccatgtag

SEQ ID NO: 38794 - DNA, 207 bp, Artificial Sequence
  Description of Artificial Sequence: Synthetic coding sequence
atggagaacatgcacctgcggcgggtgaggaccatgcccaggcacagccagagcctgaccatggccccctacagctctgtgtccctggtggagcagctggaggaccgcatcctgtgccacgagaagaccacagctgccctggtggagcacgccttccgcatcaaggatgacatcgtgaacagcctgcagaagatgcagaacaagtag

SEQ ID NO: 38795 - DNA, 327 bp, Artificial Sequence
  Description of Artificial Sequence: Synthetic coding sequence
atggagaacatgcacctgcggcgggtgaggaccatgcccaggcacagccagagcctgaccatggccccctacagctctgtgtccctggtggagcagctggaggaccgcatcctgtgccacgagaagaccacagctgccctggtggagcacgccttccgcatcaaggatgacatcgtgaacagcctgcagaagatgcagaacaagggcggcggggaccggctggcccggctcttcctggaggagcacatccggaacatcacagccatcgtgaagcagctgaacagagacatcgaggtgctgcaggagcagatccgggcccgggactag

SEQ ID NO: 38796 - DNA, 204 bp, Artificial Sequence
  Description of Artificial Sequence: Synthetic coding sequence
atggagaacatgcacctgcggcgggtgaggaccatgcccaggcacagccagagcctgaccatggccccctacagctctgtgtccctggtggagcagctggaggaccgcatcctgtgccacgagaagaccacagctgccctggtggagcacgccttccgcatcaaggatgacatcgtgaacagcctgcagaagatgcagaactag

SEQ ID NO: 38797 - DNA, 348 bp, Artificial Sequence
  Description of Artificial Sequence: Synthetic coding sequence
atggagaacatgcacctgcggcgggtgaggaccatgcccaggcacagccagagcctgaccatggccccctacagctctgtgtccctggtggagcagctggaggaccgcatcctgtgccacgagaagaccacagctgccctggtggagcacgccttccgcatcaaggatgacatcgtgaacagcctgcagaagatgcagaacaagggcggcggggaccggctggcccggctcttcctggaggagcacatccggaacatcacagccatcgtgaagcagctgaacagagacatcgaggtgctgcaggagcagatccgggcccgggacaacatctcctatggcaccaactag

SEQ ID NO: 38798 - DNA, 177 bp, Artificial Sequence
  Description of Artificial Sequence: Synthetic coding sequence
atggagaacatgcacctgcggcgggtgaggaccatgcccaggcacagccagagcctgaccatggccccctacagctctgtgtccctggtggagcagctggaggaccgcatcctgtgccacgagaagaccacagctgccctggtggagcacgccttccgcatcaaggatgacatctag

SEQ ID NO: 38799 - DNA, 402 bp, Artificial Sequence
  Description of Artificial Sequence: Synthetic coding sequence
atggagaacatgcacctgcggcgggtgaggaccatgcccaggcacagccagagcctgaccatggccccctacagctctgtgtccctggtggagcagctggaggaccgcatcctgtgccacgagaagaccacagctgccctggtggagcacgccttccgcatcaaggatgacatcgtgaacagcctgcagaagatgcagaacaagggcggcggggaccggctggcccggctcttcctggaggagcacatccggaacatcacagccatcgtgaagcagctgaacagagacatcgaggtgctgcaggagcagatccgggcccgggacaacatctcctatggcaccaacagcgccctgaagaccctggagatgaggcagctgagcggcctgggggacctgaggtag

SEQ ID NO: 38800 - DNA, 351 bp, Artificial Sequence
  Description of Artificial Sequence: Synthetic coding sequence
atggagaacatgcacctgcggcgggtgaggaccatgcccaggcacagccagagcctgaccatggccccctacagctctgtgtccctggtggagcagctggaggaccgcatcctgtgccacgagaagaccacagctgccctggtggagcacgccttccgcatcaaggatgacatcgtgaacagcctgcagaagatgcagaacaagggcggcggggaccggctggcccggctcttcctggaggagcacatccggaacatcacagccatcgtgaagcagctgaacagagacatcgaggtgctgcaggagcagatccgggcccgggacaacatctcctatggcaccaacagctag

SEQ ID NO: 38801 - DNA, 1359 bp, Artificial Sequence
  Description of Artificial Sequence: Synthetic coding sequence
atgcagctgcagttcctgggcaccctggccagcagcgagaagaggaagaagagccagaggctcttcttcaagaacatcaagagcaccaagaacaaggccggcaaggccagcatcatgagcagtgacaccaacgtgaacaagagcgccagccccacagccacagctgaggagcagcctgtggagccagatggccccctgcccggcagtgacaacaaccaggagaagaaggtgcggctgagccctgccaagatgagcaccaagaacagcacagacctggtggagtatgtggacaagagccacgccttcctgcccatcatccccaacacccagaggggccagctggaggaccggctgaacaaccaggcccggaccatcgccttcctgctggagcaggccttccgcatcaaggaggacatcagcgcctgcctgcagggcacccacggcttcaggaaggaggagagcctggccaggaagctgctggagagccacatccagaccatcaccagcatcgtgaagaagctgagccagaacatcgagatcctggaggaccagatccgggcccgggaccaggccgccaccggcaccaactttgctgtgcatgagatcaacatcaagcacctgcagggcgtgggggacctgcggggccgggtggcccgctgtgacagcagcatcgtgaagctgagcggggacatccacctgttccggcaggagcaccggcagatcgagaaggccatccaggagtttgtgcctgccctggagaccctgagcaagaacctggacatgaaggtgatgcagctgctgggcaagattgaaacagccagccctgagcagaccagcaacctgaagatggtgcagggcgactacagacatgagatgaacctgctggagttcaagttccacagcctgagcagcaacctgtatgaggaggtggagaacaacaagaagtggacagagaaccagttcctgaagtacaggaaggaccacctgggccacatcaatgaatgtctgaaggtgctgcaggagaagctggagaagtctgagaacaagatggaggagaagctgctgcagctgagcagcaaggtggagaacttcatcaacacccagaagcaggagacccagctgagcaaggtgaagcacatggagaacaagctgagcaagaagatggagcagatggagaagcagatctggggcgagctggagaccatgcagaatgagtaccagagcggcttcaagagcatccatgacagcctgagcagcctgcagcagatccagaagaccaagatggacctggagaagtacaaggtgcagaaggacctgaagaagctgcagaggaagatcgtggagctgcaggaggtgtag

SEQ ID NO: 38802 - DNA, 1104 bp, Artificial Sequence
  Description of Artificial Sequence: Synthetic coding sequence
atgagccgcagccgccacctgggcaagatcaggaagaggctggaggatgtgaagagccagtgggtgcggcctgcccgggctgacttcagtgacaatgaaagtgcccggctggccacagatgccctgctggatggcggcagcgaggcctactggagggtgctgagccaggagggggaggtggacttcctgagctctgtggaggcccagtacatccaggcccaggcccgggagcccccctgccccccagacaccctgggcggcgctgaggccggccccaagggcctggacagcagcagcctgcagagcggcacctacttccctgtggccagcgagggcagcgagcccgccctgctgcacagctgggccagcgctgagaagccctacctgaaggagaagagcagcgccaccgtgtacttccagacagtgaagcacaacaacatccgggacctggtgcggcgctgcatcaccaggaccagccaggtgctggtgatcctgatggatgtgttcacagatgtggagatcttctgtgacatcctggaggccgccaacaagaggggcgtgtttgtgtgtgtgctgctggaccagggcggcgtgaagctgttccaggagatgtgtgacaaggtgcagatcagtgacagccacctgaagaacatcagcatccgctctgtggagggggagatctactgtgccaagagcggcaggaagtttgctggccagatccgggagaagttcatcatcagtgactggaggtttgtgctgagcggcagctacagcttcacctggctgtgtggccacgtgcacaggaacatcctgagcaagttcaccggccaggccgtggagctgtttgatgaggagttccgccacctgtatgccagcagcaagcctgtgatgggcctgaagagcccccggctggtggcccctgtgcccccaggggccgccccagccaacggccgcctgagcagcagcagcggcagcgccagtgacaggaccagcagcaaccccttcagcggccgctctgctggcagccaccctgtgcctgagagcaagcagaacaagaccaagaccaagaagcagaccaccctgtggttcctgatggccttctag

SEQ ID NO: 38803 - DNA, 1305 bp, Artificial Sequence
  Description of Artificial Sequence: Synthetic coding sequence
atgagccgcagccgccacctgggcaagatcaggaagaggctggaggatgtgaagagccagtgggtgcggcctgcccgggctgacttcagtgacaatgaaagtgcccggctggccacagatgccctgctggatggcggcagcgaggcctactggagggtgctgagccaggagggggaggtggacttcctgagctctgtggaggcccagtacatccaggcccaggcccgggagcccccctgccccccagacaccctgggcggcgctgaggccggccccaagggcctggacagcagcagcctgcagagcggcacctacttccctgtggccagcgagggcagcgagcccgccctgctgcacagctgggccagcgctgagaagccctacctgaaggagaagagcagcgccaccgtgtacttccagacagtgaagcacaacaacatccgggacctggtgcggcgctgcatcaccaggaccagccaggtgctggtgatcctgatggatgtgttcacagatgtggagatcttctgtgacatcctggaggccgccaacaagaggggcgtgtttgtgtgtgtgctgctggaccagggcggcgtgaagctgttccaggagatgtgtgacaaggtgcagatcagtgacagccacctgaagaacatcagcatccgctctgtggagggggagatctactgtgccaagagcggcaggaagtttgctggccagatccgggagaagttcatcatcagtgactggaggtttgtgctgagcggcagctacagcttcacctggctgtgtggccacgtgcacaggaacatcctgagcaagttcaccggccaggccgtggagctgtttgatgaggagttccgccacctgtatgccagcagcaagcctgtgatgggcctgaagagcccccggctggtggcccctgtgcccccaggggccgccccagccaacggccgcctgagcagcagcagcggcagcgccagtgacaggaccagcagcaaccccttcagcggccgctctgctggcagccaccctggcaccaggtctgtgtctgccagcagcggcccctgcagccctgctgccccccaccccccacctccaccccgcttccagccccaccagggcccctggggcgcccccagcccccaggcccacctgagcccccggccccatgatggccccccagctgctgtgtacagcaacctgggcgcctaccggcccacccggctgcagctggagcagctgggcctggtgccccggctgacccccacctggaggcccttcctgcaggccagcccccacttctag

SEQ ID NO: 38804 - DNA, 1305 bp, Artificial Sequence; identical to SEQ ID NO: 38803
  Description of Artificial Sequence: Synthetic coding sequence

SEQ ID NO: 38805 - DNA, 885 bp, Artificial Sequence
  Description of Artificial Sequence: Synthetic coding sequence
atgagccgcagccgccacctgggcaagatcaggaagaggctggaggatgtgaagagccagtgggtgcggcctgcccgggctgacttcagtgacaatgaaagtgcccggctggccacagatgccctgctggatggcggcagcgaggcctactggagggtgctgagccaggagggggaggtggacttcctgagctctgtggaggcccagtacatccaggcccaggcccgggagcccccctgccccccagacaccctgggcggcgctgaggccggccccaagggcctggacagcagcagcctgcagagcggcacctacttccctgtggccagcgagggcagcgagcccgccctgctgcacagctgggccagcgctgagaagccctacctgaaggagaagagcagcgccaccgtgtacttccagacagtgaagcacaacaacatccgggacctggtgcggcgctgcatcaccaggaccagccagaacatcagcatccgctctgtggagggggagatctactgtgccaagagcggcaggaagtttgctggccagatccgggagaagttcatcatcagtgactggaggtttgtgctgagcggcagctacagcttcacctggctgtgtggccacgtgcacaggaacatcctgagcaagttcaccggccaggccgtggagctgtttgatgaggagttccgccacctgtatgccagcagcaagcctgtgatgggcctgaagagcccccggctggtggcccctgtgcccccaggggccgccccagccaacggccgcctgagcagcagcagcggcagcgccagtgacaggaccagcagcaaccccttcagcggccgctctgctggcagccaccctggcaccaggacagatggatag

SEQ ID NO: 38806 - DNA, 1104 bp, Artificial Sequence; identical to SEQ ID NO: 38802
  Description of Artificial Sequence: Synthetic coding sequence

SEQ ID NO: 38807 - DNA, 885 bp, Artificial Sequence; identical to SEQ ID NO: 38805
  Description of Artificial Sequence: Synthetic coding sequence

SEQ ID NO: 38808 - DNA, 3036 bp, Artificial Sequence
  Description of Artificial Sequence: Synthetic coding sequence
atggagaccagctccatgctgagcagcctgaatgatgagtgcaagagtgacaactacatcgagccccactacaaggagtggtacagagtggccatcgacatcctgattgagcacggcctggaggcctaccaggagttcctggtgcaggagcgggtgtctgacttcctggccgaggaggagatcaactacatcctgaagaatgtgcagaaggtggcccagagcacagcccatggaacagatgacagctgtgatgacaccctgagcagcggcacctactggcctgtggagagtgatgtggaggcccccaacctggacctgggctggccctacgtgatgcctggcctgctgggcggcacccacatcgacctgctcttccaccccccccgggcccacctgctgaccatcaaggagaccatcaggaagatgatcaaggaggccaggaaggtgattgccctggtgatggacatcttcacagatgtggacatcttcaaggagatcgtggaggccagcacccggggcgtgtctgtgtacatcctgctggatgagagcaacttcaaccacttcctgaacatgacagagaagcagggctgcagcgtgcagaggctgaggaacatccgggtgaggacagtgaagggccaggactacctgagcaagacaggagccaagttccacggcaagatggagcagaagttcctgctggtggactgccagaaggtgatgtatggcagctacagctacatgtggagctttgagaaggcccacctgtccatggtgcagatcatcaccggccagctggtggagagctttgatgaggagttccgcaccctgtatgcccggagctgtgtgcccagcagctttgcccaggaggagagcgcccgggtgaagcacggcaaggccctgtgggagaatggcacctaccagcacagcgtgagcagcctggcctctgtgagcagccagaggaacctgtttggccggcaggacaagatccacaagctggacagcagctacttcaagaacagaggcatctacaccctgaatgaacatgacaagtacaacatccgcagccacggctacaagccccactttgtgcccaacttcaacggccccaatgccatccggcagttccagcccaaccagatcaatgaaaactggaagaggcacagctatgctggggagcagcctgagaccgtgccctacctgctgctgaacagagccctgaacagaaccaacaaccccccaggcaactggaagaagcccagcgacagcctgtctgtggccagcagcagccgggagggctacgtgagccaccacaacaccccagcccagagctttgccaaccggctggcccagaggaagaccaccaacctggccgacaggaacagcaatgtgcggcgctccttcaacggcacagacaaccacatccgcttcctgcagcagaggatgcccaccctggagcacaccaccaagagcttcctgaggaactggagaattgagagctacctgaatgaccacagcgaggccaccccagacagcaatggcagcgccctgggggacagatttgagggctatgacaaccctgagaacctgaaggccaatgccctgtacacccacagccggctgcggagcagcctggtgttcaagcccaccctgcctgagcagaaggaggtgaacagctgcaccaccggcagcagcaacagcaccatcatcggcagccagggcagcgagacccccaaggaggtgcctgacacccccaccaacgtgcagcacctgacagacaagcccctgcctgagagcatccccaagctgcccctgcagagcgaggcccccaagatgcacaccctgcaggtgcctgagaaccacagcgtggccctgaaccagaccaccaacggccacacagagagcaacaactacatctacaagaccctgggcgtgaacaagcagacagagaacctgaagaaccagcagacagagaacctgctgaagaggaggagcttccccctgtttgacaacagcaaggccaacctggaccccggcaacagcaagcactacgtgtacagcaccctgaccaggaacagagtgcggcagcctgagaagcccaaggaggacctgctgaagagcagcaagtccatgcacaacgtgacccacaacctggaggaggatgaggaggaggtgaccaagaggaacagccccagcggcaccaccaccaagtctgtgtccattgctgccctgctggatgtgaacaaggaggagagcaacaaggagctggccagcaagaaggaggtgaagggcagccccagcttcctgaagaagggcagccagaagctgcggagcctgctgagcctgaccccagacaagaaggagaacctgagcaagaacaaggccccagccttctaccgcctgtgcagcagcagtgacaccctggtgtctgagggggaggagaaccagaagcccaagaagagtgacaccaaggtggacagcagccccaggaggaagcacagcagcagcagcaacagccagggcagcatccacaagagcaaagaagatgtgacagtgagccccagccaggagatcaatgcccccccagatgagaacaagaggacccccagccctggccctgtggagagcaagttcctggagagagctggagatgccagcgccccccgcttcaacacagagcagatccagtacagagacagccgggagatcaatgctgtggtgaccccagagcggcggcccaccagcagcccccggcccaccagcagcgagctgctgcggagccacagcacagacagaagagtgtacagcagatttgagcccttctgcaagattgagagcagcatccagcccaccagcaacatgcccaacaccagcatcaacagacctgagatcaagagcgccaccatgggcaacagctatggccgcagcagccccctgctgaactacaacacaggagtgtaccgcagctaccagcccaatgaaaacaagttccggggcttcatgcagaagtttggaaacttcatccacaagaacaagtag

SEQ ID NO: 38809 - DNA, 2244 bp, Artificial Sequence
  Description of Artificial Sequence: Synthetic coding sequence
atgtttggaggccctggccctggggtgctgggcgcccagggcatggccggccccctgcggggccgggtggaggagctgaagctgccctggtggagggagagcagccccctggtgctgcggcacagcgaggccgcccggctggccgcagatgccctgctggagcggggggaggccgcctacctgcgggtcatcagcgaggagcgggagctgcccttcctgagcgccctggatgtggactacatgaccagccacgtgcggggcggccctgagctgtctgaggcccagggccaggaggccagcggccctgaccggctgagcctgctgtctgaggtgaccagcggcacctacttccccatggccagtgacattgatcctccagacctggacctgggctggccagaggtgccccaggccaccggcttcagccccacccaggccgtggtgcacttccagagggacaaggccaagaacatcaaggacctgctgcgcttcctgttcagccaggcccacacagtggtggccgtggtgatggacatcttcacagacatggagctgctgtgtgacctgatggaggccagcagcagaagaggagtgcctgtgtacctgctgctggcccaggagcacctgcggcacttcctggagatgtgctacaagatggacctgaatggagagcacctgcccaacatgagggtgcgcagcacctgtggggacacctactgcagcaaggccggccgccgcttcaccggccaggccctggagaagtttgtgctgattgactgtgagcaggtggtggccggcagctacagcttcacctggctgtgcagccaggcccacacctccatggtgctgcagctgcggggcagaattgtggaggactttgaccgggagttccgctgcctgtatgcagagagccagcctgtggagggcttctgtggcggggaggaccccctgagcccccgggccctgcggcccccacctgtggccctggccttccggccagatgtgcccagccccaccagcagcctgcccagcagcaccagcctgagcagcatcaagcagagccccctgatgggccgcagcagctacctggccctgcccggcggcggggactgcagcgacaccggggtggtgagcagcagcctgggccctgcccggcgggaggccagcggccagcccagcctgcaccggcagctgagtgaccccaaccacggcagccccccaggcctgtaccgggccaacctgggcaagctgggcgcctacccctggagccagagcagccctgccctgaaccacaacagcaccagccccctgaccctggccgtgggcagccccctgctgcccaggagccggcccctgctgcagttccacagaggagccccagccctgagccgcttcccagaaaatggcctgcccggcagccaggagcccagccccctgcggggccgctgggtgcccggcaccaccctggagaccgtggaggagaaggagaagaaggccagccccagccagagccggggccagctggacctgctggtgcccttcccccgggcccgggaggtgggggaccctgattctggagtgacccccaacagcggccccctgcggcctggagagcaggcccctgaggaccggcggctgagccccagccaggccgacagccagctggacctgctgagccgggccctgggcaccggcggggcccctgagctgggcagcctgcggcctggggaccgggccctggaggaccggcggctgagcctgaaccagagccggggccagagcgacctgctgatgcagtaccccaaggcccagggcagccgggtgcccctggagaccaacagcagcgcccggcctgcccggcgggccccagatgagcggcggcagaccctgggccacagccagctggacctgatcaccaagtttggccccttccggggggagggccctggccccaacggcctgcccatcagcagccctgccaggacagctggagctggcagcggagatgagaagaggctgaccctgggccacagcaagctggacctgatcaccaagtaccaccagctgcacggggcccggcagggcacagagcccggcggccccaagggcggccacctgaatggaggcaacagcgacctggtgagagatgagaagaggctgaccctgggccacagcaagctggacctgatcaccaagtacaacaagagcaagttcaagcagctgcggagcagatttgagagctag

SEQ ID NO: 38810 - DNA, 1437 bp, Artificial Sequence
  Description of Artificial Sequence: Synthetic coding sequence
atggccgccagccagctggccgccctggagggcgtggacagcggcccccgggtgcctggggccagccctggcttcctgtacagcgagggccagaggctggccctggaggccctgctgagcaaaggagctgaggccttccagacctgtgtgcagcgggaggagctgtggcccttcctgtctgcagatgaggtgcagggcctggccgctgctgctgaggactggacagtggccaagcaggagcccagcggcatggccgagggcgccaccaccacagatgtggatgctggcagcctgagctactggccaggccagagcgagcagcctgcccctgtgctgcggctgggctggcctgtggacagcgcctggaagggcatcacccgggcccagctgtacacccagcccccaggagagggccagccccccctgaaggagctggtgcggctggagatccaggccgcccacaagctggtggccgtggtgatggatgtgttcacagatcctgacctgctgctggacctggtggatgctgccacccggcgctgggtgcctgtgtacctgctgctggaccggcagcagctgcctgccttcctggagctggcccagcagctgggcgtgaacccctggaacacagaaaatgtggatgtgcgggtggtgcggggctgcagcttccagagccgctggaggcggcaggtgtctggcaccgtgcgggagaagtttgtgctgctggatggagagagggtcatcagcggcagctacagcttcacctggagcgatgcccggctgcaccggggcctggtgaccctgctgaccggggagatcgtggatgccttcagcctggagttccgcaccctgtatgctgccagctgccccctgcccccagccccaccccagaagcccagcgtcatcggcggcctgcagaggggccgcagcccccaccgggtgtccagaagaagatctgtggccccagccagccccccacctccagatggccccctggcccaccggctggccgcctgccgggtgtccccagccaccccaggccctgccctgagtgacatcctgcggtctgtgcagagggcccggacccccagcggccccccagcccggcccagccgctccatgtgggacctgagccggctgagccagctgagcggcagcagtgatggagacaatgagctgaagaagtcctggggcagcaaggacaccccagccaaggccctgatgaggcagaggggcactggaggcggcccctggggcgaggtggacagcaggcctccctggggcggggccctgcccctgcccccagcccaccggctgcgctacctgagccctgccaggagaagatttggaggagatgccaccttcaagctgcaggagccccggggcgtgcggcccagcgactgggccccccgggccggcctgggcggccagccctag

SEQ ID NO: 38811 - DNA, 1503 bp, Artificial Sequence
  Description of Artificial Sequence: Synthetic coding sequence
atggccgagagccagctgaactgcctggatgaggcccacgtgaatgagaaggtgacagaggcccaggccgccttctactactgtgagaggagaagagctgccctggaggccctgctgggcggcggggagcaggcctaccgggagcggctgaaggaggagcagctgcgggacttcctgagcagccctgagcggcaggccctgcgggccgcctggagcccctatgaagatgctgtgcctgctgccaatgcccggggcaagagcaaggccaaggccaaggccccagccccagccccagctgagagcggggagagcctggcctactggccagacagaagtgacacagaggtgccccccctggacctgggctggacagacaccggcttctacagaggagtgtcccgggtgaccctcttcacccacccccccaaggatgagaaggccccccacctgaagcaggtggtgcggcagatgatccagcaggcccagaaggtgattgctgtggtgatggacctcttcacagatggagacatcttccaggacatcgtggatgctgcctgcaagagaagagtgcctgtgtacatcatcctggatgaagctggggtgaagtacttcctggagatgtgccaggacctgcagctgacagacttccgcatccggaacatccgggtgcgctctgtgactggagtgggcttctacatgcccatgggccgcatcaagggcaccctgagcagccgcttcctgatggtggatggagacaaggtggccaccggcagctaccgcttcacctggagcagcagccacgtggacaggaacctgctgctgctgctgaccggccagaatgtggagccctttgacacagagttccgggagctgtatgccatcagcgaggaggtggacctgtaccggcagctgagcctggccggccgggtgggcctgcactacagcagcacagtggccaggaagctgatcaaccccaagtatgccctggtgtctggctgccgccaccccccaggagagatgatgcgctgggccgcccggcagcagcgggaggccggcggcaaccctgagggccaggaggagggcgccagcggcggggagagcgcctggaggctggagagcttcctgaaggacctggtgacagtggagcaggtgctgccccctgtggagcccatccccctgggggagctgagccagaaggatggccgcatggtgagccacatgcaccgggacctgaagcccaagagccgggaggcccccagcagaaatggcatgggagaggccgcccggggggaggccgccccagcccggcgcttcagcagccgcctcttcagcagaagagccaagaggcctgctgcccccaacggcatggccagctctgtgtccacagagaccagcgaggtggagttcctgaccgggaagaggcccaatgaaaacagcagcgctgacatcagcggcaagaccagccccagcagcgccaagcccagcaactgtgtgatctcctag

SEQ ID NO: 38812 - DNA, 2472 bp, Artificial Sequence
  Description of Artificial Sequence: Synthetic coding sequence
atggccttcagccaggtgcagtgcctggatgacaaccacgtgaactggaggagcagcgagagcaagccagagttcttctacagcgaggagcagaggctggccctggaggccctggtggcccggggcagagatgccttctatgaggtgctgaagcgggagaacatccgggacttcctgtctgagctggagctgaagaggatcctggagaccatcgaggtgtatgaccccggcagcgaggacccccggggcaccggccccagccagggcccagaagataatggagtgggagatggagaggaggccagcggggctgatggagtgcccattgaagctgagcccctgcccagcctggagtactggccccagaagagtgacaggagcatcccccagctggacctgggctggccagacaccatcgcctacagaggagtgacccgggcctctgtgtacatgcagccccccattgatggccaggcccacatcaaggaggtggtgaggaagatgatcagccaggcccagaaggtgattgctgtggtgatggacatgttcacagatgtggacatcttcaaggacctgctggatgctggcttcaagaggaaggtggccgtgtacatcatcgtggatgagagcaatgtgaagtacttcctgcacatgtgtgagcgggcctgcatgcacctgggccacctgaagaacctgcgggtgcgcagcagcggcggcacagagttcttcaccaggtctgccaccaagttcaagggggccctggcccagaagttcatgtttgtggatggagacagagctgtgtgtggcagctacagcttcacctggagcgctgccaggacagacagaaatgtcatctctgtgctgagcggccaggtggtggagatgtttgaccggcagttccaggagctgtacctgatgagccacagcgtgtccctgaagggcatccccatggagaaggagcctgagcctgagcccatcgtgctgcccagcgtggtgcccctggtgcctgctggcaccgtggccaagaagctggtgaaccccaagtatgccctggtgaaggccaagtctgtggatgagatcgccaagatcagcagcgagaagcaggaggccaagaagcccctgggcctgaagggccctgccctggccgagcaccctggagagctgcctgagctgctgccccccatccaccctggcctgctgcacctggagcgggccaacatgtttgagtacctgcccacctgggtggagccagaccctgagcccggcagtgacatcctgggctacatcaacatcatcgaccccaacatctggaacccccagcccagccagatgaaccgcatcaagatccgggacaccagccaggccagcgcccagcaccagctgtggaagcagagccaggacagccggcccaggcctgagccctgccccccacctgagcccagcgccccccaggatggagtgcctgcagaaaatggcctgccccagggcgaccctgagcccctgccccctgtgcccaagcccaggacagtgcctgtggctgatgtgctggcccgggacagcagtgacatcggctgggtgctggagctgcccaaggaggaggccccccagaatggaacagaccaccggctgcccaggatggccggccctggccacgcccccctgcagaggcagctgtctgtgacccaggatgatcctgagagcctgggcgtgggcctgcccaacggcctggatggagtggaggaggaggatgatgatgattatgtgaccctgagtgaccaggacagccacagcggcagcagcggccggggccctggcccccggcggcccagcgtggccagctctgtgtctgaggagtactttgaggtgcgggagcacagcgtgcccctgcggcggcggcacagcgagcaggtggccaacggccccaccccaccaccccggcggcagctgagcgccccccacatcacccggggcacctttgtgggcccccagggcggcagcccctgggcccagagccggggccgggaggaggctgatgccctgaagaggatgcaggcccagaggagcacagacaaggaggcccagggccagcagttccaccaccaccgggtgcctgccagcggcacccgggacaaggatggcttccctggccccccacgctacagatctgctgctgacagcgtgcagagcagcaccagaaatgccggccctgccatggccggcccccaccactggcaggccaagggcggccaggtgccccggctgctgcctgaccccggcagcccccggctggcccagaatgcccggcccatgacagatggccgggccacagaggagcaccccagccccttcggcatcccctacagcaagctgagccagagcaagcacctgaaggccaggactggaggcagccagtgggccagcagtgacagcaagaggcgggcccaggccccccgggacaggaaggacccctag

SEQ ID NO: 38813 - DNA, 2472 bp, Artificial Sequence; identical to SEQ ID NO: 38812
  Description of Artificial Sequence: Synthetic coding sequence

SEQ ID NO: 38814 - DNA, 819 bp, Artificial Sequence
  Description of Artificial Sequence: Synthetic coding sequence
atggccttcagccaggtgcagtgcctggatgacaaccacgtgaactggaggagcagcgagagcaagccagagttcttctacagcgaggagcagaggctggccctggaggccctggtggcccggggcagagatgccttctatgaggtgctgaagcgggagaacatccgggacttcctgtctgagctggagctgaagaggatcctggagaccatcgaggtgtatgaccccggcagcgaggacccccggggcaccggccccagccagggcccagaagataatggagtgggagatggagaggaggccagcggggctgatggagtgcccattgaagctgagcccctgcccagcctggagtactggccccagaagagtgacaggagcatcccccagctggacctgggctggccagacaccatcgcctacagaggagtgacccgggcctctgtgtacatgcagccccccattgatggccaggcccacatcaaggaggtggtgaggaagatgatcagccaggcccagaaggtgattgctgtggtgatggacatgttcacagatgtggacatcttcaaggacctgctggatgctggcttcaagaggaaggtggccgtgtacatcatcgtggatgagagcaatgtgaagtacttcctgcacatgtgtgagcgggcctgcatgcacctgggccacctgaagaacctgcgggtgcgcagcagcggcggcacagagttcttcaccaggtctgccaccaagttcaagggggccctggcccagaagttcatgtttgtggatggagacagagctgtgtgtggcagctacagatag

SEQ ID NO: 38815 - DNA, 879 bp, Artificial Sequence
  Description of Artificial Sequence: Synthetic coding sequence
atgggcaaccagctggaccgcatcacccacctgaactacagcgagctgcccaccggggaccccagcggcatcgagaaggatgagctgcgggtgggcgtggcctacttcttcagtgatgatgaggaggacctggatgagcggggccagcctgacaagtttggagtgaaggcccctcctggctgcaccccctgcccagagagccccagccgccaccaccaccacctgctgcaccagctggtgctgaatgagacccagttcagcgccttccggggccaggagtgcatcttcagcaaggtgtctgggggcccccagggcgctgacctgtctgtgtatgctgtgacagccctgcctgccctgtgtgagcccggggacctgctggagctgctgtggctgcagcctgcccctgagcccccagccccagccccccactgggccgtgtatgtgggcggcggccagatcatccacctgcaccagggcgagatccggcaggacagcctgtatgaagctggagctgccaacgtgggccgggtggtgaacagctggtaccgctaccggcccctggtggccgagctggtggtgcagaatgcctgtggccacctgggcctgaagtctgaggagatctgctggaccaacagcgagagctttgctgcctggtgccgctttgggaagcgggagttcaaggccggcggggaggtgcctgctggcacccagcccccccagcagcagtactacctgaaggtgcacctgggggagaacaaggtgcacacagcccgcttccacagcctggaggacctgatccgggagaagagaagaattgatgccagcggccgcctgcgggtgctgcaggagctggccgacctggtggatgacaaggagtag

SEQ ID NO: 38816 - DNA, 879 bp, Artificial Sequence; identical to SEQ ID NO: 38815
  Description of Artificial Sequence: Synthetic coding sequence

SEQ ID NO: 38817 - DNA, 1068 bp, Artificial Sequence
  Description of Artificial Sequence: Synthetic coding sequence
atgggcaaccagctggaccgcatcacccacctgaactacagcgagctgcccaccggggaccccagcggcatcgagaaggatgagctgcgggtgggcgtggcctacttcttcagtgatgatgaggaggacctggatgagcggggccagcctgacaagtttggagtgaaggcccctcctggctgcaccccctgcccagagagccccagccgccaccaccaccacctgctgcaccagctggtgctgaatgagacccagttcagcgccttccggggccaggagtgcatcttcagcaaggtgtctgggggcccccagggcgctgacctgtctgtgtatgctgtgacagccctgcctgccctgtgtgagcccggggacctgctggagctgctgtggctgcagcctgcccctgagcccccagccccagccccccactggtgggccagccgggcccggcgctctgctggccgcacccggcgggccagccccccaggggccgccctggccagcggcagcagccggcgggagggccgctgccggcaggcccggagccccaggagcagcagcaccatcagccgctgcacctgggagaggaccaggagcaccccacctggcttcaccgcctggaagaccagcagcgcccggtctgctgtgtccaccccagctgctgcctgtgagtgcagccgcagcagccccacctcctggaccaccaggagcagccggctgggcgctgctggccccagcgccagccctgcccccaggagcctgcccttccctgcccctggcctgcggagccagcgcttcagcaccagcgccccacccaggcatgcccggcccccacctgtggcccgggcccgggccgccccaccccacccccaggccagcggcaggaagagccaggagctgccccagggcaggaaaggagctgctgccagcgcctggctgacagccacagctgtggtgacagtgctgggggaccctgcctgtgccttccccctgcgctgcaagccaggcaccgggaagggcctgcggggggagaggacctggcccagcccccgggtgcacggccagtag

SEQ ID NO: 38818 - DNA, 594 bp, Artificial Sequence
  Description of Artificial Sequence: Synthetic coding sequence
atgcacctgttccagagcgagcgctggcccagcggcagaagacccaagaggctgcggggccacagagctgccagcgccctgcggacccggcggcctgctggagctgctgtggccgccgcccgggccggggccgcccgggcccggcctgccctgggccgcctgcggggcagaagagctgaccaccccccagccccccggcgggaccccccaggccagcctgaggccggggccgccaacgtgggccgggtggtgaacagctggtaccgctaccggcccctggtggccgagctggtggtgcagaatgcctgtggccacctgggcctgaagtctgaggagatctgctggaccaacagcgagagctttgctgcctggtgccgctttgggaagcgggagttcaaggccggcggggaggtgcctgctgctgccccagctgctgctgtgctgagccagggcgcccctggccgggagcagggcccccaccgcttccacagcctggaggacctgatccgggagaagcgctaccgccggcagaggcccccagccagcgcccctggggcccggcggccccggggccggcagggcgtggccgcctag

SEQ ID NO: 38819 - DNA, 993 bp, Artificial Sequence
  Description of Artificial Sequence: Synthetic coding sequence
atggccccagaagaaaatgccggcacagagctgctgctgcagagctttgagcggcgcttcctggccgcccggaccctgcggagcttcccctggcagagcctggaggccaagctgcgggacagcagtgacagcgagctgctgcgggacatcctgcacaagacagtgaagcaccctgtgtgtgtgaagcacccccccagcgtgaagtatgcccgctgcttcctgtctgagctgatcaagaagcatgaagctgtgcacacagagcccctggatgagctgtatgaggccctggccgagaccctgatggccaaggagagcacccagggccacaggagctacctgctgcccagcggcggctctgtgaccctgtctgagagcacagccatcatctcctatggcaccaccggcctggtgacctgggatgctgccctgtacctggccgagtgggccattgaaaatcctgctgtgttcaccaacagaacagtgctggagctgggcagcggggccggcctgaccggcctggccatctgcaagatgtgccggccccgggcctacatcttcagtgactgccacagccgggtgctggagcagctgcggggaaatgtgctgctgaatggcctgagcctggaggccgacatcacagccaagctggacagcccccgggtgacagtggcccagctggactgggatgtggccaccgtgcaccagctgagcgccttccagccagatgtggtgattgctgctgatgtgctgtactgcccagaggccatcatgagcctggtgggcgtgctgcggcggctggccgcctgccgggagcaccagagggcccctgaggtgtatgtggccttcaccgtgagaaatcctgagacctgccagctgttcaccacagagctgggccgggccggcatccgctgggaggtggagcccaggcatgagcagaagctgttcccctatgaggagcacctggagatggccatgctgaacctgaccctgtag

SEQ ID NO: 38820 - DNA, 891 bp, Artificial Sequence
  Description of Artificial Sequence: Synthetic coding sequence
atggccccagaagaaaatgccggcacagagctgctgctgcagagctttgagcggcgcttcctggccgcccggaccctgcggagcttcccctggcagagcctggaggccaagctgcgggacagcagtgacagcgagctgctgcgggacatcctgcacaagacagtgaagcaccctgtgtgtgtgaagcacccccccagcgtgaagtatgcccgctgcttcctgtctgagctgatcaagaagcccagcggcggctctgtgaccctgtctgagagcacagccatcatctcctatggcaccaccggcctggtgacctgggatgctgccctgtacctggccgagtgggccattgaaaatcctgctgtgttcaccaacagaacagtgctggagctgggcagcggggccggcctgaccggcctggccatctgcaagatgtgccggccccgggcctacatcttcagtgactgccacagccgggtgctggagcagctgcggggaaatgtgctgctgaatggcctgagcctggaggccgacatcacagccaagctggacagcccccgggtgacagtggcccagctggactgggatgtggccaccgtgcaccagctgagcgccttccagccagatgtggtgattgctgctgatgtgctgtactgcccagaggccatcatgagcctggtgggcgtgctgcggcggctggccgcctgccgggagcaccagagggcccctgaggtgtatgtggccttcaccgtgagaaatcctgagacctgccagctgttcaccacagagctgggccgggccggcatccgctgggaggtggagcccaggcatgagcagaagctgttcccctatgaggagcacctggagatggccatgctgaacctgaccctgtag

SEQ ID NO: 38821 - DNA, 390 bp, Artificial Sequence
  Description of Artificial Sequence: Synthetic coding sequence
atgccacccagcaccctgcagaatggccccagcaggacccggcagcccagcctgacagatgtgctgtactgcccagaggccatcgtgtccctggtgggcgtgctgcagaggctggccgcctgccgggagcacaagagggcccctgaggtgtatgtggccttcaccgtgagaaatcctgagacctgccagctgttcaccacagagctgggggagccccccaggcctcctggccccacctggtgccccagctgcccctgcaggacccctgtggaggtgaaggagctgggcgctggggagaagctgggctgcagcaccctgccccactacgccggcaacagcggccggggccggcccggctgggaccagatgggcagcggcagcagcagctag

SEQ ID NO: 38822 - DNA, 462 bp, Artificial Sequence
  Description of Artificial Sequence: Synthetic coding sequence
atggccccagaagaaaatgccggcacagagctgctgctgcagggctttgagcggcgcttcctggccgtgaggaccctgcggagcttcccctggcagagcctggaggccaagctgcgggacagcagtgacagcgagctgctgcgggacatcctgcagaagacagtgcgccaccctgtgtgtgtgaagcacccccccagcgtgaagtatgcctggtgcttcctgtctgagctgatcaagaagagcagcggcggctctgtgaccctgagcaagagcacagccatcatcagccacggcaccaccggcctggtgacctgggatgctgccctgtacctggccgagtgggccattgaaaatcctgctgccttcatcaacagaagagctgtgctgcccaggagccaccgggtggccggccggggccctgctgaggccggctgcctgcccggggcccaggccggcagctag

SEQ ID NO: 38823 - DNA, 993 bp, Artificial Sequence
  Description of Artificial Sequence: Synthetic coding sequence
atggccccagaagaaaatgccggcacagagctgctgctgcagggctttgagcggcgcttcctggccgtgaggaccctgcggagcttcccctggcagagcctggaggccaagctgcgggacagcagtgacagcgagctgctgcgggacatcctgcagaagacagtgcgccaccctgtgtgtgtgaagcacccccccagcgtgaagtatgcctggtgcttcctgtctgagctgatcaagaagcatgaagctgtgcacacagagcccctggacaagctgtatgaggtgctgacagagaccctgatggccaaggagagcacccagggccacaggagctacctgctgagcagcggcggctctgtgaccctgagcaagagcacagccatcatcagccacggcaccaccggcctggtgacctgggatgctgccctgtacctggccgagtgggccattgaaaatcctgctgccttcatcaacagaacagtgctggagctgggcagcggggccggcctgaccggcctggccatctgcaagatgtgccggccccgggcctacatcttcagtgacccccacagccgggtgctggagcagctgcggggaaatgtgctgctgaatggcctgagcctggaggccgacatcactggaaacctggacagcccccgggtgacagtggcccagctggactgggatgtggccatggtgcaccagctgagcgccttccagccagatgtggtgattgctgctgatgtgctgtactgcccagaggccatcgtgtccctggtgggcgtgctgcagaggctggccgcctgccgggagcacaagagggcccctgaggtgtatgtggccttcaccgtgagaaatcctgagacctgccagctgttcaccacagagctgggcagagatggcatccgctgggaggccgaggcccaccacgaccagaagctgttcccctatggagagcacctggagatggccatgctgaacctgaccctgtag

SEQ ID NO: 38824 - DNA, 891 bp, Artificial Sequence
  Description of Artificial Sequence: Synthetic coding sequence
atggccccagaagaaaatgccggcacagagctgctgctgcagggctttgagcggcgcttcctggccgtgaggaccctgcggagcttcccctggcagagcctggaggccaagctgcgggacagcagtgacagcgagctgctgcgggacatcctgcagaagacagtgcgccaccctgtgtgtgtgaagcacccccccagcgtgaagtatgcctggtgcttcctgtctgagctgatcaagaagagcagcggcggctctgtgaccctgagcaagagcacagccatcatcagccacggcaccaccggcctggtgacctgggatgctgccctgtacctggccgagtgggccattgaaaatcctgctgccttcatcaacagaacagtgctggagctgggcagcggggccggcctgaccggcctggccatctgcaagatgtgccggccccgggcctacatcttcagtgacccccacagccgggtgctggagcagctgcggggaaatgtgctgctgaatggcctgagcctggaggccgacatcactggaaacctggacagcccccgggtgacagtggcccagctggactgggatgtggccatggtgcaccagctgagcgccttccagccagatgtggtgattgctgctgatgtgctgtactgcccagaggccatcgtgtccctggtgggcgtgctgcagaggctggccgcctgccgggagcacaagagggcccctgaggtgtatgtggccttcaccgtgagaaatcctgagacctgccagctgttcaccacagagctgggcagagatggcatccgctgggaggccgaggcccaccacgaccagaagctgttcccctatggagagcacctggagatggccatgctgaacctgaccctgtag

SEQ ID NO: 38825 - DNA, 462 bp, Artificial Sequence; identical to SEQ ID NO: 38822
  Description of Artificial Sequence: Synthetic coding sequence

SEQ ID NO: 38826 - DNA, 993 bp, Artificial Sequence
  Description of Artificial Sequence: Synthetic coding sequence
atggccccagaagaaaatgccggcacagagctgctgctgcagggctttgagcggcgcttcctggccgtgaggaccctgcggagcttcccctggcagagcctggaggccaagctgcgggacagcagtgacagcgagctgctgcgggacatcctgcagaagacagtgcgccaccctgtgtgtgtgaagcacccccccagcgtgaagtatgcctggtgcttcctgtctgagctgatcaagaagcatgaagctgtgcacacagagcccctggacaagctgtatgaggtgctggccgagaccctgatggccaaggagagcacccagggccacaggagctacctgctgagcagcggcggctctgtgaccctgagcaagagcacagccatcatcagccacggcaccaccggcctggtgacctgggatgctgccctgtacctggccgagtgggccattgaaaatcctgctgccttcatcaacagaacagtgctggagctgggcagcggggccggcctgaccggcctggccatctgcaagatgtgccggccccgggcctacatcttcagtgacccccacagccgcatcctggagcagctgcggggaaatgtgctgctgaatggcctgagcctggaggccgacatcactggaaacctggacagcccccgggtgacagtggcccagctggactgggatgtggccatggtgcaccagctgagcgccttccagccagatgtggtgattgctgctgatgtgctgtactgcccagaggccatcgtgtccctggtgggcgtgctgcagaggctggccgcctgccgggagcacaagagggcccctgaggtgtatgtggccttcaccgtgagaaatcctgagacctgccagctgttcaccacagagctgggcagagatggcatccgctgggaggccgaggcccaccacgaccagaagctgttcccctatggagagcacctggagatggccatgctgaacctgaccctgtag

SEQ ID NO: 38827 - DNA, 462 bp, Artificial Sequence; identical to SEQ ID NO: 38822
  Description of Artificial Sequence: Synthetic coding sequence

SEQ ID NO: 38828 - DNA, 891 bp, Artificial Sequence
  Description of Artificial Sequence: Synthetic coding sequence
atggccccagaagaaaatgccggcacagagctgctgctgcagggctttgagcggcgcttcctggccgtgaggaccctgcggagcttcccctggcagagcctggaggccaagctgcgggacagcagtgacagcgagctgctgcgggacatcctgcagaagacagtgcgccaccctgtgtgtgtgaagcacccccccagcgtgaagtatgcctggtgcttcctgtctgagctgatcaagaagagcagcggcggctctgtgaccctgagcaagagcacagccatcatcagccacggcaccaccggcctggtgacctgggatgctgccctgtacctggccgagtgggccattgaaaatcctgctgccttcatcaacagaacagtgctggagctgggcagcggggccggcctgaccggcctggccatctgcaagatgtgccggccccgggcctacatcttcagtgacccccacagccgcatcctggagcagctgcggggaaatgtgctgctgaatggcctgagcctggaggccgacatcactggaaacctggacagcccccgggtgacagtggcccagctggactgggatgtggccatggtgcaccagctgagcgccttccagccagatgtggtgattgctgctgatgtgctgtactgcccagaggccatcgtgtccctggtgggcgtgctgcagaggctggccgcctgccgggagcacaagagggcccctgaggtgtatgtggccttcaccgtgagaaatcctgagacctgccagctgttcaccacagagctgggcagagatggcatccgctgggaggccgaggcccaccacgaccagaagctgttcccctatggagagcacctggagatggccatgctgaacctgaccctgtag

SEQ ID NO: 38829 - DNA, 390 bp, Artificial Sequence; identical to SEQ ID NO: 38821
  Description of Artificial Sequence: Synthetic coding sequence

SEQ ID NO: 38830 - DNA, 888 bp, Artificial Sequence
  Description of Artificial Sequence: Synthetic coding sequence
atggccccagaagaaaatgccggcacagagctgctgctgcagggctttgagcggcgcttcctggccgtgaggaccctgcggagcttcccctggcagagcctggaggccaagctgcgggacagcagtgacagcgagctgctgcgggacatcctgcagaagacagtgcgccaccctgtgtgtgtgaagcacccccccagcgtgaagtatgcctggtgcttcctgtctgagctgatcaagaagagcagcggcggctctgtgaccctgagcaagagcacagccatcatcagccacggcaccaccggcctggtgacctgggatgctgccctgtacctggccgagtgggccattgaaaatcctgctgccttcatcaacagaacagtgctggagctgggcagcggggccggcctgaccggcctggccatctgcaagatgtgccggccccgggcctacatcttcagtgacccccacagccgcatcctggagcagctgcggggaaatgtgctgctgaatggcctgagcctggaggccgacatcactggaaacctggacagcccccgggtgacagtggcccagctggactgggatgtggccatggtgcaccagctgagcgccttccagccagatgtggtgattgctgctgatgtgctgtactgcccagaggccatcgtgtccctggtgggcgtgctgcagaggctggccgcctgccgggagcacaagagggcccctgaggtgtatgtggccttcaccgtgagaaatcctgagacctgccagctgttcaccacagagctgggcagagatggcatccgctgggaggccgaggcccaccacgaccagaagctgttcccctatggagagcacctggagatggccatgctgaacctgacctag

SEQ ID NO: 38831 - DNA, 450 bp, Artificial Sequence
  Description of Artificial Sequence: Synthetic coding sequence
atggccccagaagaaaatgccggcacagagctgctgctgcagggctttgagcggcgcttcctggccgtgaggaccctgcggagcttcccctggcagagcctggaggccaagctgcgggacagcagtgacagcgagctgctgcgggacatcctgcagaagacagtgcgccaccctgtgtgtgtgaagcacccccccagcgtgaagtatgcctggtgcttcctgtctgagctgatcaagaagagcagcggcggctctgtgaccctgagcaagagcacagccatcatcagccacggcaccaccggcctggtgacctgggatgctgccctgtacctggccgagtgggccattgaaaatcctgctgccttcatcaacagaagagctgtgctgcccaggagccaccgggtggccggccggggccctgctgaggccggctgcctgcccggggcctag

SEQ ID NO: 38832 - DNA, 396 bp, Artificial Sequence
  Description of Artificial Sequence: Synthetic coding sequence
atggccccagaagaaaatgccggcagcgagctgctgctgcagagcttcaagaggcgcttcctggccgcccgggccctgcggagcttccgctggcagagcctggaggccaagctgcgggacagcagtgacagcgagctgctgcgggacatcctgcagaagacctgctgcatcgcccagaagcccagctgccgctggagcggcagctgtggcggctggctgcctgctggcagcaccagcggcctgctgaacagcacctggcccctgcccagcgccacccagagatgtgccagctgcagcccccccagctatgccggcctgggcagtgatggcaagaggaagctgatcatgaccaggaactgcttccccacagagagcacctggcgctggcagagctag

SEQ ID NO: 38833 - DNA, 498 bp, Artificial Sequence
  Description of Artificial Sequence: Synthetic coding sequence
atggccccagaagaaaatgccggcagcgagctgctgctgcagagcttcaagaggcgcttcctggccgcccgggccctgcggagcttccgctggcagagcctggaggccaagctgcgggacagcagtgacagcgagctgctgcgggacatcctgcagaagcatgaggccgtgcacacagagcccctggatgagctgtatgaggtgctggtggagaccctgatggccaaggagagcacccagggccacaggagctacctgctgacctgctgcatcgcccagaagcccagctgccgctggagcggcagctgtggcggctggctgcctgctggcagcaccagcggcctgctgaacagcacctggcccctgcccagcgccacccagagatgtgccagctgcagcccccccagctatgccggcctgggcagtgatggcaagaggaagctgatcatgaccaggaactgcttccccacagagagcacctggcgctggcagagctag

SEQ ID NO: 38834 - DNA, 477 bp, Artificial Sequence
  Description of Artificial Sequence: Synthetic coding sequence
atggccccagaagaaaatgccggcagcgagctgctgctgcagagcttcaagaggcgcttcctggccgcccgggccctgcggagcttccgctggcagagcctggaggccaagctgcgggacagcagtgacagcgagctgctgcgggacatcctgcagaagacagtgaagcaccctgtgtgtgtgaagcacccccccagcgtgaagtatgcccgctgcttcctgtctgagctgatcaagaagacctgctgcatcgcccagaagcccagctgccgctggagcggcagctgtggcggctggctgcctgctggcagcaccagcggcctgctgaacagcacctggcccctgcccagcgccacccagagatgtgccagctgcagccccccatcctatgccggcctgggcagtgatggcaagaggaagctgatcatgaccaggaactgcttccccacagagagcacctggcgctggcagagctag

SEQ ID NO: 38835 - DNA, 555 bp, Artificial Sequence
  Description of Artificial Sequence: Synthetic coding sequence
atgtctggggcccgggccgcccctggagctgctggaaatggagctgtgcggggcctgcgggtggatggcctgccccccctgcccaagagcctgagcggcctgctgcacagcgccagcggcggcggggccagcggcggctggaggcacctggagcggctgtatgcccagaagagccgcatccaggatgagctgagcagaggaggccctgggggcggcggggcccgggctgctgccctgcctgccaagccacccaacctggatgctgccctggccctgctgaggaaggagatggtgggcctgcggcagctggacatgagcctgctgtgccagctgtacagcctgtatgagagcatccaggagtacaagggggcctgccaggccgccagcagcccagactgcacctacgccctggagaatggcttctttgatgaggaggaggagtacttccaggagcagaacagcctgcatgaccggcgggaccggggccccccccgggacctgagcctgcctgtgagcagcctgagcagcagtgactggatcctggagagcatctag

SEQ ID NO: 38836 - DNA, 531 bp, Artificial Sequence
  Description of Artificial Sequence: Synthetic coding sequence
atgaatggcctgcccagcgctgaggcccctgggggcgccggctgtgccctggccggcctgccccccctgccccggggcctgagcggcctgctgaatgccagcggcggctcctggagggagctggagcgggtgtacagccagaggagccgcatccatgatgagctgagccgggccgcccgggccccagatggccccaggcatgctgctggagctgccaatgccggccctgctgctggccccaggaggcctgtgaacctggacagcgccctggccgccctgaggaaggagatgctgtggggcctgtatgagagcatccaggactacaagcacctgtgccaggacctgtccttctgccaggacctgagcagcagcctgcacagcgacagcagctaccccccagatgctggcctgagtgatgatgaggagcccccagatgccagcctgcccccagaccccccacccctgactgtgccccagacccacaatgcccgggaccagtggctgcaggatgccttccacatcagcctgtag

SEQ ID NO: 38837 - DNA, 489 bp, Artificial Sequence
  Description of Artificial Sequence: Synthetic coding sequence
atgaatggcctgcccagcgctgaggcccctgggggcgccggctgtgccctggccggcctgccccccctgccccggggcctgagcggcctgctgaatgccagcggcggctcctggagggagctggagcgggtgtacagccagaggagccgggtggtgctgagcaccagcacccagcgctggccccgctgtgcccggcgctgctgcctgcaggtgggcctgcggcagctggacatgagcctgctgtgccagctgtggggcctgtatgagagcatccaggactacaagcacctgtgccaggacctgtccttctgccaggacctgagcagcagcctgcacagcgacagcagctaccccccagatgctggcctgagtgatgatgaggagcccccagatgccagcctgcccccagaccccccacccctgactgtgccccagacccacaatgcccgggaccagtggctgcaggatgccttccacatcagcctgtag

SEQ ID NO: 38838 - DNA, 465 bp, Artificial Sequence
  Description of Artificial Sequence: Synthetic coding sequence
atgaatggcctgcccagcgctgaggcccctgggggcgccggctgtgccctggccggcctgccccccctgccccggggcctgagcggcctgctgaatgccagcggcggctcctggagggagctggagcgggtgtacagccagaggagccgcatccatgatgagctgagccgggccgcccgggccccagatggccccaggcatgctgctggagctgccaatgccggccctgctgctggccccaggaggcctgtgaacctggacagcgccctggccgccctgaggaaggagatgctgtctgctgggggcgctgctgctgtgggccacgtgctggtggtgcctgctgtgggccctgtgcgggtgaaccctggcctgcagacccctgtgcccaggcctgagctgctgcccggccctgtgatcctgcccccatttggccagctgctgcccaccggctgcggccctgtgtag

SEQ ID NO: 38839 - DNA, 570 bp, Artificial Sequence
  Description of Artificial Sequence: Synthetic coding sequence
atgaatggcctgcccagcgctgaggcccctgggggcgccggctgtgccctggccggcctgccccccctgccccggggcctgagcggcctgctgaatgccagcggcggctcctggagggagctggagcgggtgtacagccagaggagccgcatccatgatgagctgagccgggccgcccgggccccagatggccccaggcatgctgctggagctgccaatgccggccctgctgctggccccaggaggcctgtgaacctggacagcgccctggccgccctgaggaaggagatggtgggcctgcggcagctggacatgagcctgctgtgccagctgtggggcctgtatgagagcatccaggactacaagcacctgtgccaggacctgtccttctgccaggacctgagcagcagcctgcacagcgacagcagctaccccccagatgctggcctgagtgatgatgaggagcccccagatgccagcctgcccccagaccccccacccctgactgtgccccagacccacaatgcccgggaccagtggctgcaggatgccttccacatcagcctgtag

SEQ ID NO: 38840 - DNA, 2517 bp, Artificial Sequence
  Description of Artificial Sequence: Synthetic coding sequence
atgaacattgatgtggagttccacatccgccacaactacccctggaacaagctgcctgccaacgtgcggcagagcctgggcaacagccagcgggagtatgagaagcaggtggtgctgtacagcatccggaaccagctgcgctacagaaacaacctggtgaagcacgtgaagaaggatgaaagacgctactatgaggagctgctgaagtacagccgggaccacctgatgctgtacccctaccacctgagtgacatcatggtgaagggcctgcgcatcacccccttctcctactacacaggcatcatggaggacatcatgaacagcgagaagagctatgacagcctgcccaacttcaccgctgctgactgcctgcggctgctgggcattggaagaaaccagtacatcgacctgatgaaccagtgccgcagcagcaagaagttcttccggaggaagacagcccgggacctgctgcccatcaagcctgtggagatcgccatcgaggcctggtgggtggtgcaggccggctacatcacagaagatgacatcaagatctgcaccctgcctgagaagtgtgctgtggacaagatcattgattctggcccccagctgagcggcagcctggactacaacgtggtgcacagcctgtacaacaagggcttcatctacctggatgtgcccatcagtgatgacagctgcatcgctgtgccccccctggagggctttgtgatgaacagagtgcagggcgactactttgagaccctgctgtacaagatctttgtgtccattgatgagcacaccaacgtggccgagctggccaacgtgctggagattgacctgagcctggtgaagaatgctgtgtccatgtactgccgcctgggctttgcccacaagaagggccaggtgatcaacctggaccagctgcacagctcctggaagaatgtgcccagcgtgaaccggctgaagagcaccctggacccccagaagatgctgctgtcctgggatggaggagagagccgcagccctgtgcaggaggccagcagcgccacagacacagacaccaacagccaggaggaccctgctgacacagcctctgtgagcagcctgagcctgagcacaggccacaccaagagaattgccttcctgtttgacagcaccctgacagccttcctgatgatgggcaacctgagccccaacctgaagagccatgctgtgaccatgtttgaggtgggcaagctgagtgatgagagcctggacagcttcctgattgagctggagaaggtgcagagcactggagagggggaggcccagcgctactttgaccacgccctgaccctgaggaacaccatcctcttcctgcggcacaacaaggacctggtggcccagacagcccagcctgaccagcccaactacggcttccccctggacctgctgcgctgtgagagcctgctgggcctggaccctgccacctgcagccgggtgctgaacaagaactacaccctgctggtgtccatggcccccctgaccaatgagatccggcctgtgagcagctgcaccccccagcacatcggccctgccatccctgaggtgtcctctgtgtggttcaagctgtacatctaccacgtgacaggccagggcccccccagcctgctgctgagcaagggcacccggctgaggaagctgcctgacatcttccagagctatgaccggctgctgatcacctcctggggccatgaccccggggtggtgcccaccagcaatgtgctgaccatgctgaatgatgccctgacccacagcgctgtgctgatccagggccacggcctgcacggcatcggggagaccgtgcacgtgcccttcccctttgatgaaacagagctgcagggcgagttcaccagggtgaacatgggcgtgcacaaggccctgcagatcctgaggaacagagtggacctgcagcacctgtgtggctacgtgaccatgctgaatgccagcagccagctggccgacaggaagctgagtgatgccagtgatgagcggggggagccagacctggccagcggcagtgatgtgaatggcagcacagagagctttgagatggtgattgaggaggccaccatcgacagcgccaccaagcagaccagcggggccaccacagaggccgactgggtgcccctggagctgtgcttcggcatccccctcttcagcagcgagctgaacaggaaggtgtgcaggaagattgctgcccacggcctgtgcaggaaggagagcctgcagaacctgctgcacagcagcaggaagctgagcctgcaggtgctgaactttgtgcacagcttccaggagggcgccagcatcctggacatccacacagagcccagcttcagcagcctgctgagccagagcagctgtgccgacatgggcgtgcccctgcctgccaagaacctgatcttcaaggatggagtgctgtctgagtggagcggccgcagccccagcagcctgctgattgccaacctgcacctgcagtag

SEQ ID NO: 38841 - DNA, 276 bp, Artificial Sequence
  Description of Artificial Sequence: Synthetic coding sequence
atgaacattgatgtggagttccacatccgccacaactacccctggaacaagctgcctgccaacgtgcggcagagcctgggcaacagccagcgggagtatgagaagcaggtggtgctgtacagcatccggaaccagctgcgctacagaaacaacctggtgaagcacgtgaagaaggatgaaagacgctactatgaggagctgctgaagtacagccgggaccacctgatgctgtacccctaccacctgagtgacagcgtgtgctacgtgtgcctgtag

SEQ ID NO: 38842 - DNA, 819 bp, Artificial Sequence
  Description of Artificial Sequence: Synthetic coding sequence
atgatgaggaggaccctggagaacagaaatgcccagaccaagcagctgcagacagctgtgtccaatgtggagaagcactttggagagctgtgccagatctttgctgcctacgtgaggaagacagcccggctgcgggacaaggctgacctgctggtgaatgagatcaatgcctatgctgccacagagaccccccacctgaagctgggcctgatgaactttgctgatgaatttgccaagctgcaggactaccggcaggccgaggtggagcggctggaggccaaggtggtggagcccctgaagacctacggcaccatcgtgaagatgaagagagatgacctgaaggccaccctgacagccaggaaccgggaggccaagcagctgacccagctggagaggacccggcagaggaaccccagcgacagacatgtgattgcccaggccgagacagagctgcagagagctgccatggatgccagcaggaccagccgccacctggaggagaccatcaacaactttgagcggcagaagatgaaggacatcaagaccatcttcagcgagttcatcaccatcgagatgctgttccacggcaaggccctggaggtgtacacagctgcctaccagaacatccagaacattgatgaagatgaggacctggaggtgttcaggaacagcctgtatgccccagactacagcagccggctggacatcgtgcgggccaacagcaagagccccctgcagaggagcctgagcgccaagtgtgtgtctggaacaggccagcaggaggccggctgggccgccacctgccagaccctcatctag

SEQ ID NO: 38843 - DNA, 756 bp, Artificial Sequence
  Description of Artificial Sequence: Synthetic coding sequence
atgatgaggaggaccctggagaacagaaatgcccagaccaagcagctgcagacagctgtgtccaatgtggagaagcactttggagagctgtgccagatctttgctgcctacgtgaggaagacagcccggctgcgggacaaggctgacctgctggtgaatgagatcaatgcctatgctgccacagagaccccccacctgaagctgggcctgatgaactttgctgatgaatttgccaagctgcaggactaccggcaggccgaggtggagcggctggaggccaaggtggtggagcccctgaagacctacggcaccatcgtgaagatgaagagagatgacctgaaggccaccctgacagccaggaaccgggaggccaagcagctgacccagctggagaggacccggcagaggaaccccagcgacagacatgtgattgcccaggccgagacagagctgcagagagctgccatggatgccagcaggaccagccgccacctggaggagaccatcaacaactttgagcggcagaagatgaaggacatcaaggtgttcaggaacagcctgtatgccccagactacagcagccggctggacatcgtgcgggccaacagcaagagccccctgcagaggagcctgagcgccaagtgtgtgtctggaacaggccaggtgtccacctgccgcctgaggaaggaccagcaggccgaggatgatgaagatgatgagctggatgtgacagaggaggagaacttcctgaagtag

SEQ ID NO: 38844 - DNA, 870 bp, Artificial Sequence
  Description of Artificial Sequence: Synthetic coding sequence
atgatgaggaggaccctggagaacagaaatgcccagaccaagcagctgcagacagctgtgtccaatgtggagaagcactttggagagctgtgccagatctttgctgcctacgtgaggaagacagcccggctgcgggacaaggctgacctgctggtgaatgagatcaatgcctatgctgccacagagaccccccacctgaagctgggcctgatgaactttgctgatgaatttgccaagctgcaggactaccggcaggccgaggtggagcggctggaggccaaggtggtggagcccctgaagacctacggcaccatcgtgaagatgaagagagatgacctgaaggccaccctgacagccaggaaccgggaggccaagcagctgacccagctggagaggacccggcagaggaaccccagcgacagacatgtgatcagccaggccgagacagagctgcagagagctgccatggatgccagcaggaccagccgccacctggaggagaccatcaacaactttgagcggcagaagatgaaggacatcaagaccatcttcagcgagttcatcaccatcgagatgctgttccacggcaaggccctggaggtgtacacagctgcctaccagaacatccagaacattgatgaagatgaggacctggaggtgttcaggaacagcctgtatgccccagactacagcagccggctggacatcgtgcgggccaacagcaagagccccctgcagaggagcctgagcgccaagtgtgtgtctggaacaggccaggtgtccacctgccgcctgaggaaggaccagcaggccgaggatgatgaagatgatgagctggatgtgacagaggaggagaacttcctgaagtag

SEQ ID NO: 38845 - DNA, 789 bp, Artificial Sequence
  Description of Artificial Sequence: Synthetic coding sequence
atgatgaggaggaccctggagaacagaaatgcccagaccaagcagctgcagacagctgtgtccaatgtggagaagcactttggagagctgtgccagatctttgctgcctacgtgaggaagacagcccggctgcgggacaaggctgacctgctggtgaatgagatcaatgcctatgctgccacagagaccccccacctgaagctgggcctgatgaactttgctgatgaatttgccaagctgcaggactaccggcaggccgaggtggagcggctggaggccaaggtggtggagcccctgaagacctacggcaccatcgtgaagatgaagagagatgacctgaaggccaccctgacagccaggaaccgggaggccaagcagctgacccagctggagaggacccggcagaggaaccccagcgacagacatgtgattgcccaggccgagacagagctgcagagagctgccatggatgccagcaggaccagccgccacctggaggagaccatcaacaactttgagcggcagaagatgaaggacatcaagaccatcttcagcgagttcatcaccatcgagatgctgttccacggcaaggccctggaggtgtacacagctgcctaccagaacatccagaacattgatgaagatgaggacctggagcgctggagctttgccatgctgccccggctggtgctgaacagctggggcagcagtgaccccccagccctggccagccagagcgtgcgcttcagcgagatcctgtgcatgcaccagatcatccacctggtgtag

SEQ ID NO: 38846 - DNA, 309 bp, Artificial Sequence
  Description of Artificial Sequence: Synthetic coding sequence
atgcagagggtgtctggcctgctgtcctggaccctgagccgggtgctgtggctgagcggcctgtctgagcccggggccgcccggcagccccgcatcatggaggagaaggccctggaggtgtatgacctgatccgcaccatccgggaccctgagaagcccaacaccctggaggagctggaggtggtgtctgagagctgtgtggaggtgcaggagatcaatgaggaggagtacctggtgatcatccgcttcacccccaccgtgccccactgcagcctggccaccctcatcgtgggcaacctgcacttctag

SEQ ID NO: 38847 - DNA, 483 bp, Artificial Sequence
  Description of Artificial Sequence: Synthetic coding sequence
atgcagagggtgtctggcctgctgtcctggaccctgagccgggtgctgtggctgagcggcctgtctgagcccggggccgcccggcagccccgcatcatggaggagaaggccctggaggtgtatgacctgatccgcaccatccgggaccctgagaagcccaacaccctggaggagctggaggtggtgtctgagagctgtgtggaggtgcaggagatcaatgaggaggagtacctggtgatcatccgcttcacccccaccgtgccccactgcagcctggccaccctcatcggcctgtgcctgcgggtgaagctgcagcgctgcctgcccttcaagcacaagctggagatctacatcagcgagggcacccacagcacagaggaggacatcaacaagcagatcaatgacaaggagcgggtggccgccgccatggagaaccccaacctgcgggagatcgtggagcagtgtgtgctggagccagactag

SEQ ID NO: 38848 - DNA, 309 bp, Artificial Sequence; identical to SEQ ID NO: 38846
  Description of Artificial Sequence: Synthetic coding sequence

SEQ ID NO: 38849 - DNA, 1557 bp, Artificial Sequence
  Description of Artificial Sequence: Synthetic coding sequence
atggagtgtgacctgatggagacagacatcctggagagcctggaggacctgggctacaagggccccctgctggaggatggagccctgagccaggccgtgtctgctggggccagcagccctgagttcaccaagctgtgtgcctggctggtgtctgagctgcgggtgctgtgcaagctggaggagaatgtgcaggccaccaacagccccagcgaggccgaggagttccagctggaggtgtctggcctgctgggggagatgaactgcccctacctgagcctgaccagcggagatgtgaccaagaggctgctgatccagaagaactgcctgctgctgctgacctacctgatcagcgagctggaggccgccaggatgctgtgtgtgaatgccccacccaagaaggcccaggagggcggcggcagcgaggtgttccaggagctgaagggcatctgcatcgccctgggcatgagcaagcccccagccaacatcaccatgttccagttcttctctggaattgagaagaagctgaaggagaccctggccaaggtgccccccaaccacgtgggcaagcccctgctgaagaagcccatgggccctgcccactgggagaagattgaggccatcaaccaggccatcgccaatgaatatgaggtgcggaggaagctgctgatcaagaggctggatgtgacagtgcagagctttggctggagcgaccgggccaagagccagacagagaagctggccaaggtgtaccagcccaagaggtctgtgctgagccccaagaccaccatctctgtggcccacctgctggccgcccggcaggacctgagcaagatcctgcggaccagcagcggcagcatccgggagaagacagcctgtgccatcaacaaggtgctgatgggccgggtgcctgaccggggcggccggcccaatgaaattgagcccccacctcctgagatgccaccctggcagaagaggcaggacggcccccagcagcagacaggaggccggggcggcggccggggcggctatgagcacagcagctatggaggccggggcggccacgagcagggcggcggccggggcggccggggcggctatgaccacggcggccggggcggcggccggggcaacaagcaccagggcggctggacagatggcggcagcggcggcggcggcggctaccaggacggcggctacagagacagcggcttccagcccggcggctaccacggcggccacagcagcggcggctaccagggcggcggctatggaggcttccagaccagcagcagctacacaggcagcggctaccagggcggcggctaccagcaggacaaccgctaccaggacggcggccaccacggggaccggggcggcggccggggcggccggggcggccggggcggccggggcggccgggccggccagggcggcggctggggcggccggggcagccagaactaccaccagggcggccagtttgagcagcacttccagcacggcggctaccagtacaaccacagcggcttcggccagggccgccactacaccagctag

SEQ ID NO: 38850 - DNA, 1560 bp, Artificial Sequence
  Description of Artificial Sequence: Synthetic coding sequence
atggagtgtgacctgatggagacagacatcctggagagcctggaggacctgggctacaagggccccctgctggaggatggagccctgagccaggccgtgtctgctggggccagcagccctgagttcaccaagctgtgtgcctggctggtgtctgagctgcgggtgctgtgcaagctggaggagaatgtgcaggccaccaacagccccagcgaggccgaggagttccagctggaggtgtctggcctgctgggggagatgaactgcccctacctgagcctgaccagcggagatgtgaccaagaggctgctgatccagaagaactgcctgctgctgctgacctacctgatcagcgagctggaggccgccaggatgctgtgtgtgaatgccccacccaagaaggcccaggagggcggcggcagcgaggtgttccaggagctgaagggcatctgcatcgccctgggcatgagcaagcccccagccaacatcaccatgttccagttcttctctggaattgagaagaagaagctgaaggagaccctggccaaggtgccccccaaccacgtgggcaagcccctgctgaagaagcccatgggccctgcccactgggagaagattgaggccatcaaccaggccatcgccaatgaatatgaggtgcggaggaagctgctgatcaagaggctggatgtgacagtgcagagctttggctggagcgaccgggccaagagccagacagagaagctggccaaggtgtaccagcccaagaggtctgtgctgagccccaagaccaccatctctgtggcccacctgctggccgcccggcaggacctgagcaagatcctgcggaccagcagcggcagcatccgggagaagacagcctgtgccatcaacaaggtgctgatgggccgggtgcctgacagaggaggccggcccaatgaaattgagcccccacctcctgagatgccaccctggcagaagaggcaggacggcccccagcagcagacaggaggccggggcggcggccggggcggctatgagcacagcagctatggaggccggggcggccacgagcagggcggcggccggggcggccggggcggctatgaccatggaggccggggcggcggccggggcaacaagcaccagggcggctggacagatggcggcagcggcggcggcggcggctaccaggacggcggctacagagattctggcttccagcccggcggctaccatggaggccacagcagcggcggctaccagggcggcggctacggcggcttccagaccagcagcagctacacaggcagcggctaccagggcggcggctaccagcaggacaaccgctaccaggacggcggccaccacggggacagaggaggcggccggggcggccggggcggccggggcggccggggcggccgggccggccagggcggcggctggggcggccggggcagccagaactaccaccagggcggccagtttgagcagcacttccagcacggcggctaccagtacaaccacagcggcttcggccagggccgccactacaccagctag

SEQ ID NO: 38851 - DNA, 972 bp, Artificial Sequence
  Description of Artificial Sequence: Synthetic coding sequence
atgggccctgcccactgggagaagattgaggccatcaaccaggccatcgccaatgaatatgaggtgcggaggaagctgctgatcaagaggctggatgtgacagtgcagagctttggctggagcgaccgggccaagagccagacagagaagctggccaaggtgtaccagcccaagaggtctgtgctgagccccaagaccaccatctctgtggcccacctgctggccgcccggcaggacctgagcaagatcctgcggaccagcagcggcagcatccgggagaagacagcctgtgccatcaacaaggtgctgatgggccgggtgcctgacagaggaggccggcccaatgaaattgagcccccacctcctgagatgccaccctggcagaagaggcaggacggcccccagcagcagacaggaggccggggcggcggccggggcggctatgagcacagcagctatggaggccggggcggccacgagcagggcggcggccggggcggccggggcggctatgaccatggaggccggggcggcggccggggcaacaagcaccagggcggctggacagatggcggcagcggcggcggcggcggctaccaggacggcggctacagagattctggcttccagcccggcggctaccatggaggccacagcagcggcggctaccagggcggcggctacggcggcttccagaccagcagcagctacacaggcagcggctaccagggcggcggctaccagcaggacaaccgctaccaggacggcggccaccacggggacagaggaggcggccggggcggccggggcggccggggcggccggggcggccgggccggccagggcggcggctggggcggccggggcagccagaactaccaccagggcggccagtttgagcagcacttccagcacggcggctaccagtacaaccacagcggcttcggccagggccgccactacaccagctag

SEQ ID NO: 38852 - DNA, 1302 bp, Artificial Sequence
  Description of Artificial Sequence: Synthetic coding sequence
atgaggggccctgagcccggcccccagcccaccatggagggagatgtgctggacaccctggaggccctgggctacaagggccccctgctggaggagcaggccctgaccaaggctgctgagggcggcctgagcagccctgagttcagcgagctgtgcatctggctgggcagccagatcaagagcctgtgcaacctggaggagagcatcaccagcgctggaagagatgacctggagagcttccagctggagatcagcggcttcctgaaggagatggcctgcccctacagcgtgctgatcagcggggacatcaaggaccggctgaagaagaaggaggactgcctgaagctgctgctcttcctgagcacagagctgcaggccagccagatcctgcagaacaagaagcacaagaacagccagctggacaagaacagcgaggtgtaccaggaggtgcaggccatgtttgacaccctgggcatccccaagagcaccaccagtgacatcccccacatgctgaaccaggtggagagcaaggtgaaggacatcctgagcaaggtgcagaagaaccacgtgggcaagcccctgctgaagatggacctgaacagcgagcaggccgagcagctggagcgcatcaatgatgccctgagctgtgaatatgaatgtagaagaaggatgctgatgaagaggctggatgtgacagtgcagagctttggctggagcgaccgggccaaggtgaagacagatgacatcgcccgcatctaccagcccaagagatatgccctgagccccaagaccaccatcaccatggcccacctgctggccgcccgggaggacctgagcaagatcatccgcaccagcagcggcaccagccgggagaagacagcctgtgccatcaacaaggtgctgatgggccgggtgcctgacagaggaggccggcccaatgaaattgagcccccacctcctgagatgccaccctggcagaagaggcaggagggcggcggcggccggggcggctggggcggcggcggcggcggcggcggccggggcggcggcggcggcggcggcggccggggcggctggggcggcggcggcggcggctggggcggcggcggcggcggcggcggcggctggggcggcggcggcggcggcggccggggcggcttccagggccgcggggactatggaggccggggcggctatggaggccggggcggctatggaggccggggctacggggacccctacggcggcggcggcggcggcggcggcggcggcggcggcggcggcggctaccgccgctactag

SEQ ID NO: 38853 - DNA, 993 bp, Artificial Sequence
  Description of Artificial Sequence: Synthetic coding sequence
atgaggggccctgagcccggcccccagcccaccatggagggagatgtgctggacaccctggaggccctgggctacaagggccccctgctggaggagcaggccctgaccaaggctgctgagggcggcctgagcagccctgagttcagcgagctgtgcatctggctgggcagccagatcaagagcctgtgcaacctggaggagagcatcaccagcgctggaagagatgacctggagagcttccagctggagatcagcggcttcctgaaggagatggcctgcccctacagcgtgctgatcagcggggacatcaaggaccggctgaagaagaaggaggactgcctgaagctgctgctcttcctgagcacagagctgcaggccagccagatcctgcagaacaagaagcacaagaacagccagctggacaagaacagcgaggtgtaccaggaggtgcaggccatgtttgacaccctgggcatccccaagagcaccaccagtgacatcccccacatgctgaaccaggtggagagcaaggtgaaggacatcctgagcaaggtgcagaagaaccacgtgggcaagcccctgctgaagatggacctgaacagcgagcaggccgagcagctggagcgcatcaatgatgccctgagctgtgaatatgaatgtagaagaaggatgctgatgaagaggctggatgtgacagtgcagagctttggctggagcgaccgggccaaggtgaagacagatgacatcgcccgcatctaccagcccaagagatatgccctgagccccaagaccaccatcaccatggcccacctgctggccgcccgggaggacctgagcaagatcatccgcaccagcagcggcaccagccgggagaagacagcctgtgccatcaacaaggtgggcgtgtccttcagcacagtggagaatgagctgatgatctcctacctgatgttcctgcagatcctggtgtacttctccttcatgtcctggtag

SEQ ID NO: 38854 - DNA, 549 bp, Artificial Sequence
  Description of Artificial Sequence: Synthetic coding sequence
atgatgcaggagagcccagaccctgaagatgatgagacccccacccagagcgaccggctgtccatgctgagccaggagatccagaccctgaagaggagcagcacaggcagctatgaggagcgggtgaagaggctgtctgtgtctgagctgaatgagatcctggaggagattgaaacagccatcaaggagtacagcgaggagctggtgcagcagctggccctgagagatgagctggagtttgagaaggaggtgaagaacagcttcatctctgtgctgattgaggtgcagaacaagcagaaggagcacaaggagacagccaagaagaagaagaagctgaagaatggcagcagccagaatggcaagaatgaaagaagccacatgcctggcacctacctgaccaccgtcatcccctatgagaagaagaatggcccccccagcgtggaggacctgcagatcctgaccaagatcctgcgggccatgaaggaggacagcgagaaggtgcccagcctgctgacagactacatcctgaaggtgctgtgccccacctag

SEQ ID NO: 38855 - DNA, 1062 bp, Artificial Sequence
  Description of Artificial Sequence: Synthetic coding sequence
atggctgctgatggagactggcaggacttctatgagttccaggagcccgcccggagcctgctggaccaggagaactgcaatgccagccctgagcccggggctgaggccggggctgaggccggcggcggcgcagatggcttccctgccccagcctgcagcctggaggagaagctgagcctgtgcttccggcccagcgaccctggagctgagccccccaggacagctgtgcggcccatcacagagaggagcctgctgcagggagatgagatctggaatgccctgacagacaactatggaaatgtgatgcctgtggactggaagagcagccacaccaggaccctgcacctgctgaccctgaacctgtctgagaagggcgtgtctgacagcctgctgtttgacaccagtgatgatgaggagctgcgggagcagctggacatgcacagcatcatcgtgtcctgtgtgaatgatgagcccctcttcaccgctgaccaggtgattgaggagattgaggagatgatgcaggagagcccagaccctgaagatgatgagacccccacccagagcgaccggctgtccatgctgagccaggagatccagaccctgaagaggagcagcacaggcagctatgaggagcgggtgaagaggctgtctgtgtctgagctgaatgagatcctggaggagattgaaacagccatcaaggagtacagcgaggagctggtgcagcagctggccctgagagatgagctggagtttgagaaggaggtgaagaacagcttcatctctgtgctgattgaggtgcagaacaagcagaaggagcacaaggagacagccaagaagaagaagaagctgaagaatggcagcagccagaatggcaagaatgaaagaagccacatgcctggcacctacctgaccaccgtcatcccctatgagaagaagaatggacctccttctgtggaggacctgcagatcctgaccaagatcctgcgggccatgaaggaggacagcgagaaggtgcccagcctgctgacagactacatcctgaaggtgctgtgccccacctag

SEQ ID NO: 38856 - DNA, 1143 bp, Artificial Sequence
  Description of Artificial Sequence: Synthetic coding sequence
atggctgctgatggagactggcaggacttctatgagttccaggagcccgcccggagcctgctggaccaggagaactgcaatgccagccctgagcccggggctgaggccggggctgaggccggcggcggcgcagatggcttccctgccccagcctgcagcctggaggagaagctgagcctgtgcttccggcccagcgaccctggagctgagccccccaggacagctgtgcggcccatcacagagaggagcctgctgcagggagatgagatctggaatgccctgacagacaactatggaaatgtgatgcctgtggactggaagagcagccacaccaggaccctgcacctgctgaccctgaacctgtctgagaagggcgtgtctgacagcctgctgtttgacaccagtgatgatgaggagctgcgggagcagctggacatgcacagcatcatcgtgtcctgtgtgaatgatgagcccctcttcaccgctgaccaggtgattgaggagattgaggagatgatgcaggagagcccagaccctgaagatgatgagacccccacccagagcgaccggctgtccatgctgagccaggagatccagaccctgaagaggagcagcacaggcagctatgaggagcgggtgaagaggctgtctgtgtctgagctgaatgagatcctggaggagattgaaacagccatcaaggagtacagcgaggagctggtgcagcagctggccctgagagatgagctggagtttgagaaggaggtgaagaacagcttcatctctgtgctgattgaggtgcagaacaagcagaaggagcacaaggagacagccaagaagaagaagaagctgaagaatggcagcagccagaatggcaagaatgaaagaagccacatgcctggcacccgcttctccatggagggcatcagcaatgtcatccagaatggcctgcggcacaccttcggcaacagcggcggggagaagcagtacctgaccaccgtcatcccctatgagaagaagaatggcccccccagcgtggaggacctgcagatcctgaccaagatcctgcgggccatgaaggaggacagcgagaaggtgcccagcctgctgacagactacatcctgaaggtgctgtgccccacctag

SEQ ID NO: 38857 - DNA, 423 bp, Artificial Sequence
  Description of Artificial Sequence: Synthetic coding sequence
atgattgaccagctgcagggcacctggaagagcatcagctgtgaaaattctgaggactacatgaaggagctgggcatcggccgggccagcaggaagctgggccgcctggccaagcccaccgtgaccatcagcacagatggagatgtgatcaccatcaagaccaagagcatcttcaagaacaatgagatctccttcaagctgggggaggagtttgaggagatcacccctgggggccacaagaccaagagcaaggtgaccctggacaaggagagcctcatccaggtgcaggactgggatggcaaggagaccaccatcaccaggaagctggtggatggcaagatggtggtggagagcacagtgaacagcgtcatctgcaccaggacctatgagaaggtgagcagcaacagcgtgagcaacagctag

SEQ ID NO: 38858 - DNA, 2208 bp, Artificial Sequence
  Description of Artificial Sequence: Synthetic coding sequence
atgaccccagagctgatgatcaaggcctgcagcttctacacaggccacctggtgaagacccacttctgcacctggagggacatcgcccggaccaatgaaaatgtggtgctggccgagaagatgaacagagctgtgacctgctacaacttccggctgcagaagtctgtgttccaccactggcacagctacatggaggaccagaaggagaagctgaagaacatcctgctgcgcatccagcagatcatctactgccacaagctgaccatcatcctgaccaagtggaggaacacagcccggcacaagagcaagaagaaggaggatgagctgatcctgaagcatgagctgcagctgaagaagtggaagaacagactcatcctgaagagagctgctgctgaggagagcaacttccctgagaggagcagcagcgaggtgttcctggtggatgagaccctgaagtgtgacatcagcctgctgcctgagcgggccatcctgcagatcttcttctacctgagcctgaaggatgtgatcatctgtggccaggtgaaccacgcctggatgctgatgacccagctgaacagcctgtggaatgccatcgacttcagctctgtgaagaatgtcatcccagacaagtacatcgtgtccaccctgcagcgctggaggctgaatgtgctgcggctgaacttccggggctgcctgctgcggcccaagaccttccgctctgtgagccactgcaggaacctgcaggagctgaatgtgtctgactgccccaccttcacagatgagagcatgaggcacatcagcgagggctgccctggggtgctgtgcctgaacctgagcaacaccaccatcaccaacagaaccatgaggctgctgcccaggcacttccacaacctgcagaacctgagcctggcctactgccgccgcttcacagacaagggcctgcagtacctgaacctgggcaatggctgccacaagctgatctacctggacctgagcggctgcacccagatctctgtgcagggcttccgctacatcgccaacagctgcaccggcatcatgcacctgaccatcaatgacatgcccaccctgacagacaactgtgtgaaggccctggtggagaagtgcagccgcatcaccagcctggtgttcaccggggccccccacatcagtgactgcaccttccgggccctgagcgcctgcaagctgaggaagatccgctttgagggcaacaagagggtgacagatgccagcttcaagttcatcgacaagaactaccccaacctgagccacatctacatggctgactgcaagggcatcacagacagcagcctgcggagcctgagccccctgaagcagctgactgtgctgaacctggccaactgtgtgcgcatcggggacatgggcctgaagcagttcctggatggccctgcctccatgaggatccgggagctgaacctgagcaactgtgtgcggctgagtgatgcctctgtgatgaagctgtctgagcgctgccccaacctgaactacctgagcctgaggaactgtgagcacctgacagcccagggcatcggctacatcgtgaacatcttcagcctggtgtccattgacctgagcggcacagacatcagcaatgaaggcctgaatgtgctgagccgccacaagaagctgaaggagctgtctgtgtctgagtgctaccgcatcacagatgatggcatccaggccttctgcaagagcagcctcatcctggagcacctggatgtgtcctactgcagccagctgagtgacatgatcatcaaggccctggccatctactgcatcaacctgaccagcctgagcattgctggctgccccaagatcacagacagcgccatggagatgctgagcgccaagtgccactacctgcacatcctggacatcagcggctgtgtgctgctgacagaccagatcctggaggacctgcagatcggctgcaagcagctgcgcatcctgaagatgcagtactgcaccaacatcagcaagaaggccgcccagaggatgagcagcaaggtgcagcagcaggagtacaacaccaatgaccccccacgctggtttggctatgaccgggagggcaaccctgtgacagagctggacaacatcaccagcagcaagggggccctggagctgactgtgaagaagagcacctacagcagcgaggaccaggccgcctag

SEQ ID NO: 38859 - DNA, 1371 bp, Artificial Sequence
  Description of Artificial Sequence: Synthetic coding sequence
atcctgctgcgcatccagcagatcatctactgccacaagctgaccatcatcctgaccaagtggaggaacacagcccggcacaagagcaagaagaaggaggatgagctgatcctgaagcatgagctgcagctgaagaagtggaagaacagactcatcctgaagagagctgctgctgaggagagcaacttccctgagaggagcagcagcgaggtgttcctggtggatgagaccctgaagtgtgacatcagcctgctgcctgagcgggccatcctgcagatcttcttctacctgagcctgaaggatgtgatcatctgtggccaggtgaaccacgcctggatgctgatgacccagctgaacagcctgtggaatgccatcgacttcagctctgtgaagaatgtcatcccagacaagtacatcgtgtccaccctgcagcgctggaggctgaatgtgctgcggctgaacttccggggctgcctgctgcggcccaagaccttccgcagcctgagccccctgaagcagctgactgtgctgaacctggccaactgtgtgagaattggagacatgggcctgaagcagttcctggatggccctgcctccatgaggatccgggagctgaacctgagcaactgtgtgcggctgagtgatgcctctgtgatgaagctgtctgagcgctgccccaacctgaactacctgagcctgaggaactgtgagcacctgacagcccagggcatcggctacatcgtgaacatcttcagcctggtgtccattgacctgtctggaacagacatcagcaatgaaggcctgaatgtgctgagccgccacaagaagctgaaggagctgtctgtgtctgagtgctaccgcatcacagatgatggcatccaggccttctgcaagagcagcctcatcctggagcacctggatgtgtcctactgcagccagctgagtgacatgatcatcaaggccctggccatctactgcatcaacctgaccagcctgagcattgctggctgccccaagatcacagattctgccatggagatgctgagcgccaagtgccactacctgcacatcctggacatcagcggctgtgtgctgctgacagaccagatcctggaggacctgcagatcggctgcaagcagctgcgcatcctgaagatgcagtactgcaccaacatcagcaagaaggccgcccagaggatgagcagcaaggtgcagcagcaggagtacaacaccaatgaccccccacgctggtttggctatgaccgggagggcaaccctgtgacagagctggacaacatcaccagcagcaaaggagccctggagctgactgtgaagaagagcacctacagcagcgaggaccaggccgcctag

SEQ ID NO: 38860 - DNA, 2124 bp, Artificial Sequence
  Description of Artificial Sequence: Synthetic coding sequence
atgaccccagagctgatgatcaaggcctgcagcttctacacaggccacctggtgaagacccacttctgcacctggagggacatcgcccggaccaatgaaaatgtggtgctggccgagaagatgaacagagctgtgacctgctacaacttccggctgcagaagtctgtgttccaccactggcacagctacatggaggaccagaaggagaagctgaagaacatcctgctgcgcatccagcagatcatctactgccacaagctgaccatcatcctgaccaagtggaggaacacagcccggcacaagagcaagaagaaggaggatgagctgatcctgaagcatgagctgcagctgaagaagtggaagaacagactcatcctgaagagagctgctgctgaggagagcaacttccctgagaggagcagcagcgaggtgttcctggtggatgagaccctgaagtgtgacatcagcctgctgcctgagcgggccatcctgcagatcttcttctacctgagcctgaaggatgtgatcatctgtggccaggtgaaccacgcctggatgctgatgacccagctgaacagcctgtggaatgccatcgacttcagctctgtgaagaatgtcatcccagacaagtacatcgtgtccaccctgcagcgctggaggctgaatgtgctgcggctgaacttccggggctgcctgctgcggcccaagaccttccgctctgtgagccactgcaggaacctgcaggagctgaatgtgtctgactgccccaccttcacagatgagagcatgaggcacatcagcgagggctgccctggggtgctgtgcctgaacctgagcaacaccaccatcaccaacagaaccatgaggctgctgcccaggcacttccacaacctgcagaacctgagcctggcctactgccgccgcttcacagacaagggcctgcagtacctgaacctgggcaatggctgccacaagctgatctacctggacctgagcggctgcacccagatctctgtgcagggcttccgctacatcgccaacagctgcaccggcatcatgcacctgaccatcaatgacatgcccaccctgacagacaactgtgtgaaggccctggtggagaagtgcagccgcatcaccagcctggtgttcaccggggccccccacatcagtgactgcaccttccgggccctgagcgcctgcaagctgaggaagatccgctttgagggcaacaagagggtgacagatgccagcttcaagttcatcgacaagaactaccccaacctgagccacatctacatggctgactgcaagggcatcacagacagcagcctgcggagcctgagccccctgaagcagctgactgtgctgaacctggccaactgtgtgcgcatcggggacatgggcctgaagcagttcctggatggccctgcctccatgaggatccgggagctgaacctgagcaactgtgtgcggctgagtgatgcctctgtgatgaagctgtctgagcgctgccccaacctgaactacctgagcctgaggaactgtgagcacctgacagcccagggcatcggctacatcgtgaacatcttcagcctggtgtccattgacctgagcggcacagacatcagcaatgaggccttctgcaagagcagcctcatcctggagcacctggatgtgtcctactgcagccagctgagtgacatgatcatcaaggccctggccatctactgcatcaacctgaccagcctgagcattgctggctgccccaagatcacagacagcgccatggagatgctgagcgccaagtgccactacctgcacatcctggacatcagcggctgtgtgctgctgacagaccagatcctggaggacctgcagatcggctgcaagcagctgcgcatcctgaagatgcagtactgcaccaacatcagcaagaaggccgcccagaggatgagcagcaaggtgcagcagcaggagtacaacaccaatgaccccccacgctggtttggctatgaccgggagggcaaccctgtgacagagctggacaacatcaccagcagcaagggggccctggagctgactgtgaagaagagcacctacagcagcgaggaccaggccgcctag

SEQ ID NO: 38861 - DNA, 1362 bp, Artificial Sequence
  Description of Artificial Sequence: Synthetic coding sequence
atgaccccagagctgatgatcaaggcctgcagcttctacacaggccacctggtgaagacccacttctgcacctggagggacatcgcccggaccaatgaaaatgtggtgctggccgagaagatgaacagagctgtgacctgctacaacttccggctgcagaagtctgtgttccaccactggcacagctacatggaggaccagaaggagaagctgaagaacatcctgctgcgcatccagcagatcatctactgccacaagctgaccatcatcctgaccaagtggaggaacacagcccggcacaagagcaagaagaaggaggatgagctgatcctgaagcatgagctgcagctgaagaagtggaagaacagactcatcctgaagagagctgctgctgaggagagcaacttccctgagaggagcagcagcgaggtgttcctggtggatgagaccctgaagtgtgacatcagcctgctgcctgagcgggccatcctgcagatcttcttctacctgagcctgaaggatgtgatcatctgtggccaggtgaaccacgcctggatgctgatgacccagctgaacagcctgtggaatgccatcgacttcagctctgtgaagaatgtcatcccagacaagtacatcgtgtccaccctgcagcgctggaggctgaatgtgctgcggctgaacttccggggctgcctgctgcggcccaagaccttccgctctgtgagccactgcaggaacctgcaggagctgaatgtgtctgactgccccaccttcacagatgagagcatgaggcacatcagcgagggctgccctggggtgctgtgcctgaacctgagcaacaccaccatcaccaacagaaccatgaggctgctgcccaggcacttccacaacctgcagaacctgagcctggcctactgccgccgcttcacagacaagggcctgcagtacctgaacctgggcaatggctgccacaagctgatctacctggacctgagcggctgcacccagatcacagacagcgccatggagatgctgagcgccaagtgccactacctgcacatcctggacatcagcggctgtgtgctgctgacagaccagatcctggaggacctgcagatcggctgcaagcagctgcgcatcctgaagatgcagtactgcaccaacatcagcaagaaggccgcccagaggatgagcagcaaggtgcagcagcaggagtacaacaccaatgaccccccacgctggtttggctatgaccgggagggcaaccctgtgacagagctggacaacatcaccagcagcaagggggccctggagctgactgtgaagaagagcacctacagcagcgaggaccaggccgcctag

SEQ ID NO: 38862 - DNA, 2073 bp, Artificial Sequence
  Description of Artificial Sequence: Synthetic coding sequence
atgaccccagagctgatgatcaaggcctgcagcttctacacaggccacctggtgaagacccacttctgcacctggagggacatcgcccggaccaatgaaaatgtggtgctggccgagaagatgaacagagctgtgacctgctacaacttccggctgcagaagtctgtgttccaccactggcacagctacatggaggaccagaaggagaagctgaagaacatcctgctgcgcatccagcagatcatctactgccacaagctgaccatcatcctgaccaagtggaggaacacagcccggcacaagagcaagaagaaggaggatgagctgatcctgaagcatgagctgcagctgaagaagtggaagaacagactcatcctgaagagagctgctgctgaggagagcaacttccctgagaggagcagcagcgaggtgttcctggtggatgagaccctgaagtgtgacatcagcctgctgcctgagcgggccatcctgcagatcttcttctacctgagcctgaaggatgtgatcatctgtggccaggtgaaccacgcctggatgctgatgacccagctgaacagcctgtggaatgccatcgacttcagctctgtgaagaatgtcatcccagacaagtacatcgtgtccaccctgcagcgctggaggctgaatgtgctgcggctgaacttccggggctgcctgctgcggcccaagaccttccgctctgtgagccactgcaggaacctgcaggagctgaatgtgtctgactgccccaccttcacagatgagagcatgaggcacatcagcgagggctgccctggggtgctgtgcctgaacctgagcaacaccaccatcaccaacagaaccatgaggctgctgcccaggcacttccacaacctgcagaacctgagcctggcctactgccgccgcttcacagacaagggcctgcagtacctgaacctgggcaatggctgccacaagctgatctacctggacctgagcggctgcacccagatctctgtgcagggcttccgctacatcgccaacagctgcaccggcatcatgcacctgaccatcaatgacatgcccaccctgacagacaactgtgtgaaggccctggtggagaagtgcagccgcatcaccagcctggtgttcaccggggccccccacatcagtgactgcaccttccgggccctgagcgcctgcaagctgaggaagatccgctttgagggcaacaagagggtgacagatgccagcttcaagttcatcgacaagaactaccccaacctgagccacatctacatggctgactgcaagggcatcacagacagcagcctgcggagcctgagccccctgaagcagctgactgtgctgaacctggccaactgtgtgcgcatcggggacatgggcctgaagcagttcctggatggccctgcctccatgaggatccgggagctgaacctgagcaactgtgtgcggctgagtgatgcctctgtgatgaagctgtctgagcgctgccccaacctgaactacctgagcctgaggaactgtgagcacctgacagcccagggcatcggctacatcgtgaacatcttcagcctggtgtccattgacctgagcggcacagacatcagcaatgaaggcctgaatgtgctgagccgccacaagaagctgaaggagctgtctgtgtctgagtgctaccgcatcacagatgatggcatccagatcacagattctgccatggagatgctgagcgccaagtgccactacctgcacatcctggacatcagcggctgtgtgctgctgacagaccagatcctggaggacctgcagatcggctgcaagcagctgcgcatcctgaagatgcagtactgcaccaacatcagcaagaaggccgcccagaggatgagcagcaaggtgcagcagcaggagtacaacaccaatgaccccccacgctggtttggctatgaccgggagggcaaccctgtgacagagctggacaacatcaccagcagcaaaggagccctggagctgactgtgaagaagagcacctacagcagcgaggaccaggccgcctag

SEQ ID NO: 38863 - DNA, 2124 bp, Artificial Sequence; identical to SEQ ID NO: 38860
  Description of Artificial Sequence: Synthetic coding sequence

SEQ ID NO: 38864 - DNA, 2208 bp, Artificial Sequence; identical to SEQ ID NO: 38858
  Description of Artificial Sequence: Synthetic coding sequence

SEQ ID NO: 38865 - DNA, 2073 bp, Artificial Sequence; identical to SEQ ID NO: 38862
  Description of Artificial Sequence: Synthetic coding sequence

SEQ ID NO: 38866 - DNA, 1362 bp, Artificial Sequence; identical to SEQ ID NO: 38861
  Description of Artificial Sequence: Synthetic coding sequence

SEQ ID NO: 38867 - DNA, 1440 bp, Artificial Sequence
  Description of Artificial Sequence: Synthetic coding sequence
atgagcagccctggcattgatggagaccccaagccaccctgcctgcccagaaatggcctggtgaagctgcccggccagcccaacggcctgggcgccgccagcatcaccaagggcaccccagccaccaagaaccggccctgccagcccccacctccacccaccctgcccccacccagcctggccgcccccctgagcagagctgccctggccggcggcccctgcaccccagctgggggccctgccagcgccctggcccctggccaccctgctgagaggcctcccctggccacagatgagaagatcctgaatggcctcttctggtacttcagcgcctgtgagaagtgtgtgctggcccaggtgtgcaaggcctggaggagagtgctgtaccagcccaagttctgggccggcctgacccctgtgctgcacgccaaggagctgtacaacgtgctgcctggaggagagaaggagtttgtgaacctgcagggctttgctgcccggggctttgagggcttctgcctggtgggcgtgtctgacctggacatctgtgagttcatcgacaactatgccctgagcaagaagggcgtgaaggccatgagcctgaagaggagcaccatcacagatgctggcctggaggtgatgctggagcagatgcagggcgtggtgcggctggagctgagcggctgcaatgacttcacagaggccggcctgtggagcagcctgagcgcccgcatcaccagcctgtctgtgtctgactgcatcaacgtggctgatgatgccatcgccgccatcagccagctgctgcccaacctggccgagctgagcctgcaggcctaccacgtgacagacacagccctggcctacttcaccgcccggcagggccacagcacccacaccctgcggctgctgagctgctgggagatcaccaaccacggcgtggtgaatgtggtgcacagcctgcccaacctgacagccctgagcctgagcggctgcagcaaggtgacagatgatggagtggagctggtggccgagaacctgaggaagctgcggagcctggacctgtcctggtgcccccgcatcacagacatggccctggagtatgtggcctgtgacctgcaccggctggaggagctggtgctggacagatgtgtgcgcatcacagacaccggcctgagctacctgagcaccatgagcagcctgcggagcctgtacctgcgctggtgctgccaggtgcaggactttggcctgaagcacctgctggccctgggcagcctgcggctgctgagcctggccggctgccccctgctgaccaccaccggcctgagcggcctggtgcagctgcaggagctggaggagctggagctgaccaactgccctggggccaccccagagctgttcaagtacttcagccagcacctgccccgctgcctggtgattgaatag

SEQ ID NO: 38868 - DNA, 1440 bp, Artificial Sequence; identical to SEQ ID NO: 38867
  Description of Artificial Sequence: Synthetic coding sequence

SEQ ID NO: 38869 - DNA, 780 bp, Artificial Sequence
  Description of Artificial Sequence: Synthetic coding sequence
atgcatgctgtgccccggggctttgggaagaaggtgcgggtgggcgtgcagagctgcccccccctgctgggccctggggtgcccccagccctgctgcgggtgctggtgtctgctgaggagcccgccctgcccggcacccccagggctgactgggtgcagctgctgctgcggcatgccccccagagggcccggcacccccagctggcccccaccctgcagcccaggacagaatgtcggggcctgggcggcggccgccacaggcctgctggcctgcctgctgccccagatgccaggacagctgcccagaggccctacggcctgcgggccggccagtacagacctgctgtgcctgctgtggccgtgcctgtggccggccagcccggccatgatggagagggcggcgtgcacgcccgggccctgcggcacgtggaggccctgcaggccgctgagggcccccaggccggggccgccctgctgcagaggcagaggcctgtgctgcctggagctgagcctgtgcccctggccgccgcccctgtgcccggcctgagccagaggcaccccccagcccgctgcagagctggcctgcacggcagcctgcctgctggctgccacgtgccccctgtgcacagaggagtgcccaggcacctgcaggagcctgctgctgtggccagcccccagctgcccggccgggccgcccgggtgaagaggaggcacctgcccagcgccccccggggccctgaccggcggcaccctggccggcccccaggggcccctggatag

SEQ ID NO: 38870 - DNA, 2418 bp, Artificial Sequence
  Description of Artificial Sequence: Synthetic coding sequence
atggccagcagcggggaggacatcagcaatgatgatgatgacatgcaccctgctgctgctggcatggctgatggagtgcacctgctgggcttcagtgatgagatcctgctgcacatcctgagccacgtgcccagcacagacctgatcctgaatgtgcggaggacctgcaggaagctggccgccctgtgcctggacaagagcctcatccacacagtgctgctgcagaaggactaccaggccagcgaggacaaggtgcggcagctggtgaaggagatcggccgggagatccagcagctgtccatggccggctgctactggctgcccggcagcacagtggagcacgtggcccgctgccgcagcctggtgaaggtgaacctgagcggctgccacctgaccagcctgcggctgagcaagatgctgagcgccctgcagcacctgcggagcctggccattgatgtgtccccaggctttgatgccagccagctgagcagcgagtgcaaggccaccctgagccgggtgcgggagctgaagcagaccctcttcacccccagctatggagtggtgccctgctgcaccagcctggagaagctgctgctgtactttgagatcctggacaggacccgggagggcgccatcctgagcggccagctgatggtgggccagagcaatgtgccccactaccagaacctgcgggtcttctacgcccggctggcccctggctacatcaaccaggaggtggtgcggctgtacctggccgtgctgagtgacaggaccccccagaacctgcacgccttcctgatctctgtgcccggcagctttgctgagagcggggccaccaagaacctgctggacagcatggccagaaatgtggtgctggatgccctgcagctgcccaagtcctggctgaatggcagcagcctgctgcagcacatgaagttcaacaaccccttctacttctccttcagccgctgcaccctgagcggcggccacctgatccagcaggtgatcaatggaggcaaggacctgcggagcctggccagcctgaacctgagcggctgtgtgcactgcctgagcccagacagcctgctgaggaaggcagaagatgacatcgacagcagcatcctggagaccctggtggccagctgctgcaacctgcggcacctgaacctgtctgctgcccaccaccacagcagcgagggcctgggccgccacctgtgccagctgctggcccggctgcggcacctgcggagcctgagcctgcctgtgtgcagcgtggccgacagcgcccccagggctgaccgggccccagcccagcctgccatgcatgctgtgccccggggctttgggaagaaggtgcgggtgggcgtgcagagctgccccagccccttcagcggccaggcctgcccccagcccagctctgtgttctggagcctgctgaagaacctgcccttcctggagcacctggagctgattggcagcaacttcagcagcgccatgcccagaaatgagcccgccatccggaacagcctgcccccctgcagccgggcccagagcgtgggggacagcgaggtggccgccatcggccagctggccttcctgcggcacctgaccctggcccagctgcccagcgtgctgaccggcagcggcctggtgaacatcggcctgcagtgccagcagctgcggagcctgagcctggccaacctgggcatgatgggcaaggtggtgtacatgcctgccctgagtgacatgctgaagcactgcaagaggctgcgggacctgcggctggagcagccctacttcagcgccaatgcccagttcttccaggccctgagccagtgccccagcctgcagaggctgtgcctggtgagccgcagcggcaccctgcagccagatgctgtgctggccttcatggcccgctgcctgcaggtggtgatgtgccacctgttcaccggggagagcctggccacctgcaagagcctgcagcagagcctgctgcggcgctggggcgaggtgacaggccggcggccccagctgttcacagagctgcgggaggagcccagcgcccggaccagccgggccaccggccggcggcagccctgcctgcctgacagcggcgtggtgtgctgcccctgtggccggcccctggccgtgtctggcatcatcctggtgggcgtgagccccagcctggtggtgaagaccacctgtgtgtacagagtgctcttcaagaacctggactatgccagcatcttcttcctggtgtgcctgtttgaaacagagagccacagcgtggtgcaggccggcgtgcagtggagggacctgagcagcctgcagcccctgctgagcggcctgcagccccagcccccagagcagctggagaatgagctggagatcggcttctcctactgctttgtgatctag

SEQ ID NO: 38871 - DNA, 2157 bp, Artificial Sequence
  Description of Artificial Sequence: Synthetic coding sequence
atggccagcagcggggaggacatcagcaatgatgatgatgacatgcaccctgctgctgctggcatggctgatggagtgcacctgctgggcttcagtgatgagatcctgctgcacatcctgagccacgtgcccagcacagacctgatcctgaatgtgcggaggacctgcaggaagctggccgccctgtgcctggacaagagcctcatccacacagtgctgctgcagaaggactaccaggccagcgaggacaaggtgcggcagctggtgaaggagatcggccgggagatccagcagctgtccatggccggctgctactggctgcccggcagcacagtggagcacgtggcccgctgccgcagcctggtgaaggtgaacctgagcggctgccacctgaccagcctgcggctgagcaagatgctgagcgccctgcagcacctgcggagcctggccattgatgtgtccccaggctttgatgccagccagctgagcagcgagtgcaaggccaccctgagccgggtgcgggagctgaagcagaccctcttcacccccagctatggagtggtgccctgctgcaccagcctggagaagctgctgctgtactttgagatcctggacaggacccgggagggcgccatcctgagcggccagctgatggtgggccagagcaatgtgccccactaccagaacctgcgggtcttctacgcccggctggcccctggctacatcaaccaggaggtggtgcggctgtacctggccgtgctgagtgacaggaccccccagaacctgcacgccttcctgatctctgtgcccggcagctttgctgagagcggggccaccaagaacctgctggacagcatggccagaaatgtggtgctggatgccctgcagctgcccaagtcctggctgaatggcagcagcctgctgcagcacatgaagttcaacaaccccttctacttctccttcagccgctgcaccctgagcggcggccacctgatccagcaggtgatcaatggaggcaaggacctgcggagcctggccagcctgaacctgagcggctgtgtgcactgcctgagcccagacagcctgctgaggaaggcagaagatgacatcgacagcagcatcctggagaccctggtggccagctgctgcaacctgcggcacctgaacctgtctgctgcccaccaccacagcagcgagggcctgggccgccacctgtgccagctgctggcccggctgcggcacctgcggagcctgagcctgcctgtgtgcagcgtggccgacagcgcccccagggctgaccgggccccagcccagcctgccatgcatgctgtgccccggggctttgggaagaaggtgcgggtgggcgtgcagagctgccccagccccttcagcggccaggcctgcccccagcccagctctgtgttctggagcctgctgaagaacctgcccttcctggagcacctggagctgattggcagcaacttcagcagcgccatgcccagaaatgagcccgccatccggaacagcctgcccccctgcagccgggcccagagcgtgggggacagcgaggtggccgccatcggccagctggccttcctgcggcacctgaccctggcccagctgcccagcgtgctgaccggcagcggcctggtgaacatcggcctgcagtgccagcagctgcggagcctgagcctggccaacctgggcatgatgggcaaggtggtgtacatgcctgccctgagtgacatgctgaagcactgcaagaggctgcgggacctgcggctggagcagccctacttcagcgccaatgcccagttcttccaggccctgagccagtgccccagcctgcagaggctgtgcctggtgagccgcagcggcaccctgcagccagatgctgtgctggccttcatggcccgctgcctgcaggtggtgatgtgccacctgttcaccggggagagcctggccacctgcaagagcctgcagcagagcctgctgcgctccttccaggccgagaggcctgccctgaatgtggtgatcttccccctgctgcacgagggcctgacagatgtgatcagagatgtgcccctggtgcacctggatgagatcaccctcttcaagagccgggtggccgaggagccccccaacctgtggtggtag

SEQ ID NO: 38872 - DNA, 2406 bp, Artificial Sequence
  Description of Artificial Sequence: Synthetic coding sequence
atggccagcagcggggaggacatcagcaatgatgatgatgacatgcaccctgctgctgctggcatggctgatggagtgcacctgctgggcttcagtgatgagatcctgctgcacatcctgagccacgtgcccagcacagacctgatcctgaatgtgcggaggacctgcaggaagctggccgccctgtgcctggacaagagcctcatccacacagtgctgctgcagaaggactaccaggccagcgaggacaaggtgcggcagctggtgaaggagatcggccgggagatccagcagctgtccatggccggctgctactggctgcccggcagcacagtggagcacgtggcccgctgccgcagcctggtgaaggtgaacctgagcggctgccacctgaccagcctgcggctgagcaagatgctgagcgccctgcagcacctgcggagcctggccattgatgtgtccccaggctttgatgccagccagctgagcagcgagtgcaaggccaccctgagccgggtgcgggagctgaagcagaccctcttcacccccagctatggagtggtgccctgctgcaccagcctggagaagctgctgctgtactttgagatcctggacaggacccgggagggcgccatcctgagcggccagctgatggtgggccagagcaatgtgccccactaccagaacctgcgggtcttctacgcccggctggcccctggctacatcaaccaggaggtggtgcggctgtacctggccgtgctgagtgacaggaccccccagaacctgcacgccttcctgatctctgtgcccggcagctttgctgagagcggggccaccaagaacctgctggacagcatggccagaaatgtggtgctggatgccctgcagctgcccaagtcctggctgaatggcagcagcctgctgcagcacatgaagttcaacaaccccttctacttctccttcagccgctgcaccctgagcggcggccacctgatccagcaggtgatcaatggaggcaaggacctgcggagcctggccagcctgaacctgagcggctgtgtgcactgcctgagcccagacagcctgctgaggaaggcagaagatgacatcgacagcagcatcctggagaccctggtggccagctgctgcaacctgcggcacctgaacctgtctgctgcccaccaccacagcagcgagggcctgggccgccacctgtgccagctgctggcccggctgcggcacctgcggagcctgagcctgcctgtgtgcagcgtggccgacagcgcccccagggctgaccgggccccagcccagcctgccatgcatgctgtgccccggggctttgggaagaaggtgcgggtgggcgtgcagagctgccccagccccttcagcggccaggcctgcccccagcccagctctgtgttctggagcctgctgaagaacctgcccttcctggagcacctggagctgattggcagcaacttcagcagcgccatgcccagaaatgagcccgccatccggaacagcctgcccccctgcagccgggcccagagcgtgggggacagcgaggtggccgccatcggccagctggccttcctgcggcacctgaccctggcccagctgcccagcgtgctgaccggcagcggcctggtgaacatcggcctgcagtgccagcagctgcggagcctgagcctggccaacctgggcatgatgggcaaggtggtgtacatgcctgccctgagtgacatgctgaagcactgcaagaggctgcgggacctgcggctggagcagccctacttcagcgccaatgcccagttcttccaggccctgagccagtgccccagcctgcagaggctgtgcctggtgagccgcagcggcaccctgcagccagatgctgtgctggccttcatggcccgctgcctgcaggtggtgatgtgccacctgttcaccggggagagcctggccacctgcaagagcctgcagcagagcctgctgcggcgctggggcgaggtgacaggccggcggccccagctgttcacagagctgcgggaggagcccagcgcccggaccagccgggccaccggccggcggcagccctgcctgcctgacagcggcgtggtgtgctgcccctgtggccggcccctggccgtgtctggcatcatcctggtgggcgtgagccccagcctggtggtgaagaccacctgtgtgtacagagtgctcttcaagaacctggactatgccagcatcttcttcctggtgtgcctgtttgaaacagagagccacagcgtggtgcaggccggcgtgcagtggagggacctgagcagcctgcagcccctgctgagcggcctgcagccccagcccccagagcagctgggcctgcaggtgtgcaccaccatccctggatag

SEQ ID NO: 38873 - DNA, 726 bp, Artificial Sequence
  Description of Artificial Sequence: Synthetic coding sequence
atgcacatcacccagctgaacagagaatgtctgctgcacctgttctccttcctggacaaggacagcaggaagagcctggcccggacctgcagccagctgcatgatgtgtttgaggaccctgccctgtggagcctgctgcacttccgcagcctgacagagctgcagaaggacaacttcctgctgggccctgccctgcggagcctgagcatctgctggcacagcagccgggtgcaggtgtgcagcattgaggactggctgaagagcgccttccagaggagcatctgcagcagacatgagagcctggtgaatgacttcctgctgcgggtgtgtgaccggctgtctgctgtgcgcagccccaggagaagagaggccccagcccccagcagcggcacccccatcgctgtgggccccaagagcccccgctggggcggccctgaccacagcgagtttgctgacctgcggtctggagtgactggagcccgggctgctgcccggcggggcctgggcagcctgcgggcagagcggcccagcgagaccccaccagcccctggggtgtcctggggccccccacctcctggggcccctgtggtgatctctgtgaagcaggaggagggcaagcagggccgcacaggccgccgcagccacagagctgccccaccctgtggctttgcccggaccagggtgtgcccccccaccttccctggagcagatgccttcccccagtag

SEQ ID NO: 38874 - DNA, 1620 bp, Artificial Sequence
  Description of Artificial Sequence: Synthetic coding sequence
atggccgccccagccagccggcaggtgagaagaagagcccgggccgccccccggcccaggtctgctgaggactggtggtgggaccggctggccccccggggcagcggctaccacctgctgcagagcgacagcatgctgctggtgctgtctgagcccggccctgcccggccccgggcccagaggcgggccagcaggaggaccccccggcagcccccccggggccccagcgctgctgccaagcccaaggccggcctgcggtctgaggccgctgctgccccagccccagccccagcccccacccccaccccagaggagggcccagatgctggctggggagaccgcatccccctggagatcctggtgcagatcttcggcctgctggtggccgcagatggccccatgcccttcctgggccgggccgcccgggtgtgccgccgctggcaggaggccgccagccagcctgccctgtggcacacagtgaccctgagcagccccctggtgggccggcctgccaagggcggcgtgaaggccgagaagaagctgctggccagcctggagtggctgatgcccaaccgcttcagccagctgcagaggctgaccctcatccactggaagagccaggtgcaccctgtgctgaagctggtgggggagtgctgcccccggctgaccttcctgaagctgagcggctgccacggcgtgacagcagatgccctggtgatgctggccaaggcctgctgccagctgcacagcctggacctgcagcacagcatggtggagagcacagctgtggtgtccttcctggaggaggccggcagcaggatgaggaagctgtggctgacctacagcagccagaccacagccatcctgggcgccctgctgggcagctgctgcccccagctgcaggtgctggaggtgtccacaggcatcaacagaaattccatccccctgcagctgcctgtggaggccctgcagaagggctgcccccagctgcaggtgctgcggctgctgaacctgatgtggctgcccaagcccccaggccggggcgtggcccctggccctggcttccccagcctggaggagctgtgcctggccagcagcacctgcaactttgtgtccaatgaggtgctgggccgcctgctgcacggcagccccaacctgcggctgctggacctgcggggctgtgcccgcatcaccccagctggcctgcaggacctgccctgccgggagctggagcagctgcacctgggcctgtatggcaccagtgaccggctgaccctggccaaggagggcagccccttcctgacccagaagtggtgccacaccctgcgggagctggacctgagcggccagggcttcagcgagaaggacctggagcaggccctggccgccttcctgagcacccctgggggcagccacccagccctgtgcagcctgaacctgcggggcaccagggtgacccccagcacagtgagcagcgtcatcagcagctgccccggcctgctgtacctgaacctggagagctgccgctgcctgccccggggcctgaagagggcctaccggggcctggaggaggtgcagtggtgcctggagcagctgctgaccagccccagccccagctag

SEQ ID NO: 38875 - DNA, 1602 bp, Artificial Sequence
  Description of Artificial Sequence: Synthetic coding sequence
atggccgccccagccagccggcaggtgagaagaagagcccgggccgccccccggcccaggtctgctgaggactggtggtgggaccggctggccccccggggcagcggctaccacctgctgcagagcgacagcatgctgctggtgctgtctgagcccggccctgcccggccccgggcccagaggcgggccagcaggaggaccccccggcagcccccccggggccccagcgctgctgccaagcccaaggccggcctgcggtctgaggccgctgctgccccagccccagccccagcccccacccccaccccagaggagggcccagatgctggctggggagaccgcatccccctggagatcctggtgcagatcttcggcctgctggtggccgcagatggccccatgcccttcctgggccgggccgcccgggtgtgccgccgctggcaggaggccgccagccagcctgccctgtggcacacagtgaccctgagcagccccctggtgggccggcctgccaagggcggcgtgaaggccgagaagaagctgctggccagcctggagtggctgatgcccaaccgcttcagccagctgcagaggctgaccctcatccactggaagagccagctggtgggggagtgctgcccccggctgaccttcctgaagctgagcggctgccacggcgtgacagcagatgccctggtgatgctggccaaggcctgctgccagctgcacagcctggacctgcagcacagcatggtggagagcacagctgtggtgtccttcctggaggaggccggcagcaggatgaggaagctgtggctgacctacagcagccagaccacagccatcctgggcgccctgctgggcagctgctgcccccagctgcaggtgctggaggtgtccacaggcatcaacagaaattccatccccctgcagctgcctgtggaggccctgcagaagggctgcccccagctgcaggtgctgcggctgctgaacctgatgtggctgcccaagcccccaggccggggcgtggcccctggccctggcttccccagcctggaggagctgtgcctggccagcagcacctgcaactttgtgtccaatgaggtgctgggccgcctgctgcacggcagccccaacctgcggctgctggacctgcggggctgtgcccgcatcaccccagctggcctgcaggacctgccctgccgggagctggagcagctgcacctgggcctgtatggcaccagtgaccggctgaccctggccaaggagggcagccccttcctgacccagaagtggtgccacaccctgcgggagctggacctgagcggccagggcttcagcgagaaggacctggagcaggccctggccgccttcctgagcacccctgggggcagccacccagccctgtgcagcctgaacctgcggggcaccagggtgacccccagcacagtgagcagcgtcatcagcagctgccccggcctgctgtacctgaacctggagagctgccgctgcctgccccggggcctgaagagggcctaccggggcctggaggaggtgcagtggtgcctggagcagctgctgaccagccccagccccagctag

SEQ ID NO: 38876 - DNA, 1125 bp, Artificial Sequence
  Description of Artificial Sequence: Synthetic coding sequence
atggccgagcccggggagggcctgcctgaggaggtgctggccctgatcttccgccacctgagcctgcgggacagagctgctgctgcccgggtgtgccgggcctgggccgccgccgccacctgcagcgctgtgtggcatgacaccaagatcagctgtgaatgtgagctggagggcatgctgcccccctacctgagcgcctgcctggaccacatccacaacctgcggctggagtttgagcccagcaggaagcccagccggcgggccgccatcgagctgctgatggtgctggccggccgggcccctggcctgcggggcctgcggctggagtgccgcggggagaagcccctgtttgatgctggaagagatgtgctggaggccgtgcatgctgtgtgtggggccgccagccagctgcggcacctggacctgcggcggctgtccttcaccctggatgatgccctggtgctgcaggccgcccggagctgcccagagctgcacagcctcttcctggacaacagcaccctggtgggctctgtgggccctggctctgtgctggagctgctggaggcctgcccccggctgcgggccctgggcctgcacctggccagcctgagccacgccatcctggaggccctggccgccccagaccgggccccctttgccctgctggccctgcgctgtgcctgcccagaagatgcccgggccagccccctgcccaatgaggcctgggtggccctgcggcggcggcaccctggcctggccgtggagctggagctggagcccgccctgcctgctgagagcgtgaccagggtgctgcagcctgctgtgcctgtggccgccctgcggctgaacctgagcggggacacagtgggccctgtgcgctttgctgcccaccactacgccgccaccctgtgtgccctggaggtgcgggctgctgccagcgctgagctgaatgctgccctggaggagctggccgcccgctgtgccgccctgcgggaggtgcactgcttctgtgtggtgagccacagcgtgctggatgccttccgggcccactgcccccggctgcggacctacaccctgaagctgacccgggagccccacccctggaggcccaccctggtggcctag

SEQ ID NO: 38877 - DNA, 492 bp, Artificial Sequence
  Description of Artificial Sequence: Synthetic coding sequence
atggccgagcccggggagggcctgcctgaggaggtgctggccctgatcttccgccacctgagcctgcgggacagagctgctgctgcccgggtgtgccgggcctgggccgccgccgccacctgcagcgctgtgtggcatgacaccaagatcagctgtgaatgtgagctggagggcatgctgcccccctacctgagcgcctgcctggaccacatccacaacctgcggctggagtttgagcccagcaggaagcccagccggcgggccgccatcgagctgctgatggtgctggccggccgggcccctggcctgcggggcctgcggctggagtgccgcggggagaagcccctgtttgatgctggaagagatgtgctggaggccgtgcatgctgtgtgtggggccgccagccagctgcggcacctggacctgcggcggctgtccttcaccctggatgatgccctggtgctgcaggccgcccggagctgcccagagtag

SEQ ID NO: 38878 - DNA, 1125 bp, Artificial Sequence; identical to SEQ ID NO: 38876
  Description of Artificial Sequence: Synthetic coding sequence

SEQ ID NO: 38879 - DNA, 390 bp, Artificial Sequence
  Description of Artificial Sequence: Synthetic coding sequence
atggccgagcccggggagggcctgcctgaggaggtgctggccctgatcttccgccacctgagcctgcgggacagagctgctgctgcccgggtgtgccgggcctgggccgccgccgccacctgcagcgctgtgtggcatgacaccaagatcagctgtgaatgtgagctggagggcatgctgcccccctacctgagcgcctgcctggaccacatccacaacctgcggctggagtttgagcccagcaggaagcccagccggcgggccgccatcgagctgctgatggtgctggccggccgggcccctggcctgcggggcctgcggctggagtgccgcggggagaagcccctgtttgatgctggaagagatgtgctggaggccgtgcacgcctag

SEQ ID NO: 38880 - DNA, 1701 bp, Artificial Sequence
  Description of Artificial Sequence: Synthetic coding sequence
atggatgagggcggcacccccctgctgcctgacagcctggtgtaccagatcttcctgagcctgggccctgcagatgtgctggccgccggcctggtgtgccggcagtggcaggccgtgtccagagatgagttcctgtggagggagcagttctaccgctactaccaggtggccagagatgtgcccaggcaccctgctgccatgtcctggtatgaggagttccagaggctgtatgacacagtgccctgtgtggaggtgcagaccctgcgggagcacacagaccaggtgctgcacctgtccttcagccacagcggctaccagtttgccagctgcagcaaggactgcaccgtgaagatctggagcaatgacctgaccatcagcctgctgcacagcgctgacatgaggccctacaactggagctacacccagttcagccagttcaacaaggatgacagcctgctgctggccagcggggtcttcctgggcccccacaacagcagcagtggagaaattgctgtgatcagcctggacagctttgccctgctgagccgggtgaggaacaagccctatgatgtgtttggctgctggctgacagagaccagcctcatcagcggcaacctgcacagaattggagacatcaccagctgcagcgtgctgtggctgaacaatgccttccaggatgtggagagtgaaaatgtgaatgtggtgaagaggctcttcaagatccagaacctgaatgccagcacagtgaggacagtgatggtggccgactgcagcagatttgacagcccagacctgctgctggaggccggggaccctgccaccagcccctgccgcatctttgacctgggcagtgacaatgaggaggtggtggccggccctgccccagcccacgccaaggagggcctgcggcacttcctggacagagtgctggagggccgggcccagccccagctgtctgagaggatgctggagaccaaggtggccgagctgctggcccagggccacaccaagcccccagagaggtctgccaccggggccaagagcaagtacctgatcttcaccaccggctgcctgacctacagcccccaccagatcggcatcaagcagatcctgccccaccagatgaccacagctggccctgtgctgggggagggccggggcagtgatgccttctttgatgccctggaccacgtgattgacatccacggccacatcatcggcatgggcctgagcccagacaaccgctacctgtatgtgaacagccgggcctggcccaacggggctgtggtggccgaccccatgcagcccccacccatcgccgaggagattgacctgctggtgtttgacctgaagaccatgagggaggtgagaagagccctgcgggcccaccgggcctacaccccaaatgatgagtgcttcttcatcttcctggatgtgtcccgggactttgtggccagcggggctgaagatagacatggctacatctgggacagacactacaacatctgcctggcccggctgcggcatgaagatgtggtgaacagcgtggtgttcagcccccaggagcaggagctgctgctgacagccagtgatgatgccaccatcaaggcctggaggagccccaggaccatgagggtgctgcaggccccccggccccggcccaggaccttcttctcctggctggccagccagaggaggtag

SEQ ID NO: 38881 - DNA, 603 bp, Artificial Sequence
  Description of Artificial Sequence: Synthetic coding sequence
atggatgagggcggcacccccctgctgcctgacagcctggtgtaccagatcttcctgagcctgggccctgcagatgtgctggccgccggcctggtgtgccggcagtggcaggccgtgtccagagatgagttcctgtggagggagcagttctaccgctactaccaggtggccagagatgtgcccaggcaccctgctgccatgtcctggtatgaggagttccagaggctgtatgacacagtgccctgtgtggaggtgcagaccctgcgggagcacacagaccaggtgctgcacctgtccttcagccacagcggctaccagtttgccagctgcagcaaggactgcaccgtgaaggccatcaccacagctgccccagctgagcagatctggagcaatgacctgaccatcagcctgctgcacagcgctgacatgaggccctacaactggagctacacccagttcagccagttcaacaaggatgacagcctgctgctggccagcggggtcttcctgggcccccacaacagcagcagtggagaaattgctgtgatcagcctggacagctttgccctgctgagccgggtgaggaacaagccctatgactag

SEQ ID NO: 38882 - DNA, 804 bp, Artificial Sequence
  Description of Artificial Sequence: Synthetic coding sequence
gacagcctgagcagccctggcctgcccacagacagctttgccctgctgagccgggtgaggaacaagccctatgatgtgtttggctgctggctgacagagaccagcctcatcagcggcaacctgcaccgcatcggggacatcaccagctgcagcgtgctgtggctgaacaatgccttccaggatgtggagagtgaaaatgtgaatgtggtgaagaggctcttcaagatccagaacctgaatgccagcacagtgaggacagtgatggtggccgactgcagcagatttgacagcccagacctgctgctggaggccggggaccctgccaccagcccctgccgcatctttgacctgggcagtgacaatgaggaggtggtggccggccctgccccagcccacgccaaggagggcctgcggcacttcctggacagagtgctggagggccgggcccagccccagctgtctgagaggatgctggagaccaaggtggccgagctgctggcccagggccacaccaagcccccagagaggtctgccactggagccaagagcaagtacctgatcttcaccaccggctgcctgacctacagcccccaccagatcggcatcaagcagatcctgccccaccagatgaccacagctggccctgtgctgggggagggccggggcagtgatgccttctttgatgccctggaccacgtgattgacatccacggccacatcatcggcatgggcctgagcccagacaaccgctacctgtatgtgaacagccgggcctggcccaatggagctgtggtggccgactag

SEQ ID NO: 38883 - DNA, 390 bp, Artificial Sequence
  Description of Artificial Sequence: Synthetic coding sequence
atggatgagggcggcacccccctgctgcctgacagcctggtgtaccagatcttcctgagcctgggccctgcagatgtgctggccgccggcctggtgtgccggcagtggcaggccgtgtccagagatgagttcctgtggagggagcagttctaccgctactaccaggtggccagagatgtgcccaggcaccctgctgccatgtcctggtatgaggagttccagaggctgtatgacacagtgccctgtgtggaggtgcagaccctgcgggagcacacagaccaggtgctgcacctgtccttcagccacagcggctaccagtttgccagctgcagcaaggactgcaccgtgaagatctggagcaatgacctgaccatcagcctgctgcactag

SEQ ID NO: 38884 - DNA, 1467 bp, Artificial Sequence
  Description of Artificial Sequence: Synthetic coding sequence
atggagctgcccctgggccgctgtgatgacagcaggacctgggatgatgacagcgaccctgagagcgagacagatcctgatgcccaggccaaggcctacgtggcccgggtgctgagcccccccaagagcggcctggccttcagccggcccagccagctgagcaccccagctgccagccccagcgccagcgagcccagggctgccagccgggtgtctgctgtgtctgagcccggcctgctgagcctgcccccagagctgctgctggagatctgcagctacctggatgcccggctggtgctgcacgtgctgagccgggtgtgccacgccctgcgggacctggtgtctgaccacgtgacctggaggctgcgggccctgcggcgggtgcgggccccctaccctgtggtggaggagaagaactttgactggccagctgcctgcatcgccctggagcagcacctgagccgctgggccgaggatggccgctgggtggagtacttctgcctggccgagggccacgtggcctctgtggacagcgtgctgctgctgcagggcggcagcctgtgcctgagcggcagccgggacagaaatgtgaacctgtgggacctgcggcagctgggcacagagagcaaccaggtgctgatcaagaccctgggcaccaagaggaacagcacccatgagggctgggtgtggagcctggccgcccaggaccaccgggtgtgcagcggctcctgggacagcacagtgaagctgtgggacatggctgctgatggccagcagtttggagagatcaaggccagcagcgctgtgctgtgcctgagctacctgcctgacatcctggtgacaggcacctatgacaagaaggtgaccatctatgacccccgggacaggatggagaccagagatgccctgatgggctggggcggccccagccggggcagtgacatccccccccaccggcccatcacccatgaagctggccctgccctgctgaagcaccagcagctgcacagcaggcctgtgctgaccctgctggctgatgacagacacatcatcagcggcagcgaggaccacaccctggtggtggtggaccggcgggccaacagcgtgctgcagaggctgcagctggacagctacctgctgtgcatgagctaccaggagccccagctgtgggccggggacaaccagggcctgctgcacgtgtttgccaacagaaatggctgcttccagctgatccgcagctttgatgtgggccacagcttccccatcaccggcatccagtacagcgtgggcgccctgtacaccaccagcacagacaagaccatccgggtgcacgtgcccacagatcctcccaggaccatctgcaccaggagacatgacaatggcctgaacagagtgtgtgccgagggcaacctggtggtggccggcagcggggacctgagcctggaggtgtggaggctgcaggcctag

SEQ ID NO: 38885 - DNA, 1377 bp, Artificial Sequence
  Description of Artificial Sequence: Synthetic coding sequence
atggagctgcccctgggccgctgtgatgacagcaggacctgggatgatgacagcgaccctgagagcgagacagatcctgatgcccaggccaaggcctacgtggcccgggtgctgagcccccccaagagcggcctggccttcagccggcccagccagctgagcaccccagctgccagccccagcgccagcgagcccagggctgccagccgggtgtctgctgtgtctgagcccggcctgctgagcctgcccccagagctgctgctggagatctgcagctacctggatgcccggctggtgctgcacgtgctgagccgggtgtgccacgccctgcgggacctggtgtctgaccacgtgacctggaggctgcgggccctgcggcgggtgcgggccccctaccctgtggtggaggagaagaactttgactggccagctgcctgcatcgccctggagcagcacctgagccgctgggccgaggatggccgctgggtggagtacttctgcctggccgagggccacgtggcctctgtggacagcgtgctgctgctgcagggcggcagcctgtgcctgagcggcagccgggacagaaatgtgaacctgtgggacctgcggcagctgggcacagagagcaaccaggtgctgatcaagaccctgggcaccaagaggaacagcacccatgagggctgggtgtggagcctggccgcccaggaccaccgggtgtgcagcggctcctgggacagcacagtgaagctgtgggacatggctgctgatggccagcagtttggagagatcaaggccagcagcgctgtgctgtgcctgagctacctgcctgacatcctggtgacaggcacctatgacaagaaggtgaccatctatgaccccagggctggccctgccctgctgaagcaccagcagctgcacagcaggcctgtgctgaccctgctggctgatgacagacacatcatcagcggcagcgaggaccacaccctggtggtggtggaccggcgggccaacagcgtgctgcagaggctgcagctggacagctacctgctgtgcatgagctaccaggagccccagctgtgggccggggacaaccagggcctgctgcacgtgtttgccaacagaaatggctgcttccagctgatccgcagctttgatgtgggccacagcttccccatcaccggcatccagtacagcgtgggcgccctgtacaccaccagcacagacaagaccatccgggtgcacgtgcccacagatcctcccaggaccatctgcaccaggagacatgacaatggcctgaacagagtgtgtgccgagggcaacctggtggtggccggcagcggggacctgagcctggaggtgtggaggctgcaggcctag

SEQ ID NO: 38886 - DNA, 591 bp, Artificial Sequence
  Description of Artificial Sequence: Synthetic coding sequence
atgagggccagcagcgctgtgctgtgcctgagctacctgcctgacatcctggtgacaggcacctatgacaagaaggtgaccatctatgaccccagggctggccctgccctgctgaagcaccagcagctgcacagcaggcctgtgctgaccctgctggctgatgacagacacatcatcagcggcagcgaggaccacaccctggtggtggtggaccggcgggccaacagcgtgctgcagaggctgcagctggacagctacctgctgtgcatgagctaccaggagccccagctgtgggccggggacaaccagggcctgctgcacgtgtttgccaacagaaatggctgcttccagctgatccgcagctttgatgtgggccacagcttccccatcaccggcatccagtacagcgtgggcgccctgtacaccaccagcacagacaagaccatccgggtgcacgtgcccacagatcctcccaggaccatctgcaccaggagacatgacaatggcctgaacagagtgtgtgccgagggcaacctggtggtggccggcagcggggacctgagcctggaggtgtggaggctgcaggcctag

SEQ ID NO: 38887 - DNA, 468 bp, Artificial Sequence
  Description of Artificial Sequence: Synthetic coding sequence
atgcacaagaacagcaagaggaacaacaacctgcgggtgagccacacagaggccaacagcgtggatgctgagaaggagaagaatgaaagccagaacaacttctttgagctgctgcctgctgagatcaccttcaagatcttcagccagctggacatccgcagcctgtgccgggccagcctgacctgccgctcctggaatgacaccatccggaacagcgacagcctgtggaagccccactgcatgacagtgcgggctgtgtgccggcgggagattgatgatgacctggagagcggctacagctggagggtcatcctgctgaggaactaccagaagagcaaggtgaagcatgagtggctgagcggccgctacagcaacatctgcagccccatcagcctgcctgagaagatcatgtaccccatggatgctgacacctggggcgagatcctggaggccgagctggagaggtag

SEQ ID NO: 38888 - DNA, 744 bp, Artificial Sequence
  Description of Artificial Sequence: Synthetic coding sequence
atgtggcccctgctgaccatgcacatcacccagctgaacagagaatgtctgctgcacctgttctccttcctggacaaggacagcaggaagagcctggcccggacctgcagccagctgcatgatgtgtttgaggaccctgccctgtggagcctgctgcacttccgcagcctgacagagctgcagaaggacaacttcctgctgggccctgccctgcggagcctgagcatctgctggcacagcagccgggtgcaggtgtgcagcattgaggactggctgaagagcgccttccagaggagcatctgcagcagacatgagagcctggtgaatgacttcctgctgcgggtgtgtgaccggctgtctgctgtgcgcagccccaggagaagagaggccccagcccccagcagcggcacccccatcgctgtgggccccaagagcccccgctggggcggccctgaccacagcgagtttgctgacctgcggtctggagtgactggagcccgggctgctgcccggcggggcctgggcagcctgcgggcagagcggcccagcgagaccccaccagcccctggggtgtcctggggccccccacctcctggggcccctgtggtgatctctgtgaagcaggaggagggcaagcagggccgcacaggccgccgcagccacagagctgccccaccctgtggctttgcccggaccagggtgtgcccccccaccttccctggagcagatgccttcccccagtag

SEQ ID NO: 38889 - DNA, 177 bp, Artificial Sequence
  Description of Artificial Sequence: Synthetic coding sequence
aacagcacagatcctgtgaaggccgcccagtttgagatgagcaaccccagccacctgctcttcttcctgccctgccccttcagccctgtgagcagcctgtttgcctttgtgaatgccaagctgaagtggaggctgggcctgaagaccccagagcagaccaagcccccaggcccctag

SEQ ID NO: 38890 - DNA, 2073 bp, Artificial Sequence
  Description of Artificial Sequence: Synthetic coding sequence
atgcagcccccacccaggaaggtgaagccagcccaggaggtgaagctgcgcttcctggagcagctgagcatcctgcagacctggcagcagcgggaggccgacctgctggaggacatccgcagctacagcaagcagagagctgccatcgagcgggagtatggccaggccctgcagaagctggccggccccttcctgaagcgggagggccacaggtctggagagatggacagccggggccgcacagtgtttggagcctggcgctgcctgctggatgccaccgtggccggcggccagacccggctgcaggccagtgaccgctacagagacctggccggcggcaccggccgcagcgccaaggagcaggtgctgaggaaaggaacagagaacctgcagagggcccaggccgaggtgctgcagagcgtgcgggagctgagccgcagcaggaagctgtatggccagcgggagcgggtgtgggccctggcccaggagaaggccgcagatgtgcaggcccggctgaacagaagtgaccacggcatcttccacagcaggaccagcctgcagaagctgagcaccaagctgagcgcccagagcgcccagtacagccagcagctgcaggccgccagaaatgagtacctgctgaacctggtggccaccaatgcccacctggaccactactaccaggaggagctgcctgccctgctgaaggccctggtgtctgagctgtctgagcacctgcgggaccccctgaccagcctgagccacacagagctggaggccgctgaggtgatcctggagcacgcccacagaggagagcagaccaccagccaggtgtcctgggagcaggacctgaagctgttcctgcaggagcccggggtcttcagccccaccccaccccagcagttccagcctgctggaacagaccaggtgtgtgtgctggagtggggcgctgagggcgtggccggcaagagcggcctggagaaggaggtgcagaggctgaccagccgggccgcccgggactacaagatccagaaccacggccaccgggtgctgcagaggctggagcagaggcggcagcaggccagcgagcgggaggcccccagcattgagcagaggctgcaggaggtgcgggagagcatccggcgggcccaggtgtcccaggtgaagggggccgcccggctggccctgctgcagggcgccggcctggatgtggagcgctggctgaagccagccatgacccaggcccaggatgaggtggagcaggagcggcggctgtctgaggcccggctgagccagagggacctgagccccacagcagaagatgctgagctgagtgactttgaggagtgtgaggagaccggggagctgtttgaggagcccgccccccaggccctggccacccgggccctgccctgcccagcccacgtggtgttccgctaccaggccggccgggaggatgagctgaccatcacagaaggagagtggctggaggtgattgaggagggagatgctgatgagtgggtgaaggccaggaaccagcacggggaggtgggctttgtgcctgagcgctacctgaacttcccagacctgagcctgcctgagagcagccaggacagcgacaacccctgtggggctgagcccacagccttcctggcccaggccctgtacagctacacaggccagagcgctgaggagctgtccttccctgagggcgccctgatccggctgctgccccgggcccaggatggagtggatgatggcttctggagaggagaatttggaggccgggtgggcgtcttccccagcctgctggtggaggagctgctgggccccccaggccccccagagctgagtgaccctgagcagatgctgcccagccccagcccccccagcttcagccccccagcccccacctctgtgctggatggccccccagcccctgtgctgcccggggacaaggccctggacttccctggcttcctggacatgatggccccccggctgcggcccatgaggcctcctcctcctcctccagccaaggccccagaccccggccacccagaccccctgacctag

SEQ ID NO: 38891 - DNA, 2055 bp, Artificial Sequence
  Description of Artificial Sequence: Synthetic coding sequence
atgcagaagctggccagccagtacctgaagagggactggccaggagtgaaggcagatgacagaaatgactaccgctccatgtaccctgtgtggaagagcttcctggagggcaccatgcaggtggcccagagcaggatgaacatctgtgagaactacaagaacttcatcagcgagcccgccaggacagtgcgcagcctgaaggagcagcagctgaagagatgtgtggaccagctgaccaagatccagacagagctgcaggagaccgtgaaggacctggccaagggcaagaagaagtactttgaaacagagcagatggcccatgctgtgcgggagaaggctgacatcgaggccaagagcaagctgagcctcttccagagccgcatcagcctgcagaaggcctctgtgaagctgaaggcccggcgctctgagtgcaacagcaaggccacccacgccagaaatgactacctgctgaccctggccgccgccaatgcccaccaggaccgctactaccagacagacctggtgaacatcatgaaggccctggatggaaatgtgtatgaccacctgaaggactacctgattgccttcagcaggacagagctggagacctgccaggccgtgcagaacaccttccagttcctgctggagaacagcagcaaggtggtgcgggactacaacctgcagctgttcctgcaggagaatgctgtgttccacaagccccagcccttccagttccagccctgtgacagcgacaccagccggcagctggagagcgagaccggcaccacagaggagcacagcctgaacaaggaggccaggaagtgggccaccagggtggcccgggagcacaagaacatcgtgcaccagcagagggtgctgaatgacctggagtgccacggggctgctgtgtctgagcagagcagagctgagctggagcagaagattgatgaggcccgggagaacatcaggaaggccgagatcatcaagctgaaggccgaggcccggctggacctgctgaagcagatcggcgtgtctgtggacacctggctgaagagcgccatgaaccaggtgatggaggagctggagaatgaacgctgggcccggcccccagctgtgaccagcaatggcaccctgcacagcctgaatgctgacacagagcgggaggagggggaggagtttgaggacaacatggatgtgtttgatgacagcagcagcagccccagcggcaccctgaggaactaccccctgacctgcaaggtggtgtacagctacaaggccagccagccagatgagctgaccatcgaggagcacgaggtgctggaggtgattgaagatggagacatggaggactgggtgaaggccaggaacaaggtgggccaggtgggctacgtgcctgagaagtacctgcagttccccaccagcaacagcctgctgtccatgctgcagagcctggccgccctggacagccgcagccacaccagcagcaacagcacagaggccgagctggtgtctggcagcctgaatggagatgcctctgtgtgctttgtgaaggccctgtatgactatgagggccagacagatgatgagctgtccttccctgagggcgccatcatccgcatcctgaacaaggagaaccaggatgatgatggcttctgggagggggagttcaacggccgcatcggggtcttccccagcgtgctggtggaggagctgagcgcctctgaaaatggagacaccccctggatgagggagatccagatcagccccagccccaagccccacgccagcctgccccccctgcccctgtatgaccagccccccagcagcccctaccccagcccagacaagaggagcagcctgtacttccccaggagccccagcgccaatgagaagagcctgcatgctgagagccctggcttcagccaggccagccgccacaccccagagaccagctatggcaagctgcggcctgtgcgggccgcccctcctccacccacccagaaccaccggcggcctgctgagaagattgaagatgtggagatcaccctggtgtag

SEQ ID NO: 38892 - DNA, 2223 bp, Artificial Sequence
  Description of Artificial Sequence: Synthetic coding sequence
atgcagcccccacccaggaaggtgaaggtgacccaggagctgaagaacatccaggtggagcagatgaccaagctgcaggccaagcaccaggccgagtgtgacctgctggaggacatgaggaccttcagccagaagaaggccgccatcgagcgggagtatgcccagggcatgcagaagctggccagccagtacctgaagagggactggccaggagtgaaggcagatgacagaaatgactaccgctccatgtaccctgtgtggaagagcttcctggagggcaccatgcaggtggcccagagcaggatgaacatctgtgagaactacaagaacttcatcagcgagcccgccaggacagtgcgcagcctgaaggagcagcagctgaagagatgtgtggaccagctgaccaagatccagacagagctgcaggagaccgtgaaggacctggccaagggcaagaagaagtactttgaaacagagcagatggcccatgctgtgcgggagaaggctgacatcgaggccaagagcaagctgagcctcttccagagccgcatcagcctgcagaaggcctctgtgaagctgaaggcccggcgctctgagtgcaacagcaaggccacccacgccagaaatgactacctgctgaccctggccgccgccaatgcccaccaggaccgctactaccagacagacctggtgaacatcatgaaggccctggatggaaatgtgtatgaccacctgaaggactacctgattgccttcagcaggacagagctggagacctgccaggccgtgcagaacaccttccagttcctgctggagaacagcagcaaggtggtgcgggactacaacctgcagctgttcctgcaggagaatgctgtgttccacaagccccagcccttccagttccagccctgtgacagcgacaccagccggcagctggagagcgagaccggcaccacagaggagcacagcctgaacaaggaggccaggaagtgggccaccagggtggcccgggagcacaagaacatcgtgcaccagcagagggtgctgaatgacctggagtgccacggggctgctgtgtctgagcagagcagagctgagctggagcagaagattgatgaggcccgggagaacatcaggaaggccgagatcatcaagctgaaggccgaggcccggctggacctgctgaagcagatcggcgtgtctgtggacacctggctgaagagcgccatgaaccaggtgatggaggagctggagaatgaacgctgggcccggcccccagctgtgaccagcaatggcaccctgcacagcctgaatgctgacacagagcgggaggagggggaggagtttgaggacaacatggatgtgtttgatgacagcagcagcagccccagcggcaccctgaggaactaccccctgacctgcaaggtggtgtacagctacaaggccagccagccagatgagctgaccatcgaggagcacgaggtgctggaggtgattgaagatggagacatggaggactgggtgaaggccaggaacaaggtgggccaggtgggctacgtgcctgagaagtacctgcagttccccaccagcaacagcctgctgtccatgctgcagagcctggccgccctggacagccgcagccacaccagcagcaacagcacagaggccgagctggtgtctggcagcctgaatggagatgcctctgtgtgctttgtgaaggccctgtatgactatgagggccagacagatgatgagctgtccttccctgagggcgccatcatccgcatcctgaacaaggagaaccaggatgatgatggcttctgggagggggagttcaacggccgcatcggggtcttccccagcgtgctggtggaggagctgagcgcctctgaaaatggagacaccccctggatgagggagatccagatcagccccagccccaagccccacgccagcctgccccccctgcccctgtatgaccagccccccagcagcccctaccccagcccagacaagaggagcagcctgtacttccccaggagccccagcgccaatgagaagagcctgcatgctgagagccctggcttcagccaggccagccgccacaccccagagaccagctatggcaagctgcggcctgtgcgggccgcccctcctccacccacccagaaccaccggcggcctgctgagaagattgaagatgtggagatcaccctggtgtag

SEQ ID NO: 38893 - DNA, 1548 bp, Artificial Sequence
  Description of Artificial Sequence: Synthetic coding sequence
atgcagaagctggccagccagtacctgaagagggactggccaggagtgaaggcagatgacagaaatgactaccgctccatgtaccctgtgtggaagagcttcctggagggcaccatgcaggtggcccagagcaggatgaacatctgtgagaactacaagaacttcatcagcgagcccgccaggacagtgcgcagcctgaaggagcagcagctgaagagatgtgtggaccagctgaccaagatccagacagagctgcaggagaccgtgaaggacctggccaagggcaagaagaagtactttgaaacagagcagatggcccatgctgtgcgggagaaggctgacatcgaggccaagagcaagctgagcctcttccagagccgcatcagcctgcagaaggcctctgtgaagctgaaggcccggcgctctgagtgcaacagcaaggccacccacgccagaaatgactacctgctgaccctggccgccgccaatgcccaccaggaccgctactaccagacagacctggtgaacatcatgaaggccctggatggaaatgtgtatgaccacctgaaggactacctgattgccttcagcaggacagagctggagacctgccaggccgtgcagaacaccttccagttcctgctggagaacagcagcaaggtggtgcgggactacaacctgcagctgttcctgcaggagaatgctgtgttccacaagccccagcccttccagttccagccctgtgacagcgacaccagccggcagctggagagcgagaccggcaccacagaggagcacagcctgaacaaggaggccaggaagtgggccaccagggtggcccgggagcacaagaacatcgtgcaccagcagagggtgctgaatgacctggagtgccacggggctgctgtgtctgagcagagcagagctgagctggagcagaagattgatgaggcccgggagaacatcaggaaggccgagatcatcaagctgaaggccgaggcccggctggacctgctgaagcagatcggcgtgtctgtggacacctggctgaagagcgccatgaaccaggtgatggaggagctggagaatgaacgctgggcccggcccccagctgtgaccagcaatggcaccctgcacagcctgaatgctgacacagagcgggaggagggggaggagtttgaggacaacatggatgtgtttgatgacagcagcagcagccccagcggcaccctgaggaactaccccctgacctgcaaggtggtgtacagctacaaggccagccagccagatgagctgaccatcgaggagcacgaggtgctggaggtgattgaagatggagacatggaggactgggtgaaggccaggaacaaggtgggccaggtgggctacgtgcctgagaagtacctgcagttccccaccagcaacagcctgctgtccatgctgcagagcctggccgccctggacagccgcagccacaccagcagcaacagcacagaggccgagctggtgtctggcagcctgaatggagatgccagcggcaaggactag

SEQ ID NO: 38894 - DNA, 1854 bp, Artificial Sequence
  Description of Artificial Sequence: Synthetic coding sequence
atggacctgaagacagctgtgttcaatgctgccagagatggcaagctgcggctgctgaccaagctgctggccagcaagagcaaggaggaggtgagcagcctcatcagcgagaagaccaacggggccacccccctgctgatggccgcccgctatggccacctggacatggtggagttcctgctggagcagtgcagcgccagcattgaggtgggcggctctgtgaactttgatggagagaccattgaaggagccccacccctgtgggccgccagcgctgctggccacctgaaggtggtgcagagcctgctgaaccacggggcctctgtgaacaacaccaccctgaccaacagcacccccctgcgggccgcctgctttgatggccacctggagatcgtgaagtacctggtggagcacaaggctgacctggaggtgagcaacagacatggccacacctgcctgatgatcagctgctacaagggccacaaggagatcgcccagtacctgctggagaagggagcagatgtgaacaggaagtctgtgaagggcaacacagccctgcatgactgtgccgagagcggcagcctggacatcatgaagatgctgctgatgtactgtgccaagatggagaaggatggctacggcatgacccccctgctgagcgcctctgtgacaggccacaccaacatcgtggacttcctgacccaccacgcccagaccagcaagacagagcgcatcaatgccctggagctgctgggcgccacctttgtggacaagaagagggacctgctgggcgccctgaagtactggaagaaggccatgaacatgagatacagcgacaggaccaacatcatcagcaagcctgtgccccagaccctcatcatggcctatgactatgccaaggaggtgaacagcgctgaggagctggagggcctgattgctgaccctgatgagatgaggatgcaggccctgctgatccgggagcgcatcctgggccccagccacccagacaccagctactacatccgctacagaggagctgtgtatgctgacagcggcaacttcaagcgctgcatcaacctgtggaagtatgccctggacatgcagcagagcaacctggaccccctgagccccatgacagccagcagcctgctgagctttgctgagctgttctccttcatgctgcaggaccgggccaagggcctgctgggcaccaccgtgacctttgatgacctgatgggcatcctgtgcaagtctgtgctggagattgaaagagccatcaagcagacccagtgcccagctgaccccctgcagctgaacaaggccctgagcatcatcctgcacctgatctgcctgctggagaaggtgccctgcaccctggagcaggaccacttcaagaagcagaccatctaccgcttcctgaagctgcacccccggggcaagaacaacttcagccccctgcacctggccgtggacaagaacaccacctgtgtgggccgctaccctgtgtgcaagttccccagcctgcaggtgacagccatcctgattgaatgtggggctgatgtgaatgtgcgggacagtgatgacaacagccccctgcacatcgccgccctgaacaaccacccagacatcatgaacctgctgatcaagagcggggcccactttgatgccaccaacctgcacaagcagacagccagtgacctgctggatgagaaggagatcgccaagaacctgatccagcccatcaaccacaccaccctgcagtgcctggccgcccgggtcatcgtgaaccaccgcatctactacaagggccacatccctgagaagctggagacctttgtgtccctgcacaggtag

SEQ ID NO: 38895 - DNA, 5433 bp, Artificial Sequence
  Description of Artificial Sequence: Synthetic coding sequence
atggagaccctggacagccagagggtgcaggaccggctgctggccgcccctggctgcagcagccccagcggccagcaggagctgttcagcagccacgtgatgcaggaggagagcgccaatgacatggagtgtgagcagctgcctgctgagatcctgcggcaggtgacagtgcaccgggaccccatctacggctttggatttgtggccggcagcgagaggcctgtggtggtgcgctctgtgcggcctgggggccccagcgagaacaagctgctggccggggaccagatcgtggccatcaatgaggaggatgtgtctgaggccccccgggagcggctgattgagctgatccgcagcgccaaggagttcatcgtgctgactgtgctgcacacccaccagagccccaagagcgccttcatctctgctgccaagaaggccaagctgcggagcaaccctgtgaaggtgcgcttcagcgagcaggtggccgtgggggagacagatgccaagatgatgaagaaggaggccctgctgctgatccccaacgtgctgaaggtgttcctggagaatggccagatcaagagcttcacctttgatggccgcaccaccgtgaaggatgtgatgctgaccctgcaggaccggctgagcctgcgcttcatcgagcactttgccctggtgctggagtatgccggccctgagcagaaccacaagttcctgctgctgcaggacaagcagcccctggcctacgtggtgcagaggacccactaccacggcatgaagtgcctcttccgcatctccttcttccccaaggaccctgtggagctgctgcggcgggaccctgctgcctttgagtacctgtacatccagagcagaaatgatgtgatccgggagagatttggcatggaccccaagccagagatgctgctgggcctggccgccctgcacatctacatcaccgtgtctgccacccggcccagccagaagatcagcctgaagaatgtggagaaggagtggggcctggagcccttcctgccccccagcctgctgcaggtgatcaaggagaagaacctgaggaagagcctgagccagcagctgaaggcccaccagacccaccccagctgtggcaccaagggcagcgccatccaggccaagctgcagtacctgcgcatcctgaatgagctgcccaccttcaccggggtgctcttcaacacagtgggcctggatgagaagcagagcgccaccaccctgctggtgggccccaggcatggcatcagccacgtgattgacctgaagaccaacctgaccaccgtgctgtctgagttcagcaagatcagcaagatccagctgttccgggagaaccagggcgtggcccgggtggagaccagcatcatggatgccaagcccctggtgctgctgatggagtggccagaggccaccaactttgcctgcctgattgctggctactgccgcctgctgctggacagcaggaagatggtgttcagcaggcctgccagccagcccctgcccccacccatgatcaaggctgactacatgcacagcgcccacaggcctgtgactggaggccacctgggcaagaaggagagcagctatgtgggctctgtgggcaccagccccaggaagagcagccgctgcaccccacctcctgctgacagcgagctggtgtccttctgctacctgcacatgagggagcagaggaaggagcaggagagcaggacagatgtgaatgaaaatctcatcttctttgaggagacccggcccaggaccaagagtgaccccaccagcaagagcagcggccagggctatgaggtggtgcctgatgactttgatgctgccagcctggaccacgagccctgtgccagccgggcccggagctacaccctggacaacagcctgggcgctgaggccctgaacttctactgtgacagctgcaaggccaagctgcaggagcagctgggccccaggaagggcggcaagccaggcagcagccgggacaacatcgtggacctgatgagcctgcccccacctggcagcgaggaggaggaggaggaggaggatgagaccaccagcctgctgcctgccatcgccgcccctcctcctggcttccgggacaacagcagtgatgaagatgaccccaagagaagagctgtgcagagccaggagcagggccgccacctgcggggcctgctgtatgatgagatccctgtgaccctgattgattctgtgcagaccaggacagtgcgggaccacgcccaggagctggatgatgccctggtgtccaccctgcaggccctggaggccctggccgcctctgaagatggcccccaccccccaccaccccagacagctggcctcatcgtgctggccaccatcaccccagagagcagcctggacagcggccacgagaccaacagcagcgagctgacagacatgtctgagatgatgtctgccatgaagcagcaccagaacaccacctacttcctggcccagcacctgaacaaggacagcctgctggccaggaaggacctgcccttccgcatccagagctgtgccgcccaggccgtgctgacagccccctacagcctgggccgcccagaccccaaccccagcctgcagcccatcgccaccggccagagccctggccccccaggggcccggaggaagctgccccagagcgagggccaggtgcagggcgagaggacctacagcctggccgtgcacccagccctgagcccccagctgtctgagcagaagaacctgagcctgctgagccctgtgcctgaggacaagggccctggccacaccagggctggcctggagatgagcctgcgggccgccaccagcagcctgtctgaggagcaggtgtctgagctgcgggacaacctgcccaaggaggtgcggctgagccccaagctgatcctggaccccaagagctctgtgaccccagccatcatctctgctgccctgcagcaggtggtgcacaacaagagcctggtgacagctggaggagccctgggcaacccccccagcagaggagagcggcggctggaggcctccatgggccggcctgaggtgtccatgatgagcagcagcgccagcaagaacctgaagttcaagatcagccccagcgcccctgagacctcctggaacagccagcaccagctgggcgctgaggtgagcagcagcccccgggcccccaccggcagcagagctgacagcctgcacctgagccagcaggaggacagcctgcctgtgcagaacttcccccccaagagctacctgctgcggaccagccgggagagcgtgggcaagcaggccactggagaggtggccgggaaaggaggccctgtgggcggcaagcccaccctgcagaagcagggcaccatcagcagccagggcgagaaggcccagctggagagcacccccaagaggagcaagctggaggagaccagcctggtgccccgggccacctaccccatggccctgcagagccccagctgccagagccgcagccacagccccagctgccagccccacggccacagccccagcagccagagccggggccagagccccagctgccagccccggggccagagccccctgcggagccaggccgccagccggcaggtgtccaccatgcccagcaggaagctggagaccaccctgaatggagcccacagcaccagcgagggccctgccaagcccaagagcagccggggccccttccggctgaggaacctcttcagcgccaccttccccacccggcagaagaaggagacagatgagcggcaggcccagctgcagaaggtgaagcagtatgagctggagttcctggaggagctgctgaagccacccagccagggcgagctgcccggcacagagtacctgcagcccccagcccctggccgctgcagctgccagctgcggagcagccctgtgcagcagggccctggcatgagccgggagcagaggaggagctgtgactgcaagaggatctgccggggcggccggccccaggccacccagacccctgtgcccagcctgcggggccgggagcgggacagagtgctgcccagccagaggcagcctgaggccggccctggggtgtccctgagcagccccatcaacgtgcagaggatccgcagcaccagcctggagagccgggagtgccgcagtgaccctgagagcggcgtgtcctgcctgaccacctgtgccagcggcggggagtgcctgggcgcccccaactacaggaagctgatgaggcgctacagcatcagcgagctggaccagggcgaccgggccagcctgaccagtgatgtgtacccccacccccccctgggcatgctgccccgggaggccaaggaggtggaggccagcctgcccatcgccctgggccccaagagccgcagcctggagagccccaccctgggggaccccagctatgtgcaggtggcccctgagaccaagggcccccggcagatggctgtgttcagcctgcctgaggaggtgtacaggaagccagctgagctggatgaagattctgagagcagcaagtgctgcagcatccgctactgcttctactacagaaaatgtgacatggctgatgatgccagtgatggcaaggatgagctgagctacagcatccccatgaagatcctgcccggcatgaagctggatgagcaggtggtgcctgtggtgtccaggaccctgcaggtgctggatgctgccacctgcagcagcagcagccctgaggccagcaggacccaggagattgacctgcgggtgtccacctttgagggcagcctggccaagatcaatgccctgcgggcccacgcctacggcctgcctgatggcttcctggccgcccggctggacaccaatgagctgctgactgtgctgcggcagtgtgtggccagccctgaggcccgggcccccaagccctacgtgtcccagatcagcgagtacaagctggagctggccctgaagttcaaggagctgcgggccagctgccggcgggtggccaacgtggacaagagccccacccacatgctggccgccatcaccggcagcttccaggtgctgagcagcctgattgagacctttgtgcggctggtgttcatcgtgcgctctgaggcccagaggcaggagctgctggccaaggtggaggaggtggtgaggaactacaccttcctgctgcgggctgctgaggagagcacagccaggaacctgaaccagcagcagcagcagcagcagcagcagcagcagcagcagcagcagcagcagcagcagcagcagcagcagcagcagcagcaggtggccgctgctgctggagctgccacagagcaccccccaggcagccccaccagcgccaccgtgatgagcaccttcacccacagcctgaagaccctcatcaagtag

SEQ ID NO: 38896 - DNA, 1650 bp, Artificial Sequence
  Description of Artificial Sequence: Synthetic coding sequence
atggctgtgcccccccggggccggggcatcgaccctgcccggaccaacccagacaccttccccccatctggggcccgctgcatggagcccagccctgagaggcctgcctgcagccagcaggagcccaccctgggcatggatgccatggccagcgagcacagagatgtgctggtgctgctgcccagccgggagcagctgcggctggccgtgggcgtgaaggccaccggccgggagctgttccagcaggtgtgcaatgtggccagcatcagagatgcccagttcttcggcctgtgtgtggtgagaaataatgagtacatcttcatggacctggagcagaagctgagcaagtacttcagcaaggactggaagaaggagagaaatgaaggaaatgagaagccccgggccccctttgtggccttcctgcgggtgcagcactacgtggagaatggccgggtcatcagtgaccaccgggcccggcacctgtactactgccacctgaaggagcgggtgctgcggagccagtgtgcccaccgggaggaggcctacttcctgctggccgcctgtgccctgcaggccgacctgggggagcaccgggagagcgcccatgctggccgctactttgagccccacagctacttcccccagtggatcatcaccaagaggggcatcgactacatcctgcggcacatgcccaccctgcaccgggagcggcagggcctgagccccaaggaggccatgctgtgcttcatccaggaggcctgccgcctggaggatgtgcctgtgcacttcttccggctgcacaaggacaagaaggagggccggcccaccgtcatcctgggcctggccctgcggggcgtgcacatctaccagggcaagaagctggagatccagctggatggcctgcctgctgcccagaagctggtgtactacacaggctgcacctggaggagccgccacctgctgcacctgctgcgggccagccaccagctgcacctgcgggtgcggcccaccctgcagcagctgcggcagcgggaggaggccgaggagaagcagcactaccgggagagctacatcagtgatgagctggagctggacctggccagccgctccttccctggcagcggcgtgagcagccagcactgcccccactgcctgagccgccacagcgctgacagccacggcagcagctacaccagcggcatcaaggccaacagctggctgcgggagagccgggagatgtctgtggatgtgcccctggaggtgcacggcctgcacgagaaggagcccagcagcagccccaggaccagccgcagccaccccagcaccaggggggacagccaggccacccggcaggagccctgcacccaggtgaggacccggggccagagcgctgaggccgtgcaccagatccaggagatgacagctggggtgtctgaggagcagcacagccacggcctggatgacatgcagctgcaccagctggccctgcacccagcccccaccagcctgagccacaccttccaccgggccctggactgccgcctggccggcccctgtgagacccgggccaccctgcccagcaagaggagcagcaactgcctggccctggacctgtttggagaggccccaccccaggagtttgtggtgtag

SEQ ID NO: 38897 - DNA, 1446 bp, Artificial Sequence
  Description of Artificial Sequence: Synthetic coding sequence
atggatgatgtgaaggccaccggccgggagctgttccagcaggtgtgcaatgtggccagcatcagagatgcccagttcttcggcctgtgtgtggtgagaaataatgagtacatcttcatggacctggagcagaagctgagcaagtacttcagcaaggactggaagaaggagagaaatgaaggaaatgagaagccccgggccccctttgtggccttcctgcgggtgcagcactacgtggagaatggccgggtcatcagtgaccaccgggcccggcacctgtactactgccacctgaaggagcgggtgctgcggagccagtgtgcccaccgggaggaggcctacttcctgctggccgcctgtgccctgcaggccgacctgggggagcaccgggagagcgcccatgctggccgctactttgagccccacagctacttcccccagtggatcatcaccaagaggggcatcgactacatcctgcggcacatgcccaccctgcaccgggagcggcagggcctgagccccaaggaggccatgctgtgcttcatccaggaggcctgccgcctggaggatgtgcctgtgcacttcttccggctgcacaaggacaagaaggagggccggcccaccgtcatcctgggcctggccctgcggggcgtgcacatctaccagggcaagaagctggagatccagctggatggcctgcctgctgcccagaagctggtgtactacacaggctgcacctggaggagccgccacctgctgcacctgctgcgggccagccaccagctgcacctgcgggtgcggcccaccctgcagcagctgcggcagcgggaggaggccgaggagaagcagcactaccgggagagctacatcagtgatgagctggagctggacctggccagccgctccttccctggcagcggcgtgagcagccagcactgcccccactgcctgagccgccacagcgctgacagccacggcagcagctacaccagcggcatcaaggccaacagctggctgcgggagagccgggagatgtctgtggatgtgcccctggaggtgcacggcctgcacgagaaggagcccagcagcagccccaggaccagccgcagccaccccagcaccaggggggacagccaggccacccggcaggagccctgcacccaggtgaggacccggggccagagcgctgaggccgtgcaccagatccaggagatgacagctggggtgtctgaggagcagcacagccacggcctggatgacatgcagctgcaccagctggccctgcacccagcccccaccagcctgagccacaccttccaccgggccctggactgccgcctggccggcccctgtgagacccgggccaccctgcccagcaagaggagcagcaactgcctggccctggacctgtttggagaggccccaccccaggagtttgtggtgtag

SEQ ID NO: 38898 - DNA, 963 bp, Artificial Sequence
  Description of Artificial Sequence: Synthetic coding sequence
atgcccaccctgcaccgggagcggcagggcctgagccccaaggaggccatgctgtgcttcatccaggaggcctgccgcctggaggatgtgcctgtgcacttcttccggctgcacaaggacaagaaggagggccggcccaccgtcatcctgggcctggccctgcggggcgtgcacatctaccagggcaagaagctggagatccagctggatggcctgcctgctgcccagaagctggtgtactacacaggctgcacctggaggagccgccacctgctgcacctgctgcgggccagccaccagctgcacctgcgggtgcggcccaccctgcagcagctgcggcagcgggaggaggccgaggagaagcagcactaccgggagagctacatcagtgatgagctggagctggacctggccagccgctccttccctggcagcggcgtgagcagccagcactgcccccactgcctgagccgccacagcgctgacagccacggcagcagctacaccagcggcatcaaggccaacagctggctgcgggagagccgggagatgtctgtggatgtgcccctggaggtgcacggcctgcacgagaaggagcccagcagcagccccaggaccagccgcagccaccccagcaccaggggggacagccaggccacccggcaggagccctgcacccaggtgaggacccggggccagagcgctgaggccgtgcaccagatccaggagatgacagctggggtgtctgaggagcagcacagccacggcctggatgacatgcagctgcaccagctggccctgcacccagcccccaccagcctgagccacaccttccaccgggccctggactgccgcctggccggcccctgtgagacccgggccaccctgcccagcaagaggagcagcaactgcctggccctggacctgtttggagaggccccaccccaggagtttgtggtgtag

SEQ ID NO: 38899 - DNA, 1395 bp, Artificial Sequence
  Description of Artificial Sequence: Synthetic coding sequence
atggatggaacagagggcagcgctggccagcccggccctgctgagaggagccacaggagctctgtgtcctctgtgggcgcccgggcagcagatgtgctggtgtacctggctgatgacacagtggtgcccctggccgtggagaacctgcccagcctgagcgcccacgagctgcacagagctgtgcgggaggtgctgcagctgcctgacatcgccctggatgtgtttgccctgtggctggtgagccccctgctggaggtgcagctgaagcccaagcaccagccctacaagctgggccggcagtggccagagctgctgctgcgcttcaccagcgccccagatgatgatgtggccatggatgagcccttcctgcagttcagaagaaatgtgttcttccccaagaggcgggagctgcagatccatgatgaggaggtgctgcggctgctgtatgaggaggccaagggaaatgtgctggccgcccgctacccctgtgatgtggaggactgtgaggccctgggcgccctggtgtgccgggtgcagctgggcccctaccagcccggccggcctgctgcctgtgacctgcgggagaagctggacagcttcctgcctgcccacctgtgcaagaggggccagagcctgtttgctgccctgcggggccgcggggcccgggccggccctggagagcagggcctgctgaatgcctaccggcaggtgcaggaggtgtccagtgatggcggctgtgaggccgccctgggcacccactaccgggcctacctgctgaagtgccacgagctgcccttctacggctgtgccttcttccatggagaggtggacaagccagcccagggcttcctgcacagaggaggcaggaagcctgtgtctgtggccatcagcctggagggcgtgcacgtgattgacagccgggagaagcacgtgctgctgggcctgcgcttccaggagctgtcctgggaccacaccagccctgaggaggaggagcccatcctgtggctggagtttgatggagacagcgagggcacccctgtgaacaagctgctgaagatctacagcaagcaggccgagctgatgagcagcctgattgagtactgcatcgagctgagccaggccgctgagcccgccggcccccaggacagcgccaccggcagccccagcgaccccagcagcagcctggcccctgtgcagaggcccaagctgcggcggcagggctctgtggtgagcagccgcatccagcacctgagcaccatcgactatgtggaggatggcaagggcatccggcgggtgaagcccaagaggaccaccagcttcttcagccggcagctgagcctgggccagggcagctacacagtggtgcagcccggggacagcctggagcagggctag

SEQ ID NO: 38900 - DNA, 1293 bp, Artificial Sequence
  Description of Artificial Sequence: Synthetic coding sequence
atggatggaacagagggcagcgctggccagcccggccctgctgagaggagccacaggagctctgtgtcctctgtgggcgcccgggcagcagatgtgctggtgtacctggctgatgacacagtggtgcccctggccgtggagaacctgcccagcctgagcgcccacgagctgcacagagctgtgcgggaggtgctgcagctgcctgacatcgccctggatgtgtttgccctgtggctggtgagccccctgctggatgagcccttcctgcagttcagaagaaatgtgttcttccccaagaggcgggagctgcagatccatgatgaggaggtgctgcggctgctgtatgaggaggccaagggaaatgtgctggccgcccgctacccctgtgatgtggaggactgtgaggccctgggcgccctggtgtgccgggtgcagctgggcccctaccagcccggccggcctgctgcctgtgacctgcgggagaagctggacagcttcctgcctgcccacctgtgcaagaggggccagagcctgtttgctgccctgcggggccgcggggcccgggccggccctggagagcagggcctgctgaatgcctaccggcaggtgcaggaggtgtccagtgatggcggctgtgaggccgccctgggcacccactaccgggcctacctgctgaagtgccacgagctgcccttctacggctgtgccttcttccatggagaggtggacaagccagcccagggcttcctgcacagaggaggcaggaagcctgtgtctgtggccatcagcctggagggcgtgcacgtgattgacagccgggagaagcacgtgctgctgggcctgcgcttccaggagctgtcctgggaccacaccagccctgaggaggaggagcccatcctgtggctggagtttgatggagacagcgagggcacccctgtgaacaagctgctgaagatctacagcaagcaggccgagctgatgagcagcctgattgagtactgcatcgagctgagccaggccgctgagcccgccggcccccaggacagcgccaccggcagccccagcgaccccagcagcagcctggcccctgtgcagaggcccaagctgcggcggcagggctctgtggtgagcagccgcatccagcacctgagcaccatcgactatgtggaggatggcaagggcatccggcgggtgaagcccaagaggaccaccagcttcttcagccggcagctgagcctgggccagggcagctacacagtggtgcagcccggggacagcctggagcagggctag

SEQ ID NO: 38901 - DNA, 273 bp, Artificial Sequence
  Description of Artificial Sequence: Synthetic coding sequence
atggatggaacagagggcagcgctggccagcccggccctgctgagaggagccacaggagctctgtgtcctctgtgggcgcccgggcagcagatgtgctggtgtacctggctgatgacacagtggtgcccctggccgtggagaacctgcccagcctgagcgcccacgagctgcacagagctgtgcgggaggtgctgcagctgcctgacatcgccctggatgtgtttgccctgtggctggtgagccccctgctggaggtgcagctgaagccctag

SEQ ID NO: 38902 - DNA, 1875 bp, Artificial Sequence
  Description of Artificial Sequence: Synthetic coding sequence
atggccccccggcggctgctgctggtgggggagggcaacttctcctttgctgctgccctgtctgagaccctggaccagagcacccagctgacagccacctgcctgcagaggcctgctgagctggcccgggaccccctggcctgggagaacctgcagtgcctgcgggagcggggcattgatgtgcgctttggagtggactgcacccagctggctgatgtgtttgagctgcacgagcgggagtttgaccagatctacttcatcttcccccactgcggcaggaaggccggcgtggccaagaaccgggagctgctggccaagttcttccagagctgtgctgatgtgctggccgaggagggggaggtgcacgtggccctgtgccggggccagggcggcaccccagctgacaagccccagcgggagtggcacaacagctggcaggtggtggccatggccgccctgggcggcctcatcctgagtgatgtgtaccccttcagctgcaaggctgtggccggctacaagtgcaccggctaccgcagccaggacaagagcttccacgtggagggcgccctgaaccacatcttcaccaggagcctgccctttgagggcagccagccccgcatcttccgcatcaagctgggcaaccagtggttctccttccctgagcctgaggccctggtgggcaagctgaacagaggcttcctggaggcccccagctgccaccccatcaagaccatcaatgagaagctgattgctgagctgggcaaggtgttccccctgaagaggctgaagtgcagctaccccctgctgccccaggagggcacctctgtgctgcccttctggaactgtgacttcctgtctgctgccttctggatcagcctgcacgaggacaacagcaacagcgagagcctgaccggcggcaccagccaggatgtggaggacttcctggtgtccttcagcgagctgagcctgctgaagaaccctggaagagatggcaaggaggaggcctgtgagggcacctgtggccaggccaagatctgcctgcggcccagcctgctggtgcacgtgcaggatgtgattgaggtgcctgacttcctgagcggcagcctgcacatcctgagcggccctgtgttccagaagtgccacatcctgcccttcaccatgcctgccttccacgagaccctcttcatcctgggcgtgaaccagaacctgaaggatggctgcctgcagagcctgctggaccacctgaagggcatcctggacagcctgctgacccagaccctgcctgagagcagcaagctgagcagcctggtgaagtttgtgctgcagagcaatggcaaggactacatgatccgggtgaagacccacaacttctccccagactgcacagaagatctcatcatcggcagcgtcatcaccagcgccaccagcgtcatccacaaggaccagtgctttgtgtttgtgtccatgaacctggacctgctggccatgctggtgtggtgcatcagtgactggaggatgctgtggacctttgacaaccgcttcctgaagaactttgtgcctgggaagattgagcccttcaagagccacagcctgtacccaccctgctacgtgcatgatgtgtccttctggattgaccagaagaagggctttgatgagctggagttccacacagtggcccgggctgtgtcccaggacaccatcatcagcatccagttcctgagccgcttccagcaccccaagacccagcaggtgtccctgtgctaccgcctgacctaccagacctgtgacaaggccctgacccagcagcaggtggcctccatgcagagccagttcaggaaggagatccagcagcacctgtatgtgatccccaggtag

SEQ ID NO: 38903 - DNA, 1428 bp, Artificial Sequence
  Description of Artificial Sequence: Synthetic coding sequence
atggccgccctgggcggcctcatcctgagtgatgtgtaccccttcagctgcaaggctgtggccggctacaagtgcaccggctaccgcagccaggacaagagcttccacgtggagggcgccctgaaccacatcttcaccaggagcctgccctttgagggcagccagccccgcatcttccgcatcaagctgggcaaccagtggttctccttccctgagcctgaggccctggtgggcaagctgaacagaggcttcctggaggcccccagctgccaccccatcaagaccatcaatgagaagctgattgctgagctgggcaaggtgttccccctgaagaggctgaagtgcagctaccccctgctgccccaggagggcacctctgtgctgcccttctggaactgtgacttcctgtctgctgccttctggatcagcctgcacgaggacaacagcaacagcgagagcctgactggaggcaccagccaggatgtggaggacttcctggtgtccttcagcgagctgagcctgctgaagaaccctggaagagatggcaaggaggaggcctgtgagggcacctgtggccaggccaagatctgcctgcggcccagcctgctggtgcacgtgcaggacgtcatcgaggtgcctgacttcctgagcggcagcctgcacatcctgagcggccctgtgttccagaagtgccacatcctgcccttcaccatgcctgccttccacgagaccctcttcatcctgggcgtgaaccagaacctgaaggatggctgcctgcagagcctgctggaccacctgaagggcatcctggacagcctgctgacccagaccctgcctgagagcagcaagctgagcagcctggtgaagtttgtgctgcagagcaatggcaaggactacatgatccgggtgaagacccacaacttctccccagactgcacagaggacctgatcatcggcagcgtcatcaccagcgccaccagcgtcatccacaaggaccagtgctttgtgtttgtgtccatgaacctggacctgctggccatgctggtgtggtgcatcagtgactggaggatgctgtggacctttgacaaccgcttcctgaagaactttgtgcctgggaagattgagcccttcaagagccacagcctgtacccaccctgctacgtgcatgatgtgtccttctggattgaccagaagaagggctttgatgagctggagttccacacagtggcccgggctgtgtcccaggacaccatcatcagcatccagttcctgagccgcttccagcaccccaagacccagcaggtgtccctgtgctaccgcctgacctaccagacctgtgacaaggccctgacccagcagcaggtggcctccatgcagagccagttcaggaaggagatccagcagcacctgtatgtgatccccaggtag

SEQ ID NO: 38904 - DNA, 1656 bp, Artificial Sequence
  Description of Artificial Sequence: Synthetic coding sequence
atgtctggaggagagcagaagccagagcgctactacgtgggcgtggatgtgggcactggatctgtgcgggccgccctggtggaccagagcggcgtgctgctggcctttgctgaccagcccatcaagaactgggagccccagttcaaccaccacgagcagagcagcgaggacatctgggccgcctgctgcgtggtgaccaagaaggtggtgcagggcatcgacctgaaccagatccggggcctgggctttgatgccacctgcagcctggtggtgctggacaagcagttccaccccctgcctgtgaaccaggagggggacagccacagaaatgtcatcatgtggctggaccacagagctgtgtcccaggtgaaccgcatcaatgagaccaagcacagcgtgctgcagtatgtgggcggcgtgatgtctgtggagatgcaggcccccaagctgctgtggctgaaggagaacctgcgggagatctgctgggacaaggccggccacttctttgacctgcctgacttcctgtcctggaaggccaccggggtgacagcccggagcctgtgcagcctggtgtgcaagtggacctacagcgctgagaagggctgggatgacagcttctggaagatgattggcctggaggactttgtggccgacaactacagcaagattggcaaccaggtgctgcccccaggggccagcctgggcaatggcctgaccccagaggccgcccgggacctgggcctgctgcccggcattgctgtggccgccagcctgattgatgcccatgctgggggcctgggcgtgattggagcagatgtgcggggccacggcctcatctgtgagggccagcctgtgaccagccggctggccgtcatctgtggcaccagcagctgccacatgggcatcagcaaggaccccatctttgtgcctggggtgtggggcccctacttcagcgccatggtgcccggcttctggctgaatgaaggaggccagagcgtgacaggcaagctgattgaccacatggtgcagggccacgccgccttccctgagctgcaggtgaaggccacagcccgctgccagagcatctatgcctacctgaacagccacctggacctgatcaagaaggcccagcctgtgggcttcctgactgtggacctgcacgtgtggccagacttccacggcaacagaagccccctggccgacctgaccctgaagggcatggtgacaggcctgaagctgagccaggacctggatgacctggccatcctgtacctggccaccgtgcaggccatcgccctgggcacccgcttcatcatcgaggccatggaggccgccggccacagcatcagcaccctcttcctgtgtggcggcctgagcaagaaccccctgtttgtgcagatgcatgctgacatcaccggcatgcctgtggtgctgagccaggaggtggagagcgtgctggtgggcgctgctgtgctgggcgcctgtgccagcggggactttgcctctgtgcaggaggccatggccaagatgagcaaggtgggcaaggtggtgttcccccggctgcaggacaagaagtactatgacaagaagtaccaggtgttcctgaagctggtggagcaccagaaggagtacctggccatcatgaatgatgactag

SEQ ID NO: 38905 - DNA, 558 bp, Artificial Sequence
  Description of Artificial Sequence: Synthetic coding sequence
atgtctggaggagagcagaagccagagcgctactacgtgggcgtggatgtgggcactggatctgtgcgggccgccctggtggaccagagcggcgtgctgctggcctttgctgaccagcccatcaagaactgggagccccagttcaaccaccacgagcagagcagcgaggacatctgggccgcctgctgcgtggtgaccaagaaggtggtgcagggcatcgacctgaaccagatccggggcctgggctttgatgccacctgcagcctggtggtgctggacaagcagttccaccccctgcctgtgaaccaggagggggacagccacagaaatgtcatcatgtggctggaccacagagctgtgtcccaggtgaaccgcatcaatgagaccaagcacagcgtgctgcagtatgtgggcggcgtgatgtctgtggagatgcaggcccccaagctgctgtggctgaaggagaacctgcgggagatctgctgggacaaggccggccacttctttgacctgcctgacttcctgtcctggaaggccaccggggtgacagccaggtag

SEQ ID NO: 38906 - DNA, 1392 bp, Artificial Sequence
  Description of Artificial Sequence: Synthetic coding sequence
atgtctggaggagagcagaagccagagcgctactacgtgggcgtggatgtgggcactggatctgtgcgggccgccctggtggaccagagcggcgtgctgctggcctttgctgaccagcccatcaagaactgggagccccagttcaaccaccacgagcagagcagcgaggacatctgggccgcctgctgcgtggtgaccaagaacctgcgggagatctgctgggacaaggccggccacttctttgacctgcctgacttcctgtcctggaaggccaccggggtgacagcccggagcctgtgcagcctggtgtgcaagtggacctacagcgctgagaagggctgggatgacagcttctggaagatgattggcctggaggactttgtggccgacaactacagcaagattggcaaccaggtgctgcccccaggggccagcctgggcaatggcctgaccccagaggccgcccgggacctgggcctgctgcccggcattgctgtggccgccagcctgattgatgcccatgctgggggcctgggcgtgattggagcagatgtgcggggccacggcctcatctgtgagggccagcctgtgaccagccggctggccgtcatctgtggcaccagcagctgccacatgggcatcagcaaggaccccatctttgtgcctggggtgtggggcccctacttcagcgccatggtgcccggcttctggctgaatgaaggaggccagagcgtgacaggcaagctgattgaccacatggtgcagggccacgccgccttccctgagctgcaggtgaaggccacagcccgctgccagagcatctatgcctacctgaacagccacctggacctgatcaagaaggcccagcctgtgggcttcctgactgtggacctgcacgtgtggccagacttccacggcaacagaagccccctggccgacctgaccctgaagggcatggtgacaggcctgaagctgagccaggacctggatgacctggccatcctgtacctggccaccgtgcaggccatcgccctgggcacccgcttcatcatcgaggccatggaggccgccggccacagcatcagcaccctcttcctgtgtggcggcctgagcaagaaccccctgtttgtgcagatgcatgctgacatcaccggcatgcctgtggtgctgagccaggaggtggagagcgtgctggtgggcgctgctgtgctgggcgcctgtgccagcggggactttgcctctgtgcaggaggccatggccaagatgagcaaggtgggcaaggtggtgttcccccggctgcaggacaagaagtactatgacaagaagtaccaggtgttcctgaagctggtggagcaccagaaggagtacctggccatcatgaatgatgactag

SEQ ID NO: 38907 - DNA, 1728 bp, Artificial Sequence
  Description of Artificial Sequence: Synthetic coding sequence
atgtctggaggagagcagaagccagagcgctactacgtgggcgtggatgtgggcactggatctgtgcgggccgccctggtggaccagagcggcgtgctgctggcctttgctgaccagcccatcaagaactgggagccccagttcaaccaccacgagcagagcagcgaggacatctgggccgcctgctgcgtggtgaccaagaaggtggtgcagggcatcgacctgaaccagatccggggcctgggctttgatgccacctgcagcctggtggtgctggacaagcagttccaccccctgcctgtgaaccaggagggggacagccacagaaatgtcatcatgtggctggaccacagagctgtgtcccaggtgaaccgcatcaatgagaccaagcacagcgtgctgcagtatgtgggcggcgtgatgtctgtggagatgcaggcccccaagctgctgtggctgaaggagaacctgcgggagatctgctgggacaaggccggccacttctttgacctgcctgacttcctgtcctggaaggccaccggggtgacagcccggagcctgtgcagcctggtgtgcaagtggacctacagcgctgagaagggctgggatgacagcttctggaagatgattggcctggaggactttgtggccgacaactacagcaagattggcaaccaggtgctgcccccaggggccagcctgggcaatggcctgaccccagaggccgcccgggacctgggcctgctgcccggcattgctgtggccgccagcctgattgatgcccatgctgggggcctgggcgtgattggagcagatgtgcggggccacggcctcatctgtgagggccagcctgtgaccagccggctggccgtcatctgtggcaccagcagctgccacatgggcatcagcaaggaccccatctttgtgcctggggtgtggggcccctacttcagcgccatggtgcccggcttctggctgaatgaaggaggccagagcgtgacaggcaagctgattgaccacatggtgcagggccacgccgccttccctgagctgcaggtgaaggccacagcccgctgccagagcatctatgcctacctgaacagccacctggacctgatcaagaaggcccagcctgtgggcttcctgactgtggacctgcacgtgtggccagacttccacggcaacagaagccccctggccgacctgaccctgaagggcatgaggaccaccggctacctgtacatcccagccctggccgccctgcacagccccagcagcctgctgagcccccaggtgacaggcctgaagctgagccaggacctggatgacctggccatcctgtacctggccaccgtgcaggccatcgccctgggcacccgcttcatcatcgaggccatggaggccgccggccacagcatcagcaccctcttcctgtgtggcggcctgagcaagaaccccctgtttgtgcagatgcatgctgacatcaccggcatgcctgtggtgctgagccaggaggtggagagcgtgctggtgggcgctgctgtgctgggcgcctgtgccagcggggactttgcctctgtgcaggaggccatggccaagatgagcaaggtgggcaaggtggtgttcccccggctgcaggacaagaagtactatgacaagaagtaccaggtgttcctgaagctggtggagcaccagaaggagtacctggccatcatgaatgatgactag

SEQ ID NO: 38908 - DNA, 3432 bp, Artificial Sequence
  Description of Artificial Sequence: Synthetic coding sequence
atgcacgtgatgaactgtgtgtccctggtgtctgacaaggaaaatggaaacatcgccacagcccctggcttcatgattggccagaccccacctccagcccctcctcctcctcctcctcctcctccacccagccccccctgcagctgcagccgggaggagtgccccagcagccccccacctcctcctcctccacccctgcctggagagccccccatccccccacctcctcctggcctgccccccaccacccacatgaatggctacagccacctgggcaagaagaagaggatgaggagcttcttctggaagaccatccctgaggagcaggtgcggggcaagaccaacatctggaccctggccgcccggcaggagcaccactaccagattgacaccaagaccatcgaggagctgtttggccagcaggaggacaccaccaagagcagcctgccccggcggggccgcaccctgaacagcagcttccgggaggcccgggaggagatcaccatcctggatgccaagaggtccatgaacatcggcatcttcctgaagcagttcaagaagagccccaggagcatcgtggaggacatccaccagggcaagtctgagcactacggcagcgagaccctgcgggagttcctgaagttcctgcctgagagcgaggaggtgaagaagctgaaggccttctctggagatgtgtccaagctgagcctggccgacagcttcctgtatggcctcatccaggtgcccaactacagcctgagaattgaggccatggtgctgaagaaggagttcctgcccagctgcagcagcctgtacacagacatcaccgtgctgaggacagccatcaaggagctgatgagctgtgaggagctgcacagcatcctgcacctggtgctgcaggccggcaacatcatgaatgccggcggctatgctggaaatgctgtgggcttcaagctgagcagcctgctgaagctggccgacaccaaggccaacaagccaggcatgaacctgctgcactttgtggcccaggaggcccagaagaaggacaccatcctgctgaacttcagcgagaagctgcaccacgtgcagaagacagcccggctgagcctggagaacacagaagctgagctgcacctgctgtttgtgaggaccaagagcctgaaggagaacatccagagagatggagagctgtgccagcagatggaggacttcctgcagtttgccatcgagaagctgcgggagctggagtgctggaagcaggagctgcaggatgaggcctacaccctgattgacttcttctgtgaggacaagaagaccatgaagctggatgagtgcttccagatcttccgggacttctgcaccaagttcaacaaggctgtgaaggacaaccacgaccgggaggcccaggagctgcggcagctgcagaggctgaaggagcaggagcagaagcagaggtcctgggccactggagagctgggcgccttcggccgcagcagcagtgaaaatgatgtggagctgctgaccaagaagggagctgagggcctgctgcccttcctgcacccccggcccatcagccccagcagccccagctacagaccacccaacaccaggaggagccggctgagcctgggccccagcgctgaccgggagctgctgaccttcctggagagcagcacaggcagccctgaggagcccaacaagttccacagcctgcccaggagcagcccccggcaggcccggcccaccatcgcctgcctggagcctgctgaggtgcgccaccaggacagcagctttgcccacaagccccaggccagcggcggccaggaggaggcccccaacccccccagcgcccaggcccaccagctggccgccgcccagcctgagaaccacgccagcgccttcccccgggcccggcggcagggcgtgtctgtgctgaggaagcgctacagcgagcctgtgtccctgggcagcgcccagagcccccccctgagccccctggccctgggcatcaaggagcacgagctggtgacaggcctggcccagttcaacctgcagggcagccagggcatggaggagaccagccagctgaccctgagtgacttcagccccatggagctggagagcgtgggccaccggggcccccagagcctgagcgccagcagcagcagcctgacccccatgggcagagatgccctgggcagcctgagccctgccctggaggatggcaaggccgccccagatgagcccggcagcgctgccctgggctctgtgggcagcagtgaccctgagaacaaggacccccggcccctcttctgcatcagtgacaccacagactgcagcctgaccctggactgcagcgagggcacagacagccggccccggggcggggaccctgaggagggcggggagggagatggctccatgagcagcggcgtgggggagatgggagacagccaggtgagcagcaaccccaccagcagccccccaggagaggccccagcccctgtgtctgtggacagcgagcccagctgcaagggcggcctgccccgggacaagcccaccaagaggaaggatgtggtggcccccaagaggggcagcctgaaggaggccagccctggggccagcaagccaggcagcgcccggcgcagccagggcgctgtggccaagtctgtgaggaccctgacagcctctgaaaatgaatccatgaggaaggtgatgcccatcaccaagagcagcagaggagctggctggaggaggcctgagctgagcagccggggccccagccagaacccccccagcagcacagacacagtgtggagccggcagaacagcgtgcggcgggccagcactggagctgaggagcagaggctgccccggggcagcagcggcagcagcagcaccaggcctggaagagatgtgcccctgcagccccggggcagcttcaagaagcccagcgccaagcccctgaggaacctgccccggcagaagccagaggagaacaagacctgccgggcccacagcgagggccctgagagccccaaggaggagcccaagaccccatctgtgcccagcgtgccccatgagctgccccgggtgcccagctttgccaggaacacagtggccagcagcagccgctccatgaggacagacctgccccctgtggccaaggcccctggcatcaccaggacagtgtcccagaggcagctgcgggtgaagggggaccctgaagatgctgcccccaaggacagcagcaccctgcggcgggccagcagcgcccgggcccccaagaagaggcctgagagcgctgagggccccagcgccaacacagaggcccccctgaaggcccggggggccggggagcgggccagcctgcggaggaaggacagcagcaggaccaccctgggccgcatcctgaaccccctgaggaagtag

SEQ ID NO: 38909 - DNA, 3432 bp, Artificial Sequence; identical to SEQ ID NO: 38908
  Description of Artificial Sequence: Synthetic coding sequence

SEQ ID NO: 38910 - DNA, 2250 bp, Artificial Sequence
  Description of Artificial Sequence: Synthetic coding sequence
atggaggaggagagcggggaggagctgggcctggacaggagcacccccaaggacttccacttctaccacatggacctgtatgattctgaggaccggctgcacctgtttcctgaggagaacaccaggatgaggaaggtggtgcaggccgagatggccaatgaaagcagaggagctggagatggcaaggcccagagggacctgcaggaggaggtggatgagctggtgcacctgtatggcctggaggatgaccacgagctgggagatgaatttgtggatgagaacatccccaggactggagtgtctgagtacccaccctacatgatgaagaggcgggaccctgcccgggagcagagggactggaggctgtctggagaggccgctgaggccgaggacctgggctttggaggctggggcagcgctggccagtgccaggacctgcgggaggcctaccgctacacccacggccgggccagcgaggagtatgagtgctacgtgattcctgaggaggaggatgaggaggaggccgcagatgtgttctgtgtgacctgcaagacccccatccgggccttccagaaggtgtttgatgagcacaaggagcacgaggtgatccccctgaatgaggccctggagagcgccaaggatgagatccacaagaacatgtacaagctggagaagcagatcatcgagatggagaactttgccaaccacctggaggaggtgttcatcaccgtggaggagaactttgggaagcaggagcagaactttgagagccactacaatgagatcctggagaccctggcccagaagtatgaggagaagatccaggccctgggggagaagaagaaggagaagctggaggccctgtatggccagctggtgtcctgtggggagaacctggacacctgcaaggagctgatggagaccatcgaggagatgtgccacgaggagaaggtggacttcatcaaggatgctgtggccatggctgaccggctgggcaagttcctgaagaccaagacagatgtggagatcagcgcccagcctgagtttgaggaccagaccctggacttcagtgatgtggagcagctgatgggcagcatcaacaccatcccagcccccagcgcccctgtgatcaacccccaggtgcccaacagcgccaccggcagctctgtgcgggtgtgctggagcctgtacagtgatgacacagtggagagctaccagctgagctacagacctgtgcaggacagcagccctggaacagaccaggccgagttcaccgtgacagtgaaggagacctactgcagcgtgaccaacctggtgcccaacacccagtatgagttctgggtgacagcccacaacagagctggccccagccccagcagcgagagagctgtgtacatgacagcccccagcccccccatcatcaagaccaaggagatccgcagctgtgaggaggccgtgctgatctgctgggagagcggcaacctgaaccctgtggacagctacacagtggagctgacccaggccgagagccctgaggccagcggcgtgacagaatctgtggtgggcatccccacctgtgagagcgtggtgcagctgcagcccggccgcagctacatcatctacgtgcgggccctgaacatgggcggccccagcgtgcgctctgagcccgccaccgtgcacaccatcggcagctacttccggctgaacaaggacacctgccacccctggctgaccatcagtgaagatggcctgacagctgtgcgctcagaaagaaggaccccagcccgggagctgagccccagcgacacccacttcacccgctgtgtggccgtgatgggcaacctgatccctgtgcggggccaccactactgggaggtggaggtggatgagcacctggactacagagtgggcgtggcctttgctgatgtgaggaagcaggaggacctgggcgccaactgcctgtcctggtgcatgaggcacacctttgccagcagccgccacaagtatgagttcctgcacaacagaaccaccccagacatccgcatcaccgtgccccccaagaagattggcatcctgctggactatgagcacagcaagctgtccttcttcaacgtggacctgagccagcacctgtacaccttcagctgccagctgcatgaatttgtgcacccctgcttcagcctggagaagccaggctgcctgaaggtgcacaacggcatctccatgcccaagcacgtgaccttctactag

SEQ ID NO: 38911 - DNA, 306 bp, Artificial Sequence
  Description of Artificial Sequence: Synthetic coding sequence
atggaggaggagagcggggaggagctgggcctggacaggagcacccccaaggacttccacttctaccacatggacctgtatgattctgaggaccggctgcacctgtttcctgaggagaacaccaggatgaggaaggtggtgcaggccgagatggccaatgaaagcagaggagctggagatggcaaggcccagagggacctgcaggaggaggtggatgagctggtgcacctgtatggcctggaggatgaccacgagctgggagatgaatttgtggatgagaacatccccaggactggagtgtcctag

SEQ ID NO: 38912 - DNA, 975 bp, Artificial Sequence
  Description of Artificial Sequence: Synthetic coding sequence
atggccagcgaggccctgcaccaggtgggagatggagaggaggccgtgctgaagaaggagaacttcaacatgatgaatgccctggaccagctgcccaagcccttcagcaaccccaagtccatgaacagaacagtgaccaccaagggcctgcccctggccagcaaaggaaacctggtgaacttcctggaggatgacaccatcaacctgctgaagcccctgcctgtggaggacagcgactgcagcagtgatgagaccagcatcagcgccttcagcagcaccctgctgaaccccatcaagctggccgtgacccagcccaacagcagcttctttgctggcatgctggagggggagctgaacaagctgtccttcagccccatggccaagaatgcagaaaatgaagacctggccctgggcccctgcccctgccccagcaagagccagatggccacccggggcctgctggacctggacaaccctgagctggagacagagaccagcagcacccacagcgagagctctgtggtggtggacctgcctgacacccccttcatctttgagcacacagtgaacaacagcacagctgtgatctcctggacctacgccctgggcaagcagcctgtgtccttctaccagctgctgctgcaggaggtggccaagacccaggagaatgagctgcctgaggccaagaaccggccctggatcttcaacaagatcctgggcaccaccgtgaagctgatggagctgaagcccaacacctgctactgcctgtctgtgcgggccgccaacacagctggggtgggcaagtggtgcaagccctacaagtttgccaccctggccacagacttcagcagcttccctgagaactaccccatccagatcaccgtgcggaggaaggagccccggcagaagatcgtgtccatcggccctgaggagatgaggcggctggaggacctggagtacctgttcccctgctag

SEQ ID NO: 38913 - DNA, 1383 bp, Artificial Sequence
  Description of Artificial Sequence: Synthetic coding sequence
atgtttgagaagtacccaggcaagatggagggcctcttccgccacaacccctacacagccttccccccagctgtgcccggcctgcccccaggcctgcccccagctgtgtcctttggcagcctgcagggcgccttccagcccaagagcaccaaccctgagctgcccccccggctgggccctgtgcccagcggcctgagccagaagggcacccagatcccagaccacttccggccccccctgaggaagccaggcaagtggtgtgccatgcacgtgcgggtggcctacatgatcctgcggcaccaggagaagatgaagggggacagccacaagctggacttcagaaatgacctgctgccctgcctgcccggcccctatggagccctgcccccaggccaggagctgagccacccagccagcctcttcaccgccaccggggctgtgcatgctgctgccaaccccttcaccgctgcccctggggcccacggccccttcctgagccccagcacccacatcgaccccttcggccggcccaccagctttgccagcctggccgccctgagcaatggagcctttggaggcctgggcagccccaccttcaacagcggggctgtgtttgcccagaaggagagccctggggcccccccagcctttgccagccccccagacccctggggccgcctgcacaggagccccctgaccttccctgcctgggtgcggcccccagaggccgcccggaccccaggcagtgacaaggagaggcctgtggagcggcgggagcccagcatcaccaaggaggagaaggaccgggacctgcccttcagccggccccagctgcgggtgtccccagccacccccaaggcccgggccggggaggagggcccccggcccaccaaggagagcgtgcgggtgaaggaggagaggaaggaggaggccgctgctgctgctgctgctgctgctgctgctgctgctgctgctgctgctgctgccaccggcccccagggcctgcacctgctgtttgagcggccccggcccccacccttcctgggccccagccccccagacagatgtgccggcttcctggagcccacctggctggccgccccaccccggctggcccggcccccacgcttctatgaggccggggaggagctgactggacctggagctgtggccgccgcccggctgtatggcctggagcccgcccaccccctgctgtacagccggctggcccctcctcctcctcctgctgctgcccctggcaccccccacctgctgagcaagaccccacctggggccctgctgggcgcccccccacccctggtgcctgccccccggcccagcagccccccccggggccctggccctgcccgggctgacagatag

SEQ ID NO: 38914 - DNA, 1200 bp, Artificial Sequence
  Description of Artificial Sequence: Synthetic coding sequence
atgcacgtgcgggtggcctacatgatcctgcggcaccaggagaagatgaagggggacagccacaagctggacttcagaaatgacctgctgccctgcctgcccggcccctatggagccctgcccccaggccaggagctgagccacccagccagcctcttcaccgccaccggggctgtgcatgctgctgccaaccccttcaccgctgcccctggggcccacggccccttcctgagccccagcacccacatcgaccccttcggccggcccaccagctttgccagcctggccgccctgagcaatggagcctttggaggcctgggcagccccaccttcaacagcggggctgtgtttgcccagaaggagagccctggggcccccccagcctttgccagccccccagacccctggggccgcctgcacaggagccccctgaccttccctgcctgggtgcggcccccagaggccgcccggaccccaggcagtgacaaggagaggcctgtggagcggcgggagcccagcatcaccaaggaggagaaggaccgggacctgcccttcagccggccccagctgcgggtgtccccagccacccccaaggcccgggccggggaggagggcccccggcccaccaaggagagcgtgcgggtgaaggaggagaggaaggaggaggccgctgctgctgctgctgctgctgctgctgctgctgctgctgctgctgctgctgccaccggcccccagggcctgcacctgctgtttgagcggccccggcccccacccttcctgggccccagccccccagacagatgtgccggcttcctggagcccacctggctggccgccccaccccggctggcccggcccccacgcttctatgaggccggggaggagctgactggacctggagctgtggccgccgcccggctgtatggcctggagcccgcccaccccctgctgtacagccggctggcccctcctcctcctcctgctgctgcccctggcaccccccacctgctgagcaagaccttctgcaccttcctgcagggctgccccagccagcagttccccagctggctgatcaagcccagcgactggtgctgcgtgcccagcctgtggcccctgtgtggggagcggggcctgcagggcgaggagcccggccgggacagccaggccagcccctgggagggcggggccagcagaagatag

SEQ ID NO: 38915 - DNA, 2919 bp, Artificial Sequence
  Description of Artificial Sequence: Synthetic coding sequence
atggaggccaaggaggaggaggtgattgatggctttgccatcgccagcttcagcaccctggaggccctggagaaggacatggccctgaagccccatgagaggaaggagaagtgggagcggcggctcatcaagaagccccgggagagcgagacctgccccccagctgagcccagtgaaaatagaagacccctggaggccggcagccctggccaggacctggagcccgcctgtgatggagccaggaaggtgcccctgcagcccagcaagcagatgaaggtgacagtgtccaaaggaggagaccgggacagtgatgatgattctgtgctggaggccaccagcagccgggaccccctgagtgacagcagcgcccatgctgtgtctggccggggctacagctgtgacagcgagagcggcccagatgacaaggcctctgtgggcagcgagaagctgtttgcccctggaacagacaagggccctgccctggagaagtctgaggccaaggccggccctgtgcccaaggtgtctggcctggagaggagccgggagctgtctgctgagagcttcctgcccacagccagccctgcccctcatgctgccccctgccccggccccccacctggcagccgggccaaccccctggtgaagaaggagcccccagccccccaccgccacaccccccagcccccaccaccccagccccggggcctgctgcccacccacgtgcctgccagcctgggcgcctttgctggccacagccaggccgccgccaacggcctgcacggcctgagccgcagcagcagcgcccccctgggcctgggcaagcacgtgtccctgagcccccacggccctggcccccacctgagcaccagccacctggccctgcggagccaggcccagcaccagctgcacgccgccatgtttgctgccccacccaccctgcccccacctccagccctgcctgccagcagcctggtgctgcccggccaccctgctgaccacgagctgctgcggcaggagctgaacacccgcttcctggtgcagagcgctgagaggcctggggccagcctgggccctggggccctgctgcgggcagagttccaccagcaccagcacacccaccagcacacccaccagcacacccaccagcaccagcacacctttgcccccttccctgctggcctgccccccaccccacctgctgcccctcctccatttgacaagtatgcccccaagctggacagcccctacttccgccacagctctgtgtccttcttccccagcttccccccagccatccctggcctgcccaccctgctgccccaccctggccccttcggcagcctgcagggcgccttccagcccaaggtgtctgacccctacagagctgtggtgaaggtgtccacctgctgggagggcccctggcagggccgcaccctggtgcccccaggccggcccaggggggcccgggacagccgcagcctgcagaagacctgggtgggcgtggccccagcccccctgagcgccagcatcctgagccagaagccaggccgctggtgtgctgtgcacgtgcagatcgcctggcagatctaccgccaccagcagaagatcaaggagatgcagctggacccccacaagctggaggtgggcgccaagctggacctgtttggccggcccccagcccctggggtgtttgctggcttccactacccccaggacctggcccggcccctcttccccagcactggagctgcccacccagccagcaaccccttcggccccagcgcccaccctggcagcttcctgcccaccggccccctgacagaccccttcagccggcccagcaccttcggcggcctgggcagcctgagcagccacgcctttggaggcctgggcagccacgccctggcccctgggggcagcatctttgcccccaaggagggcagctctgtgcacggcctgcccagcccccatgaggcctggaaccggctgcaccgggcccctccttccttccctgcccccccaccctggcccaagtctgtggatgctgagcgggtgtctgccctgaccaaccacgaccgggagccagacaatggcaaggaggagcaggagcgggacctgctggagaagacccggctgctgagccgggccagccctgccaccccagctggccaccctgtgtctggcctgctgctgcgggcccagagcgagctgggccgcagcggggccccagctgagcgggaggccgagccccgggtgaaggagagccgcagccctgccaaggaggaggccgccaagatgcctgcccgggccagccccccccacagcaaggccgcccctggagatgtgaaggtgaaggaggagcggggggaggatgaggccagcgagcccccagctgggggcctgcacccagcccccctgcagctgggcctgggccgggagcggctgggcgcccctggctttgcctgggagcccttccggggcctggagctgccccggcgggccttccctgctgctgccccagcccctggcagcgctgccctgctggagcccccagagcggccctacagagaccgggagccccacggctacagccctgagcggctgcggggggagctggagcgggcccgggccccccacctgcccccagctgccccagccctggatggagccctgctgcccagcctgggcgccctgcacttcccccggctgagccctgctgccctgcacaacggcctgctggcccggaccccacctgctgctgctgccctgggcgcccccccacccctggtgacagctgctggcccccccaccccacctggccccccaagaagcaggaccacccccctgggcggcctgggccctggagaggcccgggactacagccccagcaggaaccccccagaggtggaggccaggtag

SEQ ID NO: 38916 - DNA, 3138 bp, Artificial Sequence
  Description of Artificial Sequence: Synthetic coding sequence
atggaggccaaggtgcggcccagcagaagaagccgggcccagagggaccggggcagaagaagagaagctgccagagatgcccgggcccagagccccagcagtggagatgagcctgagcccagccctgggaaggaaaatgccggcctgcggggggcccccccaagaggagctgccccagcccccaggacagcccggccccccaggagaagaagaagagagagcagcagccaggaggaggaggtgattgatggctttgccatcgccagcttcagcaccctggaggccctggagaaggacatggccctgaagccccatgagaggaaggagaagtgggagaggaggctcatcaagaagccccgggagagcgagacctgccccccagctgagcccagcgagaacagaagacccctggaggccggcagccctggccaggacctggagcccgcctgtgatggagccaggaaggtgcccctgcagcccagcaagcagatgaaggtgacagtgtccaagggcggggaccgggacagtgatgatgacagcgtgctggaggccaccagcagccgggaccccctgagtgacagcagcgcccatgctgtgtctggccggggctacagctgtgacagcgagagcggcccagatgacaaggcctctgtgggcagcgagaagctgtttgcccctggaacagacaagggccctgccctggagaagtctgaggccaaggccggccctgtgcccaaggtgtctggcctggagaggagccgggagctgtctgctgagagcttcctgcccacagccagccctgcccctcatgctgccccctgccccggccccccacctggcagccgggccaaccccctggtgaagaaggagcccccagccccccaccgccacaccccccagcccccaccaccccagccccggggcctgctgcccacccacgtgcctgccagcctgggcgcctttgctggccacagccaggccgccgccaacggcctgcacggcctgagccgcagcagcagcgcccccctgggcctgggcaagcacgtgtccctgagcccccacggccctggcccccacctgagcaccagccacctggccctgcggagccaggcccagcaccagctgcatgctgccatgtttgctgccccacccaccctgcccccacctccagccctgcctgccagcagcctggtgctgcccggccaccctgctgaccacgagctgctgcggcaggagctgaacacccgcttcctggtgcagagcgctgagaggcctggggccagcctgggccctggggccctgctgcgggcagagttccaccagcaccagcacacccaccagcacacccaccagcacacccaccagcaccagcacacctttgcccccttccctgctggcctgccccccaccccacctgctgcccccccaccatttgacaagtatgcccccaagctggacagcccctacttccgccacagctctgtgtccttcttccccagcttccccccagccatccctggcctgcccaccctgctgccccaccctggccccttcggcagcctgcagggcgccttccagcccaaggtgtctgacccctacagagctgtggtgaaggtgtccacctgctgggagggcccctggcagggccgcaccctggtgcccccaggccggcccaggggggcccgggacagccgcagcctgcagaagacctgggtgggcgtggccccagcccccctgagcgccagcatcctgagccagaagccaggccgctggtgtgctgtgcacgtgcagatcgcctggcagatctaccgccaccagcagaagatcaaggagatgcagctggacccccacaagctggaggtgggcgccaagctggacctgtttggccggcccccagcccctggggtgtttgctggcttccactacccccaggacctggcccggcccctcttccccagcactggagctgcccacccagccagcaaccccttcggccccagcgcccaccctggcagcttcctgcccaccggccccctgacagaccccttcagccggcccagcacctttggaggcctgggcagcctgagcagccacgccttcggcggcctgggcagccacgccctggcccctgggggcagcatctttgcccccaaggagggcagctctgtgcacggcctgcccagcccccatgaggcctggaaccggctgcaccgggccccacccagcttccctgcccccccaccctggcccaagtctgtggatgctgagcgggtgtctgccctgaccaaccacgaccgggagccagacaacgggaaggaggagcaggagcgggacctgctggagaagacccggctgctgagccgggccagccctgccaccccagctggccaccctgtgtctggcctgctgctgcgggcccagagcgagctgggccgcagcggggccccagctgagcgggaggccgagccccgggtgaaggagagccgcagccctgccaaggaggaggccgccaagatgcctgcccgggccagccccccccacagcaaggccgcccctggagatgtgaaggtgaaggaggagagaggagaagatgaggccagcgagcccccagctgggggcctgcacccagcccccctgcagctgggcctgggccgggagcggctgggcgcccctggctttgcctgggagcccttccggggcctggagctgccccggcgggccttccctgctgctgccccagcccctggcagcgctgccctgctggagcccccagagcggccctacagagaccgggagccccacggctacagccctgagcggctgcggggggagctggagcgggcccgggccccccacctgcccccagctgccccagccctggatggagccctgctgcccagcctgggcgccctgcacttcccccggctgagccctgctgccctgcacaacggcctgctggcccggaccccacctgctgctgctgccctgggcgcccccccacccctggtgacagctgctggcccccccaccccacctggcccccccaggagcaggaccacccccctgggcggcctgggccctggagaggcccgggactacagccccagcagaaatcctcctgaggtggaggccaggtag

SEQ ID NO: 38917 - DNA, 1746 bp, Artificial Sequence
  Description of Artificial Sequence: Synthetic coding sequence
atggacatcatcaagggcaacctggatggcatcagcaagccagccagcaacagccgcatccggcccggcagccgcagcagcaatgccagcctggaggtgctgagcacagagcccggcagcttcaaggtggacacagccagcaacctgaacagcggcaaggaggaccacagcgagagcagcaacacagaaaatagaaggaccagcaatgatgacaagcaggagagctgcagcgagaagatcaagctggccgaggagggcagtgatgaggacctggacctggtgcagcaccagatcatcagtgaatgttctgatgagcccaagctgaaggagctggacagccagctgcaggatgccatccagaagatgaagaagctggacaagatcctggccaagaagcagaggcgggagaaggagatcaagaagcagggcctggagatgaggatcaagctgtgggaggagatcaagagcgccaagtacagcgaggcctggcagagcaaggaggagatggagaacaccaagaagttcctgagcctgacagctgtgtctgaggagaccgtgggccccagccatgaggaggaggacaccttcagcagcgtcttccacacccagatccccccagaggagtatgagatgcagatgcagaagctgaacaaggacttcacctgtgatgtggagagaaatgaaagcctcatcaagagcggcaagaagcccttcagcaacacagagaagattgagctgcggggcaagcacaaccaggacttcatcaagagaaatattgagctggccaaggagagcaggaaccctgtggtgatggtggaccgggagaagaagaggctggtggagctgctgaaggacctggatgagaaggacagcggcctgagcagcagcgagggggaccagagcggctgggtggtgcctgtgaagggctatgagctggccgtgacccagcaccagcagctggccgagattgacatcaagctgcaggagctgtctgctgccagccccaccatcagcagcttcagcccccggctggagaacagaaacaaccagaagccagacagagatggagagaggaacatggaggtgaccccaggagagaagatcctgaggaacaccaaggagcagagggacctgcacaaccggctgcgggagattgatgagaagctgaagatgatgaaggaaaatgtgctggagagcaccagctgcctgtctgaggagcagctgaagtgcctgctggatgagtgcatcctgaagcagaagagcatcatcaagctgagcagcgagaggaagaaggaggacattgaagatgtgacccctgtgttcccccagctgagccgcagcatcatcagcaagctgctgaatgaaagtgagaccaaggtgcagaagacagaggtggaggatgctgacatgctggagagtgaagaatgtgaggccagcaagggctactacctgaccaaggccctgaccggccacaacatgtctgaggccctggtgacagaagctgagaacatgaagtgcctgcagttcagcaaggatgtgatcatcagtgacaccaaggactacttcatgagcaagaccctgggcatcggccgcctgaagaggcccagcttcctggatgaccccctgtatggcatctctgtgtccctgagcagcgaggaccagcacctgaagctgagcagccctgagaacaccatcgcagatgagcaggagaccaaggatgctgctgaggagtgcaaggagccctag

SEQ ID NO: 38918 - DNA, 48 bp, Artificial Sequence
  Description of Artificial Sequence: Synthetic coding sequence
tgagagcaggagaccaaggatgctgctgaggagtgcaaggagccctag

SEQ ID NO: 38919 - DNA, 7920 bp, Artificial Sequence
  Description of Artificial Sequence: Synthetic coding sequence
atgagcagcagccacagccgggccggccagagcgctgctggagctgcccctgggggcggcgtggacaccagagatgctgagatgcctgccacagagaaggacctggctgaagatgccccctggaagaagatccagcagaacaccttcacccgctggtgcaatgagcacctgaagtgtgtgtccaagagaattgccaacctgcagacagacctgagtgatggcctgcggctcatcgccctgctggaggtgctgagccagaagaagatgcacaggaagcacaaccagaggcccaccttccggcagatgcagctggagaatgtgtctgtggccctggagttcctggaccgggagagcatcaagctggtgtccattgacagcaaggccatcgtggatggcaacctgaagctgatcctgggcctcatctggaccctcatcctgcactacagcatctccatgcccatgtgggatgaggaggaggatgaggaggccaagaagcagacccccaagcagaggctgctgggctggatccagaacaagctgccccagctgcccatcaccaacttcagccgggactggcagagcggccgggccctgggcgccctggtggacagctgtgcccctggcctgtgcccagactgggacagctgggatgccagcaagcctgtgaccaatgcccgggaggccatgcagcaggctgatgactggctgggcatcccccaggtgatcaccccagaggagatcgtggaccccaacgtggatgagcacagcgtgatgacctacctgagccagttccccaaggccaagctgaagccaggggcccccctgcggcccaagctgaaccccaagaaggcccgggcctacggccctggcatcgagcccaccggcaacatggtgaagaagagagctgagttcaccgtggagaccaggtctgctggccagggcgaggtgctggtgtatgtggaggaccctgctggccaccaggaggaggccaaggtgacagccaacaatgacaagaacagaaccttctctgtgtggtacgtgcctgaggtgacaggcacccacaaggtgacagtgctgtttgctggccagcacatcgccaagagcccctttgaggtgtatgtggacaagagccagggagatgccagcaaggtgacagcccagggccctggcctggagcccagcggcaacatcgccaacaagaccacctactttgagatcttcaccgctggagctggcactggagaggtggaggtggtgatccaggaccccatgggccagaagggcaccgtggagccccagctggaggcccggggggacagcacctaccgctgcagctaccagcccaccatggagggcgtgcacacagtgcacgtgacctttgctggggtgcccatccccaggagcccctacacagtgacagtgggccaggcctgcaaccccagcgcctgcagagctgtgggccggggcctgcagcccaagggcgtgcgggtgaaggagacagctgacttcaaggtgtacaccaagggggccggcagcggggagctgaaggtgacagtgaagggccccaagggggaggagcgggtgaagcagaaggacctgggagatggagtgtatggctttgagtactaccccatggtgcccggcacctacatcgtgaccatcacctggggcggccagaacatcggccgcagcccctttgaggtgaaggtgggcacagaatgtggcaaccagaaggtgcgggcctggggccctggcctggagggcggcgtggtgggcaagtctgctgactttgtggtggaggccatcggagatgatgtgggcaccctgggcttctctgtggagggccccagccaggccaagattgaatgtgatgacaagggagatggcagctgtgatgtgcgctactggccccaggaggccggggagtatgctgtgcacgtgctgtgcaacagcgaggacatccggctgagccccttcatggctgacatcagagatgccccccaggacttccacccagacagagtgaaggcccggggccctggcctggagaagacaggagtggccgtgaacaagccagctgagttcaccgtggatgccaagcatggaggcaaggcccccctgcgggtgcaggtgcaggacaatgaaggctgccctgtggaggccctggtgaaggacaatggaaatggcacctacagctgcagctatgtgcccaggaagcctgtgaagcacacagccatggtgtcctggggcggcgtgtccatccccaacagccccttccgggtgaatgtgggcgccggcagccaccccaacaaggtgaaggtgtatggccctggggtggccaagacaggcctgaaggcccacgagcccacctacttcaccgtggactgtgccgaggccggccagggagatgtgtccatcggcatcaagtgtgcccctggggtggtgggccctgctgaggccgacatcgactttgacatcatcagaaatgacaatgacaccttcaccgtgaagtacaccccaagaggagctggcagctacaccatcatggtgctgtttgctgaccaggccacccccaccagccccatccgggtgaaggtggagcccagccatgatgccagcaaggtgaaggccgagggccctggcctgagcaggactggagtggagctgggcaagcccacccacttcaccgtgaatgccaaggccgccggcaagggcaagctggatgtgcagttcagcggcctgaccaagggagatgctgtgagagatgtggacatcatcgaccaccacgacaacacctacacagtgaagtacacccctgtgcagcagggccctgtgggcgtgaatgtgacctatggaggagaccccatccccaagagccccttctctgtggccgtgagccccagcctggacctgagcaagatcaaggtgtctggcctgggggagaaggtggatgtgggcaaggaccaggagttcaccgtgaagagcaagggggccggcggccagggcaaggtggccagcaagatcgtgggccccagcggggctgctgtgccctgcaaggtggagcccggcctgggcgctgacaacagcgtggtgcgcttcctgccccgggaggagggcccctatgaggtggaggtgacctatgatggagtgcctgtgcccggcagccccttccccctggaggccgtggcccccaccaagcccagcaaggtgaaggcctttggacctggcctgcagggcggcagcgctggcagccctgcccgcttcaccatcgacaccaagggagctggcactggaggcctgggcctgactgtggagggcccctgtgaggcccagctggagtgcctggacaatggagatggcacctgcagcgtgtcctatgtgcccacagagcccggggactacaacatcaacatcctgtttgctgacacccacatccctggcagccccttcaaggcccacgtggtgccctgctttgatgccagcaaggtgaagtgcagcggccctggcctggagcgggccacagctggggaggtgggccagttccaggtggactgcagcagcgctggcagcgctgagctgaccatcgagatctgcagcgaggccggcctgcctgctgaggtgtacatccaggaccatggagatggcacccacaccatcacctacatccccctgtgccctggggcctacacagtgaccatcaagtatggaggccagcctgtgcccaacttccccagcaagctgcaggtggagcctgctgtggacaccagcggcgtgcagtgctacggccctggcatcgagggccagggcgtcttccgggaggccaccacagagttctctgtggatgcccgggccctgacccagacaggaggcccccacgtgaaggcccgggtggccaaccccagcggcaacctgacagagacctacgtgcaggacagaggagatggcatgtacaaggtggagtacaccccctatgaggagggcctgcacagcgtggatgtgacctatgatggcagccctgtgcccagcagccccttccaggtgcctgtgacagagggctgtgaccccagccgggtgcgggtgcacggccctggcatccagagcggcaccaccaacaagcccaacaagttcaccgtggagaccagaggagctggcactggaggcctgggcctggccgtggagggccccagcgaggccaagatgagctgcatggacaacaaggatggcagctgcagcgtggagtacatcccctatgaagctggcacctacagcctgaatgtgacctacggcggccaccaggtgcccggcagccccttcaaggtgcctgtgcatgatgtgacagatgccagcaaggtgaagtgcagcggccctggcctgagccctggcatggtgcgggccaacctgccccagagcttccaggtggacaccagcaaggccggcgtggcccccctgcaggtgaaggtgcagggccccaagggcctggtggagcctgtggatgtggtggacaatgctgatggcacccagacagtgaactacgtgcccagccgggagggcccctacagcatctctgtgctgtatggagatgaggaggtgcccaggagccccttcaaggtgaaggtgctgcccacccatgatgccagcaaggtgaaggccagcggccctggcctgaacaccaccggggtgcctgccagcctgcctgtggagttcaccattgatgccaaggatgctggggagggcctgctggccgtgcagatcacagatcctgagggcaagcccaagaagacccacatccaggacaaccatgatggcacctacacagtggcctacgtgcctgatgtgacaggccgctacaccatcctgatcaagtatggaggagatgagatccccttcagcccctacagagtgcgggctgtgcccactggagatgccagcaagtgcaccgtgactggagctggcatcggccccaccatccagatcggggaggagaccgtcatcaccgtggacaccaaggctgctgggaagggcaaggtgacctgcaccgtgtgcaccccagatggcagcgaggtggatgtggatgtggtggagaatgaagatggcacctttgacatcttctacacagccccccagcccgggaagtatgtgatctgtgtgcgctttggaggagagcacgtgcccaacagccccttccaggtgacagccctggccggggaccagcccagcgtgcagccccccctgcggagccagcagctggccccccagtacacctacgcccagggcggccagcagacctgggcccctgagcggcccctggtgggcgtgaatggcctggatgtgaccagcctgcggccctttgacctggtgatccccttcaccatcaagaagggggagatcactggagaggtgaggatgcccagcggcaaggtggcccagcccaccatcacagacaacaaggatggcaccgtgacagtgcgctatgcccccagcgaggccggcctgcacgagatggacatccgctatgacaacatgcacatccctggcagccccctgcagttctacgtggactatgtgaactgtggccacgtgacagcctacggccctggcctgacccatggagtggtgaacaagccagccaccttcaccgtgaacaccaaggatgctggggagggcggcctgagcctggccatcgagggccccagcaaggccgagatcagctgcacagacaaccaggacggcacctgcagcgtgtcctacctgcctgtgctgcccggggactacagcatcctggtgaagtacaatgagcagcacgtgcccggcagccccttcaccgcccgggtgactggagatgacagcatgaggatgagccacctgaaggtgggcagcgctgctgacatccccatcaacatcagcgagacagacctgagcctgctgacagccaccgtggtgcccccatctggccgggaggagccctgcctgctgaagaggctgagaaatggccacgtgggcatcagctttgtgcccaaggagaccggggagcacctggtgcacgtgaagaagaatggccagcacgtggccagcagccccatccctgtggtgatcagccagagcgagattggagatgccagccgggtgcgggtgtctggccagggcctgcacgagggccacacctttgagcctgctgagttcatcatcgacaccagagatgctggctatggaggcctgagcctgagcattgagggccccagcaaggtggacatcaacacagaggacctggaggatggcacctgccgggtgacctactgccccacagagcccggcaactacatcatcaacatcaagtttgctgaccagcacgtgcccggcagccccttctctgtgaaggtgactggagagggccgggtgaaggagagcatcaccaggagaagaagagcccccagcgtggccaacgtgggcagccactgtgacctgagcctgaagatccctgagatcagcatccaggacatgacagcccaggtgaccagccccagcggcaagacccatgaggccgagatcgtggagggggagaaccacacctactgcatccgctttgtgcctgctgagatgggcacccacacagtgtctgtgaagtacaagggccagcacgtgcccggcagccccttccagttcaccgtgggccccctgggggagggcggggcccacaaggtgcgggccggcggccctggcctggagagagctgaggccggcgtgcctgctgagttcagcatctggacccgggaggccggggccggcggcctggccatcgctgtggagggccccagcaaggccgagatcagctttgaggacaggaaggatggcagctgtggggtggcctacgtggtgcaggagcccggggactatgaggtgtctgtgaagttcaatgaggagcacatcccagacagcccctttgtggtgcctgtggccagccccagcggagatgcccggcggctgactgtgagcagcctgcaggagagcggcctgaaggtgaaccagcctgccagctttgctgtgtccctgaatggagccaagggggccattgatgccaaggtgcacagccccagcggggccctggaggagtgctacgtgacagaaattgaccaggacaagtatgctgtgcgcttcatcccccgggagaatggagtgtacctgattgatgtgaagttcaacggcacccacatccctggcagccccttcaagatccgggtgggggagcccggccatggaggagaccccggcctggtgtctgcctatggagctggcctggagggcggcgtgacaggcaacccagctgagtttgtggtgaacaccagcaatgctggggccggggccctgtctgtgaccattgatggccccagcaaggtgaagatggactgccaggagtgcccagagggctacagagtgacctacacccccatggcccctggcagctacctgatcagcatcaagtatggaggcccctaccacatcggcggcagccccttcaaggccaaggtgacaggcccccggctggtgagcaaccacagcctgcacgagaccagctctgtgtttgtggacagcctgaccaaggccacctgtgccccccagcacggggcccctggccctggccctgcagatgccagcaaggtggtggccaagggcctgggcctgagcaaggcctacgtgggccagaagagcagcttcaccgtggactgcagcaaggccggcaacaacatgctgctggtgggcgtgcacggccccaggaccccctgtgaggagatcctggtgaagcacgtgggcagccggctgtacagcgtgtcctacctgctgaaggacaagggggagtacaccctggtggtgaagtggggagatgagcacatccctggcagcccctacagagtggtggtgccctag

SEQ ID NO: 38920 - DNA, 3642 bp, Artificial Sequence
  Description of Artificial Sequence: Synthetic coding sequence
atgaggagcaggaaccagggcggggagagcgccagtgatggccacatcagctgccccaagcccagcatcattggaaatgctggggagaagagcctgtctgaagatgccaagaagaagaagaagagcaacaggaaggaggatgatgtgatggccagcggcaccgtgaagaggcacctgaagaccagcggggagtgtgagaggaagaccaagaagagcctggagctgagcaaggaggacctgatccagctgctgagcatcatggagggggagctgcaggccagagaagatgtgatccacatgctgaagacagagaagaccaagccagaggtgctggaggcccactacggcagcgctgagcctgagaaggtgctgcgggtgctgcacagagatgccatcctggcccaggagaagagcattggagaagatgtgtatgagaagcccatcagcgagctggaccggctggaggagaagcagaaggagacctacagaaggatgctggagcagctgctgctggccgagaagtgccacagaagaacagtgtatgagctggagaatgagaagcacaagcacacagactacatgaacaagagtgatgacttcaccaacctgctggagcaggagcgggagcggctgaagaagctgctggagcaggagaaggcctaccaggccaggaaggagaaggaaaatgccaagaggctgaacaagctgagagatgagctggtgaagctgaagagctttgccctgatgctggtggatgagcggcagatgcacatcgagcagctgggcctgcagagccagaaggtgcaggacctgacccagaagctgcgggaggaggaggagaagctgaaggccatcaccagcaagagcaaagaagatcggcagaagctgctgaagctggaggtggactttgagcacaaggccagccgcttcagccaggagcacgaggagatgaatgccaagctggccaaccaggagagccacaaccggcagctgcggctgaagctggtgggcctgacccagagaattgaggagctggaggagaccaacaagaacctgcagaaggccgaggaggagctgcaggagctgcgggacaagatcgccaagggggagtgtggcaacagcagcctgatggccgaggtggagaacctgaggaagagggtgctggagatggagggcaaggatgaggagatcaccaagacagagagccagtgccgggagctgaggaagaagctgcaggaggaggagcaccacagcaaggagctgcggctggaggtggagaagctgcagaagaggatgtctgagctggagaagctggaggaggccttcagcaagagcaagtctgagtgcacccagctgcacctgaacctggagaaggagaagaacctgaccaaggacctgctgaatgagctggaggtggtgaagagccgggtgaaggagctggagtgcagcgagagccggctggagaaggccgagctgagcctgaaggatgacctgaccaagctgaagagcttcaccgtgatgctggtggatgagaggaagaacatgatggagaagatcaagcaggaggagaggaaggtggatggcctgaacaagaacttcaaggtggagcagggcaaggtgatggatgtgacagagaagctgattgaggagagcaagaagctgctgaagctgaagtctgagatggaggagaaggtgtacaacctgacccgggagagagatgagctgattggcaagctgaagtctgaggaggagaagagcagcgagctgagctgcagcgtggacctgctgaagaagaggctggatggcatcgaggaggtggagcgggagatcacccggggccgcagcaggaaaggaagtgagctgacctgcccagaggacaacaagatcaaggagctgaccctggagattgaaaggctgaagaagaggctgcagcagctggaggtggtggagggggacctgatgaagacagaagatgaatatgaccagctggagcagaagttcagaacagagcaggacaaggccaacttcctgagccagcagctggaggagatcaagcaccagatcgccaagaacaaggccatcgagaagggggaggtggtgtcccaggaggccgagctgcggcaccgcttccggctggaggaggccaagagccgggacctgaaggccgaggtgcaggccctgaaggagaagatccacgagctgatgaacaaggaggaccagctgagccagctgcaggtggactacagcgtgctgcagcagcgcttcatggaggaggagaacaagaacaagaacatgggccaggaggtgctgaacctgaccaaggagctggagctgagcaagcgctacagccgggccctgcggcccagcgtgaatggaagaaggatggtggatgtgcctgtgaccagcactggagtgcagacagatgctgtgtctggagaggccgctgaggaggagaccccagctgtgttcatcaggaagagcttccaggaggagaaccacatcatgagcaacctgcggcaggtgggcctgaagaagcctgtggagaggagctctgtgctggaccgctacccacctgctgccaatgagctgaccatgaggaagtcctggatcccctggatgaggaagagagaaaatggccccagcatcacccaggagaagggccccaggaccaacagcagccctggccaccctggagaggtggtgctgagccccaagcagggccagcccctgcacatccgggtgaccccagaccacgagaacagcacagccaccctggagatcaccagccccaccagcgaggagttcttcagcagcaccaccgtcatccccaccctgggcaaccagaagccccgcatcaccatcatccccagccccaacgtgatgccccagaagcagaagagcggggacaccaccctgggccctgagcgggccatgagccctgtgaccatcaccaccttcagccgggagaagaccccagagagcggccgcggggcctttgctgaccggcccaccagccccatccagatcatgacagtgtccaccagcgctgccccagctgagattgctgtgtccccagagagccaggagatgcccatgggccgcaccatcctgaaggtgaccccagagaagcagacagtgcccacccctgtgaggaagtacaacagcaatgccaacatcatcaccacagaggacaacaagatccacatccacctgggcagccagttcaagaggagccctggcaccagcggggagggcgtgtcccctgtgatcaccgtgcggcctgtgaatgtgacagctgagaaggaggtgtccactggaacagtgctgcggagccccaggaaccacctgagcagcaggcctggggccagcaaggtgaccagcaccatcaccatcacccctgtgaccaccagcagcgcccggggcacccagagcgtgtctggccaggacggcagcagccagaggcccacccccacccgcatccccatgagcaagggcatgaaggccggcaagcctgtggtggccgcccctggggccggcaacctgaccaagtttgagcccagggctgagacccagagcatgaagattgagctgaagaagtctgctgccagcagcaccaccagcctgggcggcggcaagggctag

SEQ ID NO: 38921 - DNA, 3345 bp, Artificial Sequence
  Description of Artificial Sequence: Synthetic coding sequence
atgctgaagacagagaagaccaagccagaggtgctggaggcccactacggcagcgctgagcctgagaaggtgctgcgggtgctgcacagagatgccatcctggcccaggagaagagcatcggggaggatgtgtatgagaagcccatcagcgagctggaccggctggaggagaagcagaaggagacctacagaaggatgctggagcagctgctgctggccgagaagtgccacagaagaacagtgtatgagctggagaatgagaagcacaagcacacagactacatgaacaagagtgatgacttcaccaacctgctggagcaggagcgggagcggctgaagaagctgctggagcaggagaaggcctaccaggccaggaaggagaaggaaaatgccaagaggctgaacaagctgagagatgagctggtgaagctgaagagctttgccctgatgctggtggatgagcggcagatgcacatcgagcagctgggcctgcagagccagaaggtgcaggacctgacccagaagctgcgggaggaggaggagaagctgaaggccatcaccagcaagagcaaggaggaccggcagaagctgctgaagctggaggtggactttgagcacaaggccagccgcttcagccaggagcacgaggagatgaatgccaagctggccaaccaggagagccacaaccggcagctgcggctgaagctggtgggcctgacccagagaattgaggagctggaggagaccaacaagaacctgcagaaggccgaggaggagctgcaggagctgcgggacaagatcgccaagggagaatgtggcaacagcagcctgatggccgaggtggagaacctgaggaagagggtgctggagatggagggcaaggatgaggagatcaccaagacagagagccagtgccgggagctgaggaagaagctgcaggaggaggagcaccacagcaaggagctgcggctggaggtggagaagctgcagaagaggatgtctgagctggagaagctggaggaggccttcagcaagagcaagtcagaatgtacccagctgcacctgaacctggagaaggagaagaacctgaccaaggacctgctgaatgagctggaggtggtgaagagccgggtgaaggagctggagtgcagcgagagccggctggagaaggccgagctgagcctgaaggatgacctgaccaagctgaagagcttcaccgtgatgctggtggatgagaggaagaacatgatggagaagatcaagcaggaggagaggaaggtggatggcctgaacaagaacttcaaggtggagcagggcaaggtgatggatgtgacagagaagctgattgaggagagcaagaagctgctgaagctgaagtctgagatggaggagaaggtgtacaacctgacccgggagagagatgagctgattggcaagctgaagtctgaggaggagaagagcagcgagctgagctgcagcgtggacctgctgaagaagaggctggatggcatcgaggaggtggagcgggagatcacccggggccgcagcaggaagggcagcgagctgacctgcccagaggacaacaagatcaaggagctgaccctggagattgagcggctgaagaagaggctgcagcagctggaggtggtggagggggacctgatgaagacagaagatgaatatgaccagctggagcagaagttcagaacagagcaggacaaggccaacttcctgagccagcagctggaggagatcaagcaccagatcgccaagaacaaggccattgaaaaaggagaggtggtgtcccaggaggccgagctgcggcaccgcttccggctggaggaggccaagagccgggacctgaaggccgaggtgcaggccctgaaggagaagatccacgagctgatgaacaaggaggaccagctgagccagctgcaggtggactacagcgtgctgcagcagcgcttcatggaggaggagaacaagaacaagaacatgggccaggaggtgctgaacctgaccaaggagctggagctgagcaagcgctacagccgggccctgcggcccagcgtgaatggccgcaggatggtggatgtgcctgtgaccagcactggagtgcagacagatgctgtgtctggagaggccgctgaggaggagaccccagctgtgttcatcaggaagagcttccaggaggagaaccacatcatgagcaacctgcggcaggtgggcctgaagaagcctgtggagaggagctctgtgctggaccgctaccccccagctgccaatgagctgaccatgaggaagtcctggatcccctggatgaggaagcgggagaatggccccagcatcacccaggagaagggccccaggaccaacagcagccctggccaccctggagaggtggtgctgagccccaagcagggccagcccctgcacatccgggtgaccccagaccacgagaacagcacagccaccctggagatcaccagccccaccagcgaggagttcttcagcagcaccaccgtcatccccaccctgggcaaccagaagccccgcatcaccatcatccccagccccaacgtgatgccccagaagcagaagagcggggacaccaccctgggccctgagcgggccatgagccctgtgaccatcaccaccttcagccgggagaagaccccagagagcggccgcggggcctttgctgaccggcccaccagccccatccagatcatgacagtgtccaccagcgctgccccagctgagattgctgtgtccccagagagccaggagatgcccatgggccgcaccatcctgaaggtgaccccagagaagcagacagtgcccacccctgtgaggaagtacaacagcaatgccaacatcatcaccacagaggacaacaagatccacatccacctgggcagccagttcaagaggagccctggcaccagcggggagggcgtgtcccctgtgatcaccgtgcggcctgtgaatgtgacagctgagaaggaggtgtccacaggcaccgtgctgcggagccccaggaaccacctgagcagcaggcctggggccagcaaggtgaccagcaccatcaccatcacccctgtgaccaccagcagcgcccggggcacccagagcgtgtctggccaggacggcagcagccagaggcccacccccacccgcatccccatgagcaagggcatgaaggccggcaagcctgtggtggccgcccctggagctggcaacctgaccaagtttgagcccagggctgagacccagagcatgaagattgagctgaagaagtctgctgccagcagcaccaccagcctgggcggcggcaaaggatag

SEQ ID NO: 38922 - DNA, 3534 bp, Artificial Sequence
  Description of Artificial Sequence: Synthetic coding sequence
atgaggagcaggaaccagggcggggagagcgccagtgatggccacatcagctgccccaagcccagcatcattggaaatgctggggagaagagcctgtctgaagatgccaagaagaagaagaagagcaacaggaaggaggatgatgtgatggccagcggcaccgtgaagaggcacctgaagaccagcggggagtgtgagaggaagaccaagaagagcctggagctgagcaaggaggacctgatccagctgctgagcatcatggagggggagctgcaggccagagaagatgtgatccacatgctgaagacagagaagaccaagccagaggtgctggaggcccactacggcagcgctgagcctgagaaggtgctgcgggtgctgcacagagatgccatcctggcccaggagaagagcattggagaagatgtgtatgagaagcccatcagcgagctggaccggctggaggagaagcagaaggagacctacagaaggatgctggagcagctgctgctggccgagaagtgccacagaagaacagtgtatgagctggagaatgagaagcacaagcacacagactacatgaacaagagtgatgacttcaccaacctgctggagcaggagcgggagcggctgaagaagctgctggagcaggagaaggcctaccaggccaggaaggagaaggaaaatgccaagaggctgaacaagctgagagatgagctggtgaagctgaagagctttgccctgatgctggtggatgagcggcagatgcacatcgagcagctgggcctgcagagccagaaggtgcaggacctgacccagaagctgcgggaggaggaggagaagctgaaggccatcaccagcaagagcaaagaagatcggcagaagctgctgaagctggaggtggactttgagcacaaggccagccgcttcagccaggagcacgaggagatgaatgccaagctggccaaccaggagagccacaaccggcagctgcggctgaagctggtgggcctgacccagagaattgaggagctggaggagaccaacaagaacctgcagaaggccgaggaggagctgcaggagctgcgggacaagatcgccaagggggagtgtggcaacagcagcctgatggccgaggtggagaacctgaggaagagggtgctggagatggagggcaaggatgaggagatcaccaagacagagagccagtgccgggagctgaggaagaagctgcaggaggaggagcaccacagcaaggagctgcggctggaggtggagaagctgcagaagaggatgtctgagctggagaagctggaggaggccttcagcaagagcaagtctgagtgcacccagctgcacctgaacctggagaaggagaagaacctgaccaaggacctgctgaatgagctggaggtggtgaagagccgggtgaaggagctggagtgcagcgagagccggctggagaaggccgagctgagcctgaaggatgacctgaccaagctgaagagcttcaccgtgatgctggtggatgagaggaagaacatgatggagaagatcaagcaggaggagaggaaggtggatggcctgaacaagaacttcaaggtggagcagggcaaggtgatggatgtgacagagaagctgattgaggagagcaagaagctgctgaagctgaagtctgagatggaggagaaggtgtacaacctgacccgggagagagatgagctgattggcaagctgaagtctgaggaggagaagagcagcgagctgagctgcagcgtggacctgctgaagaagaggctggatggcatcgaggaggtggagcgggagatcacccggggccgcagcaggaaaggaagtgagctgacctgcccagaggacaacaagatcaaggagctgaccctggagattgaaaggctgaagaagaggctgcagcagctggaggtggtggagggggacctgatgaagacagaagatgaatatgaccagctggagcagaagttcagaacagagcaggacaaggccaacttcctgagccagcagctggaggagatcaagcaccagatcgccaagaacaaggccatcgagaagggggaggtggtgtcccaggaggccgagctgcggcaccgcttccggctggaggaggccaagagccgggacctgaaggccgaggtgcaggccctgaaggagaagatccacgagctgatgaacaaggaggaccagctgagccagctgcaggtggactacagcgtgctgcagcagcgcttcatggaggaggagaacaagaacaagaacatgggccaggaggtgctgaacctgaccaaggagctggagctgagcaagcgctacagccgggccctgcggcccagcgtgaatggaagaaggatggtggatgtgcctgtgaccagcactggagtgcagacagatgctgtgtctggagaggccgctgaggaggagaccccagctgtgttcatcaggaagagcttccaggaggagaaccacatcatgagcaacctgcggcaggtgggcctgaagaagcctgtggagaggagctctgtgctggaccgctacccacctgctgccaatgagctgaccatgaggaagtcctggatcccctggatgaggaagagagaaaatggccccagcatcacccaggagaagggccccaggaccaacagcagccctggccaccctggagaggtggtgctgagccccaagcagggccagcccctgcacatccgggtgaccccagaccacgagaacagcacagccaccctggagatcaccagccccaccagcgaggagttcttcagcagcaccaccgtcatccccaccctgggcaaccagaagccccgcatcaccatcatccccagccccaacgtgatgccccagaagcagaagagcggggacaccaccctgggccctgagcgggccatgagccctgtgaccatcaccaccttcagccgggagaagaccccagagagcggccgcggggcctttgctgaccggcccaccagccccatccagatcatgacagtgtccaccagcgctgccccagctgagattgctgtgtccccagagagccaggagatgcccatgggccgcaccatcctgaaggtgaccccagagaagcagacagtgcccacccctgtgaggaagtacaacagcaatgccaacatcatcaccacagaggacaacaagatccacatccacctgggcagccagttcaagaggagccctggcaccagcggggagggcgtgtcccctgtgatcaccgtgcggcctgtgaatgtgacagctgagaaggaggtgtccactggaacagtgctgcggagccccaggaaccacctgagcagcaggcctggggccagcaaggtgaccagcaccatcaccatcacccctgtgaccaccagcagcgcccggggcacccagagcgtgtctggccaggacggcagcagccagaggcccacccccacccgcatccccatgagcaaggagagcatcatcatccaccagctgaggatgaacagcaggtag

SEQ ID NO: 38923 - DNA, 279 bp, Artificial Sequence
  Description of Artificial Sequence: Synthetic coding sequence
atgggcgtgcacgtggagaccatcagccctggagatggcatgctggaggatggcaagaagtttgacagcagccgggacaggaacaagcccttcaagttcatgctgggcaagcaggaggtgatccggggctgggaggagggcgtggtgcagatgtctgtgggccagagggccaagctgaccatcagcccagactatgcctatggagccaccggccaccctggcatcatcccccctcatgccaccctggtgtttgatgtggagctgctgaagctggagtag

SEQ ID NO: 38924 - DNA, 327 bp, Artificial Sequence
  Description of Artificial Sequence: Synthetic coding sequence
atgggcgtgcacgtggagaccatcagccctggggactggaggaccttccccaagaggagccagacctgtgtgatgcactacacaggcatgctggaggatggcaagaagtttgacagcagccgggacaggaacaagcccttcaagttcatgctgggcaagcaggaggtgatccggggctgggaggagggcgtggtgcagatgtctgtgggccagagggccaagctgaccatcagcccagactatgcctatggagccaccggccaccctggcatcatcccccctcatgccaccctggtgtttgatgtggagctgctgaagctggagtag

SEQ ID NO: 38925 - DNA, 774 bp, Artificial Sequence
  Description of Artificial Sequence: Synthetic coding sequence
atgcccaagaccatgcacttcctgttccgcttcatcgtgttcttctacctgtggggcctcttcaccgcccagaggcagaagaaggaggagagcacagaggaggtgaagattgaggtgctgcacaggcctgagaactgcagcaagaccagcaagaagggggacctgctgaatgcccactatgatggctacctggccaaggatggcagcaagttctactgcagcaggacccagaatgaaggccaccccaagtggtttgtgctgggcgtgggccaggtgatcaagggcctggacatcgccatgacagacatgtgccctggagagaagaggaaggtggtgatcccccccagctttgcctacggcaaggagggctacggcatcctggaggaggtgttcctgctgcagaacatcctggtgtcctgccacaggaccaccctgcacgtgctgaagtgcatgctgctggtgaacaacaacacctgtgccgagggcaagatccccccagatgccaccctcatctttgaaattgagctgtatgctgtgaccaagggccccaggagcattgagaccttcaagcagattgacatggacaatgaccggcagctgagcaaggccgagatcaacctgtacctgcagcgggagtttgagaaggatgagaagccccgggacaagagctaccaggatgctgtgctggaggacatcttcaagaagaatgaccatgatggagatggcttcatcagccccaaggagtacaacgtgtaccagcatgatgagctgtag

SEQ ID NO: 38926 - DNA, 669 bp, Artificial Sequence
  Description of Artificial Sequence: Synthetic coding sequence
atgcccaagaccatgcacttcctgttccgcttcatcgtgttcttctacctgtggggcctcttcaccgcccagaggcagaagaaggaggagagcacagaggaggtgaagattgaggtgctgcacaggcctgagaactgcagcaagaccagcaagaagggggacctgctgaatgcccactatgatggctacctggccaaggatggcagcaagttctactgcagcaggacccagaatgaaggccaccccaagtggtttgtgctgggcgtgggccaggtgatcaagggcctggacatcgccatgacagacatgtgccctggagagaagaggaaggtggtgatcccccccagctttgcctacggcaaggagggctatgcagagggcaagatccccccagatgccaccctcatctttgaaattgagctgtatgctgtgaccaagggccccaggagcattgagaccttcaagcagattgacatggacaatgaccggcagctgagcaaggccgagatcaacctgtacctgcagcgggagtttgagaaggatgagaagccccgggacaagagctaccaggatgctgtgctggaggacatcttcaagaagaatgaccatgatggagatggcttcatcagccccaaggagtacaacgtgtaccagcatgatgagctgtag

SEQ ID NO: 38927 - DNA, 666 bp, Artificial Sequence
  Description of Artificial Sequence: Synthetic coding sequence
atgcccaagaccatgcacttcctgttccgcttcatcgtgttcttctacctgtggggcctcttcaccgcccagaggcagaagaaggaggagagcacagaggaggtgaagattgaggtgctgcacaggcctgagaactgcagcaagaccagcaagaagggggacctgctgaatgcccactatgatggctacctggccaaggatggcagcaagttctactgcagcaggacccagaatgaaggccaccccaagtggtttgtgctgggcgtgggccaggtgatcaagggcctggacatcgccatgacagacatgtgccctggagagaagaggaaggtggtgatcccccccagctttgcctacggcaaggagggctatgagggcaagatccccccagatgccaccctcatctttgaaattgagctgtatgctgtgaccaagggccccaggagcattgagaccttcaagcagattgacatggacaatgaccggcagctgagcaaggccgagatcaacctgtacctgcagcgggagtttgagaaggatgagaagccccgggacaagagctaccaggatgctgtgctggaggacatcttcaagaagaatgaccatgatggagatggcttcatcagccccaaggagtacaacgtgtaccagcatgatgagctgtag

SEQ ID NO: 38928 - DNA, 1050 bp, Artificial Sequence
  Description of Artificial Sequence: Synthetic coding sequence
atggagaccccacctgtgaacaccatcggggagaaggacaccagccagccccagcaggagtgggagaagaacctgcgggagaacctggacagcgtcatccagatccggcagcagccccgggaccccccaacagagaccctggagctggaggtgtccccagaccctgccagccagatcctggagcacacccagggcgctgagaagctggtggccgagctggagggggacagccacaagagccacggcagcaccagccagatgcctgagaccctgcaggccagtgacctgtggtactgcccagatggcagctttgtgaagaagatcgtcatccggggccacggcctggacaagcccaagctgggcagctgctgccgggtgctggccctgggcttcccctttggaagtggccccccagagggctggacagagctgaccatgggcgtgggcccctggagggaggagacctggggcgagctgattgagaagtgcctggagagcatgtgccagggcgaggaggccgagctgcagctgcccggccacagcggcccccctgtgcggctgaccctggccagcttcacccagggccgggacagctgggagctggagaccagcgagaaggaggccctggcccgggaggagcgggcccggggcacagagctgttccgggccggcaaccctgagggcgccgcccgctgctacggccgggccctgcggctgctgctgaccctgcccccacctggccccccagagaggacagtgctgcacgccaacctggccgcctgccagctgctgctgggccagccccagctggccgcccagagctgtgacagagtgctggagcgggagcccggccacctgaaggccctgtacagaagaggagtggcccaggccgccctgggcaacctggagaaggccacagctgacctgaagaaggtgctggccatcgaccccaagaacagagctgcccaggaggagctgggcaaggtggtgatccagggcaagaaccaggatgctggcctggcccagggcctgaggaagatgtttggatag

SEQ ID NO: 38929 - DNA, 423 bp, Artificial Sequence
  Description of Artificial Sequence: Synthetic coding sequence
atgcccctgcctgagcccagcgagcaggagggggagagcgtgaaggccagccaggagcccagccccaagccaggcacagaggtgatcccagctgcccccaggaagcccaggaagttcagcaagctggtgctgctgacagccagcaaggacagcaccaaggtggccggggccaagaggaagggcgtgcactgtgtgatgagcctgggcgtgcccggccctgccaccctggccaaggccctgctgcagacccaccctgaggcccagagggccattgaagctgccccccaggagcctgagcagaagaggagccggcaggaccctggaacagacagaacagaagattctggcctggccgccggccccccagaggccgctggagaaaattttgccccctgcagcgtggcccctgggaagagcctgtag

SEQ ID NO: 38930 - DNA, 423 bp, Artificial Sequence; identical to SEQ ID NO: 38929
  Description of Artificial Sequence: Synthetic coding sequence

SEQ ID NO: 38931 - DNA, 735 bp, Artificial Sequence
  Description of Artificial Sequence: Synthetic coding sequence
atggacatggcctggcagatgatgcagctgctgctgctggccctggtgacagctgctggcagcgcccagcccaggtctgcccgggccaggacagacctgctgaatgtgtgcatgaatgccaagcaccacaagacccagcccagcccagaagatgagctgtatggccagtgcagcccctggaagaagaatgcctgctgcacagccagcaccagccaggagctgcacaaggacaccagccggctgtacaacttcaactgggaccactgcggcaagatggagcccacctgcaagaggcacttcatccaggacagctgcctggagtgcagccccaacctgggcccctggatccggcaggtgaaccagagctggaggaaggagcgcatcctgaatgtgcccctgtgcaaggaggactgtgagcgctggtgggaggactgcaggaccagctacacctgcaagagcaactggcacaagggctggaactggaccagcggcatcaatgaatgtcctgctggggccctgtgcagcacctttgagagctacttccccaccccagctgccctgtgtgagggcctgtggagccacagcttcaaggtgagcaactacagccggggcagcggccgctgcatccagatgtggtttgattctgcccagggcaaccccaatgaggaggtggccaagttctatgctgctgccatgaatgctggggcccccagccggggcatcatcgacagctag

SEQ ID NO: 38932 - DNA, 864 bp, Artificial Sequence
  Description of Artificial Sequence: Synthetic coding sequence
atggacatggcctggcagatgatgcagctgctgctgctggccctggtgacagctgctggcagcgcccagcccaggtctgcccgggccaggacagacctgctgaatgtgtgcatgaatgccaagcaccacaagacccagcccagcccagaagatgagctgtatggccaggtgggcgccccccagggccccagccctggctctgtgcccctggatgacctgcccggggctgaggagccagaatatggaggagatggctgcggcggggagcggctgagccctgtgagcagccccccatctgctgtgcccggccgcaggatgcctgctgcccggcctgccccagcccggagctgcaccaggaccccaccagcctgcaccaccctgaccggcatcaccgtggtgcgctggaaccccccagccagcgccaccctgagcaggacagctgtgtctgagtgcagccccaacctgggcccctggatccggcaggtgaaccagagctggaggaaggagcgcatcctgaatgtgcccctgtgcaaggaggactgtgagcgctggtgggaggactgcaggaccagctacacctgcaagagcaactggcacaagggctggaactggaccagcggcatcaatgaatgtcctgctggggccctgtgcagcacctttgagagctacttccccaccccagctgccctgtgtgagggcctgtggagccacagcttcaaggtgagcaactacagccggggcagcggccgctgcatccagatgtggtttgacagcgcccagggcaaccccaatgaggaggtggccaagttctacgccgccgccatgaatgctggggcccccagccggggcatcatcgacagctag

SEQ ID NO: 38933 - DNA, 1380 bp, Artificial Sequence
  Description of Artificial Sequence: Synthetic coding sequence
atgaccctgagcacagagatgtctgatgccagcggcctggccgaggagacagacattgatgtggtgggggagggggaggatgaagaagatgaggaggaggaggatgatgatgaaggaggcggcggcggcccccggctggccgtgcctgcccagaggagaagaagaagaagaagctatgctggggaggatgagctggaggacctggaggaggaggaggatgatgatgacatcctgctggcccctcctgctgggggcagccctgcccctcctggccctgccccagctgctggggccggggccggcggcggcggcggcggcggcggggccggcggcggcggcagcgctggcagcggggccaagaaccccctggtgaagccaccctacagctacatcgccctgatcaccatggccatcctgcagagccccaagaagaggctgaccctgtctgagatctgtgagttcatcagcggccgcttcccctactaccgggagaagtttcctgcctggcagaacagcatccgccacaacctgagcctgaatgactgctttgtgaagatcccccgggagcccggcaaccctggaaaaggaaactactggaccctggaccctgagagcgctgacatgtttgacaatggcagcttcctgcggcggaggaagcgcttcaagaggcagcccctgctgcccccaaatgctgctgctgctgagagcctgctgctgcggggggccggggctgctggaggagctggggaccctgctgctgctgctgccctcttccccccagcccctcctcctcctcctcatgcctacggctacggcccctacggctgcggctacggcctgcagctgcccccctatgcccctccttctgccctgtttgctgctgctgccaggagaagaagaagaaggctgcccccagccctggccccagctgccccagccacagcccggcggggcagaagagctggccctgaccggctgcggctgcctgctgccccagccaggagaagacccacccggcccccagctggcctgcggggccagggcggccggcccggccgcctgtctgctggggccctggccctgctgcaccgggagcaccaccggggccagctgggccctggaagacgctgcagaagaagaagagctggaagaagaagaagaagtggcctggccctggccctggccggcggcggggccgccagcagccgcatccagaggcggcggctgcggggggccggcggccggggccctgggggccgggcccaccccatcccccggggccggcggggcagaagaaggctgctgagcctgctggtgcggcggctgggggacagcgccccccgggactgccctgtgcagtgccgggagctgtactgctag

SEQ ID NO: 38934 - DNA, 2202 bp, Artificial Sequence
  Description of Artificial Sequence: Synthetic coding sequence
atggccgaggtgggggaggacagcggggcccgggccctgctggccctgcggagcgccccctgcagccctgtgctgtgtgccgctgctgctgctgctgccttccctgctgctgcccctcctccagccccagcccagccccagcccccacctggccccccacctcctcctcctccacccctgcccccaggggccatcgccggggccggcagcagcggcggcagcagtggagtgtctggggacagcgctgtggccggggccgccccagccctggtggccgctgctgctgcctctgtgcggcagagccctggccctgccctggcccggctggagggccgggagtttgagttcctgatgaggcagcccagcgtgaccatcggcaggaacagcagccagggctctgtggacctgtccatgggcctgagcagcttcatcagccgccgccacctgcagctgtccttccaggagccccacttctacctgcgctgcctgggcaagaatggagtgtttgtggatggagccttccagaggagaggagccccagccctgcagctgcccaagcagtgcaccttccgcttccccagcacagccatcaagatccagttcaccagcctgtaccacaaggaggaggccccagccagccccctgcggcccctgtacccccagatcagccccctgaagatccacatccctgagccagacctgcgctccatggtgtcccctgtgcccagccccaccggcaccatctctgtgcccaacagctgcccagccagccccagaggagctggcagcagcagctacagatttgtgcagaatgtgaccagtgacctgcagctggccgctgagtttgctgccaaggccgccagcgagcagcaggccgacaccagcggcggggacagccccaaggatgagagcaagccacccttctcctatgcccagctgattgtgcaggccatcagcagcgcccaggaccggcagctgaccctgagcggcatctatgcccacatcaccaagcactacccctactacagaacagctgacaagggctggcagaacagcatccgccacaacctgagcctgaaccgctacttcatcaaggtgcccaggagccaggaggagcccgggaagggcagcttctggagaattgatcctgccagcgaggccaagctggtggagcaggccttcaggaagaggcggcagaggggcgtgtcctgcttccgcaccccatttggccccctgagcagccgcagcgccccagccagccccacccaccctggcctgatgagccccaggtctgggggcctgcagaccccagagtgcctgagccgggagggcagccccatcccccatgaccctgagtttggcagcaagctggcctctgtgcctgagtaccgctacagccagagcgcccctggcagccctgtgtctgcccagcccgtcatcatggctgtgcccccccggcccagcagcctggtggccaagcctgtggcctacatgcctgccagcatcgtgaccagccagcagcctgctggccacgccatccacgtggtgcagcaggcccccaccgtgaccatggtgcgggtggtgaccaccagcgccaacagcgccaacggctacatcctgaccagccagggcgccgccggcggcagccatgatgctgctggagctgctgtgctggacctgggcagcgaggcccggggcctggaggagaagcccaccatcgcctttgccaccatcccagctgctggaggagtcatccagacagtggccagccagatggcccctggggtgcccggccacacagtgaccatcctgcagcctgccacccctgtgaccctgggccagcaccacctgcctgtgcgggctgtgacccagaatggcaagcatgctgtgcccaccaacagcctggccggaaatgcctatgccctgaccagccccctgcagctgctggccacccaggccagcagcagcgcccctgtggtggtgaccagggtgtgtgaggtgggccccaaggagcctgctgctgctgtggccgccacagccaccaccaccccagccacagccaccacagccagcgccagcgccagcagcactggagagcctgaggtgaagaggagccgggtggaggagcccagcggggctgtgaccaccccagctggggtgattgctgctgctggcccccagggccctggcactggagagtag

SEQ ID NO: 38935 - DNA, 1713 bp, Artificial Sequence
  Description of Artificial Sequence: Synthetic coding sequence
atggcctactgcctgggcgtgaactttgtgcccagccgcttctgctaccagctgcaccggctgctgctgcgctgcaccttccgcttccccagcacagccatcaagatccagttcaccagcctgtaccacaaggaggaggccccagccagccccctgcggcccctgtacccccagatcagccccctgaagatccacatccctgagccagacctgcgctccatggtgtcccctgtgcccagccccaccggcaccatctctgtgcccaacagctgcccagccagccccaggggggccggcagcagcagctacagatttgtgcagaatgtgaccagtgacctgcagctggccgctgagtttgctgccaaggccgccagcgagcagcaggccgacaccagcggcggggacagccccaaggatgagagcaagccacccttctcctatgcccagctgattgtgcaggccatcagcagcgcccaggaccggcagctgaccctgagcggcatctatgcccacatcaccaagcactacccctactacagaacagctgacaagggctggcagaacagcatccgccacaacctgagcctgaaccgctacttcatcaaggtgcccaggagccaggaggagcccgggaagggcagcttctggagaattgatcctgccagcgaggccaagctggtggagcaggccttcaggaagaggcggcagaggggcgtgtcctgcttccgcacccccttcggccccctgagcagccgcagcgccccagccagccccacccaccctggcctgatgagccccaggtctgggggcctgcagaccccagaatgtctgagccgggagggcagccccatcccccatgaccctgagtttggcagcaagctggcctctgtgcctgagtaccgctacagccagagcgcccctggcagccctgtgtctgcccagcctgtgatcatggctgtgcccccccggcccagcagcctggtggccaagcctgtggcctacatgcctgccagcatcgtgaccagccagcagcctgctggccacgccatccacgtggtgcagcaggcccccaccgtgaccatggtgcgggtggtgaccaccagcgccaacagcgccaacggctacatcctgaccagccagggcgctgctgggggcagccatgatgctgctggagctgctgtgctggacctgggcagcgaggcccggggcctggaggagaagcccaccatcgcctttgccaccatcccagctgctgggggcgtcatccagacagtggccagccagatggcccctggggtgcccggccacacagtgaccatcctgcagcctgccacccctgtgaccctgggccagcaccacctgcctgtgcgggctgtgacccagaatggcaagcatgctgtgcccaccaacagcctggccggaaatgcctatgccctgaccagccccctgcagctgctggccacccaggccagcagcagcgcccctgtggtggtgaccagggtgtgtgaggtgggccccaaggagcctgctgctgctgtggccgccacagccaccaccaccccagccacagccaccacagccagcgccagcgccagcagcactggagagcctgaggtgaagaggagccgggtggaggagcccagcggggctgtgaccaccccagctggggtgattgctgctgctggcccccagggccctggcaccggggagtag

SEQ ID NO: 38936 - DNA, 1470 bp, Artificial Sequence
  Description of Artificial Sequence: Synthetic coding sequence
atggtgtcccctgtgcccagccccaccggcaccatctctgtgcccaacagctgcccagccagccccagaggagctggcagcagcagctacagatttgtgcagaatgtgaccagtgacctgcagctggccgctgagtttgctgccaaggccgccagcgagcagcaggccgacaccagcggcggggacagccccaaggatgagagcaagccacccttctcctatgcccagctgattgtgcaggccatcagcagcgcccaggaccggcagctgaccctgagcggcatctatgcccacatcaccaagcactacccctactacagaacagctgacaagggctggcagaacagcatccgccacaacctgagcctgaaccgctacttcatcaaggtgcccaggagccaggaggagcccgggaagggcagcttctggagaattgatcctgccagcgaggccaagctggtggagcaggccttcaggaagaggcggcagaggggcgtgtcctgcttccgcaccccatttggccccctgagcagccgcagcgccccagccagccccacccaccctggcctgatgagccccaggtctgggggcctgcagaccccacccatcccccatgaccctgagtttggcagcaagctggcctctgtgcctgagtaccgctacagccagagcgcccctggcagccctgtgtctgcccagcccgtcatcatggctgtgcccccccggcccagcagcctggtggccaagcctgtggcctacatgcctgccagcatcgtgaccagccagcagcctgctggccacgccatccacgtggtgcagcaggcccccaccgtgaccatggtgcgggtggtgaccaccagcgccaacagcgccaacggctacatcctgaccagccagggcgccgccggcggcagccatgatgctgctggagctgctgtgctggacctgggcagcgaggcccggggcctggaggagaagcccaccatcgcctttgccaccatcccagctgctggaggagtcatccagacagtggccagccagatggcccctggggtgcccggccacacagtgaccatcctgcagcctgccacccctgtgaccctgggccagcaccacctgcctgtgcgggctgtgacccagaatggcaagcatgctgtgcccaccaacagcctggccggaaatgcctatgccctgaccagccccctgcagctgctggccacccaggccagcagcagcgcccctgtggtggtgaccagggtgtgtgaggtgggccccaaggagcctgctgctgctgtggccgccacagccaccaccaccccagccacagccaccacagccagcgccagcgccagcagcactggagagcctgaggtgaagaggagccgggtggaggagcccagcggggctgtgaccaccccagctggggtgattgctgctgctggcccccagggccctggcactggagagtag

SEQ ID NO: 38937 - DNA, 1752 bp, Artificial Sequence
  Description of Artificial Sequence: Synthetic coding sequence
atgaggcagcccagcgtgaccatcggcaggaacagcagccagggctctgtggacctgtccatgggcctgagcagcttcatcagcagaagacacctgcagctgtccttccaggagccccacttctacctgcgctgcctgggcaagaatggagtgtttgtggatggagccttccagaggagaggagccccagccctgcagctgcccaagcagtgcaccttccgcttccccagcacagccatcaagatccagttcaccagcctgtaccacaaggaggaggccccagccagccccctgcggcccctgtacccccagatcagccccctgaagatccacatccctgagccagacctgcgctccatggtgtcccctgtgcccagccccaccggcaccatctctgtgcccaacagctgcccagccagccccaggggggccggcagcagcagctacagatttgtgcagaatgtgaccagtgacctgcagctggccgctgagtttgctgccaaggccgccagcgagcagcaggccgacaccagcggcggggacagccccaaggatgagagcaagccacccttctcctatgcccagctgattgtgcaggccatcagcagcgcccaggaccggcagctgaccctgagcggcatctatgcccacatcaccaagcactacccctactacagaacagctgacaagggctggcagaacagcatccgccacaacctgagcctgaaccgctacttcatcaaggtgcccaggagccaggaggagcccgggaagggcagcttctggagaattgatcctgccagcgaggccaagctggtggagcaggccttcaggaagaggcggcagaggggcgtgtcctgcttccgcacccccttcggccccctgagcagccgcagcgccccagccagccccacccaccctggcctgatgagccccaggtctgggggcctgcagaccccagaatgtctgagccgggagggcagccccatcccccatgaccctgagtttggcagcaagctggcctctgtgcctgagtaccgctacagccagagcgcccctggcagccctgtgtctgcccagcctgtgatcatggctgtgcccccccggcccagcagcctggtggccaagcctgtggcctacatgcctgccagcatcgtgaccagccagcagcctgctggccacgccatccacgtggtgcagcaggcccccaccgtgaccatggtgcgggtggtgaccaccagcgccaacagcgccaacggctacatcctgaccagccagggcgctgctgggggcagccatgatgctgctggagctgctgtgctggacctgggcagcgaggcccggggcctggaggagaagcccaccatcgcctttgccaccatcccagctgctgggggcgtcatccagacagtggccagccagatggcccctggggtgcccggccacacagtgaccatcctgcagcctgccacccctgtgaccctgggccagcaccacctgcctgtgcgggctgtgacccagaatggcaagcatgctgtgcccaccaacagcctggccggaaatgcctatgccctgaccagccccctgcagctgctggccacccaggccagcagcagcgcccctgtggtggtgaccagggtgtgtgaggtgggccccaaggagcccctgcccccaccacccctgcccccacccctgcccctggagagccccaggagcaaaggacctggctggaggagccctgtggtgctgtag

SEQ ID NO: 38938 - DNA, 1947 bp, Artificial Sequence
  Description of Artificial Sequence: Synthetic coding sequence
atggtgtccctgcccccaccccagagtgatgtgaccctgcccggccccacccggctggagggggagcggcagggcgacctgatgcaggcccctggcctgcccggcagccctgccccccagagcaagcacgccggcttcagctgcagcagctttgtgtctgatggccccccagagaggacccccagcctgcccccccacagcccccgcatcgccagccctggccctgagcaggtgcagggccactgcccagctggccctggccctggccccttccggctgagccccagcgacaagtacccaggcttcggctttgaggaggccgccgccagcagccctggccgcttcctgaagggcagccacgcccccttccacccctacaagaggcccttccatgaagatgtgtttcctgaggccgagaccaccctggccctgaagggccacagcttcaagaccccaggccccctggaggcctttgaggagatccctgtggatgtggccgaggccgaggccttcctgcccggcttctctgctgaggcctggtgcaatggcctgccctaccccagccaggagcacggcccccaggtgctgggcagcgaggtgaaggtgaagccccctgtgctggagagcggggccggcatgttctgctaccagccccccctgcagcacatgtactgcagcagccagccccccttccaccagtacagccctgggggcggcagctaccccatcccctacctgggcagcagccactaccagtaccagaggatggccccccaggccagcacagatggccaccagcccctcttccccaagcccatctacagctacagcatcctgatcttcatggccctgaagaacagcaagacaggcagcctgcctgtgtctgagatctacaacttcatgacagagcacttcccctacttcaagacagccccagatggctggaagaacagcgtgcgccacaacctgagcctgaacaagtgctttgagaaggtggagaacaagagcggcagcagcagcaggaagggctgcctgtgggccctgaacccagccaagattgacaagatgcaggaggagctgcagaagtggaagaggaaggaccccatcgctgtgaggaagtccatggccaagccagaggagctggacagcctgattggagacaagcgggagaagctgggcagccccctgctgggctgccccccacctggcctgagcggcagcggccccatccggcccctggcccctcctgctggcctgagcccccccctgcacagcctgcacccagcccctggccccatccctgggaagaaccccctgcaggacctgctgatgggccacacccccagctgctacggccagacctacctgcacctgagccctggcctggcccctcctggccccccccagcccctcttcccccagccagatggccacctggagctgcgggcccagcccggcaccccccaggacagccccctgcctgcccacaccccacccagccacagcgccaagctgctggccgagcccagccctgcccggaccatgcatgacaccctgctgcctgatggagacctgggcacagacctggatgccatcaaccccagcctgacagactttgacttccagggcaacctgtgggagcagctgaaggatgacagcctggccctggaccccctggtgctggtgaccagcagccccaccagcagctccatgcccccaccccagcccccaccccactgcttccccccaggcccctgcctgacagagaccggcagcggggccggggacctggccgcccctggcagcggcggcagcggggccctgggggacctgcacctgaccaccctgtacagcgccttcatggagctggagcccaccccacccacagccccagctggccccagcgtgtacctgagccccagcagcaagcctgtggccctggcctag

SEQ ID NO: 38939 - DNA, 1191 bp, Artificial Sequence
  Description of Artificial Sequence: Synthetic coding sequence
atgcccaaccccaggcctgggaagcccagcgcccccagcctggccctgggccccagccctggggccagccccagctggagggctgcccccaaggccagtgacctgctgggcgcccggggccctgggggcaccttccagggccgggacctgcggggcggggcccacgccagcagcagcagcctgaaccccatgccacccagccagctgcagctgagcacagtggatgcccacgcccggacccctgtgctgcaggtgcaccccctggagagccctgccatgatcagcctgaccccacccaccacagccactggagtcttcagcctgaaggcccggcccggcctgcccccaggcatcaacgtggccagcctggagtgggtgtcccgggagcccgccctgctgtgcaccttccccaaccccagcgcccccaggaaggacagcaccctgtctgctgtgccccagagcagctaccccctgctggccaatggagtgtgcaagtggccaggctgtgagaaggtgtttgaggagcctgaggacttcctgaagcactgccaggccgaccacctgctggatgagaagggccgggcccagtgcctgctgcagcgggagatggtgcagagcctggagcagcagctggtgctggagaaggagaagctgagcgccatgcaggcccacctggccggcaagatggccctgaccaaggccagctctgtggccagcagtgacaagggcagctgctgcatcgtggccgccggcagccagggccctgtggtgcctgcctggagcggcccccgggaggccccagacagcctgtttgctgtgcggcggcacctgtggggcagccacggcaacagcaccttccctgagttcctgcacaacatggactacttcaagttccacaacatgaggcctcccttcacctacgccaccctcatccgctgggccatcctggaggcccctgagaagcagaggaccctgaatgagatctaccactggttcaccaggatgtttgccttcttcaggaaccacccagccacctggaagaatgccatccgccacaacctgagcctgcacaagtgctttgtgcgggtggagagcgagaagggagctgtgtggacagtggatgagctggagttcaggaagaagaggagccagaggcccagccgctgcagcaaccccaccccaggcccctag

SEQ ID NO: 38940 - DNA, 2052 bp, Artificial Sequence
  Description of Artificial Sequence: Synthetic coding sequence
atgcaggagctggagagcctgctggcccagcagaagaaggccctggccaagagcatcacccaggagaagaacagagtgaaggaggccctggaggaggagcagaccagggtgcaggagctggaggagcggctggcccggcagaaggagatcagcgagagcaacatcgcctatgagaagaggaaggccaaggaggccatggagaaggagaagaagaaggtgcaggacctggagaaccggctgaccaagcagaaggaggagctggagctgaaggagcagaaggaggatgtgctgaacaacaagctgagtgatgccctggccatggtggaggagacccagaagaccaaggccacagagagcctgaaggccgagagcctggccctgaagctgaatgagaccctggccgagctggagaccaccaagaccaagatgatcatggtggaggagcggctcatcctgcagcagaagatggtgaaggccctgcaggatgagcaggagagccagagacatggctttgaggaggagatcatggagtacaaggagcagatcaagcagcacgcccagaccatcgtgtccctggaggagaagctgcagaaggtgacccagcaccacaagaagattgaaggagagatcgccaccctgaaggacaatgaccctgcccccaaggaggagcggccccaggaccccctggtggcccccatgacagagagcagcgccaaggacatggcctatgagcacctgattgatgacctgctggccgcccagaaggagatcctgagccagcaggaggtgatcatgaagctgaggaaggacctgacagaggcccacagcaggatgtctgacctgcggggggagctgaatgagaagcagaagatggagctggagcagaatgtggtgctggtgcagcagcagagcaaggagctgtctgtgctgaaggagaagatggcccagatgagcagcctggtggagaagaaggaccgggagctgaaggccctggaggaggccctgcgggccagccaggagaagcaccggctgcagctgaacacagagaaggagcagaagcccaggaagaagacccagacctgtgacacctctgtgcagatcgagcctgtgcacacagaggccttcagcagcagccaggagcagcagagcttcagtgacctgggcgtgcgctgcaagggcagcagacatgaggaggtgatccagaggcagaagaaggccctgtctgagctgcgggcccgcatcaaggagctggagaaggcccggagcccagaccacaaggaccaccagaatgaaagcttcctggacctgaagaacctgaggatggagaacaacgtgcagaagatcctgctggatgccaagccagacctgcccaccctgagccgcatcgagatcctggccccccagaatggcctgtgcaatgcccgcttcggcagcgccatggagaagagcggcaagatggatgtggccgaggccctggagctgtctgagaagctgtacctggacatgagcaagaccctgggcagcctgatgaacatcaagaacatgagcggccacgtgtccatgaagtacctgagccggcaggagcgggagaaggtgaaccagctgcggcagagggacctggacctggtgtttgacaagatcacccagctgaagaaccagctgggcaggaaggaggagctgctgcggggctatgagaaggatgtggagcagctgcggcgcagcaaggtgtccattgagatgtaccagagccaggtggccaagctggaggatgacatctacaaggaggccgaggagaaggccctgctgaaggaggccctggagaggatggagcaccagctgtgccaggagaagaggatcaacagagccatccggcagcagaagagaagagtgtttgtggagatggtgaagaacaggatgcagaacagcaacagccaggtgggcaccaggaaggccagcctgaagatggaccaggagcgggagatgctgaggaaggagaccagcagcaagagcagccagagcctgctgcacagcaagcccagcggcaagtactag

SEQ ID NO: 38941 - DNA, 4239 bp, Artificial Sequence
  Description of Artificial Sequence: Synthetic coding sequence
atgaaggcctacctgaagtctgctgagggcttctttgtgctgaacaagagcaccaccatcggcagacatgagaacagcgacctggtgctgcagagcccagacatcgacaaccaccacgccctgattgagtacaatgaagctgagtgcagctttgtgctgcaggacttcaacagcagaaatggcacctttgtgaatgaatgccacatccagaatgtggccgtgaagctgatccctggggacatcctgcgcttcggcagcgctggcctgacctatgagctggtgattgagaaccccccacctgtgtccttcccctggatgaggggccctgccccctggccaggcccccagcccccccgggccacccagcagcccaaccaggcccccccacccagccacatccccttccaccagggcgtgcagcctgcccccatgcagaggtcctggagccaggccttcccccggcccaccgtggtgctgcctgccagccaccggcggcctgtgtctgccaacaaggagatgttctcctttgtggtggatgatgccaggaagccccctgtgatcaagcaggtgtggaccaatgccatgaagctgtctgagaagtctgtggccgagggcatccctggagctgtgcccccagctgagatctacgtggaggaggacctggcccagcaggacaaggatgagatcatcctgctgctgggcaaggaggtgtcccggctgagtgactatgaaattgagagcaagtacaaggatgtgatcatcgccaacctgcagaatgaggtggccgagctgagccagaaggtgtctgagaccaccaccagccggcagaatgagaaggagatcagccagaagtgccaggtgctggatgaggacattgatgccaagcagaaggagatccagagcctgaagagccagatcagcgccctgcagaagggctacagcaaggtgctgtgccagaccctgtctgagaggaacagcgagatcaccagcctgaagaatgaaggagagaacctgaagagggacaatgccatcaccagcggcatggtgagcagcctgcagaaggacatcctggccaaggatgagcaggtgcagcagctgaaggaggaggtgagccacctgaagagccagaacaaggacaaggaccaccagctggaggccctgggcagccgctgcagcgtgctgaaggaggagctgaagcaggaggatgcccaccgggagctgcgggaggcccaggagaaggagctgaagctgtgcaagacccagatccaggacatggagaaggagatgaagaagctgcgggcagagctgaggaagagctgcacagagcagagcgtcatcagcaggaccctgcgggagaagagcaaggtggaggagaagctgcaggaggacagcaggaggaagctgctgcagctgcaggagatgggcaaccgggagagcgtcatcaagatcaacctggagagagctgtgggccagctggagcacttccgcagccaggtgatcaaggccacctacggccgggccaagcccttccgggacaagcctgtgacagaccagcagctgattgagaagatcacccaggtgacagaggacaacatcaacttccagcagaagaagtggaccctgcagaaggagacccagctgagcaacagcaagcaggaggagaccacagaaaatattgagaagctgcggaccagcctggacagctgccaggcctgcatgaagatcagctgctgcagccatgacctgaagaaggaggtggacctgctgcagcacctgcaggtgagcccccctgtgtctggcctgcagaaggtggtgctggatgtgctgcggcatgccctgtcctggctggaggaggtggagcagctgctgcgggacctgggcatcctgcccagcagccccaacaaggaccaggtgcagcagttcagcggcaacagcgctgtgttcaccgctgggaaggccgccggggccagcggccgggagggggaggccgagcggggggaggcccgggcccggggggaggcccagagccagaaccaggccacagatggccgggagggcggcaaggccctggaggagtacatcacccaggagaggaacagagccaaggagaccctggaggaggagaggaagaggatgcaggagctggagagcctgctggcccagcagaagaaggccctggccaagagcatcacccaggagaagaacagagtgaaggaggccctggaggaggagcagaccagggtgcaggagctggaggagcggctggcccggcagaaggaggtgctggagagcagcatcgcccacgagaagaggaaggccaaggaggccctggagagcgagaagaggaaggtgcaggacctggagaaccacctgacccagcagaaggagatcagcgagagcaacatcgcctatgagaagaggaaggccaaggaggccatggagaaggagaagaagaaggtgcaggacctggagaaccggctgaccaagcagaaggaggagctggagctgaaggagcagaaggaggatgtgctgaacaacaagctgagtgatgccctggccatggtggaggagacccagaagaccaaggccacagagagcctgaaggccgagagcctggccctgaagctgaatgagaccctggccgagctggagaccaccaagaccaagatgatcatggtggaggagcggctcatcctgcagcagaagatggtgaaggccctgcaggatgagcaggagagccagagacatggctttgaggaggagatcatggagtacaaggagcagatcaagcagcacgcccagaccatcgtgtccctggaggagaagctgcagaaggtgacccagcaccacaagaagattgaaggagaaattgccaccctgaaggacaatgaccctgcccccaaggaggagcggccccaggaccccctggtggcccccatgacagagagcagcgccaaggacatggcctatgagcacctgattgatgacctgctggccgcccagaaggagatcctgagccagcaggaggtgatcatgaagctgaggaaggacctgacagaggcccacagcaggatgtctgacctgcggggggagctgaatgagaagcagaagatggagctggagcagaatgtggtgctggtgcagcagcagagcaaggagctgtctgtgctgaaggagaagatggcccagatgagcagcctggtggagaagaaggaccgggagctgaaggccctggaggaggccctgcgggccagccaggagaagcaccggctgcagctgaacacagagaaggagcagaagcccaggaagaagacccagacctgtgacacctctgtgcagatcgagcctgtgcacacagaggccttcagcagcagccaggagcagcagagcttcagtgacctgggcgtgcgctgcaagggcagcagacatgaggaggtgatccagaggcagaagaaggccctgtctgagctgcgggcccgcatcaaggagctggagaaggcccggagcccagaccacaaggaccaccagaatgaaagcttcctggacctgaagaacctgaggatggagaacaacgtgcagaagatcctgctggatgccaagccagacctgcccaccctgagcagaattgagatcctggccccccagaatggcctgtgcaatgccaggtttggaagtgccatggagaagagcggcaagatggatgtggccgaggccctggagctgtctgagaagctgtacctggacatgagcaagaccctgggcagcctgatgaacatcaagaacatgagcggccacgtgtccatgaagtacctgagccggcaggagcgggagaaggtgaaccagctgcggcagagggacctggacctggtgtttgacaagatcacccagctgaagaaccagctgggcaggaaggaggagctgctgcggggctatgagaaggatgtggagcagctgcggcgcagcaaggtgtccattgagatgtaccagagccaggtggccaagctggaggatgacatctacaaggaggccgaggagaaggccctgctgaaggaggccctggagaggatggagcaccagctgtgccaggagaagaggatcaacagagccatccggcagcagaaggtgggcaccaggaaggccagcctgaagatggaccaggagcgggagatgctgaggaaggagaccagcagcaagagcagccagagcctgctgcacagcaagcccagcggcaagtactag

SEQ ID NO: 38942 - DNA, 4362 bp, Artificial Sequence
  Description of Artificial Sequence: Synthetic coding sequence
atgaaggcctacctgaagtctgctgagggcttctttgtgctgaacaagagcaccaccatcggcagacatgagaacagcgacctggtgctgcagagcccagacatcgacaaccaccacgccctgattgagtacaatgaagctgagtgcagctttgtgctgcaggacttcaacagcagaaatggcacctttgtgaatgaatgccacatccagaatgtggccgtgaagctgatccctggggacatcctgcgcttcggcagcgctggcctgacctatgagctggtgattgagaaccccccacctgtgtccttcccctggatgaggggccctgccccctggccaggcccccagcccccccgggccacccagcagcccaaccaggcccccccacccagccacatccccttccaccagggcgtgcagcctgcccccatgcagaggtcctggagccaggccttcccccggcccaccgtggtgctgcctgccagccaccggcggcctgtgtctgccaacaaggagatgttctcctttgtggtggatgatgccaggaagccccctgtgatcaagcaggtgtggaccaatgccatgaagctgtctgagaagtctgtggccgagggcatccctggagctgtgcccccagctgagatctacgtggaggaggacctggcccagcaggacaaggatgagatcatcctgctgctgggcaaggaggtgtcccggctgagtgactatgaaattgagagcaagtacaaggatgtgatcatcgccaacctgcagaatgaggtggccgagctgagccagaaggtgtctgagaccaccaccagccggcagaatgagaaggagatcagccagaagtgccaggtgctggatgaggacattgatgccaagcagaaggagatccagagcctgaagagccagatcagcgccctgcagaagggctacagcaaggtgctgtgccagaccctgtctgagaggaacagcgagatcaccagcctgaagaatgaaggagagaacctgaagagggacaatgccatcaccagcggcatggtgagcagcctgcagaaggacatcctggccaaggatgagcaggtgcagcagctgaaggaggaggtgagccacctgaagagccagaacaaggacaaggaccaccagctggaggccctgggcagccgctgcagcgtgctgaaggaggagctgaagcaggaggatgcccaccgggagctgcgggaggcccaggagaaggagctgaagctgtgcaagacccagatccaggacatggagaaggagatgaagaagctgcgggcagagctgaggaagagctgcacagagcagagcgtcatcagcaggaccctgcgggagaagagcaaggtggaggagaagctgcaggaggacagcaggaggaagctgctgcagctgcaggagatgggcaaccgggagagcgtcatcaagatcaacctggagagagctgtgggccagctggagcacttccgcagccaggtgatcaaggccacctacggccgggccaagcccttccgggacaagcctgtgacagaccagcagctgattgagaagatcacccaggtgacagaggacaacatcaacttccagcagaagaagtggaccctgcagaaggagacccagctgagcaacagcaagcaggaggagaccacagaaaatattgagaagctgcggaccagcctggacagctgccaggcctgcatgaagatcagctgctgcagccatgacctgaagaaggaggtggacctgctgcagcacctgcaggtgagcccccctgtgtctggcctgcagaaggtggtgctggatgtgctgcggcatgccctgtcctggctggaggaggtggagcagctgctgcgggacctgggcatcctgcccagcagccccaacaaggaccaggtgcagcagttcagcggcaacagcgctgtgttcaccgctgggaaggccgccggggccagcggccgggagggggaggccgagcggggggaggcccgggcccggggggaggcccagagccagaaccaggccacagatggccgggagggcggcaaggccctggaggagtacatcacccaggagaggaacagagccaaggagaccctggaggaggagaggaagaggatgcaggagctggagagcctgctggcccagcagaagaaggccctggccaagagcatcacccaggagaagaacagagtgaaggaggccctggaggaggagcagaccagggtgcaggagctggaggagcggctggcccggcagaaggaggtgctggagagcagcatcgcccacgagaagaggaaggccaaggaggccctggagagcgagaagaggaaggtgcaggacctggagaaccacctgacccagcagaaggagatcagcgagagcaacatcgcctatgagaagaggaaggccaaggaggccatggagaaggagaagaagaaggtgcaggacctggagaaccggctgaccaagcagaaggaggagctggagctgaaggagcagaaggaggatgtgctgaacaacaagctgagtgatgccctggccatggtggaggagacccagaagaccaaggccacagagagcctgaaggccgagagcctggccctgaagctgaatgagaccctggccgagctggagaccaccaagaccaagatgatcatggtggaggagcggctcatcctgcagcagaagatggtgaaggccctgcaggatgagcaggagagccagagacatggctttgaggaggagatcatggagtacaaggagcagatcaagcagcacgcccagaccatcgtgtccctggaggagaagctgcagaaggtgacccagcaccacaagaagattgaaggagaaattgccaccctgaaggacaatgaccctgcccccaaggaggagcggccccaggaccccctggtggcccccatgacagagagcagcgccaaggacatggcctatgagcacctgattgatgacctgctggccgcccagaaggagatcctgagccagcaggaggtgatcatgaagctgaggaaggacctgacagaggcccacagcaggatgtctgacctgcggggggagctgaatgagaagcagaagatggagctggagcagaatgtggtgctggtgcagcagcagagcaaggagctgtctgtgctgaaggagaagatggcccagatgagcagcctggtggagaagaaggaccgggagctgaaggccctggaggaggccctgcgggccagccaggagaagcaccggctgcagctgaacacagagaaggagcagaagcccaggaagaagacccagacctgtgacacctctgtgcagatcgagcctgtgcacacagaggccttcagcagcagccaggagcagcagagcttcagtgacctgggcgtgcgctgcaagggcagcagacatgaggaggtgatccagaggcagaagaaggccctgtctgagctgcgggcccgcatcaaggagctggagaaggcccggagcccagaccacaaggaccaccagaatgaaagcttcctggacctgaagaacctgaggatggagaacaacgtgcagaagatcctgctggatgccaagccagacctgcccaccctgagcagaattgagatcctggccccccagaatggcctgtgcaatgccaggtttggaagtgccatggagaagagcggcaagatggatgtggccgaggccctggagctgtctgagaagctgtacctggacatgagcaagaccctgggcagcctgatgaacatcaagaacatgagcggccacgtgtccatgaagtacctgagccggcaggagcgggagaaggtgaaccagctgcggcagagggacctggacctggtgtttgacaagatcacccagctgaagaaccagctgggcaggaaggaggagctgctgcggggctatgagaaggatgtggagcagctgcggcgcagcaaggtgtccattgagatgtaccagagccaggtggccaagctggaggatgacatctacaaggaggccgaggagaaggccctgctgaaggaggccctggagaggatggagcaccagctgtgccaggagaagaggatcaacagagccatccggcagcagaagatgaggaagctgcggctgcgggagctgcggggggcccaggtgcacacagctgctgggaaggacagctgggacctgaccccagaccccagcgaccccggcagccctgctgtgtgccgggtgggcaggaaatgtagaggagccaggacagagaagaggaagagaattgacaccctgcagctgtgcctgcagcgggagcggcaggccggccctgcccccccagcctgcagcctgaatggatag

SEQ ID NO: 38943 - DNA, 951 bp, Artificial Sequence
  Description of Artificial Sequence: Synthetic coding sequence
atgatcctgcggcccccccggccctgtggcaccatcagcgccctgcagaagggctacagcaaggtgctgtgccagaccctgtctgagaggaacagcgagatcaccagcctgaagaatgaaggagagaacctgaagagggacaatgccatcaccagcggcatggtgagcagcctgcagaaggacatcctggccaaggatgagcaggtgcagcagctgaaggaggaggtgagccacctgaagagccagaacaaggacaaggaccaccagctggaggccctgggcagccgctgcagcgtgctgaaggaggagctgaagcaggaggatgcccaccgggagctgcgggaggcccaggagaaggagctgaagctgtgcaagacccagatccaggacatggagaaggagatgaagaagctgcgggcagagctgaggaagagctgcacagagcagagcgtcatcagcaggaccctgcgggagaagagcaagctggagcacttccgcagccaggtgatcaaggccacctacggccgggccaagcccttccgggacaagcctgtgacagaccagcagctgattgagaagatcacccaggtgacagaggacaacatcaacttccagcagaagaagtggaccctgcagaaggagacccagctgagcaacagcaagcaggaggagaccacagaaaatattgagaagctgcggaccagcctggacagctgccaggcctgcatgaagatcagctgctgcagccatgacctgaagaaggaggtggacctgctgcagcacctgcaggtgagcccccctgtgtctggcctgcagaaggtggtgctggatgtgctgcggcatgccctgtcctggctggaggaggtggagcagctgctgcgggacctgggcatcctgcccagcagccccaacaagggctactgggacttcttcagccacatggtggcctag

SEQ ID NO: 38944 - DNA, 4131 bp, Artificial Sequence
  Description of Artificial Sequence: Synthetic coding sequence
atgaaggcctacctgaagtctgctgagggcttctttgtgctgaacaagagcaccaccatcggcagacatgagaacagcgacctggtgctgcagagcccagacatcgacaaccaccacgccctgattgagtacaatgaagctgagtgcagctttgtgctgcaggacttcaacagcagaaatggcacctttgtgaatgaatgccacatccagaatgtggccgtgaagctgatccctggggacatcctgcgcttcggcagcgctggcctgacctatgagctggtgattgagaaccccccacctgtgtccttcccctggatgaggggccctgccccctggccaggcccccagcccccccgggccacccagcagcccaaccaggcccccccacccagccacatccccttccaccagggcgtgcagcctgcccccatgcagaggtcctggagccaggccttcccccggcccaccgtggtgctgcctgccagccaccggcggcctgtgtctgccaacaaggagatgttctcctttgtggtggatgatgccaggaagccccctgtgatcaagcaggtgtggaccaatgccatgaagctgtctgagaagtctgtggccgagggcatccctggagctgtgcccccagctgagatctacgtggaggaggacctggcccagcaggacaaggatgagatcatcctgctgctgggcaaggaggtgtcccggctgagtgactatgaaattgagagcaagtacaaggatgtgatcatcgccaacctgcagaatgaggtggccgagctgagccagaaggtgtctgagaccaccaccagccggcagaatgagaaggagatcagccagaagtgccaggtgctggatgaggacattgatgccaagcagaaggagatccagagcctgaagagccagatcagcgccctgcagaagggctacagcaaggtgctgtgccagaccctgtctgagaggaacagcgagatcaccagcctgaagaatgaaggagagaacctgaagagggacaatgccatcaccagcggcatggtgagcagcctgcagaaggacatcctggccaaggatgagcaggtgcagcagctgaaggaggaggtgagccacctgaagagccagaacaaggacaaggaccaccagctggaggccctgggcagccgctgcagcgtgctgaaggaggagctgaagcaggaggatgcccaccgggagctgcgggaggcccaggagaaggagctgaagctgtgcaagacccagatccaggacatggagaaggagatgaagaagctgcgggcagagctgaggaagagctgcacagagcagagcgtcatcagcaggaccctgcgggagaagagcaaggtggaggagaagctgcaggaggacagcaggaggaagctgctgcagctgcaggagatgggcaaccgggagagcgtcatcaagatcaacctggagagagctgtgggccagctggagcacttccgcagccaggtgatcaaggccacctacggccgggccaagcccttccgggacaagcctgtgacagaccagcagctgattgagaagatcacccaggtgacagaggacaacatcaacttccagcagaagaagtggaccctgcagaaggagacccagctgagcaacagcaagcaggaggagaccacagaaaatattgagaagctgcggaccagcctggacagctgccaggcctgcatgaagatcagctgctgcagccatgacctgaagaaggaggtggacctgctgcagcacctgcaggtgagcccccctgtgtctggcctgcagaaggtggtgctggatgtgctgcggcatgccctgtcctggctggaggaggtggagcagctgctgcgggacctgggcatcctgcccagcagccccaacaaggaccaggtgcagcagttcagcggcaacagcgctgtgttcaccgctgggaaggccgccggggccagcggccgggagggggaggccgagcggggggaggcccgggcccggggggaggcccagagccagaaccaggccacagatggccgggagggcggcaaggccctggaggagtacatcacccaggagaggaacagagccaaggagaccctggaggaggagaggaagaggatgcaggagctggagagcctgctggcccagcagaagaaggccctggccaagagcatcacccaggagaagaacagagtgaaggaggccctggaggaggagcagaccagggtgcaggagctggaggagcggctggcccggcagaaggagatcagcgagagcaacatcgcctatgagaagaggaaggccaaggaggccatggagaaggagaagaagaaggtgcaggacctggagaaccggctgaccaagcagaaggaggagctggagctgaaggagcagaaggaggatgtgctgaacaacaagctgagtgatgccctggccatggtggaggagacccagaagaccaaggccacagagagcctgaaggccgagagcctggccctgaagctgaatgagaccctggccgagctggagaccaccaagaccaagatgatcatggtggaggagcggctcatcctgcagcagaagatggtgaaggccctgcaggatgagcaggagagccagagacatggctttgaggaggagatcatggagtacaaggagcagatcaagcagcacgcccagaccatcgtgtccctggaggagaagctgcagaaggtgacccagcaccacaagaagattgaaggagaaattgccaccctgaaggacaatgaccctgcccccaaggaggagcggccccaggaccccctggtggcccccatgacagagagcagcgccaaggacatggcctatgagcacctgattgatgacctgctggccgcccagaaggagatcctgagccagcaggaggtgatcatgaagctgaggaaggacctgacagaggcccacagcaggatgtctgacctgcggggggagctgaatgagaagcagaagatggagctggagcagaatgtggtgctggtgcagcagcagagcaaggagctgtctgtgctgaaggagaagatggcccagatgagcagcctggtggagaagaaggaccgggagctgaaggccctggaggaggccctgcgggccagccaggagaagcaccggctgcagctgaacacagagaaggagcagaagcccaggaagaagacccagacctgtgacacctctgtgcagatcgagcctgtgcacacagaggccttcagcagcagccaggagcagcagagcttcagtgacctgggcgtgcgctgcaagggcagcagacatgaggaggtgatccagaggcagaagaaggccctgtctgagctgcgggcccgcatcaaggagctggagaaggcccggagcccagaccacaaggaccaccagaatgaaagcttcctggacctgaagaacctgaggatggagaacaacgtgcagaagatcctgctggatgccaagccagacctgcccaccctgagcagaattgagatcctggccccccagaatggcctgtgcaatgccaggtttggaagtgccatggagaagagcggcaagatggatgtggccgaggccctggagctgtctgagaagctgtacctggacatgagcaagaccctgggcagcctgatgaacatcaagaacatgagcggccacgtgtccatgaagtacctgagccggcaggagcgggagaaggtgaaccagctgcggcagagggacctggacctggtgtttgacaagatcacccagctgaagaaccagctgggcaggaaggaggagctgctgcggggctatgagaaggatgtggagcagctgcggcgcagcaaggtgtccattgagatgtaccagagccaggtggccaagctggaggatgacatctacaaggaggccgaggagaaggccctgctgaaggaggccctggagaggatggagcaccagctgtgccaggagaagaggatcaacagagccatccggcagcagaaggtgggcaccaggaaggccagcctgaagatggaccaggagcgggagatgctgaggaaggagaccagcagcaagagcagccagagcctgctgcacagcaagcccagcggcaagtactag

SEQ ID NO: 38945 - DNA, 1656 bp, Artificial Sequence
  Description of Artificial Sequence: Synthetic coding sequence
atgtcctggggcacagagctgtgggaccagtttgacagcctggacaagcacacccagtggggcatcgacttcctggagagatatgccaagtttgtgaaggagcgcatcgagattgagcagaactatgccaagcagctgaggaacctggtgaagaagtactgccccaagaggagcagcaaggatgaggagccccgcttcaccagctgtgtggccttcttcaacatcctgaatgagctgaatgactatgccggccagcgggaggtggtggccgaggagatggcccaccgggtgtatggagagctgatgagatatgcccatgacctgaagacagagaggaagatgcacctgcaggagggcaggaaggcccagcagtacctggacatgtgctggaagcagatggacaacagcaagaagaagtttgaaagagaatgtcgggaggccgagaaggcccagcagagctatgaaaggctggacaatgacaccaatgccaccaaggcagatgtggagaaggccaagcagcagctgaacctgcggacccacatggctgatgagaacaagaatgaatatgctgcccagctgcagaacttcaatggagagcagcacaagcacttctacgtggtgatcccccagatctacaagcagctgcaggagatggatgaaagaaggaccatcaagctgtctgagtgctaccggggctttgctgacagcgagaggaaggtgatccccatcatcagcaagtgcctggagggcatgatcctggccgccaagtctgtggatgaaagaagagacagccagatggtggtggacagcttcaagagcggctttgagcccccaggggacttcccctttgaggactacagccagcacatctaccgcaccatcagtgatggcaccatcagcgccagcaagcaggagagcggcaagatggatgccaagaccaccgtgggcaaggccaagggcaagctgtggctgtttgggaagaagcccaagggccctgccctggaggacttcagccacctgcccccagagcagaggaggaagaagctgcagcagagaattgatgagctgaaccgggagctgcagaaggagagtgaccagaaggatgccctgaacaagatgaaggatgtgtatgagaagaacccccagatgggagaccccggcagcctgcagcccaagctggccgagaccatgaacaacatcgaccggctgaggatggagatccacaagaatgaggcctggctgtctgaggtggagggcaagacaggaggccgcggggacagaagacacagcagtgacatcaaccacctggtgacccagggccgggagagccctgagggcagctacacagatgatgccaaccaggaggtgcggggccccccccagcagcacggccaccacaatgaatttgatgatgaatttgaagatgatgaccccctgcctgccatcggccactgcaaggccatctacccctttgatggccacaatgaaggcaccctggccatgaaggagggggaggtgctgtacatcatcgaggaggacaagggagatggctggacccgggcccggcggcagaatggagaggagggctacgtgcccaccagctacattgatgtgaccctggagaagaacagcaaaggagctgtgacctacatctag

SEQ ID NO: 38946 - DNA, 1818 bp, Artificial Sequence
  Description of Artificial Sequence: Synthetic coding sequence
atgtcctggggcacagagctgtgggaccagtttgacagcctggacaagcacacccagtggggcatcgacttcctggagagatatgccaagtttgtgaaggagcgcatcgagattgagcagaactatgccaagcagctgaggaacctggtgaagaagtactgccccaagaggagcagcaaggatgaggagccccgcttcaccagctgtgtggccttcttcaacatcctgaatgagctgaatgactatgccggccagcgggaggtggtggccgaggagatggcccaccgggtgtatggagagctgatgagatatgcccatgacctgaagacagagaggaagatgcacctgcaggagggcaggaaggcccagcagtacctggacatgtgctggaagcagatggacaacagcaagaagaagtttgaaagagaatgtcgggaggccgagaaggcccagcagagctatgaaaggctggacaatgacaccaatgccaccaaggcagatgtggagaaggccaagcagcagctgaacctgcggacccacatggctgatgagaacaagaatgaatatgctgcccagctgcagaacttcaatggagagcagcacaagcacttctacgtggtgatcccccagatctacaagcagctgcaggagatggatgaaagaaggaccatcaagctgtctgagtgctaccggggctttgctgacagcgagaggaaggtgatccccatcatcagcaagtgcctggagggcatgatcctggccgccaagtctgtggatgaaagaagagacagccagatggtggtggacagcttcaagagcggctttgagcccccaggggacttcccctttgaggactacagccagcacatctaccgcaccatcagtgatggcaccatcagcgccagcaagcaggagagcggcaagatggatgccaagaccaccgtgggcaaggccaagggcaagctgtggctgtttgggaagaagcccaagccccagagcccccccctgacccccaccagcctcttcaccagcagcacccccaacggcagccagttcctgaccttcagcattgagcctgtgcactactgcatgaatgagatcaagacaggcaagccccgcatccccagcttccgcagcctgaagaggggctggagcgtgaagatgggccctgccctggaggacttcagccacctgcccccagagcagaggaggaagaagctgcagcagagaattgatgagctgaaccgggagctgcagaaggagagtgaccagaaggatgccctgaacaagatgaaggatgtgtatgagaagaacccccagatgggagaccccggcagcctgcagcccaagctggccgagaccatgaacaacatcgaccggctgaggatggagatccacaagaatgaggcctggctgtctgaggtggagggcaagacaggaggccgcggggacagaagacacagcagtgacatcaaccacctggtgacccagggccgggagagccctgagggcagctacacagatgatgccaaccaggaggtgcggggccccccccagcagcacggccaccacaatgaatttgatgatgaatttgaagatgatgaccccctgcctgccatcggccactgcaaggccatctacccctttgatggccacaatgaaggcaccctggccatgaaggagggggaggtgctgtacatcatcgaggaggacaagggagatggctggacccgggcccggcggcagaatggagaggagggctacgtgcccaccagctacattgatgtgaccctggagaagaacagcaagggcagctag

SEQ ID NO: 38947 - DNA, 1815 bp, Artificial Sequence
  Description of Artificial Sequence: Synthetic coding sequence
atgtcctggggcacagagctgtgggaccagtttgacagcctggacaagcacacccagtggggcatcgacttcctggagagatatgccaagtttgtgaaggagcgcatcgagattgagcagaactatgccaagcagctgaggaacctggtgaagaagtactgccccaagaggagcagcaaggatgaggagccccgcttcaccagctgtgtggccttcttcaacatcctgaatgagctgaatgactatgccggccagcgggaggtggtggccgaggagatggcccaccgggtgtatggagagctgatgagatatgcccatgacctgaagacagagaggaagatgcacctgcaggagggcaggaaggcccagcagtacctggacatgtgctggaagcagatggacaacagcaagaagaagtttgaaagagaatgtcgggaggccgagaaggcccagcagagctatgaaaggctggacaatgacaccaatgccaccaaggcagatgtggagaaggccaagcagcagctgaacctgcggacccacatggctgatgagaacaagaatgaatatgctgcccagctgcagaacttcaatggagagcagcacaagcacttctacgtggtgatcccccagatctacaagcagctgcaggagatggatgaaagaaggaccatcaagctgtctgagtgctaccggggctttgctgacagcgagaggaaggtgatccccatcatcagcaagtgcctggagggcatgatcctggccgccaagtctgtggatgaaagaagagacagccagatggtggtggacagcttcaagagcggctttgagcccccaggggacttcccctttgaggactacagccagcacatctaccgcaccatcagtgatggcaccatcagcgccagcaagcaggagagcggcaagatggatgccaagaccaccgtgggcaaggccaagggcaagctgtggctgtttgggaagaagcccaagccccagagcccccccctgacccccaccagcctcttcaccagcagcacccccaacggcagccagttcctgaccttcagcattgagcctgtgcactactgcatgaatgagatcaagacaggcaagccccgcatccccagcttccgcagcctgaagagaggaggccctgccctggaggacttcagccacctgcccccagagcagaggaggaagaagctgcagcagagaattgatgagctgaaccgggagctgcagaaggagagtgaccagaaggatgccctgaacaagatgaaggatgtgtatgagaagaacccccagatgggagaccccggcagcctgcagcccaagctggccgagaccatgaacaacatcgaccggctgaggatggagatccacaagaatgaggcctggctgtctgaggtggagggcaagacaggaggccgcggggaccggcggcacagcagtgacatcaaccacctggtgacccagggccgggagagccctgagggcagctacacagatgatgccaaccaggaggtgcggggccccccccagcagcacggccaccacaatgaatttgatgatgaatttgaagatgatgaccccctgcctgccatcggccactgcaaggccatctacccctttgatggccacaatgaaggcaccctggccatgaaggagggggaggtgctgtacatcattgaagaagataaaggagatggctggacccgggcccggcggcagaatggagaggagggctacgtgcccaccagctacattgatgtgaccctggagaagaacagcaaaggagctgtgacctacatctag

SEQ ID NO: 38948 - DNA, 1803 bp, Artificial Sequence
  Description of Artificial Sequence: Synthetic coding sequence
atgtcctggggcacagagctgtgggaccagtttgacagcctggacaagcacacccagtggggcatcgacttcctggagagatatgccaagtttgtgaaggagcgcatcgagattgagcagaactatgccaagcagctgaggaacctggtgaagaagtactgccccaagaggagcagcaaggatgaggagccccgcttcaccagctgtgtggccttcttcaacatcctgaatgagctgaatgactatgccggccagcgggaggtggtggccgaggagatggcccaccgggtgtatggagagctgatgagatatgcccatgacctgaagacagagaggaagatgcacctgcaggagggcaggaaggcccagcagtacctggacatgtgctggaagcagatggacaacagcaagaagaagtttgaaagagaatgtcgggaggccgagaaggcccagcagagctatgaaaggctggacaatgacaccaatgccaccaaggcagatgtggagaaggccaagcagcagctgaacctgcggacccacatggctgatgagaacaagaatgaatatgctgcccagctgcagaacttcaatggagagcagcacaagcacttctacgtggtgatcccccagatctacaagcagctgcaggagatggatgaaagaaggaccatcaagctgtctgagtgctaccggggctttgctgacagcgagaggaaggtgatccccatcatcagcaagtgcctggagggcatgatcctggccgccaagtctgtggatgaaagaagagacagccagatggtggtggacagcttcaagagcggctttgagcccccaggggacttcccctttgaggactacagccagcacatctaccgcaccatcagtgatggcaccatcagcgccagcaagcaggagagcggcaagatggatgccaagaccaccgtgggcaaggccaagggcaagctgtggctgtttgggaagaagcccaagccccagagcccccccctgacccccaccagcctcttcaccagcagcacccccaacggcagccagttcctgaccttcagcattgagcctgtgcactactgcatgaatgagatcaagacaggcaagccccgcatccccagcttccgcagcctgaagagaggaggccctgccctggaggacttcagccacctgcccccagagcagaggaggaagaagctgcagcagagaattgatgagctgaaccgggagctgcagaaggagagtgaccagaaggatgccctgaacaagatgaaggatgtgtatgagaagaacccccagatgggagaccccggcagcctgcagcccaagctggccgagaccatgaacaacatcgaccggctgaggatggagatccacaagaatgaggcctggctgtctgaggtggagggcaagacaggaggccgcggggaccggcggcacagcagtgacatcaaccacctggtgacccagggccgggagagccctgagggcagctacacagatgatgccaaccaggaggtgcggggccccccccagcagcacggccaccacaatgaatttgatgatgaatttgaagatgatgaccccctgcctgccatcggccactgcaaggccatctacccctttgatggccacaatgaaggcaccctggccatgaaggagggggaggtgctgtacatcattgaagaagataaaggagatggctggacccgggcccggcggcagaatggagaggagggctacgtgcccaccagctacattgatgtgaccctggagaagaacagcaagggcagctag

SEQ ID NO: 38949 - DNA, 1257 bp, Artificial Sequence
  Description of Artificial Sequence: Synthetic coding sequence
gacaacagcaagaagaagtttgagcgggagtgccgggaggccgagaaggcccagcagagctatgagcggctggacaatgacaccaatgccaccaaggcagatgtggagaaggccaagcagcagctgaacctgcggacccacatggctgatgagaacaagaatgaatatgctgcccagctgcagaacttcaacggggagcagcacaagcacttctacgtggtgatcccccagatctacaagcagctgcaggagatggatgagaggaggaccatcaagctgtctgagtgctaccggggctttgctgacagcgagaggaaggtgatccccatcatcagcaagtgcctggagggcatgatcctggccgccaagtctgtggatgagcggcgggacagccagatggtggtggacagcttcaagagcggctttgagcccccaggggacttcccctttgaggactacagccagcacatctaccgcaccatcagtgatggcaccatcagcgccagcaagcaggagagcggcaagatggatgccaagaccaccgtgggcaaggccaagggcaagctgtggctgtttgggaagaagcccaagggccctgccctggaggacttcagccacctgcccccagagcagaggaggaagaagctgcagcagagaattgatgagctgaaccgggagctgcagaaggagagtgaccagaaggatgccctgaacaagatgaaggatgtgtatgagaagaacccccagatgggagaccccggcagcctgcagcccaagctggccgagaccatgaacaacatcgaccggctgaggatggagatccacaagaatgaggcctggctgtctgaggtggagggcaagacaggaggccgcggggaccggcggcacagcagtgacatcaaccacctggtgacccagggccgggagagccctgagggcagctacacagatgatgccaaccaggaggtgcggggccccccccagcagcacggccaccacaatgaatttgatgatgaatttgaagatgatgaccccctgcctgccatcggccactgcaaggccatctacccctttgatggccacaatgaaggcaccctggccatgaaggagggggaggtgctgtacatcattgaagaagataaaggagatggctggacccgggcccggcggcagaatggagaggagggctacgtgcccaccagctacattgatgtgaccctggagaagaacagcaaaggagctgtgacctacatctag

SEQ ID NO: 38950 - DNA, 747 bp, Artificial Sequence
  Description of Artificial Sequence: Synthetic coding sequence
atggatgccaagaccaccgtgggcaaggccaagggcaagctgtggctgtttgggaagaagcccaagccccagagcccccccctgacccccaccagcctcttcaccagcagcacccccaacggcagccagttcctgaccttcagcattgagcctgtgcactactgcatgaatgagatcaagacaggcaagccccgcatccccagcttccgcagcctgaagaggggctggagcgtgaagatgggccctgccctggaggacttcagccacctgcccccagagcagaggaggaagaagctgcagcagagaattgatgagctgaaccgggagctgcagaaggagagtgaccagaaggatgccctgaacaagatgaaggatgtgtatgagaagaacccccagatgggagaccccggcagcctgcagcccaagctggccgagaccatgaacaacatcgaccggctgaggatggagatccacaagaatgaggcctggctgtctgaggtggagggcaagacaggaggccgcggggacagaagacacagcagtgacatcaaccacctggtgacccagggccgggagagccctgagggcagctacacagatgatgccaaccaggaggtgcggggccccccccagcagcacggccaccacaatgaatttgatgatgaatttgaagatgatgaccccctgcctgccatcggccactgcaaggccatctaccccctgatggacatcatgaaggtgctgtag

SEQ ID NO: 38951 - DNA, 3054 bp, Artificial Sequence
  Description of Artificial Sequence: Synthetic coding sequence
atgggcaagaagagcagagctgtgcctggaagaagacccatcctgcagctgagccccccaggcccccggggcagcaccccaggccgggaccctgagcctgagccagacacagagccagacagcacagctgctgtgcccagccagcctgcccccagcgctgccaccaccaccaccacagctgtgacagctgctgctgccagtgatgacagccccagtgaagatgagcaggaggccgtgcaggaggtgccccgggtggtgcagaacccccccaagcctgtgatgaccacccggcccacagctgtgaaggccaccggcggcctgtgcctgctgggcgcctatgctgacagtgatgatgatgacaatgatgtgtctgagaagctggcccagagcaaggagaccaacggcaaccagagcacagacatcgacagcaccctggccaacttcctggccgagattgatgccatcacagccccccagcctgctgcccctgtgggcgccagcgcccccccacccaccccacccaggcctgagcccaaggaggccgccaccagcaccctgagcagcagcaccagcaatggaacagacagcacccagaccagcggctggcagtatgacacccagtgcagcctggccggcgtgggcatcgagatgggagactggcaggaggtgtgggatgagaacacaggctgctactactactggaacacccagaccaatgaggtgacctgggagctgccccagtacctggccacccaggtgcagggcctgcagcactaccagcccagctctgtgcctggagctgagaccagctttgtggtgaacacagacatctacagcaaggagaagaccatctctgtgagcagcagcaagagcggccctgtgattgccaagcgggaggtgaagaaggaggtgaatgaaggcatccaggccctgagcaacagcgaggaggagaagaagggcgtggccgccagcctgctggcccccctgctgcctgagggcatcaaggaggaggaggagcgctggaggaggaaggtgatctgcaaggaggagcctgtgtctgaggtgaaggagaccagcaccaccgtggaggaggccaccaccatcgtgaagccccaggagatcatgctggacaacatcgaggaccccagccaggaggacctgtgcagcgtggtgcagagcggggagagcgaggaggaggaggagcaggacaccctggagctggagctggtgctggagaggaagaaggccgagctgcgggccctggaggagggagatggctctgtgtctggcagcagccccaggagtgacatcagccagcctgccagccaggacggcatgaggcggctgatgagcaagaggggcaagtggaagatgtttgtgcgggccaccagccctgagagcaccagccgcagcagcagcaagacaggccgggacaccccagaaaatggagaaacagccatcggggctgagaacagcgagaagattgatgaaaattctgacaaggagatggaggtggaggagagccctgagaagatcaaggtgcagaccacccccaaggtggaggaggagcaggacctgaagttccagatcggggagctggccaacaccctgaccagcaagtttgagttcctgggcatcaaccggcagagcatcagcaacttccacgtgctgctgctgcagacagagaccagaattgctgactggagggagggcgccctgaatggaaactacctgaagaggaagctgcaggatgctgctgagcagctgaagcagtatgagatcaatgccacccccaagggctggagctgccactgggaccgggaccaccggcgctacttctacgtgaatgagcagagcggggagagccagtgggagttcccagatggagaggaggaggaggaggagagccaggcccaggagaacagagatgagaccctggccaagcagaccctgaaggacaagacaggaacagacagcaacagcacagagagcagcgagaccagcacaggcagcctgtgcaaggagagcttcagcggccaggtgagcagcagcagcctgatgcccctgacccccttctggaccctgctgcagagcaatgtgcctgtgctgcagccccccctgcccctggagatgcctcctcctcctcctcctcctcctgagagccccccacctcctcctcctcctcctcctccagcagaagatggagagatccaggaggtggagatggaggatgagggcagcgaggagcccccagcccctggaacagaggaggacacccccctgaagcccagcgcccagaccaccgtggtgaccagccagagctctgtggacagcaccatcagcagcagcagcagcaccaagggcatcaagaggaaggccacagagatcagcacagctgtggtgcagaggtctgccaccatcggcagcagccctgtgctgtacagccagagcgccatcgccaccggccaccaggccgccggcatcggcaaccaggccactggaattggccaccagaccatccctgtgtccctgcctgctgctggcatgggccaccaggcccggggcatgagcctgcagagcaactacctgggcctggccgccgccccagccatcatgtcctatgcagagtgcagcgtgcccatcggcgtgacagcccccagcctgcagcctgtgcaggcccggggagctgtgcccacagccaccatcatcgagcccccacctcctcctcctcctcctcctcctcctcctcctccagcccccaagatgcctcctcctgagaagaccaagaagggcaggaaggacaaggccaagaagagcaagaccaagatgcccagcctggtgaagaagtggcagagcatccagcgggagctggatgaggaggacaacagcagcagcagcgaggaggaccgggagagcacagcccagaagagaattgaggagtggaagcagcagcagctggtgtctggcatggccgagagaaatgccaactttgaggccctgcctgaggactggagggcccggctgaagaggaggaagatggcccccaacacctag

SEQ ID NO: 38952 - DNA, 3279 bp, Artificial Sequence
  Description of Artificial Sequence: Synthetic coding sequence
atgggaaatgccggctccatggacagccagcagacagacttccgggcccacaacgtgcccctgaagctgcccatgcctgagcccggggagctggaggagagatttgccatcgtgctgaatgccatgaacctgcccccagacaaggcccggctgctgcggcagtatgacaatgagaagaagtgggagctgatctgtgaccaggagcgcttccaggtgaagaaccccccccacacctacatccagaagctgaagggctacctggaccctgctgtgaccaggaagaagttcagaagaagagtgcaggagagcacccaggtgctgcgggagctggagatcagcctgcggaccaaccacatcggctgggtgcgggagttcctgaatgaagaaaataaaggcctggatgtgctggtggagtacctgagctttgcccagtatgctgtgacctttgattttgaatctgtggagagcacagtggagagctctgtggacaagagcaagccctggagccgcagcattgaggacctgcaccggggcagcaacctgcccagccctgtgggcaacagcgtgagccgcagcggccgccacagcgccctgcgctacaacaccctgcccagcaggaggaccctgaagaacagccggctggtgtccaagaaggatgatgtgcacgtgtgcatcatgtgcctgcgggccatcatgaactaccagtatggcttcaacatggtgatgagccacccccatgctgtgaatgaaattgccctgagcctgaacaacaagaaccccaggaccaaggccctggtgctggagctgctggccgctgtgtgcctggtgcggggcggccacgagatcatcctgagcgcctttgacaacttcaaggaggtgtgtggggagaagcagagatttgagaagctgatggagcacttcagaaatgaagacaacaacatcgacttcatggtggcctccatgcagttcatcaacatcgtggtgcacagcgtggaggacatgaacttccgggtgcacctgcagtatgagttcaccaagctgggcctggatgagtacctggacaagctgaagcacacagaaagtgacaagctgcaggtgcagatccaggcctacctggacaacgtgtttgatgtgggcgccctgctggaggatgctgagaccaagaatgctgccctggagcgggtggaggagctggaggagaacatcagccacctgtctgagaagctgcaggacacagaaaatgaggccatgagcaagatcgtggagctggagaagcagctgatgcagaggaacaaggagctggatgtggtgcgggagatctacaaggatgccaacacccaggtgcacaccctgaggaagatggtgaaggagaaggaggaggccatccagaggcagagcaccctggagaagaagatccacgagctggagaagcagggcaccatcaagatccagaagaagggagatggagacatcgccatcctgcctgtggtggccagcggcaccctgtccatgggcagcgaggtggtggccggcaacagcgtgggccccaccatgggcgccgccagcagcggccccctgcccccacctcctccacccctgccccccagcagtgacaccccagagaccgtgcagaatggacctgtgaccccacccatgcctcctcctcctcctcctcctcctcctcctcctcctcctcctcctcctcctcctcctccacccctgcccggccctgctgctgagaccgtgcctgccccacccctggccccacccctgcccagcgccccacccctgcccggcaccagcagccccaccgtggtgttcaacagcggcctggccgctgtgaagatcaagaagcccatcaagaccaagttcaggatgcctgtgttcaactgggtggccctgaagcccaaccagatcaatggcaccgtcttcaatgaaattgatgatgagcgcatcctggaggacctgaatgtggatgaatttgaggagatcttcaagaccaaggcccagggccctgccatcgacctgagcagcagcaagcagaagatcccccagaagggcagcaacaaggtgaccctgctggaggccaacagagccaagaacctggccatcaccctgaggaaggccggcaagacagcagatgagatctgcaaggccatccacgtgtttgacctgaagaccctgcctgtggactttgtggagtgcctgatgaggttcctgcccacagaaaatgaggtgaaggtgctgcggctgtatgaaagagagaggaagcccctggagaacctgagtgatgaagatcgcttcatgatgcagttcagcaagattgagcggctgatgcagaagatgaccatcatggccttcatcggcaactttgctgagagcatccagatgctgaccccccagctgcacgccatcatcgccgcctctgtgtccatcaagagcagccagaagctgaagaagatcctggagatcatcctggccctgggcaactacatgaacagcagcaagagaggagctgtgtatggcttcaagctgcagagcctggacctgctgctggacaccaagagcacagacaggaagcagaccctgctgcactacatcagcaatgtggtgaaggagaagtaccaccaggtgtccctcttctacaatgagctgcactacgtggagaaggctgctgctgtgtccctggagaatgtgctgctggatgtgaaggagctgcagaggggcatggacctgaccaagcgggagtacaccatgcatgaccacaacaccctgctgaaggagttcatcctgaacaatgaaggcaagctgaagaagctgcaggatgatgccaagatcgcccaggatgcctttgatgatgtggtgaagtactttggagagaaccccaagaccaccccacccagcgtcttcttccctgtgtttgtgcgctttgtgaaggcctacaagcaggccgaggaggagaatgagctgaggaagaagcaggagcaggccctgatggagaagctgctggagcaggaggccctgatggagcagcaggaccccaagagccccagccacaagagcaagaggcagcagcaggagctgattgctgagctgcggcggcggcaggtgaaggacaacagacatgtgtatgagggcaaggatggagccatcgaggacatcatcacagacctgaggaaccagccctaccgccgggcagatgctgtgcggcgctctgtgagaagaagatttgatgaccagaacctgcggtctgtgaatggagctgagatcaccatgtag

SEQ ID NO: 38953 - DNA, 1707 bp, Artificial Sequence
  Description of Artificial Sequence: Synthetic coding sequence
atgggcagcgaggtggtggccggcaacagcgtgggccccaccatgggcgccgccagcagcggccccctgcccccacctcctccacccctgccccccagcagtgacaccccagagaccgtgcagaatggacctgtgaccccacccatgcctcctcctccacccctgcccggccctgctgctgagaccgtgcctgccccacccctggccccacccctgcccagcgccccacccctgcccggcaccagcagccccaccgtggtgttcaacagcggcctggccgctgtgaagatcaagaagcccatcaagaccaagttcaggatgcctgtgttcaactgggtggccctgaagcccaaccagatcaatggaacagtgttcaatgaaattgatgatgagcgcatcctggaggacctgaatgtggatgaatttgaggagatcttcaagaccaaggcccagggccctgccatcgacctgagcagcagcaagcagaagatcccccagaagggcagcaacaaggtgaccctgctggaggccaacagagccaagaacctggccatcaccctgaggaaggccggcaagacagcagatgagatctgcaaggccatccacgtgtttgacctgaagaccctgcctgtggactttgtggagtgcctgatgaggttcctgcccacagaaaatgaggtgaaggtgctgcggctgtatgagcgggagaggaagcccctggagaacctgagtgatgaggaccgcttcatgatgcagttcagcaagattgaaaggctgatgcagaagatgaccatcatggccttcatcggcaactttgctgagagcatccagatgctgaccccccagctgcacgccatcatcgccgcctctgtgtccatcaagagcagccagaagctgaagaagatcctggagatcatcctggccctgggcaactacatgaacagcagcaagagaggagctgtgtatggcttcaagctgcagagcctggacctgctgctggacaccaagagcacagacaggaagcagaccctgctgcactacatcagcaatgtggtgaaggagaagtaccaccaggtgtccctcttctacaatgagctgcactacgtggagaaggctgctgctgtgtccctggagaatgtgctgctggatgtgaaggagctgcagaggggcatggacctgaccaagcgggagtacaccatgcatgaccacaacaccctgctgaaggagttcatcctgaacaatgaaggcaagctgaagaagctgcaggatgatgccaagatcgcccaggatgcctttgatgatgtggtgaagtactttggagagaaccccaagaccaccccaccttctgtgttcttccctgtgtttgtgcgctttgtgaaggcctacaagcaggccgaggaggagaatgagctgaggaagaagcaggagcaggccctgatggagaagctgctggagcaggaggccctgatggagcagcaggaccccaagagccccagccacaagagcaagaggcagcagcaggagctgattgctgagctgcggcggcggcaggtgaaggacaacagacatgtgtatgagggcaaggatggagccatcgaggacatcatcacagccctgaagaagaacaacatcaccaagttccccaacgtgcacagccgggtgcgcatcagcagcagcacccctgtggtggaggacacccagagctag

SEQ ID NO: 38954 - DNA, 3087 bp, Artificial Sequence
  Description of Artificial Sequence: Synthetic coding sequence
atgggcaacctggagagcgctgagggcgtgcctggagagccccccagcgtgcccctgctgctgcccccaggcaagatgcccatgcctgagccctgtgagctggaggagagatttgccctggtgctgagctccatgaacctgcccccagacaaggcccggctgctgcggcagtatgacaatgagaagaagtgggacctgatctgtgaccaggagcgcttccaggtgaagaaccccccccacacctacatccagaagctgcagagcttcctggaccccagcgtgaccaggaagaagttcagaagaagagtgcaggagagcaccaaggtgctgcgggagctggagatcagcctgcggaccaaccacatcggctgggtgcgggagttcctgaatgatgagaacaagggcctggatgtgctggtggactacctgagctttgcccagtgcagcgtgatgtttgattttgagggcctggagagcggagatgatggagcctttgacaagctgcgctcctggagccgcagcattgaggacctgcagccccccagcgccctgagcgcccccttcaccaacagcctggcccggagcgcccggcagagcgtgctgcgctacagcaccctgcctggaagaagagccctgaagaacagccggctggtgtcccagaaggatgatgtgcacgtgtgcatcctgtgcctgcgggccatcatgaactaccagtatggcttcaacctggtgatgagccacccccatgctgtgaatgagatcgccctgagcctgaacaacaagaaccccaggaccaaggccctggtgctggagctgctggccgctgtgtgcctggtgcggggcggccacgagatcatcctggccgcctttgacaacttcaaggaggtgtgcaaggagctgcacagatttgagaagctgatggagtacttcagaaatgaagacagcaacatcgacttcatggtggcctgcatgcagttcatcaacatcgtggtgcacagcgtggaggacatgaacttccgggtgcacctgcagtatgagttcaccaagctgggcctggaggagttcctgcagaagagccgccacacagagagcgagaagctgcaggtgcagatccaggcctacctggacaacgtgtttgatgtgggcggcctgctggaggatgctgagaccaagaatgtggccctggagaaggtggaggagctggaggagcacgtgagccacctgacagagaagctgctggacctggagaatgaaaacatgatgagggtggccgagctggagaagcagctgctgcagcgggagaaggagctggagagcatcaaggagacctatgagaacaccagccaccaggtgcacaccctgcggcggctcatcaaggagaaggaggaggccttccagaggcgctgccacctggagcccaacgtgcggggcctggagagcgtggacagcgaggccctggcccgggtgggccctgctgagctgtctgagggcatgcccccaagtgacctggacctgctggccccagcccctcctcctgaggaggtgctgcccctgcccccacctccagccccacccctgcccccacctcctccacccctgcctgacaagtgccccccagccccacccctgcccggggccgcccccagcgtggtgctgactgtgggcctgagcgccatccgcatcaagaagcccatcaagaccaagttccggctgcccgtcttcaactggacagccctgaagcccaaccagatctctggaacagtgttcagcgagctggatgatgagaagatcctggaggacctggacctggacaagtttgaggagctgttcaagaccaaggcccagggccctgccctggacctgatctgcagcaagaacaagacagcccagaaggccgccagcaaggtgaccctgctggaggccaacagagccaagaacctggccatcaccctgaggaaggccggccgctctgctgaggagatctgccgggccatccacacctttgacctgcagaccctgcctgtggactttgtggagtgcctgatgaggttcctgcccacagaagctgaggtgaagctgctgcggcagtatgagcgggagcggcagcccctggaggagctggccgctgaggaccgcttcatgctgctcttcagcaaggtggagcggctgacccagaggatggccggcatggccttcctgggcaacttccaggacaacctgcagatgctgaccccccagctgaatgccatcatcgccgccagcgcctctgtgaagagcagccagaagctgaagcagatgctggagatcatcctggccctgggcaactacatgaacagcagcaagagaggagctgtgtatggcttcaagctgcagagcctggacctgctgctggacaccaagagcacagacaggaagatgaccctgctgcacttcatcgccctgactgtgaaggagaagtacccagacctggccaacttctggcatgagctgcactttgtggagaaggctgctgctgtgtccctggagaatgtgctgctggatgtgaaggagctgggccggggcatggagctgatcagaagagaatgttccatccatgacaacagcgtgctgaggaacttcctgagcaccaatgaaggcaagctggacaagctgcagagagatgccaagacagctgaggaggcctacaatgctgtggtgcgctactttggagagagccccaagaccaccccacccagcgtcttcttccctgtgtttgtgcgcttcatccgcagctacaaggaggccgagcaggagaatgaggccaggaagaagcaggaggaggtgatgagggagaagcagctggcccaggaggccaagaagctggatgccaagacccccagccagaggaacaagtggcagcagcaggagctgattgctgagctgcggcggcggcaggccaaggagcacaggcctgtgtatgagggcaaggatggcaccatcgaggacatcatcaccgtgctgaagtctgtgcccttcaccgccaggacagccaagaggggcagccgcttcttctgtgatgctgcccaccatgatgagagcaactgctag

SEQ ID NO: 38955 - DNA, 3084 bp, Artificial Sequence
  Description of Artificial Sequence: Synthetic coding sequence
atgggcaacctggagagcgctgagggcgtgcctggagagccccccagcgtgcccctgctgctgcccccaggcaagatgcccatgcctgagccctgtgagctggaggagagatttgccctggtgctgagctccatgaacctgcccccagacaaggcccggctgctgcggcagtatgacaatgagaagaagtgggacctgatctgtgaccaggagcgcttccaggtgaagaaccccccccacacctacatccagaagctgcagagcttcctggaccccagcgtgaccaggaagaagttcagaagaagagtgcaggagagcaccaaggtgctgcgggagctggagatcagcctgcggaccaaccacatcggctgggtgcgggagttcctgaatgatgagaacaagggcctggatgtgctggtggactacctgagctttgcccagtgcagcgtgatgtttgattttgagggcctggagagcggagatgatggagcctttgacaagctgcgctcctggagccgcagcattgaggacctgcagccccccagcgccctgagcgcccccttcaccaacagcctggcccggagcgcccggcagagcgtgctgcgctacagcaccctgcctggaagaagagccctgaagaacagccggctggtgtcccagaaggatgatgtgcacgtgtgcatcctgtgcctgcgggccatcatgaactaccagtatggcttcaacctggtgatgagccacccccatgctgtgaatgagatcgccctgagcctgaacaacaagaaccccaggaccaaggccctggtgctggagctgctggccgctgtgtgcctggtgcggggcggccacgagatcatcctggccgcctttgacaacttcaaggaggtgtgcaaggagctgcacagatttgagaagctgatggagtacttcagaaatgaagacagcaacatcgacttcatggtggcctgcatgcagttcatcaacatcgtggtgcacagcgtggaggacatgaacttccgggtgcacctgcagtatgagttcaccaagctgggcctggaggagttcctgcagaagagccgccacacagagagcgagaagctgcaggtgcagatccaggcctacctggacaacgtgtttgatgtgggcggcctgctggaggatgctgagaccaagaatgtggccctggagaaggtggaggagctggaggagcacgtgagccacctgacagagaagctgctggacctggagaatgaaaacatgatgagggtggccgagctggagaagcagctgctgcagcgggagaaggagctggagagcatcaaggagacctatgagaacaccagccaccaggtgcacaccctgcggcggctcatcaaggagaaggaggaggccttccagaggcgctgccacctggagcccaacgtgcggggcctggagagcgtggacagcgaggccctggcccgggtgggccctgctgagctgtctgagggcatgcccccaagtgacctggacctgctggccccagcccctcctcctgaggaggtgctgcccctgcccccacctccagccccacccctgcccccacctcctccacccctgcctgacaagtgccccccagccccacccctgcccggggccgcccccagcgtggtgctgactgtgggcctgagcgccatccgcatcaagaagcccatcaagaccaagttccggctgcccgtcttcaactggacagccctgaagcccaaccagatctctggaacagtgttcagcgagctggatgatgagaagatcctggaggacctggacctggacaagtttgaggagctgttcaagaccaaggcccagggccctgccctggacctgatctgcagcaagaacaagacagcccagaaggccgccagcaaggtgaccctgctggaggccaacagagccaagaacctggccatcaccctgaggaaggccggccgctctgctgaggagatctgccgggccatccacacctttgacctgcagaccctgcctgtggactttgtggagtgcctgatgaggttcctgcccacagaagctgaggtgaagctgctgcggcagtatgagcgggagcggcagcccctggaggagctggccgctgaggaccgcttcatgctgctcttcagcaaggtggagcggctgacccagaggatggccggcatggccttcctgggcaacttccaggacaacctgcagatgctgaccccccagctgaatgccatcatcgccgccagcgcctctgtgaagagcagccagaagctgaagcagatgctggagatcatcctggccctgggcaactacatgaacagcagcaagagaggagctgtgtatggcttcaagctgcagagcctggacctgctgctggacaccaagagcacagacaggaagatgaccctgctgcacttcatcgccctgactgtgaaggagaagtacccagacctggccaacttctggcatgagctgcactttgtggagaaggctgctgctgtgtccctggagaatgtgctgctggatgtgaaggagctgggccggggcatggagctgatcagaagagaatgttccatccatgacaacagcgtgctgaggaacttcctgagcaccaatgaaggcaagctggacaagctgcagagagatgccaagacagctgaggaggcctacaatgctgtggtgcgctactttggagagagccccaagaccaccccacccagcgtcttcttccctgtgtttgtgcgcttcatccgcagctacaaggaggccgagcaggagaatgaggccaggaagaagcaggaggaggtgatgagggagaagcagctggcccaggaggccaagaagctggatgccaagacccccagccagaggaacaagtggcagcagcaggagctgattgctgagctgcggcggcggcaggccaaggagcacaggcctgtgtatgagggcaaggatggcaccatcgaggacatcatcaccggcctgcactgccagcccatggtggtgcgccaccaggcccggtctgctgccccacccagcggccccccccgggcccctggcccccactag

SEQ ID NO: 38956 - DNA, 2931 bp, Artificial Sequence
  Description of Artificial Sequence: Synthetic coding sequence
atgggcaacctggagagcgctgagggcgtgcctggagagccccccagcgtgcccctgctgctgcccccaggcaagatgcccatgcctgagccctgtgagctggaggagagatttgccctggtgctgagctccatgaacctgcccccagacaaggcccggctgctgcggcagtatgacaatgagaagaagtgggacctgatctgtgaccaggagcgcttccaggtgaagaaccccccccacacctacatccagaagctgcagagcttcctggaccccagcgtgaccaggaagaagttcagaagaagagtgcaggagagcaccaaggtgctgcgggagctggagatcagcctgcggaccaaccacatcggctgggtgcgggagttcctgaatgatgagaacaagggcctggatgtgctggtggactacctgagctttgcccagtgcagcgtgatgtacagcaccctgcccggccggcgggccctgaagaacagccggctggtgtcccagaaggatgatgtgcacgtgtgcatcctgtgcctgcgggccatcatgaactaccagtatggcttcaacctggtgatgagccacccccatgctgtgaatgaaattgccctgagcctgaacaacaagaaccccaggaccaaggccctggtgctggagctgctggccgctgtgtgcctggtgcggggcggccacgagatcatcctggccgcctttgacaacttcaaggaggtgtgcaaggagctgcacagatttgagaagctgatggagtacttcagaaatgaagacagcaacatcgacttcatggtggcctgcatgcagttcatcaacatcgtggtgcacagcgtggaggacatgaacttccgggtgcacctgcagtatgagttcaccaagctgggcctggaggagttcctgcagaagagccgccacacagaaagtgagaagctgcaggtgcagatccaggcctacctggacaacgtgtttgatgtgggcggcctgctggaggatgctgagaccaagaatgtggccctggagaaggtggaggagctggaggagcacgtgagccacctgacagagaagctgctggacctggagaatgaaaacatgatgagggtggccgagctggagaagcagctgctgcagcgggagaaggagctggagagcatcaaggagacctatgagaacaccagccaccaggtgcacaccctgcggcggctcatcaaggagaaggaggaggccttccagaggcgctgccacctggagcccaacgtgcggggcctggagagcgtggacagcgaggccctggcccgggtgggccctgctgagctgtctgagggcatgccacccagcgacctggacctgctggccccagcccctcctcctgaggaggtgctgcccctgcccccacctccagccccacccctgcccccacctcctccacccctgcctgacaagtgccccccagccccacccctgcctggagctgcccccagcgtggtgctgactgtgggcctgagcgccatccgcatcaagaagcccatcaagaccaagttccggctgcctgtgttcaactggacagccctgaagcccaaccagatcagcggcaccgtcttcagcgagctggatgatgagaagatcctggaggacctggacctggacaagtttgaggagctgttcaagaccaaggcccagggccctgccctggacctgatctgcagcaagaacaagacagcccagaaggccgccagcaaggtgaccctgctggaggccaacagagccaagaacctggccatcaccctgaggaaggccggccgctctgctgaggagatctgccgggccatccacacctttgacctgcagaccctgcctgtggactttgtggagtgcctgatgaggttcctgcccacagaggccgaggtgaagctgctgcggcagtatgaaagagagcggcagcccctggaggagctggccgcagaagatcgcttcatgctgctcttcagcaaggtggagcggctgacccagaggatggccggcatggccttcctgggcaacttccaggacaacctgcagatgctgaccccccagctgaatgccatcatcgccgccagcgcctctgtgaagagcagccagaagctgaagcagatgctggagatcatcctggccctgggcaactacatgaacagcagcaagagaggagctgtgtatggcttcaagctgcagagcctggacctgctgctggacaccaagagcacagacaggaagatgaccctgctgcacttcatcgccctgactgtgaaggagaagtacccagacctggccaacttctggcatgagctgcactttgtggagaaggctgctgctgtgtccctggagaatgtgctgctggatgtgaaggagctgggccggggcatggagctgatccggcgggagtgcagcatccatgacaacagcgtgctgaggaacttcctgagcaccaatgaaggcaagctggacaagctgcagagagatgccaagacagctgaggaggcctacaatgctgtggtgcgctactttggagagagccccaagaccaccccaccttctgtgttcttccctgtgtttgtgcgcttcatccgcagctacaaggaggccgagcaggagaatgaggccaggaagaagcaggaggaggtgatgagggagaagcagctggcccaggaggccaagaagctggatgccaagacccccagccagaggaacaagtggcagcagcaggagctgattgctgagctgcggcggcggcaggccaaggagcacaggcctgtgtatgagggcaaggatggcaccatcgaggacatcatcaccggcctgcactgccagcccatggtggtgcgccaccaggcccggtctgctgcccctccttctggccccccccgggcccctggcccccactag

SEQ ID NO: 38957 - DNA, 3084 bp, Artificial Sequence
  Description of Artificial Sequence: Synthetic coding sequence
atgggcaacctggagagcgctgagggcgtgcctggagagccccccagcgtgcccctgctgctgcccccaggcaagatgcccatgcctgagccctgtgagctggaggagagatttgccctggtgctgagctccatgaacctgcccccagacaaggcccggctgctgcggcagtatgacaatgagaagaagtgggacctgatctgtgaccaggagcgcttccaggtgaagaaccccccccacacctacatccagaagctgcagagcttcctggaccccagcgtgaccaggaagaagttcagaagaagagtgcaggagagcaccaaggtgctgcgggagctggagatcagcctgcggaccaaccacatcggctgggtgcgggagttcctgaatgatgagaacaagggcctggatgtgctggtggactacctgagctttgcccagtgcagcgtgatgtttgattttgagggcctggagagcggagatgatggagcctttgacaagctgcgctcctggagccgcagcattgaggacctgcagccccccagcgccctgagcgcccccttcaccaacagcctggcccggagcgcccggcagagcgtgctgcgctacagcaccctgcctggaagaagagccctgaagaacagccggctggtgtcccagaaggatgatgtgcacgtgtgcatcctgtgcctgcgggccatcatgaactaccagtatggcttcaacctggtgatgagccacccccatgctgtgaatgagatcgccctgagcctgaacaacaagaaccccaggaccaaggccctggtgctggagctgctggccgctgtgtgcctggtgcggggcggccacgagatcatcctggccgcctttgacaacttcaaggaggtgtgcaaggagctgcacagatttgagaagctgatggagtacttcagaaatgaagacagcaacatcgacttcatggtggcctgcatgcagttcatcaacatcgtggtgcacagcgtggaggacatgaacttccgggtgcacctgcagtatgagttcaccaagctgggcctggaggagttcctgcagaagagccgccacacagagagcgagaagctgcaggtgcagatccaggcctacctggacaacgtgtttgatgtgggcggcctgctggaggatgctgagaccaagaatgtggccctggagaaggtggaggagctggaggagcacgtgagccacctgacagagaagctgctggacctggagaatgaaaacatgatgagggtggccgagctggagaagcagctgctgcagcgggagaaggagctggagagcatcaaggagacctatgagaacaccagccaccaggtgcacaccctgcggcggctcatcaaggagaaggaggaggccttccagaggcgctgccacctggagcccaacgtgcggggcctggagagcgtggacagcgaggccctggcccgggtgggccctgctgagctgtctgagggcatgcccccaagtgacctggacctgctggccccagcccctcctcctgaggaggtgctgcccctgcccccacctccagccccacccctgcccccacctcctccacccctgcctgacaagtgccccccagccccacccctgcccggggccgcccccagcgtggtgctgactgtgggcctgagcgccatccgcatcaagaagcccatcaagaccaagttccggctgcccgtcttcaactggacagccctgaagcccaaccagatctctggaacagtgttcagcgagctggatgatgagaagatcctggaggacctggacctggacaagtttgaggagctgttcaagaccaaggcccagggccctgccctggacctgatctgcagcaagaacaagacagcccagaaggccgccagcaaggtgaccctgctggaggccaacagagccaagaacctggccatcaccctgaggaaggccggccgctctgctgaggagatctgccgggccatccacacctttgacctgcagaccctgcctgtggactttgtggagtgcctgatgaggttcctgcccacagaagctgaggtgaagctgctgcggcagtatgagcgggagcggcagcccctggaggagctggccgctgaggaccgcttcatgctgctcttcagcaaggtggagcggctgacccagaggatggccggcatggccttcctgggcaacttccaggacaacctgcagatgctgaccccccagctgaatgccatcatcgccgccagcgcctctgtgaagagcagccagaagctgaagcagatgctggagatcatcctggccctgggcaactacatgaacagcagcaagagaggagctgtgtatggcttcaagctgcagagcctggacctgctgctggacaccaagagcacagacaggaagatgaccctgctgcacttcatcgccctgactgtgaaggagaagtacccagacctggccaacttctggcatgagctgcactttgtggagaaggctgctgctgtgtccctggagaatgtgctgctggatgtgaaggagctgggccggggcatggagctgatcagaagagaatgttccatccatgacaacagcgtgctgaggaacttcctgagcaccaatgaaggcaagctggacaagctgcagagagatgccaagacagctgaggcctacaatgctgtggtgcgctactttggagagagccccaagaccaccccaccttctgtgttcttccctgtgtttgtgcgcttcatccgcagctacaaggaggccgagcaggagaatgaggccaggaagaagcaggaggaggtgatgagggagaagcagctggcccaggaggccaagaagctggatgccaagacccccagccagaggaacaagtggcagcagcaggagctgattgctgagctgcggcggcggcaggccaaggagcacaggcctgtgtatgagggcaaggatggcaccatcgaggacatcatcaccgtgctgaagtctgtgcccttcaccgccaggacagccaagaggggcagccgcttcttctgtgatgctgcccaccatgatgagagcaactgctag

SEQ ID NO: 38958 - DNA, 1227 bp, Artificial Sequence
  Description of Artificial Sequence: Synthetic coding sequence
atgagcaagagggacatcgtgctgaccaacgtgacagtggtgcagctgctgcggcagccctgccctgtgacccgggcccctcctcctcctgagcccaaggccgaggtggagccccagccccagcctgagcccacccctgtgcgggaggagatcaagcccccacctccacccctgcccccccacccagccaccccaccacccaagatggtgtctgtggcccgggagctgactgtgggcatcaatggatttggccgcatcggccgcctggtgctgcgggcctgcatggagaagggcgtgaaggtggtggccgtgaatgaccccttcattgatcctgagtacatggtgtacatgttcaagtatgacagcacccacggccgctacaagggctctgtggagttcagaaatggccagctggtggtggacaaccacgagatctctgtgtaccagtgcaaggagcccaagcagatcccctggagggctgtgggcagcccctacgtggtggagagcactggagtgtacctgagcatccaggccgccagtgaccacatctctgctggggcccagagggtggtgatcagcgcccccagcccagatgcccccatgtttgtgatgggcgtgaatgaaaatgactacaaccctggctccatgaacatcgtgtccaatgccagctgcaccaccaactgcctggcccccctggccaaggtgattcatgagcgcttcggcatcgtggagggcctgatgaccaccgtgcacagctacacagccacccagaagacagtggatggccccagcaggaaggcctggagagatggccgcggggcccaccagaacatcatcccagccagcactggagctgccaaggctgtgaccaaggtgattcctgagctgaagggcaagctgaccggcatggccttccgggtgcccaccccagatgtgtctgtggtggacctgacctgccgcctggcccagcctgccccctacagcgccatcaaggaggccgtgaaggctgctgccaagggccccatggccggcatcctggcctacacagaagatgaggtggtgtccacagacttcctgggggacacccacagcagcatctttgatgccaaggccggcatcgccctgaatgacaactttgtgaagctgatctcctggtatgacaatgaatatggctacagccaccgggtggtggacctgctgcgctacatgttcagccgggacaagtag

SEQ ID NO: 38959 - DNA, 2811 bp, Artificial Sequence
  Description of Artificial Sequence: Synthetic coding sequence
atggctgctgcccgggaccccccagaggtgtccctgcgggaggccacccagaggaagctgcggcgcttcagcgagctgcggggcaagctggtggcccggggggagttctgggacatcgtggccatcacagctgctgatgagaagcaggagctggcctacaaccagcagctgtctgagaagctgaagaggaaggagctgcccctgggcgtgcagtaccacgtgtttgtggaccctgctggggccaagattggaaatggaggcagcaccctgtgtgccctgcagtgcctggagaagctgtatggagacaagtggaacagcttcaccatcctgctgatccacagtgatgagtggaagaagaaggtgtctgagagctatgtgatcaccatcgagcggctggaggatgacctgcagatcaaggagaaggagctgacagagctgaggaacatcttcggcagtgatgaggccttcagcaaggtgaacctgaactacagaacagaaaatggcctgagcctgctgcacctgtgctgcatctgtggcggcaagaagagccacatccgcaccctgatgctgaagggcctgcggcccagccggctgaccagaaatggcttcaccgccctgcacctggccgtgtacaaggacaatgctgagctgatcaccagcctgctgcacagcggggctgacatccagcaggtgggctatggaggcctgacagccctgcacatcgccaccatcgccggccacctggaggccgcagatgtgctgctgcagcacggggccaacgtgaacatccaggatgctgtgttcttcacccccctgcacatcgccgcctactacggccacgagcaggtgacccggctgctgctgaagtttggagcagatgtgaatgtgtctggagaggtgggggaccggcccctgcacctggccagcgccaagggcttcctgaacatcgccaagctgctgatggaggagggcagcaaggcagatgtgaatgcccaggacaatgaagatcatgtgcccctgcacttctgcagccgcttcggccaccacgacatcgtgaagtacctgctgcagagcgacctggaggtgcagccccacgtggtgaacatctacggggacacccccctgcacctggcctgctacaacgggaagtttgaggtggccaaggagatcatccagatcagcggcacagagagcctgaccaaggagaacatcttcagcgagacagccttccacagcgcctgcacctacggcaagagcattgacctggtgaagttcctgctggaccagaatgtcatcaacatcaaccaccagggcagagatggccacacaggcctgcacagcgcctgctaccacggccacatccggctggtgcagttcctgctggacaatggagctgacatgaacctggtggcctgtgaccccagccgcagcagcggggagaaggatgagcagacctgcctgatgtgggcctatgaaaaaggacatgatgccatcgtgaccctgctgaagcactacaagaggccccaggatgagctgccctgcaatgagtacagccagcctggaggagatggcagctatgtgtctgtgcccagccccctgggcaagatcaagtccatgaccaaggagaaggctgacatcctgctgctgcgggccggcctgcccagccacttccacctgcagctgtctgaaattgagttccacgagatcatcggcagcggcagctttgggaaggtgtacaagggccgctgcaggaacaagatcgtggccatcaagcgctaccgggccaacacctactgcagcaagagtgatgtggacatgttctgccgggaggtgtccatcctgtgccagctgaaccacccctgtgtgatccagtttgtgggcgcctgcctgaatgaccccagccagtttgccatcgtgacccagtacatcagcggcggcagcctcttcagcctgctgcacgagcagaagaggatcctggacctgcagagcaagctgatcatcgctgtggatgtggccaagggcatggagtacctgcacaacctgacccagcccatcatccaccgggacctgaacagccacaacatcctgctgtatgaagatggccatgctgtggtggccgactttggagagagccgcttcctgcagagcctggatgaggacaacatgaccaagcagcccggcaacctgcgctggatggcccctgaggtgttcacccagtgcacccgctacaccatcaaggcagatgtgttctcctatgccctgtgcctgtgggagatcctgactggagagatcccctttgcccacctgaagccagctgctgctgctgctgacatggcctaccaccacatccggccccccatcggctacagcatccccaagcccatcagcagcctgctgatccggggctggaatgcctgcccagagggccggcctgagttcagcgaggtggtgatgaagctggaggagtgcctgtgcaacatcgagctgatgagccctgccagcagcaacagcagcggcagcctgagccccagcagcagcagtgactgcctggtgaacagaggaggccctggccgcagccacgtggccgccctgcggagcagatttgagctggagtatgccctgaatgcccggagctatgctgccctgagccagagcgctggccagtacagcagccagggcctgagcctggaggagatgaagaggagcctgcagtacacccccatcgacaagtatggctacgtgtctgaccccatgagctccatgcacttccacagctgcaggaacagcagcagctttgaggacagcagctag

SEQ ID NO: 38960 - DNA, 2532 bp, Artificial Sequence
  Description of Artificial Sequence: Synthetic coding sequence
atggctgctgcccgggaccccccagaggtgtccctgcgggaggccacccagaggaagctgcggcgcttcagcgagctgcggggcaagctggtggcccggggggagttctgggacatcgtggccatcacagctgctgatgagaagcaggagctggcctacaaccagcagctgtctgagaagctgaagaggaaggagctgcccctgggcgtgcagtaccacgtgtttgtggaccctgctggggccaagattggaaatggaggcagcaccctgtgtgccctgcagtgcctggagaagctgtatggagacaagtggaacagcttcaccatcctgctgatccacagtgatgagtggaagaagaaggtgtctgagagctatgtgatcaccatcgagcggctggaggatgacctgcagatcaaggagaaggagctgacagagctgaggaacatcttcggcagtgatgaggccttcagcaaggtgaacctgaactacagaacagaaaatggcctgagcctgctgcacctgtgctgcatctgtggcggcaagaagagccacatccgcaccctgatgctgaagggcctgcggcccagccggctgaccagaaatggcttcaccgccctgcacctggccgtgtacaaggacaatgctgagctgatcaccagcctgctgcacagcggggctgacatccagcaggtgggctatggaggcctgacagccctgcacatcgccaccatcgccggccacctggaggccgcagatgtgctgctgcagcacggggccaacgtgaacatccaggatgctgtgttcttcacccccctgcacatcgccgcctactacggccacgagcaggtgacccggctgctgctgaagtttggagcagatgtgaatgtgtctggagaggtgggggaccggcccctgcacctggccagcgccaagggcttcctgaacatcgccaagctgctgatggaggagggcagcaaggcagatgtgaatgcccaggacaatgaagatcatgtgcccctgcacttctgcagccgcttcggccaccacgacatcgtgaagtacctgctgcagagcgacctggaggtgcagccccacgtggtgaacatctacggggacacccccctgcacctggcctgctacaacgggaagtttgaggtggccaaggagatcatccagatcagcggcacagagagcctgaccaaggagaacatcttcagcgagacagccttccacagcgcctgcacctacggcaagagcattgacctggtgaagttcctgctggaccagaatgtcatcaacatcaaccaccagggcagagatggccacacaggcctgcacagcgcctgctaccacggccacatccggctggtgcagttcctgctggacaatggagctgacatgaacctggtggcctgtgaccccagccgcagcagcggggagaaggatgagcagacctgcctgatgtgggcctatgaaaaaggacatgatgccatcgtgaccctgctgaagcactacaagaggccccaggatgagctgccctgcaatgagtacagccagcctggaggagatggcagctatgtgtctgtgcccagccccctgggcaagatcaagtccatgaccaaggagaaggctgacatcctgctgctgcgggccggcctgcccagccacttccacctgcagctgtctgaaattgagttccacgagatcatcggcagcggcagctttgggaaggtgtacaagggccgctgcaggaacaagatcgtggccatcaagcgctaccgggccaacacctactgcagcaagagtgatgtggacatgttctgccgggaggtgtccatcctgtgccagctgaaccacccctgtgtgatccagtttgtgggcgcctgcctgaatgaccccagccagtttgccatcgtgacccagtacatcagcggcggcagcctcttcagcctgctgcacgagcagaagaggatcctggacctgcagagcaagctgatcatcgctgtggatgtggccaagggcatggagtacctgcacaacctgacccagcccatcatccaccgggacctgaacagccacaacatcctgctgtatgaagatggccatgctgtggtggccgactttggagagagccgcttcctgcagagcctggatgaggacaacatgaccaagcagcccggcaacctgcgctggatggcccctgaggtgttcacccagtgcacccgctacaccatcaaggcagatgtgttctcctatgccctgtgcctgtgggagatcctgactggagagatcccctttgcccacctgaagccagctgctgctgctgctgacatggcctaccaccacatccggccccccatcggctacagcatccccaagcccatcagcagcctgctgatccggggctggaatgcctgcccagaggccaagagccggcccagccactaccctgtgtcctctgtgtacacagagaccctgaagaagaagaatgaagatcgcttcggcatgtggattgagtacctgcggaggtag

SEQ ID NO: 38961 - DNA, 444 bp, Artificial Sequence
  Description of Artificial Sequence: Synthetic coding sequence
atgtccttccgcttcggccagcacctgatcaagcccagcgtggtgttcctgaagacagagctgagctttgccctggtgaacaggaagcctgtggtgcccggccacgtgctggtgtgccccctgcggcctgtggagcgcttccatgacctgcggccagatgaggtggccgacctcttccagaccacccagagggtgggcaccgtggtggagaagcacttccacggcaccagcctgaccttctccatgcaggacggccctgaggccggccagacagtgaagcacgtgcacgtgcacgtgctgcccaggaaggccggggacttccacagaaatgacagcatctatgaggagctgcagaagcatgacaaggaggacttccctgcctcctggaggtctgaggaggagatggctgctgaggccgccgccctgcgggtgtacttccagtag

SEQ ID NO: 38962 - DNA, 930 bp, Artificial Sequence
  Description of Artificial Sequence: Synthetic coding sequence
atggagcagctgctgcgggcagagctgaggacagccaccctgcgggcctttggaggccctggggccggctgcatcagcgagggccgggcctatgacacagatgctggccctgtgtttgtgaaggtgaacagaaggacccaggcccggcagatgtttgaaggagaggtggccagcctggaggccctgcggagcacaggcctggtgcgggtgccccggcccatgaaggtgattgacctgcccggcggcggggccgcctttgtgatggagcacctgaagatgaagagcctgagcagccaggccagcaagctgggggagcagatggctgacctgcacctgtacaaccagaagctgcgggagaagctgaaggaggaggagaacacagtgggccggcggggggagggcgctgagccccagtatgtggacaagtttggcttccacacagtgacctgctgcggcttcatcccccaggtgaatgagtggcaggatgactggcccaccttctttgcccggcaccggctgcaggcccagctggacctgattgagaaggactatgctgaccgggaggcccgggagctgtggagccggctgcaggtgaagatcccagacctcttctgtggcctggagatcgtgcctgccctgctgcatggagacctgtggagcggaaatgtggctgaagatgatgtgggccccatcatctatgaccctgccagcttctacggccacagcgagtttgagctggccatcgccctgatgtttggaggcttccccaggagcttcttcaccgcctaccacaggaagatccccaaggcccctggctttgaccagaggctgctgctgtaccagctgttcaactacctgaaccactggaaccacttcggccgggagtaccgcagccccagcctgggcaccatgaggcggctgctgaagtag

SEQ ID NO: 38963 - DNA, 609 bp, Artificial Sequence
  Description of Artificial Sequence: Synthetic coding sequence
atggagcagctgctgcgggcagagctgaggacagccaccctgcgggcctttggaggccctggggccggctgcatcagcgagggccgggcctatgacacagatgctggccctgtgtttgtgaaggtgaacagaaggacccaggcccggcagatgtttgaaggagaggtggccagcctggaggccctgcggagcacaggcctggtgcgggtgccccggcccatgaaggtgattgacctgcccggcggcggggccgcctttgtgatggagcacctgaagatgaagagcctgagcagccaggccagcaagctgggggagcagatggctgacctgcacctgtacaaccagaagctgcgggagaagctgaaggaggaggagaacacagtgggccggcggggggagggcgctgagccccagtatgtggacaagtttggcttccacacagtgacctgctgcggcttcatcccccaggagcccctggagcccagcagcctgaagtctgtgaagttccagaggcggctgtggacagcccagctgccctgtgccagcctggaggaggccaacatcggcccctacttcggctttgtgaggaacacagcccccatcatctag

SEQ ID NO: 38964 - DNA, 534 bp, Artificial Sequence
  Description of Artificial Sequence: Synthetic coding sequence
atgcaggcccggcagatgtttgaaggagaggtggccagcctggaggccctgcggagcacaggcctggtgcgggtgccccggcccatgaaggtgattgacctgcccggcggcggggccgcctttgtgatggagcacctgaagatgaagagcctgagcagccaggccagcaagctgggggagcagatggctgacctgcacctgtacaaccagaagctgcgggagaagctgaaggaggaggagaacacagtgggcagaagaggagagggcgctgagccccagtatgtggacaagtttggcttccacacagtgacctgctgcggcttcatcccccaggtgaatgagtggcaggatgactggcccaccttctttgcccggcaccggctgcaggcccagctggacctgattgagaaggactatgctgaccgggaggcccgggagctgtggagccggctgcaggtgggcacagctgtgaccagcctgggcaagtcctggagcagccatgaccctgctgcctttgtgcgggtgcacctgtag

SEQ ID NO: 38965 - DNA, 1212 bp, Artificial Sequence
  Description of Artificial Sequence: Synthetic coding sequence
atgcctgagcccctggcccctgagagctacccagagagcgtgtgtgaagaagatgtgaccctggccctgaaggagctggatgagcgctgtgaggaggaggaggccgacttcagcggcctgagcagccaggatgaggaggagcaggacggcttccctgaggtgcagaccagccccctgcccagccccttcctgagcgccatcatcgccgccttccagcctgtggcctatgatgatgaggaggaggcctggcgctgccacgtgaaccagatgctgagtgacacagatggcagcagcgctgtgttcaccttccacgtgttcagccgcctcttccagaccatccagaggaagtttggagagatcaccaatgaggccgtgtccttcctgggggacagcctgcagagaattggcaccaagttcaagagcagcctggaggtgatgatgctgtgcagtgaatgtcccaccgtgtttgtggatgctgagaccctgatgagctgtggcctgctggagaccctgaagtttggagtgctggagctgcaggagcacctggacacctacaacgtgaagcgggaggccgctgagcagtggctggatgactgcaagaggacctttggagccaaggaggacatgtaccgcatcaacacagatgcccaggagctggagctgtgcagaagactctacaagctgcacttccagctgctgctgctcttccaggcctactgcaagctgatcaaccaggtgaacaccatcaagaatgaagctgaggtgatcaacatgtctgaggagctggcccagctggagagcatcctgaaggaggccgagagcgcctctgaaaatgaggagattgacatcagcaaggccgcccagaccaccattgaaacagccatccacagcctgattgagaccctgaagaacaaggagttcatctctgctgtggcccaggtgaaggccttccgcagcctgtggcccagcgacatcttcggcagctgtgaagatgatcctgtgcagaccctgctgcacatctacttccaccaccagaccctgggccagacaggcagctttgctgtgattggcagcaacctggacatgtctgaggccaactacaagctgatggagctgaacctggagatccgggagagcctgaggatggtgcagagctaccagctgctggcccaggccaagcccatgggcaacatggtgtccacaggcttctag

SEQ ID NO: 38966 - DNA, 9042 bp, Artificial Sequence
  Description of Artificial Sequence: Synthetic coding sequence
atgagcaacatcaccatcgaccctgatgtgaagccaggagaatatgtgatcaagagcctgtttgctgagtttgctgtgcaggccgagaagaagattgaggtggtgatggccgagcccctggagaagctgctgagccgcagcctgcagagaggagaggacctgcagtttgaccagctgatcagctccatgagctctgtggccgagcactgcctgcccagcctgctgcggaccctgtttgactggtaccgccggcagaatggaacagaagatgagagctatgagtaccggcccaggagcagcaccaagagcaaaggagatgagcagcagcgggagcgggactacctgctggagcggcgggacctggccgtggacttcatcttctgcctggtgctggtggaggtgctgaagcagatccctgtgcaccctgtgcctgaccccctggtgcatgaggtgctgaacctggccttcaagcacttcaagcacaaggagggctacagcggcaccaacacaggaaatgtgcacatcatcgctgacctgtatgcagaggtgattggagtgctggcccagagcaagttccaggccgtgaggaagaagtttgtgacagagctgaaggagctgcggcagaaggagcagagcccccacgtggtgcagagcgtcatcagcctcatcatgggcatgaagttcttccgggtgaagatgtaccctgtggaggactttgaggccagcttccagttcatgcaggagtgtgcccagtacttcctggaggtgaaggacaaggacatcaagcacgccctggccggcctgtttgtggagatcctgatccctgtggccgctgctgtgaagaatgaggtgaatgtgccctgcctgaagaactttgtggagatgctgtaccagaccacctttgagctgagcagcaggaagaagcacagcctggccctgtaccccctcatcacctgcctgctgtgtgtgtcccagaagcagttcttcctgaacaactggcacatcttcctgcagaactgcctgagccacctgaagaacaaggaccccaagatgagccgggtggccctggagagcctgtaccgcctgctgtgggtgtatgtgatccgcatcaagtgtgagagcaacacagtgacccagagccggctgatgagcatcgtgtctgccctcttccccaagggcagccgctctgtggtgccccgggacacccccctgaacatctttgtgaagatcatccagttcatcgcccaggagcggctggactttgccatgaaggagatcatctttgacctgctgtctgtgggcaagagcaccaagaccttcaccatcaaccctgagaggatgaacatcggcctgcgggtcttcctggtgattgctgacagcctgcagcagaaggatggagagccccccatgcccaccactggagtcatcctgcccagcggcaacaccctgcgggtgaagaagatcttcctgaacaagaccctgacagatgaggaggccaaggtgattggcatgtctgtgtactacccccaggtgaggaaggccctggacagcatcctgcggcacctggacaaggaggtgggccggcccatgtgcatgacctctgtgcagatgagcaacaaggagcctgaggacatgatcactggagagaggaagcccaagattgacctcttccgcacctgcatcgccgccatccccaggctcatcccagatggcatgagcaggacagacctgattgagctgctggcccggctgaccatccacatggatgaggagctgcgggccctggccttcaacaccctgcaggccctgatgctggacttcccagactggagagaagatgtgctgagcggctttgtgtacttcatcgtgcgggaggtgacagatgtgcaccccaccctgctggacaatgctgtgaagatgctggtgcagctgatcaaccagtggaagcaggccgcccagatgcacaacaagaaccaggacacccagcacggcgtggccaatggagccagccaccccccacccctggagaggagcccctacagcaatgtgttccacgtggtggagggctttgccctggtgatcctgtgcagcagcaggcctgccacccggcggctggccgtgtctgtgctgcgggagatccgggccctgtttgccctgctggagatccccaagggagatgatgagctggccattgatgtgatggaccggctgagccccagcatcctggagagcttcatccacctgactggagctgaccagaccaccctgctgtactgccccagcagcattgacctgcagaccctggccgagtggaacagcagccccatcagccaccagtttgatgtgatcagccccagccacatctggatctttgcccacgtgacccagggccaggacccctggatcatcagcctgagcagcttcctgaagcaggagaacctgcccaagcactgcagcacagctgtgtcctatgcctggatgtttgcctacacccggctgcagctgctgagcccccaggtggacatcaacagccccatcaatgccaagaaggtgaacaccaccaccagcagtgacagctacatcggcctgtggaggaactacctgatcctgtgctgcagcgctgccaccagcagcagcagcaccagcgctggctctgtgcgctgcagccccccagagaccctggccagcaccccagacagcggctacagcattgacagcaagatcatcggcatccccagccccagcagcctcttcaagcacatcgtgcccatgatgaggtctgagagcatggagatcacagagagcctggtgctgggcctgggccgcaccaaccctggggccttccgggagctgattgaggagctgcaccccatcatcaaggaggccctggagaggaggcctgagaacatgaagagaagaagaagaagagacatcctgcgggtgcagctggtgcgcatctttgagctgctggctgatgctggggtcatcagccacagcgccagcggcggcctggacaatgagacccacttcctgaacaacaccctgctggagtatgtggacctgacccggcagctgctggaggctgaaaatgagaaggacagcgacaccctgaaggacatccgctgccacttcagcgccctggtggccaacatcatccagaatgtgcctgtgcaccagaggaggagcatcttcccccagcagagcctgcggcacagcctcttcatgctgttcagccactgggccggccccttcagcatcatgttcacccccctggaccgctacagcgacaggaacatgcagatcaacagacaccagtactgtgccctgaaggccatgtctgctgtgctgtgctgcggccctgtggccgacaacgtgggcctgagcagtgatggctacctgtacaagtggctggacaacatcctggacagcctggacaagaaggtgcaccagctgggctgtgaggccgtgaccctgctgctggagctgaacccagaccagagcaacctgatgtactgggccgtggaccgctgctacacaggcagcggccgggtggccgccggctgcttcaaggccatcgccaacgtgttccagaacagagactaccagtgtgacacagtgatgctgctgaacctgatcctcttcaaggctgctgacagcagccgcagcatctatgaggtggccatgcagctgctgcagatcctggagcccaagatgttccgctatgcccacaagctggaggtgcagaggacagatggagtgctgagccagctgagccccctgccccacctgtacagcgtgtcctactaccagctgtctgaggagctggcccgggcctacccagagctgaccctggccatcttcagcgagatcagccagaggatccagacagcccaccctgctggccggcaggtgatgctgcactacctgctgccctggatgaacaacatcgagctggtggacctgaagcccctgcccacagccaggagacatgatgaagatgaagatgacagcctgaaggaccgggagctgatggtgaccagccgccgctggctgcggggggagggctggggcagcccccaggccacagccatggtgctgaacaacctgatgtacatgacagccaagtatggagatgagctggcctggagcgaggtggagaatgtgtggaccaccctggctgatggctggcccaagaacctgaagatcatcctgcacttcctgatcagcatctgtggggtgaacagcgagcccagcctgctgccctacgtgaagaaggtgattgtgtacctgggccgggacaagaccatgcagctgctggaggagctggtgtctgagctgcagctgacagatcctgtgagcagcggcgtgacccacatggacaaccccccctactaccgcatcaccagcagctacaagatccccagcgtgaccagcggcaccaccagcagcagcaacaccatggtggcccccacagatggcaacccagacaacaagcccatcaaggagaacatcgaggagagctatgtgcacctggacatctacagcggcctgaacagccacctgaaccggcagcaccaccggctggagagccgctacagcagcagcagcggcggcagctatgaggaggagaagagtgacagcatgcccctgtacagcaactggaggctgaaggtgatggagcacaaccagggcgagcccctgcccttccccccagctgggggctgctggagccccctggtggactatgtgcctgagaccagcagccctggcctgcccctgcaccgctgcaacattgctgtgatcctgctgacagacctgatcatcgaccacagcgtgaaggtggagtggggcagctacctgcacctgctgctgcacgccatcttcatcggctttgaccactgccaccctgaggtgtatgagcactgcaagaggctgctgctgcacctgctgattgtgatgggccccaacagcaacatcagaacagtggcctctgtgctgctgaggaacaaggagttcaatgagccccgggtgctgactgtgaagcaggtggcccacctggactacaacttcaccgctggcatcaatgacttcatcccagactaccagcccagccccatgacagattctggcctgagcagcagcagcaccagcagcagcatcagcctgggcaacaacagcgctgccatcagccacctgcacaccaccatcctgaatgaggtggacatctctgtggagcaggacggcaaggtgaagaccctgatggagttcatcaccagcaggaagaggggccccctgtggaaccatgaagatgtgtctgccaagaaccccagcatcaagtctgctgagcagctgaccaccttcctgaagcacgtggtgtctgtgttcaagcagagcagcagcgagggcatccacctggagcaccacctgtctgaggtggccctgcagacagccctgagctgcagcagccgccactacgccggccgctccttccagatcttccgggccctgaagcagcccctgacagccaccaccctgagtgatgtgctgagccggctggtggagaccgtgggggaccctggagaagatgcccagggcttcgtcatcgagctgctgctgaccctggagagcgccatcgacaccctggccgagaccatgaagcactatgacctgctgagcgccctgagccagaccagctaccatgaccccatcatgggcaacaagtatgctgccaacaggaagagcacaggccagctgaacctgagcaccagccccatcaacagcagcagctacctgggctacaacagcaatgcccggagcaacagcctgcggctgagcctgattggagaccggcggggggacagaagaagaagcaacaccctggacatcatggatggccgcatcaaccacagcagcagcctggcccggaccaggagcctgagcagcctgcgggagaagggcatgtatgatgtgcagagcaccacagagcccaccaacctgatggccaccatcttctggattgctgccagcctgctggagagtgactatgaatatgagtacctgctggccctgcggctgctgaacaagctgctgatccacctgcccctggacaagtctgagagccgggagaagattgaaaatgtgcagagcaagctgaagtggaccaacttccctggcctgcagcagctgttcctgaagggcttcaccagcgccagcacccaggagatgacagtgcacctgctgagcaagctgatctctgtgtccaagcacaccctggtggaccccagccagctgagcggcttccccctgaacatcctgtgcctgctgccccacctgatccagcactttgacagccccacccagttctgcaaggagacagccagcagaattgccaaggtgtgtgccgaggagaagtgccccaccctggtgaacctggcccacatgatgagcctgtacagcacccacacctacagccgggactgcagcaactggatcaacgtggtgtgccgctacctgcatgacagcttcagtgacaccaccttcaacctggtgacctacctggccgagctgctggagaagggcctgagctccatgcagcagagcctgctgcagatcatctacagcctgctgagccacatcgacctgtctgctgccccagccaagcagttcaacctggagatcatcaagatcatcggcaagtatgtgcagagcccctactggaaggaggccctgaacatcctgaagctggtggtgagccgcagcgccagcctggtggtgcccagcgacatccccaagacctacggcggggacaccggcagccctgagatctccttcaccaagatcttcaacaacgtgtccaaggagctgcccgggaagaccctggacttccactttgacatcagcgagacccccatcatcggcaacaagtatggagaccagcacagcgctgctggaagaaatggcaagcccaaggtgattgctgtgaccaggagcaccagcagcaccagcagcggcagcaacagcaatgccctggtgcctgtgtcctggaagaggccccagctgagccagaggaggacccgggagaagctgatgaatgtgctgagcctgtgtggccctgagagcggcctgcccaagaaccccagcgtggtgttcagcagcaatgaagacctggaggtgggggaccagcagaccagcctcatcagcaccacagaggacatcaaccaggaggaggaggtggccgtggaggacaacagcagcgagcagcagtttggagtcttcaaggactttgacttcctggatgtggagctggaggatgctgagggggagagcatggacaacttcaactggggcgtgagaagaagaagcctggacagcattgacaagggggacacccccagcctgcaggagtaccagtgcagcagcagcacccccagcctgaacctgaccaaccaggaggacacagatgagagcagcgaggaggaggccgccctgacagccagccagatcctgagcaggacccagatgctgaacagcgacagcgccacagatgagaccatcccagaccacccagacctgctgctgcagagcgaggacagcacaggcagcatcaccacagaggaggtgctgcagatcagagatgagacccccaccctggaggccagcctggacaatgccaacagccggctgcctgaggacaccacctctgtgctgaaggaggagcacgtgaccacctttgaagatgagggcagctacatcatccaggagcagcaggagagcctggtgtgccagggcatcctggacctggaggagacagagatgcctgagcccctggcccctgagagctacccagagagcgtgtgtgaagaagatgtgaccctggccctgaaggagctggatgagcgctgtgaggaggaggaggccgacttcagcggcctgagcagccaggatgaggaggagcaggacggcttccctgaggtgcagaccagccccctgcccagccccttcctgagcgccatcatcgccgccttccagcctgtggcctatgatgatgaggaggaggcctggcgctgccacgtgaaccagatgctgagtgacacagatggcagcagcgctgtgttcaccttccacgtgttcagccgcctcttccagaccatccagaggaagtttggagagatcaccaatgaggccgtgtccttcctgggggacagcctgcagagaattggcaccaagttcaagagcagcctggaggtgatgatgctgtgcagtgaatgtcccaccgtgtttgtggatgctgagaccctgatgagctgtggcctgctggagaccctgaagtttggagtgctggagctgcaggagcacctggacacctacaacgtgaagcgggaggccgctgagcagtggctggatgactgcaagaggacctttggagccaaggaggacatgtaccgcatcaacacagatgcccagcagatggagatcctggccgagctggagctgtgcagaagactctacaagctgcacttccagctgctgctgctcttccaggcctactgcaagctgatcaaccaggtgaacaccatcaagaatgaagctgaggtgatcaacatgtctgaggagctggcccagctggagagcatcctgaaggaggccgagagcgcctctgaaaatgaggagattgacatcagcaaggccgcccagaccaccattgaaacagccatccacagcctgattgagaccctgaagaacaaggagttcatctctgctgtggcccaggtgaaggccttccgcagcctgtggcccagcgacatcttcggcagctgtgaagatgatcctgtgcagaccctgctgcacatctacttccaccaccagaccctgggccagacaggcagctttgctgtgattggcagcaacctggacatgtctgaggccaactacaagctgatggagctgaacctggagatccgggagagcctgaggatggtgcagagctaccagctgctggcccaggccaagcccatgggcaacatggtgtccacaggcttctag

SEQ ID NO: 38967 - DNA, 9042 bp, Artificial Sequence; identical to SEQ ID NO: 38966
  Description of Artificial Sequence: Synthetic coding sequence

SEQ ID NO: 38968 - DNA, 1212 bp, Artificial Sequence; identical to SEQ ID NO: 38965
  Description of Artificial Sequence: Synthetic coding sequence

SEQ ID NO: 38969 - DNA, 9042 bp, Artificial Sequence
  Description of Artificial Sequence: Synthetic coding sequence
atgagcaacatcaccatcgaccctgatgtgaagccaggagaatatgtgatcaagagcctgtttgctgagtttgctgtgcaggccgagaagaagattgaggtggtgatggccgagcccctggagaagctgctgagccgcagcctgcagagaggagaggacctgcagtttgaccagctgatcagctccatgagctctgtggccgagcactgcctgcccagcctgctgcggaccctgtttgactggtaccgccggcagaatggaacagaagatgagagctatgagtaccggcccaggagcagcaccaagagcaaaggagatgagcagcagcgggagcgggactacctgctggagcggcgggacctggccgtggacttcatcttctgcctggtgctggtggaggtgctgaagcagatccctgtgcaccctgtgcctgaccccctggtgcatgaggtgctgaacctggccttcaagcacttcaagcacaaggagggctacagcggcaccaacacaggaaatgtgcacatcatcgctgacctgtatgcagaggtgattggagtgctggcccagagcaagttccaggccgtgaggaagaagtttgtgacagagctgaaggagctgcggcagaaggagcagagcccccacgtggtgcagagcgtcatcagcctcatcatgggcatgaagttcttccgggtgaagatgtaccctgtggaggactttgaggccagcttccagttcatgcaggagtgtgcccagtacttcctggaggtgaaggacaaggacatcaagcacgccctggccggcctgtttgtggagatcctgatccctgtggccgctgctgtgaagaatgaggtgaatgtgccctgcctgaagaactttgtggagatgctgtaccagaccacctttgagctgagcagcaggaagaagcacagcctggccctgtaccccctcatcacctgcctgctgtgtgtgtcccagaagcagttcttcctgaacaactggcacatcttcctgcagaactgcctgagccacctgaagaacaaggaccccaagatgagccgggtggccctggagagcctgtaccgcctgctgtgggtgtatgtgatccgcatcaagtgtgagagcaacacagtgacccagagccggctgatgagcatcgtgtctgccctcttccccaagggcagccgctctgtggtgccccgggacacccccctgaacatctttgtgaagatcatccagttcatcgcccaggagcggctggactttgccatgaaggagatcatctttgacctgctgtctgtgggcaagagcaccaagaccttcaccatcaaccctgagaggatgaacatcggcctgcgggtcttcctggtgattgctgacagcctgcagcagaaggatggagagccccccatgcccaccactggagtcatcctgcccagcggcaacaccctgcgggtgaagaagatcttcctgaacaagaccctgacagatgaggaggccaaggtgattggcatgtctgtgtactacccccaggtgaggaaggccctggacagcatcctgcggcacctggacaaggaggtgggccggcccatgtgcatgacctctgtgcagatgagcaacaaggagcctgaggacatgatcactggagagaggaagcccaagattgacctcttccgcacctgcatcgccgccatccccaggctcatcccagatggcatgagcaggacagacctgattgagctgctggcccggctgaccatccacatggatgaggagctgcgggccctggccttcaacaccctgcaggccctgatgctggacttcccagactggagagaagatgtgctgagcggctttgtgtacttcatcgtgcgggaggtgacagatgtgcaccccaccctgctggacaatgctgtgaagatgctggtgcagctgatcaaccagtggaagcaggccgcccagatgcacaacaagaaccaggacacccagcacggcgtggccaatggagccagccaccccccacccctggagaggagcccctacagcaatgtgttccacgtggtggagggctttgccctggtgatcctgtgcagcagcaggcctgccacccggcggctggccgtgtctgtgctgcgggagatccgggccctgtttgccctgctggagatccccaagggagatgatgagctggccattgatgtgatggaccggctgagccccagcatcctggagagcttcatccacctgactggagctgaccagaccaccctgctgtactgccccagcagcattgacctgcagaccctggccgagtggaacagcagccccatcagccaccagtttgatgtgatcagccccagccacatctggatctttgcccacgtgacccagggccaggacccctggatcatcagcctgagcagcttcctgaagcaggagaacctgcccaagcactgcagcacagctgtgtcctatgcctggatgtttgcctacacccggctgcagctgctgagcccccaggtggacatcaacagccccatcaatgccaagaaggtgaacaccaccaccagcagtgacagctacatcggcctgtggaggaactacctgatcctgtgctgcagcgctgccaccagcagcagcagcaccagcgctggctctgtgcgctgcagccccccagagaccctggccagcaccccagacagcggctacagcattgacagcaagatcatcggcatccccagccccagcagcctcttcaagcacatcgtgcccatgatgaggtctgagagcatggagatcacagagagcctggtgctgggcctgggccgcaccaaccctggggccttccgggagctgattgaggagctgcaccccatcatcaaggaggccctggagaggaggcctgagaacatgaagagaagaagaagaagagacatcctgcgggtgcagctggtgcgcatctttgagctgctggctgatgctggggtcatcagccacagcgccagcggcggcctggacaatgagacccacttcctgaacaacaccctgctggagtatgtggacctgacccggcagctgctggaggctgaaaatgagaaggacagcgacaccctgaaggacatccgctgccacttcagcgccctggtggccaacatcatccagaatgtgcctgtgcaccagaggaggagcatcttcccccagcagagcctgcggcacagcctcttcatgctgttcagccactgggccggccccttcagcatcatgttcacccccctggaccgctacagcgacaggaacatgcagatcaacagacaccagtactgtgccctgaaggccatgtctgctgtgctgtgctgcggccctgtggccgacaacgtgggcctgagcagtgatggctacctgtacaagtggctggacaacatcctggacagcctggacaagaaggtgcaccagctgggctgtgaggccgtgaccctgctgctggagctgaacccagaccagagcaacctgatgtactgggccgtggaccgctgctacacaggcagcggccgggtggccgccggctgcttcaaggccatcgccaacgtgttccagaacagagactaccagtgtgacacagtgatgctgctgaacctgatcctcttcaaggctgctgacagcagccgcagcatctatgaggtggccatgcagctgctgcagatcctggagcccaagatgttccgctatgcccacaagctggaggtgcagaggacagatggagtgctgagccagctgagccccctgccccacctgtacagcgtgtcctactaccagctgtctgaggagctggcccgggcctacccagagctgaccctggccatcttcagcgagatcagccagaggatccagacagcccaccctgctggccggcaggtgatgctgcactacctgctgccctggatgaacaacatcgagctggtggacctgaagcccctgcccacagccaggagacatgatgaagatgaagatgacagcctgaaggaccgggagctgatggtgaccagccgccgctggctgcggggggagggctggggcagcccccaggccacagccatggtgctgaacaacctgatgtacatgacagccaagtatggagatgagctggcctggagcgaggtggagaatgtgtggaccaccctggctgatggctggcccaagaacctgaagatcatcctgcacttcctgatcagcatctgtggggtgaacagcgagcccagcctgctgccctacgtgaagaaggtgattgtgtacctgggccgggacaagaccatgcagctgctggaggagctggtgtctgagctgcagctgacagatcctgtgagcagcggcgtgacccacatggacaaccccccctactaccgcatcaccagcagctacaagatccccagcgtgaccagcggcaccaccagcagcagcaacaccatggtggcccccacagatggcaacccagacaacaagcccatcaaggagaacatcgaggagagctatgtgcacctggacatctacagcggcctgaacagccacctgaaccggcagcaccaccggctggagagccgctacagcagcagcagcggcggcagctatgaggaggagaagagtgacagcatgcccctgtacagcaactggaggctgaaggtgatggagcacaaccagggcgagcccctgcccttccccccagctgggggctgctggagccccctggtggactatgtgcctgagaccagcagccctggcctgcccctgcaccgctgcaacattgctgtgatcctgctgacagacctgatcatcgaccacagcgtgaaggtggagtggggcagctacctgcacctgctgctgcacgccatcttcatcggctttgaccactgccaccctgaggtgtatgagcactgcaagaggctgctgctgcacctgctgattgtgatgggccccaacagcaacatcagaacagtggcctctgtgctgctgaggaacaaggagttcaatgagccccgggtgctgactgtgaagcaggtggcccacctggactacaacttcaccgctggcatcaatgacttcatcccagactaccagcccagccccatgacagattctggcctgagcagcagcagcaccagcagcagcatcagcctgggcaacaacagcgctgccatcagccacctgcacaccaccatcctgaatgaggtggacatctctgtggagcaggacggcaaggtgaagaccctgatggagttcatcaccagcaggaagaggggccccctgtggaaccatgaagatgtgtctgccaagaaccccagcatcaagtctgctgagcagctgaccaccttcctgaagcacgtggtgtctgtgttcaagcagagcagcagcgagggcatccacctggagcaccacctgtctgaggtggccctgcagacagccctgagctgcagcagccgccactacgccggccgctccttccagatcttccgggccctgaagcagcccctgacagccaccaccctgagtgatgtgctgagccggctggtggagaccgtgggggaccctggagaagatgcccagggcttcgtcatcgagctgctgctgaccctggagagcgccatcgacaccctggccgagaccatgaagcactatgacctgctgagcgccctgagccagaccagctaccatgaccccatcatgggcaacaagtatgctgccaacaggaagagcacaggccagctgaacctgagcaccagccccatcaacagcagcagctacctgggctacaacagcaatgcccggagcaacagcctgcggctgagcctgattggagaccggcggggggacagaagaagaagcaacaccctggacatcatggatggccgcatcaaccacagcagcagcctggcccggaccaggagcctgagcagcctgcgggagaagggcatgtatgatgtgcagagcaccacagagcccaccaacctgatggccaccatcttctggattgctgccagcctgctggagagtgactatgaatatgagtacctgctggccctgcggctgctgaacaagctgctgatccacctgcccctggacaagtctgagagccgggagaagattgaaaatgtgcagagcaagctgaagtggaccaacttccctggcctgcagcagctgttcctgaagggcttcaccagcgccagcacccaggagatgacagtgcacctgctgagcaagctgatctctgtgtccaagcacaccctggtggaccccagccagctgagcggcttccccctgaacatcctgtgcctgctgccccacctgatccagcactttgacagccccacccagttctgcaaggagacagccagcagaattgccaaggtgtgtgccgaggagaagtgccccaccctggtgaacctggcccacatgatgagcctgtacagcacccacacctacagccgggactgcagcaactggatcaacgtggtgtgccgctacctgcatgacagcttcagtgacaccaccttcaacctggtgacctacctggccgagctgctggagaagggcctgagctccatgcagcagagcctgctgcagatcatctacagcctgctgagccacatcgacctgtctgctgccccagccaagcagttcaacctggagatcatcaagatcatcggcaagtatgtgcagagcccctactggaaggaggccctgaacatcctgaagctggtggtgagccgcagcgccagcctggtggtgcccagcgacatccccaagacctacggcggggacaccggcagccctgagatctccttcaccaagatcttcaacaacgtgtccaaggagctgcccgggaagaccctggacttccactttgacatcagcgagacccccatcatcggcaacaagtatggagaccagcacagcgctgctggaagaaatggcaagcccaaggtgattgctgtgaccaggagcaccagcagcaccagcagcggcagcaacagcaatgccctggtgcctgtgtcctggaagaggccccagctgagccagaggaggacccgggagaagctgatgaatgtgctgagcctgtgtggccctgagagcggcctgcccaagaaccccagcgtggtgttcagcagcaatgaagacctggaggtgggggaccagcagaccagcctcatcagcaccacagaggacatcaaccaggaggaggaggtggccgtggaggacaacagcagcgagcagcagtttggagtcttcaaggactttgacttcctggatgtggagctggaggatgctgagggggagagcatggacaacttcaactggggcgtgagaagaagaagcctggacagcattgacaagggggacacccccagcctgcaggagtaccagtgcagcagcagcacccccagcctgaacctgaccaaccaggaggacacagatgagagcagcgaggaggaggccgccctgacagccagccagatcctgagcaggacccagatgctgaacagcgacagcgccacagatgagaccatcccagaccacccagacctgctgctgcagagcgaggacagcacaggcagcatcaccacagaggaggtgctgcagatcagagatgagacccccaccctggaggccagcctggacaatgccaacagccggctgcctgaggacaccacctctgtgctgaaggaggagcacgtgaccacctttgaagatgagggcagctacatcatccaggagcagcaggagagcctggtgtgccagggcatcctggacctggaggagacagagatgcctgagcccctggcccctgagagctacccagagagcgtgtgtgaagaagatgtgaccctggccctgaaggagctggatgagcgctgtgaggaggaggaggccgacttcagcggcctgagcagccaggatgaggaggagcaggacggcttccctgaggtgcagaccagccccctgcccagccccttcctgagcgccatcatcgccgccttccagcctgtggcctatgatgatgaggaggaggcctggcgctgccacgtgaaccagatgctgagtgacacagatggcagcagcgctgtgttcaccttccacgtgttcagccgcctcttccagaccatccagaggaagtttggagagatcaccaatgaggccgtgtccttcctgggggacagcctgcagagaattggcaccaagttcaagagcagcctggaggtgatgatgctgtgcagtgaatgtcccaccgtgtttgtggatgctgagaccctgatgagctgtggcctgctggagaccctgaagtttggagtgctggagctgcaggagcacctggacacctacaacgtgaagcgggaggccgctgagcagtggctggatgactgcaagaggacctttggagccaaggaggacatgtaccgcatcaacacagatgcccagctgaatgagatcctggtggagctggagctgtgcagaagactctacaagctgcacttccagctgctgctgctcttccaggcctactgcaagctgatcaaccaggtgaacaccatcaagaatgaagctgaggtgatcaacatgtctgaggagctggcccagctggagagcatcctgaaggaggccgagagcgcctctgaaaatgaggagattgacatcagcaaggccgcccagaccaccattgaaacagccatccacagcctgattgagaccctgaagaacaaggagttcatctctgctgtggcccaggtgaaggccttccgcagcctgtggcccagcgacatcttcggcagctgtgaagatgatcctgtgcagaccctgctgcacatctacttccaccaccagaccctgggccagacaggcagctttgctgtgattggcagcaacctggacatgtctgaggccaactacaagctgatggagctgaacctggagatccgggagagcctgaggatggtgcagagctaccagctgctggcccaggccaagcccatgggcaacatggtgtccacaggcttctag

SEQ ID NO: 38970 - DNA, 549 bp, Artificial Sequence
  Description of Artificial Sequence: Synthetic coding sequence
atgagggagcccatctacatgcacagcaccatggtgttcctgccctgggagctgcacaccaagaagggccccagccccccagagcagttcatggctgtgaagctgagtgacagccgcatcgccctgaagagcggctacggcaagtacctgggcatcaacagtgatgagctggtgggccacagtgatgccatcggcccccgggagcagtgggagcccgtcttccagaatggcaagatggccctgctggccagcaacagctgcttcatccgctgcaatgaggccggggacatcgaggccaagagcaagacagctggggaggaggagatgatcaagatccgcagctgtgccgagaaggagaccaagaagaaggatgacatcccagaagaagataaaggaaatgtgaagcagtgtgagatcaactacgtgaagaagttccagagcttccaggaccacaagctgaagatcagcaaggaggagagcaagatcctgaagaaggcccagaaggatggcttcctgcacgagaccctgctggaccgggagcccaactag

SEQ ID NO: 38971 - DNA, 549 bp, Artificial Sequence; identical to SEQ ID NO: 38970
  Description of Artificial Sequence: Synthetic coding sequence

SEQ ID NO: 38972 - DNA, 369 bp, Artificial Sequence
  Description of Artificial Sequence: Synthetic coding sequence
atggatgagggcacctacatccacgccctggacaatggcctcttcaccctgggcgccccccacaaggaggacattgatgagggccccagccccccagagcagttcatggctgtgaagctgagtgacagcagaattgccctgaagagcggctacggcaagtacctgggcatcaacagtgatgagctggtgggccacagtgatgccatcggcccccgggagcagtgggagcctgtgttccagaatggcaagatggccctgctggccagcaacagctgcttcatccgctgcaatgaagctggggacatcgaggccaagagcaagacagctggggaggaggagatgatcaagatgctgagccaccacctgtag

SEQ ID NO: 38973 - DNA, 837 bp, Artificial Sequence
  Description of Artificial Sequence: Synthetic coding sequence
atgggcaaaggaaatgaagacagcgacctgcactgcagcagcatccagtgcagcacagaccagccccccttccagcagatctccttcacagagaagggcagtgatgagaagaagcccttcaaggagaagggcaagacagccttcagccacagcagcgagaagcacatccagaggcagggcagcgagcccaaccccaacaaggagaacagcgaggagaccaagctgaaggccggcaacagcacagctggcagcgagcctgagagcagcagctaccgggagaactgcaggaagaggaagatgagcagcaaggacagctgccaggacacagctggcaactgcccagagaaggaatgttccctgagcctgaacaagaagagccgcagcagcacagctgtgcacaacagcgagatccaggagacctgtgatgcccaccaccggggccacagccgggcctgcaccggccacagcaagaggcacaggagccgggccctgggcgtgcagacccccagcatcaggaagagcctggtgacctctgtgcgggccatgtctgaggccgtgtaccaggacctggcccaggtgtgggcccagcagatccacagccccctgacctgtgagcagctgaccctgctgacccggctgcggggccccctgtgtgcccaggtgcagaccctgtacagcatggccacccaggccgcctacgtgtttcctgctgagagctggctggtgcctgccaccctgcccggccctggagagagcgccctggaccgggaggcccaccccttccctggccaggagatcacagaaacagtgtctggcagtgatgaggccaagctgtag

SEQ ID NO: 38974 - DNA, 849 bp, Artificial Sequence
  Description of Artificial Sequence: Synthetic coding sequence
atgggcaaaggaaatgaagatcctgacctgcactgcagcagcatccagtgcagcacagaccagccccccttccagcagatctccttcacagagaagggcagtgatgagaagaagcccttcaagggcaagggcaagacagccttcagccacagcagcgagaagcacacccagaggcaggccggcagtgaccccaaccccaacaaggaaaattctgaggagaccaagctgaaggccggcaacagcacagctggcagcgagcctgagagcagcagctaccaggagaactgcaggaagaggaagatcagcagcaaggacatctgccaggacagagctggcaactgcccagaggaggagtgcaacctgaccctgaacaagaagagccgcagcagcacagctgtgcacaacagcgagatccaggagacctgtgatgcccaccaccggggcagcagccgggcctgcaccggccgcagcaagaggcacaggagccgggccctggaggtgcagacccccagcctgaggaagagcctggtgacctctgtgcgggccatgtctgaggccgtgtaccaggacctggcccaggtgtgggcccagcagatccacagccccctgacctgtgagcagctgaccctgctgacccggctgcggggccccctgtgtgcccaggtgcagaccctgtacagcatggccacccaggccgcctacgtgtttcctgctgagagctggctggtgcctgccaccctgcccggccctggggacagcgccctggaccgggaggcccaccccttccctggccaggagatcacagagcctgtgtctggcagtgatgaggccaagctgggcgccccctag

SEQ ID NO: 38975 - DNA, 984 bp, Artificial Sequence
  Description of Artificial Sequence: Synthetic coding sequence
atgggccgcaccagcaaggacaagagagatgtgtactaccgcctggccaaggaaaatggctggagggcccggagcgccttcaagctgctgcagctggacaaggagttccagctgttccagggcgtgaccagggctgtggacctgtgtgccgcccctggctcctggagccaggtgctgagccagaagattggaggccagggcagcggccacgtggtggccgtggacctgcaggccatggcccccctgcccggggtggtgcagatccagggcgacatcacccagctgagcacagccaaggagatcatccagcacttcaagggctgcccagctgacctggtggtgtgtgatggagccccagatgtgacaggcctgcatgatgtggatgagtacatgcaggcccagctgctgctggccgccctgaacatcgccacccacgtgctgaagccaggcggctgctttgtggccaagatcttccggggcagagatgtgaccctgctgtacagccagctgcaggtgttcttcagctctgtgctgtgtgccaagcccaggagcagcaggaacagcagcattgaggcctttgctgtgtgccagggctatgaccccccagagggcttcatcccagacctgagcaagcccctgctggaccacagctatgacttcaaccagctggatggccccacccgcatcatcgtgccctttgtgacctgtggggacctgagcagctatgacagcgacaggagctaccccctggacctggagggcggcagcgagtacaagtacaccccacccacccagccccccatcagccccccctaccaggaggcctgcaccctgaagaggaagggccagctggccaaggagatccggccccaggactgccccatcagccgggtggacaccttcccccagcccctggccgccccccagtgccacaccctgctggcccctgagatggaggacaatgagatgagctgcagcccctag

SEQ ID NO: 38976 - DNA, 984 bp, Artificial Sequence; identical to SEQ ID NO: 38975
  Description of Artificial Sequence: Synthetic coding sequence

SEQ ID NO: 38977 - DNA, 411 bp, Artificial Sequence
  Description of Artificial Sequence: Synthetic coding sequence
ctgctgggggagcgggccatcccccgggccggcagccaggccggctggaggcccaccctgggctctgtgggcggccgggtgggcagccccagcagcgctgagtgctgccggcccttccctggccagaggcgctggaactttgtggccctgcagcccccagcccggcgctgggacctgaccatgctgccccggctggtgctgaacagctgggcccaggccatcctgcccccccagccccccaaggtgctgggcctgcaggaccccggggccagctttggcagccggctgcacccagccctggagaggagccctggcatgatctacagctgggccgtgttcctgtacccaggagtgcaccctgtgcaccccaggaacacagacctgatcaccgtgaccaagagtgatggatag

SEQ ID NO: 38978 - DNA, 450 bp, Artificial Sequence
  Description of Artificial Sequence: Synthetic coding sequence
atgaagccagctggaaatggcttccccagccccctggccggccctggcagccggcggggctgtgtgcccggcctgaccacctggatccgggcccgggcccgggagaccggcagcagaagaggaagaaatgtgttcagccctgagagagctgctggcagcggcggctgcttctgcagcggccgcatcccccgggtgtctgctgtggatgccctgcgggtggccggggccaggagagctgctgtgtcccggggcaaggccggcgtgcccctgcgctaccgggagcggcacctggagctgtctgagtggcccaggaagccagcccgggcccacttccctgccaggacaggctgctggtggttctggtggctgctgagcggcggcaccccaggcaccagcaaaggaggcttcatctggctgtacctgacctggcagttcctgctgaacaagtag

SEQ ID NO: 38979 - DNA, 747 bp, Artificial Sequence
  Description of Artificial Sequence: Synthetic coding sequence
atgggcatcatggccgccagccggcccctgagccgcttctgggagtggggcaagaacatcgtgtgtgtgggcagaaattatgctgaccacgtgcgggagatgaggtctgctgtgctgtctgagcctgtgctcttcctgaagcccagcacagcctatgcccctgagggcagccccatcctgatgcctgcctacaccaggaacctgcaccacgagctggagctgggcgtggtgatgggcaagcgctgcagagctgtgcctgaggccgccgccatggactatgtgggcggctacgccctgtgcctggacatgacagccagagatgtgcaggatgagtgcaagaagaagggcctgccctggaccctggccaagagcttcaccgccagctgccctgtgtctgcctttgtgcccaaggagaagatcccagacccccacaagctgaagctgtggctgaaggtgaatggagagctgcggcaggagggggagaccagctccatgatcttcagcatcccctacatcatctcctatgtgtccaagatcatcaccctggaggagggggacatcatcctgaccggcacccccaagggcgtgggccctgtgaaggaaaatgatgaaattgaagctggcatccacggcctgcggcagggcctgaccctgagccccaagctggagtgcagcagcgccatcacagcccactgcagcctggagctgcccggcagcagcaacccccccagcgccagccgcttctag

SEQ ID NO: 38980 - DNA, 681 bp, Artificial Sequence
  Description of Artificial Sequence: Synthetic coding sequence
atgggcatcatggccgccagccggcccctgagccgcttctgggagtggggcaagaacatcgtgtgtgtgggcagaaattatgctgaccacgtgcgggagatgaggtctgctgtgctgtctgagcctgtgctcttcctgaagcccagcacagcctatgcccctgagggcagccccatcctgatgcctgcctacaccaggaacctgcaccacgagctggagctgggcgtggtgatgggcaagcgctgcagagctgtgcctgaggccgccgccatggactatgtgggcggctacgccctgtgcctggacatgacagccagagatgtgcaggatgagtgcaagaagaagggcctgccctggaccctggccaagagcttcaccgccagctgccctgtgtctgcctttgtgcccaaggagaagatcccagacccccacaagctgaagctgtggctgaaggtgaatggagagctgcggcaggagggggagaccagctccatgatcttcagcatcccctacatcatctcctatgtgtccaagatcatcaccctggaggagggggacatcatcctgaccggcacccccaagggcgtgggccctgtgaaggaaaatgatgaaattgaagctggcatccacggcctgcccaaggtgtcctctgccaccctgcctgtgcggctgcaggagtag

SEQ ID NO: 38981 - DNA, 675 bp, Artificial Sequence
  Description of Artificial Sequence: Synthetic coding sequence
atgggcatcatggccgccagccggcccctgagccgcttctgggagtggggcaagaacatcgtgtgtgtgggcagaaattatgctgaccacgtgcgggagatgaggtctgctgtgctgtctgagcctgtgctcttcctgaagcccagcacagcctatgcccctgagggcagccccatcctgatgcctgcctacaccaggaacctgcaccacgagctggagctgggcgtggtgatgggcaagcgctgcagagctgtgcctgaggccgccgccatggactatgtgggcggctacgccctgtgcctggacatgacagccagagatgtgcaggatgagtgcaagaagaagggcctgccctggaccctggccaagagcttcaccgccagctgccctgtgtctgcctttgtgcccaaggagaagatcccagacccccacaagctgaagctgtggctgaaggtgaatggagagctgcggcaggagggggagaccagctccatgatcttcagcatcccctacatcatctcctatgtgtccaagatcatcaccctggaggagggggacatcatcctgaccggcacccccaagggcgtgggccctgtgaaggaaaatgatgaaattgaagctggcatccacggcctggtgtccatgaccttcaaggtggagaagccagagtactag

SEQ ID NO: 38982 - DNA, 1134 bp, Artificial Sequence
  Description of Artificial Sequence: Synthetic coding sequence
atgtacacctttgtggtgagagatgagaacagctctgtgtatgcagaggtgtcccggctgctgctggccaccggccactggaagaggctgcggcgggacaacccccgcttcaacctgatgctgggggagaggaaccggctgcccttcggccgcctgggccacgagcccggcctggtgcagctggtgaactactacagaggagctgacaagctgtgcaggaaggccagcctggtgaagctgatcaagaccagccctgagctggccgagagctgcacctggttccctgagagctatgtgatctaccccaccaacctgaagacccctgtggccccagcccagaatggcatccagccccccatcagcaacagcaggacagatgagcgggagttcttcctggccagctacaacaggaagaaggaggatggagagggcaatgtgtggatcgccaagagcagcgctggggccaagggggagggcatcctgatcagcagcgaggccagcgagctgctggacttcatcgacaaccagggccaggtgcacgtgatccagaagtacctggagcaccccctgctgctggagcccggccacaggaagtttgacatccgctcctgggtgctggtggaccaccagtacaacatctacctgtaccgggagggcgtgctgaggacagccagcgagccctaccacgtggacaacttccaggacaagacctgccacctgaccaaccactgcatccagaaggagtacagcaagaactacggcaagtatgaggagggcaatgagatgttcttcaaggagttcaaccagtacctgaccagcgccctgaacatcaccctggagagcagcatcctgctgcagatcaagcacatcatccggaactgcctgctgtctgtggagcccgccatcagcaccaagcacctgccctaccagagcttccagctgtttggatttgacttcatggtggatgaggagctgaaggtgtggctgattgaggtgaatggagccccagcctgtgcccagaagctgtatgcagagctgtgccagggcatcgtggacatcgccatcagctctgtgttccccccaccagatgtggagcagccccagacccagcctgctgccttcatcaagctgtag

SEQ ID NO: 38983 - DNA, 384 bp, Artificial Sequence
  Description of Artificial Sequence: Synthetic coding sequence
atgctggtgtctggaagaagaaggctgctgactgtgctgctgcaggcccagaagtggcccttccagcccagccgggacatgaggctggtgcagttccgggccccccacctggtgggcccccacctgggcctggagactggaaatggaggaggagtcatcaacctgaatgcctttgaccccaccctgcccaagaccatgacccagttcctggagcagggcgaggccaccctgtctgtggcccggcgggccctggccgcccagctgcctgtgctgcccaggtctgaggtgaccttcctggcccctgtgaccaggccagacaaggtggtgtgtgtgggcatgaactacgtggaccactgcaaggagcagaatgtgcctgtgccctag

SEQ ID NO: 38984 - DNA, 246 bp, Artificial Sequence
  Description of Artificial Sequence: Synthetic coding sequence
atgctggtgtctggaagaagaaggctgctgactgtgctgctgcaggcccagaagtggcccttccagcccagccgggacatgaggctggtgcagttccgggccccccacctggtgggcccccacctgggcctggagactggaaatggaggaggagtcatcaacctgaatgcctttgaccccaccctgcccaagaccatgacccagttcctggagcagggcgaggccaccctgtctgtggccaggtag

SEQ ID NO: 38985 - DNA, 945 bp, Artificial Sequence
  Description of Artificial Sequence: Synthetic coding sequence
atgctggtgtctggaagaagaaggctgctgactgtgctgctgcaggcccagaagtggcccttccagcccagccgggacatgaggctggtgcagttccgggccccccacctggtgggcccccacctgggcctggagactggaaatggaggaggagtcatcaacctgaatgcctttgaccccaccctgcccaagaccatgacccagttcctggagcagggcgaggccaccctgtctgtggcccggcgggccctggccgcccagctgcctgtgctgcccaggtctgaggtgaccttcctggcccctgtgaccaggccagacaaggtggtgtgtgtgggcatgaactacgtggaccactgcaaggagcagaatgtgcctgtgcccaaggagcccatcatcttcagcaagtttgccagcagcatcgtgggcccctatgatgaggtggtgctgcccccccagagccaggaggtggactgggaggtggagctggccgtggtgattggcaagaagggcaagcacatcaaggccacagatgccatggcccacgtggccggcttcaccgtggcccatgatgtgtctgcccgggactggcagatgagaagaaatggcaagcagtggctgctgggcaagacctttgacaccttctgccccctgggccctgccctggtgaccaaggacagcgtggccgacccccacaacctgaagatctgctgccgggtgaatggagaggtggtgcagagcggcaacaccaaccagatggtgttcaagacagaagatctcatcgcctgggtgtcccagtttgtgaccttctacccaggagatgtgatcctgaccggcaccccacctggggtgggcgtcttcaggaagccccctgtgttcctgaagaagggagatgaggtgcagtgtgaaattgaggagctgggcgtcatcatcaacaaggtggtgtag

SEQ ID NO: 38986 - DNA, 945 bp, Artificial Sequence
  Description of Artificial Sequence: Synthetic coding sequence
atgctggtgtctggaagaagaaggctgctgacagccctgctgcaggcccagaagtggcccttccagcccagccgggacatgaggctggtgcagttccgggccccccacctggtgggcccccacctgggcctggagactggaaatggaggaggagtcatcaacctgaatgcctttgaccccaccctgcccaagaccatgacccagttcctggagcagggcgaggccaccctgtctgtggcccggcgggccctggccgcccagctgcctgtgctgccctggagcgaggtgaccttcctggcccctgtgacctggccagacaaggtggtgtgtgtgggcatgaactacgtggaccactgcaaggagcagaatgtgcctgtgcccaaggagcccatcatcttcagcaagtttgccagcagcatcgtgggcccctatgatgaggtggtgctgcccccccagagccaggaggtggactgggaggtggagctggccgtggtgattggcaagaagggcaagcacatcaaggccacagatgccatggcccacgtggccggcttcaccgtggcccatgatgtgtctgcccgggactggctgaccaggagaaatggcaagcagtggctgctgggcaagacctttgacaccttctgccccctgggccctgccctggtgaccaaggacagcgtggccgacccccacaacctgaagatctgctgccgggtgaatggagaggtggtgcagagcagcaacaccaaccagatggtgttcaagacagaagatctcatcgcctgggtgtcccagtttgtgaccttctacccaggagatgtgatcctgaccggcaccccacctggggtgggcgtcttcaggaagccccctgtgttcctgaagaagggagatgaggtgcagtgtgaaattgaggagctgggcgtcatcatcaacaaggtggtgtag

SEQ ID NO: 38987 - DNA, 945 bp, Artificial Sequence; identical to SEQ ID NO: 38986
  Description of Artificial Sequence: Synthetic coding sequence

SEQ ID NO: 38988 - DNA, 945 bp, Artificial Sequence; identical to SEQ ID NO: 38986
  Description of Artificial Sequence: Synthetic coding sequence

SEQ ID NO: 38989 - DNA, 468 bp, Artificial Sequence
  Description of Artificial Sequence: Synthetic coding sequence
atggccaccaggaaccccccaccccaggactatgaaagtgatgatgacagctatgaggtgctggacctgacagaatatgcccggcggcaccagtggtggaacagagtgtttggccacagcagcggccccatggtggagaagtacagcgtggccacccagatcgtgatgggcggcgtgacaggctggtgtgccggcttcctgttccagaaggtgggcaagctggccgccacagctgtgggcggcggcttcctgctgctgcagatcgccagccacagcggctacgtgcagattgactggaagagggtggagaaggatgtgaacaaggccaagaggcagatcaagaagagggccaacaaggccgcccctgagatcaacaacctgattgaggaggccacagagttcatcaagcagaacatcgtcatcagcagcggctttgtgggcggcttcctgctgggcctggccagctag

SEQ ID NO: 38990 - DNA, 339 bp, Artificial Sequence
  Description of Artificial Sequence: Synthetic coding sequence
atggagctggtgctggtgttcctgtgcagcctgctggcccccatggtgctggccagcgctgctgagaaggagaaggagatggaccccttccactatgactaccagaccctgagaattggaggcctggtgtttgctgtggtgctcttctctgtgggcatcctgctgatcctgcggccccaggagatgaggaagccccgctggaggaccagcagcccccccatgcagcagagccccaggaagcagaggacagaggtgcagcccagcggcggccggcggcagccccagggcggccggggccctgtgctgctgtggcagaagatccccctgtggggccagtag

SEQ ID NO: 38991 - DNA, 339 bp, Artificial Sequence; identical to SEQ ID NO: 38990
  Description of Artificial Sequence: Synthetic coding sequence

SEQ ID NO: 38992 - DNA, 3537 bp, Artificial Sequence
  Description of Artificial Sequence: Synthetic coding sequence
atgggccaggatgctgaggacaccagcgaggagcccccagagaaggaggagctggccggcgtgcaggaggccgagacagccacagactgcccagaggtgctggaggagggctgtgaggaggccaccggggtgactggaggagagcaggtggacctgtctgagcccccagaccacgagaagaagaccaaccaggaggtggccgccgccaccctggaggaccacgcccaggatgaatctgctgaggagagctgccagatcgtgccctttgaaaatgactgcatggaggactttgtgaccagcctgaccggcagcccctatgagttcttccccacagagagcaccagcttctgcagcgagagctgcagccccctgtctgagagcgccaagggcctggagagcgagcaggcccccaagctgggcctgcgggcagaggagaaccccatggtgggcgccctgtgtggccagtgtggcagcctgcagggcggcgctgctgagggccctgctgccccagatgtggtggtggtgctggaggaggaggccctggatgatgccctggccaacccctacgtgatgggcgtgggcctgcccggccaggccgcccctggagagggcggccaggccgccagtgatgccctgggcggctacggcagcaaggaggagctgaactgtgaggccgagggcggcctggtgcctgctgacaggaagaacaccagcaccagggtgcggccccacagcggcaaggtggccggctacgtgcctgagaccgtgcctgaggagaccggccctgaggccggcagcagcgcccctggcattggaggagctgctgaggaggtgggcaagaccctgctgagcctggagggcaagcccctggaggccagccgggccctgcctgccaagccccgggccttcaccctgtaccccaggagcttctctgtggagggccgggagatccctgtgtctgtgtaccaggagcctgagggcagcggcctggatgaccaccgcatcaagaggaaagaagacaacctgagcctgagctgtgtgattggcagcagcggcagcttcagccagaggaaccacctgcccagcagcggcaccagcacccccagctccatggtggacatccccccaccatttgacctggcctgcatcaccaagaagcccatcaccaagagcagccccagcctgctgattgaaagtgacagcccagacaagtacaagaagaagaagagcagcttcaagcgcttcctggccctgaccttcaagaagaagacagagaacaagctgcacgtggatgtgaatgtgagcagcagccgcagcagcagcgagagcagctaccacggccccagccgcatcctggaggtggaccggcgcagcctgagcaacagcccccagctgaagagcaggacaggcaagctgcgggccagcgagagccccagcagcctcatcttctacagagatggcaagaggaagggcgtgcccttcagcaggacagtgtcccgggtggagagctttgaagatagaagccggccccccttcctgcccctgcccctgaccaagcccaggagcatctccttccccagcgctgacaccagtgactatgagaacatcccagccatgaacagcgactatgagaacatccagatccccccaagaagacctgcccgggccggggccttcaccaagctgtttgaggaccagagccgggccctgagcacagccaatgaaaatgatggctacgtggacatgagcagcttcaatgcctttgagagcaagcagcagagcgctgaccaggatgctgagagcgcctacacagagccctacaaggtgtgccccatcagcagcgctgcccccaaggaggacctgaccagtgatgaggagcagaggagcagcgaggaggaggacagcgccagccgggaccccagcgtgacccacaaggtggagggccagagccgggccctggtgattgcccaggagctgctgagcagcgagaaggcctacgtggagatgctgcagcacctgaacctggacttccacggggctgtgatgagggccctggatgacatggaccacgagggccgggacaccctggcccgggaggagctgcggcagggcctgtctgagctgcctgccatccatgacctgcaccagggcatcctggaggagctggaggagcggctgagcaactgggagagccagcagaaggtggctgatgtgttcctggcccgggagcagggctttgaccaccacgccacccacatcctgcagtttgaccgctacctgggcctgctgtctgagaactgcctgcacagcccccggctggccgctgctgtgcgggagtttgagcagagcgtgcagggcggcagccagacagccaagcaccggctgctgcgggtggtgcagaggctcttccagtaccaggtgctgctgacagactacctgaacaacctgtgcccagacagcgcagaatatgacaacacccagggcgccctgagcctcatcagcaaggtgacagaccgggccaatgacagcatggagcagggcgagaacctgcagaagctggtgcacatcgagcacagcgtgcggggccagggcgacctgctgcagcccggccgggagttcctgaaggagggcaccctgatgaaggtgacaggcaagaacagaagacccaggcacctgttcctgatgaatgatgtgctgctgtacacctacccccagaaggatggcaagtaccgcctgaagaacaccctggccgtggccaacatgaaggtgtccaggcctgtgatggagaaggtgccctatgccctgaagattgagaccagcgagagctgcctgatgctgagcgccagcagctgtgccgagagagatgagtggtacggctgcctgagccgggccctgcctgaggactacaaggcccaggccctggccgccttccaccacagcgtggagatccgggagcggctgggcgtgtccctgggggagaggcctcccaccctggtgcctgtgacccacgtgatgatgtgcatgaactgtggctgtgacttcagcctgaccctgcggcggcaccactgccacgcctgtgggaagatcgtgtgcaggaactgcagcaggaacaagtaccccctgaagtacctgaaggacaggatggccaaggtgtgtgatggctgcttcggggagctgaagaagaggggccgggctgtgcccggcctgatgagggagaggcctgtgtccatgtccttccccctgagcagcccccgcttcagcggcagcgccttcagctctgtgttccagagcatcaaccccagcaccttcaagaagcagaagaaggtgcccagcgccctgacagaggacaaggtggccctggagagcatgcccctgctgggcttcaccatcgcccctgagaaggaggagggcagcagcgaggtgggccccatcttccacctgtaccacaagaagaccctcttctacagcttcaaggccgaggacaccaacagcgcccagcgctggattgaggccatggaggatgcctctgtgctgtag

SEQ ID NO: 38993 - DNA, 24 bp, Artificial Sequence
  Description of Artificial Sequence: Synthetic coding sequence
tgagagaagcagagccagtgctag

SEQ ID NO: 38994 - DNA, 354 bp, Artificial Sequence
  Description of Artificial Sequence: Synthetic coding sequence
atgtcctggaggggccgcagcacctactactggccccggcccaggagatatgtgcagcccccagagatgattggccccatgaggcctgagcagttcagtgatgaggtggagcccgccaccccagaggagggggagcccgccacccagtgccaggaccctgctgctgcccaggagggggaggatgaaggagccagcgctggccagggccccaagccagaggcccacagccaggagcagggccacccccagacaggctgtgaatgtgaagatggcccagatggccaggagatggacccccccaaccctgaggaggtgaagaccccagaggagggggagaagcagagccagtgctag

SEQ ID NO: 38995 - DNA, 354 bp, Artificial Sequence; identical to SEQ ID NO: 38994
  Description of Artificial Sequence: Synthetic coding sequence

SEQ ID NO: 38996 - DNA, 354 bp, Artificial Sequence
  Description of Artificial Sequence: Synthetic coding sequence
atgtcctggaggggccgcagcacctactactggccccggcccaggagatatgtgcagcccccagagatgattggccccatgaggcctgagcagttcagtgatgaggtggagcccgccaccccagaggagggggagcccgccacccagaggcaggaccctgctgctgcccaggagggggaggatgaaggagccagcgctggccagggccccaagccagaggcccacagccaggagcagggccacccccagacaggctgtgaatgtgaagatggcccagatggccaggagatggacccccccaaccctgaggaggtgaagaccccagaggagggggagaagcagagccagtgctag

SEQ ID NO: 38997 - DNA, 354 bp, Artificial Sequence; identical to SEQ ID NO: 38996
  Description of Artificial Sequence: Synthetic coding sequence

SEQ ID NO: 38998 - DNA, 354 bp, Artificial Sequence; identical to SEQ ID NO: 38996
  Description of Artificial Sequence: Synthetic coding sequence

SEQ ID NO: 38999 - DNA, 354 bp, Artificial Sequence
  Description of Artificial Sequence: Synthetic coding sequence
atgtcctggaggggccgcagcacctactactggccccggcccaggagatatgtgcagcccccagagatgattggccccatgaggcctgagcagttcagtgatgaggtggagcccgccaccccagaggagggggagcccgccacccagaggcaggaccctgctgctgcccaggagggggaggatgaaggagccagcgctggccagggccccaagccagaggccgacagccaggagcagggccacccccagacaggctgtgaatgtgaagatggcccagatggccaggagatggacccccccaaccctgaggaggtgaagaccccagaggagggggagggccagagccagtgctag

SEQ ID NO: 39000 - DNA, 1131 bp, Artificial Sequence
  Description of Artificial Sequence: Synthetic coding sequence
atgtttggagctgctggccggcagcccatcggggccccagctgctggcaacagctggcacttcagcaggaccatggaggagctggtgcatgacctggtgtctgccctggaggagagcagcgagcaggcccggggcggctttgctgagaccggggaccacagccgcagcatcagctgccccctgaagaggcaggccaggaagaggcggggcaggaagagaagaagctacaacgtgcaccacccctgggagaccggccactgcctgtctgagggcagtgacagcagcctggaggagcccagcaaggactaccgggagaaccacaacaacaacaagaaggaccacagcgacagtgatgaccagatgctggtggccaagaggcggcccagcagcaacctgaacaacaacgtgcggggcaagaggcccctgtggcatgaaagtgactttgctgtggacaacgtgggcaacagaaccctgcggcggcggaggaaggtgaagaggatggctgtggacctgccccaggacatcagcaacaagaggaccatgacccagcccccagagggctgccgggaccaggacatggacagcgaccgggcctaccagtaccaggagttcaccaagaacaaggtgaagaagaggaagctgaagatcatccggcagggccccaagatccaggatgaaggagtggtgctggagagcgaggagaccaaccagaccaacaaggacaagatggagtgtgaggagcagaaggtgtctgatgagctgatgtctgagagtgacagcagcagcctgagcagcacagatgctggcctcttcaccaatgatgagggccggcagggagatgatgagcagagcgactggttctatgagaaggagagcggcggggcctgtggcatcactggagtggtgccctggtgggagaaggaggaccccacagagctggacaagaatgtgcctgaccctgtgtttgagagcatcctgaccggcagcttccccctgatgagccaccccagccggcggggcttccaggcccggctgagccggctgcacggcatgagcagcaagaacatcaagaagagcggcggcacccccacctccatggccaccaactggaccagcgagatccccctgtag

SEQ ID NO: 39001 - DNA, 1587 bp, Artificial Sequence
  Description of Artificial Sequence: Synthetic coding sequence
atgtttggagctgctggccggcagcccatcggggccccagctgctggcaacagctggcacttcagcaggaccatggaggagctggtgcatgacctggtgtctgccctggaggagagcagcgagcaggcccggggcggctttgctgagaccggggaccacagccgcagcatcagctgccccctgaagaggcaggccaggaagaggcggggcaggaagagaagaagctacaacgtgcaccacccctgggagaccggccactgcctgtctgagggcagtgacagcagcctggaggagcccagcaaggactaccgggagaaccacaacaacaacaagaaggaccacagcgacagtgatgaccagatgctggtggccaagaggcggcccagcagcaacctgaacaacaacgtgcggggcaagaggcccctgtggcatgaaagtgactttgctgtggacaacgtgggcaacagaaccctgcggcggcggaggaaggtgaagaggatggctgtggacctgccccaggacatcagcaacaagaggaccatgacccagcccccagagggctgccgggaccaggacatggacagcgaccgggcctaccagtaccaggagttcaccaagaacaaggtgaagaagaggaagctgaagatcatccggcagggccccaagatccaggatgaaggagtggtgctggagagcgaggagaccaaccagaccaacaaggacaagatggagtgtgaggagcagaaggtgtctgatgagctgatgtctgagagtgacagcagcagcctgagcagcacagatgctggcctcttcaccaatgatgagggccggcagggagatgatgagcagagcgactggttctatgagaaggagagcggcggggcctgtggcatcactggagtggtgccctggtgggagaaggaggaccccacagagctggacaagaatgtgcctgaccctgtgtttgagagcatcctgaccggcagcttccccctgatgagccaccccagccggcggggcttccaggcccggctgagccggctgcacggcatgagcagcaagaacatcaagaagagcggcggcacccccacctccatggtgcccatccctggccctgtgggcaacaagaggatggtgcacttctccccagacagccaccaccacgaccactggttcagccctggggccaggacagaacatgaccagcaccagctgctgcgggacaacagagctgagcggggccacaagaagaactgcagcgtgaggacagccagccggcagacctccatgcacctgggcagcctgtgcacaggagacatcaagagaagaaggaaggccgcccccctgcccggccccaccacagctggctttgtgggggagaatgcccagcccatcctggagaacaacatcggcaacaggatgctgcagaacatgggctggaccccaggcagcggcctgggcagagatggcaagggcatcagcgagcccatccaggccatgcagaggcccaagggcctgggcctgggcttccccctgcccaagagcaccagcgccaccaccaccccaaatgctgggaagagcgcctag

SEQ ID NO: 39002 - DNA, 1578 bp, Artificial Sequence
  Description of Artificial Sequence: Synthetic coding sequence
atggctgtgcctggagaggccgaggaggaggccaccgtgtacctggtggtgtctggcatccccagcgtgctgcggagcgcccacctgcggagctacttcagccagttccgggaggagcggggcggcggcttcctgtgcttccactaccgccacaggcctgagcgggccccaccccaggccgcccccaacagcgccctgatccccacagatcctgctgctgagggccagctgctgagccagaccagcgccacagatgtgcggcccctgagcacccgggacagcacccccatccagaccaggacctgctgctgcgtcatctctgtgcggggcctggcccaggcccagaggctcatccgcatgtacagcggccgccgctggctggacagccacggcacctggctgcccggccgctgcctgatccggcggctgcggctgcccacagaggccagcggcctgggcagcttccccttcaagaccaggaaggagctgcagagctggaaggcagaaaatgaggccttcaccctggccgacctgaagcagctgcctgagctgaacccccctgtgctgatgcccagaggaaatgtgggcacccccctgcgggtcttcctggagctgatccgggcctgccgcctgcccccacgcatcatcacccagctgcagctgcagttccccaagacaggcagcagccgccgctatggaaatgtgccctttgaatatgaggacagcgagaccgtggagcaggaggagctggtgtacacagctgagggggaggagatcccccagggcacctacctggccgacatcccagccagcccctgtggggagcctgaggaggaggtgggcaaggaggaggaggaggagagccacagtgatgaagatgatgacagaggagaggagtgggagagacatgaggccctgcatgaagatgtgacaggccaggagaggaccacagagcagctgtttgaggaggagattgagctgaagtgggagaagggcggcagcggcctggtgttctacacagatgcccagttctggcaggaggaggagggggactttgatgagcagacagcagatgactgggatgtggacatgtctgtgtactatgacagagatggaggagacaaggatgcccgggacagcgtgcagatgaggctggagcagaggctgagagatggccaggaggatggctctgtgattgagcggcaggtgggcacctttgagcggcacaccaagggcattggaaggaaggtgatggagcggcagggctgggccgagggccagggcctgggctgccgctgcagcggcgtgcctgaggccctggacagtgatggccagcacccccgctgcaagaggggcctgggctaccacggggagaagctgcagcccttcggccagctgaagaggcccaggagaaatggcctgggcctcatcagcaccatctatgatgagcccctgccccaggaccagacagagagcctgctgcggcggcagccccccacctccatgaagttcagaacagacatggcctttgtgcggggcagcagctgtgccagtgacagccccagcctgcctgactag

SEQ ID NO: 39003 - DNA, 714 bp, Artificial Sequence
  Description of Artificial Sequence: Synthetic coding sequence
atgcccagaggaaatgtgggcacccccctgcgggtcttcctggagctgatccgggcctgccgcctgcccccacgcatcatcacccagctgcagctgcagttccccaagacaggcagcagcagaagatatggaaatgtgccctttgaatatgaagattctgaaacagtggagcaggaggagctggtgtacacagctgagggggaggagatcccccagggcacctacctggccgacatcccagccagcccctgtggggagcctgaggaggaggtgggcaaggaggaggaggaggagagccacagtgatgaagatgatgacagaggagaggagtgggagagacatgaggccctgcatgaagatgtgacaggccaggagaggaccacagagcagctgtttgaggaggagattgagctgaagtgggagaagggcggcagcggcctggtgttctacacagatgcccagttctggcaggaggaggagggggactttgatgagcagacagcagatgactgggatgtggacatgtctgtgtactatgacagagatggaggagacaaggatgcccgggacagcgtgcagatgaggctggagcagaggctgagagatggccaggaggatggcagcgtcatcgagcggcaggtgggcacctttgagcggcacaccaagggcatcttcaccaagagccccctgcccagcccccccctgggctactag

SEQ ID NO: 39004 - DNA, 231 bp, Artificial Sequence
  Description of Artificial Sequence: Synthetic coding sequence
tgatttgatgagcagacagcagatgactgggatgtggacatgtctgtgtactatgacagagatggaggagacaaggatgcccgggacagcgtgcagatgaggctggagcagaggctgagagatggccaggaggatggctctgtgattgagcggcaggtgggcacctttgagcggcacaccaagggcatcttcaccaagagccccctgcccagcccccccctgggctactag

SEQ ID NO: 39005 - DNA, 387 bp, Artificial Sequence
  Description of Artificial Sequence: Synthetic coding sequence
atgaggctggagcagaggctgagagatggccaggaggatggctctgtgattgagcggcaggtgggcacctttgagcggcacaccaagggcattggaaggaaggtgatggagcggcagggctgggccgagggccagggcctgggctgccgctgcagcggcgtgcctgaggccctggacagtgatggccagcacccccgctgcaagaggggcctgggctaccacggggagaagctgcagcccttcggccagctgaagaggcccaggagaaatggcctgggcctcatcagcaccatctatgatgagcccctgccccaggaccagacagagagcctgctgcggcggcagccccccacctccatgaagttcagaacagacatggccttctag

SEQ ID NO: 39006 - DNA, 1524 bp, Artificial Sequence
  Description of Artificial Sequence: Synthetic coding sequence
atggctgtgcctggagaggccgaggaggaggccaccgtgtacctggtggtgtctggcatccccagcgtgctgcggagcgcccacctgcggagctacttcagccagttccgggaggagcggggcggcggcttcctgtgcttccactaccgccacaggcctgagcgggccccaccccaggccgcccccaacagcgccctgatccccacagatcctgctgctgagggccagctgctgagccagaccagcgccacagatgtgcggcccctgagcacccgggacagcacccccatccagaccaggacctgctgctgcgtcatctctgtgcggggcctggcccaggcccagaggctcatccgcatgtacagcggccgccgctggctggacagccacggcacctggctgcccggccgctgcctgatccggcggctgcggctgcccacagaggccagcggcctgggcagcttccccttcaagaccaggaaggagctgcctgagctgaacccccctgtgctgatgcccagaggaaatgtgggcacccccctgcgggtcttcctggagctgatccgggcctgccgcctgcccccacgcatcatcacccagctgcagctgcagttccccaagacaggcagcagccgccgctatggaaatgtgccctttgaatatgaggacagcgagaccgtggagcaggaggagctggtgtacacagctgagggggaggagatcccccagggcacctacctggccgacatcccagccagcccctgtggggagcctgaggaggaggtgggcaaggaggaggaggaggagagccacagtgatgaagatgatgacagaggagaggagtgggagagacatgaggccctgcatgaagatgtgacaggccaggagaggaccacagagcagctgtttgaggaggagattgagctgaagtgggagaagggcggcagcggcctggtgttctacacagatgcccagttctggcaggaggaggagggggactttgatgagcagacagcagatgactgggatgtggacatgtctgtgtactatgacagagatggaggagacaaggatgcccgggacagcgtgcagatgaggctggagcagaggctgagagatggccaggaggatggctctgtgattgagcggcaggtgggcacctttgagcggcacaccaagggcattggaaggaaggtgatggagcggcagggctgggccgagggccagggcctgggctgccgctgcagcggcgtgcctgaggccctggacagtgatggccagcacccccgctgcaagaggggcctgggctaccacggggagaagctgcagcccttcggccagctgaagaggcccaggagaaatggcctgggcctcatcagcaccatctatgatgagcccctgccccaggaccagacagagagcctgctgcggcggcagccccccacctccatgaagttcagaacagacatggcctttgtgcggggcagcagctgtgccagtgacagccccagcctgcctgactag

SEQ ID NO: 39007 - DNA, 420 bp, Artificial Sequence
  Description of Artificial Sequence: Synthetic coding sequence
atggatggcctgaaggtgggccatgaccctgccaaggagttcaccaaccactggtggaatgagctgttcaacaagacagctgccaacctggtggtggagaccggccaggatggagtgcagatccgcagcctgagcaaggagaccacccgctacaaccaccccaagcccaacctgctgtaccagaagtttgtgaaggtgctggaggccgtgggcaacagagtgcaccccttcagcctgccctggttcccctggggcctgaacagctgcctggtgtgcctgatcaacagccagaacttccccaacatcgtgggcagctgtgaccagccctgctgctgcctgctgcggctgccccggcccagcgctggcatcgagatcttccgcttccggggcagctgccacctgctgcgggagcagcagtag

SEQ ID NO: 39008 - DNA, 1338 bp, Artificial Sequence
  Description of Artificial Sequence: Synthetic coding sequence
atgaatgtgaccccagaggtgaagagccggggcatgaagtttgctgaggagcagctgctgaagcacggctggacccagggcaagggcctgggcaggaaagaaaatggcatcacccaggccctgcgggtgaccctgaagcaggacacccacggcgtgggccatgaccctgccaaggagttcaccaaccactggtggaatgagctgttcaacaagacagctgccaacctggtggtggagaccggccaggatggagtgcagatccgcagcctgagcaaggagaccacccgctacaaccaccccaagcccaacctgctgtaccagaagtttgtgaagatggccaccctgaccagcggcggggagaagcccaacaaggacctggagagctgcagtgatgatgacaaccagggcagcaagagccccaagatcctgacagatgagatgctgctgcaggcctgtgagggccgcacagcccacaaggccgcccggctgggcatcaccatgaaggccaagctggcccggctggaggcccaggagcaggccttcctggcccggctgaagggccaggaccccggggccccccagctgcagagcgagagcaagccacccaagaagaagaagaagaagaggcggcagaaggaggaggaggaggccacagccagcgagagaaatgatgctgatgagaagcaccctgagcacgccgagcagaacatcaggaagagcaagaagaagaagagaagacaccaggagggcaaggtgtctgatgagcgggagggcaccaccaagggaaatgagaaggaggatgctgctggcaccagcggcctgggggagctgaacagccgggagcagaccaaccagagcctgaggaagggcaagaagaagaagcgctggcaccacgaggaggagaagatgggcgtgctggaggagggcggcaagggcaaggaggccgccggctctgtgaggacagaggaggtggagagccgggcctatgctgacccctgcagcaggaggaagaagaggcagcagcaggaggaggaggacctgaacctggaggacagaggagaggagaccctgggcggcggcacccgggaggccgagagccgggcctgcagtgatggccgcagcaggaagagcaagaagaagaggcagcagcaccaggaggaggaggacatcctggatgtgagagatgagaaggatggaggagcccgggaggccgagagccgggcccacacaggcagcagcagccggggcaagaggaagaggcagcagcaccccaagaaggagagagctggggtgtccacagtgcagaaggccaagaagaagcagaagaagagggactag

SEQ ID NO: 39009 - DNA, 1113 bp, Artificial Sequence
  Description of Artificial Sequence: Synthetic coding sequence
atgaatgtgaccccagaggtgaagagccggggcatgaagtttgctgaggagcagctgctgaagcacggctggacccagggcaagggcctgggcaggaaagaaaatggcatcacccaggccctgcgggtgaccctgaagcaggacacccacggcgtgggccatgaccctgccaaggagttcaccaaccactggtggaatgagctgttcaacaagacagctgccaacctggtggtggagaccggccaggatggagtgcagatccgcagcctgagcaaggagaccacccgctacaaccaccccaagcccaacctgctgtaccagaagtttgtgaagatggccaccctgaccagcggcggggagaagcccaacaaggacctggagagctgcagtgatgatgacaaccagggcagcaagagccccaagatcctgacagatgagatgctgctgcaggcctgtgagggccgcacagcccacaaggccgcccggctgggcatcaccatgaaggccaagctggcccggctggaggcccaggagcaggccttcctggcccggctgaagggccaggaccccggggccccccagctgcagagcgagagcaagccacccaagaagaagaagaagaagaggcggcagaaggaggaggaggaggccacagccagcgagagaaatgatgctgatgagaagcaccctgagcacgccgagcagaacatcaggaagagcaagaagaagaagagaagacaccaggagggcaaggtgtctgatgagcgggagggcaccaccaagggaaatgagaaggaggatgctgctggcaccagcggcctgggggagctgaacagccgggagcagaccaaccagagcctgaggaagggcaagaagaagaagcgctggcaccacgaggaggagaagatgggcgtgctggaggagggcggcaagggcaaggaggccgccggctctgtgaggacagaggaggtggagagccgggcctatgctgacccctgcagcaggaggaagaagaggcagcagcaggaggaggaggacctgaacctggaggacagaggagaggagaccttccgctggtggaaccagggcagccgggagcagagcatgcagtag

SEQ ID NO: 39010 - DNA, 1128 bp, Artificial Sequence
  Description of Artificial Sequence: Synthetic coding sequence
atgttccccaggagcggccccagcaatgatgaggtgaagagccggggcatgaagtttgctgaggagcagctgctgaagcacggctggacccagggcaagggcctgggcaggaaagaaaatggcatcacccaggccctgcgggtgaccctgaagcaggacacccatggagtgggccatgaccctgccaaggagttcaccaaccactggtggaatgaactcttcaacaagacagctgccaacctggtggtggagaccggccaggatggagtgcagatccgcagcctgagcaaggagaccacccgctacaaccaccccaagcccaacctgctgtaccagaagtttgtgaagatggccaccctgaccagcggcggggagaagcccaacaaggacctggagagctgcagtgatgatgacaaccagggcagcaagagccccaagatcctgacagatgagatgctgctgcaggcctgtgagggccgcacagcccacaaggccgcccggctgggcatcaccatgaaggccaagctggcccggctggaggcccaggagcaggccttcctggcccggctgaagggccaggaccccggggccccccagctgcagagcgagagcaagccacccaagaagaagaagaagaagaggcggcagaaggaggaggaggaggccacagccagcgagagaaatgatgctgatgagaagcaccctgagcacgccgagcagaacatcaggaagagcaagaagaagaagaggaggcaccaggagggcaaggtgtctgatgagcgggagggcaccaccaagggaaatgagaaggaggatgctgctggcaccagcggcctgggggagctgaacagccgggagcagaccaaccagagcctgaggaagggcaagaagaagaagcgctggcaccacgaggaggagaagatgggcgtgctggaggagggcggcaagggcaaggaggccgccggctctgtgaggacagaggaggtggagagccgggcctatgctgacccctgcagcaggaggaagaagaggcagcagcaggaggaggaggacctgaacctggaggacagaggagaggagaccttccgctggtggaaccagggcagccgggagcagagcatgcagtag

SEQ ID NO: 39011 - DNA, 1218 bp, Artificial Sequence
  Description of Artificial Sequence: Synthetic coding sequence
tgaagcctggtgctgggcgtcatcacctgtgcccctgagcggctgaacttccctgccagcgcctgtgccctgaagagagctgcctggctgctgcggggccggggcgtcttccacaacggcctgaagatctgtgagaagtttggccccaacctggacacctgcccagagggcaccatcctgggcctgcggctggacagcagcggcggcctgcacctgcacgtgaatggagtggaccagggcgtggccgtgcctgatgtgccccagccctgccacgccctggtggacctgtatggccagtgtgagcaggtgaccatcgtgaaccctgagcccggggccgccagcggcaagtctgctggcacccagggcgacatggagaaggctgacatggtggatggcatcaaggagagcgtgtgctggggccccccacctgctgccagccccctgaagagctgtgagtaccacgccctgtgcagccgcttccaggagctgctgctgctgcctgaggactacttcatgcccccacccaagaggagcctgtgctactgtgagagctgcaggaagctgcggggagatgaggcccacagaagaagaggagagcccccccgggagtatgccctgcccttcggctggtgccgcttcaacctgcgggtgaacccccggctggaggccggcaccctgaccaagaagtggcacatggcctaccacggcagcaatgtggccgctgtgagaagagtgctggacagaggagagctgggcgccggcacagccagcatcctgagctgccggcccctgaagggggagcccggggtgggctttgaggagcctggagagaactgtgccccaccccgggaggagcagcccccacctgtgctgctgagccccagcctgcagtatgctggagctgagaccctggccagcaaggtgcagttccgggaccccaagagccagaggacccaccaggcccaggtggccttccagaggagcctgagcctgtgcccccatgaggccgccttcagcggggccaccggccgggagtggggccgggtgggcgccaggaagatgggcgcctctgtgcagctgctgctgaccctcatcagcaaggagcccatcaacacagtgtctgagcccccaccccggcccctgagccgggcccccctgagcggggcccgggtgccctggggcgccacccgctgggcccgggagatcaaggagagctag

SEQ ID NO: 39012 - DNA, 1377 bp, Artificial Sequence
  Description of Artificial Sequence: Synthetic coding sequence
atgagcagcagcaggcctgagcccggcccctgggcccccctgagcccccggctgcagcccctgagccagagcagcagcagcctgctgggggagggccgggagcagaggcctgagctgaggaagacagccagcagcacagtgtggcaggcccagctgggggaggccagcacccggccccaggcccctgaggaggagggcaaccccccagagagcatgaagccagcccgggccagcggccccaaggcccggcccagcgctgggggccactggtggagcagcacagtgggcaatgtgtccaccatgggcggcagtgacctgtgccgcctgcgggcccccagcgctgctgccatgcagaggagccacagcgacctggtgcgcagcacccagatgaggggccacagcggggccaggaaggccagcctgagctgcagcgccctgggcagcagccctgtgcaccgggcccagctgcagcccggcggcaccagcggccagggcggccaggccccagctggcctggagcgggacctggccccagaagatgagaccagcaacagcgcctggatgctgggcgccagccagctgtctgtgccccccctggacctgggggacaccacagcccacagcagcagcgcccaggccgagcccaaggctgctgagcagctggccaccaccacctgccacgccctgcccccagctgccctgctgtgtggcatgagggaggtgcgggccggcggctgctgccacgccctgcctgccaccggcatcctggccttccccaagctggtggcctctgtgtctgagagcggcctgcaggcccagcacggcgtgaagatccactgccgcctgagcggcggcctgcccggccacagccactgctgtgcccacctgtggggccctgctggcctggtgcctgagcccggcagcaggaccaaggatgtgtggaccatgaccagcgccaatgacctggccccagctgaggccagccccctgagcgcccaggatgctggggtgcaggccgcccctgtggccgcctgcaaggctgtggccaccagccccagcctggaggccccagctgccctgcacgtgtttcctgaggtgaccctgggcagcagcctggaggaggtgcccagccctgtgagagatgtgcgctgggatgctgagggcatgacctgggaggtgtatggagctgctgtggacctggaggtgctgggcgtggccatccagaagcacctggagatgcagtttgagcagctgcagagggccccagccagcgaggacagcctgtctgtggagggcagaagaggccccctgcgggctgtgatgcagagcctgcggcggcccagctgctgcggctgcagcggggccgcccctgagtag

SEQ ID NO: 39013 - DNA, 1377 bp, Artificial Sequence; identical to SEQ ID NO: 39012
  Description of Artificial Sequence: Synthetic coding sequence

SEQ ID NO: 39014 - DNA, 1377 bp, Artificial Sequence; identical to SEQ ID NO: 39012
  Description of Artificial Sequence: Synthetic coding sequence

SEQ ID NO: 39015 - DNA, 1641 bp, Artificial Sequence
  Description of Artificial Sequence: Synthetic coding sequence
atggagctggagaacatcgtggccaacagcctgctgctgaaggcccggcaggagaaggactacagcagcctgtgtgacaagcagcccatcggccggcggctcttccggcagttctgtgacaccaagcccaccctgaagaggcacatcgagttcctggatgctgtggccgagtatgaggtggctgatgatgaggacagaagtgactgtggcctgagcatcctggaccgcttcttcaatgacaagctggccgcccccctgcctgagatccccccagatgtggtgacagagtgccgcctgggcctgaaggaggagaaccccagcaagaaggcctttgaagaatgtaccagggtggcccacaactacctgcggggggagccctttgaggagtaccaggagagcagctacttcagccagttcctgcagtggaagtggctggagcggcagcctgtgaccaagaacaccttccgccactacagagtgctgggcaaaggaggctttggagaggtgtgtgcctgccaggtgcgggccaccgggaagatgtatgcctgcaagaagctgcagaagaagaggatcaagaagaggaaaggagaggccatggccctgaatgagaagaggatcctggagaaggtgcagagcagatttgtggtgtccctggcctatgcctatgagaccaaggatgccctgtgcctggtgctgaccatcatgaatggaggagacctgaagttccacatctacaacctgggcaaccctggctttgatgagcagagagctgtgttctatgctgctgagctgtgctgcggcctggaggacctgcagcgggagcgcatcgtgtacagagacctgaagccagagaacatcctgctggatgaccggggccacatccgcatcagtgacctgggcctggccacagagatccctgagggccagagggtgcggggccgggtgggcaccgtgggctacatggcccctgaggtggtgaacaatgagaagtacaccttctccccagactggtggggcctgggctgcctgatctatgagatgatccagggccacagccccttcaagaagtacaaggagaaggtgaagtgggaggaggtggaccagaggatcaagaatgacacagaggagtacagcgagaagttctctgaagatgccaagagcatctgcaggatgctgctgaccaagaaccccagcaagaggctgggctgccgcggggagggcgctgctggggtgaagcagcaccctgtgttcaaggacatcaacttccggcggctggaggccaacatgctggagccccccttctgcccagacccccatgctgtgtactgcaaggatgtgctggacatcgagcagttctctgtggtgaagggcatctacctggacacagcagatgaggacttctacgccaggtttgccaccggctgtgtgtccatcccctggcagaatgagatgattgaaagtggctgcttcaaggacatcaacaagtctgagagcgaggaggccctgcccctggacctggacaagaacatccacacccctgtgtcccggcccaacagaggcttcttctaccgcctcttcagaagaggaggctgcctgaccatggtgcccagcgagaaggaggtggagcccaagcagtgctag

SEQ ID NO: 39016 - DNA, 1503 bp, Artificial Sequence
  Description of Artificial Sequence: Synthetic coding sequence
atggagctggagaacatcgtggccaacagcctgctgctgaaggcccggcaggagaaggactacagcagcctgtgtgacaagcagcccatcggccggcggctcttccggcagttctgtgacaccaagcccaccctgaagaggcacatcgagttcctggatgctgtggccgagtatgaggtggctgatgatgaggacagaagtgactgtggcctgagcatcctggaccgcttcttcaatgacaagctggccgcccccctgcctgagatccccccagatgtggtgacagagtgccgcctgggcctgaaggaggagaaccccagcaagaaggcctttgaagaatgtaccagggtggcccacaactacctgcggggggagccctttgaggagtaccaggagagcagctacttcagccagttcctgcagtggaagtggctggagcggcagcctgtgaccaagaacaccttccgccactacagagtgctgggcaaaggaggctttggagaggtgtgtgcctgccaggtgcgggccaccgggaagatgtatgcctgcaagaagctgcagaagaagaggatcaagaagaggaaaggagaggccatggccctgaatgagaagaggatcctggagaaggtgcagagcagatttgtggtgtccctggcctatgcctatgagaccaaggatgccctgtgcctggtgctgaccatcatgaatggaggagacctgaagttccacatctacaacctgggcaaccctggctttgatgagcagagagctgtgttctatgctgctgagctgtgctgcggcctggaggacctgcagcgggagcgcatcgtgtacagagacctgaagccagagaacatcctgctggatgaccggggccacatccgcatcagtgacctgggcctggccacagagatccctgagggccagagggtgcggggccgggtgggcaccgtgggctacatggcccctgaggtggtgaacaatgagaagtacaccttctccccagactggtggggcctgggctgcctgatctatgagatgatccagggccacagccccttcaagaagtacaaggagaaggtgaagtgggaggaggtggaccagaggatcaagaatgacacagaggagtacagcgagaagttctctgaagatgccaagagcatctgcaggatgctgctgaccaagaaccccagcaagaggctgggctgccgcggggagggcgctgctggggtgaagcagcaccctgtgttcaaggacatcaacttccggcggctggaggccaacatgctggagccccccttctgcccagacccccatgctgtgtactgcaaggatgtgctggacatcgagcagttctctgtggtgaagggcatctacctggacacagcagatgaggacttctacgccaggtttgccaccggctgtgtgtccatcccctggcagaatgaaggctgcctgaccatggtgcccagcgagaaggaggtggagcccaagcagtgctag

SEQ ID NO: 39017 - DNA, 405 bp, Artificial Sequence
  Description of Artificial Sequence: Synthetic coding sequence
atgcacggcggcggcggcgtgagcagctgcagcgccagctctgtgtcctctgtgtcccagaaccccccagctgctgctgcccctggccacggggcccgggagcaccggggccagctggccgctgctgagagcgccagcagccccctgcacccagccaccaaggcctctgtgggccctgccctgcagcgggagacccccaccatcctgtgtgccatcctgtgcctgggcccccacgtgtccctggcctgtgtgtcccgggagctggccacagagcccaggaccagcagcccctgtgccagccacggcagcagcagccaccctgtgaccctgacagagctgctgatcagcagcatcagcctgagagatggagctgccctgctgggcctgtgcagcaggacagtgtag

SEQ ID NO: 39018 - DNA, 1599 bp, Artificial Sequence
  Description of Artificial Sequence: Synthetic coding sequence
atggagctggagaacatcgtggccaacagcctgctgctgaaggcccggcagggcggctacggcaagaagagcggccgcagcaagaagtggaaggagatcctgaccctgccccctgtgtcccagtgcagcgagctgcggcacagcattgagaaggactacagcagcctgtgtgacaagcagcccatcggccggcggctcttccggcagttctgtgacaccaagcccaccctgaagaggcacatcgagttcctggatgctgtggccgagtatgaggtggctgatgatgaggacagaagtgactgtggcctgagcatcctggaccgcttcttcaatgacaagctggccgcccccctgcctgagatccccccagatgtggtgacagagtgccgcctgggcctgaaggaggagaaccccagcaagaaggcctttgaagaatgtaccagggtggcccacaactacctgcggggggagccctttgaggagtaccaggagagcagctacttcagccagttcctgcagtggaagtggctggagcggcagcctgtgaccaagaacaccttccgccactacagagtgctgggcaaaggaggctttggagaggtgtgtgcctgccaggtgcgggccaccgggaagatgtatgcctgcaagaagctgcagaagaagaggatcaagaagaggaaaggagaggccatggccctgaatgagaagaggatcctggagaaggtgcagagcagatttgtggtgtccctggcctatgcctatgagaccaaggatgccctgtgcctggtgctgaccatcatgaatggaggagacctgaagttccacatctacaacctgggcaaccctggctttgatgagcagagagctgtgttctatgctgctgagctgtgctgcggcctggaggacctgcagcgggagcgcatcgtgtacagagacctgaagccagagaacatcctgctggatgaccggggccacatccgcatcagtgacctgggcctggccacagagatccctgagggccagagggtgcggggccgggtgggcaccgtgggctacatggcccctgaggtggtgaacaatgagaagtacaccttctccccagactggtggggcctgggctgcctgatctatgagatgatccagggccacagccccttcaagaagtacaaggagaaggtgaagtgggaggaggtggaccagaggatcaagaatgacacagaggagtacagcgagaagttctctgaagatgccaagagcatctgcaggatgctgctgaccaagaaccccagcaagaggctgggctgccgcggggagggcgctgctggggtgaagcagcaccctgtgttcaaggacatcaacttccggcggctggaggccaacatgctggagccccccttctgcccagacccccatgctgtgtactgcaaggatgtgctggacatcgagcagttctctgtggtgaagggcatctacctggacacagcagatgaggacttctacgccaggtttgccaccggctgtgtgtccatcccctggcagaatgaaggctgcctgaccatggtgcccagcgagaaggaggtggagcccaagcagtgctag

SEQ ID NO: 39019 - DNA, 942 bp, Artificial Sequence
  Description of Artificial Sequence: Synthetic coding sequence
atgaagagcccccccctgctgagcccctgcctgtcctggaagaggatggccggcatcttcttcctgcccttcatcagcagcggctttgccccccgcttcaagcaggaggagaacttcatgctgggccgggcccaccccagccagccccgcttcaactggagccacctgacccccctggagctgaagaacagatctgtgggcctgggcacagagagcacaggccggggcaagccccacttcaccctggagggccacaagttcctgatctttggaggcagcatccactacttccgggtgccccgggagtactggagggaccggctgctgaagctgaaggcctgtggcttcaacacagtgaccacctacgtgccctggaacctgcacgagcctgagcggggcaagtttgacttcagcggcaacctggacctggaggcctttgtgctgatggctgctgagatcggcctgtgggtgatcctgcggcccggccgctacatctgcagcgagatggacctgggcggcctgcccagctggctgctgcaggacccccggctgctgctgcggaccaccaacaagagcttcatcgaggccgtggagaagtactttgaccacctgatccccagggtcatccccctgcagtaccggcaggccggccctgtgattgctgtgcaggtggagaatgaatatggcagcttcaacaaggacaagacctacatgccctacctgcacaaggccctgctgcggcggggcatcgtggagctgctgctgaccagtgatggagagaagcacgtgctgagcggccacaccaagggcgtgctggccgccatcaacctgcagaagctgcaccaggacaccttcaaccagctgcacaaggtgcagggcgccagcattgatgctggcctgctgagtgatgccagccaggccgccaccagcagcagcctgtag

SEQ ID NO: 39020 - DNA, 1962 bp, Artificial Sequence
  Description of Artificial Sequence: Synthetic coding sequence
atgaagagcccccccctgctgagcccctgcctgtcctggaagaggatggccggcatcttcttcctgcccttcatcagcagcggctttgccccccgcttcaagcaggaggagaacttcatgctgggccgggcccaccccagccagccccgcttcaactggagccacctgacccccctggagctgaagaacagatctgtgggcctgggcacagagagcacaggccggggcaagccccacttcaccctggagggccacaagttcctgatctttggaggcagcatccactacttccgggtgccccgggagtactggagggaccggctgctgaagctgaaggcctgtggcttcaacacagtgaccacctacgtgccctggaacctgcacgagcctgagcggggcaagtttgacttcagcggcaacctggacctggaggcctttgtgctgatggctgctgagatcggcctgtgggtgatcctgcggcccggccgctacatctgcagcgagatggacctgggcggcctgcccagctggctgctgcaggacccccggctgctgctgcggaccaccaacaagagcttcatcgaggccgtggagaagtactttgaccacctgatccccagggtcatccccctgcagtaccggcaggccggccctgtgattgctgtgcaggtggagaatgaatatggcagcttcaacaaggacaagacctacatgccctacctgcacaaggccctgctgcggcggggcatcgtggagctgctgctgaccagtgatggagagaagcacgtgctgagcggccacaccaagggcgtgctggccgccatcaacctgcagaagctgcaccaggacaccttcaaccagctgcacaaggtgcagagggacaagcccctgctgatcatggagtactgggtgggctggtttgaccgctggggagacaagcaccacgtgaaggatgccaaggaggtggagcacgctgtgtctgagttcatcaagtatgagatctccttcaacgtgtacatgttccacggcggcaccaactttggcttcatgaatggagccacctactttgggaagcacagcggcatcgtgaccagctatgactatgatgctgtgctgacagaagctggggactacacagagaagtacctgaagctgcagaagctgttccagagcgtgtctgccacccccctgccccgggtgcccaagctgccccccaaggctgtgtacccacctgtgcggcccagcctgtacctgcccctgtgggatgccctgagctacctgaatgaacctgtgcgcagccggcagcctgtgaacatggagaacctgcccatcaacaacggcagcggccagagctatggcctggtgctgtatgagaagagcatctgcagcggcggccgcctgcgggcccacgcccatgatgtggcccaggtgttcctggatgagaccatgattggcatcctgaatgaaaacaacaaggacctgcacatccctgagctgcgggactgccgctacctgcgcatcctggtggagaaccagggccgggtgaacttctcctggcagatccagaatgagcagaagggcatcactggatctgtgtccatcaacaacagcagcctggagggcttcaccatctacagcctggagatgaagatgtccttctttgagcggctgcggagcgccacctggaagcctgtgcctgacagccaccagggccctgccttctactgcggcaccctgaaggccggccccagccccaaggacaccttcctgagcctgctgaactggaactacggctttgtgttcatcaatggaagaaacctgggccgctactggaacatcggcccccagaagaccctgtacctgcccggggtgtggctgcacccagaagataatgaagtcatcctgtttgagaagatgatgagcggcagtgacatcaagagcacagacaagcccaccctgtag

SEQ ID NO: 39021 - DNA, 447 bp, Artificial Sequence
  Description of Artificial Sequence: Synthetic coding sequence
atggagcctgaggcctttgagatctgcccctatgacccccaccaccgcatccccctgagccgcttccagtaccacctggccagctgcaggaggaagaaccccaagaaggccaagaagatggccacctgcaagtacaatgcctgccacgtggtgcccatcaagaacctggaggagcatgaagctgtgtgtgtgaacagatctgctgtggaggaggaggacacagagaaccccctgaaggtgagcccccccagcagcgagcagaatgatgacacccagcaggtgagcccctgcctgcccagcccagacatctggaatgtggatggagccaactgccagcacgtgtttgtgctgaagaccttcttcccccagaaggtggtgtgtgaaaatgacaccaaggagagcgcccgggagaccagcccccagaagatcctgcggcccggccagtag

SEQ ID NO: 39022 - DNA, 372 bp, Artificial Sequence
  Description of Artificial Sequence: Synthetic coding sequence
atggagcctgaggcctttgagatctgcccctatgacccccaccaccgcatccccctgagccgcttccagtaccacctggccagctgcaggaggaagaaccccaagaaggccaagaagatggccacctgcaagtacaatgcctgccacgtggtgcccatcaagaacctggaggagcatgaagctgtgtgtgtgaacagatctgctgtggaggaggaggacacagagaaccccctgaaggtgagcccccccagcagcgagcagaatgatgacacccagcagaccttcttcccccagaaggtggtgtgtgaaaatgacaccaaggagagcgcccgggagaccagcccccagaagatcctgcggcccggccagtag

SEQ ID NO: 39023 - DNA, 1491 bp, Artificial Sequence
  Description of Artificial Sequence: Synthetic coding sequence
atggaccccctgggcgcccccagccagtttgtggatgtggacaccctgcccagctggggagacagctgccaggatgagctgaacagcagtgacaccacagctgagatcttccaggaggacacagtgcgcagccccttcctgtacaacaaggatgtgaatggcaaggtggtgctgtggaagggagatgtggccctgctgaactgcacagccatcgtgaacaccagcaatgaaagcctgacagacaagaaccctgtgtctgagagcatcttcatgctggccggccctgacctgaaggaggacctgcagaagctgaagggctgcaggactggagaggccaagctgaccaagggcttcaacctggccgcccgcttcatcatccacacagtgggccccaagtacaagagccgctacagaacagctgctgagagcagcctgtacagctgctacagaaatgtgctgcagctggccaaggagcagagcatgagctctgtgggcttctgtgtgatcaacagcgccaagaggggctaccccctggaggatgccacccacatcgccctgaggacagtgcggcgcttcctggagatccacggggagaccatcgagaaggtggtgtttgctgtgtctgacctggaggagggcacctaccagaagctgctgcccctgtacttccccaggagcctgaaggaggagaacagaagcctgccctacctgcctgctgacattggaaatgctgagggggagcctgtggtgcctgagcggcagatccgcatcagcgagaagccaggggcccctgaggacaaccaggaggaggaggatgagggcctgggcgtggacctgtccttcatcggcagccacgcctttgccaggatggagggggacatcgacaagcagaggaagctgatcctgcagggccagctgtctgaggccgccctgcagaagcagcaccagaggaactacaaccgctggctgtgccaggcccggtctgaggacctgagtgacatcgccagcctgaaggccctgtaccagacaggagtggacaactgtggccgcacagtgatggtggtggtgggcaggaacatccctgtgaccctgattgacatggacaaggccctgctgtacttcatccacgtgatggaccacatcgctgtgaaggagtatgtgctggtgtacttccacaccctgaccagcgagtacaaccacctggacagcgacttcctgaagaagctgtatgatgtggtggatgtgaagtacaagaggaacctgaaggctgtgtactttgtgcaccccaccttccgcagcaaggtgtccacctggttcttcaccaccttctctgtgtctggcctgaaggacaagatccaccacgtggacagcctgcaccagctgttcagcgccatcagccctgagcagattgacttccccccatttgtgctggagtatgatgcccgggtgcgcagcaccaggagcagccccagccctggcatggtgtactag

SEQ ID NO: 39024 - DNA, 1494 bp, Artificial Sequence
  Description of Artificial Sequence: Synthetic coding sequence
atggaccccctgggcgcccccagccagtttgtggatgtggacaccctgcccagctggggagacagctgccaggatgagctgaacagcagtgacaccacagctgagatcttccaggaggacacagtgcgcagccccttcctgtacaacaaggatgtgaatggcaaggtggtgctgtggaagggagatgtggccctgctgaactgcacagccatcgtgaacaccagcaatgaaagcctgacagacaagaaccctgtgtctgagagcatcttcatgctggccggccctgacctgaaggaggacctgcagaagctgaagggctgcaggactggagaggccaagctgaccaagggcttcaacctggccgcccgcttcatcatccacacagtgggccccaagtacaagagccgctacagaacagctgctgagagcagcctgtacagctgctacagaaatgtgctgcagctggccaaggagcagagcatgagctctgtgggcttctgtgtgatcaacagcgccaagaggggctaccccctggaggatgccacccacatcgccctgaggacagtgcggcgcttcctggagatccacggggagaccatcgagaaggtggtgtttgctgtgtctgacctggaggagggcacctaccagaagctgctgcccctgtacttccccaggagcctgaaggaggagaacagaagcctgccctacctgcctgctgacattggaaatgctgagggggagcctgtggtgcctgagcggcagatccgcatcagcgagaagccaggggcccctgaggacaaccaggaggaggaggatgagggcctgggcgtggacctgtccttcatcggcagccacgcctttgccaggatggagggggacatcgacaagcagaggaagctgatcctgcagggccagctgtctgaggccgccctgcagaagcagcaccagaggaactacaaccgctggctgtgccaggcccggtctgaggacctgagtgacatcgccagcctgaaggccctgtaccagacaggagtggacaactgtggccgcacagtgatggtggtggtgggcaggaacatccctgtgaccctgattgacatggacaaggccctgctgtacttcatccacgtgatggaccacatcgctgtgaaggagtatgtgctggtgtacttccacaccctgaccagcgagtacaaccacctggacagcgacttcctgaagaagctgtatgatgtggtggatgtgaagtacaagaggaacctgaaggctgtgtactttgtgcaccccaccttccgcagcaaggtgtccacctggttcttcaccaccttctctgtgtctggcctgaaggacaagatccaccacgtggacagcctgcaccagctgttcagcgccatcagccctgagcagattgacttccccccatttgtgctggagtatgatgccagagaaaatggcccctactacaccagctacccacccagcccagacctgtag

SEQ ID NO: 39025 - DNA, 384 bp, Artificial Sequence
  Description of Artificial Sequence: Synthetic coding sequence
atggccaagatcctggagcatgatgatgtgtcctacctgaagaagatcctgggggagctggccatggtgctggaccagattgaagctgagctggagaagaggaagctggagaatgaaggccagaagtgtgagctgtggctgtgtggctgtgccttcaccctggctgatgtgctgctgggcgccaccctgcaccggctgaagttcctgggcctgagcaagaagtactgggaggatggcagccggcccaacctgcagagcttctttgagcgggtgcagaggagatttgccttcaggaaggtgagccgctggaactgtggggactggctgggcagcgagggcaccctgccccaggacaaggctgacatcaagacccagctgctgtag

SEQ ID NO: 39026 - DNA, 1104 bp, Artificial Sequence
  Description of Artificial Sequence: Synthetic coding sequence
atggccacccccaacaacctgacccccaccaactgctcctggtggcccatcagcgccctggagagtgatgctgccaagccagctgaggccccagatgcccctgaggccgccagccctgcccactggccccgggagagcctggtgctgtaccactggacccagagcttcagcagccagaaggtgcggctggtgattgctgagaagggcctggtgtgtgaggagagagatgtgtccctgccccagagcgagcacaaggagccctggttcatgaggctgaacctgggggaggaggtgcctgtgatcatccaccgggacaacatcatcagtgactatgaccagatcattgattatgtggagaggaccttcaccggggagcacgtggtggccctgatgcctgaggtgggcagcctgcagcacgcccgggtgctgcagtaccgggagctgctggatgccctgcccatggatgcctacacccacggctgcatcctgcaccctgagctgaccacagacagcatgatccccaagtatgccacagctgagatccgccgccacctggccaatgccaccacagacctgatgaagctggaccacgaggaggagccccagctgtctgagccctacctgagcaagcagaagaagctgatggccaagatcctggagcatgatgatgtgtcctacctgaagaagatcctgggggagctggccatggtgctggaccagattgaagctgagctggagaagaggaagctggagaatgaaggccagaagtgtgagctgtggctgtgtggctgtgccttcaccctggctgatgtgctgctgggcgccaccctgcaccggctgaagttcctgggcctgagcaagaagtactgggaggatggcagccggcccaacctgcagagcttctttgagcgggtgcagaggagatttgccttcaggaaggtgctgggggacatccacaccaccctgctgtctgctgtgatccccaatgccttccggctggtgaagaggaagccacccagcttcttcggggccagcttcctgatgggcagcctgggcggcatgggctactttgcctactggtacctgaagaagaagtacatctag

SEQ ID NO: 39027 - DNA, 930 bp, Artificial Sequence
  Description of Artificial Sequence: Synthetic coding sequence
atggccacccccaacaacctgacccccaccaactgctcctggtggcccatcagcgccctggagagtgatgctgccaagccagctgaggccccagatgcccctgaggccgccagccctgcccactggccccgggagagcctggtgctgtaccactggacccagagcttcagcagccagaaggtgcggctggtgattgctgagaagggcctggtgtgtgaggagagagatgtgtccctgccccagagcgagcacaaggagccctggttcatgaggctgaacctgggggaggaggtgcctgtgatcatccaccgggacaacatcatcagtgactatgaccagatcattgattatgtggagaggaccttcaccggcggccacctggccaatgccaccacagacctgatgaagctggaccacgaggaggagccccagctgtctgagccctacctgagcaagcagaagaagctgatggccaagatcctggagcatgatgatgtgtcctacctgaagaagatcctgggggagctggccatggtgctggaccagattgaagctgagctggagaagaggaagctggagaatgaaggccagaagtgtgagctgtggctgtgtggctgtgccttcaccctggctgatgtgctgctgggcgccaccctgcaccggctgaagttcctgggcctgagcaagaagtactgggaggatggcagccggcccaacctgcagagcttctttgagcgggtgcagaggagatttgccttcaggaaggtgctgggggacatccacaccaccctgctgtctgctgtgatccccaatgccttccggctggtgaagaggaagccacccagcttcttcggggccagcttcctgatgggcagcctgggcggcatgggctactttgcctactggtacctgaagaagaagtacatctag

SEQ ID NO: 39028 - DNA, 1089 bp, Artificial Sequence
  Description of Artificial Sequence: Synthetic coding sequence
atggccacccccaacaacctgacccccaccaactgctcctggtggcccatcagcgccctggagagctgtggccaggccagcggcggccccaggaggagcagaggaggccagccccactggccccgggagagcctggtgctgtaccactggacccagagcttcagcagccagaaggtgcggctggtgattgctgagaagggcctggtgtgtgaggagagagatgtgtccctgccccagagcgagcacaaggagccctggttcatgaggctgaacctgggggaggaggtgcctgtgatcatccaccgggacaacatcatcagtgactatgaccagatcattgattatgtggagaggaccttcaccggggagcacgtggtggccctgatgcctgaggtgggcagcctggccaggactggagctgctgtgcgggagctgctggatgccctgcccatggatgcctacacccacggctgcatcctgcaccctgagctgaccacagacagcatgatccccaagtatgccacagctgagatcagaagacacctggccaatgccaccacagacctgatgaagctggaccacgaggaggagccccagctgtctgagccctacctgagcaagcagaagaagctgatggccaagatcctggagcatgatgatgtgtcctacctgaagaagatcctgggggagctggccatggtgctggaccagatcgagggcgctggggaggaggaggccggggagagaggagctgagatgagagctgtggccctgtggctgtgcctgcacgcagatgtgctgctgggcgccaccctgcaccggctgaagttcctgggcctgagcaagaagtactgggaggatggcagccggcccaacctgcagagcttctttgagcgggtgcagaggagatttgccttcaggaaggtgctgggggacatccacaccaccctgctgtctgctgtgatccccaatgccttccggctggtgaagaggaagcccccatccttctttggagccagcttcctgatgggcagcctgggcggcatgggctactttgcctactggtacctgaagaagaagtacatctag

SEQ ID NO: 39029 - DNA, 444 bp, Artificial Sequence
  Description of Artificial Sequence: Synthetic coding sequence
atggccacccccaacaacctgacccccaccaactgctcctggtggcccatcagcgccctggagagtgatgctgccaagccagctgaggccccagatgcccctgaggccgccagccctgcccactggccccgggagagcctggtgctgtaccactggacccagagcttcagcagccagaaggtgcggctggtgattgctgagaagggcctggtgtgtgaggagagagatgtgtccctgccccagagcgagcacaaggagccctggttcatgaggctgaacctgggggaggaggtgcctgtgatcatccaccgggacaacatcatcagtgactatgaccagatcattgattatgtggagaggaccttcaccggcggcccccggctggccgccagcctggagctgcggggggccaacccccggggccagctgggccgggcccagtag

SEQ ID NO: 39030 - DNA, 867 bp, Artificial Sequence
  Description of Artificial Sequence: Synthetic coding sequence
atggccacccccaacaacctgacccccaccaactgctcctggtggcccatcagcgccctggagagtgatgctgccaagccagctgaggccccagatgcccctgaggccgccagccctgcccactggccccgggagagcctggtgctgtaccactggacccagagcttcagcagccagaaggtgcggctggtgattgctgagaagggcctggtgtgtgaggagagagatgtgtccctgccccagagcgagcacaaggagccctggttcatgaggctgaacctgggggaggaggtgcctgtgatcatccaccgggacaacatcatcagtgactatgaccagatcattgattatgtggagaggaccttcaccggcggccacctggccaatgccaccacagacctgatgaagctggaccacgaggaggagccccagctgtctgagccctacctgagcaagcagaagaagctgatggccaagatcctggagcatgatgatgtgtcctacctgaagaagatcctgggggagctggccatggtgctggaccagattgaagctgagctggagaagaggaagctggagaatgaaggccagaagtgtgagctgtggctgtgtggctgtgccttcaccctggctgatgtgctgctgggcgccaccctgcaccggctgaagttcctgggcctgagcaagaagtactgggaggatggcagccggcccaacctgcagagcttctttgagcgggtgcagaggagatttgccttcaggaaggtgctgggggacatccacaccaccctgctgtctgctgtgatccccaatgccttccggctggtgaagaggaagccacccagcttcttcggggccagcttctag

SEQ ID NO: 39031 - DNA, 756 bp, Artificial Sequence
  Description of Artificial Sequence: Synthetic coding sequence
tgaagcttcagcagccagaaggtgcggctggtgattgctgagaagggcctggtgtgtgaggagagagatgtgtccctgccccagagcgagcacaaggagccctggttcatgaggctgaacctgggggaggaggtgcctgtgatcatccaccgggacaacatcatcagtgactatgaccagatcatcgactatgtggagaggaccttcaccggggagcacgtggtggccctgatgcctgaggtgggcagcctgcagcacgcccgggtgctgcagtaccgggagctgctggatgccctgcccatggatgcctacacccacggctgcatcctgcaccctgagctgaccacagacagcatgatccccaagtatgccacagctgagatcagaagacacctggccaatgccaccacagacctgatgaagctggaccacgaggaggagccccagctgtctgagccctacctgagcaagcagaagaagctgatggccaagatcctggagcatgatgatgtgtcctacctgaagaagatcctgggggagctggccatggtgctggaccagatcgaggccgagctggagaagaggaagctggagaatgaaggaggctgccagccctggggccgctggggcctgcagcccacccagcccaccctgcccctgcccagcctgagcctcttcttcccccagaagagccagaggaccagccaggtggtgaagaggatgggctatggagtgcggctgcgcttcaagagctag

SEQ ID NO: 39032 - DNA, 372 bp, Artificial Sequence
  Description of Artificial Sequence: Synthetic coding sequence
ctggagcatgatgatgtgtcctacctgaagaagatcctgggggagctggccatggtgctggaccagattgaagctgagctggagaagaggaagctggagaatgaaggccagaagtgtgagctgtggctgtgtggctgtgccttcaccctggctgatgtgctgctgggcgccaccctgcaccggctgaagttcctgggcctgagcaagaagtactgggaggatggcagccggcccaacctgcagagcttctttgagcgggtgcagaggagatttgccttcaggaaggtgagccgctggaactgtggggactggctgggcagcgagggcaccctgccccaggacaaggctgacatcaagacccagctgctgtag

SEQ ID NO: 39033 - DNA, 528 bp, Artificial Sequence
  Description of Artificial Sequence: Synthetic coding sequence
atgaagctggaccacgaggaggagccccagctgtctgagccctacctgagcaagcagaagaagctgatggccaagatcctggagcatgatgatgtgtcctacctgaagaagatcctgggggagctggccatggtgctggaccagattgaagctgagctggagaagaggaagctggagaatgaaggccagaagtgtgagctgtggctgtgtggctgtgccttcaccctggctgatgtgctgctgggcgccaccctgcaccggctgaagttcctgggcctgagcaagaagtactgggaggatggcagccggcccaacctgcagagcttctttgagcgggtgcagaggagatttgccttcaggaaggtgctgggggacatccacaccaccctgctgtctgctgtgatccccaatgccttccggctggtgaagaggaagccacccagcttcttcggggccagcttcctgatgggcagcctgggcggcatgggctactttgcctactggtacctgaagaagaagtacatctag

SEQ ID NO: 39034 - DNA, 1002 bp, Artificial Sequence
  Description of Artificial Sequence: Synthetic coding sequence
ccccggcgcagccggggcggccagccccactggccccgggagagcctggtgctgtaccactggacccagagcttcagcagccagaaggtgcggctggtgattgctgagaagggcctggtgtgtgaggagagagatgtgtccctgccccagagcgagcacaaggagccctggttcatgaggctgaacctgggggaggaggtgcctgtgatcatccaccgggacaacatcatcagtgactatgaccagatcatcgactatgtggagaggaccttcaccggggagcacgtggtggccctgatgcctgaggtgggcagcctggccaggactggagctgctgtgcgggagctgctggatgccctgcccatggatgcctacacccacggctgcatcctgcaccctgagctgaccacagacagcatgatccccaagtatgccacagctgagatccgccgccacctggccaatgccaccacagacctgatgaagctggaccacgaggaggagccccagctgtctgagccctacctgagcaagcagaagaagctgatggccaagatcctggagcatgatgatgtgtcctacctgaagaagatcctgggggagctggccatggtgctggaccagattgaaggagctggggaggaggaggccggggagagaggagctgagatgagagctgtggccctgtggctgtgcctgcatgctgatgtgctgctgggcgccaccctgcaccggctgaagttcctgggcctgagcaagaagtactgggaggatggcagccggcccaacctgcagagcttctttgagcgggtgcagaggagatttgccttcaggaaggtgctgggggacatccacaccaccctgctgtctgctgtgatccccaatgccttccggctggtgaagaggaagccacccagcttcttcggggccagcttcctgatgggcagcctgggcggcatgggctactttgcctactggtacctgaagaagaagtacatctag

SEQ ID NO: 39035 - DNA, 1302 bp, Artificial Sequence
  Description of Artificial Sequence: Synthetic coding sequence
atgggagactggagcttcctgggcaacatcctggaggaggtgaatgagcacagcacagtgattggccgggtgtggctgactgtgctcttcatcttccgcatcctgatcctgggcacagctgctgagtttgtgtggggagatgagcagagcgactttgtgtgcaacacccagcagcccggctgtgaaaatgtgtgctatgatgaggccttccccatcagccacatccggctgtgggtgctgcagatcatctttgtgtccacccccagcctgatgtatgtgggccatgctgtgcactacgtgaggatggaggagaagaggaagagccgggaggccgaggagctgggccagcaggccggcaccaatggaggccctgaccagggctctgtgaagaagagcagcggcagcaagggcaccaagaagttccggctggagggcaccctgctgcggacctacatctgccacatcatcttcaagaccctgtttgaggtgggcttcatcgtgggccactacttcctgtatggcttccgcatcctgcccctgtaccgctgcagccgctggccctgccccaacgtggtggactgctttgtgtcccggcccacagagaagaccatcttcatcctcttcatgctgtctgtggcctctgtgtccctcttcctgaatgtgatggagctgggccacctgggcctgaagggcatccgcagcgccctgaagaggcctgtggagcagcccctgggggagatccctgagaagagcctgcacagcattgctgtgagcagcatccagaaggccaagggctaccagctgctggaggaggagaagatcgtgagccactacttccccctgacagaggtgggcatggtggagaccagccccctgcctgccaagcccttcaaccagtttgaggagaagatcagcacaggccccctgggggacctgagccggggctaccaggagaccctgcccagctatgcccaggtgggcgcccaggaggtggagggggagggccccccagctgaggagggcgctgagcctgaggtgggggagaagaaggaggaggccgagcggctgaccacagaggagcaggagaaggtggccgtgcctgagggggagaaggtggagaccccaggagtggacaaggagggggagaaggaggagccccagagcgagaaggtgtccaagcagggcctgcctgctgagaagacccccagcctgtgcccagagctgaccacagatgatgcccggcccctgagccggctgagcaaggccagcagccgggcccggagtgatgacctgactgtgtag

SEQ ID NO: 39036 - DNA, 1455 bp, Artificial Sequence
  Description of Artificial Sequence: Synthetic coding sequence
atgggcagcgcctttgagcgggtggtgcggcgggtggtgcaggagctggaccacggcggggagttcatccctgtgaccagcctgcagagcagcacaggcttccagccctactgcctggtggtgaggaagcccagcagctcctggttctggaagccccgctacaagtgtgtgaacctgagcatcaaggacatcctggagccagatgctgctgagccagatgtgcagaggggccgctccttccacttctatgatgccatggatggccagatccagggctctgtggagctggccgcccctggccaggccaagattgctggaggagctgctgtgtctgacagcagcagcacctccatgaatgtgtacagcctgtctgtggaccccaacacctggcagaccctgctgcacgagcggcacctgcggcagcctgagcacaaggtgctgcagcagctgcggagcagaggagacaacgtgtatgtggtgacagaggtgctgcagacccagaaggaggtggaggtgaccaggacccacaagcgggagggcagcggccgcttcagcctgcccggggccacctgcctgcagggcgagggccagggccacctgagccagaagaagacagtgaccatccccagcggcagcaccctggccttccgggtggcccagctggtgattgacagcgacctggatgtgctgctcttcccagacaagaagcagaggaccttccagcccccagccaccggccacaagaggagcaccagcgagggcgcctggccccagctgcccagcggcctgtccatgatgcgctgcctgcacaacttcctgacagatggagtgcctgctgagggcgccttcacagaggacttccagggcctgcgggcagaggtggagaccatcagcaaggagctggagctgctggaccgggagctgtgccagctgctgctggagggcctggagggcgtgctgcgggaccagctggccctgcgggccctggaggaggccctggagcagggccagagcctgggccctgtggagcccctggatggccctgctggagctgtgctggagtgcctggtgctgagcagcggcatgctggtgcctgagctggccatccctgtggtgtacctgctgggcgccctgaccatgctgtctgagacccagcacaagctgctggccgaggccctggagagccagaccctgctgggccccctggagctggtgggcagcctgctggagcagagcgccccctggcaggagaggagcaccatgagcctgcccccaggcctgctgggcaacagctggggcgagggcgccccagcctgggtgctgctggatgaatgtggcctggagctgggggaggacacccctcatgtgtgctgggagccccaggcccagggccgcatgtgtgccctgtatgccagcctggccctgctgagcggcctgagccaggagccccactag

SEQ ID NO: 39037 - DNA, 345 bp, Artificial Sequence
  Description of Artificial Sequence: Synthetic coding sequence
atgggcagcgcctttgagcgggtggtgcggcgggtggtgcaggagctggaccacggcggggagttcatccctgtgaccagcctgcagagcagcacaggcttccagccctactgcctggtggtgaggaagcccagcagctcctggttctggaagccccgctacaagtgtgtgaacctgagcatcaaggacatcctggagccagatgctgctgagccagatgtgcagaggggccgctccttccacttctatgatgccatggatggccagatccagggctctgtggagctggccgcccctggccaggccaagattgctggaggagctgctgtgtctgacagcagctag

SEQ ID NO: 39038 - DNA, 1455 bp, Artificial Sequence; identical to SEQ ID NO: 39036
  Description of Artificial Sequence: Synthetic coding sequence

SEQ ID NO: 39039 - DNA, 147 bp, Artificial Sequence
  Description of Artificial Sequence: Synthetic coding sequence
atgggcagcgcctttgagcgggtggtgcggcgggtggtgcaggagctggaccacggcggggagttcatccctgtgaccagcctgcagagcagcacaggcttccagccctactgcctggtggtgaggaagcccagcagctcctggtag

SEQ ID NO: 39040 - DNA, 495 bp, Artificial Sequence
  Description of Artificial Sequence: Synthetic coding sequence
atgggcagcgcctttgagcgggtggtgcggcgggtggtgcaggagctggaccacggcggggagttcatccctgtgaccagcctgcagagcagcacaggcttccagccctactgcctggtggtgaggaagcccagcagctcctggttctggaagccccgctacaagtgtgtgaacctgagcatcaaggacatcctggagccagatgctgctgagccagatgtgcagaggggccgctccttccacttctatgatgccatggatggccagatccagggctctgtggagctggccgcccctggccaggccaagattgctggaggagctgctgtgtctgacagcagcagcacctccatgaatgtgtacagcctgtctgtggaccccaacacctggcagaccctgctgcacgagcggcacctgcggcagcctgagcacaaggtgctgcagcagctgcggagcagaggagacaacgtgtatgtggtgacagaggtgctgtag

SEQ ID NO: 39041 - DNA, 465 bp, Artificial Sequence
  Description of Artificial Sequence: Synthetic coding sequence
atgggcagcgcctttgagcgggtggtgcggcgggtggtgcaggagctggaccacggcggggagttcatccctgtgaccagcctgcagagcagcacaggcttccagccctactgcctggtggtgaggaagcccagcagctcctggttctggaagccccgctacaagtgtgtgaacctgagcatcaaggacatcctggagccagatgctgctgagccagatgtgcagaggggccgctccttccacttctatgatgccatggatggccagatccagggctctgtggagctggccgcccctggccaggccaagattgctggaggagctgctgtgtctgacagcagcagcacctccatgaatgtgtacagcctgtctgtggaccccaacacctggcagaccctgctgcacgagcggcacctgcggcagcctgagcacaaggtgctgcagcagctgcggagccggggctag

SEQ ID NO: 39042 - DNA, 810 bp, Artificial Sequence
  Description of Artificial Sequence: Synthetic coding sequence
atgcccctgggcctgaagcccacctgcagcgtgtgcaagaccaccagcagctccatgtggaagaagggggcccagggcgagatcctgtgccaccactgcaccggccggggcggggccggcagcggcggggccggcagcggggctgctgggggcaccggcggcagcggcggcggcggctttggagctgccacctttgccagcaccagcgccaccccaccccagagcaatggaggcggcggcggcaagcagagcaagcaggagatccaccggcgcagcgcccggctgaggaacaccaagtacaagagcgccccagctgctgagaagaaggtgtccaccaagggcaaaggaagaagacacatcttcaagctgaagaaccccatcaaggcccctgagagcgtgtccaccatcatcacagctgagagcatcttctacaagggcgtgtactaccagattggagatgtggtgtctgtgattgatgagcaggacggcaagccctactatgcccagatccggggcttcatccaggaccagtactgtgagaagtctgctgccctgacctggctgatccccaccctgagcagcccccgggaccagtttgatcctgccagctacatcatcggccctgaggaggacctgcccaggaagatggagtacctggagtttgtgtgccacgcccccagcgagtacttcaagagccgcagcagccccttccccaccgtgcccaccaggcctgagaagggctacatctggacccacgtgggccccaccccagccatcaccatcaaggagagcgtggccaaccacctgtag

SEQ ID NO: 39043 - DNA, 990 bp, Artificial Sequence
  Description of Artificial Sequence: Synthetic coding sequence
atggagctgcacatcctggagcaccggctgcaggtggcctctgtggccaatgaaagcatccccctcttcacctacggcctcatcaagctggccttcctgagcagcaagacccgctgcaagttcttcagcctgacagagaccccagaggactacaccatcatcgtggatgaggagggcttcctggagctgcccagcagcgagcacctgtctgtggctgatgccacctggctggccctgaatgtggtgtctgggggcggcagcttcagcagcagccagcccatcggcgtgaccaagatcgccaagagcgtcatcgcccccctggccgaccagaacatctctgtgttcatgctgagcacctaccagacagacttcatcctggtgcgggagcgggacctgccctttgtgacccacaccctgagcagcgagttcaccatcctgcgggtggtgaatggagaaacagtggccgctgagaacctgggcatcaccaatggatttgtgaagcccaagctggtgcagaggcctgtgatccaccccctgagcagccccagcaaccgcttctgtgtgaccagcctggaccctgacaccctgcctgctgtggccaccctgctgatggatgtgatgttctacagcaatggagtgaaggaccccatggccactggagatgactgtggccacatccgcttcttctccttcagcctcatcgagggctacatcagcctggtgatggatgtgcagacccagcagcgcttccccagcaacctgctcttcaccagcgccagcggggagctgtggaagatggtgagaattggaggccagcccctgggctttgatgaatgtggcatcgtggcccagatcagcgagcccctggccgctgctgacatcccagcctactacatcagcaccttcaagtttgaccacgccctggtgcctgaggagaacatcaatggagtcatcagcgccctgaaggtgtcccaggccgagaagcactag

SEQ ID NO: 39044 - DNA, 990 bp, Artificial Sequence
  Description of Artificial Sequence: Synthetic coding sequence
atggagctgcacatcctggagcaccggctgcaggtggcctctgtggccaaggagagcatccccctcttcacctacggcctcatcaagctggccttcctgagcagcaagacccgctgcaagttcttcagcctgacagagaccccagaggactacaccatcatcgtggatgaggagggcttcctggagctgcccagcagcgagcacctgtctgtggctgatgccacctggctggccctgaatgtggtgtctgggggcggcagcttcagcagcagccagcccatcggcgtgaccaagatcgccaagagcgtcatcgcccccctggccgaccagaacatctctgtgttcatgctgagcacctaccagacagacttcatcctggtgcgggagcgggacctgccctttgtgacccacaccctgagcagcgagttcaccatcctgcgggtggtgaatggagaaacagtggccgctgagaacctgggcatcaccaatggatttgtgaagcccaagctggtgcagaggcctgtgatccaccccctgagcagccccagcaaccgcttctgtgtgaccagcctggaccctgacaccctgcctgctgtggccaccctgctgatggatgtgatgttctacagcaatggagtgaaggaccccatggccactggagatgactgtggccacatccgcttcttctccttcagcctcatcgagggctacatcagcctggtgatggatgtgcagacccagcagcgcttccccagcaacctgctcttcaccagcgccagcggggagctgtggaagatggtgagaattggaggccagcccctgggctttgatgaatgtggcatcgtggcccagatcagcgagcccctggccgctgctgacatcccagcctactacatcagcaccttcaagtttgaccacgccctggtgcctgaggagaacatcaatggagtcatcagcgccctgaaggtgtcccaggccgagaagcactag

SEQ ID NO: 39045 - DNA, 990 bp, Artificial Sequence
  Description of Artificial Sequence: Synthetic coding sequence
atggagctgcacatcctggagcaccgggtgcgggtgctgtctgtggcccggcccggcctgtggctgtacacccaccccctcatcaagctgctcttcctgcccaggaggagccgctgcaagttcttcagcctgacagagaccccagaggactacaccctgatggtggatgaggagggcttcaaggagctgccccccagcgagttcctgcaggtggccgaggccacctggctggtgctgaatgtgagcagccacagcggggctgctgtgcaggccgccggcgtgaccaagatcgcccggagcgtcatcgcccccctggccgagcaccacgtgtctgtgctgatgctgagcacctaccagacagacttcatcctggtgcgggagcaggacctgtctgtggtgatccacaccctggcccaggagtttgacatctaccgggaggtgggcggggagcctgtgcctgtgaccagagatgacagcagcaatggcttccccaggacccagcacggccccagccccaccgtgcaccccatccagagcccccagaaccgcttctgtgtgctgaccctggaccctgagaccctgcctgccatcgccaccaccctgattgatgtgctcttctacagccacagcacccccaaggaggccgccagcagcagccctgagcccagcagcatcaccttctttgccttcagcctgattgagggctacatcagcatcgtgatggatgctgagacccagaagaagttccccagcgacctgctgctgaccagcagcagtggagagctgtggaggatggtgcgcatcggcggccagcccctgggctttgatgaatgtggcatcgtggcccagattgctggccccctggccgctgctgacatcagcgcctactacatcagcaccttcaactttgaccacgccctggtgcctgaagatggcatcggctctgtgattgaggtgctgcagaggcggcaggagggcctggccagctag

SEQ ID NO: 39046 - DNA, 492 bp, Artificial Sequence
  Description of Artificial Sequence: Synthetic coding sequence
atgagctgccggggccgcggggccggcggccgctggaacagcacctcctggagcacaggctgcaagctgcctgccagcccccggcgggtgagccgctgcagccccaccggcctcatcaagctggccttcctgttcagcaagacccgctgcaagttcttcagcctgacagagaccccagaggactacaccatcatcgtggatgaggagggcttcctggagctgcccagcagcgagcacctgtctgtggctgatgccacctggctggccctgaatgtggtgtctgggggcggcagcttcagcagcagccagcccatcggcatgaccaagatcgccaagtctgtgattgcccccctggccgaccagaacatcagcgtcttcatgctgagcacctaccagacagacttcatcctggtgctgaagagggacctgccctttgtgacccacaccctgagcagcgagttcaccatcctgtggagcgtggcccggctgtag

SEQ ID NO: 39047 - DNA, 1164 bp, Artificial Sequence
  Description of Artificial Sequence: Synthetic coding sequence
atgaaggccctgatcctggtgggcggctacggcacccggctgcggcccctgaccctgagcacccccaagcccctggtggacttctgcaacaagcccatcctgctgcaccaggtggaggccctggccgccgccggcgtggaccacgtgatcctggccgtgtcctacatgagccaggtgctggagaaggagatgaaggcccaggagcagaggctgggcatccgcatctccatgagccatgaggaggagcccctgggcacagctggccccctggccctggcccgggacctgctgtctgaaacagctgaccccttctttgtgctgaacagtgatgtgatctgtgacttccccttccaggccatggtgcagttccaccgccaccacggccaggagggcagcatcctggtgaccaaggtggaggagcccagcaaatatggagtggtggtgtgtgaggccgacaccggccgcatccacagatttgtggagaagccccaggtgtttgtgagcaacaagatcaatgccggcatgtacatcctgagccctgctgtgctgcagaggatccagctgcagcccaccagcattgagaaggaggtgttccccatcatggccaaggagggccagctgtatgccatggagctgcagggcttctggatggacatcggccagcccaaggacttcctgaccggcatgtgcctcttcctgcagagcctgcggcagaagcagcctgagcggctgtgcagcggccctggcatcgtgggcaatgtgctggtggaccccagcgcccgcatcggccagaactgcagcatcggccccaacgtgtccctgggccctggggtggtggtggaggatggagtgtgcatccgccgctgcaccgtgctgagagatgcccgcatccgcagccacagctggctggagagctgcatcgtgggctggcgctgccgggtgggccagtgggtgtccctgtgggccggcctgggcggggagagaggaggagaatgtgcctgcctgcctgacaaggcctaccccctgctggaggtgaggatggagaatgtgacagtgctgggagaagatgtgattgtgaatgatgagctgtacctgaatggagcctctgtgctgccccacaagagcatcggggagagcgtgcctgagccccgcatcatcatgtag

SEQ ID NO: 39048 - DNA, 1083 bp, Artificial Sequence
  Description of Artificial Sequence: Synthetic coding sequence
atgaaggccctgatcctggtgggcggctacggcacccggctgcggcccctgaccctgagcacccccaagcccctggtggacttctgcaacaagcccatcctgctgcaccaggtggaggccctggccgccgccggcgtggaccacgtgatcctggccgtgtcctacatgagccaggtgctggagaaggagatgaaggcccaggagcagaggctgggcatccgcatctccatgagccatgaggaggagcccctgggcacagctggccccctggccctggcccgggacctgctgtctgaaacagctgaccccttctttgtgctgaacagtgatgtgatctgtgacttccccttccaggccatggtgcagttccaccgccaccacggccaggagggcagcatcctggtgaccaaggtggaggagcccagcaaatatggagtggtggtgtgtgaggccgacaccggccgcatccacagatttgtggagaagccccaggtgtttgtgagcaacaagatcaatgccggcatgtacatcctgagccctgctgtgctgcagaggatccagctgcagcccaccagcattgagaaggaggtgttccccatcatggccaaggagggccagctgtatgccatggagctgcagggcttctggatggacatcggccagcccaaggacttcctgaccggcatgtgcctcttcctgcagagcctgcggcagaagcagcctgagcggctgtgcagcggccctggcatcgtgggcaatgtgctggtggaccccagcgcccgcatcggccagaactgcagcatcggccccaacgtgtccctgggccctggggtggtggtggaggatggagtgtgcatccgccgctgcaccgtgctgagagatgcccgcatccgcagccacagctggctggagagctgcatcgtgggctggcgctgccgggtgggccagtgggtgaggatggagaatgtgacagtgctgggggaggatgtgattgtgaatgatgagctgtacctgaatggagcctctgtgctgccccacaagagcattggagagagcgtgcctgagccccgcatcatcatgtag

SEQ ID NO: 39049 - DNA, 1083 bp, Artificial Sequence; identical to SEQ ID NO: 39048
  Description of Artificial Sequence: Synthetic coding sequence

SEQ ID NO: 39050 - DNA, 555 bp, Artificial Sequence
  Description of Artificial Sequence: Synthetic coding sequence
atggacctgggccccctgaacatctgtgaggagatgaccatcctgcacggcggcttcctgctggccgagcagctgttccaccccaaggccctggccgagctgaccaagagtgactgggagcgggtgggccggcccatcgtggaggccctgcgggagatcagcagcgctgctgcccacagccagccctttgcctggaagaagaaggccctgatcatcatctgggccaaggtgctgcagccccaccctgtgacccccagcgacacagagacccgctggcaggaggacctcttcttctctgtgggcaacatgatccccaccatcaaccacaccatcctgtttgagctgctgaagagcctggaggccagcggcctcttcatccagctgctgatggccctgcccaccaccatctgccacgccgagctggagcgcttcctggagcacgtgacagtggacaccagcgcagaagatgtggccttcttcctggatgtgtggtgggagaggaccaccccccggcgctgcctgcagccctgcatctggaccaactggcccaggtag

SEQ ID NO: 39051 - DNA, 1188 bp, Artificial Sequence
  Description of Artificial Sequence: Synthetic coding sequence
atggatgaggagcctgagaggaccaagcgctgggagggcggctatgaaagaacctgggagatcctgaaggaggatgaaagtggcagcctgaaggccaccatcgaggacatcctcttcaaggccaagaggaagagggtgtttgagcaccacggccaggtgcggctgggcatgatgaggcacctgtatgtggtggtggatggcagcaggaccatggaggaccaggacctgaagcccaaccggctgacctgcaccctgaagctgctggagtactttgtggaggagtactttgaccagaaccccatcagccagatcggcatcatcgtgaccaagagcaagagagctgagaagctgacagagctgagcggcaaccccaggaagcacatcaccagcctgaagaaggctgtggacatgacctgccacggggagcccagcctgtacaacagcctgagcatcgccatgcagaccctgaagcacatgcctggccacaccagccgggaggtgctgatcatcttcagcagcctgaccacctgtgaccccagcaacatctatgacctgatcaagaccctgaaggccgccaagatccgggtgtctgtgattggcctgtctgctgaggtgcgggtgtgcaccgtgctggcccgggagactggaggcacctaccacgtgatcctggatgagagccactacaaggagctgctgacccaccacgtgagccccccaccagccagcagcagcagcgagtgcagcctcatccgcatgggcttcccccagcacaccatcgccagcctgagtgaccaggatgccaagcccagcttctccatggcccacctggatggcaacacagagcccggcctgaccctgggcggctacttctgcccccagtgccgggccaagtactgtgagctgcctgtggagtgcaagatctgtggcctgaccctggtgtctgccccccacctggcccggagctaccaccacctgttccccctggatgccttccaggagatccccctggaggagtacaacggggagcgcttctgctacggctgccagggcgagctgaaggaccagcacgtgtatgtgtgtgctgtgtgccagaatgtgttctgtgtggactgtgatgtgtttgtgcatgacagcctgcactgctgccccggctgcatccacaagatcccagcccccagcggcgtgtag

SEQ ID NO: 39052 - DNA, 1188 bp, Artificial Sequence
  Description of Artificial Sequence: Synthetic coding sequence
atggatgaggagcctgagaggaccaagcgctgggagggcggctatgaaagaacctgggagatcctgaaggaggatgaaagtggcagcctgaaggccaccatcgaggacatcctcttcaaggccaagaggaagagggtgtttgagcaccacggccaggtgcggctgggcatgatgaggcacctgtatgtggtggtggatggcagcaggaccatggaggaccaggacctgaagcccaaccggctgacctgcaccctgaagctgctggagtactttgtggaggagtactttgaccagaaccccatcagccagatcggcatcatcgtgaccaagagcaagagagctgagaagctgacagagctgagcggcaaccccaggaagcacatcaccagcctgaaggaggccgtggacatgacctgccacggggagcccagcctgtacaacagcctgtccatggccatgcagaccctgaagcacatgcctggccacaccagccgggaggtgctgatcatcttcagcagcctgaccacctgtgaccccagcaacatctatgacctgatcaagaccctgaaggccgccaagatccgggtgtctgtgattggcctgtctgctgaggtgcgggtgtgcaccgtgctggcccgggagactggaggcacctaccacgtgatcctggatgagagccactacaaggagctgctgacccaccacctgagccccccaccagccagcagcagcagcgagtgcagcctcatccgcatgggcttcccccagcacaccatcgccagcctgagtgaccaggatgccaagcccagcttctccatggcccacctggatggcaacacagagcccggcctgaccctgggcggctacttctgcccccagtgccgggccaagtactgtgagctgcctgtggagtgcaagatctgtggcctgaccctggtgtctgccccccacctggcccggagctaccaccacctgttccccctggatgccttccaggagatccccctggaggagtacaacggggagcgcttctgctacggctgccagggcgagctgaaggaccagcacgtgtatgtgtgtgctgtgtgccagaatgtgttctgtgtggactgtgatgtgtttgtgcatgacagcctgcactgctgccccggctgcatccacaagatcccagcccccagcggcgtgtag

SEQ ID NO: 39053 - DNA, 537 bp, Artificial Sequence
  Description of Artificial Sequence: Synthetic coding sequence
cagtacatctgcagctttgaggactgcaagaagaccttcaagaagcaccagcagctgaagatccaccagtgccagcacaccaatgagcccctcttcaagtgcacccaggagggctgcggcaagcactttgccagccccagcaagctgaagagacatgccaaggcccacgagggctacgtgtgccagaagggctgcagctttgtggccaagacctggacagagctgctgaagcacgtgcgggagacccacaaggaggagagccggccctttgtgtgtgagcacgccggctgcggcaagacctttgccatgaagcagagcctgaccaggcatgctgtggtgcatgaccctgacaagaagaagatgaagctgaaggtgaagaagagccgggagaagaggagcctggccagccacctgagcggctacatcccccccaagaggaagcagggccagggcctgagcctgtgccagaatggagagagccccaactgtgtggaggacaagatgctgagcacagtggccgtgctgaccctgggctag

SEQ ID NO: 39054 - DNA, 1098 bp, Artificial Sequence
  Description of Artificial Sequence: Synthetic coding sequence
ctggaccccccagctgtggtggccgagagcgtgagcagcctgaccatcgcagatgccttcatcgctgctggggagagcagcgcccccaccccacccaggcctgccctgccccggcgcttcatctgcagcttcccagactgcagcgccaactacagcaaggcctggaagctggatgcccacctgtgcaagcacactggagagcggccctttgtgtgtgactatgagggctgcggcaaggccttcatccgggactaccacctgagccgccacatcctgacccacactggagagaagccctttgtgtgtgccgccaacggctgtgaccagaagttcaacaccaagagcaacctgaagaagcactttgagaggaagcatgagaaccagcagaagcagtacatctgcagctttgaggactgcaagaagaccttcaagaagcaccagcagctgaagatccaccagtgccagcacaccaatgagcccctcttcaagtgcacccaggagggctgcggcaagcactttgccagccccagcaagctgaagagacatgccaaggcccacgagggctacgtgtgccagaagggctgcagctttgtggccaagacctggacagagctgctgaagcacgtgcgggagacccacaaggaggagatcctgtgtgaggtgtgcaggaagaccttcaagaggaaggactacctgaagcagcacatgaagacccacgcccctgagagagatgtgtgccgctgcccccgggagggctgcggccgcacctacaccaccgtcttcaacctgcagagccacatcctgtccttccacgaggagagccggccctttgtgtgtgaacatgctggctgtgggaagacctttgccatgaagcagagcctgaccaggcatgctgtggtgcatgaccctgacaagaagaagatgaagctgaaggtgaagaagagccgggagaagaggagcctggccagccacctgagcggctacatcccccccaagaggaagcagggccagggcctgagcctgtgccagaatggagagagccccaactgtgtggaggacaagatgctgagcacagtggccgtgctgaccctgggctag

SEQ ID NO: 39055 - DNA, 1089 bp, Artificial Sequence
  Description of Artificial Sequence: Synthetic coding sequence
atgtctgaccccagccagctgacccagaatgtgtgcctgacccaggagatggagctgagcaaggccttcagcggccagaggaccctgctgagcgccatcctgtccatgctgagcctgtccttcagcaccaccagcctgctgagcaactactggtttgtgggcacccagaaggtgcccaagcccctgtgtgagaagggcctggccgccaagtgctttgacatgcctgtgtccctggatggagacaccaacaccagcacccaggaggtggtgcagtacaactgggagactggagatgaccgcttctccttccgctccttccgcagcggcatgtggctgagctgtgaggagaccgtggaggagcccgccctgctgcacccccagagctggaagcagttccgggccctgcggagcagcggcacagctgctgccaagggggagcgctgccgctccttcatcgagctgaccccaccagccaagcgggagatcctgtggctgagcctgggcacccagatcacctacatcggcctgcagttcatctccttcctgctgctgctgacagacctgctgctgactggaaatcctgcctgtggcctgaagctgagcgcctttgctgctgtgtcctctgtgctgagcggcctgctgggcatggtggcccacatgatgtacagccaggtgttccaggccaccgtgaacctgggccctgaggactggaggccccacgtgtggaactacggctgggccttctacatggcctggctgtccttcacctgctgcatggccagcgctgtgaccaccttcaacacctacaccaggatggtgctggagttcaagtgcaagcacagcaagagcttcaaggagaaccccaactgcctgccccaccaccaccagtgcttcccccggcggctgagcagcgctgcccccaccgtgggccccctgaccagctaccaccagtaccacaaccagcccatccacagcgtgtctgaaggagtggacttctacagcgagctgagaaataaaggcttccagagaggagccagccaggagctgaaggaggccgtgcgcagctctgtggaggaggagcagtgctag

SEQ ID NO: 39056 - DNA, 981 bp, Artificial Sequence
  Description of Artificial Sequence: Synthetic coding sequence
atggccaagatggagctgagcaaggccttcagcggccagaggaccctgctgagcgccatcctgtccatgctgagcctgtccttcagcaccaccagcctgctgagcaactactggtttgtgggcacccagaaggtgcccaagcccctgtgtgagaagggcctggccgccaagtgctttgacatgcctgtgtccctggatggagacaccaacaccagcacccaggaggtggtgcagtacaactgggagactggagatgaccgcttctccttccgctccttccgcagcggcatgtggctgagctgtgaggagaccgtggaggagcccggggagcgctgccgctccttcatcgagctgaccccaccagccaagcgggagatcctgtggctgagcctgggcacccagatcacctacatcggcctgcagttcatctccttcctgctgctgctgacagacctgctgctgactggaaatcctgcctgtggcctgaagctgagcgcctttgctgctgtgtcctctgtgctgagcggcctgctgggcatggtggcccacatgatgtacagccaggtgttccaggccaccgtgaacctgggccctgaggactggaggccccacgtgtggaactacggctgggccttctacatggcctggctgtccttcacctgctgcatggccagcgctgtgaccaccttcaacacctacaccaggatggtgctggagttcaagtgcaagcacagcaagagcttcaaggagaaccccaactgcctgccccaccaccaccagtgcttcccccggcggctgagcagcgctgcccccaccgtgggccccctgaccagctaccaccagtaccacaaccagcccatccacagcgtgtctgaaggagtggacttctacagcgagctgagaaataaaggcttccagagaggagccagccaggagctgaaggaggccgtgcgcagctctgtggaggaggagcagtgctag

SEQ ID NO: 39057 - DNA, 966 bp, Artificial Sequence
  Description of Artificial Sequence: Synthetic coding sequence
atgtctgaccccagccagctgacccagaatgtgtgcctgacccaggagatggagctgagcaaggccttcagcggccagaggaccctgctgagcgccatcctgtccatgctgagcctgtccttcagcaccaccagcctgctgagcaactactggtttgtgggcacccagaaggtgcccaagcccctgtgtgagaagggcctggccgccaagtgctttgacatgcctgtgtccctggatggagacaccaacaccagcacccaggaggtggtgcagtacaactgggagactggagatgaccgcttctccttccgctccttccgcagcggcatgtggctgagctgtgaggagaccgtggaggagcccgccctgctgcacccccagagctggaagcagttccgggccctgcggagcagcggcacagctgctgccaagggggagcgctgccgctccttcatcgagctgaccccaccagccaagagaggagagaagggcctgctggagtttgccaccctgcagggcccctgccaccccaccctgcgctttggaggcaagaggctgatggagaaggccagcctgcccagcccccccctgggcctgtgtgggaagaaccccatggtgattcctggaaatgctgaccacctgcacaggaccagcatccaccagctgcccccagccaccaaccggctggccacccactgggagccctgcctgtgggcccagacagagcggctgtgctgctgcttcctgtgccctgtgcgcagccctggagatggcggcccccatgatgtgttcaccagcctgcccagcgactgccagctgggcagccggcggctggagaccacctgcctggagctgtggctgggcctgctgcacggcctggccctgctgcacctgctgcacggcgtgggctgccaccacctgcagcacgtgcaccaggatggagctggggtgcaggtgcaggcctag

SEQ ID NO: 39058 - DNA, 858 bp, Artificial Sequence
  Description of Artificial Sequence: Synthetic coding sequence
atggccaagatggagctgagcaaggccttcagcggccagaggaccctgctgagcgccatcctgtccatgctgagcctgtccttcagcaccaccagcctgctgagcaactactggtttgtgggcacccagaaggtgcccaagcccctgtgtgagaagggcctggccgccaagtgctttgacatgcctgtgtccctggatggagacaccaacaccagcacccaggaggtggtgcagtacaactgggagactggagatgaccgcttctccttccgctccttccgcagcggcatgtggctgagctgtgaggagaccgtggaggagcccggggagcgctgccgctccttcatcgagctgaccccaccagccaagagaggagagaagggcctgctggagtttgccaccctgcagggcccctgccaccccaccctgcgctttggaggcaagaggctgatggagaaggccagcctgcccagcccccccctgggcctgtgtgggaagaaccccatggtgattcctggaaatgctgaccacctgcacaggaccagcatccaccagctgcccccagccaccaaccggctggccacccactgggagccctgcctgtgggcccagacagagcggctgtgctgctgcttcctgtgccctgtgcgcagccctggagatggcggcccccatgatgtgttcaccagcctgcccagcgactgccagctgggcagccggcggctggagaccacctgcctggagctgtggctgggcctgctgcacggcctggccctgctgcacctgctgcacggcgtgggctgccaccacctgcagcacgtgcaccaggatggagctggggtgcaggtgcaggcctag

SEQ ID NO: 39059 - DNA, 888 bp, Artificial Sequence
  Description of Artificial Sequence: Synthetic coding sequence
atggagctgagcaaggccttcagcggccagaggaccctgctgagcgccatcctgtccatgctgagcctgtccttcagcaccaccagcctgctgagcaactactggtttgtgggcacccagaaggtgcccaagcccctgtgtgagaagggcctggccgccaagtgctttgacatgcctgtgtccctggatggagacaccaacaccagcacccaggaggtggtgcagtacaactgggagactggagatgaccgcttctccttccgctccttccgcagcggcatgtggctgagctgtgaggagaccgtggaggagcccgccctgctgcacccccagagctggaagcagttccgggccctgcggagcagcggcacagctgctgccaagggggagcgctgccgctccttcatcgagctgaccccaccagccaagaggggcctgctgggcatggtggcccacatgatgtacagccaggtgttccaggccaccgtgaacctgggccctgaggactggaggcctcatgtgtggaactacggctgggccttctacatggcctggctgtccttcacctgctgcatggccagcgctgtgaccaccttcaacacctacaccaggatggtgctggagttcaagtgcaagcacagcaagagcttcaaggagaaccccaactgcctgccccaccaccaccagtgcttcccccggcggctgagcagcgctgcccccaccgtgggccccctgaccagctaccaccagtaccacaaccagcccatccacagcgtgtctgagggcgtggacttctacagcgagctgaggaacaagggcttccagagaggagccagccaggagctgaaggaggccgtgcgcagctctgtggaggaggagcagtgctag

SEQ ID NO: 39060 - DNA, 1023 bp, Artificial Sequence
  Description of Artificial Sequence: Synthetic coding sequence
atggagctgagcaaggccttcagcggccagaggaccctgctgagcgccatcctgtccatgctgagcctgtccttcagcaccaccagcctgctgagcaactactggtttgtgggcacccagaaggtgcccaagcccctgtgtgagaagggcctggccgccaagtgctttgacatgcctgtgtccctggatggagacaccaacaccagcacccaggaggtggtgcagtacaactgggagactggagatgaccgcttctccttccgctccttccgcagcggcatgtggctgagctgtgaggagaccgtggaggagcctggagagcgctgccgctccttcatcgagctgaccccaccagccaagagaggagagaagggcctgctggagtttgccaccctgcagggcccctgccaccccaccctgcgctttggaggcaagaggctgatggagaaggccagcctgcccagcccccccctgggcctgtgtgggaagaaccccatggtgattcctggaaatgctgaccacctgcacaggaccagcatccaccagctgcccccagccaccaaccggctggccacccactgggagccctgcctgtgggcccagacagagcggctgtgctgctgcttcctgtgccctgtgcgcagccctggagatggcggcccccatgatgtgttcaccagcctgcccagcgactgccagctgggcagccggcggctggagaccacctgcctggagctgtggctgggcctgctgcacggcctggccctgctgcacctgctgcatggagtgggctgccaccacctgcagcacgaccaccaccagtgcttcccccggcggctgagcagcgctgcccccaccgtgggccccctgaccagctaccaccagtaccacaaccagcccatccacagcgtgtctgaaggagtggacttctacagcgagctgagaaataaaggcttccagagaggagccagccaggagctgaaggaggccgtgcgcagctctgtggaggaggagcagtgctag

SEQ ID NO: 39061 - DNA, 1020 bp, Artificial Sequence
  Description of Artificial Sequence: Synthetic coding sequence
atgtctgaccccagccagctgacccagaatgtgtgcctgacccaggagatggagctgagcaaggccttcagcggccagaggaccctgctgagcgccatcctgtccatgctgagcctgtccttcagcaccaccagcctgctgagcaactactggtttgtgggcacccagaaggtgcccaagcccctgtgtgagaagggcctggccgccaagtgctttgacatgcctgtgtccctggatggagacaccaacaccagcacccaggaggtggtgcagtacaactgggagactggagatgaccgcttctccttccgctccttccgcagcggcatgtggctgagctgtgaggagaccgtggaggagcctggagagcgctgccgctccttcatcgagctgaccccaccagccaagcgggagatcctgtggctgagcctgggcacccagatcacctacatcggcctgcagttcatctccttcctgctgctgctgacagacctgctgctgaccggcaacccagcctgtggcctgaagctgagcgcctttgctgctgtgtcctctgtgctgagcggcctgctgggcatggtggcccacatgatgtacagccaggtgttccaggccaccgtgaacctgggccctgaggactggaggcctcatgtgtggaactacggctgggccttctacatggcctggctgtccttcacctgctgcatggccagcgctgtgaccaccttcaacacctacaccaggatggtgctggagttcaagtgcaagcacagcaagagcttcaaggagaaccccaactgcctgccccaccaccaccagtgcttcccccggcggctgagcagcgctgcccccaccgtgggccccctgaccagctaccaccagtaccacaaccagcccatccacagcgtgtctgagggcgtggacttctacagcgagctgaggaacaagggcttccagagaggagccagccaggagctgaaggaggccgtgcgcagctctgtggaggaggagcagtgctag

SEQ ID NO: 39062 - DNA, 828 bp, Artificial Sequence
  Description of Artificial Sequence: Synthetic coding sequence
atggccaagatggagctgagcaaggccttcagcggccagaggaccctgctgagcgccatcctgtccatgctgagcctgtccttcagcaccaccagcctgctgagcaactactggtttgtgggcacccagaaggtgcccaagcccctgtgtgagaagggcctggccgccaagtgctttgacatgcctgtgtccctggatggagacaccaacaccagcacccaggaggtggtgcagtacaactgggagactggagatgaccgcttctccttccgctccttccgcagcggcatgtggctgagctgtgaggagaccgtggaggagcccggggagcgctgccgctccttcatcgagctgaccccaccagccaagaggggcctgctgggcatggtggcccacatgatgtacagccaggtgttccaggccaccgtgaacctgggccctgaggactggaggcctcatgtgtggaactacggctgggccttctacatggcctggctgtccttcacctgctgcatggccagcgctgtgaccaccttcaacacctacaccaggatggtgctggagttcaagtgcaagcacagcaagagcttcaaggagaaccccaactgcctgccccaccaccaccagtgcttcccccggcggctgagcagcgctgcccccaccgtgggccccctgaccagctaccaccagtaccacaaccagcccatccacagcgtgtctgagggcgtggacttctacagcgagctgaggaacaagggcttccagagaggagccagccaggagctgaaggaggccgtgcgcagctctgtggaggaggagcagtgctag

SEQ ID NO: 39063 - DNA, 897 bp, Artificial Sequence
  Description of Artificial Sequence: Synthetic coding sequence
atggccaagatggagctgagcaaggccttcagcggccagaggaccctgctgagcgccatcctgtccatgctgagcctgtccttcagcaccaccagcctgctgagcaactactggtttgtgggcacccagaaggtgcccaagcccctgtgtgagaagggcctggccgccaagtgctttgacatgcctgtgtccctggatggagacaccaacaccagcacccaggaggtggtgcagtacaactgggagactggagatgaccgcttctccttccgctccttccgcagcggcatgtggctgagctgtgaggagaccgtggaggagcccgccctgctgcacccccagagctggaagcagttccgggccctgcggagcagcggcacagctgctgccaagggggagcgctgccgctccttcatcgagctgaccccaccagccaagaggggcctgctgggcatggtggcccacatgatgtacagccaggtgttccaggccaccgtgaacctgggccctgaggactggaggccccacgtgtggaactacggctgggccttctacatggcctggctgtccttcacctgctgcatggccagcgctgtgaccaccttcaacacctacaccaggatggtgctggagttcaagtgcaagcacagcaagagcttcaaggagaaccccaactgcctgccccaccaccaccagtgcttcccccggcggctgagcagcgctgcccccaccgtgggccccctgaccagctaccaccagtaccacaaccagcccatccacagcgtgtctgaaggagtggacttctacagcgagctgagaaataaaggcttccagagaggagccagccaggagctgaaggaggccgtgcgcagctctgtggaggaggagcagtgctag

SEQ ID NO: 39064 - DNA, 462 bp, Artificial Sequence
  Description of Artificial Sequence: Synthetic coding sequence
atgtctgagagcctggtggtgtgtgatgtggccgaggacctggtggagaagctgaggaagttccgcttcaggaaggagaccaacaatgctgccatcatcatgaagattgacaaggacaagaggctggtggtgctggatgaggagctggagggcatcagcccagatgagctgaaggatgagctgcctgagcggcagccccgcttcatcgtgtacagctacaagtaccagcatgatgatggccgggtgtcctaccccctgtgcttcatcttcagcagccctgtgggctgcaagccagagcagcagatgatgtatgccggcagcaagaacaagctggtgcagacagctgagctgaccaaggtgtttgagatccggaacacagaggacctgacagaggagtggctgcgggagaagctgttcttcaccaacgtgaacttctgtgtgtccaaggtgttcatgtactag

SEQ ID NO: 39065 - DNA, 429 bp, Artificial Sequence
  Description of Artificial Sequence: Synthetic coding sequence
atgtctgagagcctggtggtgtgtgatgtggccgaggacctggtggagaagctgaggaagttccgcttcaggaaggagaccaacaatgctgccatcatcatgaagattgacaaggacaagaggctggtggtgctggatgaggagctggagggcatcagcccagatgagctgaaggatgagctgcctgagcggcagccccgcttcatcgtgtacagctacaagtaccagcatgatgatggccgggtgtcctaccccctgtgcttcatcttcagcagccctgtgggctgcaagccagagcagcagatgatgtatgccggcagcaagaacaagctggtgcagacagctgagctgaccaaggtgtttgagatccggaacacagaggacctgacagaggagtggctgcgggagaagctgggcttcttccactag

SEQ ID NO: 39066 - DNA, 1785 bp, Artificial Sequence
  Description of Artificial Sequence: Synthetic coding sequence
atggctgtggaggagctgcagagcatcatcaagcgctgccagatcctggaggagcaggacttcaaggaggaggactttggcctcttccagctggccggccagcgctgcatcgaggagggccacacagaccagctgctggagatcatccagaatgagaagaacaaggtgatcatcaagaacatgggctggaacctggtgggccctgtggtgcgctgcctgctgtgcaaggacaaggaggacagcaagaggaaggtgtacttcctgatctttgacctgctggtgaagctgtgcaaccccaaggagctgctgctgggcctgctggagctgattgaggagcccagcggcaagcagatcagccagagcatcctgctgctgctgcagcccctgcagaccgtcatccagaagctgcacaacaaggcctacagcatcggcctggccctgagcaccctgtggaaccagctgagcctgctgcctgtgccctacagcaaggagcagatccagatggatgattatggcctgtgccagtgctgcaaggccctgattgagttcaccaagccctttgtggaggaggtgattgacaacaaggagaacagcctggagaatgagaagctgaaggatgagctgctgaagttctgcttcaagagcctgaagtgccccctgctgacagcccagttctttgagcagagcgaggagggcggcaatgaccccttccgctactttgccagcgagatcatcggcttcctgagcgccatcggccaccccttccccaagatgatcttcaaccacggcaggaagaagaggacctggaactacctggagtttgaggaggaggagaacaagcagctggccgacagcatggccagcctggcctacctggtgtttgtgcagggcatccacatcgaccagctgcccatggtgctgagccccctgtacctgctgcagttcaacatgggccacatcgaggtgttcctgcagaggacagaggagagcgtcatcagcaagggcctggagctgctggagaacagcctgctgagaattgaggacaacagcctgctgtaccagtacctggagatcaagagcttcctgactgtgccccagggcctggtgaaggtgatgaccctgtgccccatcgagaccctgaggaagaagagcctggccatgctgcagctgtacatcaacaagctggacagccagggcaagtacaccctcttccgctgcctgctgaacaccagcaaccacagcggcgtggaggccttcatcatccagaacatcaagaaccagattgacatgagcctgaagaggaccaggaacaacaagtggttcaccggcccccagctgatcagcctgctggacctggtgctcttcctgcctgagggcgctgagacagacctgctgcagaacagcgaccgcatcatggccagcctgaacctgctgcgctacctggtgatcaaggacaatgaaaatgacaaccagacaggcctgtggacagagctgggcaacatcgagaacaacttcctgaagcccctgcacatcggcctgaacatgagcaaggcccactatgaggccgagatcaagaacagccaggaggcccagaagagcaaggacctgtgcagcatcaccgtgtctggagaggagatccccaacatgcctcctgagatgcagctgaaggtgctgcacagcgccctcttcacctttgacctgattgagagcgtgctggcccgggtggaggagctgattgagatcaagaccaagagcaccagtgaagaaaatattggcatcaagtag

SEQ ID NO: 39067 - DNA, 1743 bp, Artificial Sequence
  Description of Artificial Sequence: Synthetic coding sequence
atggctgtggaggagctgcagagcatcatcaagcgctgccagatcctggaggagcaggacttcaaggaggaggactttggcctcttccagctggccggccagcgctgcatcgaggagggccacacagaccagctgctggagatcatccagaatgagaagaacaaggtgatcatcaagaacatgggctggaacctggtgggccctgtggtgcgctgcctgctgtgcaaggacaaggaggacagcaagaggaaggtgtacttcctgatctttgacctgctggtgaagctgtgcaaccccaaggagctgctgctgggcctgctggagctgattgaggagcccagcggcaagcagatcagccagagcatcctgctgctgctgcagcccctgcagaccgtcatccagaagctgcacaacaaggcctacagcatcggcctggccctgagcaccctgtggaaccagctgagcctgctgcctgtgccctacagcaaggagcagatccagatggatgattatggcctgtgccagtgctgcaaggccctgattgagttcaccaagccctttgtggaggaggtgattgacaacaaggagaacagcctggagaatgagaagctgaaggatgagctgctgaagttctgcttcaagagcctgaagtgccccctgctgacagcccagttctttgagcagagcgaggagggcggcaatgaccccttccgctactttgccagcgagatcatcggcttcctgagcgccatcggccaccccttccccaagatgatcttcaaccacggcaggaagaagaggacctggaactacctggagtttgaggaggaggagaacaagcagctggccgacagcatggccagcctggcctacctggtgtttgtgcagggcatccacatcgaccagctgcccatggtgctgagccccctgtacctgctgcagttcaacatgggccacatcgaggtgttcctgcagaggacagaggagagcgtcatcagcaagggcctggagctgctggagaacagcctgctgagaattgaggacaacagcctgctgtaccagtacctggagatcaagagcttcctgactgtgccccagaggaagaagagcctggccatgctgcagctgtacatcaacaagctggacagccagggcaagtacaccctcttccgctgcctgctgaacaccagcaaccacagcggcgtggaggccttcatcatccagaacatcaagaaccagattgacatgagcctgaagaggaccaggaacaacaagtggttcaccggcccccagctgatcagcctgctggacctggtgctcttcctgcctgagggcgctgagacagacctgctgcagaacagcgaccgcatcatggccagcctgaacctgctgcgctacctggtgatcaaggacaatgaaaatgacaaccagacaggcctgtggacagagctgggcaacatcgagaacaacttcctgaagcccctgcacatcggcctgaacatgagcaaggcccactatgaggccgagatcaagaacagccaggaggcccagaagagcaaggacctgtgcagcatcaccgtgtctggagaggagatccccaacatgcctcctgagatgcagctgaaggtgctgcacagcgccctcttcacctttgacctgattgagagcgtgctggcccgggtggaggagctgattgagatcaagaccaagagcaccagtgaagaaaatattggcatcaagtag

SEQ ID NO: 39068 - DNA, 768 bp, Artificial Sequence
  Description of Artificial Sequence: Synthetic coding sequence
aatggcaagacagtgcaggtgctgcccagcgccctgagcaccatgtttggcatcgacagctgcccctactacgtgctggagaaccactacatcaccacccccctgagcacagaggaggccgccttccccctggcctacgtgatgaccatcagccaggactttgacacctttgagtggctgttctgggccatctacatgccccagaatgtgtactgcatccacgtggacaaggccgccaccatcgacttcaagattgctgtgtctgagctgctggagtgcttcagcaatgccttcatcagcagccagagcgagtacatcatctacggcggcaagagccggctgcaggccgacctggcctgcatgagggacctgattgccagcacagtgcagtggaggtatgtgaccaacacaggagaccatgacttccccctgaagaccaaccgggagatcgtgcagtacctgaagaccatgaactggaccaacatcacccccaacctggtgtctgtgctgaagagcacagagcgcatcaagtacacccaccgggagtaccgcacccgggcccacgcctttgtgctgaagaagcacaagaagaagagccccccaccccggcagctgaagatccacttcggcagcagctatgtggccctgacccgggagtttgtgcactttgccctgtacaacaagatcgccatcgagctgctgcagaggagccaggacacctacagcccagacaagcacttctggatcaccctgaacaacatcccctag

SEQ ID NO: 39069 - DNA, 1176 bp, Artificial Sequence
  Description of Artificial Sequence: Synthetic coding sequence
atgaaggtgtggagctgctacctgtgcatcatcaccctgcagatcatcatcatcgtgacagtgctgtacaacgtgcacgtgtcccagcctgacagcggccagattgatgatgtgggcggggagtaccaggccctgagccggctgcacatctgtgatgctgccctgaatggcaagacagtgcaggtgctgcccagcgccctgagcaccatgtttggaattgacagctgcccctactacgtgctggagaaccactacatcaccacccccctgagcacagaggaggccgccttccccctggcctacgtgatgaccatcagccaggactttgacacctttgagtggctgttctgggccatctacatgccccagaatgtgtactgcatccacgtggacaaggccgccaccatcgacttcaagattgctgtgtctgagctgctggagtgcttcagcaatgccttcatcagcagccagagcgagtacatcatctatggaggcaagagccggctgcaggccgacctggcctgcatgagggacctgattgccagcacagtgcagtggaggtatgtgaccaacacaggagaccatgacttccccctgaagaccaaccgggagatcgtgcagtacctgaagaccatgaactggaccaacatcacccccaacctggtgtctgtgctgaagagcacagagcgcatcaagtacacccaccgggagtaccgcacccgggcccacgcctttgtgctgaagaagcacaagaagaagagccccccaccccggcagctgaagatccacttcggcagcagctatgtggccctgacccgggagtttgtgcactttgccctgtacaacaagatcgccatcgagctgctgcagaggagccaggacacctacagcccagacaagcacttctggatcaccctgaacaacatccctgtggagtgcaccggcccctggatcctggccgtgaacagcggcagctgccagaacagacacatctgcccccggggcctggagttccagcagcagtaccctgtgaacagctttggaggcaacaactgcagcattgctgctggaacagctgccccccgggaggccctgggccccttccacctgaaggccgcctgcagcgcccaccagaacaagtggggcttctggaactgctacctgcacctgaagtag

SEQ ID NO: 39070 - DNA, 909 bp, Artificial Sequence
  Description of Artificial Sequence: Synthetic coding sequence
atgtgcctgcagcccctgcaggagcagaagcagtgggccctggatggagctgagtaccgcaccatccaggccaactgcacaggaactggaattggctacaacatcatctgggtgcccatggccagctgtgacttcagcatccgcacctacacctatgctgacaccccagatgacttccagctgcacaacttcagcctgcctgaggaggacaccaagctgaagatccccctcatccaccgggccctgcagctggcccagaggcctgtgtccctgctggccagcccctggaccagccccacccggctgaagaccaagggagctggaaatggcaagggccccctgaagggccagccccgggacatctaccaccagacctgggcccgctacatcgtgaagttcctggatgcctatgcagagcacaagctgcagttctgggccgtgacagcagaaaatgagcccagcgctggcctgctgagcggctaccccttccagtgcctgggcttcaccccagagcaccagagggacttcatcgcccgggacctgggccccaccctggccaacggcacccaccacaacgtgcggctgctgatgctggatgaccagaggctgctgctgccccactgggccaaggtggtgctgacagatcctgaggccgccaagtatgtgcatggaattgctgtgcactggtacctggacttcctggccccagccaaggccaccctgcgggagacccaccacctgttccccaacaccatgctgtttgccagcgaggcctgtgtgggcagcaagttctgggagcagagcgtgcggctgggctcctgggaccggggcatgcagtacagccacagcatcatcaccaacctgctgtaccacgtggtgggctggacagactggaaccccagcctgtag

SEQ ID NO: 39071 - DNA, 1080 bp, Artificial Sequence
  Description of Artificial Sequence: Synthetic coding sequence
atgtgcctgcagcccctgcaggagcagaagcagtgggccctggatggagctgagtaccgcaccatccaggccaactgcacaggaactggaattggctacaacatcatctgggtgcccatggccagctgtgacttcagcatccgcacctacacctatgctgacaccccagatgacttccagctgcacaacttcagcctgcctgaggaggacaccaagctgaagatccccctcatccaccgggccctgcagctggcccagaggcctgtgtccctgctggccagcccctggaccagccccacccggctgaagaccaagggagctggaaatggcaagggccccctgaagggccagccccgggacatctaccaccagacctgggcccgctacatcgtgaagttcctggatgcctatgcagagcacaagctgcagttctgggccgtgacagcagaaaatgagcccagcgctggcctgctgagcggctaccccttccagtgcctgggcttcaccccagagcaccagagggacttcatcgcccgggacctgggccccaccctggccaacggcacccaccacaacgtgcggctgctgatgctggatgaccagaggctgctgctgccccactgggccaaggtggtgctgacagatcctgaggccgccaagggcctgtgtggcttccaggtgctgggcgcagaatgtgccgcccggctgctgggcagcagagatgctgtgcagccccagcaccaccacaagccccctgtgccctgtggccgcctggaccggctggagcccatcatcgtggacatcaccaagcacaccttctacaagcagcccatgttctaccacctgggccacttcagcaagttcatccctgagggcagccagagggtgggcctggtggccagccagaagaatgaccctgatgctgtggccctgatgcacccagatggcagccctgtggtggtggtgctgaacagaagcagcaaggatgtgcccctgaccatcaaggaccctgctgtgggcttcctggagaccatcagccctggctacagcatccacacctacctgtggaggcggcagtag

SEQ ID NO: 39072 - DNA, 1566 bp, Artificial Sequence
  Description of Artificial Sequence: Synthetic coding sequence
atgagcagtgacagcgaccggcagtgccctgtggatggagacatcgaccagcaggagatgatccccagcaagaagaatgctgtgctggtggatggagtggtgctgaatggccccaccacagatgccaaggccggggagaagtttgtggaggaggcctgccgcctcatcatggaggaggtggtgctgaaggccacagatgtgaatgagaaggtgtgtgagtggaggcctcctgagcagctgaagcagctgctggacctggagatgagggacagcggggagcccccccacaagctgctggagctgtgcagagatgtgatccactacagcgtgaagaccaaccacccccgcttcttcaaccagctgtatgccggcctggactactacagcctggtggcccgcttcatgacagaggccctgaaccccagcgtgtacacctatgaggtgtcccctgtgttcctgctggtggaggaggccgtgctgaagaagatgattgagttcatcggctggaaggagggagatggcatcttcaaccctgggggctctgtgagcaacatgtatgccatgaacctggcccgctacaagtactgcccagacatcaaggagaagggcctgagcggcagccccaggctcatcctcttcaccagcgctgagtgccactacagcatgaagaaggccgccagcttcctgggcattggaacagaaaatgtgtgctttgtggagacagatggccggggcaagatgatccctgaggagctggagaagcaggtgtggcaggccaggaaggagggcgccgcccccttcctggtgtgtgccaccagcggcaccaccgtgctgggcgcctttgaccccctggatgaaattgctgacatctgtgagcggcacagcctgtggctgcacgtggatgcctcctggggcggcagcgccctgatgagcaggaagcacaggaagctgctgcacggcatccacagagctgacagcgtggcctggaacccccacaagatgctgatggccggcatccagtgctgtgccctgctggtgaaggacaagagtgacctgctgaagaagtgctacagcgccaaggccagctacctgttccagcaggacaagttctatgatgtgtcctatgacacaggagacaagagcatccagtgcagccggcggccagatgccttcaagttctggatgacctggaaggccctgggcaccctgggcctggaggagcgggtgaacagagccctggccctgagccgctacctggtggatgagatcaagaagcgggagggcttcaagctgctgatggagccagaatatgccaacatctgcttctggtacatcccccccagcctgcgggagatggaggagggccctgagttctgggccaagctgaacctggtggccccagccatcaaggagaggatgatgaagaagggcagcctgatgctgggctaccagccccaccggggcaaggtgaacttcttccggcaggtggtgatcagcccccaggtgtcccgggaggacatggacttcctgctggatgaaattgacctgctgggcaaggacatgtag

SEQ ID NO: 39073 - DNA, 1116 bp, Artificial Sequence
  Description of Artificial Sequence: Synthetic coding sequence
atgagccatgagaagagcttcctggtgtctggggacaactaccccccacccaaccctggctacccaggcggcccccagccccccatgccaccctatgcccagcccccctacccaggggccccctacccccagccccccttccagcccagcccctacggccagcccggctacccccacggccccagcccctacccccagggcggctacccccagggcccctacccccagggcggctacccccagggcccctacccccaggagggctacccccagggcccctacccccagggcggctacccccagggcccctacccccagagccccttcccccccaacccctacggccagccccaggtgtttcctggccaggaccctgacagcccccagcacggcaactaccaggaggagggcccccccagctactatgacaaccaggacttccctgccaccaactgggatgacaagagcatccggcaggccttcatcaggaaggtgttcctggtgctgaccctgcagctgtctgtgaccctgagcacagtgtctgtgttcacctttgtggccgaggtgaagggctttgtgagagaaaatgtgtggacctactacgtgtcctatgctgtgttcttcatcagcctcatcgtgctgagctgctgcggggacttccggaggaagcacccctggaacctggtggccctgtctgtgctgacagccagcctgagctacatggtgggcatgattgccagcttctacaacacagaagctgtgatcatggctgtgggcatcaccacagctgtgtgcttcaccgtggtgatcttctccatgcagaccaggtatgacttcaccagctgcatgggcgtgctgctggtgtccatggtggtgctcttcatctttgccatcctgtgcatcttcatccggaaccgcatcctggagatcgtgtatgccagcctgggcgccctgctcttcacctgcttcctggccgtggacacccagctgctgctgggcaacaagcagctgagcctgagccctgaggagtatgtgtttgctgccctgaacctgtacacagacatcatcaacatcttcctgtacatcctgaccatcatcggccgggccaaggagtag

SEQ ID NO: 39074 - DNA, 1332 bp, Artificial Sequence
  Description of Artificial Sequence: Synthetic coding sequence
atggccgcccacaggaagcacgtgtttgtggagaaggtgctgcagaggctcttcccccctgtgcccagcggccagggcaagcgggagccccagaccctggccgtgcagaacccccccaagaaggtgaccagcgagaaggtgtcccagaagcacgccgagcccctgacagacaccggcagcgagacccccacagcccggcggctgtacacagccagcggccccccagagggctacgtgccctgctggccagagcccagcagctgtggcagcccagaaaatgccagcagtggagatgacacagaggaccaggacccccatgaccagcccaagagaagacgcatcaggaagcacaagagcaagaagaagttcaagaaccccaacaacgtgctgattgagcaggccgagctggagaagcagcagagcctgctgcaggagaagagccagaggcagcacacagatggcaccaccatcagcaagaacaagaagaggaagctgaagaagaagcagcagatcaagaggaagaaggctgctggcctggccgccaaggccgccggcgtgtccttcatgtaccagcctgaggacagcagcaatgaaggagaaggagtgggggaggcctgtgaggaggatggagtggacaccagcgaggaggaccccaccctggccggggaggaggatgtgaaggacacccgggaggaggatggagcagatgccagcgaggaggacctgacccgggcccggcaggaggagggcgcagatgccagcgaggaggaccccaccccagctggggaggaggatgtgaaggatgcccgggaggaggatggagtggacaccatcgaggaggacctgaccagggctggggaggaggatggcaaggacacccgggaggaggatggagcagatgccagcgaggaggaccccacctgggccggggaggaggagggcgctgacagcggggaggaggatggagcagatgccagcgaggaggatgacaccatcaccaatgagaaggcccacagcatcctgaacttcctgaagagcacccaggagatgtacttctatgatggagtgtccagagatgctgccagcgctgccctggctgatgctgctgaggagctgctggaccggctggccagccacagcatgctgcccagtgatgtgtccatcctgtaccacatgaagaccctgctgctgctgcaggacacagagcggctgaagcacgccctggagatgtttcctgagcactgcaccatgcccccagaccacgcccgggtcatcagcgccttcttctcctactggatcacccacatcctgcctgagaagagcagtgactag

SEQ ID NO: 39075 - DNA, 1269 bp, Artificial Sequence
  Description of Artificial Sequence: Synthetic coding sequence
atggccgcccacaggaagcacgtgtttgtggagaaggtgctgcagaggctcttcccccctgtgcccagcggccagggcaagcgggagccccagaccctggccgtgcagaacccccccaagaaggtgaccagcgagaaggtgtcccagaagcacgccgagcccctgacagacaccggcagcgagacccccacagcccggcggctgtacacagccagcggccccccagagggctacgtgccctgctggccagagcccagcagctgtggcagcccagaaaatgccagcagtggagatgacacagaggaccaggacccccatgaccagcccaagagaagacgcatcaggaagcacaagagcaagaagaagttcaagaaccccaacaacgtgctgattgagcaggccgagctggagaagcagcagagcctgctgcaggagaagagccagaggcagcacacagatggcaccaccatcagcaagaacaagaagaggaagctgaagaagaagcagcagatcaagaggaagaaggctgctggcctggccgccaaggccgccggcgtgtccttcatgtaccagcctgaggacagcagcaatgaaggagaaggagtgggggaggcctgtgaggaggatggagtggacaccagcgaggaggaccccaccctggccggggaggaggatgtgaaggacacccgggaggaggatggagcagatgccagcgaggaggacctgacccgggcccggcaggaggagggcgcagatgccagcgaggaggaccccaccccagctggggaggaggatgtgaaggatgcccgggaggaggatggagtggacaccatcgaggaggacctgaccagggctggggaggaggatggcaaggacacccgggaggaggatggagcagatgccagcgaggaggaccccacctgggccggggaggaggagggcgctgacagcggggaggaggatggagcagatgccagcgaggaggatgacaccatcaccaatgagaaggcccacagcatcctgaacttcctgaagagcacccaggagatgtacttctatgatggagtgtccagagatgctgccagcgctgccctggctgatgctgctgaggagctgctggaccggctggccagccacagcatgctgcccagtgatgtgtccatcctgtaccacatgaagaccctgctgctgctgcaggacacagagcggctgaagcacgccctggagatgtttcctgagcactgcaccatgcccccagccctgacctag

SEQ ID NO: 39076 - DNA, 3948 bp, Artificial Sequence
  Description of Artificial Sequence: Synthetic coding sequence
atgaacttcctgagcacagctgagagcaggacagcccaggccgccgccagcggcaccaccctgctgccccagttccgggcccccagctggcagacaggcatgcacagcagcgctgccacagagctgtttgccaccggccccctgcccagcacaggcaccctgccccccagcctgagcgcctaccagcaccccaccaccttcagcaacagaaactttgccaccaccagccccctggtgctgcaggacagcaccttcaacaccaccagcaatggcatcctgagccaccacgaccccctgctgcagatcaagaccagccagggcaccgtgcccacagccctggcctttgagcggctgggcagctctgtgctgagcaacagcatccccccccagagcagcacctaccgcagcgcccaggagagcgccccccacctgctgcagccccagttcagcctgctgcccagcgccctgggcggcagccagcagaccccccaggcctacagcagcaccctcttcaccagcagcacagccagcattgaaagagccctgctgagagaatgttctgtcatcaagcaccaccagaggcccagcggcacccagagcatccaggcccagctgaccggcagccagcacagcctgcacagctacctgagcaacagctctgtggtgaacttccaggagaccacccggcagagcagcctgagctgcagccccatcggggacagcacccagaacctgcctgacagcagccccacccagaactacatctccatgcacagcagccagaatgtgcagacccaggagagcagcagcccccagagccagaagttcctgcctgctgtgcagagcagcagctttgccagcagcacccactgccagaccctgcagaacaacatcaccagcccagaccccaagagctatgcagagaggaagctggacagtgatgtgtaccccagcagcaagcaggaggatggcttccccatgcaggagctgcaggtgctgcagccccaggccagcctggagagcagcacccagaggctgagtgatggagagatcaatgcccaggagagcacctacaaggtgtccaaggcagatgaccgctacagccagagcgtcatccgcagcaacagccggctggaggaccaggtgattggagtggccctgcaggccagcaagaaggaggagagcgtggtgggctctgtgacccagctgaaccagcagatcggccaggtgaacaatgctgccaccctggacctgaagaacagcaccaacctgatccagaccccccagatccggctgaacaccaaggacctgaagcagcagcaccccctcatcctgaaggtgcatgagagcaaggtgcaggagcagcacgaccagatcatcaatgccagcagccagatccagatccccaaccacgccctgggccacggccaccaggccagcctgcccaacacccaggtgctgctggacagcgcctgtgacctgcagatcctgcagcagagcatcctgcaggccggcctgggccaggtgaaggccagcctgcaggcccagagggtgcagagcccccagcagatcgtgcaccccttcctgcagatggagggccacgtgatccagagcaatggagaccacagccagcagcagctgcacccccagaacagcgaggtgatgaagatggacctgtctgagagcagcaagcccctgcagcagcacctgaccaccaagggccacttcagcgagaccaaccagcacgacagcaagaaccagtttgtgtccctgggctccatgtgcttccctgaggccgtgctgctgagtgatgagaggaacatcctgagcaatgtggatgacatcctggccgccacagctgctgcctgtggggtgacccccacagacttcagcaagagcaccagcaatgagaccatgcaggccgtggaggatggagacagcaagagccacttccagcagagcctggatgtgagacatgtgaccagtgacttcaacagcatgacagccaccgtgggcaagccccagaacatcaatgacaccagcctgaatggaaaccaggtgacagtgaacctgagccctgtgcctgccctgcagagcaagatgaccctggaccagcagcacatcgagaccccaggccagaacatccccaccaaggtgaccagcgctgtggtgggccccagccatgaggtgcaggagcagagcagcggccccttcaagaagcagagcgccaccaacctggagagcgaggaggacagcgaggcccctgtggacagcaccctgaacaacaacagaaaccaggagtttgtgagcagcagccgcagcatcagcggggagaatgccaccagcgagagcgagttcaccctgggcggagatgattctggagtgtccatgaacccagcccggagcgccctggccctgctggccatggcccagagcggagatgctgtgtctgtgaagattgaggaggagaaccaggacctgatgcacttcaacctgcagaagaagagggccaagggcaagggccaggtgaaggaggaggacaacagcaaccagaagcagctgaagaggcctgcccagggcaagaggcagaacccccggggcacagacatctacctgccctacaccccacccagcagcgagagctgccatgatggctaccagcaccaggagaagatgaggcagaagatcaaggaggtggaggagaagcagcctgaggtgaagacaggcttcatcgccagcttcctggacttcctgaagagcggccccaagcagcagttcagcaccctggccgtgaggatgcccaacagaacccggcggcccggcacccagatggtgaggaccttctgccccccacccctgcccaagcccagcagcaccacccccacccccctggtgtctgagaccggcggcaacagccccagcgacaaggtggacaatgagctgaagaacctggagcacctgagcagcttcagcagtgatgaagatgatcctggctacagccaggatgcctacaagtctgtgtccacccccctgaccaccctggatgccaccagtgacaagaagaagaagacagaggccctgcaggtggccaccaccagccccacagccaacaccactggaacagccaccaccagcagcaccaccgtgggcgctgtgaagcaggagcccctgcacagcaccagctatgctgtgaacatcctggagaacatcagcagcagcgagagcagcaagcccatcgagctggatggcctgcccagcgaccagtttgccaagggccaggacacagtggccatcgagggcttcacagatgaggaggacacagaaagtggaggagagggccagtaccgggagagagatgaatttgtggtgaagattgaggacatcgagaccttcaaggaggccctgaagacaggcaaggagcccccagccatctggaaggtgcagaaggccctgctgcagaagtttgtgcctgagatcagagatggccagcgggagtttgctgccaccaacagctacctgggctactttggagatgccaagagcaagtacaagaggatctacgtgaagttcattgaaaatgccaacaagaaggagtatgtgcgggtgtgcagcaagaagcccaggaacaagcccagccagaccatcagaacagtgcaggccaagcccagcagcagcagcaagaccagtgaccccctggccagcaagaccaccaccaccaaggcccccagcgtgaagcccaaggtgaagcagcccaaggtgaaggccgagcccccacccaagaagaggaagaagtggaaggaggagttcagcagcagccagagcgacagcagccctgagatccacaccagcagcagtgatgatgaggagtttgagcccccagccccctttgtgacccgcttcctgaacacccgggccatgaaggagaccttcaagagctacatggagtag

SEQ ID NO: 39077 - DNA, 5208 bp, Artificial Sequence
  Description of Artificial Sequence: Synthetic coding sequence
atgaacttcctgagcacagctgagagcaggacagcccaggccgccgccagcggcaccaccctgctgccccagttccgggcccccagctggcagacaggcatgcacagcagcgctgccacagagctgtttgccaccggccccctgcccagcacaggcaccctgccccccagcctgagcgcctaccagcaccccaccaccttcagcaacagaaactttgccaccaccagccccctggtgctgcaggacagcaccttcaacaccaccagcaatggcatcctgagccaccacgaccccctgctgcagatcaagaccagccagggcaccgtgcccacagccctggcctttgagcggctgggcagctctgtgctgagcaacagcatccccccccagagcagcacctaccgcagcgcccaggagagcgccccccacctgctgcagccccagttcagcctgctgcccagcgccctgggcggcagccagcagaccccccaggcctacagcagcaccctcttcaccagcagcacagccagcattgaaagagccctgctgagagaatgttctgtcatcaagcaccaccagaggcccagcggcacccagagcatccaggcccagctgaccggcagccagcacagcctgcacagctacctgagcaacagctctgtggtgaacttccaggagaccacccggcagagcagcctgagctgcagccccatcggggacagcacccaggtgtccaatggaggcctgcagcagaagaccagccaggtgtctgtggagctggcccagagctacagcagcgccatccccagcagcggctacccacccagcaccaccaagatcaagagctgcagcacagagcagcccctgaccagcaccaagacccccaagccccagagcatcatcccccctgtgcagaccctgagctacagcaagcccctgcacaaccagagcagcgtcatcagcggccaggcccagatctacagcacagcccagctgcccagcctgctgtctgtgtcccagagccagaactacggcctggtgcagccccacaacgtgcccagcatcgtgcacagccaggtgtaccgcagcagcaaggtggagaagctgccccccctgtacaagaccctgaccttcagcggcagcagccagacagtgaccccagagaaccagaccctgaactacagcagcaaccagcaggaggtgctgagctctgtgaccaatgaaaactacccagcccagacccgggacctgagctctgtgtcccagagccagagctacagcagcggccacagccagggcctgagccctgtgtcccagacccaggtgtcctacagcagccagagccaggtgctgtctgtggtgtccctgtctgagagctatgccagcggggagagcctgaccctgacagcccccagcctgagctacagcagcgccagccgggcccagaacctgcctgacagcagccccacccagaactacatctccatgcacagcagccagaatgtgcagacccaggagagcagcagcccccagagccagaagttcctgcctgctgtgcagagcagcagctttgccagcagcacccactgccagaccctgcagaacaacatcaccagcccagaccccaagagctatgcagagaggaagctggacagtgatgtgtaccccagcagcaagcaggaggatggcttccccatgcaggagctgcaggtgctgcagccccaggccagcctggagagcagcacccagaggctgagtgatggagagatcaatgcccaggagagcacctacaaggtgtccaaggcagatgaccgctacagccagagcgtcatccgcagcaacagccggctggaggaccaggtgattggagtggccctgcaggccagcaagaaggaggagagcgtggtgggctctgtgacccagctgaaccagcagatcggccaggtgaacaatgctgccaccctggacctgaagaacagcaccaacctgatccagaccccccagatccggctgaacaccaaggacctgaagcagcagcaccccctcatcctgaaggtgcatgagagcaaggtgcaggagcagcacgaccagatcatcaatgccagcagccagatccagatccccaaccacgccctgggccacggccaccaggccagcctgcccaacacccaggtgctgctggacagcgcctgtgacctgcagatcctgcagcagagcatcctgcaggccggcctgggccaggtgaaggccagcctgcaggcccagagggtgcagagcccccagcagatcgtgcaccccttcctgcagatggagggccacgtgatccagagcaatggagaccacagccagcagcagctgcacccccagaacagcgaggtgatgaagatggacctgtctgagagcagcaagcccctgcagcagcacctgaccaccaagggccacttcagcgagaccaaccagcacgacagcaagaaccagtttgtgtccctgggctccatgtgcttccctgaggccgtgctgctgagtgatgaaagaaacatcctgagcaatgtggatgacatcctggccgccacagctgctgcctgtggggtgacccccacagacttcagcaagagcaccagcaatgagaccatgcaggccgtggaggatggagacagcaagagccacttccagcagagcctggatgtgcgccacgtgaccagtgacttcaacagcatgacagccaccgtgggcaagccccagaacatcaatgacaccagcctgaatggaaaccaggtgacagtgaacctgagccctgtgcctgccctgcagagcaagatgaccctggaccagcagcacatcgagaccccaggccagaacatccccaccaaggtgaccagcgctgtggtgggccccagccatgaggtgcaggagcagagcagcggccccttcaagaagcagagcgccaccaacctggagagtgaagaagattctgaggcccctgtggacagcaccctgaacaacaacagaaaccaggagtttgtgagcagcagccgcagcatctctggagaaaatgccaccagcgagagcgagttcaccctgggcggagatgacagcggcgtgtccatgaacccagcccggagcgccctggccctgctggccatggcccagagcggagatgctgtgtctgtgaagattgaggaggagaaccaggacctgatgcacttcaacctgcagaagaagagggccaagggcaagggccaggtgaaggaggaggacaacagcaaccagaagcagctgaagaggcctgcccagggcaagaggcagaacccccggggcacagacatctacctgccctacaccccacccagcagcgagagctgccatgatggctaccagcaccaggagaagatgaggcagaagatcaaggaggtggaggagaagcagcctgaggtgaagacaggcttcatcgccagcttcctggacttcctgaagagcggccccaagcagcagttcagcaccctggccgtgaggatgcccaacagaacaagaagacctggcacccagatggtgaggaccttctgccccccacccctgcccaagcccagcagcaccacccccacccccctggtgtctgaaacaggaggcaacagccccagcgacaaggtggacaatgagctgaagaacctggagcacctgagcagcttcagcagtgatgaagatgaccccggctacagccaggatgcctacaagtctgtgtccacccccctgaccaccctggatgccaccagtgacaagaagaagaagacagaggccctgcaggtggccaccaccagccccacagccaacaccaccggcacagccaccaccagcagcaccaccgtgggcgctgtgaagcaggagcccctgcacagcaccagctatgctgtgaacatcctggagaacatcagcagcagcgagagcagcaagcccatcgagctggatggcctgcccagcgaccagtttgccaagggccaggacacagtggccatcgagggcttcacagatgaggaggacacagagagcggcggggagggccagtaccgggagagagatgaatttgtggtgaagattgaagatattgagaccttcaaggaggccctgaagacaggcaaggagcccccagccatctggaaggtgcagaaggccctgctgcagaagtttgtgcctgagatcagagatggccagcgggagtttgctgccaccaacagctacctgggctactttggagatgccaagagcaagtacaagaggatctacgtgaagttcattgaaaatgccaacaagaaggagtatgtgcgggtgtgcagcaagaagcccaggaacaagcccagccagaccatcagaacagtgcaggccaagcccagcagcagcagcaagaccagtgaccccctggccagcaagaccaccaccaccaaggcccccagcgtgaagcccaaggtgaagcagcccaaggtgaaggccgagcccccacccaagaagaggaagaagtggaaggaggagttcagcagcagccagagcgacagcagccctgagatccacaccagcagcagtgatgatgaggagtttgagcccccagccccctttgtgacccgcttcctgaacacccgggccatgaaggagaccttcaagagctacatggagctgctggtgtccatcgccctggaccctgacaccatgcaggccctggagaagagcaatgatgagctgctgctgccccacatgaagaagattgatggcatgctgaatgacaacaggaagaggctgctgctgaacctgcacctggaccagagcttcaagaatgccctggagagcttccctgagctgaccatcatcacccgggacagcaaggccaagagcggcggcacagccatcagcaagatcaagatgaatggcaaggcctacaacaagaagaccctgcggaccagcaagaccaccaccaagagcgcccaggagtttgctgtggaccctgagaagatccagctgtacagcctgtaccacagcctgcaccactacaagtaccacgtgtacctgatctgcaaggatgagatcagctctgtgcagaagaagaatgaagacctgggccaggaggagatcgtgcagctgtgcatgaagaatgtgaagtgggtggaggacctgtttgagaagtttggagagctgctgaaccacgtgcagcagaagtgcagctag

SEQ ID NO: 39078 - DNA, 195 bp, Artificial Sequence
  Description of Artificial Sequence: Synthetic coding sequence
atgaacttcctgagcacagctgagagcaggacagcccaggccgccgccagcggcaccaccctgctgccccagttccgggcccccagctggcagacaggcatgcacagcagcgctgccacagagctgtttgccaccggccccctgcccagcacaggcaccctgccccccagcctgagcgcctaccagcacccctag

SEQ ID NO: 39079 - DNA, 4992 bp, Artificial Sequence
  Description of Artificial Sequence: Synthetic coding sequence
atgaaggatgctgctgaggagctgagctttgcccgggtgctgctgcagagggtggatgagctggagaagctgttcaaggaccgggagcagttcctggagctggtgtccaggaagctgagcctggtgcctggagctgaggaggtgaccatggtgacctgggaggagctggagcaggccatcacagatggctggagggccagccaggccggcagcgagaccctgatgggcttcagcaagcacggcggcttcaccagcctgaccagccctgagggcaccctgagcggggacagcaccaagcagcccagcattgagcaggccctggacagcgccagcggcctgggccctgacagaacagccagcggcagcggcggcacagcccaccccagtgatggagtgagcagccgggagcagagcaaggtgcccagcggcaccggccggcagcagcagccccgggccagagatgaggccggcgtgccccggctgcaccagagcagcaccttccagttcaagagtgacagcgacagacacaggagccgggagaagctgaccagcacccagcccaggagaaatgcccggcccggccctgtgcagcaggacctgcccctggcccgggaccagcccagctctgtgcctgccagccagagccaggtgcacctgcggccagacagaagaggcctggagcccaccggcatgaaccagcccggcctggtgcctgccagcacctacccccacggcgtggtgcccctgtccatgggccagctgggcgtgcccccacctgagatggatgaccgggagctgatcccctttgtggtggatgagcagaggatgctgccccccagcgtgcccggccgggaccagcagggcctggagctgcccagcacagaccagcacggcctggtgtctgtgtctgcctaccagcacggcatgaccttccctggaacagaccagaggtccatggagcccctgggcatggaccagaggggctgtgtgatcagcggcatgggccagcagggcctggtgcccccaggcatcgaccagcagggcctgaccctgcctgtggtggaccagcacggcctggtgctgcccttcacagaccagcacggcctggtgtccccaggcctgatgcccatctctgctgaccagcagggctttgtgcagcccagcctggaggccaccggcttcatccagcctggaacagagcagcacgacctgatccagagcggccgcttccagagggccctggtgcagagaggagcctaccagcccggcctggtgcagcctggagctgaccagaggggcctggtgcggcccggcatggaccagagcggcctggcccagcctggagctgaccagaggggcctggtgtggccaggcatggaccagagcggcctggcccagcccggccgggaccagcacggcctcatccagcccggcaccggccagcacgacctggtgcagagcggcaccggccagggcgtgctggtgcagcccggggtggaccagcccggcatggtgcagcccggccgcttccagagggccctggtgcagcccggggcctaccagcccggcctggtgcagcctggagctgaccagattgatgtggtgcagcctggagctgaccagcacggcctggtgcagagcggggctgaccagagcgacctggcccagcctggagctgtgcagcacggcctggtgcagcccggggtggaccagaggggcctggcccagcccagggctgaccaccagaggggcctggtgcccccaggagctgaccagaggggcctggtgcagcccggggctgaccagcacggcctggtgcagcccggggtggaccagcacggcctggcccagcccggggaggtgcagaggagcctggtgcagcccggcatcgtgcagaggggcctggtgcagcccggggctgtgcagaggggcctggtgcagcccggggctgtgcagaggggcctggtgcagcccggggtggaccagaggggcctggtgcagcccggggctgtgcagaggggcctggtgcagcccggggctgtgcagcacggcctggtgcagcccggggctgaccagaggggcctggtgcagcccggggtggaccagaggggcctggtgcagcccggggtggaccagaggggcctggtgcagcccggcatggaccagaggggcctcatccagcccggggctgaccagcccggcctggtgcagcccggggccggccagctgggcatggtgcagcccggcatcggccagcagggcatggtgcagccccaggccgacccccacggcctggtgcagcccggggcctaccccctgggcctggtgcagcccggggcctacctgcatgacctgagccagagcggcacctacccccggggcctggtgcagcccggcatggaccagtatggcctgcggcagcccggggcctaccagcccggcctcatcgcccctggcaccaagctgcggggcagcagcaccttccaggccgacagcacaggcttcatctctgtgcggccctaccagcacggcatggtgcccccaggccgggagcagtatggccaggtgagccccctgctggccagccagggcctggccagccctggcatcgaccggcgcagcctggtgcccccagagacctaccagcagggcctgatgcaccctggaacagaccagcacagccccatccccctgagcacaggcctgggcagcacccacccagaccagcagcacgtggccagccctggccctggagaacatgaccaggtgtacccagatgctgcccagcacggccacgccttcagcctgtttgacagccatgacagcatgtacccaggctaccggggccctggctacctgtctgctgaccagcacggccaggagggcctggaccccaacagaacccgggccagtgacagacatggcatcccagcccagaaggcccctggccaggatgtgaccctcttccgcagcccagacagcgtggacagagtgctgtctgagggcagcgaggtgtcctctgaggtgctgtctgaaagaagaaacagcctgcggaggatgagcagcagcttccccacagctgtggagaccttccacctgatgggagagctgagcagcctgtatgtgggcctgaaggagagcatgaaggacctggatgaggagcaggccggccagacagacctggagaagatccagttcctgctggcccagatggtgaagaggaccatccccccagagctgcaggagcagctgaagacagtgaagaccctggccaaggaggtgtggcaggagaaggccaaggtggagcggctgcagaggatcctggagggggagggcaaccaggaggccggcaaggagctgaaggccggggagctgcggctgcagctgggcgtgctgcgggtgacagtggccgacatcgagaaggagctggccgagctgcgggagagccaggaccggggcaaggccgccatggagaacagcgtgtctgaggccagcctgtacctgcaggaccagctggacaagctgaggatgatcattgaatccatgctgaccagcagcagcaccctgctgtccatgtccatggccccccacaaggcccacaccctggcccctggccagattgatcctgaggccacctgcccagcctgcagcctggatgtgagccaccaggtgtccaccctggtgagaagatatgagcagctgcaggacatggtgaacagcctggccgtgtcccggcccagcaagaaggccaagctgcagaggcaggatgaggagctgctgggccgggtgcagagcgccatcctgcaggtgcagggcgactgtgagaagctgaacatcaccaccagcaacctgattgaggaccaccggcagaagcagaaggacatcgccatgctgtaccagggcctggagaagctggagaaggagaaggccaaccgggagcacctggagatggagattgatgtgaaggctgacaagagcgccctggccaccaaggtgtcccgggtgcagtttgatgccaccacagagcagctgaaccacatgatgcaggagctggtggccaagatgagcggccaggagcaggactggcagaagatgctggaccggctgctgacagagatggacaacaagctggaccggctggagctggaccctgtgaagcagctgctggaggaccgctggaagagcctgcggcagcagctgcgggagcggccccccctgtaccaggctgatgaggccgccgccatgaggcggcagctgctggcccacttccactgcctgagctgtgaccggcccctggagacccctgtgactggacatgccatccctgtgaccccagctggccctggcctgcccggccaccacagcatccggccctacacagtgtttgagctggagcaggtgcggcagcacagcaggaacctgaagctgggcagcgccttccccaggggggacctggcccagatggagcagagcgtgggccgcctgcgctccatgcacagcaagatgctgatgaacatcgagaaggtgcagatccactttggaggcagcaccaaggccagcagccagatcatccgggagctgctgcacgcccagtgcctgggcagcccctgctacaagagggtgacagacatggctgactacacctacagcacagtgccccggcgctgtggcggcagccacaccctgacctacccctaccacaggagccggccccagcacctgccccggggcctgtaccccacagaggagatccagatcgccatgaagcatgatgaggtggacatcctgggcctggatggccacatctacaagggccgcatggacacccggctgcccggcatcctgaggaaggacagcagcggcaccagcaagaggaagagccagcagccccggccccacgtgcacaggcctcccagcctgagcagcaatggccagctgcccagccggccccagagcgcccagatctctgctggcaacaccagcgagaggtag

SEQ ID NO: 39080 - DNA, 4290 bp, Artificial Sequence
  Description of Artificial Sequence: Synthetic coding sequence
atgaaggatgctgctgaggagctgagctttgcccgggtgctgctgcagagggtggatgagctggagaagctgttcaaggaccgggagcagttcctggagctggtgtccaggaagctgagcctggtgcctggagctgaggaggtgaccatggtgacctgggaggagctggagcaggccatcacagatggctggagggccagccaggccggcagcgagaccctgatgggcttcagcaagcacggcggcttcaccagcctgaccagccctgagggcaccctgagcggggacagcaccaagcagcccagcattgagcaggccctggacagcgccagcggcctgggccctgacagaacagccagcggcagcggcggcacagcccaccccagtgatggagtgagcagccgggagcagagcaaggtgcccagcggcaccggccggcagcagcagccccgggccagagatgaggccggcgtgccccggctgcaccagagcagcaccttccagttcaagagtgacagcgacagacacaggagccgggagaagctgaccagcacccagcccaggagaaatgcccggcccggccctgtgcagcaggacctgcccctggcccgggaccagcccagctctgtgcctgccagccagagccaggtgcacctgcggccagacagaagaggcctggagcccaccggcatgaaccagcccggcctggtgcctgccagcacctacccccacggcgtggtgcccctgtccatgggccagctgggcgtgcccccacctgagatggatgaccgggagctgatcccctttgtggtggatgagcagaggatgctgccccccagcgtgcccggccgggaccagcagggcctggagctgcccagcacagaccagcacggcctggtgtctgtgtctgcctaccagcacggcatgaccttccctggaacagaccagaggtccatggagcccctgggcatggaccagaggggctgtgtgatcagcggcatgggccagcagggcctggtgcccccaggcatcgaccagcagggcctgaccctgcctgtggtggaccagcacggcctggtgctgcccttcacagaccagcacggcctggtgtccccaggcctgatgcccatctctgctgaccagcagggctttgtgcagcccagcctggaggccaccggcttcatccagcctggaacagagcagcacgacctgatccagagcggccgcttccagagggccctggtgcagagaggagcctaccagcccggcctggtgcagcctggagctgaccagaggggcctggtgcggcccggcatggaccagagcggcctggcccagcctggagctgaccagaggggcctggtgtggccaggcatggaccagagcggcctggcccagcccggccgggaccagcacggcctcatccagcccggcaccggccagcacgacctggtgcagagcggcaccggccagggcgtgctggtgcagcccggggtggaccagcccggcatggtgcagcccggccgcttccagagggccctggtgcagcccggggcctaccagcccggcctggtgcagcctggagctgaccagattgatgtggtgcagcctggagctgaccagcacggcctggtgcagagcggggctgaccagagcgacctggcccagcctggagctgtgcagcacggcctggtgcagcccggggtggaccagaggggcctggcccagcccagggctgaccaccagaggggcctggtgcccccaggagctgaccagaggggcctggtgcagcccggggctgaccagcacggcctggtgcagcccggggtggaccagcacggcctggcccagcccggggaggtgcagaggagcctggtgcagcccggcatcgtgcagaggggcctggtgcagcccggggctgtgcagaggggcctggtgcagcccggggctgtgcagaggggcctggtgcagcccggggtggaccagaggggcctggtgcagcccggggctgtgcagaggggcctggtgcagcccggggctgtgcagcacggcctggtgcagcccggggctgaccagaggggcctggtgcagcccggggtggaccagaggggcctggtgcagcccggggtggaccagaggggcctggtgcagcccggcatggaccagaggggcctcatccagcccggggctgaccagcccggcctggtgcagcccggggccggccagctgggcatggtgcagcccggcatcggccagcagggcatggtgcagccccaggccgacccccacggcctggtgcagcccggggcctaccccctgggcctggtgcagcccggggcctacctgcatgacctgagccagagcggcacctacccccggggcctggtgcagcccggcatggaccagtatggcctgcggcagcccggggcctaccagcccggcctcatcgcccctggcaccaagctgcggggcagcagcaccttccaggccgacagcacaggcttcatctctgtgcggccctaccagcacggcatggtgcccccaggccgggagcagtatggccaggtgagccccctgctggccagccagggcctggccagccctggcatcgaccggcgcagcctggtgcccccagagacctaccagcagggcctgatgcaccctggaacagaccagcacagccccatccccctgagcacaggcctgggcagcacccacccagaccagcagcacgtggccagccctggccctggagaacatgaccaggtgtacccagatgctgcccagcacggccacgccttcagcctgtttgacagccatgacagcatgtacccaggctaccggggccctggctacctgtctgctgaccagcacggccaggagggcctggaccccaacagaacccgggccagtgacagacatggcatcccagcccagaaggcccctggccaggatgtgaccctcttccgcagcccagacagcgtggacagagtgctgtctgagggcagcgaggtgtcctctgaggtgctgtctgaaagaagaaacagcctgcggaggatgagcagcagcttccccacagctgtggagaccttccacctgatgggagagctgagcagcctgtatgtgggcctgaaggagagcatgaaggacctggatgaggagcaggccggccagacagacctggagaagatccagttcctgctggcccagatggtgaagaggaccatccccccagagctgcaggagcagctgaagacagtgaagaccctggccaaggaggtgtggcaggagaaggccaaggtggagcggctgcagaggatcctggagggggagggcaaccaggaggccggcaaggagctgaaggccggggagctgcggctgcagctgggcgtgctgcgggtgacagtggccgacatcgagaaggagctggccgagctgcgggagagccaggaccggggcaaggccgccatggagaacagcgtgtctgaggccagcctgtacctgcaggaccagctggacaagctgaggatgatcattgaatccatgctgaccagcagcagcaccctgctgtccatgtccatggccccccacaaggcccacaccctggcccctggccagattgatcctgaggccacctgcccagcctgcagcctggatgtgagccaccaggtgtccaccctggtgagaagatatgagcagctgcaggacatggtgaacagcctggccgtgtcccggcccagcaagaaggccaagctgcagaggcaggatgaggagctgctgggccgggtgcagagcgccatcctgcaggtgcagggcgactgtgagaagctgaacatcaccaccagcaacctgattgaggaccaccggcagaagcagaaggacatcgccatgctgtaccagggcctggagaagctggagaaggagaaggccaaccgggagcacctggagatggagattgatgtgaaggctgacaagagcgccctggccaccaaggtgtcccgggtgcagtttgatgccaccacagagcagctgaaccacatgatgcaggagctggtggccaagatgagcggccaggagcaggactggcagaagatgctggaccggctgctgacagagatggacaacaagctgcccggcatcctgaggaaggacagcagcggcaccagcaagaggaagagccagcagccccggccccacgtgcacaggcctcccagcctgagcagcaatggccagctgcccagccggccccagagcgcccagatctctgctggcaacaccagcgagaggtag

SEQ ID NO: 39081 - DNA, 2331 bp, Artificial Sequence
  Description of Artificial Sequence: Synthetic coding sequence
atgaacaacagcctggagaacaccatcagctttgaggagtacatccgggtgaaggcccggtctgtgccccagcacaggatgaaggagttcctggacagcctggccagcaaaggacctgaggccctgcaggagttccagcagacagccaccaccaccatggtgtaccagcagggcggcaactgcatctacacagacagcacagaggtggccggcagcctgctggagctggcctgccctgtgaccacctctgtgcagccccagacccagcaggagcagcagatccaggtgcagcagccccagcaggtgcaggtgcaggtgcaggtgcagcagagcccccagcaggtgtctgcccagctgagcccccagctgactgtgcaccagcccacagagcagcccatccaggtgcaggtgcagatccagggccaggccccccagagcgctgcccccagcatccagacccccagcctgcagagccccagccccagccagctgcaggccgcccagatccaggtgcagcacgtgcaggccgcccagcagatccaggccgctgagatccctgaggagcacatcccccaccagcagatccaggcccagctggtggccggccagagcctggccggcggccagcagatccagatccagacagtgggcgccctgagccccccacccagccagcagggcagcccccgggagggggagcggcgggtgggcacagcctctgtgctgcagcctgtgaagaagaggaaggtggacatgcccatcaccgtgtcctatgccatcagcggccagcctgtggccaccgtgctggccatcccccagggccagcagcagagctatgtgtccctgcggccagacctgctgactgtggacagcgcccacctgtacagcgccaccggcaccatcaccagccccactggagagacctggaccatccctgtgtacagcgcccagcccaggggggacccccagcagcagagcatcacccacatcgccatcccccaggaggcctacaatgctgtgcacgtgtctggcagccccacagccctggccgctgtgaagctggaggatgacaaggagaagatggtgggcaccacctctgtggtgaagaacagccatgaggaggtggtgcagaccctggccaacagcctcttccctgcccagttcatgaatggaaacatccacatccctgtggccgtgcaggccgtggccggcacctaccagaacacagcccagacagtgcacatctgggacccccagcagcagccccagcagcagaccccccaggagcagaccccaccaccccagcagcagcagcagcagctgcaggtgacctgcagcgcccagacagtgcaggtggccgaggtggagccccagagccagccccagcccagccctgagctgctgctgcccaacagcctgaagccagaggagggcctggaggtgtggaagaactgggcccagaccaagaatgctgagctggagaaggatgcccagaaccggctggcccccatcggccggcggcagctgctgcgcttccaggaggacctgatcagcagcgctgtggccgagctgaactacggcctgtgcctgatgacccgggaggccagaaatggagagggggagccctatgaccctgatgtgctgtactacatcttcctgtgcatccagaagtacctgtttgaaaatggccgggtggatgacatcttcagtgacctgtactacgtgcgcttcacagagtggctgcacgaggtgctgaaggatgtgcagccccgggtgacccccctgggctacgtgctgcccagccacgtgacagaggagatgctgtgggagtgcaagcagctgggcgcccacagccccagcaccctgctgaccaccctgatgttcttcaacaccaagtacttcctgctgaagacagtggaccagcacatgaagctggccttcagcaaggtgctgcggcagaccaagaagaaccccagcaaccccaaggacaagagcaccagcatccgctacctgaaggccctgggcatccaccagacaggccagaaggtgacagatgacatgtatgcagagcagacagaaaatcctgagaaccccctgcgctgccccatcaagctgtatgacttctacctgttcaagtgcccccagagcgtgaagggcagaaatgacaccttctacctgaccccagagcctgtggtggcccccaacagccccatctggtacagcgtgcagcccatcagccgggagcagatgggccagatgctgacccgcatcctggtgatccgggagatccaggaggccatcgctgtggccaatgccagcaccatgcactag

SEQ ID NO: 39082 - DNA, 2331 bp, Artificial Sequence; identical to SEQ ID NO: 39081
  Description of Artificial Sequence: Synthetic coding sequence

SEQ ID NO: 39083 - DNA, 2331 bp, Artificial Sequence; identical to SEQ ID NO: 39081
  Description of Artificial Sequence: Synthetic coding sequence

SEQ ID NO: 39084 - DNA, 747 bp, Artificial Sequence
  Description of Artificial Sequence: Synthetic coding sequence
atggaggaccctgagaagaagctgaaccagaagagtgatggcaagcccaggaaggtgcgcttcaagatcagcagcagctacagcggccgggtgctgaagcaggtgtttgaagatggccaggagctggagagccccaaggaggagtacccccacagcttcctgcaggagagcctggagaccatggatggagtgtatggcagcggggaggtgccccggccccagatgtgcagccccaagctgacagcccagaggatcagcgtcttccgggagggcaatgcctacaccctggccggcggccagccccgcttcaatgactacaaggccaatgaccacaagcccctgcccatcatcgactttgggaagatcatcatctacaccaacaacctgaagatcatccgcacccccatggacaagagggactttgtgaggaagatcctgcagaaggaggaggaggccgaggaggagagcctgatgaacaaggaggagagctatggaggccgggaccagcacgaccggcccctggtggaggccgagagcaccctgccccagaaccgctacacccaggagggggacatccctgaggacagctgcttccactgccggggcagcggcagcgccacctgcagcctgtgccacggcagcaagttctccatgctggccaaccgcttcaaggagagctaccgggccctgcgctgcccagcctgcaatgaaaatggcctgcagccctgccagatctgcaaccagtag

SEQ ID NO: 39085 - DNA, 660 bp, Artificial Sequence
  Description of Artificial Sequence: Synthetic coding sequence
atgttccagcagttccaggccagctgcctggtgctcttcttcctggtgggctttgcccagcagaccctgaagccccagaacaggaaggtggactgcaacaagggcgtgacaggcaccatctatgaatatggagccctgaccctgaatggagaggagtacatccagttcaagcagtttgctgggaagcacgtgctgtttgtgaatgtggccgcctacctggccgcccagtacccagagctgaatgccctgcaggaggagctgaagaactttggagtgattgtgctggccttcccctgcaaccagtttgggaagcaggagcccggcaccaacagcgagatcctgctgggcctgaagtatgtgtgccccggcagcggctttgtgcccagcttccagctgtttgagaagggagatgtgaatggagagaaggagcagaaggtgttcaccttcctgaagaacagctgcccccccaccagtgacctgctgggcagcagcagccagctgttctgggagcccatgaaggtgcatgacatccgctggaactttgagaagttcctggtgggcccagatggagtgcctgtgatgcactggttccaccaggcccctgtgtccacagtgaagagtgacatcctggagtacctgaagcagttcaacacccactag

SEQ ID NO: 39086 - DNA, 216 bp, Artificial Sequence
  Description of Artificial Sequence: Synthetic coding sequence
ctgaccagcttccgggtggtgcacaccatccccatgatcaagagcttcttcaactacctgagccccaagcacctgaagttccaggtggactgcaacaagggcgtgacaggcaccatctatgaatatggagccctgaccctgaatggagaggagtacatccagttcaagcagtttgctgggaagcacgtgctgtttgtgaatgtggccgcctactag

SEQ ID NO: 39087 - DNA, 1590 bp, Artificial Sequence
  Description of Artificial Sequence: Synthetic coding sequence
atgagcggcctgctgacagatcctgagcagagggcccaggagccccgctacccaggctttgtgctgggcctggatgtgggcagcagcgtcatccgctgccacgtgtatgacagagctgcccgggtgtgtggcagctctgtgcagaaggtggagaacctgtacccccagatcggctgggtggagattgatcctgatgtgctgtggatccagtttgtggccgtcatcaaggaggccgtgaaggccgccggcatccagatgaaccagatcgtgggcctgggcatcagcacccagagggccaccttcatcacctggaacaagaagacaggcaaccacttccacaacttcatctcctggcaggacctgcgggctgtggagctggtgaagtcctggaacaacagcctgctgatgaagatcttccacagcagctgccgggtgctgcacttcttcaccaggagcaagaggctcttcaccgccagcctcttcaccttcaccacccagcagaccagcctgcggctggtgtggatcctgcagaacctgacagaggtgcagaaggctgtggaggaggagaactgctgcttcggcaccatcgacacctggctgctgtacaagctgaccaagggctctgtgtatgccacagacttcagcaatgccagcaccaccggcctgtttgacccctacaagatgtgctggagcggcatgatcaccagcctcatcagcatccccctgagcctgctgccccctgtgcgggacaccagccacaactttggatctgtggatgaggagatctttggagtgcccatccccatcgtggccctggtggccgaccagcagagcgccatgtttggagagtgctgcttccagacaggagatgtgaagctgaccatgggcaccggcaccttcctggacatcaacacaggcaacagcctgcagcagaccactggaggcttctaccccctcatcggctggaagattggccaggaggtggtgtgcctggccgagagcaatgctggggacacaggaacagccatcaagtgggcccagcagctggacctcttcacagatgctgctgagacagagaagatggccaagagcctggaggacagcgagggcgtgtgctttgtgcccagcttcagcggcctgcaggcccccctgaatgacccctgggcctgtgccagcttcatgggcctgaagcccagcaccagcaagtaccacctggtgcgggccatcctggagagcatcgccttcaggaacaagcagctgtatgagatgatgaagaaggagatccacatccctgtgaggaagatccgggcagatggcggcgtgtgcaagaatggatttgtgatgcagatgaccagtgacctgatcaatgaaaatattgacaggcctgctgacatcgacatgagctgcctgggcgccgccagcctggccggcctggccgtgggcttctggacagacaaggaggagctgaagaagctgcggcagagcgaggtggtgttcaagccccagaagaagtgccaggagtatgagatgagcctggagaactgggccaaggctgtgaagaggtccatgaactggtacaacaagacctag

SEQ ID NO: 39088 - DNA, 906 bp, Artificial Sequence
  Description of Artificial Sequence: Synthetic coding sequence
atgagcggcctgctgacagatcctgagcagagggcccaggagccccgctacccaggctttgtgctgggcctggatgtgggcagcagcgtcatccgctgccacgtgtatgacagagctgcccgggtgtgtggcagctctgtgcagaaggtggagaacctgtacccccagatcggctgggtggagattgatcctgatgtgctgtggatccagtttgtggccgtcatcaaggaggccgtgaaggccgccggcatccagatgaaccagatcgtgggcctgggcatcagcacccagagggccaccttcatcacctggaacaagaagacaggcaaccacttccacaacttcatctcctggcaggacctgcgggctgtggagctggtgaagtcctggaacaacagcctgctgatgaagatcttccacagcagctgccgggtgctgcacttcttcaccaggagcaagaggctcttcaccgccagcctcttcaccttcaccacccagcagaccagcctgcggctggtgtggatcctgcagaacctgacagaggtgcagaaggctgtggaggaggagaactgctgcttcggcaccatcgacacctggctgctgtacaagctgaccaagggctctgtgtatgccacagacttcagcaatgccagcaccaccggcctgtttgacccctacaagatgtgctggagcggcatgatcaccagcctcatcagcatccccctgagcctgctgccccctgtgcgggacaccagccacaactttggatctgtggatgaggagatctttggagtgcccatccccatcgtggccctgctgaaggtgcccggctatgaccagaacatctgctacatctttgggaagggcaccatcgagcctgtgttctaccacggcagcaccctgtag

SEQ ID NO: 39089 - DNA, 360 bp, Artificial Sequence
  Description of Artificial Sequence: Synthetic coding sequence
atgtctgtgacagaccaggcctttgtgaccctggccacagatgacatctactgccagggcgccctggtgctgggccagagcctgcggcggcaccggctgaccaggaagctggtggtgctgatcaccccccaggtgagcagcctgctgcgggacatggatgaagctggcaaccacgacagcgagcagaccatcgccggcatcgagaaccagaccctgcacgtgctgacccaccgctgggagctgaacaatgaaaacacctggacccagggcggggagcaccacaccctggagcctgtggtgggccgcggggagggcggcggcatcgccctgggggacatccccaacgtgaatgatgaatag

SEQ ID NO: 39090 - DNA, 291 bp, Artificial Sequence
  Description of Artificial Sequence: Synthetic coding sequence
atgagcggcagccacagcgtgacccaggccggcgtggagtggtacaaccacagcagcctgcagccccagaccccccggctgaagtacccacccaccagcgccagccaggtggccgtgaccaccgtgacagaccaggcctttgtgaccctggccacagatgacatctactgccagggcgccctggtgctgggccagagcctgcggcggcaccggctgaccaggaagctggtggtgctgatcaccccccaggtgagcagcctgctgcgggtgtccctggtggcccaggcctag

SEQ ID NO: 39091 - DNA, 195 bp, Artificial Sequence
  Description of Artificial Sequence: Synthetic coding sequence
atgtctgtgacagaccaggcctttgtgaccctggccacagatgacatctactgccagggcgccctggtgctgggccagagcctgcggcggcaccggctgaccaggaagctggtggtgctgatcaccccccaggtgagcagcctgctgcggcctgctgccagcctggtgctgagccgggtgagcagccggccctag

SEQ ID NO: 39092 - DNA, 192 bp, Artificial Sequence
  Description of Artificial Sequence: Synthetic coding sequence
atgtctgtgacagaccaggcctttgtgaccctggccacagatgacatctactgccagggcgccctggtgctgggccagagcctgcggcggcaccggctgaccaggaagctggtggtgctgatcaccccccaggtgagcagcctgctgagcctgagcaagcgctgcaagatcagcagcagccacctggactag

SEQ ID NO: 39093 - DNA, 966 bp, Artificial Sequence
  Description of Artificial Sequence: Synthetic coding sequence
atgagccccagccccacagccctcttctgcctgggcctgtgcctgggccgggtgcctgcccagagcggccccctgcccaagcccagcctgcaggccctgcccagcagcctggtgcccctggagaagcctgtgaccctgcgctgccagggccccccaggagtggacctgtaccgcctggagaagctgagcagcagccgctaccaggaccaggccgtgctcttcatcccagccatgaagaggagcctggccggccgctaccgctgcagctaccagaatggcagcctgtggagcctgcccagcgaccagctggagctggtggccaccggggtgtttgccaagcccagcctgagcgcccagcccggccctgctgtgtcctctggaggagatgtgaccctgcagtgccagaccaggtatggctttgaccagtttgccctgtacaaggagggggaccctgccccctacaagaaccctgagcgctggtaccgggccagcttccccatcatcaccgtgacagctgcccacagcggcacctaccgctgctacagcttcagcagccgggacccctacctgtggagcgcccccagcgaccccctggagctggtggtgacagagttcagcgaggccacagctgagctgactgtgtccttcaccaatgaggtgttcaccacagagaccagccgcagcatcacagccagccccaaggagagtgacagccctgctggccctgcccggcagtactacaccaagggcaacctggtgcgcatctgcctgggcgctgtgatcctgatcatcctggccggcttcctggccgaggactggcacagcaggaggaagaggctgcggcaccggggccgggctgtgcagaggcccctgccccccctgccccccctgcccctgaccaggaagagcaatggaggccaggacggcggccggcaggatgtgcacagccggggcctgtgcagctag

SEQ ID NO: 39094 - DNA, 966 bp, Artificial Sequence; identical to SEQ ID NO: 39093
  Description of Artificial Sequence: Synthetic coding sequence

SEQ ID NO: 39095 - DNA, 966 bp, Artificial Sequence; identical to SEQ ID NO: 39093
  Description of Artificial Sequence: Synthetic coding sequence

SEQ ID NO: 39096 - DNA, 966 bp, Artificial Sequence; identical to SEQ ID NO: 39093
  Description of Artificial Sequence: Synthetic coding sequence

SEQ ID NO: 39097 - DNA, 966 bp, Artificial Sequence; identical to SEQ ID NO: 39093
  Description of Artificial Sequence: Synthetic coding sequence

SEQ ID NO: 39098 - DNA, 966 bp, Artificial Sequence; identical to SEQ ID NO: 39093
  Description of Artificial Sequence: Synthetic coding sequence

SEQ ID NO: 39099 - DNA, 966 bp, Artificial Sequence; identical to SEQ ID NO: 39093
  Description of Artificial Sequence: Synthetic coding sequence

SEQ ID NO: 39100 - DNA, 966 bp, Artificial Sequence; identical to SEQ ID NO: 39093
  Description of Artificial Sequence: Synthetic coding sequence

SEQ ID NO: 39101 - DNA, 1116 bp, Artificial Sequence
  Description of Artificial Sequence: Synthetic coding sequence
atgtccttcaggaaggtgaacatcatcatcctggtgctggccgtggccctcttcctgctggtgctgcaccacaacttcctgagcctgagcagcctgctgagaaatgaggtgacagacagcggcatcgtgggcccccagcccatcgactttgtgcccaatgccctgcggcatgctgtggatggccggcaggaggagatccctgtggtgattgctgccagcgaggaccggctgggcggggccatcgccgccatcaacagcatccagcacaacaccaggagcaatgtcatcttctacatcgtgaccctgaacaacacagctgaccacctgcgctcctggctgaacagcgacagcctgaagagcatccgctacaagatcgtgaactttgaccccaagctgctggagggcaaggtgaaggaggaccctgaccagggcgagagcatgaagcccctgacctttgcccgcttctacctgcccatcctggtgcccagcgccaagaaggccatctacatggatgatgatgtgattgtgcagggcgacatcctggccctgtacaacacagccctgaagccaggccatgctgctgccttcagcgaggactgtgacagcgccagcaccaaggtggtgatccggggggccggcaaccagtacaactacatcggctacctggactacaagaaggagcgcatcaggaagctgtccatgaaggccagcacctgcagcttcaaccctggggtgtttgtggccaacctgacagagtggaagaggcagaacatcaccaaccagctggagaagtggatgaagctgaatgtggaggagggcctgtacagcaggaccctggccggcagcatcaccaccccacccctgctgattgtgttctaccagcagcacagcaccatcgaccccatgtggaatgtgcgccacctgggcagcagcgctgggaagcgctacagcccccagtttgtgaaggccgccaagctgctgcactggaatggccacctgaagccctggggccgcacagccagctacacagatgtgtgggagaagtggtacatcccagaccccaccgggaagttcaacctgatccgccgctacacagagatcagcaacatcaagtag

SEQ ID NO: 39102 - DNA, 1116 bp, Artificial Sequence; identical to SEQ ID NO: 39101
  Description of Artificial Sequence: Synthetic coding sequence

SEQ ID NO: 39103 - DNA, 681 bp, Artificial Sequence
  Description of Artificial Sequence: Synthetic coding sequence
atggatgatgatgtgattgtgcagggcgacatcctggccctgtacaacacagccctgaagccaggccacgccgccgccttcagcgaggactgtgacagcgccagcaccaaggtggtgatcagaggagctggcaaccagtacaactacatcggctacctggactacaagaaggagcgcatcaggaagctgtccatgaaggccagcacctgcagcttcaaccctggggtgtttgtggccaacctgacagagtggaagaggcagaacatcaccaaccagctggagaagtggatgaagctgaatgtggaggagggcctgtacagcaggaccctggccggcagcatcaccaccccacccctgctgattgtgttctaccagcagcacagcaccatcgaccccatgtggaaccccccaccctggttccagtgctggaagaccatcttcacctctgtgtgcaagggctgccaggtgacccactggaatggccacctgaagccctggggccgcacagccagctacacctgcctgggcaagatggtgtacagccggcccaaccggcagatccagcccaaccccaagatctacagagacctgaagcacaaggtgaagcagaacctgaactgcaagcaggccttcctgaggaagtcctggaagatcgcctgtgtgggcagcaacagctgctag

SEQ ID NO: 39104 - DNA, 1116 bp, Artificial Sequence; identical to SEQ ID NO: 39101
  Description of Artificial Sequence: Synthetic coding sequence

SEQ ID NO: 39105 - DNA, 93 bp, Artificial Sequence
  Description of Artificial Sequence: Synthetic coding sequence
atgtccttcaggaaggtgaacatcatcatcctggtgctggccgtggccctcttcctgctggtgctgcaccacaacttcctgagcctgtcctag

SEQ ID NO: 39106 - DNA, 1116 bp, Artificial Sequence; identical to SEQ ID NO: 39101
  Description of Artificial Sequence: Synthetic coding sequence

SEQ ID NO: 39107 - DNA, 525 bp, Artificial Sequence
  Description of Artificial Sequence: Synthetic coding sequence
atgtccttcaggaaggtgaacatcatcatcctggtgctggccgtggccctcttcctgctggtgctgcaccacaacttcctgagcctgagcagcctgctgagaaatgaggtgacagacagcggcatcgtgggcccccagcccatcgactttgtgcccaatgccctgcggcatgctgtggatggccggcaggaggagatccctgtggtgattgctgccagcgaggaccggctgggcggggccatcgccgccatcaacagcatccagcacaacaccaggagcaatgtcatcttctacatcgtgaccctgaacaacacagctgaccacctgcgctcctggctgaacagcgacagcctgaagagcatccgctacaagatcgtgaactttgaccccaagctgctggagggcaaggtgaaggaggaccctgaccagggcgagagcatgaagcccctgacctttgcccgcttctacctgcccatcctggtgcccagcgccaagaaggccatctacatggatgatgatgtgtag

SEQ ID NO: 39108 - DNA, 189 bp, Artificial Sequence
  Description of Artificial Sequence: Synthetic coding sequence
atgtccttcaggaaggtgaacatcatcatcctggtgctggccgtggccctcttcctgctggtgctgcaccacaacttcctgagcctgagcagcctgctgagaaatgaggtgacagacagcggcatcgtgggcccccagcccatcgactttgtgcccaatgccctgcggcatgctgtggatggccgctag

SEQ ID NO: 39109 - DNA, 333 bp, Artificial Sequence
  Description of Artificial Sequence: Synthetic coding sequence
atgtccttcaggaaggtgaacatcatcatcctggtgctggccgtggccctcttcctgctggtgctgcaccacaacttcctgagcctgagcagcctgctgagaaatgaggtgacagacagcggcatcgtgggcccccagcccatcgactttgtgcccaatgccctgcggcatgctgtggatggccggcaggaggagatccctgtggtgattgctgccagcgaggaccggctgggcggggccatcgccgccatcaacagcatccagcacaacaccaggagcaatgtcatcttctacatcgtgaccctgaacaacacagctgaccacctgaggtag

SEQ ID NO: 39110 - DNA, 1116 bp, Artificial Sequence; identical to SEQ ID NO: 39101
  Description of Artificial Sequence: Synthetic coding sequence

SEQ ID NO: 39111 - DNA, 270 bp, Artificial Sequence
  Description of Artificial Sequence: Synthetic coding sequence
atgtccttcaggaaggtgaacatcatcatcctggtgctggccgtggccctcttcctgctggtgctgcaccacaacttcctgagcctgagcagcctgctgagaaatgaggtgacagacagcggcatcgtgggcccccagcccatcgactttgtgcccaatgccctgcggcatgctgtggatggccggcaggaggagatccctgtggtgattgctgccagcgaggaccggctgggcggggccatcgccgccatcaacagcatccagcactag

SEQ ID NO: 39112 - DNA, 192 bp, Artificial Sequence
  Description of Artificial Sequence: Synthetic coding sequence
atgtccttcaggaaggtgaacatcatcatcctggtgctggccgtggccctcttcctgctggtgctgcaccacaacttcctgagcctgagcagcctgctgagaaatgaggtgacagacagcggcatcgtgggcccccagcccatcgactttgtgcccaatgccctgcggcatgctgtggatggccggcagtag

SEQ ID NO: 39113 - DNA, 483 bp, Artificial Sequence
  Description of Artificial Sequence: Synthetic coding sequence
atgctgcggcacctgcccagccggctgcctgtgaagatgtggggccgcaccctggagaagcagagctggagggacagcagccagaccccaccaccctgcctgatccggcggctggaccacatcgtgatgacagtgaagagcatcaaggacaccaccatgttctacagcaagatcctgggcatggaggtgatgaccttcaaggaggacaggaaggccctgtgctttggagaccagaagttcaacctgcacgaggtgggcaaggagtttgagcccaaggccgcccaccctgtgcccggcagcctggacatctgcctgatcacagaggtgcccctggaggagatgatccagcacctgaaggcctgtgatgtgcccatcgaggagggccctgtgcccaggactggagccaagggccccatcatgagcatctacttccgggaccctgacaggaacctgattgaggtgagcaactacatcagcagctag

SEQ ID NO: 39114 - DNA, 384 bp, Artificial Sequence
  Description of Artificial Sequence: Synthetic coding sequence
tgaatccggcggctggaccacatcgtgatgacagtgaagagcatcaaggacaccaccatgttctacagcaagatcctgggcatggaggtgatgaccttcaaggaggacaggaaggccctgtgcttcggggaccagaagttcaacctgcacgaggtgggcaaggagtttgagcccaaggccgcccaccctgtgcccggcagcctggacatctgcctgatcacagaggtgcccctggaggagatgatccagcacctgaaggcctgtgatgtgcccatcgaggagggccctgtgcccaggactggagccaagggccccatcatgagcatctacttccgggaccctgacaggaacctgattgaggtgagcaactacatcagcagctag

SEQ ID NO: 39115 - DNA, 2082 bp, Artificial Sequence
  Description of Artificial Sequence: Synthetic coding sequence
atgtggccccagccctacctgcccccccaccccatgatgctggaggagagccggcagaacaagctggccgccgccaagaagaagctgaaggagtaccagcagaggaagagccctggcatcccagctggggccaagaccaagaagaagaagacagacagcagccctgagaccaccaccagcggcggctgccacagccctggggacagccagtaccaggagctggccgtggccctggagagcagctctgtgaccatcagccagctgaatgaaaacatcgagagcctgaagcagcagaagaagcaggtggagcaccagctggaggaggccaagaagaccaacaatgagatccacaaggcccagatggagcggctggagaccatcaacatcctgaccctggagaaggctgacctgaagaccaccctgtaccacaccaagagagctgcccggcactttgaggaggagagcaaggacctggccggccgcctgcagtacagcctgcagaggatccaggagctggagcgggccctgtgtgctgtgtccacccagcagcaggaggaggacaggagcagcagctgccgggaggccgtgctgcagcgctggctgcagcagaccatcaaggagcgggccctgctgaatgcccacgtgacccaggtgacagagagcctgaagcaggtgcagctggagagagatgaatatgccaagcacatcaagggggagcgggcccgctggcaggagaggatgtggaagatgtctgtggaggcccggaccctgaaggaggagaagaagagggacatccaccgcatccaggagctggagaggagcctgtctgagctgaagaaccagatggccgagccccccagcctggcccccccagctgtgacctctgtggtggagcagctgcaggatgaggccaagcacctgcggcaggaggtggagggcctggagggcaagctgcagagccaggtggagaacaaccaggccctgagcctgctgagcaaggagcagaagcagaggctgcaggagcaggaggagatgctgcgggagcaggaggcccagagggtgcgggagcaggagcggctgtgtgagcagaatgaaaggctgcgggagcagcagaagaccctgcaggagcagggcgagcggctgaggaagcaggagcagaggctgaggaagcaggaggagcggctgaggaaggaggaggagcggctgcagaagcaggagaagaggctgtgggaccaggaggagcggctgtggaagaaggaggagcggctgcagaagcaggaggagcggctggccctgagccagaaccacaagctggacaagcagctggccgagccccagtgcagctttgaggacctgaacaatgagaagaagagcgccctgcagctggagcagcaggtgaaggagctgcaggagaagctggatgaggagcacctggaggccgccagccaccagaaccagcagctggagacccagctgagcctggtggccctgcccggggagggagatggcggccagcacctggacagcgaggaggaggaggccccccggcccacccccaacatccctgaggacctggagagccgggaggccaccagcagcttcatggacctgcccaaggagaaggcagatggaacagagcaggtggagcggcgggagctgggctttgtgcagcccagcggcgtgacagatggcatgagggagagcttcaccgtgtatgagagccagggcgctgtgcccaacaccaggcaccaggagatggaggatgtgatccggctggcccagaaggaggaggagatgaaggtgaagctgctggagctgcaggagctggtgctgcccctggtgggcaaccacgagggccacggcaagttcctgattgctgcccagaacccagcagatgagcccacccctggggccccagccccccaggagctgggcgctgctggggagcaggatgtgttctatgaggtgtccctggacaacaacgtggagcccgcccctggggccgcccgggagggcagcccccatgacaaccccaccgtgcagcagatcgtgcagctgagccctgtgatgcaggacacctag

SEQ ID NO: 39116 - DNA, 2082 bp, Artificial Sequence
  Description of Artificial Sequence: Synthetic coding sequence
atgtggccccagccctacctgcccccccaccccatgatgctggaggagagccggcagaacaagctggccgccgccaagaagaagctgaaggagtaccagcagaggaagagccctggcatcccagctggggccaagaccaagaagaagaagacagacagcagccctgagaccaccaccagcggcggcggccacagccctggggacagccagtaccaggagctggccgtggccctggagagcagctctgtgaccatcagccagctgaatgaaaacatcgagagcctgaagcagcagaagaagcaggtggagcaccagctggaggaggccaagaagaccaacaatgagatccacaaggcccagatggagcggctggagaccatcaacatcctgaccctggagaaggctgacctgaagaccaccctgtaccacaccaagagagctgcccggcactttgaggaggagagcaaggacctggccggccgcctgcagtacagcctgcagaggatccaggagctggagcgggccctgtgtgctgtgtccacccagcagcaggaggaggacaggagcagcagctgccgggaggccgtgctgcaccggcggctgcagcagaccatcaaggagcgggccctgctgaatgcccacgtgacccaggtgacagagagcctgaagcaggtgcagctggagagagatgaatatgccaagcacatcaagggggagcgggcccgctggcaggagaggatgtggaagatgtctgtggaggcccggaccctgaaggaggagaagaagagggacatccaccgcatccaggagctggagaggagcctgtctgagctgaagaaccagatggccaagccacccagcctggcccccccagctgtgacctctgtggtggagcagctgcaggatgaggccaagcacctgcggcaggaggtggagggcctggagggcaagctgcagagccaggtggagaacaaccaggccctgagcctgctgagcaaggagcagaagcagaggctgcaggagcaggaggagatgctgcgggagcaggaggtgcagagggtgcgggagcaggagcggctgtgtgagcagaatgaaaggctgcgggagcagcagaagaccctgcaggagcagggcgagcggctgaggaagcaggagcagaggctgaggaagcaggaggagcggctgaggaaggaggaggagcggctgcagaagcaggagaagaggctgtgggaccaggaggagcggctgtggaagaaggaggagcggctgcagaagcaggaggagcggctggccctgagccagaaccacaagctggacaagcagctggccgagccccagtgcagctttgaggacctgaacaatgagaagaagagcgccctgcagctggagcagcaggtgaaggagctgcaggagaagctggatgaggagcacctggaggccgccagccagcagaaccagcagctggagacccagctgagcctggtggccctgcccggggagggagatggcggccagcacctggacagcgaggaggaggaggccccccggcccacccccaacatccctgaggacctggagagccgggaggccaccagcagcttcatggacctgcccaaggagaaggcagatggaacagagcaggtggagcggcgggagctgggctttgtgcagcccagcggcgtgacagatggcatgagggagagcttcaccgtgtatgagagccagggcgctgtgcccaacaccaggcaccaggagatggaggatgtgatccggctggcccagaaggaggaggagatgaaggtgaagctgctggagctgcaggagctggtgctgcccctggtgggcaaccacgagggccacggcaagttcctgattgctgcccagaacccagcagatgagcccacccctggggccccagccccccaggagctgggcgctgctggggagcaggatgacttctatgaggtgtccctggacaacaacgtggagcccgcccctggggccgcccgggagggcagcccccatgacaaccccaccgtgcagcagatcgtgcagctgagccctgtgatgcaggacacctag

SEQ ID NO: 39117 - DNA, 2082 bp, Artificial Sequence
  Description of Artificial Sequence: Synthetic coding sequence
atgtggccccagccctacctgcccccccaccccatgatgctggaggagagccggcagaacaagctggccgccgccaagaagaagctgaaggagtaccagcagaggaagagccctggcatcccagctggggccaagaccaagaagaagaagacagacagcagccctgagaccaccaccagcggcggcggccacagccctggggacagccagtaccaggagctggccgtggccctggagagcagctctgtgaccatcaaccagctgaatgaaaacatcgagagcctgaagcagcagaagaagcaggtggagcaccagctggaggaggccaagaagaccaacaatgagatccacaaggcccagatggagcagctggagaccatcaacatcctgaccctggagaaggctgacctgaagaccaccctgtaccacaccaagagagctgcccggcactttgaggaggagagcaaggacctggccggccgcctgcagtacagcctgcagaggatccaggagctggagcgggccctgtctgctgtgtccacccagcagcaggaggaggacaggagcagcagctgccgggaggccgtgctgcagaggcggctgcagcagaccatcaaggagcgggccctgctgaatgcccacgtgacccaggtgacagagagcctgaagcaggtgcagctggagagagatgaatatgccaagcacatcaagggggagcgggcccgctggcaggagaggatgtggaagatgtctgtggaggcccggaccctgaaggaggagaagaagagggacatccaccgcatccaggagctggagaggagcctgtctgagctgaagaaccagatggccgagccccccagcctggcccccccagctgtgacctctgtggtggagcagctgcaggatgaggccaagcacctgcggcaggaggtggagggcctggagggcaagctgcagagccaggtggagaacaaccaggccctgagcctgctgagcaaggagcagaagcagaggctgcaggagcaggaggagatgctgcgggagcaggaggcccagagggtgcgggagcaggagcggctgtgtgagcagaatgaaaggctgcgggagcagcagaagaccctgcaggagcagggcgagcggctgaggaagcaggagcagaggctgaggaagcaggaggagcggctgaggaaggaggaggagcggctgcagaagcaggagaagaggctgtgggaccaggaggagcggctgtggaagaaggaggagcggctgcagaagcaggaggagcggctggccctgagccagaaccacaagctggacaagcagctggccgagccccagtgcagctttgaggacctgaacaatgagaagaagagcgccctgcagctggagcagcaggtgaaggagctgcaggagaagctggatgaggagcacctggaggccgccagccagaggaaccagcagctggagacccagctgagcctggtggccctgcccggggagggagatggcggccagcacctggacagcgaggaggaggaggccccccggcccacccccaacatccctgaggacctggagagccgggaggccaccagcagcttcatggacctgcccaaggagaaggcagatggaacagagcaggtggagcggcgggagctgggctttgtgcagcccagcggcgtgacagatggcatgagggagagcttcaccgtgtatgagagccagggcgctgtgcccaacaccaggcaccaggagatggaggatgtgatccggctggcccagaaggaggaggagatgaaggtgaagctgctggagctgcaggagctggtgctgcccctggtgggcaaccacgagggccacggcaagttcctgattgctgcccagaacccagcagatgagcccacccctggggccccagccccccaggagctgggcgctgctggggagcaggatgacttctatgaggtgtccctggacaacaacgtggagcccgcccctggggccgcccgggagggcagcccccatgacaacccccctgtgcagcagatcgtgcagctgagccctgtgatgcaggacacctag

SEQ ID NO: 39118 - DNA, 2082 bp, Artificial Sequence
  Description of Artificial Sequence: Synthetic coding sequence
atgtggccccagccctacctgcccccccaccccatgatgctggaggagagccggcagaacaagctggccgccgccaagaagaagctgaaggagtaccagcagaggaagagccctggcatcccagctggggccaagaccaagaagaagaagacagacagcagccctgagaccaccaccagcggcggcggccacagccctggggacagccagtaccaggagctggccgtggccctggagagcagctctgtgaccatcaaccagctgaatgaaaacatcgagagcctgaagcagcagaagaagcaggtggagcaccagctggaggaggccaagaagaccaacaatgagatccacaaggcccagatggagcagctggagaccatcaacatcctgaccctggagaaggctgacctgaagaccaccctgtaccacaccaagagagctgcccggcactttgaggaggagagcaaggacctggccggccgcctgcagtacagcctgcagcacatccaggagctggagcgggccctgtgtgctgtgtccacccagcagcaggaggaggacaggagcagcagctgccgggaggccgtgctgcagaggcggctgcagcagaccatcaaggagcgggccctgctgaatgcccacgtgacccaggtgacagagagcctgaagcaggtgcagctggagagagatgaatatgccaagcacatcaagggggagcgggcccgctggcaggagaggatgtggaagatgtctgtggaggcccggaccctgaaggaggagaagaagagggacatccaccgcatccaggagctggagaggagcctgtctgagctgaagaaccagatggccgagccccccagcctggcccccccagctgtgacctctgtggtggagcagctgcaggatgaggccaagcacctgcggcaggaggtggagggcctggagggcaagctgcagagccaggtggagaacaaccaggccctgagcctgctgagcaaggagcagaagcagaggctgcaggagcaggaggagatgctgcgggagcaggaggcccagagggtgcgggagcaggagcggctgtgtgagcagaatgaaaggctgcgggagcagcagaagaccctgcaggagcagggcgagcggctgaggaagcaggagcagaggctgaggaagcaggaggagcggctgaggaaggaggaggagcggctgcagaagcaggagaagaggctgtgggaccaggaggagcggctgtggaagaaggaggagcggctgcagaagcaggaggagcggctggccctgagccagaaccacaagctggacaagcagctggccgagccccagtgcagctttgaggacctgaacaatgagaagaagagcgccctgcagctggagcagcaggtgaaggagctgcaggagaagctggatgaggagcacctggaggccgccagccagaggaaccagcagctggagacccagctgagcctggtggccctgcccggggagggagatggcggccagcacctggacagcgaggaggaggaggccccccggcccacccccaacatccctgaggacctggagagccgggaggccaccagcagcttcatggacctgcccaaggagaaggcagatggaacagagcaggtggagcggcgggagctgggctttgtgcagcccagcggcgtgacagatggcatgagggagagcttcaccgtgtatgagagccagggcgctgtgcccaacaccaggcaccaggagatggaggatgtgatccggctggcccagaaggaggaggagatgaaggtgaagctgctggagctgcaggagctggtgctgcccctggtgggcaaccacgagggccacggcaagttcctgattgctgcccagaacccagcagatgagcccacccctggggccccagccccccaggagctgggcgctgctggggagcaggatgtgttctatgaggtgtccctggacaacaacgtggagcccgcccctggggtggcccgggagggcagcccccacaacaaccccaccgtgcagcagatcgtgcagctgagccctgtgatgcaggacacctag

SEQ ID NO: 39119 - DNA, 2007 bp, Artificial Sequence
  Description of Artificial Sequence: Synthetic coding sequence
atgctgatgtggccccagccccacctgcccacccacccccacctgcccacccacccccacctgcccacccacccccacctgcccacccacccccacctgcccacccacccccacctgcccacccacccccacctgcccacccaccccatgatgagcaaggagacccggcagagcaagctggccgaggccaaggagcagctgacagaccaccacccccagaccaaccccagcgtgggcacagctgccagtgacaccaagaagaagaagatcaacaacggcaccaaccctgagaccaccaccagcggcggctgccacagcccagaagatgagcagaaggccagccaccagcaccaggaggccctgcggcgggagctggaggcccaggtgcacaccatccgcatcctgacctgccagaagacagagctgcagatggccctgtactacagccagcacgctgtgaagcagctggagggggaggcccgggacctgatcagccggctgcatgacagctggaagtttgctggggagctggagcaggccctgtctgctgtggccacccagaagaagaaggctgaccgctacatcgaggagctgaccaaggagagagatgccctgagcctggagctgtacagaaacaccatcacagatgaggagctgaaggagaagaatgccaagctgcaggagaagctgcagctggtggagagcgagaagtctgagatccagctgaatgtgaaggagctgaagaggaagctggagcgggccaagctgctgctgccccagcagcagctgcaggccgaggccgaccacctgggcaaggagctgcagagcgtgtctgccaagctgcaggcccaggtggaggagaatgagctgtggaaccggctgaaccagcagcaggaggagaagatgtggaggcaggaggagaagatccaggagtgggaggagaagatccaggagcaggaggagaagatccgggagcaggaggagaagatccgggagcaggaggagaagatgaggcggcaggaggagatgatgtgggagaaggaggagaagatgaggcggcaggaggagatgatgtgggagaaggaggagaagatgaggcggctggaggagatgatgtgggagaaggaggagaagatccgggagctggaggagaagatgcatgagcaggagaagatccgggagcaggaggagaagaggcaggaggaggagaagatccgggagcaggagaagaggcaggagcaggaggccaagatgtggaggcaggaggagaagatccgggagcaggaggagaagatccgggagcaggagaagaagatgtggaggcaggaggagaagatccacgagcaggagaagatccgggaggaggagaagaggcaggagcaggaggagatgtggaggcaggaggagaagatccgggagcaggaggagatctggaggcagaaggagaagatgcatgagcaggagaagatcaggaagcaggaggagaaggtgtggaggcaggaggagaagatgcatgaccaggaggagaagatccgggagcaggaggagaagatgtggaggcaggaggagaagatccgggagcaggaggagaagatccgggagcaggaggagaagatccgggagcaggaggagatgatgcaggagcaggaggagaagatgggagagcaggaggagaagatgcaggagcaggagaagatgaggcggcaggaggagaagatccgggagcaggaggagaagatccgggagcagaaggagaagatccgggagcaggaggagaagatctgggagcaggaggagaagatccgggagcaggaggagatgatgcaggagcaggaggagaagatgtgggagcaggaggagaagatgtgtgagcaggaggagaagatgcaggagcaggaggagaagatgaggcggcaggaggagaagatgtgggagcaggaggtgcggctgcggcagcaggaggagaagatgcaggagcaccaggagcacctggaggccgccatctag

SEQ ID NO: 39120 - DNA, 1857 bp, Artificial Sequence
  Description of Artificial Sequence: Synthetic coding sequence
atgatgagcaaggagacccggcagagcaagctggccgaggccaaggagcagctgacagaccaccacccccagaccaaccccagcgtgggcacagctgccagtgacaccaagaagaagaagatcaacaacggcaccaaccctgagaccaccaccagcggcggctgccacagcccagaagatgagcagaaggccagccaccagcaccaggaggccctgcggcgggagctggaggcccaggtgcacaccatccgcatcctgacctgccagaagacagagctgcagatggccctgtactacagccagcacgctgtgaagcagctggagggggaggcccgggacctgatcagccggctgcatgacagctggaagtttgctggggagctggagcaggccctgtctgctgtggccacccagaagaagaaggctgaccgctacatcgaggagctgaccaaggagagagatgccctgagcctggagctgtacagaaacaccatcacagatgaggagctgaaggagaagaatgccaagctgcaggagaagctgcagctggtggagagcgagaagtctgagatccagctgaatgtgaaggagctgaagaggaagctggagcgggccaagctgctgctgccccagcagctgcaggccgaggccgaccacctgggcaaggagctgcagagcgtgtctgccaagctgcaggcccaggtggaggagaatgagctgtggaaccggctgaaccagcagcaggaggagaagatgtggaggcaggaggagaagatccaggagtgggaggagaagatccaggagcaggaggagaagatccgggagcaggaggagaagatccgggagcaggaggagaagatgaggcggcaggaggagatgatgtgggagaaggaggagaagatgaggcggcaggaggagatgatgtgggagaaggaggagaagatgaggcggctggaggagatgatgtgggagaaggaggagaagatccgggagctggaggagaagatgcatgagcaggagaagatccgggagcaggaggagaagaggcaggaggaggagaagatccgggagcaggagaagaggcaggagcaggaggccaagatgtggaggcaggaggagaagatccgggagcaggaggagaagatccgggagcaggagaagaagatgtggaggcaggaggagaagatccacgagcaggagaagatccgggaggaggagaagaggcaggagcaggaggagatgtggaggcaggaggagaagatccgggagcaggaggagatctggaggcagaaggagaagatgcatgagcaggagaagatcaggaagcaggaggagaaggtgtggaggcaggaggagaagatgcatgaccaggaggagaagatccgggagcaggaggagaagatgtggaggcaggaggagaagatccgggagcaggaggagaagatccgggagcaggaggagaagatccgggagcaggaggagatgatgcaggagcaggaggagaagatgggagagcaggaggagaagatgcaggagcaggagaagatgaggcggcaggaggagaagatccgggagcaggaggagaagatccgggagcagaaggagaagatccgggagcaggaggagaagatctgggagcaggaggagaagatccgggagcaggaggagatgatgcaggagcaggaggagaagatgtgggagcaggaggagaagatgtgtgagcaggaggagaagatgcaggagcaggaggagaagatgaggcggcaggaggagaagatgtgggagcaggaggtgcggctgcggcagcaggaggagaagatgcaggagcaccaggagcacctggaggccgccatctag

SEQ ID NO: 39121 - DNA, 1143 bp, Artificial Sequence
  Description of Artificial Sequence: Synthetic coding sequence
atgtggccccagccccggctgcccccccacccagccatgtctgagaagacccagcagggcaagctggccgccgccaagaagaagctgaaggcctactggcagaggaagagccctggcatcccagctggggccaacaggaagaagaaggtgaatggcagcagcccagacacagccaccagcggcggctaccacagccctggggacagcgccaccggcatctacggggagggccgggccagcagcaccaccctgcaggacctggagagccagtaccaggagctggccgtggccctggacagcagcagcgccatcatcagccagctgacagagaacatcaacagcctggtgaggaccagcaaggaggagaagaagcatgagatccacctggtgcagaagctgggccgcagcctcttcaagctgaagaaccagacagctgagcccctggcccctgagcccccagctggccccagcaaggtggagcagctgcaggatgagaccaaccacctgaggaaggagctggagagcgtgggccggcagctgcaggccgaggtggagaacaaccagatgctgagcctgctgaacagacggcaggaggagcggctgcgggagcaggaggagcggctgcacgagcaggaggagcggctgcacgagcaggaggagcggctgtgtgagcaggaggagcggctgtgtgagcaggaggagcggctgcgggagcaggaggagcggctgcgggagcaggaggagcggctgcacgagcaggaggagcggctgtgtgagcaggaggagcggctgtgtgagcaggaggagcggctgtgtgagcaggagaagctgcccggccaggagcggctgctggaggaggtggagaagctgctggagcaggagcggcggcaggaggagcaggagcggctgctggagcgggagcggctgtggacccgctggaggagctcctggagcagaagaggcttcggcaacaggatgaggggctgcggcagccggcggctgtgtggctcctggaggggctgcggctcctggaggggctgcggctcctggaggggctgcggctcctggaggggctgctggagctggggcggcaagccctgcaccagcagcggccccagccatgctgctgccagccgctcctag

SEQ ID NO: 39122 - DNA, 1440 bp, Artificial Sequence
  Description of Artificial Sequence: Synthetic coding sequence
atgtggccccagccccggctgcccccccacccagccatgtctgagaagacccagcagggcaagctggccgccgccaagaagaagctgaaggcctactggcagaggaagagccctggcatcccagctggggccaacaggaagaagaaggtgaatggcagcagcccagacacagccaccagcggcggctaccacagccctggggacagcgccaccggcatctacggggagggccgggccagcagcaccaccctgcaggacctggagagccagtaccaggagctggccgtggccctggacagcagcagcgccatcatcagccagctgacagagaacatcaacagcctggtgaggaccagcaaggaggagaagaagcatgagatccacctggtgcagaagctgggccgcagcctcttcaagctgaagaaccagacagctgagcccctggcccctgagcccccagctggccccagcaaggtggagcagctgcaggatgagaccaaccacctgaggaaggagctggagagcgtgggccggcagctgcaggccgaggtggagaacaaccagatgctgagcctgctgaacagacggcaggaggagcggctgcgggagcaggaggagcggctgcacgagcaggaggagcggctgcacgagcaggaggagcggctgtgtgagcaggaggagcggctgtgtgagcaggaggagcggctgcgggagcaggaggagcggctgcgggagcaggaggagcggctgcacgagcaggaggagcggctgtgtgagcaggaggagcggctgtgtgagcaggaggagcggctgtgtgagcaggagaagctgcccggccaggagcggctgctggaggaggtggagaagctgctggagcaggagcggcggcaggaggagcaggagcggctgctggagcgggagcggctgctggatgaggtggaggagctgctggagcaggagcggctgcggcagcaggatgagcggctgtggcagcaggagaccctgcgggagctggagcggctgcgggagctggagcggctgcgggagctggagcggctgcgggagctggagaggatgctggagctgggctgggaggccctgtatgagcagagagctgagcccaggagcggctttgaggagctgaacaatgaaaacaagagcaccctgcagctggagcagcaggtgaaggagctggagaagtctggaggagctgaggagccccggggcagcgagagcgctgctgctgcccggcctgtgcctggggcccctgtgccccagggcgcctggatgtgtggccaggccggctggaccccccaggagcaccctggcctgtctggagaggccgtgggcactggagaggccgccggcggcgctgaggaggccgcctgccacagcttccgggctgctgagaaccgggagctgaacatcaccatcatctag

SEQ ID NO: 39123 - DNA, 1953 bp, Artificial Sequence
  Description of Artificial Sequence: Synthetic coding sequence
atgtggccccagccccacctgcccccccaccccatgatgtctgagaagacccggcagaacaagctggccgaggccaagaagaagttcacagactaccggcagtggaacattgctggggtgggcacccgggccacagacaccaagaagaagaagatcaacaacggcaccaaccctgagaccaccaccagcgagggctgccacagccctgaggacacccagcagaacagagcccagctgaaggaggagaagaaggccagccaccagcaccaggaggccctgcggcgggagattgaggcccaggaccacaccatccgcatcctgacctgccagaagacagagctggagacagccctgtactacagccaggatgctgccaggaagtttgaagatggcaacctgggcacccccagcagcttcaacctggccctgagccaggccttccggggcagccccctgggctgtgtgtccaccagcctcatccctggagagagcaaggacctggccggccgcctgcaccacagctggcactttgctggggagctgcagagggccctgtctgctgtgtccacctggcacaagaaggctgaccgctacatcgaggagctgaccaaggagagagatgccctgagcctggagctgtacagaaacaccatcaccaatgaggagctgaagaagaagaatgctgagctgcaggagaagctgcggctggccgagagcgagaagtctgagatccagctgaatgtgaaggagctgaagaggaagctggagcgggccaagttcctgctgccccaggtgcagaccaacaccctgcaggaggagatgtggaggcaggaggaggagctgcgggagcaggagaagaagatcaggaagcaggaggagaagatgtggaggcaggaggagcggctgcgggagcaggagggcaagatgagggagcaggaggagaagatgaggcggcaggagaagaggctgcgggagcaggagaaggagctgcgggagcaggagaaggagctgcgggagcagaagaagctgcgggagcaggaggagcagatgcaggagcaggaggagaagatgtgggagcaggaggagaagatgagggagcaggaggagaagatgtggaggcaggaggagcggctgtgggagcaggagaagcagatgagggagcaggagcagaagatgagggaccaggaggagaggatgtgggagcaggatgagcggctgcgggagaaggaggagaggatgagggagcaggagaagatgtgggagcaggtggagaagatgagggaggagaagaagatgcaggagcaggagaagaagacccgggaccaggaggagaagatgcaggaggaggagcgcatccgggagcgggagaagaagatgagggaggaggaggagaccatgagggagcaggaggagaagatgcagaagcaggaggagaacatgtgggagcaggaggagaaggagtggcagcagcagaggctgcctgagcagaaggagaagctgtgggagcaggagaagatgcaggagcaggaggagaagatctgggagcaggaggagaagatccgggaccaggaggagatgtggggccaggagaagaagatgtggaggcaggagaagatgagggagcaggaggatgagatgagggagaaggaggagcgcatccgggaccagaaggagaagatgcaggagcggctgcctgagcacgaggagcgctgcagcgagccctgcctgccccccagcaaggtgctgtgcaacatgagccacacaggctctgtggagcctgctggaggagaggccggggagggcagcccccaggacaaccccacagcccaggagatcatgcagctgttctgtggcatgaagaatgcccagcagtgccccggcctgggcagcaccagctgcatccccttcttctacagaggagacaagaggaagatgaagatcatcaacatctag

SEQ ID NO: 39124 - DNA, 945 bp, Artificial Sequence
  Description of Artificial Sequence: Synthetic coding sequence
atgtggaggcaggaggaggagctgcgggagcaggagaagaagatcaggaagcaggaggagaagatgtggaggcaggaggagcggctgcgggagcaggagggcaagatgagggagcaggaggagaagatgaggcggcaggagaagaggctgcgggagcaggagaaggagctgcgggagcaggagaaggagctgcgggagcagaagaagctgcgggagcaggaggagcagatgcaggagcaggaggagaagatgtgggagcaggaggagaagatgagggagcaggaggagaagatgtggaggcaggaggagcggctgtgggagcaggagaagcagatgagggagcaggagcagaagatgagggaccaggaggagaggatgtgggagcaggatgagcggctgcgggagaaggaggagaggatgagggagcaggagaagatgtgggagcaggtggagaagatgagggaggagaagaagatgcaggagcaggagaagaagacccgggaccaggaggagaagatgcaggaggaggagcgcatccgggagcgggagaagaagatgagggaggaggaggagaccatgagggagcaggaggagaagatgcagaagcaggaggagaacatgtgggagcaggaggagaaggagtggcagcagcagaggctgcctgagcagaaggagaagctgtgggagcaggagaagatgcaggagcaggaggagaagatctgggagcaggaggagaagatccgggaccaggaggagatgtggggccaggagaagaagatgtggaggcaggagaagatgagggagcaggaggatgtgggcgctggaggagatgcccgggagggcggggaggacaccaggtctgagcgggaggatgctggggaggccgcccgggcccggggagctgtgctgcgggccctgccccccagcctgcagagcagcctgtag

SEQ ID NO: 39125 - DNA, 753 bp, Artificial Sequence
  Description of Artificial Sequence: Synthetic coding sequence
atgctgagcctgctgaacagacggcaggaggagcggctgcgggagcaggaggagcggctgcgggagcaggaggagcggctgcgggagcaggaggagcggctgtgtgagcaggaggagcggctgcgggagcaggaggagcggctgtgtgagcaggagaagctgcccggccaggagcggctgctggaggaggtggagaagctgctggagcaggagcggcggcaggaggagcaggagcggctgctggagcgggagcggctgctggaggaggtggagaagctgctggagcaggagcggctgcggcagcaggatgagcggctgtggcagcaggagaccctgcaggagctggagcggctgcgggagctggagcggctgcgggagctggagaggatgctggagctgggctgggaggccctgtatgagcagagagctgagcccaggagcggctttgaggagctgaacaatgaaaacaagagcaccctgcagctggagcagcaggtgaaggagctgaagaagagcggcggcgctgaggagccccggggcagcgagagcgctgctgctgcccggcctgtggccggggcccctgtgccccagggcgcctggatgtgtggccaggccggctggaccccccaggagcaccctggcctgagcggggaggccgtgggcaccggggaggccgccggcggggccggggaggccgcctgccacagcttccgggcagcagaaaatcgggagctgaacatcaccatcatctag

SEQ ID NO: 39126 - DNA, 348 bp, Artificial Sequence
  Description of Artificial Sequence: Synthetic coding sequence
cacctgcggctgcggcagcaggatgagcggctgtggcagcaggagaccctgcaggagctggagcggctgcgggagctggagcggctgcgggagctggagaggatgctggagctgggctgggaggccctgtatgagcagagagctgagcccaggagcggctttgaggagctgaacaatgaaaacaagagcaccctgcagctggagcagcaggtgaaggagctgaagaagtctggagagctgaaggagaccgtgaccagtgaccccagcaagaagatgtgggaggccggcaccagcctgtggggcggggaggtgcccggccaccggcagctgcagcccggggacagatag

SEQ ID NO: 39127 - DNA, 2253 bp, Artificial Sequence
  Description of Artificial Sequence: Synthetic coding sequence
atgctgatgtggccccagccccacctgcccacccacccccacctgcccacccacccccacctgcccacccacccccacctgcccacccacccccacctgcccacccacccccacctgcccacccacccccacctgcccacccaccccatgatgagcaaggagacccggcagagcaagctggccgaggccaaggagcagctgacagaccaccacccccagaccaaccccagcgtgggcacagctgccagtgacaccaagaagaagaagatcaacaacggcaccaaccctgagaccaccaccagcggcggctgccacagcccagaagatgagcagaaggccagccaccagcaccaggaggccctgcggcgggagctggaggcccaggtgcacaccatccgcatcctgacctgccagaagacagagctgcagatggccctgtactacagccagcacgctgtgaagcagctggagggggaggcccgggacctgatcagccggctgcatgacagctggaagtttgctggggagctggagcaggccctgtctgctgtggccacccagaagaagaaggctgaccgctacatcgaggagctgaccaaggagagagatgccctgagcctggagctgtacagaaacaccatcacagatgaggagctgaaggagaagaatgccaagctgcaggagaagctgcagctggtggagagcgagaagtctgagatccagctgaatgtgaaggagctgaagaggaagctggagcgggccaagctgctgctgccccagcagcagctgcaggccgaggccgaccacctgggcaaggagctgcagagcgtgtctgccaagctgcaggcccaggtggaggagaatgagctgtggaaccggctgaaccagcagcaggaggagaagatgtggaggcaggaggagaagatccaggagtgggaggagaagatccaggagcaggaggagaagatccgggagcaggaggagaagatccgggagcaggaggagaagatgaggcggcaggaggagatgatgtgggagaaggaggagaagatgaggcggcaggaggagatgatgtgggagaaggaggagaagatgaggcggcaggaggagatgatgtgggagaaggaggagaagatgaggcggcaggaggagatgatgtgggagaaggaggagaagatccgggagctggaggagaagatgcatgagcaggagaagatccgggagcaggaggagaagaggcaggaggaggagaagatccgggagcaggagaagaggcaggagcaggaggccaagatgtggaggcaggaggagaagatccgggagcaggaggagaagatccgggagcaggagaagaagatgtggaggcaggaggagaagatccacgagcaggagaagatccgggaggaggagaagaggcaggagcaggaggagatgtggaggcaggaggagaagatccacgagcaggaggagatctggaggcagaaggagaagatgcatgagcaggaggagaagatcaggaagcaggaggagaaggtgtggaggcaggaggagaagatccgggagcaggaggagaagatccgggagcaggaggagaagatgtggaggcaggaggagaagatccgggagcaggaggagatgtggagggaggaggagaagatgcatgagcaggagaagatctgggaggaggagaagaggcaggagcaggaggacaagatgtggaggcaggaggagaagatccgggagcaggaggagaaggtgtggaggcaggaggagaagatccgggagcaggaggagaagaggcaggagcaggaggagaagatgtggaagcaggaggagaagatccgggagcaggaggagaagatccaggagcaggaggagaagatccgggagcaggaggagaagatccgggagcaggaggagatgacccaggagcaggaggagaagatgggagagcaggaggagaagatgtgtgagcaggaggagaagatgcaggagcaggaggagaccatgtggaggcaggaggagaagatccgggagcaggagaagaagatccgggagcaggaggagaagatccgggagcaggaggagatgatgcaggagcaggaggagaagatgtgggagcaggaggagaagatgtgtgagcaggaggagaagatgcaggagcaggaggagaagatgaggcggcaggaggagaagatgtgggagcaggaggtgcggctgcggcagcaggaggagaagatgcaggagcactag

SEQ ID NO: 39128 - DNA, 1299 bp, Artificial Sequence
  Description of Artificial Sequence: Synthetic coding sequence
atgtggccccagccccggctgcccccccacccagccatgtctgagaagacccagcagggcaagctggccgccgccaagaagaagctgaaggcctactggcagaggaagagccctggcatcccagctggggccaacaggaagaagaaggtgaatggcagcagcccagacacagccaccagcggcggctaccacagccctggggacagcgccaccggcatctacggggagggccgggccagcagcaccaccctgcaggacctggagagccagtaccaggagctggccgtggccctggacagcagcagcgccatcatcagccagctgacagagaacatcaacagcctggtgaggaccagcaaggaggagaagaagcatgagatccacctggtgcagaagctgggccgcagcctcttcaagctgaagaaccagacagctgagcccctggccccccagcccccagctggccccagcaaggtggagcagctgcaggatgagaccaaccacctgaggaaggagctggagagcgtgggccggcagctgcaggccgaggtggagaacaaccagatgctgagcctgctgaacagacggcaggaggagcggctgcgggagcaggaggagcggctgcgggagcaggaggagcggctgtgtgagcaggaggagcggctgtgtgagcaggaggagcggctgcgggagcaggaggagcggctgtgtgagcaggagaagctgcccggccaggagcggctgctggaggaggtggagaagctgctgaagcaggagcggcggcaggaggagcaggagcggctgctggagcgggagcggctgctggatgaggtggaggagctgctggagcaggagcggctgcggcagcaggatgagcggctgtggcagcaggagaccctgcgggagctggagcggctgcgggagctggagaggatgctggagctgggctgggaggccctgtatgagcagagagctgagcccaggagcggctttgaggagctgaacaatgaaaacaagagcaccctgcagctggagcagcaggtgaaggagctggagaagagcggcggcgctgaggagccccggggcagcgagagcgctgctgctgcccggcctgtgcctggggcccctgtgccccagggcgcctggatgtgtggccaggccggctggaccccccaggagcaccctggcctgagcggggaggccgtgggcaccggggaggccgccggcggggccggggaggccgcctgccacagcttccgggcagcagaaaatcgggagctgaacatcaccatcatctag

SEQ ID NO: 39129 - DNA, 1812 bp, Artificial Sequence
  Description of Artificial Sequence: Synthetic coding sequence
atggccgaggagaccggccagagcaagctggccgccgccaagaagaagttcaaggagtactggcagaggaacagacctggggtgcctgctgctgccaagaggaacaccaaggccaacggcagcagccctgagacagctgccagcggcggctgccacagcagcgaggccagcagcagcgccagcagcagcctgcacgcccggcagagcccctgccaggagcaggccgctgtgctgaacagccgcagcatcaagatcagccggctgaatgacaccatcaagagcctgaagcagcagaagaagcaggtggagcaccagctggaggaggagaagaaggccaacaatgagaagcagaaggccgagcgggagctggagggccagatccagaggctgaacacagagaagaagaagctgaacacagacctgtaccacatgaagcacagcctgcgctactttgaggaggagagcaaggacctggccggccgcctgcagaggagcagccagagaattggagagctggagtggagcctgtgtgctgtggccgccacccagaagaagaagccagatggcttcagcagccgcagcaaggccctgctgaagaggcagctggagcagagcatccgggagcagatcctgctgaagggccacgtgacccagctgaaggagagcctgaaggaggtgcagctggagcgggaccagtatgcagagcagatcaagggggagcgggcccagtggcagcagaggatgaggaagatgagccaggaggtgtgcaccctgaaggaggagaagaagcatgacacccaccgggtggaggagctggagaggagcctgagccggctgaagaaccagatggccgagcccctgcccccagatgccccagctgtgagcagcgaggtggagctgcaggacctgaggaaggagctggagcgggtggccggggagctgcaggcccaggtggagaacaaccagtgcatcagcctgctgaacagaggccagaaggagcggctgcgggagcaggaggagcggctgcaggagcagcaggagcggctgcgggagcgggagaagaggctgcagcagctggccgagccccagagcgacctggaggagctgaagcatgagaacaagagcgccctgcagctggagcagcaggtgaaggagctgcaggagaagctgggccaggtgatggagaccctgaccagcgctgagaaggagcctgaggccgctgtgcctgccagcggcactggaggagagagcagcggcctgatggacctgctggaggagaaggctgacctgcgggagcacgtggagaagctggagctgggcttcatccagtacagaagagagcgctgccaccagaaggtgcaccggctgctgacagagcccggggacagcgccaaggatgccagccctgggggcggccaccaccaggccggccctggccagggcggggaggagggggaggccgccggggctgctggagatggagtggccgcctgtggcagctacagcgagggccacggcaagttcctggccgccgccagaaatcctgctgctgagcccagccctggggccccagccccccaggagctgggcgctgctgacaagcatggagacctgtgtgaggccagcctgaccaacagcgtggagcccgcccagggcgaggcccgggagggcagcagccaggacaaccccacagcccagcctgtggtgcagctgctgggggagatgcaggaccaccaggagcaccctggcctgggcagcaactgctgcgtgccctgcttctgctgggcctggctgcccaggagaagaagatag

SEQ ID NO: 39130 - DNA, 1812 bp, Artificial Sequence; identical to SEQ ID NO: 39129
  Description of Artificial Sequence: Synthetic coding sequence

SEQ ID NO: 39131 - DNA, 1902 bp, Artificial Sequence
  Description of Artificial Sequence: Synthetic coding sequence
atgctgcctgtggatggagaggagaggaagtctgagggcagtgacacagaaggagacaggaccagcccctgtgccggccccaccagcagcgccaccctgaaggacctggaggtgggcggcagcggccgccgctgcagcgaccctgctggccagcccagcaacctgctgccccagaggggcctgggcgcccccctgcctgctgagacagcccacacccagcccagccccaatgacaggagcctgtacctgagccccaagagcagcagcgccagcagcagcctgcacgcccggcagagcccctgccaggagcaggccgctgtgctgaacagccgcagcatcaagatcagccggctgaatgacaccatcaagagcctgaagcagcagaagaagcaggtggagcaccagctggaggaggagaagaaggccaacaatgagaagcagaaggccgagcgggagctggagggccagatccagaggctgaacacagagaagaagaagctgaacacagacctgtaccacatgaagcacagcctgcgctactttgaggaggagagcaaggacctggccggccgcctgcagaggagcagccagagaattggagagctggagtggagcctgtgtgctgtggccgccacccagaagaagaagccagatggcttcagcagccgcagcaaggccctgctgaagaggcagctggagcagagcatccgggagcagatcctgctgaagggccacgtgacccagctgaaggagagcctgaaggaggtgcagctggagcgggaccagtatgcagagcagatcaagggggagcgggcccagtggcagcagaggatgaggaagatgagccaggaggtgtgcaccctgaaggaggagaagaagcatgacacccaccgggtggaggagctggagaggagcctgagccggctgaagaaccagatggccgagcccctgcccccagatgccccagctgtgagcagcgaggtggagctgcaggacctgaggaaggagctggagcgggtggccggggagctgcaggcccaggtggagaacaaccagtgcatcagcctgctgaacagaggccagaaggagcggctgcgggagcaggaggagcggctgcaggagcagcaggagcggctgcgggagcgggagaagaggctgcagcagctggccgagccccagagcgacctggaggagctgaagcatgagaacaagagcgccctgcagctggagcagcaggtgaaggagctgcaggagaagctgggccaggtgatggagaccctgaccagcgctgagaaggagcctgaggccgctgtgcctgccagcggcactggaggagagagcagcggcctgatggacctgctggaggagaaggctgacctgcgggagcacgtggagaagctggagctgggcttcatccagtacagaagagagcgctgccaccagaaggtgcaccggctgctgacagagcccggggacagcgccaaggatgccagccctgggggcggccaccaccaggccggccctggccagggcggggaggagggggaggccgccggggctgctggagatggagtggccgcctgtggcagctacagcgagggccacggcaagttcctggccgccgccagaaatcctgctgctgagcccagccctggggccccagccccccaggagctgggcgctgctgacaagcatggagacctgtgtgaggccagcctgaccaacagcgtggagcccgcccagggcgaggcccgggagggcagcagccaggacaaccccacagcccagcctgtggtgcagctgctgggggagatgcaggaccaccaggagcaccctggcctgggcagcaactgctgcgtgccctgcttctgctgggcctggctgcccaggagaagaagatag

SEQ ID NO: 39132 - DNA, 1383 bp, Artificial Sequence
  Description of Artificial Sequence: Synthetic coding sequence
atgaagcacagcctgcgctactttgaggaggagagcaaggacctggccggccgcctgcagaggagcagccagagaattggagagctggagtggagcctgtgtgctgtggccgccacccagaagaagaagccagatggcttcagcagccgcagcaaggccctgctgaagaggcagctggagcagagcatccgggagcagatcctgctgaagggccacgtgacccagctgaaggagagcctgaaggaggtgcagctggagcgggaccagtatgcagagcagatcaagggggagcgggcccagtggcagcagaggatgaggaagatgagccaggaggtgtgcaccctgaaggaggagaagaagcatgacacccaccgggtggaggagctggagaggagcctgagccggctgaagaaccagatggccgagcccctgcccccagatgccccagctgtgtcctctgaggtggagctgcaggacctgaggaaggagctggagcgggtggccggggagctgcaggcccaggtggagaacaaccagtgcatcagcctgctgaacagaggccagaaggagcggctgcgggagcaggaggagcggctgcaggagcagcaggagcggctgcgggagcgggagaagaggctgcagcagctggccgagccccagagcgacctggaggagctgaagcatgagaacaagagcgccctgcagctggagcagcaggtgaaggagctgcaggagaagctgggccaggtgatggagaccctgaccagcgctgagaaggagcctgaggccgctgtgcctgccagcggcaccggcggggagagcagcggcctgatggacctgctggaggagaaggctgacctgcgggagcacgtggagaagctggagctgggcttcatccagtaccgccgggagcgctgccaccagaaggtgcaccggctgctgacagagcccggggacagcgccaaggatgccagccctgggggcggccaccaccaggccggccctggccagggcggggaggagggggaggccgccggggctgctggagatggagtggccgcctgtggcagctacagcgagggccacggcaagttcctggccgccgccaggaacccagctgctgagcccagccctggggccccagccccccaggagctgggcgctgctgacaagcacggggacctgtgtgaggccagcctgaccaacagcgtggagcccgcccagggcgaggcccgggagggcagcagccaggacaaccccacagcccagcctgtggtgcagctgctgggggagatgcaggaccaccaggagcaccctggcctgggcagcaactgctgcgtgccctgcttctgctgggcctggctgcccaggagaagaagatag

SEQ ID NO: 39133 - DNA, 1899 bp, Artificial Sequence
  Description of Artificial Sequence: Synthetic coding sequence
atggccgaggagacccagcacaacaagctggccgccgccaagaagaagctgaaggagtactggcagaagaacagcccccgggtgcctgctggggccaacagaaacaggaagaccaacggcagcatcccccagacagccaccagcggcggctgccagcccccaggggacagcgccaccggcttccaccgggagggccccaccagcagcgccaccctgaaggacctggagagcccctgccaggagagagctgtggtgctggacagccgctctgtggagatcagccagctgaagaacaccatcaagagcctgaagcagcagaagaagcaggtggagcaccagctggaggaggagaagaaggccaacatcaagaagcagaaggccaagagggtgctggaggtgcagatccagaccctgaacatccagaaggaggagctgaacacagacctgtaccacatgaagaggagcctgcgctactttgaggagaagagcaaggacctggccgtgcggctgcagcacagcctgcagaggaaaggagagctggagagcgtgctgagtgatgtgatggccacccagaagaagaaggccaaccagctgagcagccccagcaaggccggcacagagtggaagctggagcagagcatgagggaggaggccctgctgaaggtgcagctgacccagctgaaggagagcttccagcagctgcagctggagagacatgaatatgcagagcacctgaagggggagcgggcccgctggcagcagaggatgaggaagatgagccaggagatctgcaccctgaagaaggagaagcagcaggacatgagaagagtggagaagctggagaggagcctgagcaagctgaagaaccagatggccgagcccctgcccccagagcccccagctgtgcccagcgaggtggagctgcagcacctgaggaaggagctggagcgggtggccggggccctgcaggcccaggtgaagaacaaccagaggatcagcctgctgaacagaggccaggaggagcgcatccgggagcaggaggagcggctgaggaagcaggaggagcgcatccaggagcagcacaagagcctgcagcagctggccaagccccagagcgtgtttgaggagcccaacaatgaaaacaagagcgccctgcagctggagcagcaggtgaaggagctgcaggagaagctgggggaggagcacctggaggccgccagccagcagaaccagcagctgacagcccagctgagcctgatggccctgcctggagagggccatggaggagagcacctggacagcgagggggaggaggccccccagcccatgcccagcgtgcctgaggacctggagagccgggaggccatgagcagcttcatggaccacctggaggagaaggctgacctgtctgagctggtgaagaagaaggagctgtgcttcatccaccactggagggagcgctgccaccagaagacccaccacctgctgtctgagcccggcggccgggccaaggatgctgccctgggcggcggccaccaccaggccggggcccagggcggagatgaaggagaggccgccggggctgctgctgatggcattgctgcctacagcaactacaacaacggccacaggaagttcctggccgccgcccacaacccagcagatgagcccggccctggggccccagccccccaggagctgggcgctgctgacaagcatggagacctgtgtgaggtgtccctgaccagcagcgcccagggcgaggcccgggaggaccccctgctggacaagcccacagcccagcccatcgtgcaggaccaccaggagcaccctggcctgggcagcaactgctgcgtgcccttcttctgctgggcctggctgcccaggagaagaagatag

SEQ ID NO: 39134 - DNA, 1338 bp, Artificial Sequence
  Description of Artificial Sequence: Synthetic coding sequence
atggccacccagaagaagaaggccaaccagctgagcagccgcagcaaggccaggacagagtggaagctggagcagagcatgagggaggaggccctgctgaaggtgcagctgacccagttcaaggagagcttccagcaggtgcagctggagagagatgagtacagcgagcacctgaagggggagcgggcccgctggcagcagaggatgaggaagatgagccaggagatctgcaccctgaagaaggagaagcagcaggacatgagaagagtggagaagctggagaggagcctgagcaagctgaagaaccagatggccgagcccctgcccccagagcccccagctgtgcccagcgaggtggagctgcagcacctgaggaaggagctggagcgggtggccggggagctgcaggcccaggtgaagaacaaccagaggatcagcctgctgaaccagaggcaggaggagcgcatccgggagcaggaggagcggctgaggaagcaggaggagcgcatccaggagcagcacaagagcctgcagcagctggccaagccccagagcgtcttcaaggagcccaacaatgaaaacaagaatgccctgcagctggagcagcaggtgaaggagctgcaggagaagctgggggaggagcacctggaggccgccagccagcagaaccagcagctgacagcccagctgagcctgatggccctgcccggggagggccacggcggggagcacctggacagcgagggggaggaggccccccggcccatgcccagcgtgcctgaagatcctgagagccgggaggccatgagcagcttcatggaccacctggaggagaaggctgacctgtctgagctggtgaagaagaaggagctgtgcttcatccaccactggagggagcgctgccaccagaagacccaccacctgctgtctgagcccggcggccgggccaaggatgctgccctgggcggcggccaccaccaggccggggcccagggcggagatgaaggagaggccgccggggctgctgctgatggcattgctgcctacagcaactacaacaacggccacaggaagttcctggccgccgcccacaacagcgcagatgagcccggccctggggccccagccccccaggagctgggcgctgctgacaagcacggccacctgtgtgaggtgtccctgaccagcagcgcccagggcgaggcccgggaggaccccctgctggacaagcccacagcccagcccatcgtgcaggaccaccaggagcaccctggcctgggcagcaactgctgcgtgcccttcctgtgctgggcctggctgcccaggagaagaagatag

SEQ ID NO: 39135 - DNA, 1299 bp, Artificial Sequence; identical to SEQ ID NO: 39128
  Description of Artificial Sequence: Synthetic coding sequence

SEQ ID NO: 39136 - DNA, 1896 bp, Artificial Sequence
  Description of Artificial Sequence: Synthetic coding sequence
atggccgaggagacccagcacaacaagctggccgccgccaagaagaagctgaaggagtactggcagaagaaccggccccgggtgcctgctggggtgaacagaaacaggaagaccaacggcagcatccctgagacagccaccagcggcggctgccagcccccaggggacagcgccaccggcttccaccgggagggccccaccagcagcgccaccctgaaggacctggagagcccctgccaggagagagctgtggtgctggacagcacctctgtgaagatcagccggctgaagaacaccatcaagagcctgaagcagcagaagaagcaggtggagcaccagctggaggaggagaagaaggccaacaatgaaaggcagaaggccgagcgggtgctggaggtgcagatccagaccctcatcatccagaaggaggagctgaacacagacctgtaccacatggagaggagcctgcgctactttgaggaggagagcaaggacctggccgtgcggctgcagcacagcctgcagtgcaagggggagctggagcgggccctgtctgctgtgattgccacagagaagaagaaggccaaccagctgagcagctgcagcaaggcccacacagagtgggagctggagcagagcctgcaggaccaggccctgctgaaggcccagctgacccagctgaaggagagcttccagcagctgcagctggagagagatgaatgtgccgagcacattgaaggagagcgggcccgctggcaccagaggatgagcaagatgagccaggagatctgcaccctgaagaaggagaagcaggacatgcgctgggtggagcagctggagtggagcctgagcaagctgaagaaccagacagctgagcccctgcccccagagcccccagctgtgcccagcgaggtggagctgcagcacctgaggaaggagctggagcgggtggccggggagctgcagagccaggtgaagaacaaccagcacatcagcctgctgaacagacggcaggaggagcgcatccgggagcaggaggagcggctgaggaagcaggaggagcggctgcaggagcagcacgagaagctgcggcagctggccaagccccagagcgtgtttgaggagctgaacaatgaaaacaagagcaccctgcagctggagcagcaggtgaaggagctgcaggagaagctgggggaggagcacctggaggtggccagccagcagaaccagcagctgacagcccagctgagcctgatggccctgcccggggagggccacggcggggagcacctggacagcgagggggaggaggccccccagcccatgcccagcgtgcctgaagatcctgagagccgggaggccatgagcagcttcatggaccacctgaaggagaaggctgacctgtctgagctgctgaagaagcaggagctgcgcttcatccagtactggcaggagcgctgccaccagaagatccaccacctgctgtctgagcccggcggccgggccaaggatgctgccctgggcggcggccaccaccaggccggggcccagggcggagatgaaggagaggccgccggggctgctgctgatggcattgctgcctacagcaactacaacaacggccacaggaagttcctggccgccgcccacaacagcgcagatgagcccggccctggggccccagccccccaggagctgggcgctgctgacaagcacggggacctgcgggaggtgaccctgaccagcagcgcccagggcgaggcccgggaggaccccctgctggacaagcccacagcccagcccatcgtgcaggaccaccaggagcaccctggcctgggcagcaactgctgcgtgcccctcttctgctgggcctggctgcccaggagaagaagatag

SEQ ID NO: 39137 - DNA, 885 bp, Artificial Sequence
  Description of Artificial Sequence: Synthetic coding sequence
atggccgaggagacccagcacaacaagctggccgccgccaagaagaagctgaaggagtactggcagaagaaccggccccgggtgcctgctggggtgaacagaaacaggaagaccaacggcagcatccctgagacagccaccagcggcggctgccagcccccaggggacagcgccaccggcttccaccgggagggccccaccagcagcgccaccctgaaggacctggagagcccctgccaggagagagctgtggtgctggacagcacctctgtgaagatcagccggctgaagaacaccatcaagagcctcatctgcaccctgaagaaggagaagcaggacatgcgctgggtggagcagctggagtggagcctgagcaagctgaagaaccagacagctgagcccctgcccccagagcccccagctgtgcccagcgaggtggagctgcagcacctgaggaaggagctggagcgggtggccggggagctgcagagccaggtgaagaacaaccagcacatcagcctgctgaacagacggcaggaggagcgcatccgggagcaggaggagcggctgaggaagcaggaggagcggctgcaggagcagcacgagaagctgcggcagctggccaagccccagagcgtgtttgaggagctgaacaatgaaaacaagagcaccctgcagctggagcagcaggtgaaggagctgcaggagaagctgggggaggtgaaggagacagagaccagcacccccagcaagaagggctgggaggccggcagcagcctgctgggcggggaggtgcccggccagaggcagctgcctgcctggggcctggtgaccacagccccccggcgggctgtgctgcggctcttcctgaccagctgcctgtag

SEQ ID NO: 39138 - DNA, 519 bp, Artificial Sequence
  Description of Artificial Sequence: Synthetic coding sequence
atggccggggccgcccccaccacagccttcggccaggccgtgattggccccccaggcagcggcaagaccacctactgcctgggcatgtctgagttcctgcgggccctgggccggcgggtggccgtggtgaacctggaccctgccaatgaaggcctgccctatgacatcttcagccagatggcccagtgggacctgcggctgacagctgtgcacctggtggacagccactactgcacagatcctgccaagttcatctctgtgctgtgcaccagcctggccaccatgctgcacgtggagctgccccacatcaacctgctgagcaagatggacctgattgagcactacggcaagctggccttcaacctggactactacacagaggtgctggacctgagctacctgctggaccacctggccagtgaccccttcttccgccactaccggcagctgaatgagaagctggtgcagctgattgaggactacagcctggtgtccttcatccccctgaacatccagtag

SEQ ID NO: 39139 - DNA, 396 bp, Artificial Sequence
  Description of Artificial Sequence: Synthetic coding sequence
atgctggccggcctggagctgctgaccagcgccttcaacctggactactacacagaggtgctggacctgagctacctgctggaccacctggccagtgaccccttcttccgccactaccggcagctgaatgagaagctggtgcagctgattgaggactacagcctggtgtccttcatccccctgaacatccaggacaaggagagcatccagagggtgctgcaggccgtggacaaggccaacggctactgcttccgggcccaggagcagaggagcctggaggccatgatgtctgctgccatgggcgctgacttccacttcagcagcaccctgggcatccaggagaagtacctggcccccagcaaccagagcgtggagcaggaggccatgcagctgtag

SEQ ID NO: 39140 - DNA, 933 bp, Artificial Sequence
  Description of Artificial Sequence: Synthetic coding sequence
atggccggggccgcccccaccacagccttcggccaggccgtgattggccccccaggcagcggcaagaccacctactgcctgggcatgtctgagttcctgcgggccctgggccggcgggtggccgtggtgaacctggaccctgccaatgaaggcctgccctatgaatgtgctgtggatgtgggggagctggtgggcctgggagatgtgatggatgccctgcggctgggccccaacggcggcctgctgtactgcatggagtacctggaggccaacctggactggctgcgggccaagctggaccccctgcggggccactacttcctgtttgactgccccggccaggtggagctgtgcacccaccacggggccctgcggagcatcttcagccagatggcccagtgggacctgcggctgacagctgtgcacctggtggacagccactactgcacagatcctgccaagttcatctctgtgctgtgcaccagcctggccaccatgctgcacgtggagctgccccacatcaacctgctgagcaagatggacctgattgagcactacggcaagctggccttcaacctggactactacacagaggtgctggacctgagctacctgctggaccacctggccagtgaccccttcttccgccactaccggcagctgaatgagaagctggtgcagctgattgaggactacagcctggtgtccttcatccccctgaacatccaggacaaggagagcatccagagggtgctgcaggccgtggacaaggccaacggctactgcttccgggcccaggagcagaggagcctggaggccatgatgtctgctgccatgggcgctgacttccacttcagcagcaccctgggcatccaggagaagtacctggcccccagcaaccagagcgtggagcaggaggccatgcagctgtag

SEQ ID NO: 39141 - DNA, 519 bp, Artificial Sequence; identical to SEQ ID NO: 39138
  Description of Artificial Sequence: Synthetic coding sequence

SEQ ID NO: 39142 - DNA, 537 bp, Artificial Sequence
  Description of Artificial Sequence: Synthetic coding sequence
atgcctgcctaccacagcagcctgatggaccctgacaccaagctgattggcaacatggccctgctgcccatccgcagccagttcaagggccctgccccccgggagaccaaggacacagacatcgtggatgaggccatctactacttcaaggccaacgtgttcttcaagaactatgagatcaagaatgaggccgacaggaccctcatctacatcaccctgtacatcagtgaatgtctgaagaagctgcagaagtgcaacagcaagagccagggcgagaaggagatgtacaccctgggcatcaccaacttccccatccctggagagcccggcttccccctgaatgccatctatgccaagccagccaacaagcaggaggatgaggtgatgagggcctacctgcagcagctgcggcaggagaccggcctgcggctgtgtgagaaggtgtttgacccccagaatgacaagcccagcaagtggtggacctgctttgtgaagaggcagttcatgaacaagagcctgagcggccctggccagtag

SEQ ID NO: 39143 - DNA, 885 bp, Artificial Sequence
  Description of Artificial Sequence: Synthetic coding sequence
atgcccaggtatgcccagctggtgatgggccctgctggcagcggcaaggtgcgcatctgtggggacaaggagaggaagagcacctactgtgccaccatggtgcagcactgtgaggccctgaacagatctgtgcaggtggtgaacctggaccctgctgctgagcacttcaactacagcgtgatggctgacatccgggagctgattgaggtggatgatgtgatggaggatgacagcctgcgcttcggccccaacggcggcctggtgttctgcatggagtactttgccaacaactttgactggctggagaactgcctgggccacgtggaggatgactacatcctgtttgactgccccggccagatcgagctgtacacccacctgcctgtgatgaagcagctggtgcagcagctggagcagtgggagttccgggtgtgtggggtcttcctggtggacagccagttcatggtggagagcttcaagttcatcagcggcatcctggccgccctgagcgccatgatcagcctggagatcccccaggtgaacatcatgaccaagatggacctgctgagcaagaaggccaagaaggagattgagaagttcctggaccctgacatgtacagcctgctggaggacagcaccagtgacctgcggagcaagaagttcaagaagctgaccaaggccatctgtggcctgattgatgactacagcatggtgcgcttcctgccctatgaccagagtgatgaggagagcatgaacatcgtgctgcagcacatcgactttgccatccagtacggggaggacctggagttcaaggagcccaaggagagagaagatgagagcagctccatgtttgatgagtacttccaggagtgccaggatgaatag

SEQ ID NO: 39144 - DNA, 972 bp, Artificial Sequence
  Description of Artificial Sequence: Synthetic coding sequence
atgctgcccaagaccaggggggccttccacttcagcatcccagacccccagcacatctgcaagagccggggcagcccctaccgcagcaatgtgtgcacccagaccacagacaggagcacctggaggaaggatgctgagctgtacctgctgagcgtcatcacccagagcacctactgtgccaccatggtgcagcactgtgaggccctgaacagatctgtgcaggtggtgaacctggaccctgctgctgagcacttcaactacagcgtgatggctgacatccgggagctgattgaggtggatgatgtgatggaggatgacagcctgcgcttcggccccaatggaggcctggtgttctgcatggagtactttgccaacaactttgactggctggagaactgcctgggccacgtggaggatgactacatcctgtttgactgccccggccagatcgagctgtacacccacctgcctgtgatgaagcagctggtgcagcagctggagcagtgggagttccgggtgtgtggggtcttcctggtggacagccagttcatggtggagagcttcaagttcatcagcggcatcctggccgccctgagcgccatgatcagcctggagatcccccaggtgaacatcatgaccaagatggacctgctgagcaagaaggccaagaaggagattgagaagttcctggaccctgacatgtacagcctgctggaggacagcaccagtgacctgcggagcaagaagttcaagaagctgaccaaggccatctgtggcctgattgatgactacagcatggtgcgcttcctgccctatgaccagagtgatgaggagagcatgaacatcgtgctgcagcacatcgactttgccatccagtatggagaggacctggagttcaaggagcccaaggagcgggaggatgagagcagctccatgtttgatgagtacttccaggagtgccaggatgaatag

SEQ ID NO: 39145 - DNA, 2331 bp, Artificial Sequence
  Description of Artificial Sequence: Synthetic coding sequence
atgggcaccgtgcctgaccccctgcggagcgccaagaccagcctgattgctgccagcggcaaggaggatgacctgggggagccccaggccgccagccccaggcacaggcctgccctgctgtgcaagaatgccaacggcttcagcggggccccagctgagccagacctgagccccagggctgctgctgaggccctgatgcaggtgtgtgaacatgagaccacccagcctgacatgagcagccctggggtcttcaatgaggtgcagaaggccccagccaccttcaacagccctggcaacccccagctgcccggcagcagccagcctgctgccagcgcccccagcagcgctgctggccgggacctgatccacacccccctgaccatgcctgccaaccagcacacctgccagagcatccctggggaccagcccaatgccatcaccagctccatgcctgaggacagcctgatgaggagccagaggaccagcaaccgggagcagcctgagaagcccagctgccctgtgggcggcgtgctgagcagcagcaaggaccaggtgtcctgtgagttccccagccctgagaccatccagggcaccgtgcagacccctgtgacagctgcccgggtggtgagccacagcagcagccctgtgggcggccctgagggggagcggcagggcgccatctgtgacagcgagatgaggagctgcaagcccctgacccgggagagcggctgcagcgagaacaagcagcccagcgtgacagccagcggcccccagggcaccacctctgtgaccccccagcccacccccctgaccagcgagcccagcgcctgccccccaggccctgagaaggtgcccctgcctgcccagaggcagatgagccgcttcaaggaggccagcaccatgaccaaccaggccgagagcgagatcaaggaggtgcccagccgggcctggcaggatgctgaggtgcaggccgtggcctctgtggagagccgctctgtgtccaccagccccagcatcctgacagccttcctgaaggagagccgggcccctgagcactttgagcaggagcagctgcgggtcatctgccacagcagcggcagccacaccctggagctgagtgacagcaccctggccccccaggagagcagccagtgccccggcatcatgccccaggtgcacatccaggccgctgctgctgagagcacagccttccagcgggagaacaagctggccagcctgcccggcggcgtgctgaagaccagcagcatcaacctggtgagcagcaatgcccagcacacctgcaaggaggatggccgcctggccggcatgacccctgtgcgggaggagagcacagccaagaagctggccggcaccaacagcagcagcctgaaggccacagccatcgaccagatcagcatcagcgcctgcagccaggccgagaccagctatggcctgggcaagtttgagacccggcccagcgagtttgctgagaagaccaccaacggccacaagacagatcctgactgcaagctgagtgacagctgtggcagcatcagcaaggctgaccacagcggcagcctggaccccaccaacaagggagatgcccgggagaagaagccagccagcccccaggtggtgaaggagaaggagagcactggaacagacaccagtgatgccaagaccctgctgctgaaccccaagagccaggagagcggcggcacagagagcgctgccaaccccacccccagccccatcaggaagaaccaggagagcaccctggaggagaaccggcagaccaagacagccaccagcctgagcctgcccagcgaccccatgggagacagcagccctggcagcggcaagaagacccccagccgctctgtgaaggccagcccccggcggcccagccgggtgtctgagttcctgaaggagcagaagctgaatgtgacagctgctgctgcccaggtgggcctgacccctggggacaagaagaagcagctgggcgctgacagcaagctgcagctgaagcagagcaagagggtgagagatgtggtgtgggatgagcagggcatgacctgggaggtgtatggagccagcctggatgctgagagcctgggcatcgccatccagaaccacctgcagaggcagatccgggagcacgagaagctgatcaagacccagaacagccagacccggcgcagcatcagcagtgacaccagcagcaacaagaagctgcggggccggcagcacagcgtcttccagagcatgctgcagaacttcagaagacccaactgctgcgtgcggcctgcccccagctctgtgctggactag

SEQ ID NO: 39146 - DNA, 1299 bp, Artificial Sequence
  Description of Artificial Sequence: Synthetic coding sequence
atgacagagctgcagcaggatgtggaggacaccaagccagccaaggtgctgggcaagcgggagagcaagctgggcagcgcccacagcgaggccgagaatggagtggaggagaagaagaaggcctgccgcagccccacagcccagagccccaccccatctgtggaggccgacagcccagaccagaagaagatcatcagcctgtggagcaagagcagctttgatggagccagcctggccagtgacaagaatgactgcaagacagagagcaagaatgaccccaagacagagaggaagaagagcagcagcagcagccagtacaaggccaacatgcacttccacaagctgttcctgtctgtgcccacagaggagcccctgaagcagagcttcacctgtgccctgcagaaggagatcctgtaccagggcaagctgtttgtgtctgagaactggatctgcttccacagcaaggtgtttgggaaggacaccaagatcagcatcccagccttctctgtgaccctcatcaagaagaccaagacagccctgctggtgcccaatgccctgatcatcgccaccgtgacagaccgctacatctttgtgtccctgctgagccgggacagcacctacaagctgctgaagtctgtgtgtggccacctggagaacacctctgtgggcaacagccccaaccccagcagcgctgagaacagcttccgggctgaccggcccagcagcctgcccctggacttcaatgatgagttcagtgacctggatggagtggtgcagcagaggcggcaggacatggagggctacagcagcagcggcagccagaccccagagagcgagaacagccgggacttccacgccacagagagccagacagtgctgaatgtgtccaaaggagaggccaagcccaccagggcagatgcccacgtgaacagagtgcctgagggcaaggccaagagcctgcctgtgcagggcctgtctgagaccgtgggcatcctgcacaaggtgaagagccagaagtgccccatgctgcaccacatcctgatcttctacgccatcgtggtgtgtgccctgatcatcagcaccttctacatgagataccgcatcaacaccctggaggagcagctgggcctgctgaccagcatcgtggacacccacaacacagagcaggccgcccccagcggcctgcggagccaggtgcagttcaacgtggaggtgctgtgccaggagctgacagccaacatcgtgaagctggagaagatccagaacaacctgcagaagctgctggagaatggagactag

SEQ ID NO: 39147 - DNA, 1323 bp, Artificial Sequence
  Description of Artificial Sequence: Synthetic coding sequence
atgtggaagacccagagcctgaggaaatgttctggccggggccgggccaacctggcccagcccacccagaggctgaggatggtgtggaggaggaagaggaagccagctggccggcagcagcccaaccccctgccccacctgtggaggaggaccccccagaccaggaggaagagcctggcctatgcccacatcttcagccccaacctgtgcttcatccaggaccaggagagcaagagcagctttgatggagccagcctggccagtgacaagaatgactgcaagacagagagcaagaatgaccccaagacagagaggaagaagagcagcagcagcagccagtacaaggccaacatgcacttccacaagctgttcctgtctgtgcccacagaggagcccctgaagcagagcttcacctgtgccctgcagaaggagatcctgtaccagggcaagctgtttgtgtctgagaactggatctgcttccacagcaaggtgtttgggaaggacaccaagatcagcatcccagccttctctgtgaccctcatcaagaagaccaagacagccctgctggtgcccaatgccctgatcatcgccaccgtgacagaccgctacatctttgtgtccctgctgagccgggacagcacctacaagctgctgaagtctgtgtgtggccacctggagaacacctctgtgggcaacagccccaaccccagcagcgctgagaacagcttccgggctgaccggcccagcagcctgcccctggacttcaatgatgagttcagtgacctggatggagtggtgcagcagaggcggcaggacatggagggctacagcagcagcggcagccagaccccagagagcgagaacagccgggacttccacgccacagagagccagacagtgctgaatgtgtccaaaggagaggccaagcccaccagggcagatgcccacgtgaacagagtgcctgagggcaaggccaagagcctgcctgtgcagggcctgtctgagaccgtgggcatcctgcacaaggtgaagagccagaagtgccccatgctgcaccacatcctgatcttctacgccatcgtggtgtgtgccctgatcatcagcaccttctacatgagataccgcatcaacaccctggaggagcagctgggcctgctgaccagcatcgtggacacccacaacacagagcaggccgcccccagcggcctgcggagccaggtgcagttcaacgtggaggtgctgtgccaggagctgacagccaacatcgtgaagctggagaagatccagaacaacctgcagaagctgctggagaatggagactag

SEQ ID NO: 39148 - DNA, 1116 bp, Artificial Sequence
  Description of Artificial Sequence: Synthetic coding sequence
atgacagagctgcagcaggatgtggaggacaccaagccagccaaggtgctgggcaagcgggagagcaagctgggcagcgcccacagcgaggccgagaatggagtggaggagaagaagaaggcctgccgcagccccacagcccagagccccaccccatctgtggaggccgacagcccagaccagaagaagatcatcagcctgtgcccctacctgctgagcaagtccatgctgcacagcggcccccgctacaaggccaacatgcacttccacaagctgttcctgtctgtgcccacagaggagcccctgaagcagagcttcacctgtgccctgcagaaggagatcctgtaccagggcaagctgtttgtgtctgagaactggatctgcttccacagcaaggtgtttgggaaggacaccaagatcagcatcccagccttctctgtgaccctcatcaagaagaccaagacagccctgctggtgcccaatgccctgatcatcgccaccgtgacagaccgctacatctttgtgtccctgctgagccgggacagcacctacaagctgctgaagtctgtgtgtggccacctggagaacacctctgtgggcaacagccccaaccccagcagcgcagaaaattccttccgggctgaccggcccagcagcctgcccctggacttcaatgatgagttcagtgacctggatggagtggtgcagcagaggcggcaggacatggagggctacagcagcagcggcagccagaccccagagagcgagaacagccgggtggacttccacgccacagagagccagacagtgctgaatgtgtccaaaggagaggccaagcccaccagggcagatgcccacgtgaacagagtgcctgagggcaaggccaagagcctgcctgtgcagggcctgtctgagaccgtgggcatcctgcacaaggtgaagagccagaagtgccccatgctgcaccacatcctgatcttctacgccatcgtggtgtgtgccctgatcatcagcaccttctacatgagataccgcatcaacaccctggaggagcagctgggcctgctgaccagcatcgtggacacccacaacacagagcagcaccacctggcctag

SEQ ID NO: 39149 - DNA, 879 bp, Artificial Sequence
  Description of Artificial Sequence: Synthetic coding sequence
atgagcaaggtgaagcgcttccccttcttcttcagcagcgaggccgagaatggagtggaggagaagaagaaggcctgccgcagccccacagcccagagccccaccccatctgtggaggccgacagcccagaccagaagaagatcatcagcctgtggagcaagagcagctttgatggagccagcctggccagtgacaagaatgactgcaagacagagagcaagaatgaccccaagacagagaggaagaagagcagcagcagcagccagtacaaggccaacatgcacttccacaagctgttcctgtctgtgcccacagaggagcccctgaagcagagcttcacctgtgccctgcagaaggagatcctgtaccagggcaagctgtttgtgtctgagaactggatctgcttccacagcaaggtgtttgggaaggacaccaagatcagcatcccagccttctctgtgaccctcatcaagaagaccaagacagccctgctggtgcccaatgccctgatcatcgccaccgtgacagaccgctacatctttgtgtccctgctgagccgggacagcacctacaagctgctgaagtctgtgtgtggccacctggagaacacctctgtgggcaacagccccaaccccagcagcgctgagaacagcttccgggctgaccggcccagcagcctgcccctggacttcaatgatgagttcagtgacctggatggagtggtgcagcagaggcggcaggacatggagggctacagcagcagcggcagccagaccccagagagcgagaacagccgggacttccacgccacagagagccagacagtgctgaatgtgtccatcttcctgtacagcatgcagctgctgtctgtgcactag

SEQ ID NO: 39150 - DNA, 987 bp, Artificial Sequence
  Description of Artificial Sequence: Synthetic coding sequence
atgtacaaggccaacatgcacttccacaagctgttcctgtctgtgcccacagaggagcccctgaagcagagcttcacctgtgccctgcagaaggagatcctgtaccagggcaagctgtttgtgtctgagaactggatctgcttccacagcaaggtgtttgggaaggacaccaagatcagcatcccagccttctctgtgaccctcatcaagaagaccaagacagccctgctggtgcccaatgccctgatcatcgccaccgtgacagaccgctacatctttgtgtccctgctgagccgggacagcacctacaagctgctgaagtctgtgtgtggccacctggagaacacctctgtgggcaacagccccaaccccagcagcgctgagaacagcttccgggctgaccggcccagcagcctgcccctggacttcaatgatgagttcagtgacctggatggagtggtgcagcagaggcggcaggacatggagggctacagcagcagcggcagccagaccccagagagcgagaacagccgggacttccacgccacagagagccagacagtgctgaatgtgtccaaaggagaggccaagcccaccagggcagatgcccacgtgaacagagtgcctgagggcaaggccaagagcctgcctgtgcagggcctgtctgagaccgtgggcatcctgcacaaggtgaagagccagaagtgccccatgctgcaccacatcctgatcttctacgccatcgtggtgtgtgccctgatcatcagcaccttctacatgagataccgcatcaacaccctggaggagcagctgggcctgctgaccagcatcgtggacacccacaacacagagcaggccgcccccagcggcctgcggagccaggtgcagttcaacgtggaggtgctgtgccaggagctgacagccaacatcgtgaagctggagaagatccagaacaacctgcagaagctgctggagaatggagactag

SEQ ID NO: 39151 - DNA, 1251 bp, Artificial Sequence
  Description of Artificial Sequence: Synthetic coding sequence
atgagcaaggtgaagcgcttccccttcttcttcagcagcgaggccgagaatggagtggaggagaagaagaaggcctgccgcagccccacagcccagagccccaccccatctgtggaggccgacagcccagaccagaagaagatcatcagcctgtggagcaagagcagctttgatggagccagcctggccagtgacaagaatgactgcaagacagagagcaagaatgaccccaagacagagaggaagaagagcagcagcagcagccagtacaaggccaacatgcacttccacaagctgttcctgtctgtgcccacagaggagcccctgaagcagagcttcacctgtgccctgcagaaggagatcctgtaccagggcaagctgtttgtgtctgagaactggatctgcttccacagcaaggtgtttgggaaggacaccaagatcagcatcccagccttctctgtgaccctcatcaagaagaccaagacagccctgctggtgcccaatgccctgatcatcgccaccgtgacagaccgctacatctttgtgtccctgctgagccgggacagcacctacaagctgctgaagtctgtgtgtggccacctggagaacacctctgtgggcaacagccccaaccccagcagcgctgagaacagcttccgggctgaccggcccagcagcctgcccctggacttcaatgatgagttcagtgacctggatggagtggtgcagcagaggcggcaggacatggagggctacagcagcagcggcagccagaccccagagagcgagaacagccgggacttccacgccacagagagccagacagtgctgaatgtgtccaaaggagaggccaagcccaccagggcagatgcccacgtgaacagagtgcctgagggcaaggccaagagcctgcctgtgcagggcctgtctgagaccgtgggcatcctgcacaaggtgaagagccagaagtgccccatgctgcaccacatcctgatcttctacgccatcgtggtgtgtgccctgatcatcagcaccttctacatgagataccgcatcaacaccctggaggagcagctgggcctgctgaccagcatcgtggacacccacaacacagagcaggccgcccccagcggcctgcggagccaggtgcagttcaacgtggaggtgctgtgccaggagctgacagccaacatcgtgaagctggagaagatccagaacaacctgcagaagctgctggagaatggagactag

SEQ ID NO: 39152 - DNA, 1344 bp, Artificial Sequence
  Description of Artificial Sequence: Synthetic coding sequence
atgacccggcggcagcaggtgctgcaggccaagaggagcatccagcagaccttccaggcccagctgatgccctggaagtccatgttccacggccgggaggtgaagcctgtgggccctgacctggagctgtctgaggctgaaaatggagtggaggagaagaagaaggcctgccgcagccccacagcccagagccccacccccagcgtggaggccgacagcccagaccagaagaagatcatcagcctgtggagcaagagcagctttgatggagccagcctggccagtgacaagaatgactgcaagacagagagcaagaatgaccccaagacagagaggaagaagagcagcagcagcagccagtacaaggccaacatgcacttccacaagctgttcctgtctgtgcccacagaggagcccctgaagcagagcttcacctgtgccctgcagaaggagatcctgtaccagggcaagctgtttgtgtctgagaactggatctgcttccacagcaaggtgtttgggaaggacaccaagatcagcatcccagccttctctgtgaccctcatcaagaagaccaagacagccctgctggtgcccaatgccctgatcatcgccaccgtgacagaccgctacatctttgtgtccctgctgagccgggacagcacctacaagctgctgaagtctgtgtgtggccacctggagaacacctctgtgggcaacagccccaaccccagcagcgcagaaaattccttccgggctgaccggcccagcagcctgcccctggacttcaatgatgagttcagtgacctggatggagtggtgcagcagaggcggcaggacatggagggctacagcagcagcggcagccagaccccagagagcgagaacagccgggacttccacgccacagagagccagacagtgctgaatgtgtccaagggggaggccaagcccaccagggcagatgcccacgtgaacagagtgcctgagggcaaggccaagagcctgcctgtgcagggcctgtctgaaacagtgggcatcctgcacaaggtgaagagccagaagtgccccatgctgcaccacatcctgatcttctacgccatcgtggtgtgtgccctgatcatcagcaccttctacatgagataccgcatcaacaccctggaggagcagctgggcctgctgaccagcatcgtggacacccacaacacagagcaggccgcccccagcggcctgcggagccaggtgcagttcaacgtggaggtgctgtgccaggagctgacagccaacatcgtgaagctggagaagatccagaacaacctgcagaagctgctggagaatggagactag

SEQ ID NO: 39153 - DNA, 1761 bp, Artificial Sequence
  Description of Artificial Sequence: Synthetic coding sequence
atgtctgctggagatgctgtgtgcaccggctggctggtgaagagccccccagagaggaagctgcagagatatgcctggaggaagcgctggtttgtgctgcggcggggccgcatgagcggcaacccagatgtgctggagtactacagaaacaagcacagcagcaagcccatccgggtcatcgacctgtctgaatgtgctgtgtggaagcacgtgggccccagctttgtgaggaaggagttccagaacaactttgtgttcatcgtgaagaccaccagcaggaccttctacctggtggccaagacagagcaggagatgcaggtgtgggtgcacagcatcagccaggtgtgcaacctgggccacctggaggatggagctgacagcatggagagcctgagctacacccccagcagcctgcagcccagcagcgccagcagcctgctgacagcccatgctgccagcagcagcctgcccagagatgaccccaacaccaatgctgtggccacagaggagaccaggtctgagagcgagctgctcttcctgcctgactacctggtgctgagcaactgtgaaacaggccgcctgcaccacaccagcctgcccacccgctgtgacagctggagcaacagcgacaggagcctggagcaggccagctttgatgatgtgtttgtggactgcctgcagcccctgcccagcagccacctggtgcaccccagctgccacggcagcggggcccaggaggtgcccagcagccggccccaggccgccctgatctggagccgggagatcaatggaccaccccgggaccacctgagcagcagccccctgctggagagcagcctgagcagcaccatccaggtggacaagaaccagggcagcctgccctgtggggccaaggagctggacatcatgagcaacaccccaccacccaggcctcccaagcccagccacctgtctgagcggcggcaggaggagtggagcacccacagcggcagcaagaagccagaatgtaccctggtgccccggcgcatcagcctgagcggcctggacaacatgaggacctggaaggcagatgtggagggccagagcctgcggcaccgggacaagaggctgagcctgaacctgccctgccgcttcagccccatgtaccccacagccagcgccagcattgaggacagctatgtgcccatgagcccccaggccggggccagcggcctgggcccccactgcagcccagatgactacatccccatgaacagcggcagcatcagcagccccctgcctgagctgcctgccaacctggagcccccacctgtgaacagagacctgaagccccagaggaagagccggcccccacccctggacctgaggaacctgagcatcatccgggagcacgccagcctgaccaggaccaggacagtgccctgcagcaggaccagcttcctgagccctgagagaaatggcatcaacagcgcccgcttctttgccaaccctgtgtccagagaagatgaggagagctacatcgagatggaggagcacaggacagccagcagcctgagcagcggggccctgacctggaccaagaagttcagcctggactacctggccctggacttcaacagcgccagccctgcccccatgcagcagaagctgctgctgtctgaggagcagagggtggactatgtgcaggtggatgagcagaagacccaggccctgcagagcaccaagcaggagtggacagatgagcggcagagcaaggtgtag

SEQ ID NO: 39154 - DNA, 1764 bp, Artificial Sequence
  Description of Artificial Sequence: Synthetic coding sequence
atgtctgctggagatgctgtgtgcaccggctggctggtgaagagccccccagagaggaagctgcagagatatgcctggaggaagcgctggtttgtgctgcggcggggccgcatgagcggcaacccagatgtgctggagtactacagaaacaagcacagcagcaagcccatccgggtcatcgacctgtctgaatgtgctgtgtggaagcacgtgggccccagctttgtgaggaaggagttccagaacaactttgtgttcatcgtgaagaccaccagcaggaccttctacctggtggccaagacagagcaggagatgcaggtgtgggtgcacagcatcagccaggtgtgcaacctgggccacctggaggatggagctgctgacagcatggagagcctgagctacacccccagcagcctgcagcccagcagcgccagcagcctgctgacagcccacgccgccagcagcagcctgcccagagatgaccccaacaccaatgctgtggccacagaggagaccaggtctgagagcgagctgctcttcctgcctgactacctggtgctgagcaactgtgagaccggccgcctgcaccacaccagcctgcccacccgctgtgacagctggagcaacagcgacaggagcctggagcaggccagctttgatgatgtgtttgtggactgcctgcagcccctgcccagcagccacctggtgcaccccagctgccacggcagcggggcccaggaggtgcccagcagccggccccaggccgccctgatctggagccgggagatcaatggccccccccgggaccacctgagcagcagccccctgctggagagcagcctgagcagcaccatccaggtggacaagaaccagggcagcctgccctgtggggccaaggagctggacatcatgagcaacaccccaccaccccggccccccaagcccagccacctgtctgaaagacggcaggaggagtggagcacccacagcggcagcaagaagccagagtgcaccctggtgccccggcgcatcagcctgagcggcctggacaacatgaggacctggaaggcagatgtggagggccagagcctgcggcaccgggacaagaggctgagcctgaacctgccctgccgcttcagccccatgtaccccacagccagcgccagcattgaagattcctatgtgcccatgagcccccaggccggggccagcggcctgggcccccactgcagcccagatgactacatccccatgaacagcggcagcatcagcagccccctgcctgagctgcctgccaacctggagcccccacctgtgaacagagacctgaagccccagaggaagagccggcccccacccctggacctgaggaacctgagcatcatccgggagcacgccagcctgaccaggaccaggacagtgccctgcagcaggaccagcttcctgagccctgagagaaatggcatcaacagcgcccgcttctttgccaaccctgtgtcccgggaggatgaggagagctacatcgagatggaggagcacaggacagccagcagcctgagcagcggggccctgacctggaccaagaagttcagcctggactacctggccctggacttcaacagcgccagccctgcccccatgcagcagaagctgctgctgtctgaggagcagagggtggactatgtgcaggtggatgagcagaagacccaggccctgcagagcaccaagcaggagtggacagatgagcggcagagcaaggtgtag

SEQ ID NO: 39155 - DNA, 1725 bp, Artificial Sequence
  Description of Artificial Sequence: Synthetic coding sequence
atgagcctgcccagccccagccccagccgggagctgtgccccccagaccctgcctttgcccccctgagctcctggccaggcagcggccctgctgggggcagcaccaggagcggccacgtgctgtacagcggctggctgaggaagagccccccagagaagaagctgcggctgtttgcctggaggaagcgctggttcatcctgcggcggggccagaccagcagtgaccctgatgtgctggagtactacaagaatgatggcagcaagaagcccctgcggaccatcaacctgaacctgtgtgagcagctggatgtggatgtgaccctgaacttcaacaagaaggagatccagaagggctacatgtttgacatcaagaccagcgagaggaccttctacctggtggccgagacccgggaggacatgaatgagtgggtgcagagcatctgccagatctgtggcttccggcaggaggagagcacaggcttcctgggcaacatcagcagcgccagccacggcctgtgcagcagccctgctgagcccagctgcagccaccagcacctgccccaggagcaggagcccaccagcgagccccctgtgagccactgtgtgccccccacctggcccatcccagcccctcctggctgcctgcggagccaccagcacgccagccagagagctgagcacgcccggagcgccagcttcagccagggcagcgaggcccccttcatcatgagaagaaacacagccatgcagaacctggcccagcacagcggctacagcgtggatggagtgtctggccacatccacggcttccacagcctgagcaagcccagccagcacaatgctgagttccggggcagcacccaccgcatcccctggagcctggccagccacggccacacccggggcagcctgactggaagtgaagctgacaatgaggccagcagcggcaagtacacccagcacggcggcggcaatgccagcaggcctgctgagagcatgcatgagggcgtgtgcagcttcctgcccggccgcaccctggtgggcctgagtgacagcatcgccagcgagggcagctgtgtgcccatgaaccctggcagccccaccctgcctgctgtgaagcaggccggagatgacagccagggcgtgtgcatccctgtgggcagctgcctggtgcgctttgacctgctgggcagccccctgacagagctgtccatgcaccaggacctgagccagggccacgaggtgcagctgccccctgtgaacagaagcctgaagcccaaccagaaggccaaccccaccccacccaacctgaggaacaacagagtcatcaatgagctgtccttcaagccccctgtgacagagccctggagcggcaccagccacacctttgacagcagcagcagccagcaccccatcagcacccagagcatcaccaacacagacagtgaagattctggagagcgctacctgttccccaacccagccagcgccttccctgtgtctgggggcaccagcagcagcgccccacccaggagcactggaaacatccactatgctgccctggacttccagcccagcaagcccagcatcggctctgtgaccagcggcaagaaggtggactatgtgcaggtggacctggagaagacccaggccctgcagaagaccatgcatgagcagatgtgcctgcggcagagcagcgagccccccaggggggccaagctgtag

SEQ ID NO: 39156 - DNA, 357 bp, Artificial Sequence
  Description of Artificial Sequence: Synthetic coding sequence
atggagagcgtggccctgtacagcttccaggccacagaaagtgatgagctggccttcaacaagggggacaccctgaagatcctgaacatggaggatgaccagaactggtacaaggccgagctgcggggcgtggagggcttcatccccaagaactacatccgggtgaagccccacccctggtacagcggccgcatcagccggcagctggccgaggagatcctgatgaagaggaaccacctgggcgccttcctgatccgggagagcgagagcagccctggagagttctctgtgtctgtgaacaacagagcccagaggggcccctgcctgggccccaagagccacagccggctgggctag

SEQ ID NO: 39157 - DNA, 567 bp, Artificial Sequence
  Description of Artificial Sequence: Synthetic coding sequence
atggaggatgaccagaactggtacaaggccgagctgcggggcgtggagggcttcatccccaagaactacatccgggtgaagccccacccctggtacagcggccgcatcagccggcagctggccgaggagatcctgatgaagaggaaccacctgggcgccttcctgatccgggagagcgagagcagccctggagagttctctgtgtctgtgaactacggggaccaggtgcagcacttcaaggtgctgcgggaggccagcggcaagtacttcctgtgggaggagaagttcaacagcctgaatgagctggtggacttctaccgcaccaccaccatcgccaagaagaggcagatcttcctgagagatgaggagcccctgctgaagagccctggggcctgctttgcccaggcccagtttgacttcagcgcccaggaccccagccagctgtccttcagaagaggagacatcatcgaggtgctggagaggccagacccccactggtggaggggccgcagctgtggccgggtgggcttcttccccaggagctatgtgcagcctgtgcacctgtag

SEQ ID NO: 39158 - DNA, 123 bp, Artificial Sequence
  Description of Artificial Sequence: Synthetic coding sequence
atgctgctgcgggagatcacctacagcatcacccccctgagcctgcacggcaccagcctgctgaactgcaactggagggccaccggcctggtgaccctggagggccaccggcccttccagtag

SEQ ID NO: 39159 - DNA, 801 bp, Artificial Sequence
  Description of Artificial Sequence: Synthetic coding sequence
atggtgctgagcggggcccaggcccagatggaccagaaccctggctactaccaccagctgctgcagggcgagaggaacccccggctggaggatgccatcagaacagacctgaacagaaccttcccagacaacgtgaagttcaggaagaccacagacccctgcctgcagaggaccctgtacaacgtgctgctggcctacggccaccacaaccagggcgtgggctactgccagggcatgaacttcatcgccggctacctgatcctgatcaccaacaatgaggaggagagcttctggctgctggatgccctggtgggccgcatcctgcctgactactacagccctgccatgctgggcctgaagacagaccaggaggtgctgggggagctggtgcgggccaagctgcctgctgtgggcgccctgatggagcggctgggcgtgctgtggaccctgctggtgagccgctggttcatctgcctgtttgtggacatcctgcctgtggagaccgtgctgcgcatctgggactgcctcttcaatgaaggcagcaagatcatcttccgggtggccctgaccctcatcaagcagcaccaggagctgatcctggaggccacctctgtgcctgacatctgtgacaagttcaagcagatcaccaagggcagctttgtgatggagtgccacaccttcatgcaggtgtgtggggccgcccggggctctgtgcccagccagggcgccccaccccacctgcagcccggcggctgcagcgaccaccctgagggcgcccaggacggccaccagtgggcctag

SEQ ID NO: 39160 - DNA, 1035 bp, Artificial Sequence
  Description of Artificial Sequence: Synthetic coding sequence
atgcagcctgctgagaggagccgggtgcccagaattgacccctacggctttgagaggccagaagattttgatgatgctgcctatgagaagttcttcagcagctacctggtgaccctgacccggcgggccatcaagtggagccggctgctgcagggcggcggcgtgcccaggagcaggacagtgaagcgctacgtgaggaaaggagtgcccctggagcaccgggcccgggtgtggatggtgctgagcggggcccaggcccagatggaccagaaccctggctactaccaccagctgctgcagggcgagaggaacccccggctggaggatgccatcagaacagacctgaacagaaccttcccagacaacgtgaagttcaggaagaccacagacccctgcctgcagaggaccctgtacaacgtgctgctggcctacggccaccacaaccagggcgtgggctactgccagggcatgaacttcatcgccggctacctgatcctgatcaccaacaatgaggaggagagcttctggctgctggatgccctggtgggccgcatcctgcctgactactacagccctgccatgctgggcctgaagacagaccaggaggtgctgggggagctggtgcgggccaagctgcctgctgtgggcgccctgatggagcggctgggcgtgctgtggaccctgctggtgagccgctggttcatctgcctgtttgtggacatcctgcctgtggagaccgtgctgcgcatctgggactgcctcttcaatgaaggcagcaagatcatcttccgggtggccctgaccctcatcaagcagcaccaggagctgatcctggaggccacctctgtgcctgacatctgtgacaagttcaagcagatcaccaagggcagctttgtgatggagtgccacaccttcatgcaggtgtgtggggccgcccggggctctgtgcccagccagggcgccccaccccacctgcagcccggcggctgcagcgaccaccctgagggcgcccaggacggccaccagtgggcctag

SEQ ID NO: 39161 - DNA, 1011 bp, Artificial Sequence
  Description of Artificial Sequence: Synthetic coding sequence
atgcagcctgctgagaggagccgggtgcccagaattgacccctacggctttgagaggccagaagattttgatgatgctgcctatgagaagttcttcagcagctacctggtgaccctgacccggcgggccatcaagtggagccggctgctgcagggcggcggcgtgcccaggagcaggacagtgaagcgctacgtgaggaaaggagtgcccctggagcaccgggcccgggtgtggatggtgctgagcggggcccaggcccagatggaccagaaccctggctactaccaccagctgctgcagggcgagaggaacccccggctggaggatgccatcagaacagacctgaacagaaccttcccagacaacgtgaagttcaggaagaccacagacccctgcctgcagaggaccctgtacaacgtgctgctggcctacggccaccacaaccagggcgtgggctactgccagggcatgaacttcatcgccggctacctgatcctgatcaccaacaatgaggaggagagcttctggctgctggatgccctggtgggccgcatcctgcctgactactacagccctgccatgctgggcctgaagacagaccaggaggtgctgggggagctggtgcgggccaagctgcctgctgtgggcgccctgatggagcggctgggcgtgctgtggaccctgctggtgagccgctggttcatctgcctgtttgtggacatcctgcctgtggagaccgtgctgcgcatctgggactgcctcttcaatgaaggcagcaagatcatcttccgggtggccctgaccctcatcaagcagcaccaggagctgatcctggaggccacctctgtgcctgacatctgtgacaagttcaagcagatcaccaagggcagctttgtgatggagtgccacaccttcatgcagaagatcttcagcgagcccggcagcctgtccatggccaccgtggccaagctgcgggagagctgccgggcccggctgctggcccagggctag

SEQ ID NO: 39162 - DNA, 3654 bp, Artificial Sequence
  Description of Artificial Sequence: Synthetic coding sequence
atgaagggcatgagccatgagcccaagagccccagcctgggcatgctgagcacagccaccaggaccacagccaccgtgaaccccctgacccccagccccctgaatggagccctggtgcccagcggcagccctgccaccagcagcgccctgagcgcccaggccgcccccagcagcagctttgctgctgccctgaggaagctggccaagcaggccgaggagccccggggcagcagcctgagcagcgagagcagccctgtgagcagccctgccaccaaccacagcagccctgccagcacccccaagagggtgcccatgggccccatcatcgtgcccccaggcggccacagcgtgcccagcaccccacctgtggtgaccatcgcccccaccaagacagtgaatggagtgtggaggtctgagagccggcaggatgctggcagccgcagcagcagcggcggccgggagcggctgattgtggagccccccctgccccaggagaaggccggcggccctgccatccccagccacctgctgagcaccccctaccccttcggcctgagccccagctctgtggtgcaggacagccgcttcccccccctgaacctgcagaggcctgtgcaccacgtggtgccccccagcacagtgacagaggactacctgcgctccttccggccctaccacaccacagatgacctgaggatgagcagcctgccccccctgggcctggaccctgccacagctgctgcctactaccaccccagctacctggccccccaccccttcccccacccagccttcaggatggatgacagctactgcctgagcgccctgcggagccccttctaccccatccccaccccaggcagcctgccccccctgcaccccagcgccatgcacctgcacctgagcggcgtgcgctacccacctgagctgagccacagcagcctggccgccctgcacagcgagaggatgagcggcctgtctgctgagcggctgcagatggatgaggagctgcggcgggagcgggagcgggagcgggagcgggagcgggagcgggaggccgaccgggagcgggagaaggagcgggagcgggagcgggagaaggagcgggagcaggagaaggagcgggagcgggagaaggagcgggagcgggagctggagcggcagcgggagcagagggcccgggagaaggagctgctggccgccaaggccctggagcccagcttcctgcctgtggccgagctgcacggcctgcggggccacgccacagaggagcggggcaagcccagcgagcagctgacccccaccagggctgagaagctgaaggatgctggcctgcaggcccccaagcctgtgcagcaccccctgcaccctgtgcccaccccccaccacacagtgcccagcctcatcagcaaccacggcatcttcagcctgcccagcagcagcgctgccacagccctgctgatccagaggaccaatgaggaggagaagtggctggcccggcagaggcggctgcggcaggagaaggaggaccggcagagccaggtgtctgagttccggcagcaggtgctggagcagcacctggacatgggccggccccctgtgcctgctgaggccgagcacaggcctgagagcaccacccggcccggccccaacagacatgagcccggcggccgggaccccccccagcactttggaggccccccacccctcatcagccccaagccccagctgcatgctgcccccacagccctgtggaaccctgtgtccctgatggacaacaccctggagacccggcgggcagagagccacagcctgcacagccaccctgctgcctttgagcccagccggcaggccgctgtgcccctggtgaaggtggagagggtcttctgcccagagaaggccgaggagggccccaggaagcgggagcccgcccccctggacaagtaccagcccccacctcctccaccccgggagggcggcagcctggagcaccagcccttcctgcccggccctggccccttcctggccgagctggagaagagcacccagaccatcctgggccagcagagggccagcctgccccaggccgccacctttggagagctgagcggccccctgaagccaggcagcccctaccggccccctgtgccccgggccccagaccctgcctacatctatgatgagttcctgcagcagaggcggcggctggtgtccaagctggacctggaggagaggagaagaagagaggcccaggagaagggctactactatgacctggatgacagctatgatgaaagtgatgaggaggaggtgcgggcccacctgcgctgtgtggccgagcagccccccctgaagctggacaccagcagcgagaagctggagttcctgcagctgtttggcctgaccacccagcagcagaaggaggagctggtggcccagaagaggaggaagagaagaaggatgctgcgggagaggagccccagcccccccaccatccagagcaagaggcagacccccagcccccggctggccctgagcacccgctacagcccagatgagatgaacaacagccccaactttgaggagaagaagaagttcctgaccatcttcaacctgacccacatctctgctgagaagaggaaggacaaggagcggctggtggagatgctgcgggccatgaagcagaaggccctgtctgctgctgtggccgacagcctgaccaacagcccccgggacagccctgctgtgtccctgtctgagcccgccacccagcaggccagcctggatgtggagaagcctgtgggcgtggccgccagcctgagtgacatccccaaggctgctgagcccgggaagctggagcaggtgcggccccaggagctgagccgggtgcaggagctggccccagccagcggggagaaggcccggctgtctgaggcccctgggggcaagaagagcctgtccatgctgcactacatcagaggagctgcccccaaggacatccctgtgcccctgagccacagcaccaacgggaagagcaagccctgggagccctttgtggccgaggagtttgcccaccagttccacgagagcgtgctgcagagcacccagaaggccctgcagaagcacaagggctctgtggccgtgctgtctgctgagcagaaccacaaggtggacacctctgtgcactacaacatccctgagctgcagagcagcagccgggcccccccaccccagcacaacggccagcaggagcccccaacagccaggaagggcccccccacccaggagctggaccgggacagcgaggaggaggaggaggaggatgatgaagatggagaagatgaggaggaggtgcccaagaggaagtggcagggcatcgaggccgtgtttgaggcctaccaggagcacatcgaggagcagaacctggagcggcaggtgctgcagacccagtgccggcggctggaggcccggcactacagcctgagcctgacagctgagcagctgagccacagcgtggccgagctgcggagccagaagcagaagatggtgtctgagcgggagcggctgcaggccgagctggaccacctgaggaagtgcctggccctgcctgccatgcactggccccggggctacctgaagggctaccccaggtag

SEQ ID NO: 39163 - DNA, 3342 bp, Artificial Sequence
  Description of Artificial Sequence: Synthetic coding sequence
atgggccccatcatcgtgcccccaggcggccacagcgtgcccagcaccccacctgtggtgaccatcgcccccaccaagacagtgaatggagtgtggaggtctgagagccggcaggatgctggcagccgcagcagcagcggcggccgggagcggctgattgtggagccccccctgccccaggagaaggccggcggccctgccatccccagccacctgctgagcaccccctaccccttcggcctgagccccagctctgtggtgcaggacagccgcttcccccccctgaacctgcagaggcctgtgcaccacgtggtgccccccagcacagtgacagaggactacctgcgctccttccggccctaccacaccacagatgacctgaggatgagcagcctgccccccctgggcctggaccctgccacagctgctgcctactaccaccccagctacctggccccccaccccttcccccacccagccttcaggatggatgacagctactgcctgagcgccctgcggagccccttctaccccatccccaccccaggcagcctgccccccctgcaccccagcgccatgcacctgcacctgagcggcgtgcgctacccacctgagctgagccacagcagcctggccgccctgcacagcgagaggatgagcggcctgtctgctgagcggctgcagatggatgaggagctgcggcgggagcgggagcgggagcgggagcgggagcgggagcgggaggccgaccgggagcgggagaaggagcgggagcgggagcgggagaaggagcgggagcaggagaaggagcgggagcgggagaaggagcgggagcgggagctggagcggcagcgggagcagagggcccgggagaaggagctgctggccgccaaggccctggagcccagcttcctgcctgtggccgagctgcacggcctgcggggccacgccacagaggagcggggcaagcccagcgagcagctgacccccaccagggctgagaagctgaaggatgctggcctgcaggcccccaagcctgtgcagcaccccctgcaccctgtgcccaccccccaccacacagtgcccagcctcatcagcaaccacggcatcttcagcctgcccagcagcagcgctgccacagccctgctgatccagaggaccaatgaggaggagaagtggctggcccggcagaggcggctgcggcaggagaaggaggaccggcagagccaggtgtctgagttccggcagcaggtgctggagcagcacctggacatgggccggccccctgtgcctgctgaggccgagcacaggcctgagagcaccacccggcccggccccaacagacatgagcccggcggccgggaccccccccagcactttggaggccccccacccctcatcagccccaagccccagctgcatgctgcccccacagccctgtggaaccctgtgtccctgatggacaacaccctggagacccggcgggcagagagccacagcctgcacagccaccctgctgcctttgagcccagccggcaggccgctgtgcccctggtgaaggtggagagggtcttctgcccagagaaggccgaggagggccccaggaagcgggagcccgcccccctggacaagtaccagcccccacctcctccaccccgggagggcggcagcctggagcaccagcccttcctgcccggccctggccccttcctggccgagctggagaagagcacccagaccatcctgggccagcagagggccagcctgccccaggccgccacctttggagagctgagcggccccctgaagccaggcagcccctaccggccccctgtgccccgggccccagaccctgcctacatctatgatgagttcctgcagcagaggcggcggctggtgtccaagctggacctggaggagaggagaagaagagaggcccaggagaagggctactactatgacctggatgacagctatgatgaaagtgatgaggaggaggtgcgggcccacctgcgctgtgtggccgagcagccccccctgaagctggacaccagcagcgagaagctggagttcctgcagctgtttggcctgaccacccagcagcagaaggaggagctggtggcccagaagaggaggaagagaagaaggatgctgcgggagaggagccccagcccccccaccatccagagcaagaggcagacccccagcccccggctggccctgagcacccgctacagcccagatgagatgaacaacagccccaactttgaggagaagaagaagttcctgaccatcttcaacctgacccacatctctgctgagaagaggaaggacaaggagcggctggtggagatgctgcgggccatgaagcagaaggccctgtctgctgctgtggccgacagcctgaccaacagcccccgggacagccctgctgtgtccctgtctgagcccgccacccagcaggccagcctggatgtggagaagcctgtgggcgtggccgccagcctgagtgacatccccaaggctgctgagcccgggaagctggagcaggtgcggccccaggagctgagccgggtgcaggagctggccccagccagcggggagaaggcccggctgtctgaggcccctgggggcaagaagagcctgtccatgctgcactacatcagaggagctgcccccaaggacatccctgtgcccctgagccacagcaccaacgggaagagcaagccctgggagccctttgtggccgaggagtttgcccaccagttccacgagagcgtgctgcagagcacccagaaggccctgcagaagcacaagggctctgtggccgtgctgtctgctgagcagaaccacaaggtggacacctctgtgcactacaacatccctgagctgcagagcagcagccgggcccccccaccccagcacaacggccagcaggagcccccaacagccaggaagggcccccccacccaggagctggaccgggacagcgaggaggaggaggaggaggatgatgaagatggagaagatgaggaggaggtgcccaagaggaagtggcagggcatcgaggccgtgtttgaggcctaccaggagcacatcgaggagcagaacctggagcggcaggtgctgcagacccagtgccggcggctggaggcccggcactacagcctgagcctgacagctgagcagctgagccacagcgtggccgagctgcggagccagaagcagaagatggtgtctgagcgggagcggctgcaggccgagctggaccacctgaggaagtgcctggccctgcctgccatgcactggccccggggctacctgaagggctaccccaggtag

SEQ ID NO: 39164 - DNA, 2463 bp, Artificial Sequence
  Description of Artificial Sequence: Synthetic coding sequence
atggtggtggacttctgcagaagatttgtggcccggagcctgtgcatcatcctgatgaagcacttctgcagcagctctgtgtctgaggacctgggctgccggcggggggacttcagcaggaagcactacggctctgtggagctgctgatcagcagtgatgctgatggagccatccagagagctggccgcttccgggtggagaatggcagcagtgatgaaaatgccacagccctgcccggcacctggaggagaacagatgtgcacctggagaaccctgagtaccacacccgctggtacttcaagtacttcctgggccaggtgcaccagaactacatcggaaatgatgctgagaagagccccttcttcctgtctgtgaccctgagtgaccagaacaaccagagggtgccccagtaccgggccatcctgtggaggaagacaggcacccagaagatctgcctgccctacagccccaccaagaccctgtctgtgaagagcatcctgagcgccatgaacctggacaagtttgagaagggcccccgggagatcttccaccctgagatccagaaggacctgctggtgctggaggagcaggagggctctgtgaacttcaagtttggagtgctgtttgccaaggatggccagctgacagatgatgagatgttcagcaatgaaattggcagcgagcccttccagaagttcctgaacctgctgggggacaccatcaccctgaagggctggacaggctacagaggaggcctggacaccaagaatgacaccaccggcatccacagcgtgtacacagtgtaccagggccacgagatcatgtttcatgtgtccaccatgctgccctacagcaaagaaaacaagcagcaggtggagaggaagaggcacatcggaaatgacatcgtgaccatcgtgttccaggagggggaggagagcagccctgccttcaagcccagcatgatccgcagccacttcacccacatctttgccctggtgcgctacaaccagcagaatgacaactaccgcctgaagatcttcagcgaggagagcgtgcccctgtttggaccacccctgcccaccccacctgtgttcacagaccaccaggagttccgggacttcctgctggtgaagctgatcaatggagagaaggccaccctggagacccccacctttgcccagaagagaagaaggaccctggacatgctgatccgcagcctgcaccaggacctgatgccagacctgcacaagaacatgctgaacagaagaagcttcagtgatgtgctgcctgagagccccaagagcgccaggaagaaggaggaggcccggcaggccgagtttgtgcgcatcggccaggccctgaagctgaagagcatcgtgagaggagatgcccccagcagcctggccgccagcggcatctgcaagaaggagccctgggagccccagtgcttctgcagcaacttcccccatgaggccgtgtgtgccgacccctggggccaggccctgctggtgtccacagatgctggggtgctgctggtggatgatgacctgcccagcgtgcctgtgtttgacaggaccctgcctgtgaagcagatgcacgtgctggagaccctggacctgctggtgctgcgggctgacaagggcaaggatgcccggctgtttgtgttccggctgagcgccctgcagaagggcctggagggcaagcaggccggcaagagcagaagtgactgccgggagaacaagctggagaagaccaagggctgccacctgtatgccatcaacacccaccacagccgggagctgagaattgtggtggccatccggaacaagctgctgctgatcaccaggaagcacaacaagcccagcggcgtgaccagcaccagcctgctgagccccctgtctgagagccctgtggaggagttccagtacatccgggagatctgcctgagtgacagccccatggtgatgaccctggtggatggccctgctgaggagagtgacaacctgatctgtgtggcctaccgccaccagtttgatgtggtgaatgaaagcactggagaggccttccggctgcaccacgtggaggccaacagagtgaactttgtggccgccattgatgtgtatgaagatggagaggccggcctgctgctgtgctacaactacagctgcatctacaagaaggtgtgccccttcaacggcggcagcttcctggtgcagcccagcgccagtgacttccagttctgctggaaccaggccccctatgccatcgtgtgtgccttcccctacctgctggccttcaccacagacagcatggagatccggctggtggtgaatggaaacctggtgcacacagctgtggtgccccagctgcagctggtggccagccgggtgaagttcaaccagaagatctgcacccgcttccacctggagacctcctgggccgaggccagcaatgacctgtag

SEQ ID NO: 39165 - DNA, 3042 bp, Artificial Sequence
  Description of Artificial Sequence: Synthetic coding sequence
atggtggtggacttctgcagaagatttgtggcccggagcctgtgcatcatcctgatgaagcacttctgcagcagctctgtgtctgaggacctgggctgccggcggggggacttcagcaggaagcactacggctctgtggagctgctgatcagcagtgatgctgatggagccatccagagagctggccgcttccgggtggagaatggcagcagtgatgaaaatgccacagccctgcccggcacctggaggagaacagatgtgcacctggagaaccctgagtaccacacccgctggtacttcaagtacttcctgggccaggtgcaccagaactacatcggaaatgatgctgagaagagccccttcttcctgtctgtgaccctgagtgaccagaacaaccagagggtgccccagtaccgggccatcctgtggaggaagacaggcacccagaagatctgcctgccctacagccccaccaagaccctgtctgtgaagagcatcctgagcgccatgaacctggacaagtttgagaagggcccccgggagatcttccaccctgagatccagaaggacctgctggtgctggaggagcaggagggctctgtgaacttcaagtttggagtgctgtttgccaaggatggccagctgacagatgatgagatgttcagcaatgaaattggcagcgagcccttccagaagttcctgaacctgctgggggacaccatcaccctgaagggctggacaggctacagaggaggcctggacaccaagaatgacaccaccggcatccacagcgtgtacacagtgtaccagggccacgagatcatgtttcatgtgtccaccatgctgccctacagcaaagaaaacaagcagcaggtggagaggaagaggcacatcggaaatgacatcgtgaccatcgtgttccaggagggggaggagagcagccctgccttcaagcccagcatgatccgcagccacttcacccacatctttgccctggtgcgctacaaccagcagaatgacaactaccgcctgaagatcttcagcgaggagagcgtgcccctgtttggaccacccctgcccaccccacctgtgttcacagaccaccaggagttccgggacttcctgctggtgaagctgatcaatggagagaaggccaccctggagacccccacctttgcccagaagagaagaaggaccctggacatgctgatccgcagcctgcaccaggacctgatgccagacctgcacaagaacatgctgaacagaagaagcttcagtgatgtgctgcctgagagccccaagagcgccaggaagaaggaggaggcccggcaggccgagtttgtgcgcatcggccaggccctgaagctgaagagcatcgtgagaggagatgcccccagcagcctggccgccagcggcatctgcaagaaggagccctgggagccccagtgcttctgcagcaacttcccccatgaggccgtgtgtgccgacccctggggccaggccctgctggtgtccacagatgctggggtgctgctggtggatgatgacctgcccagcgtgcctgtgtttgacaggaccctgcctgtgaagcagatgcacgtgctggagaccctggacctgctggtgctgcgggctgacaagggcaaggatgcccggctgtttgtgttccggctgagcgccctgcagaagggcctggagggcaagcaggccggcaagagcagaagtgactgccgggagaacaagctggagaagaccaagggctgccacctgtatgccatcaacacccaccacagccgggagctgagaattgtggtggccatccggaacaagctgctgctgatcaccaggaagcacaacaagcccagcggcgtgaccagcaccagcctgctgagccccctgtctgagagccctgtggaggagttccagtacatccgggagatctgcctgagtgacagccccatggtgatgaccctggtggatggccctgctgaggagagtgacaacctgatctgtgtggcctaccgccaccagtttgatgtggtgaatgaaagcactggagaggccttccggctgcaccacgtggaggccaacagagtgaactttgtggccgccattgatgtgtatgaagatggagaggccggcctgctgctgtgctacaactacagctgcatctacaagaaggtgtgccccttcaacggcggcagcttcctggtgcagcccagcgccagtgacttccagttctgctggaaccaggccccctatgccatcgtgtgtgccttcccctacctgctggccttcaccacagacagcatggagatccggctggtggtgaatggaaacctggtgcacacagctgtggtgccccagctgcagctggtggccagcagaagtgacatctacttcaccgccacagctgctgtgaatgaggtgagcagcggcggcagcagcaaaggagccagcgccaggaacagcccccagaccccacctggccgggacacccctgtgttccccagcagcctgggggagggggagatccagagcaagaacctgtacaagatccccctgaggaacctggtgggccgcagcattgagcggcccctgaagagccccctggtgtccaaggtgatcaccccacccacccccatctctgtgggcctggccgccatccctgtgacccacagcctgagcctgagcaggatggagatcaaggagatcgccagcaggacccggcgggagctgctgggcctgagtgatgagggcggccccaagtctgagggcgcccccaaggccaagagcaagcccaggaagaggctggaggagagccagggcggccccaagccaggagctgtgcgcagcagcagcagtgaccgcatccccagcggcagcctggagagcgccagcaccagcgaggccaaccctgagggccacagcgccagcagtgaccaggaccctgtggccgaccgggagggcagccctgtgtctggcagcagccccttccagctgacagccttcagtgatgaggacatcatcgacctgaagtag

SEQ ID NO: 39166 - DNA, 807 bp, Artificial Sequence
  Description of Artificial Sequence: Synthetic coding sequence
atggaccccctgaccaaggtgccctgtggcagccagatcgcccagaccatcctgtggaaggccaagagcagcctgagctttggcatccagcccctgcagacctggcccaccaaggaccctgagctggagagccaggtgaacctgtctgtgtctgaggacctgggctgcagaagaggagacttcagcaggaagcactacggctctgtggagctgctgatcagcagtgatgctgatggagccatccagagagctggccgcttccgggtggagaatggcagcagtgatgaaaatgccacagccctgcccggcacctggaggagaacagatgtgcacctggagaaccctgagtaccacacccgctggtacttcaagtacttcctgggccaggtgcaccagaactacatcggaaatgatgctgagaagagccccttcttcctgtctgtgaccctgagtgaccagaacaaccagagggtgccccagtaccgggccatcctgtggaggaagacaggcacccagaagatctgcctgccctacagccccaccaagaccctgtctgtgaagagcatcctgagcgccatgaacctggacaagtttgagaagggcccccgggagatcttccaccctgagatccagaaggacctgctggtgctggaggagcaggagggctctgtgaacttcaagtttggagtgctgtttgccaaggatggccagctgacagatgatgagatgttcagcaatgagatcggcagcgagcccttccagaagttcctgaacctgctgggggacaccatcaccctgaagggctag

SEQ ID NO: 39167 - DNA, 2976 bp, Artificial Sequence
  Description of Artificial Sequence: Synthetic coding sequence
atgaagagctctgtgtctgaggacctgggctgccggcggggggacttcagcaggaagcactacggctctgtggagctgctgatcagcagtgatgctgatggagccatccagagagctggccgcttccgggtggagaatggcagcagtgatgaaaatgccacagccctgcccggcacctggaggagaacagatgtgcacctggagaaccctgagtaccacacccgctggtacttcaagtacttcctgggccaggtgcaccagaactacatcggaaatgatgctgagaagagccccttcttcctgtctgtgaccctgagtgaccagaacaaccagagggtgccccagtaccgggccatcctgtggaggaagacaggcacccagaagatctgcctgccctacagccccaccaagaccctgtctgtgaagagcatcctgagcgccatgaacctggacaagtttgagaagggcccccgggagatcttccaccctgagatccagaaggacctgctggtgctggaggagcaggagggctctgtgaacttcaagtttggagtgctgtttgccaaggatggccagctgacagatgatgagatgttcagcaatgaaattggcagcgagcccttccagaagttcctgaacctgctgggggacaccatcaccctgaagggctggacaggctacagaggaggcctggacaccaagaatgacaccaccggcatccacagcgtgtacacagtgtaccagggccacgagatcatgtttcatgtgtccaccatgctgccctacagcaaagaaaacaagcagcaggtggagaggaagaggcacatcggaaatgacatcgtgaccatcgtgttccaggagggggaggagagcagccctgccttcaagcccagcatgatccgcagccacttcacccacatctttgccctggtgcgctacaaccagcagaatgacaactaccgcctgaagatcttcagcgaggagagcgtgcccctgtttggaccacccctgcccaccccacctgtgttcacagaccaccaggagttccgggacttcctgctggtgaagctgatcaatggagagaaggccaccctggagacccccacctttgcccagaagagaagaaggaccctggacatgctgatccgcagcctgcaccaggacctgatgccagacctgcacaagaacatgctgaacagaagaagcttcagtgatgtgctgcctgagagccccaagagcgccaggaagaaggaggaggcccggcaggccgagtttgtgcgcatcggccaggccctgaagctgaagagcatcgtgagaggagatgcccccagcagcctggccgccagcggcatctgcaagaaggagccctgggagccccagtgcttctgcagcaacttcccccatgaggccgtgtgtgccgacccctggggccaggccctgctggtgtccacagatgctggggtgctgctggtggatgatgacctgcccagcgtgcctgtgtttgacaggaccctgcctgtgaagcagatgcacgtgctggagaccctggacctgctggtgctgcgggctgacaagggcaaggatgcccggctgtttgtgttccggctgagcgccctgcagaagggcctggagggcaagcaggccggcaagagcagaagtgactgccgggagaacaagctggagaagaccaagggctgccacctgtatgccatcaacacccaccacagccgggagctgagaattgtggtggccatccggaacaagctgctgctgatcaccaggaagcacaacaagcccagcggcgtgaccagcaccagcctgctgagccccctgtctgagagccctgtggaggagttccagtacatccgggagatctgcctgagtgacagccccatggtgatgaccctggtggatggccctgctgaggagagtgacaacctgatctgtgtggcctaccgccaccagtttgatgtggtgaatgaaagcactggagaggccttccggctgcaccacgtggaggccaacagagtgaactttgtggccgccattgatgtgtatgaagatggagaggccggcctgctgctgtgctacaactacagctgcatctacaagaaggtgtgccccttcaacggcggcagcttcctggtgcagcccagcgccagtgacttccagttctgctggaaccaggccccctatgccatcgtgtgtgccttcccctacctgctggccttcaccacagacagcatggagatccggctggtggtgaatggaaacctggtgcacacagctgtggtgccccagctgcagctggtggccagcagaagtgacatctacttcaccgccacagctgctgtgaatgaggtgagcagcggcggcagcagcaaaggagccagcgccaggaacagcccccagaccccacctggccgggacacccctgtgttccccagcagcctgggggagggggagatccagagcaagaacctgtacaagatccccctgaggaacctggtgggccgcagcattgagcggcccctgaagagccccctggtgtccaaggtgatcaccccacccacccccatctctgtgggcctggccgccatccctgtgacccacagcctgagcctgagcaggatggagatcaaggagatcgccagcaggacccggcgggagctgctgggcctgagtgatgagggcggccccaagtctgagggcgcccccaaggccaagagcaagcccaggaagaggctggaggagagccagggcggccccaagccaggagctgtgcgcagcagcagcagtgaccgcatccccagcggcagcctggagagcgccagcaccagcgaggccaaccctgagggccacagcgccagcagtgaccaggaccctgtggccgaccgggagggcagccctgtgtctggcagcagccccttccagctgacagccttcagtgatgaggacatcatcgacctgaagtag

SEQ ID NO: 39168 - DNA, 807 bp, Artificial Sequence; identical to SEQ ID NO: 39166
  Description of Artificial Sequence: Synthetic coding sequence

SEQ ID NO: 39169 - DNA, 903 bp, Artificial Sequence
  Description of Artificial Sequence: Synthetic coding sequence
atggccgagagtgaagatagaagcctgagaattgtgctggtgggcaagacaggcagcggcaagagcgccacagccaacaccatcctgggggaggagatctttgacagcagaattgctgcccaggccgtgaccaagaactgccagaaggccagccgggagtggcagggccgggacctgctggtggtggacaccccaggcctgtttgacaccaaggagagcctggacaccacctgcaaggagatcagccgctgcatcatcagcagctgccccggcccccacgccatcgtgctggtgctgctgctgggccgctacacagaggaggagcagaagacagtggccctgatcaaggctgtgtttgggaagagcgccatgaagcacatggtgatcctcttcaccaggaaggaggagctggagggccagagcttccatgacttcatcgcagatgctgatgtgggcctgaagagcatcgtgaaggaatgtggcaaccgctgctgtgccttcagcaacagcaagaagaccagcaaggccgagaaggagagccaggtgcaggagctggtggagctgattgagaagatggtgcagtgcaatgaaggagcctacttcagtgatgacatctacaaggacacagaggagcggctgaagcagcgggaggaggtgctgaggaagatctacacagaccagctgaatgaggagatcaagctggtggaggaggacaagcacaagtctgaggaggagaaggagaaggagatcaagctgctgaagctgaagtatgatgagaagatcaagaacatccgggaggaggccgagaggaacatcttcaaggatgtgttcaaccgcatctggaagatgctgtctgagatctggcaccgcttcctgagcaagtgcaagttctacagcagctag

SEQ ID NO: 39170 - DNA, 207 bp, Artificial Sequence
  Description of Artificial Sequence: Synthetic coding sequence
atgagcggcttcagctctgtggccgccaccaagaaggtggtgcagcagctgcagctggaggccggcctgaacagcgtgaaggtgtcccaggccgctgctgacctgaagcagttctgcctgcagaatgcccagcacgaccccctgctgactggagtgagcagcagcaccaaccccttccggccccagaaggtgtgcagcttcctgtag

SEQ ID NO: 39171 - DNA, 1569 bp, Artificial Sequence
  Description of Artificial Sequence: Synthetic coding sequence
atggtgcgcagcggcaagaatggagacctgcacctgaagcagatcgcctactacaagaggactggagagtaccacagcaccaccctgcccagcgagaggagcggcatcagaagagctgccaagaagtttgtgttcaaggagaagaagctgttctacgtgggcaaggacaggaagcagaaccggctggtgattgtgtctgaggaggagaagaagaaggtgctgcgggagtgccatgaaaatgacagcggggcccaccacggcatcagcaggaccctgaccctggtggagagcaactactactggacctctgtgaccaatgatgtgaagcagtgggtgtatgcctgccagcactgccaggtggccaagaacacagtcatcgtggcccccaagcagcacctgctgaaggtggagaacccctggagcctggtgacagtggacctgatgggccccttccacaccagcaacagaagccacgtgtatgccatcatcatgacagacctcttcaccaagtggatcgtcatcctgcccctgtgtgatgtgtctgccagcgaggtgtccaaggccatcatcaacatcttcttcctgtatggccccccccagaagatcatcatggaccagagagatgagttcatccagcagatcaacatcgagctgtaccgcctgtttggcatcaagcagatcgtcatcagccacaccagcggcaccgtgaaccccacagagagcacccccaacaccatcaaggccttcctgagcaagcactgtgccgaccaccccaacaactgggatgaccacctgtctgctgtgtcctttgccttcaacgtgacccacctggagcccaccaagaacaccccctacttccagatgttcagcaggaacccctacatgcctgagaccagtgacagcctgcacgaggtggatggagacaacacctccatgtttgccaagatcctggatgccatcaaggaggccgacaagatcatggagaacaagaccaccagcctgggccagatggagaacaacaacctggatgagctgaacaagagcaagatcatcgtgaagaagaagcccaagcagctgaaccccttccacctgaaggtgggccacgaggtgctgcggcagaggaagaactggtggaaggatggccgcttccagagcgagtgggtgggcccctgtgtgattgactacatcacagaaagtggctgtgctgtgctgcgggacaacacaggagtgcggctgaagaggcccatcaagatgagccacctgaagccctacatccgggagagcagcgagcaggagagcctgtacctgctgcagggctctgtggtggccgaccatgactacatcggcctgcctgagatccccatcggggcctaccaggccaacatcctggtggaggatgccaccatcggcatcgtggacaatgagctgctgaccagcagcaaggaccgggagctgctggagtacagaaacaccaagatcagccccctgattgatgaccacagcagcctggagaagcagaccttcagcctgctggacagcagcaaccaggtgctggagtacctgtcctag

SEQ ID NO: 39172 - DNA, 669 bp, Artificial Sequence
  Description of Artificial Sequence: Synthetic coding sequence
atggtgcgcagcggcaagaatggagacctgcacctgaagcagatcgcctactacaagaggactggagagtaccacagcaccaccctgcccagcgagaggagcggcatcagaagagctgccaagaagtttgtgttcaaggagaagaagctgttctacgtgggcaaggacaggaagcagaaccggctggtgattgtgtctgaggaggagaagaagaaggtgctgcgggagtgccatgaaaatgacagcggggcccaccacggcatcagcaggaccctgaccctggtggagagcaactactactggacctctgtgaccaatgatgtgaagcagtgggtgtatgcctgccagcactgccaggtggccaagaacacagtcatcgtggcccccaagcagcacctgctgaaggtggagaacccctggagcctggtgacagtggacctgatgggccccttccacaccagcaacagaagccacgtgtatgccatcatcatgacagacctcttcaccaagtggatcgtcatcctgcccctgtgtgatgtgtctgccagcgaggtgtccaaggccatcatcaacatcttcttcctgtatggccccccccagaagatcatcatggaccagagagatgagttcatccagcagaaggtgttcatcagctgcaaggtgcagtag

SEQ ID NO: 39173 - DNA, 687 bp, Artificial Sequence
  Description of Artificial Sequence: Synthetic coding sequence
atggccgccccaccccagcctgtgacccacctgatctttgacatggatggcctgctgctggacacagagcggctgtacagcgtggtgttccaggagatctgcaacagatatgacaagaagtacagctgggatgtgaagagcctggtgatgggcaagaaggccctggaggccgcccagatcatcattgatgtgctgcagctgcccatgagcaaggaggagctggtggaggagagccagaccaagctgaaggaggtgttccccacagctgccctgatgcctggagctgagaagctgatcatccacctgaggaagcacggcatcccctttgccctggccaccagcagcggcagcgccagctttgacatgaagaccagccgccacaaggagttcttcagcctcttcagccacatcgtgctgggagatgatcctgaggtgcagcacggcaagccagaccctgacatcttcctggcctgtgccaagcgcttcagccccccaccagccatggagaagtgcctggtgtttgaagatgccccaaatggagtggaggccgccctggccgccggcatgcaggtggtgatggtgcctgatggcaacctgagccgggacctgaccaccaaggccaccctggtgctgaacagcctgcaggacttccagcctgagctgtttggcctgcccagctatgaatag

SEQ ID NO: 39174 - DNA, 756 bp, Artificial Sequence
  Description of Artificial Sequence: Synthetic coding sequence
atggccgccccaccccagcctgtgacccacctgatctttgacatggatggcctgctgctgggctacacaggcagcatcgtggccgccgccagcggggagagcagccggggcctgcagagccgctggacagacacagagcggctgtacagcgtggtgttccaggagatctgcaacagatatgacaagaagtacagctgggatgtgaagagcctggtgatgggcaagaaggccctggaggccgcccagatcatcattgatgtgctgcagctgcccatgagcaaggaggagctggtggaggagagccagaccaagctgaaggaggtgttccccacagctgccctgatgcctggagctgagaagctgatcatccacctgaggaagcacggcatcccctttgccctggccaccagcagcggcagcgccagctttgacatgaagaccagccgccacaaggagttcttcagcctcttcagccacatcgtgctgggagatgatcctgaggtgcagcacggcaagccagaccctgacatcttcctggcctgtgccaagcgcttcagccccccaccagccatggagaagtgcctggtgtttgaagatgcccccaacggggtggaggccgccctggccgccggcatgcaggtggtgatggtgcctgatggcaacctgagccgggacctgaccaccaaggccaccctggtgctgaacagcctgcaggacttccagcctgagctgtttggcctgcccagctatgaatag

SEQ ID NO: 39175 - DNA, 627 bp, Artificial Sequence
  Description of Artificial Sequence: Synthetic coding sequence
atggccgccccaccccagcctgtgacccacctgatctttgacatggatggcctgctgctggacacagagcggctgtacagcgtggtgttccaggagatctgcaacagatatgacaagaagtacagctgggatgtgaagagcctggtgatgggcaagaaggccctggaggccgcccagatcatcattgatgtgctgcagctgcccatgagcaaggaggagctggtggaggagagccagaccaagctgaaggaggtgttccccacagctgccctgatgcctggagctgagaagctgatcatccacctgaggaagcacggcatcccctttgccctggccaccagcagcggcagcgccagctttgacatgaagaccagccgccacaaggagttcttcagcctcttcagccacatcgtgctgggagatgatcctgaggtgcagcacggcaagccagaccctgacatcttcctggcctgtgccaagcgcttcagccccccaccagccatggagaagagcagcatccaccggccccggctgctgacagcccagaagtgccagggctgccgggaccccttcagcgccctgctgctgctgtgcaaccagctgctgctgtgcagtgatgacacctag

SEQ ID NO: 39176 - DNA, 735 bp, Artificial Sequence
  Description of Artificial Sequence: Synthetic coding sequence
atggccgccccaccccagcctgtgacccacctgatctttgatggccgcaccagcagcggctgggtggtggccgccgccagcggccgcagctgtgtgggcgtgggcacagacacagagcggctgtacagcgtggtgttccaggagatctgcaacagatatgacaagaagtacagctgggatgtgaagagcctggtgatgggcaagaaggccctggaggccgcccagatcatcattgatgtgctgcagctgcccatgagcaaggaggagctggtggaggagagccagaccaagctgaaggaggtgttccccacagctgccctgatgcctggagctgagaagctgatcatccacctgaggaagcacggcatcccctttgccctggccaccagcagcggcagcgccagctttgacatgaagaccagccgccacaaggagttcttcagcctcttcagccacatcgtgctgggagatgatcctgaggtgcagcacggcaagccagaccctgacatcttcctggcctgtgccaagcgcttcagccccccaccagccatggagaagtgcctggtgtttgaagatgccccaaatggagtggaggccgccctggccgccggcatgcaggtggtgatggtgcctgatggcaacctgagccgggacctgaccaccaaggccaccctggtgctgaacagcctgcaggacttccagcctgagctgtttggcctgcccagctatgaatag

SEQ ID NO: 39177 - DNA, 558 bp, Artificial Sequence
  Description of Artificial Sequence: Synthetic coding sequence
atggccgccccaccccagcctgtgacccacctgatctttgacatggatggcctgctgctggacacagagcggctgtacagcgtggtgttccaggagatctgcaacagatatgacaagaagtacagctgggatgtgaagagcctggtgatgggcgctgagaagctgatcatccacctgaggaagcacggcatcccctttgccctggccaccagcagcggcagcgccagctttgacatgaagaccagccgccacaaggagttcttcagcctcttcagccacatcgtgctgggagatgatcctgaggtgcagcacggcaagccagaccctgacatcttcctggcctgtgccaagcgcttcagccccccaccagccatggagaagtgcctggtgtttgaagatgcccccaacggggtggaggccgccctggccgccggcatgcaggtggtgatggtgcctgatggcaacctgagccgggacctgaccaccaaggccaccctggtgctgaacagcctgcaggacttccagcctgagctgtttggcctgcccagctatgaatag

SEQ ID NO: 39178 - DNA, 780 bp, Artificial Sequence
  Description of Artificial Sequence: Synthetic coding sequence
atggccgcctgccgggccctgaaggctgtgctggtggacctgagcggcaccctgcacattgaagatgctgctgtgcctggggcccaggaggccctgaagaggctgcggggggccagcgtcatcatccgctttgtgaccaacaccaccaaggagagcaagcaggacctgctggagcggctgaggaagctggagtttgacatcagtgaagatgagatcttcaccagcctgacagctgcccggagcctgctggagaggaagcaggtgcggcccatgctgctggtggatgaccgggccctgcctgacttcaagggcatccagaccagtgaccccaatgctgtggtgatgggcctggcccctgagcacttccactaccagatcctgaaccaggccttccggctgctgctggatggagcccccctgattgccatccacaaggcccgctactacaagaggaaggatggcctggccctgggccctggcccctttgtgacagccctggagtatgccacagacaccaaggccaccgtggtgggcaagccagagaagaccttcttcctggaggccctgcggggcaccggctgtgagcctgaggaggccgtgatgattggagatgactgcagagatgatgtgggcggggcccaggatgtgggcatgctgggcatcctggtgaagacaggcaagtaccgggccagtgatgaggagaagatcaaccccccaccctacctgacctgtgagagcttcccccatgctgtggaccacatcctgcagcacctgctgtag

SEQ ID NO: 39179 - DNA, 132 bp, Artificial Sequence
  Description of Artificial Sequence: Synthetic coding sequence
atggccatccccatcaccgtgctggactgtgacctgctgctgtatggccggggccacaggaccctggaccgcttcaagctggatgatgtgacagatgagtacctgatgtccatgtatggcttccccaggtag

SEQ ID NO: 39180 - DNA, 255 bp, Artificial Sequence
  Description of Artificial Sequence: Synthetic coding sequence
atgaagcgggagcccaagaacctgagcagcgagcaggtgctgaagcccacctacagccagagcaagcccaaccgcatccggctgtactactggggcctgggcctgaacctgcgggccgccgccagcgaggccaacaggatggagagcaagaaggtgggcaagaggctgggcgctgggaagcagcagatgggcgctgagctgacagagcagcacatggcccgcatcagcctgcctgccaagatcctgggctactag

SEQ ID NO: 39181 - DNA, 180 bp, Artificial Sequence
  Description of Artificial Sequence: Synthetic coding sequence
atgcagacaggaggctgtgagcccaagcacaggaggatgtgcccagatgacagcagcgagaacatcatgaagtggaggaccttcctgcctgaggagaggacagtgacccaggccggagatgtgacccacaccctgggcagcaagggccccaaggccggcgtgcccttcaccggcccctag

SEQ ID NO: 39182 - DNA, 369 bp, Artificial Sequence
  Description of Artificial Sequence: Synthetic coding sequence
atggtggtggtggagaagggggccagcctgatgagccgggccagcctgatgcctgcccaggcccgggcccccttccagaggctgcgggactgccggggccctgctgacagcagccacgccttcaagctgcagtgcttccccagccactgcagaagaccaccctgggtgatcagcaggaagggccgggccatcaacaagtacagcatctgcatcagctgtgtggccctgcacctggagatctccttcatctggcagctgctgcagaatgagcccaacctggagggcggcctgggccgcttcatgctggccagcctgagcctgcagcaggtgatcagcatcctggccttcaccagggtgaagcagctgtag

SEQ ID NO: 39183 - DNA, 183 bp, Artificial Sequence
  Description of Artificial Sequence: Synthetic coding sequence
atggccctgccctgtggcatgggcacagcctggtacctggacagcacagaaaatgccctgactgtgaatgtgccccgggcccagaaccacaaggccagccacaacagcatgtggaagctgggcagccacttctactgcatcctgctggtgaccaaggaccccccaggcttcaccatggtgtag

SEQ ID NO: 39184 - DNA, 393 bp, Artificial Sequence
  Description of Artificial Sequence: Synthetic coding sequence
atgagcctgtgcagcctgctgagccccaggagcggcttccgctgctgctgtgccgcccctcctcctccagcccagccccaccaggaggcccagggcggcctggtggagctgctgatgcatgctgctgccaggaagaccctcttcaacttccccccagcccccagccgggccagccctggccaccgggtggcctgccagcctgaccgggccaggaagagcggctcctgggccgtggcccagaggcggcgggagcaggaggaggccggggcccgggccggggctgtggaccccctgggcctgcccctggtgagcagcatcagctgtgtgcagcactgcaacctggccgccggcgtgcagacaggccggcccccagccagcagcacagactgctag

SEQ ID NO: 39185 - DNA, 162 bp, Artificial Sequence
  Description of Artificial Sequence: Synthetic coding sequence
gccacccaggacctgcagttccgcatccggcggccccggcccccagcccggggccggggcggggagaccaggagctgtgacctgggccgctgccacctgaagggcctggacctgctggaggccaggacagctgaggaggatggagagagaaatgccaggtag

SEQ ID NO: 39186 - DNA, 414 bp, Artificial Sequence
  Description of Artificial Sequence: Synthetic coding sequence
atgttccacttcttcaggaagcccccagagagcaagaagcccagcgtgcctgagacagaagcagatggctttgtgctgctgggggacaccacagatgagcagaggatgacagcccggggcaagaccagtgacatcgaggccaaccagcccctggagaccaacaaggagaacagcagctctgtgacagtgtctgaccctgagatggagaacaaggccggccagaccctggagaacagcagcctgatggccgagctgctgagtgatgtgcccttcaccctggccccccacgtgctggccgtgcagggcaccatcacagacctgcctgaccacctgctgtcctatgatggcagcgagaacctgagccgcttctggtatgacttcaccctggagaacagcgtgctgtgtgacagctag

SEQ ID NO: 39187 - DNA, 876 bp, Artificial Sequence
  Description of Artificial Sequence: Synthetic coding sequence
atgcctgggaagctgctgcctgagaagtgtgccctgatgtggctgcacctgggcacccgggccccccagaggcccaagcgggagagccggggcttccctggctggggctgcaggacaggccaggccctgccctgccgggcccggcccccagccccagcccccagccaccccagcagcagcctgagcctgaccccaggccctggcagcccccggcagacaggccccccctgccagacagtggccgccctgtatggcctgggcgcctggcagagccactgcggcggcggcgtgggctgccacggccagggccggcagcccctgggctgccagggctggtggagcaccctgaacccctacctgctggagagccctggcctcttccacaccaggagctgtgggaagctgtgggaccccaaggctgtgctgatcagcggcgtgaccagcagccacagcagcctgggcagccctggcaccaggcctggggtgtccctgtgcaaggagctgcccggctgctgggccgagctgtgctgccggcccaggaagatgaccaagaaggacagagctgagccccacctgcccctgctgggcggccctgagggcgcccgggcccagcagagccccatcctgcacagcctgggcagcaagaggctgccccgctgtggctggcagctgctgaccagcagcggcggggccgccggcggcctgtgccccatgggccacagaagagagaaggatggcggccgggtgtgcaccctgggccgcactggaggccgccacaggcctgagcaggtggcctgggcccacgagaagggcgtgtctgaaacaggctgcctgagccagatgcctggggtggatgaagcagatgagtggcagtag

SEQ ID NO: 39188 - DNA, 234 bp, Artificial Sequence
  Description of Artificial Sequence: Synthetic coding sequence
atgaaggcccctggcctggcccaggccgctgtggccgaggagaccccagactgggcccctgagctgtgccccagcagcgaggcccggagccctgagcccccagccaaccggctgcaggactttgacaccctggtgacagtgggcaagcagctggaggccatctgtgtgaagaagaatgtggacctgctggccaggatgcagaggcgggagcggctgctgatccgctgctggtag

SEQ ID NO: 39189 - DNA, 414 bp, Artificial Sequence
  Description of Artificial Sequence: Synthetic coding sequence
atgaccagccccctggtgtttgccagcctgagcccagatgccatggccaagatgctggagatggccgccctgaatgtgggcaccatccgcatcagcctgaacacagagcccaggcctcctgtgatcacccagctggcccccagccctgagaccctgcccttctgcccagagtggggcgctgagaaccagagccgccacctgaagctgccccccttcttcatctgccgctgccggggccccctgtaccaggaggagagcctgtctgagatccactgccacagcggcctcttcctggaccagctgagcctgcccacccccttcagcagcctgtctgtgtccctcatccactggaccttcatcagcaccaagtatgtgcccggcatcatgctggccttcggcggcaccaacaagtag

SEQ ID NO: 39190 - DNA, 141 bp, Artificial Sequence
  Description of Artificial Sequence: Synthetic coding sequence
cgggagggccatgctgatggcaacatcccagctggccctggcctgtgcagcccccagctgctgctgcccggcggccagctgttctgggcccctgaggtgctgcggagccccttccctggccctggcaccccatctgcctag

SEQ ID NO: 39191 - DNA, 444 bp, Artificial Sequence
  Description of Artificial Sequence: Synthetic coding sequence
atgggcctgctgagcctcatcctcttcctgggcgccaaggtgaccacagccaacaagacagacagcttcctgttcagcacaggcctgactgtgctgagcagccctggcctgaagatgagggtgctgggctgcccccccaccccaccccagctgacccagggccacaccagcggctacgtggacctgcacaagggccccttcctgagccccatgaggcacccccggggccacacaggcccccagatcctgccccaggcctgggagcccatcggccggcgggtgcggcagtgccggggcccccagaccttcctgaagggccctgagagcaagtacttccggctgtgcaggccagatgtgctgtgctgcaagacccagttctgctactgcagcagcaaggccgccatcgacaacagcgaggtgaatgaatgtgtggtgtcccagtag

SEQ ID NO: 39192 - DNA, 84 bp, Artificial Sequence
  Description of Artificial Sequence: Synthetic coding sequence
gacatcctgcagcacaaccaccctgtggtgggcctgctgcaggtgggcagcgagcacggcagcgaggaggccgccctgtcctag

SEQ ID NO: 39193 - DNA, 555 bp, Artificial Sequence
  Description of Artificial Sequence: Synthetic coding sequence
atgcctgtgaagggggccagcagcctgctcttcctgcccctgcccccatctgcctggcagctgtgcctgctgagcaagagaagagtgcaccccatccgcacccccctgcccttccacagctggatcaaggccctggtgatcagcaaccagaaggtgcctgagcgggagaggcctgagggcactggagtgctgagtgatggctgcctgggccagagccaggagggggagcccctgctgagccccccagccctggcccacttccccctgcacgcccgctgctgcggcagctcctgggcctggccaggcagcgctggggaggccatccgcatggtgtctggggcccccttcctgtgcttcctggatggcctggatggcctgccctgcagcagccccatggccgccctgcctgcccccatggccgccctgcctgcccggcggcagaggcaggagcacatcgagggcggcagccagggctgcggcgtgcgcagccctgccccctgccggggcaagccaggcagcgccaccagcagcaccctgcggctgtgcccagcctag

SEQ ID NO: 39194 - DNA, 417 bp, Artificial Sequence
  Description of Artificial Sequence: Synthetic coding sequence
atgctggagaagtggagggagacagaggaggcccggggcctgctgaccaggacccagcccacagccagcggccccccctgcagccacgcccacagccagctgctgctggaccggctgaagggcaacctggccaggagaggaggagtgggccgggccagcctggagaccgtgctgtggaggcctggagaaacagccttctacccccagcactggggcgagcaggccagcatcccagcctttgcctgccggcccagcagcttccccctgaaggcctacccagctgccccagccctgagaaatgccctgctgagctaccagctgtgggagcggcaggaccggctggccagcggccggcggggccgccactgcctgcccagcggccctggcccccaccgctacccccagctgcaggactag

SEQ ID NO: 39195 - DNA, 429 bp, Artificial Sequence
  Description of Artificial Sequence: Synthetic coding sequence
atgggcctgtaccacgtgggccaggccggcctggagctgctgaccagcagtgacccccccaccagcgccagccagaatgctgagatcaccggggtgagccaccgggcccagagcaaggcccacaacctgcagaggaagctgcggctgagccacaagagcagccccccctgcacctacacccagcacgccggcggcgtggacagccaccccctgacccaggacatgtgtgtgattgtgaatgtcatcgcccggccctttgacaagtgcaactgtgacatctacctgggcctggccagcgagctgtttgtggtgtcctgggtgcagctgactgtgccctaccactggatccagaccctgggcaatgtcatcctcttctgcctggacacagcccaccggggccactgtgacattgctggccactgcacctag

SEQ ID NO: 39196 - DNA, 303 bp, Artificial Sequence
  Description of Artificial Sequence: Synthetic coding sequence
atgaggcccaagcacctgcagggcatcgcccctgaggtgttccgcacccccaccggcagccacggccagatgcctggccagcccctgcagaggggccacgccctggacatccggccccccctgcggccccaccccctcatcagcggccacgccctgcggggggaccgctggcagaccccagccctggccctgggccctgccctgtgtggctttgtgcctgcccactgggtgctgactgtgcccccaccccagaggcccagcatccccagccgctctgctgacacctgcccagccagcaggtag

SEQ ID NO: 39197 - DNA, 246 bp, Artificial Sequence
  Description of Artificial Sequence: Synthetic coding sequence
atggtgttcctgaactacaagtgcaccacccccctcatcctgctgctgcccagccagatccccaggagctacaagcaggactggctgctgtactgcagcaagctgatcagcctggcctaccacgccttcctgatcttcatgcccagcctgatgatgttcagcctgctggagatctaccacatcctgctgccccagctgctgctgcaggtgaacttcctgctgaaggccgagccagaccagatctag

SEQ ID NO: 39198 - DNA, 435 bp, Artificial Sequence
  Description of Artificial Sequence: Synthetic coding sequence
atgaaggtgagcagcctgacccggcagcagaggcctccccagggcacagaggccggcacccggggcggcggccctggccgcctgagccctgagcgctgccgcctgctggacagccccctgcagctgcagggccctgccagcctgccccagcccggcggccgggagagagctgtggccaccccaccccaggccacccggcggggcggcagcgagaggacccgggacagcctgctgggcgctgtgggccccagcggggccaagaggcccttcttcagcagcgccctgcccaagggctgccggcgggtgggcgccacctggggcccccggcagaggggctggggcaatgccactggaggccctggagagggcgcccggcgcagcaggccagacccccaggccctcttctggcacgccccccacctgcgggcccagtag

SEQ ID NO: 39199 - DNA, 318 bp, Artificial Sequence
  Description of Artificial Sequence: Synthetic coding sequence
atggcccactgcagcctggacctgagcggcagcggggacccccccaccagcaccagccaggtggcccggaccatcggggcctgccaccacgtgcagctgatctttgtgttcttcggggagaccggcttccaccacgtggcccccctggtgctggagctgctggacagcagtgacccccccaccctggccagccagagcggcggcaacagacatgagcccccccaccgggccctgaagcacatcttcctgaagcacatctggctgttctccttctacttccaccagaatggccacgaggagaccatggaccagatctag

SEQ ID NO: 39200 - DNA, 396 bp, Artificial Sequence
  Description of Artificial Sequence: Synthetic coding sequence
atgcccttctggaggctggacaagctgagccctggaggagtgaagaggctgcgggtgacccagcctgccaccggcaccggggtggtgcgcagccagtgccagaagtgggtgaaggagctgggcaatgtgccccggctggccgccaggaagccaggcctgggcgtgcccggcagcagtggagctgtgaagaggcagggccagaagtgggtgaaggagctgggcaacatcccccggctggccgtgggccgggaccagggcctgggcagcctggaccccggcagcgccacagagctgctgtgtgactgcagcgtgcccctgctgcccctgagcggcggctacaggaaggcagatgtggcccaccacccagcctgtgccatcgtgtggctgcactactag

SEQ ID NO: 39201 - DNA, 444 bp, Artificial Sequence
  Description of Artificial Sequence: Synthetic coding sequence
atggtgacaggcccctgcctgacctgtgtgagcagcctcatcgagcgggccagccccaaccaccccaccaacaagggcctgaccctgctgccctggctggagtgcagcggccccatcatcgcccactgcagcctggacttccctgcctctgtggacccccccaccctcatcagccgggtggccggcacagctggcctgctgatcctgcgcttcagcagcgccagcgccaaccctgagacagcccggcccatcccccccctgccctgccccccaccccggctgctgcacatgaagaccaccaggatgaagaccttcatgatgatccacttccacctgatgaacaagctgcaggagatcatccaggaggagagacatggaggcatgctggagagcctgctgagcctgaaggtgggcaaccctggcagctgcagctgcagccactag

SEQ ID NO: 39202 - DNA, 204 bp, Artificial Sequence
  Description of Artificial Sequence: Synthetic coding sequence
atgttccacctgtgcaagctgaaccccagctacctgaagatcacctgtgggaagaggagcaagcagatcacccccacctactaccccagccggctgccccctgtgaagaggaagttctctgtgtatgatgccaagctgaccatcgtgcacctgagcaccttcagcattgaggacttccccctgtacctgtccatggccggctag

SEQ ID NO: 39203 - DNA, 423 bp, Artificial Sequence
  Description of Artificial Sequence: Synthetic coding sequence
atgggcagcgaggccgcccagctgctggaggccgctgactttgctgccaggaagcaccggcagcagaggaggaaggaccctgagggcaccccctacatcaaccaccccatcggcgtggcccgcatcctgacccatgaagctggcatcacagacatcgtggtgctgcaggccgccctgctgcatgacacagtggaggacacagacaccaccctggatgaggtggagctgcactttggagcccaggtgcggcggctggtggaggaggtgacagatgacaagaccctgcccaagctggagaggaagaggctgcaggtggagcaggccccccacagcagccctggggccaagctggtgaagctggccgacaagctgtacaacctgcgggacctgaaccgctgcaccccagaggtgaagatccagtag

SEQ ID NO: 39204 - DNA, 540 bp, Artificial Sequence
  Description of Artificial Sequence: Synthetic coding sequence
atgggcagcgaggccgcccagctgctggaggccgctgactttgctgccaggaagcaccggcagcagaggaggaaggaccctgagggcaccccctacatcaaccaccccatcggcgtggcccgcatcctgacccatgaagctggcatcacagacatcgtggtgctgcaggccgccctgctgcatgacacagtggaggacacagacaccaccctggatgaggtggagctgcactttggagcccaggtgcggcggctggtggaggaggtgacagatgacaagaccctgcccaagctggagaggaagaggctgcaggtggagcaggccccccacagcagccctggggccaagctggtgaagctggccgacaagctgtacaacctgcgggacctgaaccgctgcaccccagagggctggagcgagcaccgggtgcaggagtactttgagtgggccgcccaggtggtgaagggcctgcagggcaccaaccggcagctggaggaggccctgaagcacctgttcaagcagaggggcctgaccatctag

SEQ ID NO: 39205 - DNA, 1632 bp, Artificial Sequence
  Description of Artificial Sequence: Synthetic coding sequence
atgcccaaccccaagaacagcaagggcggcaggaagaacaagagggccaacagcagtggagatgagcaggagaatggagctggggccctggccgctgctggagctgctggagctgctgctgggggcgccctggccgctgctgctggctgtggggctgctgctgctggggcccctggggccggcggggccgccggggccggcggggccggcactggagctgccaatgctgctgctgctgctggagctgctgctgctggagatgccaagaatgaggccccctgtgccacccccctcatctgcagctttggccggcctgtggacctggagaaggatgactaccagaaggtggtgtgcaacaatgagcactgcccctgcagcacctggatgcacctgcagtgcttctatgagtgggagagcagcatcctggtgcagttcaactgcatcggccgggcccgctcctggaatgagaagcagtgccggcagaacatgtggaccaagaagggctatgacctggccttccgcttctgcagctgccgctgtggccagggccacctgaagaaggacacagactggtaccaggtgaagaggatgcaggatgagaagaagaagaagagcggcagcgagaagaacacaggccggcccccaggagaggccgctgaggaggccaagaagtgcaggcctcccaacaagccccagaagggccccagccatgacctgcccaggaggcacagcatggaccggcagaacagccaggagaaggctgtgggcgccgccgcctacggggcccggagccctgggggcagccctggccagagccccccaacaggctacagcatcctgagccctgcccacttcagcggccccaggagcagccgctacctgggggagttcctgaagaatgccatccacctggagccccacaagaaggccatggccggcggccacgtgttcagaaatgcccactttgactacagccctgctggcctggccgtgcaccggggcggccactttgacacccctgtgcagttcctgcggcggctggacctgtctgagctgctgacccacatccccaggcacaagctgaacaccttccacgtgaggatggaggatgatgcccaggtgggccagggcgaggacctgaggaagttcatcctggccgccctgagcgccagccacagaaatgtggtgaactgtgccctgtgccaccgggccctgcctgtgtttgagcagttccccctggtggatggcaccctcttcctgagccccagcagacatgatgaaattgaatatgatgtgccctgccacctgcagggccgcctgatgcacctgtatgctgtgtgtgtggactgcctggagggcgtgcacaagatcatctgcatcaagtgcaagagccgctgggatggctcctggcaccagctgggcaccatgtacacctatgacatcctggccgccagcccctgctgccaggcccggctgaactgcaagcactgcggcaagcctgtgattgatgtgcgcatcggcatgcagtacttcagcgagtacagcaatgtgcagcagtgcccccactgcggcaacctggactaccactttgtgaagcccttcagcagcttcaaggtgctggaggcctactag

SEQ ID NO: 39206 - DNA, 2568 bp, Artificial Sequence
  Description of Artificial Sequence: Synthetic coding sequence
atggccgccctgggcgtggccgaggccgtggccgccccccaccctgctgagggcgctgagacagctgaggccgtggagctgagccgggccctgagccggctgctgcccggcctggaggccgacagcaagccaggaagaagaagagccctggaggccctgcggcgggccctggaggagcccggccctgctgctgaccccacagccttccagggcccctgggcccggctgctgctgccccggctgctgcgctgcctgagtgaccctgctgagggctgccgggccctggccgtgcacctgctggacctgggcctgcggcgggccgcccggcccagagatgccctgccccggctgctgcctgccctggccgcccggctggccggccctgtgcctgcccggcggcccccagaggcctgtgaggagctgcggctggccctggtgcagctgctgggcctggccgtggacctgtgtggggccgccctggccccccacctggatgatgccctgcgggccctgcgctgcagcctgctggacccctttgctgctgtgagaagagagagctgcagctgtgccgccgccctggcccaggccaccccagaccacttccacatgcagagcgagagcctgattggccccctgatgcagaccatcagccaccagcactggaaggtgcgggtggccgccatcgaggccactggagctgtgatccactttggaaatggcaagtctgtggatgatgtgctgagccactttgcccagaggctgtttgatgatgtgccccaggtgcggcgggctgtggcctctgtggtgggcggctggctgctgtgcctgcgggaccgctacagcttcttccacaagctgatccccctgctgctgagcagcctgaatgatgaggtgcctgaggtgcggcagctggccgccagcctgtgggaggatgtgggcctgcagtggcagaaggaaaatgaggaggacctgaaggacaagctggactttgccccacccaccccaccccactacccacctcatgaaagaagacctgtgctgggctgccgggagctggtgttcaggaacctgagcaagatcctgcctgccctgtgccacgacatcacagactgggtggtgggcaccagggtgaagagcgcccagctgctgcctgtgctgctgctgcacgcagaagatcatgccacccagcacctggaggtggtgctgcggaccctcttccaggcctgcacagatgaggaggccgctgtggtgcagagctgcaccaggtctgctgagctggtgggcacctttgtgtccccagaggtgttcctgaagctgatcctgagcaccctgaagaagaccccatctgccagcggcctgctggtgctggccagcgccatgaggggctgcccccgggaggccctgcagccccacctggccgccatcgccacagagctggcccaggcccacatctgccaggcctctgaaaatgacctgtacctggagcggctgctgctgtgtgtgcaggccctggtgtctgtgtgccacgaggactgtggggtggccagcctgcagctgctggatgtgctgctgaccatcgtggccctggccggggccaccggcctgcgggacaaggcccaggagaccatggacagcctggccatggtggagggcgtgagcagctgccaggacctgtacaggaagcacatcggccccctgctggagcgggtgacagccagccacctggactggacagcccacagccctgagctgctgcagttcagcgtcatcgtggcccagagcggccctgccctgggggaggccctgccccacgtggtgcccaccctgcgggcctgcctgcagcccagccaggacccccagatgaggctgaagctgttcagcatcctgagcacagtgctgctgcgggccacagacaccatcaacagccagggccagttccccagctacctggagaccgtgaccaaggacatcctggcccccaacctgcagtggcacgccggccgcacagctgctgccatcagaacagctgctgtgtcctgcctgtgggccctgaccagcagcgaggtgctgtctgctgagcagatcagagatgtgcaggagaccctgatgccccaggtgctgaccaccctggaggaggacagcaagatgaccaggctcatcagctgccgcatcatcaacaccttcctgaagaccagcggcggcatgacagatcctgagaagctgatccgcatctacccagagctgctgaagaggctggatgatgtgtccaatgatgtgaggatggctgctgccagcaccctggtgacctggctgcagtgtgtgaagggggccaatgccaagagctactaccagagctctgtgcagtacctgtaccgggagctgctggtgcacctggatgatcctgagcgggccatccaggatgccatcctggaggtgctgaaggagggcagcggcctcttcccagacctgctggtgcgggagacagaggccgtcatccacaagcacaggtctgccacctactgtgagcagctgctgcagcacgtgcaggccgtgcctgccacccagtag

SEQ ID NO: 39207 - DNA, 2532 bp, Artificial Sequence
  Description of Artificial Sequence: Synthetic coding sequence
atggccgccctgggcgtggccgaggccgtggccgccccccaccctgctgagggcgctgagacagctgaggccgtggagctgagccgggccctgagccggctgctgcccggcctggaggccgacagcaagccaggaagaagaagagccctggaggccctgcggcgggccctggaggagcccggccctgctgctgaccccacagccttccagggcccctgggcccggctgctgctgccccggctgctgcgctgcctgagtgaccctgctgagggctgccgggccctggccgtgcacctgctggacctgggcctgcggcgggccgcccggcccagagatgccctgccccggctgctgcctgccctggccgcccggctggccggccctgtgcctgcccggcggcccccagaggcctgtgaggagctgcggctggccctggtgcagctgctgggcctggccgtggacctgtgtggggccgccctggccccccacctggatgatgccctgcgggccctgcgctgcagcctgctggacccctttgctgctgtgagaagagagagctgcagctgtgccgccgccctggcccaggccaccccagaccacttccacatgcagagcgagagcctgattggccccctgatgcagaccatcagccaccagcactggaaggtgcgggtggccgccatcgaggccactggagctgtgatccactttggaaatggcaagtctgtggatgatgtgctgagccactttgcccagaggctgtttgatgatgtgccccaggtgcggcgggctgtggcctctgtggtgggcggctggctgctgtgcctgcgggaccgctacagcttcttccacaagctgatccccctgctgctgagcagcctgaatgatgaggtgcctgaggtgcggcagctggccgccagcctgtgggaggatgtgggcctgcagtggcagaaggaaaatgaggaggacctgaaggacaagctggactttgccccacccaccccaccccactacccacctcatgaaagaagacctgtgctgggctgccgggagctggtgttcaggaacctgagcaagatcctgcctgccctgtgccacgacatcacagactgggtggtgggcaccagggtgaagagcgcccagctgctgcctgtgctgctgctgcacgcagaagatcatgccacccagcacctggaggtggtgctgcggaccctcttccaggcctgcacagatgaggaggccgctgtggtgcagagctgcaccaggtctgctgagctggtgggcacctttgtgtccccagaggtgttcctgaagctgatcctgagcaccctgaagaagaccccatctgccagcggcctgctggtgctggccagcgccatgaggggctgcccccgggaggccctgcagccccacctggccgccatcgccacagagctggcccaggcccacatctgccaggcctctgaaaatgacctgtacctggagcggctgctgctgtgtgtgcaggccctggtgtctgtgtgccacgaggactgtggggtggccagcctgcagctgctggatgtgctgctgaccatcgtggccctggccggggccaccggcctgcgggacaaggcccaggagaccatggacagcctggccatggtggagggcgtgagcagctgccaggacctgtacaggaagcacatcggccccctgctggagcgggtgacagccagccacctggactggacagcccacagccctgagctgctgcagttcagcgtcatcgtggcccagagcggccctgccctgggggaggccctgccccacgtggtgcccaccctgcgggcctgcctgcagcccagccaggacccccagatgaggctgaagctgttcagcatcctgagcacagtgctgctgcgggccacagacaccatcaacagccagggccagttccccagctacctggagaccgtgaccaaggacatcctggcccccaacctgcagtggcacgccggccgcacagctgctgccatcagaacagctgctgtgtcctgcctgtgggccctgaccagcagcgaggtgctgtctgctgagcagatcagagatgtgcaggagaccctgatgccccaggtgctgaccaccctggaggaggacagcaagatgaccaggctcatcagctgccgcatcatcaacaccttcctgaagaccagcggcggcatgacagatcctgagaagctgatccgcatctacccagagctgctgaagaggctggatgatgtgtccaatgatgtgaggatggctgctgccagcaccctggtgacctggctgcagtgtgtgaagggggccaatgccaagagctactaccagagctctgtgcagtacctgtaccgggagctgctggtgcacctggatgatcctgagcgggccatccaggatgccatcctggatgtgcccggcagccccagccccagcgccatgattggcagcttcctgcggcccccccacccctggaggacagtgtcccagctgaacctcttcagcagctag

SEQ ID NO: 39208 - DNA, 1806 bp, Artificial Sequence
  Description of Artificial Sequence: Synthetic coding sequence
atggacagcttcagcgaggtgcggcgggctgtggcctctgtggtgggcggctggctgctgtgcctgcgggaccgctacagcttcttccacaagctgatccccctgctgctgagcagcctgaatgatgaggtgcctgaggtgcggcagctggccgccagcctgtgggaggatgtgggcctgcagtggcagaaggaaaatgaggaggacctgaaggacaagctggactttgccccacccaccccaccccactacccacctcatgaaagaagacctgtgctgggctgccgggagctggtgttcaggaacctgagcaagatcctgcctgccctgtgccacgacatcacagactgggtggtgggcaccagggtgaagagcgcccagctgctgcctgtgctgctgctgcacgcagaagatcatgccacccagcacctggaggtggtgctgcggaccctcttccaggcctgcacagatgaggaggccgctgtggtgcagagctgcaccaggtctgctgagctggtgggcacctttgtgtccccagaggtgttcctgaagctgatcctgagcaccctgaagaagaccccatctgccagcggcctgctggtgctggccagcgccatgaggggctgcccccgggaggccctgcagccccacctggccgccatcgccacagagctggcccaggcccacatctgccaggcctctgaaaatgacctgtacctggagcggctgctgctgtgtgtgcaggccctggtgtctgtgtgccacgaggactgtggggtggccagcctgcagctgctggatgtgctgctgaccatcgtggccctggccggggccaccggcctgcgggacaaggcccaggagaccatggacagcctggccatggtggagggcgtgagcagctgccaggacctgtacaggaagcacatcggccccctgctggagcgggtgacagccagccacctggactggacagcccacagccctgagctgctgcagttcagcgtcatcgtggcccagagcggccctgccctgggggaggccctgccccacgtggtgcccaccctgcgggcctgcctgcagcccagccaggacccccagatgaggctgaagctgttcagcatcctgagcacagtgctgctgcgggccacagacaccatcaacagccagggccagttccccagctacctggagaccgtgaccaaggacatcctggcccccaacctgcagtggcacgccggccgcacagctgctgccatcagaacagctgctgtgtcctgcctgtgggccctgaccagcagcgaggtgctgtctgctgagcagatcagagatgtgcaggagaccctgatgccccaggtgctgaccaccctggaggaggacagcaagatgaccaggctcatcagctgccgcatcatcaacaccttcctgaagaccagcggcggcatgacagatcctgagaagctgatccgcatctacccagagctgctgaagaggctggatgatgtgtccaatgatgtgaggatggctgctgccagcaccctggtgacctggctgcagtgtgtgaagggggccaatgccaagagctactaccagagctctgtgcagtacctgtaccgggagctgctggtgcacctggatgatcctgagcgggccatccaggatgccatcctggaggtgctgaaggagggcagcggcctcttcccagacctgctggtgcgggagacagaggccgtcatccacaagcacaggtctgccacctactgtgagcagctgctgcagcacgtgcaggccgtgcctgccacccagtag

SEQ ID NO: 39209 - DNA, 2043 bp, Artificial Sequence
  Description of Artificial Sequence: Synthetic coding sequence
atgggcaagagcaggaccaagcgcttcaagaggccccagttcagccccactggagactgccaggccgaggccgctgctgctgccaatggaactggaggagaagaagatgatggccctgctgctgagctgctggagaagctgcagcaccccagcgctgaggtgcgggagtgtgcctgtgccggcctggcccggctggtgcagcagaggcctgccctgcccggcctggccaggagagatgctgtgcggcggctgggccccctgctgctggaccccagcctggccgtgcgggagacagctgctggggccctgaggaacctgagcgcctgtggcggctttgaggtgtgtgatgacatggtgaccaaggacatcatgacccccctggtggccctgctgaaggaatgttctgctggcctggacagcaatgagatgagcctgcaggagaagaaggaccagaacagaaattccattgaaaatattgccaatgaaacagtgaatgtgctgtggaacatctgtgagtgcagcagcagagctgtgtccatcttcaacaaggagggctgcctggagatcgtgctgaagtacctgagccgcttccccaccaacgtggacctggccatctctgtggcctactgcctgcagacagtgacagaggacaaccctgagctgctgaagagcttcagcgccacagccctgaacatgctggagagcgccctgctgagccctgtgtcctccatggagagcctgctgctgaagaccctggtggccggcaccatctggaacctgaaggacatcatcccctgcaagagccaggccgagatcatcaatgccctgctgaagatcctgtctgaggtgctgggcatggatgctggggagatggtgatccagatgaaggaggccgagacccagaggctgaagacagctgctgaggccgaggagatcctggagaacaccaatggagatgacctgattgaagatgatgagatggagggcatcagccacaagagaagagtgcggaggaagacctttgtgtctgacctgctgcccccaacagacaaggagctgcgggagaccatcgccctgctgacagcccagcagacagccctggagatcatcgtgaacatgtgctgcaatgaagaccccagtgatgatgagtgggaggagctgagcagcagtgatgaaagtgatgccttcatggagaacagcttctctgaatgtggcggccagctgttcagccccctgtgcctgagccatgaggtgcacacagccctgaccaactacctgatccccaagaagatctttgagaagacagccttccccaacagcattgctgtggacctgtgcagcaggaaccccacctggaagcccctcatcaggaagatgaacaccatccagtgccgggccctcttctgcctgcagagcctggtgtccctgctggatgtggagcacctgggcggggccgccgccctgcagaccctggcccagcacctgagccagctgctcttcagccagcctgactttgccaagcacgtggacttcctggaggccatcagcagcgccctgcgggccctgctgcagaccatggccagcaagaacatcagccagtgcatgaccccagaccagctgatgaccctgtgcaaggccggcatccacagcagcaatgtgggcgtgcgggtgaatgtggtgtccatcctgggcatcaccggctctgtgctggccaaggaggatggcaccctggagaccctgaagaacatcggctgcttcctgctggaggtgaccaccaaggaccccagcctggtggtggccggggaggccctggatgccctgtttgatgtgtttgctgatggcaaggaggccgagcgggccagcatccagatcaagctgctgagcgccctgaaggagttccagcctgtgttcaagatgaagatcaggaaggagggccggggcaactacagcacagaccagctgtgtgtgctggacaacgtgaagatgaacctgcggcgcttcatcgcctaccaggagaccgtggagaagaggctgaccagctag

SEQ ID NO: 39210 - DNA, 3081 bp, Artificial Sequence
  Description of Artificial Sequence: Synthetic coding sequence
atgaccaggacccagaagggcaagaccttcctgccccactgcttctaccagagcctgcccccccggctgggctggggcatgatcctgaactacagcaagctgaagggcaaggaggagtgtgcctctgtgtcctctgtgcccatggtgttcttcagcagccagtaccgcctgcacaggaagagccagtacctgaagatggccgccgccaacctgaccttcagccaggaggtggtgtggcagaggggcctgcccagcatcccctacagccagtacagctttgaccacctgtacaacaccaatgacatcatccacaccccccagatcaggaaggcccggccccagaagcctgtgtccttcaagttcctgggcagcagcagccccctgactggagacaccagcctggccgtgaagacagagagcagcgccaaccctgagaagaagctgaagaagagcaagccagccagcacagtgcgggaggccccccggcccctcatccaccacccctgcatgcacccagacatgctgggccggccccccagcctggatgtgaacctggaggagcgggaggcctggctgctgcccccagagaaggaggcccgggcctgggaggccaccgtgctggagaagctgaatgaaagaacagcccgctggatccagagcaagaggccccggcggcctggggccagccccaacaagtggcagagcttcctgcggcagcagtatgactggagccacatcagagatgagctgaccagcgccagtgacctggagctgctgaagcagctggaggccgaggagacagctgagtttgaggaccagagcgtcatcctgcccccccaggagaagaagaagccagagctgctgctgcctgtgtactaccgcctgcccagctacttccagcaggccgagaccgtggagatcatgcctggcaacaagagcacagaggacatccacgagaagaccagcctgagccagccccagacccagagctacttccggcaggtgacccccagggctgggaagtttgcctacagcacagacaacacctttgagcaggagatctactttgatgaggtgcagatcatccaccagattggagccaagagggaccagatcgtgctggagaacctgaaccgctacaacaagcagctgagcaaggtgtttcctgagaccccagagaagtggagcgcccaggccatccctgaggccagctacagacctgtgcagggcgccctgcgctggacagccctgcccaccccagccaaggacatgctgctgcaggtgggggagaaggatgtgcccatcaagacccggcggctgaagaagcaggccaagagcctgcaggaggatgtgacctgggagctggtggtgctgcggaggatgctgaaggagtggaagacagcctgggccctgatcatcgagtggcaccatgaaacagtggagaacctgctgcagagcctgggggacctgcatgatgatgtgcgcatcaaggccatcaccacctgtgccacagctgccctggagcggccccgcatcgccaccagccagagggacagcgacaagaccatccaggacctgcctgaggtgctgctgcctgccctggaggccgccctgtgtgacaagaatgcccacgtgaggatggctgctgccatctgccagtatgccatccagagccacaaccccctggccaggaacatcatgcagacagccctgctgaagggcaacagcgtggacagctgggccgccgcccagtgcctggccctggagggcacagccacctaccctgtgatcaagaggatcctgcaccagctgttcaccaagaagaatgaagacacagaggagcagagctacatcctgctgagctacctgtctgagaagaccaccctcatccacaccatgctggccgtggagctgaacagctgccagtggaagaacagaattgtggcctgccaggccttcagccgcatctctggaaatgtgtgcctggacatgaagcacaagctgatccagctgatgtggaatgactggaacaaggaggtgagaagagctgctgcccaggccctgggccagatgagcctgggcaaggaggtgcatgacatcatccgggtgaagctgggccagggcaacagccaggagcgggtggaggccctgtacctgattggagagctgaagctgatgacagccaagctgctgcccagcttcctgcactgcttcagtgatgacttcaccgctgtgcggcgggccgcctgcctggccgccggggccctgcagatccgggacaagatggtgctggagtgcctgctgaacctgatgcagagggacccctactggaagatcaaggcctttgccatccgggccctgggccagatcggccaggtgtccccagagctgacagacctgctgctgtgggccatccactatgaggagagccctggggtgcggctggaggcctgccgcagcatcctggccctgaagctgcagggcgacagagtgcgggacaccttcctggatgtgctgctgctggagaaccatgatgctgtgctgaaggagatgtaccagaccatgaagatcctgaacctgggcaatgaaggcaaccaggagatgctgcaggagatcaagaaccgcatcaagaccctgagccagaaggacctgctgacccacaagatcctgaagctggagatggtgatgggcaaggtgcgggaggaggccaagagggtgtacctgaagcccaagggggagcagggccccctgaccctgcagaccctgctgcaggagaccttccaggatgagatggtgctgccccggcggcccagcgaggtgtgtgacacagaagctgtgatcaagcctgtgaagccccgggcccccaacccctggctgcagagctctgtgcccggcctgaccaccaggagcaaggtgcgcagcagcctggtgaaggacctgcggaccagccctgagaagagaattgctgtgggccccttcagaagtgactacccagccctgtacctgggcaagttcagcgagaggaccttcttcagccccatcatgagcagccccagcggcaagaagggggcccacctgtag

SEQ ID NO: 39211 - DNA, 3081 bp, Artificial Sequence; identical to SEQ ID NO: 39210
  Description of Artificial Sequence: Synthetic coding sequence

SEQ ID NO: 39212 - DNA, 576 bp, Artificial Sequence
  Description of Artificial Sequence: Synthetic coding sequence
atgaccaggacccagaagggcaagaccttcctgccccactgcttctaccagagcctgcccccccggctgggctggggcatgatcctgaactacagcaagctgaagggcaaggaggagtgtgcctctgtgtcctctgtgcccatggtgttcttcagcagccagtaccgcctgcacaggaagagccagtacctgaagatggccgccgccaacctgaccttcagccaggaggtggtgtggcagaggggcctgcccagcatcccctacagccagtacagctttgaccacctgtacaacaccaatgacatcatccacaccccccagatcaggaaggcccggccccagaagcctgtgtccttcaagttcctgggcagcagcagccccctgactggagacaccagcctggccgtgaagacagagagcagcgccaaccctgagaagaagctgaagaagagcaagccagccagcacagtgcgggaggccccccggcccctcatccaccacccctgcatgcacccagacatgctgggccggccccccagcctggatgtgaacctggaggagcgggaggcctggtag

SEQ ID NO: 39213 - DNA, 120 bp, Artificial Sequence
  Description of Artificial Sequence: Synthetic coding sequence
atgaccaggacccagaagggcaagaccttcctgccccactgcttctaccagagcctgcccccccggctgggctggggcatgatcctgaactacagcaagctgaagggcaaggaggagtag

SEQ ID NO: 39214 - DNA, 2940 bp, Artificial Sequence
  Description of Artificial Sequence: Synthetic coding sequence
atggtgttcttcagcagccagtaccgcctgcacaggaagagccagtacctgaagatggctgctgccaacctgaccttcagccaggaggtggtgtggcagaggggcctgcccagcatcccctacagccagtacagctttgaccacctgtacaacaccaatgacatcatccacaccccccagatcaggaaggcccggccccagaagcctgtgtccttcaagttcctgggcagcagcagccccctgaccggggacaccagcctggccgtgaagacagagagcagcgccaaccctgagaagaagctgaagaagagcaagccagccagcacagtgcgggaggccccccggcccctcatccaccacccctgcatgcacccagacatgctgggccggccccccagcctggatgtgaacctggaggagcgggaggcctggctgctgcccccagagaaggaggcccgggcctgggaggccaccgtgctggagaagctgaatgaaagaacagcccgctggatccagagcaagaggcccaggaggcctggggccagccccaacaagtggcagagcttcctgcggcagcagtatgactggagccacatcagagatgagctgaccagcgccagtgacctggagctgctgaagcagctggaggccgaggagacagctgagtttgaggaccagagcgtcatcctgcccccccaggagaagaagaagccagagctgctgctgcctgtgtactaccgcctgcccagctacttccagcaggccgagaccgtggagatcatgcctggcaacaagagcacagaggacatccacgagaagaccagcctgagccagccccagacccagagctacttccggcaggtgaccccccgggccggcaagtttgcctacagcacagacaacacctttgagcaggagatctactttgatgaggtgcagatcatccaccagatcggggccaagagggaccagatcgtgctggagaacctgaaccgctacaacaagcagctgagcaaggtgtttcctgagaccccagagaagtggagcgcccaggccatccctgaggccagctacagacctgtgcagggcgccctgcgctggacagccctgcccaccccagccaaggacatgctgctgcaggtgggggagaaggatgtgcccatcaagacccggcggctgaagaagcaggccaagagcctgcaggaggatgtgacctgggagctggtggtgctgcggaggatgctgaaggagtggaagacagcctgggccctgatcatcgagtggcaccacgagaccgtggagaacctgctgcagagcctgggggacctgcatgatgatgtgcgcatcaaggccatcaccacctgtgccacagctgccctggagcggcccagaattgccaccagccagagggacagcgacaagaccatccaggacctgcctgaggtgctgctgcctgccctggaggccgccctgtgtgacaagaatgcccacgtgaggatggccgccgccatctgccagtatgccatccagagccacaaccccctggccaggaacatcatgcagacagccctgctgaagggcaacagcgtggacagctgggccgccgcccagtgcctggccctggagggcacagccacctaccctgtgatcaagaggatcctgcaccagctgttcaccaagaagaatgaagacacagaggagcagagctacatcctgctgagctacctgtctgagaagaccaccctcatccacaccatgctggccgtggagctgaacagctgccagtggaagaaccgcatcgtggcctgccaggccttcagccgcatctctggaaatgtgtgcctggacatgaagcacaagctgatccagctgatgtggaatgactggaacaaggaggtgcggcgggctgctgcccaggccctgggccagatgagcctgggcaaggaggtgcatgacatcatccgggtgaagctgggccagggcaacagccaggagcgggtggaggccctgtacctgattggagagctgaagctgatgacagccaagctgctgcccagcttcctgcactgcttcagtgatgacttcaccgctgtgagaagagctgcctgcctggccgccggggccctgcagatccgggacaagatggtgctggagtgcctgctgaacctgatgcagagggacccctactggaagatcaaggcctttgccatccgggccctgggccagatcggccaggtgtccccagagctgacagacctgctgctgtgggccatccactatgaggagagccctggggtgcggctggaggcctgccgcagcatcctggccctgaagctgcagggcgacagagtgcgggacaccttcctggatgtgctgctgctggagaaccatgatgctgtgctgaaggagatgtaccagaccatgaagatcctgaacctgggcaatgaaggcaaccaggagatgctgcaggagatcaagaaccgcatcaagaccctgagccagaaggacctgctgacccacaagatcctgaagctggagatggtgatgggcaaggtgcgggaggaggccaagagggtgtacctgaagcccaagggggagcagggccccctgaccctgcagaccctgctgcaggagaccttccaggatgagatggtgctgccccggcggcccagcgaggtgtgtgacacagaggccgtcatcaagcctgtgaagccccgggcccccaacccctggctgcagagctctgtgcccggcctgaccaccaggagcaaggtgcgcagcagcctggtgaaggacctgcggaccagccctgagaagagaattgctgtgggccccttcagaagtgactacccagccctgtacctgggcaagttcagcgagaggaccttcttcagccccatcatgagcagccccagcggcaagaagggggcccacctgtag

SEQ ID NO: 39215 - DNA, 6123 bp, Artificial Sequence
  Description of Artificial Sequence: Synthetic coding sequence
atggagctggcccacagcctgctgctgaatgaggaggcctacaaccagctgggggaggtgcagaaggccgagttcatctttgagtggctgcgctacctggagaagctgctgctggccaccagcagaaatgatgtgcgggagaagcagaagaccctggtggagcagctgctgagcctgctgaacagcagccctggcccccccaccaggaagctgctggccaagaacctggccatcctgtacagcatcggggacaccttctctgtgcatgaggccatcgacaagtgcaatgacctgatccgcagcaaggatgacagccccagctacctgcccaccaagctggccgctgtggtgtgcctgggcagcctgtacaagaagctgggccgcatcctgggcaacaccttcacagacacagtgggcaacatcctgaaggccatgaagtctgctgagagccagggccgctatgagatcatgctgagcctgcagaacatcctgaatggcctgggcgctgctgctgccccctgccacagagatgtgtacaaggccgcccggagctgcctgacagaccgctccatggctgtgcgctgtgccgccgccaagaatgaggccatcttcatgtggagcacagacctggacagcgtggccaccctgtgcttcaagagctttgagggcagcaactatgatgtgcgcatctctgtgtccaagctgctgggcatcatcctggccaaggctgtgatcagcaagcaccctggaacagctgccagccggcagagcatcagaagagtgtccctggaggaggtgctggagctgctgggcaccggcttcctgcggggcagcagcggcttcctgcgggccagcggggacatgctgaagggcaccagctctgtgtccagagatgtgcgggtgggcgtgacccaggcctacgtggtgtttgtgtccaccctgggcggggcctggctggagaagaactttgctgccttcttcagccacatcctgagcctggccagccccagccaccccaaggccacccagacccagattgatgctgtgtgctgccgccgctgtgtgtccttcatcctgcggaccaccatcggcggcctgctgggggagaaggcccagctggccgctgtgaaggacatctgccaggccatctggaagctgaagaaggtgatggatgctgtgatgtctgatggcaacctggagacccggctgggcagcacagatgtggccgccagccagcacatgctggtgtgtgccctgcaggagctgggcaacctgatccacaacctgggcaccacagctgcccccctgctgcaggacagcagcacaggcctgctggacagcatcctgagcgtcatcctgcaccccagcatctctgtgcggctggccgccgcctggtgcctgcactgcatcgctgtggccctgcccagctacctgacccccctgctggaccgctgcctggagcggctgaccggccacaagagcagccctgaggccgtgacaggcttctcctttgctgtggccgccctgctgggcgctgtgaagcactgccccctgggcatcccccacggcaagggcaagatcatcatgaccctggccgaggacctgctgtgcagcgctgcccagaacagccggctgagcgcccagaggacccaggccggctggctgctgatcagcgccctgatgaccctgggccctgctgtggtgagccaccacctggcccgggtgctgctgctgtggaagtgtgtgtttcctgccagccccaaggacctggagacagagaagagcagaggagacagcttcacctggcaggtgaccctggagggccgggccggggccctgtgtgccatcaagagctttgtgagccactgtggggacctgctgacagaggaggtgacccagaggctgctgccccccctgccctgtgctgtggacctgctgacccagctgagcagcatcctgaagatgtatggcagccccctgaagacccccagcgtggtgtaccggcagaggctgtatgagctgctgatcctgctgcccccagagacctatgagggcaacctgtgtgccatcctgcgggagctggccgctgacctgacagccccagacatccaggtggccgccagcaccttcctgctgccccccctgtgccaccaggatgacctgctgatcctgagccccttcctgcaggagacagaccaccgcttcatcgaggagcagctgctgctgggcaatggagtggcctgtggcagcctggagtatgacccctacagcatctatgagaaggatgtggagggggacagcgtgcccaagcccctgcccccagccctgagcgtcatcagcagcgccagcaagctgtttggagtggtgtgtgcccacgtgggggagacccagaggctgctgatcctggagcagctgctggacagcatcaagcacaccaagggggcccggcagcaggtggtgcagctgcacgtggtgtcctctgtgagcagcttcctgaagtatgtggccggcagcaagggctgcctgggccctgaggagatgaagagatttgccctgaccctggtgatgggcgccctggagagccccaaccccctgctgcgctgtgccgctgctgagagctgggcccggctggcccaggtggtggatgatggagccttcaccgctggcctggcccaggtgtcctttgacaagctgaagagcgccagagatgtggtgaccaggacaggccacagcctggccctgggcagcctgcaccgctacctgggcggcatcagcagcagccagcacctgaacagctgcatcggcatcctgtacaccctggcccaggacagcaccagcccagatgtgcagacctgggccctgcacagcctgagcctcatcattgattctgctggccccctgtactacgtgcacgtggagcccaccctgagcctcatcatcatgctgctgctgaatgtgccccccacccatgctgaggtgcaccagagcctgggccgctgcctgaatgccctgatcaccaccctgggccctgagctgcagggcaacagcaccagcatcagcaccctgcggaccagctgcctgctgggctgtgctgtgatgcaggacaacccagactgcctggtgcaggcccaggccatcagctgcctgcagcagctgcacatgtttgcccccaggcatgtgaacctgagcagcctggtgtcctgcctgtgtgtgaacctgtgcagcccctacctgctgctgcggcgggctgtgctggcctgcctgcggcagctggtgcagcgggaggccgctgaggtgtctgagcacgctgtgatgctggccaaggacagccgggaggagctgaccccagatgccaacatccgggaggtgggcctggagggcgccctgctgatcctgctggacaaggagacagatgagcggctgtgccacgacatcaaggagaccctgaactacatgctgacctccatggctgtggagaagctgagcctgtggctgaagctgtgcaaggatgtgctggccgccagcgctgacttcaccgctgtgacctgtgtggacaccatgcaggaggaggagggggacaagggagatgatgcctctgtgctgaccaccaggagagatgagaagagccaccccttcaccaacccccgctgggccaccagggtgtttgctgctgaatgtgtgtgccgcatcatcaaccagtgtgaaaatgccaacagcgcccactttgacatcgccctggcccaggagatgaagaagagggacagcagaaatgacttcctggtgctgcacctggccgacctgatccgcatggccttcatggccgccacagaccacagcgaccagctgcggctgagcggcctggagatgctgctggtggtgatcagaagatttgccaccgtgcctgagcctgagttccctggccacgtgatcctggagcagtaccaggccaacgtgggcgccgccctgcggcctgccttcaccagcgagaccccaccagatgtgacagccaaggcctgccaggtgtgcagcgcctggatcgccagcggcgtggtgtctgacctgaatgacctgcggcgggtgcaccagctgctggtgagcagcctgaccaagatccaggccggcaaggaggccctgagccacctgtacaatgaaagtgccagcaccatggagatcctggccgtgctgaaggcctgggccgaggtgtacatcatcgctgtgcagaggcacaagaaccaccggcagcccctgaagaccaccacctgcctggaggatggcatcagaaatggcagctgcagcagtgatggcctgctggacctggtgtatgctgacctgggcaccctgagccggctgtggctggccgccctgcaggactttgccctgctgaccctgcccagcgagtttgccagccagctgcctgctgagggcggggccttctacacagctgagaccagtgaaaatgccaagctgcactactacaacagctgggccctgatcctgcacgccacagccctgtggctgaccagcactggatttgtggtggccgaccctgatgaaggagccagcaacctgagcaggcctgtgacccccacctccatgtgccagggcagcagcagcggggccaccatcaagagcccagaagatgtgtacacagaccgcttccacctgatcctgggcatctctgtggagttcctgtgcagcctgcggagtgatgccaccatggagagcatcacagcctgcctgcacgccctgcaggccctgctggatgtgccctggcccaggagcaagattggaagtgaccaggacctgggcatcgagctgctgaatgtgctgcacagggtcatcctgacccgggagagccccagcatccagctggccagcctggaggtggtgcggcagatcatctgtgccgcccaggagcacgtgaaggagaagagaagatctgctgaggtggatgatggagctgctgagaaggagaccctgcctgagtttggagagggcaaggacacaggaggcctggtgcctgggaagagcctggtgtttgccaccctggagctgtgtgtgtgcatcctggtgcggcagctgcctgagctgaaccccaagctgaccggcagccctggggtgaaggccaccaagccccagatcctgctggaggatggcagccggctggtgtctgctgccctggtgatcctgtctgagctgcctgctgtgtgcagccctgagggcagcatcagcatcctgcccaccatcctgtacctgaccatcggcgtgctgcgggagacagctgtgaagctgcccggcggccagctgagcagcacagtggccgccagcctgcaggccctgaagggcatcctgagcagccccatggcccgggcagagaagagcaggacagcctggacagacctgctgcggagcgccctgaccaccatcctggactgctgggaccctgtggatgagacccaccaggagctggatgaggtgtccctgctgacagccatcaccgtcttcatcctgagcaccagccctgaggtgaccaccatcccctgcctgcagaagcgctgcatcgacaagttcaaggccaccctggagatcaaggaccctgtggtgcagatcaagacctaccagctgctgcacagcatcttccagtaccccaacccagctgtgtcctacccctacatctacagcctggccagctgcatcatggagaagctgcaggagattgacaagaggaagccagagaacacagctgagctggagatcttccaggagggcatcaaggtgctggagaccctggtgacagtggccgaggagcaccaccgggcccagctggtggcctgcctgctgcccatcctgatctccttcctgctggatgagaacagcctgggcagcgccaccagcatcatgaggaacctgcatgactttgccctgcagaacctgatgcagatcggcccccagtacagctctgtgttcaagagcctggtggccagcagccctgccctgaaggcccggctggaggccgccatcaagggcaaccaggagagcgtgaaggtgaagatccccaccagcaagtacaccaagagccctgggaagaacagcagcatccagctgaagaccagcttcctgtag

SEQ ID NO: 39216 - DNA, 3423 bp, Artificial Sequence
  Description of Artificial Sequence: Synthetic coding sequence
atggagctggcccacagcctgctgctgaatgaggaggcctacaaccagctgggggaggtgcagaaggccgagttcatctttgagtggctgcgctacctggagaagctgctgctggccaccagcagaaatgatgtgcgggagaagcagaagaccctggtggagcagctgctgagcctgctgaacagcagccctggcccccccaccaggaagctgctggccaagaacctggccatcctgtacagcatcggggacaccttctctgtgcatgaggccatcgacaagtgcaatgacctgatccgcagcaaggatgacagccccagctacctgcccaccaagctggccgctgtggtgtgcctgggcagcctgtacaagaagctgggccgcatcctgggcaacaccttcacagacacagtgggcaacatcctgaaggccatgaagtctgctgagagccagggccgctatgagatcatgctgagcctgcagaacatcctgaatggcctgggcgctgctgctgccccctgccacagagatgtgtacaaggccgcccggagctgcctgacagaccgctccatggctgtgcgctgtgccgccgccaagtgcctgctggagctgcagaatgaggccatcttcatgtggagcacagacctggacagcgtggccaccctgtgcttcaagagctttgagggcagcaactatgatgtgcgcatctctgtgtccaagctgctgggcatcatcctggccaaggctgtgatcagcaagcaccctggaacagctgccagccggcagagcatcagaagagtgtccctggaggaggtgctggagctgctgggcaccggcttcctgcggggcagcagcggcttcctgcgggccagcggggacatgctgaagggcaccagctctgtgtccagagatgtgcgggtgggcgtgacccaggcctacgtggtgtttgtgtccaccctgggcggggcctggctggagaagaactttgctgccttcttcagccacatcctgagcctggccagccccagccaccccaaggccacccagacccagattgatgctgtgtgctgccgccgctgtgtgtccttcatcctgcggaccaccatcggcggcctgctgggggagaaggcccagctggccgctgtgaaggacatctgccaggccatctggaagctgaagaaggtgatggatgctgtgatgtctgatggcaacctggagacccggctgggcagcacagatgtggccgccagccagcacatgctggtgtgtgccctgcaggagctgggcaacctgatccacaacctgggcaccacagctgcccccctgctgcaggacagcagcacaggcctgctggacagcatcctgagcgtcatcctgcaccccagcatctctgtgcggctggccgccgcctggtgcctgcactgcatcgctgtggccctgcccagctacctgacccccctgctggaccgctgcctggagcggctgaccggccacaagagcagccctgaggccgtgacaggcttctcctttgctgtggccgccctgctgggcgctgtgaagcactgccccctgggcatcccccacggcaagggcaagatcatcatgaccctggccgaggacctgctgtgcagcgctgcccagaacagccggctgagcgcccagaggacccaggccggctggctgctgatcagcgccctgatgaccctgggccctgctgtggtgagccaccacctggcccgggtgctgctgctgtggaagtgtgtgtttcctgccagccccaaggacctggagacagagaagagcagaggagacagcttcacctggcaggtgaccctggagggccgggccggggccctgtgtgccatcaagagctttgtgagccactgtggggacctgctgacagaggaggtgacccagaggctgctgccccccctgccctgtgctgtggacctgctgacccagctgagcagcatcctgaagatgtatggcagccccctgaagacccccagcgtggtgtaccggcagaggctgtatgagctgctgatcctgctgcccccagagacctatgagggcaacctgtgtgccatcctgcgggagctggccgctgacctgacagccccagacatccaggtggccgccagcaccttcctgctgccccccctgtgccaccaggatgacctgctgatcctgagccccttcctgcaggagacagaccaccgcttcatcgaggagcagctgctgctgggcaatggagtggcctgtggcagcctggagtatgacccctacagcatctatgagaaggatgtggagggggacagcgtgcccaagcccctgcccccagccctgagcgtcatcagcagcgccagcaagctgtttggagtggtgtgtgcccacgtgggggagacccagaggctgctgatcctggagcagctgctggacagcatcaagcacaccaagggggcccggcagcaggtggtgcagctgcacgtggtgtcctctgtgagcagcttcctgaagtatgtggccggcagcaagggctgcctgggccctgaggagatgaagagatttgccctgaccctggtgatgggcgccctggagagccccaaccccctgctgcgctgtgccgctgctgagagctgggcccggctggcccaggtggtggatgatggagccttcaccgctggcctggcccaggtgtcctttgacaagctgaagagcgccagagatgtggtgaccaggacaggccacagcctggccctgggcagcctgcaccgctacctgggcggcatcagcagcagccagcacctgaacagctgcatcggcatcctgtacaccctggcccaggacagcaccagcccagatgtgcagacctgggccctgcacagcctgagcctcatcattgattctgctggccccctgtactacgtgcacgtggagcccaccctgagcctcatcatcatgctgctgctgaatgtgccccccacccatgctgaggtgcaccagagcctgggccgctgcctgaatgccctgatcaccaccctgggccctgagctgcagggcaacagcaccagcatcagcaccctgcggaccagctgcctgctgggctgtgctgtgatgcaggacaacccagactgcctggtgcaggcccaggccatcagctgcctgcagcagctgcacatgtttgcccccaggcatgtgaacctgagcagcctggtgtcctgcctgtgtgtgaacctgtgcagcccctacctgctgctgcggcgggctgtgctggcctgcctgcggcagctggtgcagcgggaggccgctgaggtgtctgagcacgctgtgatgctggccaaggacagccgggaggagctgacccctgtgttcaccgccagcagccctggggtggacagcatctgcaggaaccacctggagtag

SEQ ID NO: 39217 - DNA, 5898 bp, Artificial Sequence
  Description of Artificial Sequence: Synthetic coding sequence
atggagctggcccacagcctgctgctgaatgaggaggcctacaaccagctgggggaggtgcagaaggccgagttcatctttgagtggctgcgctacctggagaagctgctgctggccaccagcagaaatgatgtgcgggagaagcagaagaccctggtggagcagctgctgagcctgctgaacagcagccctggcccccccaccaggaagctgctggccaagaacctggccatcctgtacagcatcggggacaccttctctgtgcatgaggccatcgacaagtgcaatgacctgatccgcagcaaggatgacagccccagctacctgcccaccaagctggccgctgtggtgtgcctgggcagcctgtacaagaagctgggccgcatcctgggcaacaccttcacagacacagtgggcaacatcctgaaggccatgaagtctgctgagagccagggccgctatgagatcatgctgagcctgcagaacatcctgaatggcctgggcgctgctgctgccccctgccacagagatgtgtacaaggccgcccggagctgcctgacagaccgctccatggctgtgcgctgtgccgccgccaagaatgaggccatcttcatgtggagcacagacctggacagcgtggccaccctgtgcttcaagagctttgagggcagcaactatgatgtgcgcatctctgtgtccaagctgctgggcatcatcctggccaaggctgtgatcagcaagcaccctggaacagctgccagccggcagagcatcagaagagtgtccctggaggaggtgctggagctgctgggcaccggcttcctgcggggcagcagcggcttcctgcgggccagcggggacatgctgaagggcaccagctctgtgtccagagatgtgcgggtgggcgtgacccaggcctacgtggtgtttgtgtccaccctgggcggggcctggctggagaagaactttgctgccttcttcagccacatcctgagcctggccagccccagccaccccaaggccacccagacccagattgatgctgtgtgctgccgccgctgtgtgtccttcatcctgcggaccaccatcggcggcctgctgggggagaaggcccagctggccgctgtgaaggacatctgccaggccatctggaagctgaagaaggtgatggatgctgtgatgtctgatggcaacctggagacccggctgggcagcacagatgtggccgccagccagcacatgctggtgtgtgccctgcaggagctgggcaacctgatccacaacctgggcaccacagctgcccccctgctgcaggacagcagcacaggcctgctggacagcatcctgagcgtcatcctgcaccccagcatctctgtgcggctggccgccgcctggtgcctgcactgcatcgctgtggccctgcccagctacctgacccccctgctggaccgctgcctggagcggctgaccggccacaagagcagccctgaggccgtgacaggcttctcctttgctgtggccgccctgctgggcgctgtgaagcactgccccctgggcatcccccacggcaagggcaagatcatcatgaccctggccgaggacctgctgtgcagcgctgcccagaacagccggctgagcgcccagaggacccaggccggctggctgctgatcagcgccctgatgaccctgggccctgctgtggtgagccaccacctggcccgggtgctgctgctgtggaagtgtgtgtttcctgccagccccaaggacctggagacagagaagagcagaggagacagcttcacctggcaggtgaccctggagggccgggccggggccctgtgtgccatcaagagctttgtgagccactgtggggacctgctgacagaggaggtgacccagaggctgctgccccccctgccctgtgctgtggacctgctgacccagctgagcagcatcctgaagatgtatggcagccccctgaagacccccagcgtggtgtaccggcagaggctgtatgagctgctgatcctgctgcccccagagacctatgagggcaacctgtgtgccatcctgcgggagctggccgctgacctgacagccccagacatccaggtggccgccagcaccttcctgctgccccccctgtgccaccaggatgacctgctgatcctgagccccttcctgcaggagacagaccaccgcttcatcgaggagcagctgctgctgggcaatggagtggcctgtggcagcctggagtatgacccctacagcatctatgagaaggatgtggagggggacagcgtgcccaagcccctgcccccagccctgagcgtcatcagcagcgccagcaagctgtttggagtggtgtgtgcccacgtgggggagacccagaggctgctgatcctggagcagctgctggacagcatcaagcacaccaagggggcccggcagcaggtggtgcagctgcacgtggtgtcctctgtgagcagcttcctgaagtatgtggccggcagcaagggctgcctgggccctgaggagatgaagagatttgccctgaccctggtgatgggcgccctggagagccccaaccccctgctgcgctgtgccgctgctgagagctgggcccggctggcccaggtggtggatgatggagccttcaccgctggcctggcccaggtgtcctttgacaagctgaagagcgccagagatgtggtgaccaggacaggccacagcctggccctgggcagcctgcaccgctacctgggcggcatcagcagcagccagcacctgaacagctgcatcggcatcctgtacaccctggcccaggacagcaccagcccagatgtgcagacctgggccctgcacagcctgagcctcatcattgattctgctggccccctgtactacgtgcacgtggagcccaccctgagcctcatcatcatgctgctgctgaatgtgccccccacccatgctgaggtgcaccagagcctgggccgctgcctgaatgccctgatcaccaccctgggccctgagctgcagggcaacagcaccagcatcagcaccctgcggaccagctgcctgctgggctgtgctgtgatgcaggacaacccagactgcctggtgcaggcccaggccatcagctgcctgcagcagctgcacatgtttgcccccaggcatgtgaacctgagcagcctggtgtcctgcctgtgtgtgaacctgtgcagcccctacctgctgctgcggcgggctgtgctggcctgcctgcggcagctggtgcagcgggaggccgctgaggtgtctgagcacgctgtgatgctggccaaggacagccgggaggagctgaccccagatgccaacatccgggaggtgggcctggagggcgccctgctgatcctgctggacaaggagacagatgagcggctgtgccacgacatcaaggagaccctgaactacatgctgacctccatggctgtggagaagctgagcctgtggctgaagctgtgcaaggatgtgctggccgccagcgctgacttcaccgctgtgacctgtgtggacaccatgcaggaggaggagggggacaagggagatgatgcctctgtgctgaccaccaggagagatgagaagagccaccccttcaccaacccccgctgggccaccagggtgtttgctgctgaatgtgtgtgccgcatcatcaaccagtgtgaaaatgccaacagcgcccactttgacatcgccctggcccaggagatgaagaagagggacagcagaaatgacttcctggtgctgcacctggccgacctgatccgcatggccttcatggccgccacagaccacagcgaccagctgcggctgagcggcctggagatgctgctggtggtgatcagaagatttgccaccgtgcctgagcctgagttccctggccacgtgatcctggagcagtaccaggccaacgtgggcgccgccctgcggcctgccttcaccagcgagaccccaccagatgtgacagccaaggcctgccaggtgtgcagcgcctggatcgccagcggcgtggtgtctgacctgaatgacctgcggcgggtgcaccagctgctggtgagcagcctgaccaagatccaggccggcaaggaggccctgagccacctgtacaatgaaagtgccagcaccatggagatcctggccgtgctgaaggcctgggccgaggtgtacatcatcgctgtgcagaggcacaagaaccaccggcagcccctgaagaccaccacctgcctggaggatggcatcagaaatggcagctgcagcagtgatggcctgctggacctggtgtatgctgacctgggcaccctgagccggctgtggctggccgccctgcaggactttgccctgctgaccctgcccagcgagtttgccagccagctgcctgctgagggcggggccttctacacagctgagaccagtgaaaatgccaagctgcactactacaacagctgggccctgatcctgcacgccacagccctgtggctgaccagcactggatttgtggtggccgaccctgatgaaggagccagcaacctgagcaggcctgtgacccccacctccatgtgccagggcagcagcagcggggccaccatcaagagcccagaagatgtgtacacagaccgcttccacctgatcctgggcatctctgtggagttcctgtgcagcctgcggagtgatgccaccatggagagcatcacagcctgcctgcacgccctgcaggccctgctggatgtgccctggcccaggagcaagattggaagtgaccaggacctgggcatcgagctgctgaatgtgctgcacagggtcatcctgacccgggagagccccagcatccagctggccagcctggaggtggtgcggcagatcatctgtgccgcccaggagcacgtgaaggagaagagaagatctgctgaggtggatgatggagctgctgagaaggagaccctgcctgagtttggagagggcaaggacacaggaggcctggtgcctgggaagagcctggtgtttgccaccctggagctgtgtgtgtgcatcctggtgcggcagctgcctgagctgaaccccaagctgaccggcagccctggggtgaaggccaccaagccccagatcctgctggaggatggcagccggctggtgtctgctgccctggtgatcctgtctgagctgcctgctgtgtgcagccctgaggtggatgagacccaccaggagctggatgaggtgtccctgctgacagccatcaccgtcttcatcctgagcaccagccctgaggtgaccaccatcccctgcctgcagaagcgctgcatcgacaagttcaaggccaccctggagatcaaggaccctgtggtgcagatcaagacctaccagctgctgcacagcatcttccagtaccccaacccagctgtgtcctacccctacatctacagcctggccagctgcatcatggagaagctgcaggagattgacaagaggaagccagaaaatacagctgagctggagatcttccaggagggcatcaaggtgctggagaccctggtgacagtggccgaggagcaccaccgggcccagctggtggcctgcctgctgcccatcctgatctccttcctgctggatgagaacagcctgggcagcgccaccagcatcatgaggaacctgcatgactttgccctgcagaacctgatgcagatcggcccccagtacagcagcgtcttcaagagcctggtggccagcagccctgccctgaaggcccggctggaggccgccatcaagggcaaccaggagagcgtgaaggtgaagatccccaccagcaagtacaccaagagccctgggaagaacagcagcatccagctgaagaccagcttcctgtag

SEQ ID NO: 39218 - DNA, 5262 bp, Artificial Sequence
  Description of Artificial Sequence: Synthetic coding sequence
atgctgaagggcaccagctctgtgtccagagatgtgcgggtgggcgtgacccaggcctacgtggtgtttgtgtccaccctgggcggggcctggctggagaagaactttgctgccttcttcagccacatcctgagcctggccagccccagccaccccaaggccacccagacccagattgatgctgtgtgctgcagaagatgtgtgtccttcatcctgcggaccaccatcggcggcctgctgggggagaaggcccagctggccgctgtgaaggacatctgccaggccatctggaagctgaagaaggtgatggatgctgtgatgtctgatggcaacctggagacccggctgggcagcacagatgtggccgccagccagcacatgctggtgtgtgccctgcaggagctgggcaacctgatccacaacctgggcaccacagctgcccccctgctgcaggacagcagcacaggcctgctggacagcatcctgagcgtcatcctgcaccccagcatctctgtgcggctggccgccgcctggtgcctgcactgcatcgctgtggccctgcccagctacctgacccccctgctggaccgctgcctggagcggctgaccggccacaagagcagccctgaggccgtgacaggcttctcctttgctgtggccgccctgctgggcgctgtgaagcactgccccctgggcatcccccacggcaagggcaagatcatcatgaccctggccgaggacctgctgtgcagcgctgcccagaacagccggctgagcgcccagaggacccaggccggctggctgctgatcagcgccctgatgaccctgggccctgctgtggtgagccaccacctggcccgggtgctgctgctgtggaagtgtgtgtttcctgccagccccaaggacctggagacagagaagagcagaggagacagcttcacctggcaggtgaccctggagggccgggccggggccctgtgtgccatcaagagctttgtgagccactgtggggacctgctgacagaggaggtgacccagaggctgctgccccccctgccctgtgctgtggacctgctgacccagctgagcagcatcctgaagatgtatggcagccccctgaagaccccatctgtggtgtaccggcagaggctgtatgagctgctgatcctgctgcccccagagacctatgagggcaacctgtgtgccatcctgcgggagctggccgctgacctgacagccccagacatccaggtggccgccagcaccttcctgctgccccccctgtgccaccaggatgacctgctgatcctgagccccttcctgcaggagacagaccaccgcttcatcgaggagcagctgctgctgggcaatggagtggcctgtggcagcctggagtatgacccctacagcatctatgagaaggatgtggagggggacagcgtgcccaagcccctgcccccagccctgagcgtcatcagcagcgccagcaagctgtttggagtggtgtgtgcccacgtgggggagacccagaggctgctgatcctggagcagctgctggacagcatcaagcacaccaagggggcccggcagcaggtggtgcagctgcacgtggtgtcctctgtgtcctccttcctgaagtatgtggccggcagcaagggctgcctgggccctgaggagatgaagagatttgccctgaccctggtgatgggcgccctggagagccccaaccccctgctgcgctgtgccgctgctgagagctgggcccggctggcccaggtggtggatgatggagccttcaccgctggcctggcccaggtgtcctttgacaagctgaagagcgccagagatgtggtgaccaggacaggccacagcctggccctgggcagcctgcaccgctacctgggcggcatcagcagcagccagcacctgaacagctgcatcggcatcctgtacaccctggcccaggacagcaccagcccagatgtgcagacctgggccctgcacagcctgagcctcatcatcgacagcgctggccccctgtactacgtgcacgtggagcccaccctgagcctcatcatcatgctgctgctgaatgtgccccccacccacgccgaggtgcaccagagcctgggccgctgcctgaatgccctgatcaccaccctgggccctgagctgcagggcaacagcaccagcatcagcaccctgcggaccagctgcctgctgggctgtgctgtgatgcaggacaacccagactgcctggtgcaggcccaggccatcagctgcctgcagcagctgcacatgtttgcccccaggcatgtgaacctgagcagcctggtgtcctgcctgtgtgtgaacctgtgcagcccctacctgctgctgcggcgggctgtgctggcctgcctgcggcagctggtgcagcgggaggccgctgaggtgtctgaacatgctgtgatgctggccaaggacagccgggaggagctgaccccagatgccaacatccgggaggtgggcctggagggcgccctgctgatcctgctggacaaggagacagatgagcggctgtgccacgacatcaaggagaccctgaactacatgctgacctccatggctgtggagaagctgagcctgtggctgaagctgtgcaaggatgtgctggccgccagcgctgacttcaccgctgtgacctgtgtggacaccatgcaggaggaggagggggacaagggagatgatgcctctgtgctgaccaccaggagagatgagaagagccaccccttcaccaacccccgctgggccaccagggtgtttgctgctgaatgtgtgtgccgcatcatcaaccagtgtgaaaatgccaacagcgcccactttgatattgccctggcccaggagatgaagaagagggacagcagaaatgacttcctggtgctgcacctggccgacctgatccgcatggccttcatggccgccacagaccacagcgaccagctgcggctgagcggcctggagatgctgctggtggtgatccgccgctttgccaccgtgcctgagcctgagttccctggccacgtgatcctggagcagtaccaggccaacgtgggcgccgccctgcggcctgccttcaccagcgagaccccaccagatgtgacagccaaggcctgccaggtgtgcagcgcctggatcgccagcggcgtggtgtctgacctgaatgacctgcggcgggtgcaccagctgctggtgagcagcctgaccaagatccaggccggcaaggaggccctgagccacctgtacaatgaaagtgccagcaccatggagatcctggccgtgctgaaggcctgggccgaggtgtacatcatcgctgtgcagaggcacaagaaccaccggcagcccctgaagaccaccacctgcctggaggatggcatcagaaatggcagctgcagcagtgatggcctgctggacctggtgtatgctgacctgggcaccctgagccggctgtggctggccgccctgcaggactttgccctgctgaccctgcccagcgagtttgccagccagctgcctgctgagggcggggccttctacacagctgagaccagtgaaaatgccaagctgcactactacaacagctgggccctgatcctgcacgccacagccctgtggctgaccagcacaggctttgtggtggccgaccctgatgagggcgccagcaacctgagcaggcctgtgacccccacctccatgtgccagggcagcagcagcggggccaccatcaagagcccagaagatgtgtacacagaccgcttccacctgatcctgggcatctctgtggagttcctgtgcagcctgcggagtgatgccaccatggagagcatcacagcctgcctgcacgccctgcaggccctgctggatgtgccctggcccaggagcaagattggaagtgaccaggacctgggcatcgagctgctgaatgtgctgcacagggtcatcctgacccgggagagccccagcatccagctggccagcctggaggtggtgcggcagatcatctgtgccgcccaggagcacgtgaaggagaagagaagatctgctgaggtggatgatggagctgctgagaaggagaccctgcctgagtttggagagggcaaggacaccggcggcctggtgcctgggaagagcctggtgtttgccaccctggagctgtgtgtgtgcatcctggtgcggcagctgcctgagctgaaccccaagctgaccggcagccctggggtgaaggccaccaagccccagatcctgctggaggatggcagccggctggtgtctgctgccctggtgatcctgtctgagctgcctgctgtgtgcagccctgagggcagcatcagcatcctgcccaccatcctgtacctgaccatcggcgtgctgcgggagacagctgtgaagctgcccggcggccagctgagcagcacagtggccgccagcctgcaggccctgaagggcatcctgagcagccccatggcccgggcagagaagagcaggacagcctggacagacctgctgcggagcgccctgaccaccatcctggactgctgggaccctgtggatgagacccaccaggagctggatgaggtgtccctgctgacagccatcaccgtcttcatcctgagcaccagccctgaggtgaccaccatcccctgcctgcagaagcgctgcatcgacaagttcaaggccaccctggagatcaaggaccctgtggtgcagatcaagacctaccagctgctgcacagcatcttccagtaccccaacccagctgtgtcctacccctacatctacagcctggccagctgcatcatggagaagctgcaggagattgacaagaggaagccagaaaatacagctgagctggagatcttccaggagggcatcaaggtgctggagaccctggtgacagtggccgaggagcaccaccgggcccagctggtggcctgcctgctgcccatcctgatctccttcctgctggatgagaacagcctgggcagcgccaccagcatcatgaggaacctgcatgactttgccctgcagaacctgatgcagatcggcccccagtacagcagcgtcttcaagagcctggtggccagcagccctgccctgaaggcccggctggaggccgccatcaagggcaaccaggagagcgtgaaggtgaagatccccaccagcaagtacaccaagagccctgggaagaacagcagcatccagctgaagaccagcttcctgtag

SEQ ID NO: 39219 - DNA, 6141 bp, Artificial Sequence
  Description of Artificial Sequence: Synthetic coding sequence
atggagctggcccacagcctgctgctgaatgaggaggcctacaaccagctgggggaggtgcagaaggccgagttcatctttgagtggctgcgctacctggagaagctgctgctggccaccagcagaaatgatgtgcgggagaagcagaagaccctggtggagcagctgctgagcctgctgaacagcagccctggcccccccaccaggaagctgctggccaagaacctggccatcctgtacagcatcggggacaccttctctgtgcatgaggccatcgacaagtgcaatgacctgatccgcagcaaggatgacagccccagctacctgcccaccaagctggccgctgtggtgtgcctgggcagcctgtacaagaagctgggccgcatcctgggcaacaccttcacagacacagtgggcaacatcctgaaggccatgaagtctgctgagagccagggccgctatgagatcatgctgagcctgcagaacatcctgaatggcctgggcgctgctgctgccccctgccacagagatgtgtacaaggccgcccggagctgcctgacagaccgctccatggctgtgcgctgtgccgccgccaagtgcctgctggagctgcagaatgaggccatcttcatgtggagcacagacctggacagcgtggccaccctgtgcttcaagagctttgagggcagcaactatgatgtgcgcatctctgtgtccaagctgctgggcatcatcctggccaaggctgtgatcagcaagcaccctggaacagctgccagccggcagagcatcagaagagtgtccctggaggaggtgctggagctgctgggcaccggcttcctgcggggcagcagcggcttcctgcgggccagcggggacatgctgaagggcaccagctctgtgtccagagatgtgcgggtgggcgtgacccaggcctacgtggtgtttgtgtccaccctgggcggggcctggctggagaagaactttgctgccttcttcagccacatcctgagcctggccagccccagccaccccaaggccacccagacccagattgatgctgtgtgctgccgccgctgtgtgtccttcatcctgcggaccaccatcggcggcctgctgggggagaaggcccagctggccgctgtgaaggacatctgccaggccatctggaagctgaagaaggtgatggatgctgtgatgtctgatggcaacctggagacccggctgggcagcacagatgtggccgccagccagcacatgctggtgtgtgccctgcaggagctgggcaacctgatccacaacctgggcaccacagctgcccccctgctgcaggacagcagcacaggcctgctggacagcatcctgagcgtcatcctgcaccccagcatctctgtgcggctggccgccgcctggtgcctgcactgcatcgctgtggccctgcccagctacctgacccccctgctggaccgctgcctggagcggctgaccggccacaagagcagccctgaggccgtgacaggcttctcctttgctgtggccgccctgctgggcgctgtgaagcactgccccctgggcatcccccacggcaagggcaagatcatcatgaccctggccgaggacctgctgtgcagcgctgcccagaacagccggctgagcgcccagaggacccaggccggctggctgctgatcagcgccctgatgaccctgggccctgctgtggtgagccaccacctggcccgggtgctgctgctgtggaagtgtgtgtttcctgccagccccaaggacctggagacagagaagagcagaggagacagcttcacctggcaggtgaccctggagggccgggccggggccctgtgtgccatcaagagctttgtgagccactgtggggacctgctgacagaggaggtgacccagaggctgctgccccccctgccctgtgctgtggacctgctgacccagctgagcagcatcctgaagatgtatggcagccccctgaagacccccagcgtggtgtaccggcagaggctgtatgagctgctgatcctgctgcccccagagacctatgagggcaacctgtgtgccatcctgcgggagctggccgctgacctgacagccccagacatccaggtggccgccagcaccttcctgctgccccccctgtgccaccaggatgacctgctgatcctgagccccttcctgcaggagacagaccaccgcttcatcgaggagcagctgctgctgggcaatggagtggcctgtggcagcctggagtatgacccctacagcatctatgagaaggatgtggagggggacagcgtgcccaagcccctgcccccagccctgagcgtcatcagcagcgccagcaagctgtttggagtggtgtgtgcccacgtgggggagacccagaggctgctgatcctggagcagctgctggacagcatcaagcacaccaagggggcccggcagcaggtggtgcagctgcacgtggtgtcctctgtgagcagcttcctgaagtatgtggccggcagcaagggctgcctgggccctgaggagatgaagagatttgccctgaccctggtgatgggcgccctggagagccccaaccccctgctgcgctgtgccgctgctgagagctgggcccggctggcccaggtggtggatgatggagccttcaccgctggcctggcccaggtgtcctttgacaagctgaagagcgccagagatgtggtgaccaggacaggccacagcctggccctgggcagcctgcaccgctacctgggcggcatcagcagcagccagcacctgaacagctgcatcggcatcctgtacaccctggcccaggacagcaccagcccagatgtgcagacctgggccctgcacagcctgagcctcatcattgattctgctggccccctgtactacgtgcacgtggagcccaccctgagcctcatcatcatgctgctgctgaatgtgccccccacccatgctgaggtgcaccagagcctgggccgctgcctgaatgccctgatcaccaccctgggccctgagctgcagggcaacagcaccagcatcagcaccctgcggaccagctgcctgctgggctgtgctgtgatgcaggacaacccagactgcctggtgcaggcccaggccatcagctgcctgcagcagctgcacatgtttgcccccaggcatgtgaacctgagcagcctggtgtcctgcctgtgtgtgaacctgtgcagcccctacctgctgctgcggcgggctgtgctggcctgcctgcggcagctggtgcagcgggaggccgctgaggtgtctgagcacgctgtgatgctggccaaggacagccgggaggagctgaccccagatgccaacatccgggaggtgggcctggagggcgccctgctgatcctgctggacaaggagacagatgagcggctgtgccacgacatcaaggagaccctgaactacatgctgacctccatggctgtggagaagctgagcctgtggctgaagctgtgcaaggatgtgctggccgccagcgctgacttcaccgctgtgacctgtgtggacaccatgcaggaggaggagggggacaagggagatgatgcctctgtgctgaccaccaggagagatgagaagagccaccccttcaccaacccccgctgggccaccagggtgtttgctgctgaatgtgtgtgccgcatcatcaaccagtgtgaaaatgccaacagcgcccactttgacatcgccctggcccaggagatgaagaagagggacagcagaaatgacttcctggtgctgcacctggccgacctgatccgcatggccttcatggccgccacagaccacagcgaccagctgcggctgagcggcctggagatgctgctggtggtgatcagaagatttgccaccgtgcctgagcctgagttccctggccacgtgatcctggagcagtaccaggccaacgtgggcgccgccctgcggcctgccttcaccagcgagaccccaccagatgtgacagccaaggcctgccaggtgtgcagcgcctggatcgccagcggcgtggtgtctgacctgaatgacctgcggcgggtgcaccagctgctggtgagcagcctgaccaagatccaggccggcaaggaggccctgagccacctgtacaatgaaagtgccagcaccatggagatcctggccgtgctgaaggcctgggccgaggtgtacatcatcgctgtgcagaggcacaagaaccaccggcagcccctgaagaccaccacctgcctggaggatggcatcagaaatggcagctgcagcagtgatggcctgctggacctggtgtatgctgacctgggcaccctgagccggctgtggctggccgccctgcaggactttgccctgctgaccctgcccagcgagtttgccagccagctgcctgctgagggcggggccttctacacagctgagaccagtgaaaatgccaagctgcactactacaacagctgggccctgatcctgcacgccacagccctgtggctgaccagcactggatttgtggtggccgaccctgatgaaggagccagcaacctgagcaggcctgtgacccccacctccatgtgccagggcagcagcagcggggccaccatcaagagcccagaagatgtgtacacagaccgcttccacctgatcctgggcatctctgtggagttcctgtgcagcctgcggagtgatgccaccatggagagcatcacagcctgcctgcacgccctgcaggccctgctggatgtgccctggcccaggagcaagattggaagtgaccaggacctgggcatcgagctgctgaatgtgctgcacagggtcatcctgacccgggagagccccagcatccagctggccagcctggaggtggtgcggcagatcatctgtgccgcccaggagcacgtgaaggagaagagaagatctgctgaggtggatgatggagctgctgagaaggagaccctgcctgagtttggagagggcaaggacacaggaggcctggtgcctgggaagagcctggtgtttgccaccctggagctgtgtgtgtgcatcctggtgcggcagctgcctgagctgaaccccaagctgaccggcagccctggggtgaaggccaccaagccccagatcctgctggaggatggcagccggctggtgtctgctgccctggtgatcctgtctgagctgcctgctgtgtgcagccctgagggcagcatcagcatcctgcccaccatcctgtacctgaccatcggcgtgctgcgggagacagctgtgaagctgcccggcggccagctgagcagcacagtggccgccagcctgcaggccctgaagggcatcctgagcagccccatggcccgggcagagaagagcaggacagcctggacagacctgctgcggagcgccctgaccaccatcctggactgctgggaccctgtggatgagacccaccaggagctggatgaggtgtccctgctgacagccatcaccgtcttcatcctgagcaccagccctgaggtgaccaccatcccctgcctgcagaagcgctgcatcgacaagttcaaggccaccctggagatcaaggaccctgtggtgcagatcaagacctaccagctgctgcacagcatcttccagtaccccaacccagctgtgtcctacccctacatctacagcctggccagctgcatcatggagaagctgcaggagattgacaagaggaagccagagaacacagctgagctggagatcttccaggagggcatcaaggtgctggagaccctggtgacagtggccgaggagcaccaccgggcccagctggtggcctgcctgctgcccatcctgatctccttcctgctggatgagaacagcctgggcagcgccaccagcatcatgaggaacctgcatgactttgccctgcagaacctgatgcagatcggcccccagtacagctctgtgttcaagagcctggtggccagcagccctgccctgaaggcccggctggaggccgccatcaagggcaaccaggagagcgtgaaggtgaagatccccaccagcaagtacaccaagagccctgggaagaacagcagcatccagctgaagaccagcttcctgtag

SEQ ID NO: 39220 - DNA, 2223 bp, Artificial Sequence
  Description of Artificial Sequence: Synthetic coding sequence
atggccgccttcagcgagatgggcgtgatgcctgagatcgcccaggccgtggaggagatggactggctgctgcccacagacatccaggccgagagcatccccctcatcctgggcggcggagatgtgctgatggctgctgagaccggcagcggcaagacaggagccttcagcatccctgtgatccagatcgtgtatgagaccctgaaggaccagcaggagggcaagaagggcaagaccaccatcaagacaggagcctctgtgctgaacaagtggcagatgaacccctatgaccggggcagcgcctttgccatcggcagtgatggcctgtgctgccagagccgggaggtgaaggagtggcacggctgccgggccaccaagggcctgatgaagggcaagcactactatgaggtgtcctgccacgaccagggcctgtgccgggtgggctggagcaccatgcaggccagcctggacctgggcacagacaagtttggatttggatttggaggcaccgggaagaagagccacaacaagcagtttgacaactacggggaggagttcaccatgcatgacaccatcggctgctacctggacatcgacaagggccacgtgaagttcagcaagaatggcaaggacctgggcctggcctttgagatccccccccacatgaagaaccaggccctcttccctgcctgtgtgctgaagaatgctgagctgaagttcaactttggagaggaggagttcaagttcccccccaaggatggctttgtggccctgagcaaggccccagatggctacatcgtgaagagccagcacagcggaaatgcccaggtgacccagaccaagttcctgcccaatgcccccaaggccctgattgtggagcccagccgggagctggccgagcagaccctgaacaacatcaagcagttcaagaagtacatcgacaaccccaagctgcgggagctgctgatcatcggcggcgtggccgcccgggaccagctgtctgtgctggagaatggagtggacatcgtggtgggcaccccaggccgcctggatgacctggtgtccacaggcaagctgaacctgagccaggtgcgcttcctggtgctggatgaagcagatggcctgctgagccagggctacagcgacttcatcaacaggatgcacaaccagatcccccaggtgaccagtgatggcaagaggctgcaggtgattgtgtgcagcgccaccctgcacagctttgatgtgaagaagctgtctgagaagatcatgcacttccccacctgggtggacctgaagggggaggacagcgtgcctgacacagtgcaccacgtggtggtgcctgtgaaccccaagacagaccggctgtgggagcggctgggcaagagccacatcagaacagatgatgtgcacgccaaggacaacaccaggcctggggccaacagccctgagatgtggagcgaggccatcaagatcctgaagggggagtatgctgtgcgggccatcaaggagcacaagatggaccaggccatcatcttctgcaggaccaagattgactgtgacaacctggagcagtacttcatccagcagggcggcggccctgacaagaagggccaccagttcagctgtgtgtgcctgcacggggacaggaagccccatgagaggaagcagaacctggagcgcttcaagaagggagatgtgcgcttcctgatctgcacagatgtggccgcccggggcatcgacatccacggcgtgccctacgtgatcaacgtgaccctgcctgatgagaagcagaactacgtgcacagaattggccgggtgggccgggcagagaggatgggcctggccatcagcctggtggccacagagaaggagaaggtgtggtaccacgtgtgcagcagccggggcaagggctgctacaacacccggctgaaggaggatggcggctgcaccatctggtacaatgagatgcagctgctgtctgaaattgaggagcacctgaactgcaccatcagccaggtggagccagacatcaaggtgcctgtggatgaatttgatggcaaggtgacctacggccagaagagagctgctgggggcggcagctacaagggccacgtggacatcctggcccccaccgtgcaggagctggccgccctggagaaggaggcccagaccagcttcctgcacctgggctacctgcccaaccagctgttccgcaccttctag

SEQ ID NO: 39221 - DNA, 5949 bp, Artificial Sequence
  Description of Artificial Sequence: Synthetic coding sequence
atggagctggcccacagcctgctgctgaatgaggaggccctggcccagatcacagaggccaagaggcctgtgttcatctttgagtggctgcgcttcctggacaaggtgctggtggccgccaacaagacagatgtgaaggagaagcagaagaagctggtggagcagctgaccggcctcatcagcagcagccctggcccccccaccaggaagctgctggccaagaacctggccgccctgtacagcatcggggacaccttcaccgtcttccagaccctggacaagtgcaatgacatcatccggaacaaggatgacacagctgcctacctgcccaccaagctggccgctgtggcctgtgtgggcgccttctatgagaagatgggccgcatgctgggcagcgccttccctgagaccgtgaacaacctgctgaagagcctgaagtctgctgagagccagggccgctctgagatcctgatgagcctgcagaaggtgctgagcggcctgggcggcgctgctgccagcagccaccgggacatctacaagaatgcccggagcctgctgacagaccgctccatggctgtgcgctgtgctgtggccaagtgcctgctggagctgcagaatgaggccgtgttcatgtggacagctgagctggagaacatcgccaccctgtgcttcaaggccctggagaacagcaactacggcgtgcgggtggccgtgtccaagctgctgggcaccgtgatggccacagccctgatgcccaagcaggccaccgtgatgaggcagaatgtgaagagggccacctttgatgaggtgctggagctgatggccaccggcttcctgcggggcggcagcggcttcctgaagagcggcggggagatgctgaaggtgggcggctctgtgaaccgggaggtgcgggtgggcgtgacccaggcctacgtggtgtttgtgaccaccctgggcggccagtggctggagaggagctttgccaccttcctgagccacgtgctggacctggtgagccacccccgggccacccagacccacgtggaggccgtgtacagccgccgctgtgtgtccttcatcctgcgggccaccgtgggcagcctgctgggggagaaggcccagattgctgctgccaaggagatctgccaggccatcggcaagcagatgaaggctgtggaggccgtggtgaatgacaccagcggggagaacaagtctggagctgctgacattgctgccagccagcacgtgatggtgtgtgccctgcaggagctgggcagcctggtgcagagcctgaatgccacagccagccccctcatccaggaggccagcatcggcctgctggagatcgtgacctctgtgctgctgcaccccagcatggccgcccggctggccgccgcctggtgcctgcgctgtgtggccgtggccctgcccttccagctgacccccttcctggacagatgtgccgagcggctgaacaacctgaagaccagccctgaggccgtgtctggctacagctttgccatggccgccctgctgggcggcgtgcaccagtgccccctgggcatcccccacgccaagggcaagatggtggtgtccattgctgaggacctgctgaggacagctgcccagaacagccggctgagcctgcagaggacccaggccggctggctgctgctgggcgccctgatgaccctgggccccagcgtggtgcgctaccacctgcccaagatgctgctgctgtggagaaatgtgttccccaggagcctgaaggagctggaggccgagaaggcccggggggacagcttcacctggcaggtgaccctggagggccgggccggggccctgtgtgccatgaggagctttgtggcccactgcccagagctgctgacagaagatgtgatcaggaagctgatgacccccattgaatgtgccatgaccatgatgagccacatccccagcgtgatgaaggcccacggggcccacctgaaggccagcgctgccatggtgcggctgcggctgtatgacatcctggccctgctgccccccaagacctatgagggcagcttcaatgccctgctgcgggagctggtggccgagttcaccctgacagacaacagcgccaacaccaccaccagcctgctgcggagcctgtgccactatgatgattctgtgctgctgggctcctggctgcaggagacagaccacaagagcattgaggaccagctgcagcccaacagcgccagcggcagcggggccctggagcatgaccccagcagcatctacctgcgcatcccagctggggaggccgtgcccggccccctgcccctgggcgtgtctgtgattgatgcctctgtggccctgtttggagtggtgttcccccacgtgtcctacaagcaccggctgcagatgctggaccactttgctgaatgtgtgaagcaggccaagggcgtgcggcagcaggccgtgcagctgaacatcttcaccgctgtgctgagcgccctgaagggcctggccgagaacaagagcaccctgggccctgaggaggtgaggaagagcgccctgaccctggtgatgggccccctggacaaccccaaccccatcctgcgctgtgccgccggggaggccctgggccgcatggcccaggtggtgggggaggccaccttcatcgccaggatggcccagtacagctttgacaagctgaagagcgccagagatgtggtgtccaggacaggccacagcctggccctgggctgcctgcaccgctacgtgggcggcatcggcagcggccagcacctgaagacctctgtgtccatcctgctggccctggcccaggacggcaccagccctgaggtgcagacctggagcctgcacagcctggccctgattgtggacagcagcggccccatgtaccggggctacgtggagcccaccctgagcctggtgctgaccctgctgctgactgtgccccccagccacacagaggtgcaccagtgcctgggccgctgcctgggcgccatcatcaccaccgtgggccctgagctgcagggcaatggagccaccaccagcaccatccgcagcagctgcctggtgggctgtgccatcacccaggaccacagcgacagcctggtgcaggccgccgccatcagctgcctgcagcagctgcacatgtttgcccccaggcatgtgaacctgagcagcctggtgcccagcctgtgtgtgcacctgtgcagcagccacctgctgctgcggcgggctgctgtggcctgcctgcggcagctggcccagcgggaggccgctgaggtgtgtgaatatgccatgagcctggccaagaacacaggagacaaggagagcagcagcgccaacgtgagcccctttgcccctggggtgagcagcaggacagacatccactgccgccaccagggcgtgaacatcacagaaacaggcctggagggcctgctgtttggcatgctggaccgggagacagacaggaagctgtgcagcgacatccatgacaccctgggccacatgctgagcagcctggccgtggagaagctgagccactggctgatgctgtgcaaggatgtgctggccgccagcagtgacatgagcacagccaccctgctgagcagcggcaaggatgaggaggccgagaagaaggatgagatggatgatgacaccatgttcaccaccctgggggaggaggacaagagcaagccctttgtggccccccgctgggccaccagggtgtttgctgctgactgcctgtgccgcatcatcaacctgtgtgaaaatgctgaccaggcccactttgacctggccctggcccggagcgccaagctgaggaaccccaccaatgacctgctggtgctgcacctgagtgacctgatccgcatggccttcatggccgccacagaccacagcaaccagctgaggatggccggcctgcaggccctggaggacatcatcaagaagtttgcctctgtgcctgagcctgagttccctggccacgtgatcctggagcagtaccaggccaacgtgggcgccgccctgcggcctgccttcagccaggacacccccagcgacatcatcgccaaggcctgccaggtgtgcagcacctggattggcagcggcgtggtgtctgacctgaatgacctgcggcgggtgcacaacctgctggtgagcagcctggacaaggtgcaggccggcaagggcagcagcagccagctgtaccgggagagcgccaccaccatggagaagctggccgtgctgaaggcctgggccgaggtgtatgtggtggccatgaacatcaagaaggaggccgagagcaagcccaagagggccatcaagaacacagatgatgatgatgatgactgtggcaccattgatgagctgcccccagacagcctcatcaccctggtgcagcctgagctgcccaccctgagccggctgtggctggccgccctgaaggactatgccctgctgaccctgcctgctgagttcagcagccagctgcccccagatggaggagccttctacaccccagagaccatcgacacagcccggctgcactacagaaattcctgggcccccatcctgcatgctgtggccctgtggctgaacagcacaggcttcacctgcagcgagagcacagaggccgccgccatcagcggcctgcagaagaggagcacctctgtgaacctgaaccaggccagcggggctgtgggcagcgccaagagcctgcctgagatcaacaaggacaggatgcacctgatcctgggcgtgtccatccagttcctgtgcagccccaggcctgaggagcccatcgagcacgtgacagcctgcctgcaggccctgcacaccctgctggacagcccctatgcccgggtgcacatcgccgaggaccagctgattggagtggagctgctgtctgtgctgcaccggctgctgctgacctggaaccccagctctgtgcagctgctggtgactggagtggtgcagcagatcgtgcgggccgcccaggactacctgcaggagaagaggaacaccctgcgctgcatgaccatcctgcccaccatcctcttcctgattgcccgcatcctgaaggacacagccatcaagtctgctgacaaccaggtgcccccacctgtgtctgctgccctgcagggcatcaagagcatcgtgaccctgtccatggccaagacagaggccggcgtgcagaagcagtggacagccctgatccgcagcaccctggcctgcatcctggagtacagccagcctgaggacagcgtgcccaccccagatgaggtgtccatgctgacagccatcgccctcttcctgtggagcgccagcaatgagatcattggagtgcagagcctgcagaatggctgcatgaaccgcttcaagaatgccctgaacagctgtgacccctgggtgcaggccaagtgctaccagctgctgctgtctgtgttccagcacagcaacagagccctgagcaccccctacatccacagcctggcccccatcgtggtggagaagctgaaggctgtggagaggaacagacctgccagcaacatcgagctgctggccgtgcaggagggcatcaaggtgctggagaccctggtggccctgggggaggagcagaacagagtgcagctgctggccctgctggtgcccaccctcatctcctacctgctggatgagaacagctttgccagcgccagcagcgccagcaaggacctgcacgagtttgccctgcagaacctgatgcacatcggccccctgtacccccacgccttcaagacagtgatgggcgccgcccctgagctgaaggtgcggctggagacagctgtgcgggccagccaggccagcaaggccaaggctgctgcccggcagcctgccccagccatccacagcgcccccaccatcaagctgaagaccagcttcttctag

SEQ ID NO: 39222 - DNA, 2307 bp, Artificial Sequence
  Description of Artificial Sequence: Synthetic coding sequence
atggagctggcccacagcctgctgctgaatgaggaggccctggcccagatcacagaggccaagaggcctgtgttcatctttgagtggctgcgcttcctggacaaggtgctggtggccgccaacaagacagatgtgaaggagaagcagaagaagctggtggagcagctgaccggcctcatcagcagcagccctggcccccccaccaggaagctgctggccaagaacctggccgccctgtacagcatcggggacaccttcaccgtcttccagaccctggacaagtgcaatgacatcatccggaacaaggatgacacagctgcctacctgcccaccaagctggccgctgtggcctgtgtgggcgccttctatgagaagatgggccgcatgctgggcagcgccttccctgagaccgtgaacaacctgctgaagagcctgaagtctgctgagagccagggccgctctgagatcctgatgagcctgcagaaggtgctgagcggcctgggcggcgctgctgccagcagccaccgggacatctacaagaatgcccggagcctgctgacagaccgctccatggctgtgcgctgtgctgtggccaagtgcctgctggagctgcagaatgaggccgtgttcatgtggacagctgagctggagaacatcgccaccctgtgcttcaaggccctggagaacagcaactacggcgtgcgggtggccgtgtccaagctgctgggcaccgtgatggccacagccctgatgcccaagcaggccaccgtgatgaggcagaatgtgaagagggccacctttgatgaggtgctggagctgatggccaccggcttcctgcggggcggcagcggcttcctgaagagcggcggggagatgctgaaggtgggcggctctgtgaaccgggaggtgcgggtgggcgtgacccaggcctacgtggtgtttgtgaccaccctgggcggccagtggctggagaggagctttgccaccttcctgagccacgtgctggacctggtgagccacccccgggccacccagacccacgtggaggccgtgtacagccgccgctgtgtgtccttcatcctgcgggccaccgtgggcagcctgctgggggagaaggcccagattgctgctgccaaggagatctgccaggccatcggcaagcagatgaaggctgtggaggccgtggtgaatgacaccagcggggagaacaagtctggagctgctgacattgctgccagccagcacgtgatggtgtgtgccctgcaggagctgggcagcctggtgcagagcctgaatgccacagccagccccctcatccaggaggccagcatcggcctgctggagatcgtgacctctgtgctgctgcaccccagcatggccgcccggctggccgccgcctggtgcctgcgctgtgtggccgtggccctgcccttccagctgacccccttcctggacagatgtgccgagcggctgaacaacctgaagaccagccctgaggccgtgtctggctacagctttgccatggccgccctgctgggcggcgtgcaccagtgccccctgggcatcccccacgccaagggcaagatggtggtgtccattgctgaggacctgctgaggacagctgcccagaacagccggctgagcctgcagaggacccaggccggctggctgctgctgggcgccctgatgaccctgggccccagcgtggtgcgctaccacctgcccaagatgctgctgctgtggagaaatgtgttccccaggagcctgaaggagctggaggccgagaaggcccggggggacagcttcacctggcaggtgaccctggagggccgggccggggccctgtgtgccatgaggagctttgtggcccactgcccagagctgctgacagaagatgtgatcaggaagctgatgacccccattgaatgtgccatgaccatgatgagccacatccccagcgtgatgaaggcccacggggcccacctgaaggccagcgctgccatggtgcggctgcggctgtatgacatcctggccctgctgccccccaagacctatgagggcagcttcaatgccctgctgcgggagctggtggccgagttcaccctgacagacaacagcgccaacaccaccaccagcctgctgcggagcctgtgccactatgatgattctgtgctgctgggctcctggctgcaggagacagaccacaagagcattgaggaccagctgcagcccaacagcgccagcggcagcggggccctggagcatgaccccagcagcatctacctgctgctcttcctggtgcactag

SEQ ID NO: 39223 - DNA, 3546 bp, Artificial Sequence
  Description of Artificial Sequence: Synthetic coding sequence
atggctgctgtgcaggtggtgggctcctggcccagcgtgcagccccgggaggccccccgggaggccatccctgagagaggaaatggcttccggctgctgagcgcccggctgtgtgccctgcggccagatgacagcagcagcgccaggacagagatccacctgctgtttgaccagctgatcagcgagaactacagcgagggcagcggcgtggccccagaagatgtgtctgccctgctggtgcaggcctgccgcctggtgcccctgaaccagaaccacctggtgtccaaggtgtcccagctgatccaccacctgctgaaccggctgcaggtgattgtggatgagcagcacctggacttcctgctggcctacaccatcagcgccatccaccagtgcagctcctggacccaccgggagatcctgcaggccctggccgccctggtgtactgcaatggcagcaagtgccagaagtacctgcctgagctgctgggcaacacaggcctgctgatgaagctgagtgacctggcccagagcgaccctgaggtgcggcgggctgctgtgcactgcatggccaacctgtgcctgtctgtgcccggccagccctacctggaggagccctaccagaatgtgtgcttccaggccttcctgaccatcctgcagagccccaagagcagtgacatggatgacatcaccttctgcatgctgctgcagaatgccctgaagggcatccagagcctgctgaatggaggccgcatgaagctgacccagacagatgagctgggcgccctgctggccgtgctgaagaagttcatgttccacggcctgcccggcctgaacatcgagatgcccaccgtgctgtaccccacccccctgccccagtatgatggccgcacccccatcaagccccagcagagcgagagcagcgccagccggcccaccctgaacaagaagaagaagagcaaggtgaagcccaagaagatccagcagggcgaggaggaggagaaggagagcagtggagaaattgaggccgcccctgtgacaggcaccggccgggtgaacctgcacgagggcaacacctggtgccccagcagcctgggcgtgcagagcctgcccctggatggcagcggggctgctgagaaggatggagtgagcagcagcttcagcagcagctcctggaagagggtgagcagcagcgagagtgacttcagtgatgctgagggcggcatgcagagcaagatgaggagctaccaggccaaggtgcggcagggcgccctggtgtgcttcctgagcaccatcaagagcattgagaagaaggtgctgtatggctactggagcgccttcatcccagacaccccagagctgggcagcccccagagcgtgtccctgatgaccctgaccctgaaggaccccagccccaagacccgggcctgtgccctgcaggtgctgagcgccatcctggagggcagcaagcagttcctgtctgtggccgaggacaccagtgaccaccggcgggccttcacccccttctctgtgatgattgcctgcagcatccgggagctgcaccgctgcctgctgctggccctggtggccgagagcagcagccagacagtgacccagatcatcaagtgcctggccaacctggtgtccaatgccccctatgaccggctgaagctgagcctgctgaccaaggtgtggaaccagatcaagccctacatccgccacaaggatgtgaatgtgcgggtgagcagcctgaccctgctgggcgccatcgtgtccacccacgcccccctgcctgaggtgcagctgctgctgcagcagccctgcagcagcggcctgggcaacagcaacagcgccaccccccacctgagccccccagactggtggaagaaggccccagctggccccagcctggaggagacctctgtgagcagccccaagggcagcagcgagccctgctggctgatccggctgtgcatcagcatcgtggtgctgcccaaggaggacagctgcagcggcagtgatgctggcagcgctgctggcagcacctatgagcccagccccatgaggctggaggccctgcaggtgctgaccctgctggcccggggctacttctccatgacccaggcctacctgatggagctgggggaggtgatctgcaagtgcatgggagaggccgaccccagcatccagctgcatggagccaagctgctggaggagctgggcaccggcctcatccagcagtacaagccagacagcacagctgccccagaccagagggcccctgtgttcctggtggtgatgttctggaccatgatgctgaatggccccctgccccgggccctgcagaacagcgagcaccccaccctgcaggccagcgcctgtgatgccctgagcagcatcctgcctgaggccttcagcaacctgcccaatgaccggcagatgctgtgcatcaccgtgctgctgggcctgaatgacagcaagaaccggctggtgaaggccgccaccagccgggccctgggcgtgtatgtgctcttcccctgcctgcggcaggacgtcatctttgtggctgatgctgccaatgccatcctgatgagcctggaggacaagagcctgaatgtgcgggccaaggccgcctggagcctgggcaacctgacagacaccctcatcgtgaacatggagaccccagaccccagcttccaggaggagttcagcggcctgctgctgctgaagatgctgcggagcgccatcgaggccagcaaggacaaggacaaggtgaagagcaatgctgtgcgggccctgggcaacctgctgcacttcctgcagcccagccacatcgagaagcccacctttgctgagatcatcgaggagagcatccaggccctgatcagcacagtgctgacagaggccgccatgaaggtgcgctggaatgcctgctacgccatgggaaatgtgttcaagaacccagccctgcccctgggcacagccccctggaccagccaggcctacaatgccctgacctctgtggtgaccagctgcaagaacttcaaggtgcgcatccgctctgctgctgccctgtctgtgcctgggaagcgggagcagtatggctctgtggaccagtatgcccgcatctggaatgccctggtgacagccctgcagaagtctgaggacaccatcgacttcctggagttcaagtactgtgtgtccctgcggacccagatctgccaggccctgatccacctgctgagcctggccagcgccagtgacctgccctgcatgaaggagaccctggagctgagcggcaacatggtgcagagctacatcctgcagttcctgaagagcggggctgaaggagatgacacaggagccccccacagcccccaggagcgggaccagatggtgaggatggccctgaagcacatgggcagcatccaggcccccaccggggacacagcccggcgggccatcatgggcttcctggaggagatcctggccgtgtgctttgacagcagcggcagccagggcgccctgcccggcctgaccaaccagtag

SEQ ID NO: 39224 - DNA, 2751 bp, Artificial Sequence
  Description of Artificial Sequence: Synthetic coding sequence
atgagcaagtacctgcctgagctgctgggcaacacaggcctgctgatgaagctgagtgacctggcccagagcgaccctgaggtgagaagagctgctgtgcactgcatggccaacctgtgcctgtctgtgcccggccagccctacctggaggagccctaccagaatgtgtgcttccaggccttcctgaccatcctgcagagccccaagagcagtgacatggatgacatcaccttctgcatgctgctgcagaatgccctgaagggcatccagagcctgctgaatggaggccgcatgaagctgacccagacagatgagctgggcgccctgctggccgtgctgaagaagttcatgtttcatggcctgcccggcctgaacatcgagatgcccaccgtgctgtaccccacccccctgccccagtatgatggccgcacccccatcaagccccagcagagcgagagcagcgccagccggcccaccctgaacaagaagaagaagagcaaggtgaagcccaagaagatccagcagggcgaggaggaggagaaggagagcagcggggagattgaagctgcccctgtgactggaacaggccgggtgaacctgcacgagggcaacacctggtgccccagcagcctgggcgtgcagagcctgcccctggatggcagcggggctgctgagaaggatggagtgagcagcagcttcagcagcagctcctggaagagggtgagcagcagcgagagtgacttcagtgatgctgagggcggcatgcagagcaagatgaggagctaccaggccaaggtgcggcagggcgccctggtgtgcttcctgagcaccatcaagagcattgagaagaaggtgctgtatggctactggagcgccttcatcccagacaccccagagctgggcagcccccagagcgtgtccctgatgaccctgaccctgaaggaccccagccccaagacccgggcctgtgccctgcaggtgctgagcgccatcctggagggcagcaagcagttcctgtctgtggccgaggacaccagtgaccacagaagagccttcacccccttctctgtgatgattgcctgcagcatccgggagctgcaccgctgcctgctgctggccctggtggccgagagcagcagccagacagtgacccagatcatcaagtgcctggccaacctggtgtccaatgccccctatgaccggctgaagctgagcctgctgaccaaggtgtggaaccagatcaagccctacatccgccacaaggatgtgaatgtgcgggtgagcagcctgaccctgctgggcgccatcgtgtccacccacgcccccctgcctgaggtgcagctgctgctgcagcagccctgcagcagcggcctgggcaacagcaacagcgccaccccccacctgagccccccagactggtggaagaaggccccagctggccccagcctggaggagacctctgtgagcagccccaagggcagcagcgagccctgctggctgatccggctgtgcatcagcatcgtggtgctgcccaaggaggacagctgcagcggcagtgatgctggcagcgctgctggcagcacctatgagcccagccccatgaggctggaggccttcagcaacctgcccaatgaccggcagatgctgtgcatcaccgtgctgctgggcctgaatgacagcaagaaccggctggtgaaggccgccaccagccgggccctgggcgtgtatgtgctcttcccctgcctgcggcaggatgtgatctttgtggctgatgctgccaatgccatcctgatgagcctggaggacaagagcctgaatgtgcgggccaaggccgcctggagcctgggcaacctgacagacaccctgattgtgaacatggagaccccagaccccagcttccaggaggagttcagcggcctgctgctgctgaagatgctgcggagcgccatcgaggccagcaaggacaaggacaaggtgaagagcaatgctgtgcgggccctgggcaacctgctgcacttcctgcagcccagccacatcgagaagcccacctttgctgagatcatcgaggagagcatccaggccctgatcagcacagtgctgacagaagctgccatgaaggtgcgctggaatgcctgctacgccatgggaaatgtgttcaagaacccagccctgcccctgggcacagccccctggaccagccaggcctacaatgccctgacctctgtggtgaccagctgcaagaacttcaaggtgcgcatccgctctgctgctgccctgtctgtgcctgggaagcgggagcagtatggctctgtggaccagtatgcccgcatctggaatgccctggtgacagccctgcagaagtctgaggacaccatcgacttcctggagttcaagtactgtgtgtccctgcggacccagatctgccaggccctgatccacctgctgagcctggccagcgccagtgacctgccctgcatgaaggagaccctggagctgagcggcaacatggtgcagagctacatcctgcagttcctgaagtctggagcagaaggagatgacaccggggccccccacagcccccaggagcgggaccagatggtgaggatggccctgaagcacatgggcagcatccaggcccccactggagacacagcccggcgggccatcatgggcttcctggaggagatcctggccgtgtgctttgacagcagcggcagccagggcgccctgcccggcctgaccaaccagtag

SEQ ID NO: 39225 - DNA, 4926 bp, Artificial Sequence
  Description of Artificial Sequence: Synthetic coding sequence
atgacagagagctccatgaagaagctggccagcaccctgctggatgccatcacagacaaggaccccctggtgcaggagcaggtgtgcagcgccctgtgcagcctgggggaggcccggcctgtggagaccctgcgggcctgtgaggagtacctgcggcagcacgacaagctggcccacccctacagagctgctgtgctgcgggccatggagcgggtgctgagcagccgggccagcgagctggacaaggacacagccagcaccatcatcctgctggccagcagcgagatgaccaagaccaaggacctggtgtgggactggcagcaggccgccagcggcgtgctggtggccgtgggccggcagttcatcagcaaggtgatggaggagctgctgcggcggctgcaccctggcaccctgccccactgtgctgtgctgcacaccctggccagcctgtctgtggccaatgccttcggcgtggtgcccttcctgcccagcgtgctgagcagcctgctgcctgtgctgggcgtggccaagcaggacacagtgcgggtggccttctgcagcgccctgcagcgcttcagcgagggcgccctggagtacctggccaacctggaccgggccccagaccccaccgtgaggaaggatgcctttgccacagacatcttcagcgcctatgatgtgctcttccaccagtggctgcagagccgggaggccaagctgcggctggccgtggtggaggccctgggccccatgagccacctgctgcccagcgagcggctggaggagcagctgcccaagctgctgcccggcatcctggccctgtacaagaagcacgccgagaccttctacctgagcaagagcctgggccagatcctggaggccgctgtgtctgtgggcagcaggaccctggagacccagctggatgccctgctggccgccctgcacagccagatctgtgtgcctgtggagagcagcagccccctggtgatgagcaaccagaaggaggtgctgcgctgcttcaccgtgctggcctgcagcagcccagaccggctgctggccttcctgctgccccggctggacaccagcaatgaaagaaccagggtgggcaccctgcaggtggtgagacatgtgatcaacagcgctgctgcccagatggaggacaagaagcccttcatcctgagctccatgaggctgcccctgctggacaccaacagcaaggtgaagagagctgtggtgcaggtgatcagcgccatggcccaccacggctacctggagcagcccggcggggaggccatgattgagtacatcgtgcagcagtgtgccctgcccccagagcaggagcctgagaagccaggccctggcagcaaggaccccaaggctgacagcgtgcgggccatctctgtgaggaccctgtacctggtgtccaccaccgtggacaggatgagccacgtgctgtggccctacctgctgcagttcctgacccctgtgcgcttcaccggggccctgacccccctgtgccgcagcctggtgcacctggcccagaagaggcaggaggccggggctgatgccttcctgatccagtatgatgcccacgccagcctgcccagcccctatgctgtgacaggccgcctgctggtggtgagcagcagcccctacctgggagatggccgcggggctgctgccctgcggctgctgtctgtgctgcaccccaacatccaccccctgctgggccagcactgggagaccaccgtgcccctgctgctgggctacctggatgagcacacagaggagaccctgccccaggaggagtgggaggagaagctgctgatgttcctgcgggacaccctggccatcatcagtgacaatgcctggatctgccagctgagcctggagctgtgccggcagctgccctgctatgatgaggccccccaggagaagaacttcctgtacaagtgcatcggcaccaccctgggcgccgccagcagcaaggaggtggtgaggaagcacctgcaggagctgctggagacagcccgctaccaggaggaggccgagcgggagggcctggcctgctgcttcggcatctgtgccatcagccacctggaggacaccctggcccagctggaggactttgtgcgctctgaggtgttcaggaagagcatcggcatcctgaacatcttcaaggacagaagtgaaaatgaggtggagaaggtgaagagcgccctgatcctgtgctacggccacgtggccgcccgggccccccgggagctggtgctggccaaggtggagagtgacatcctgaggaacatctgccagcacttcagcaccaaggtgctgggcatcaaggtggagaccaaggaccctgccctgaagctgtgcctggtgcagagcgtgtgcatggtgtcccgggccatctgcagcagcacccaggccggcagcttccacttcaccaggaaggccgagctggtggcccagatgatggagttcatccgggcagagcccccagacagcctgcggacccccatcaggaagaaggccatgctgacctgcacctacctggtgtctgtggagcccgccctggatgagcaggcccgggcagatgtgatccacggctgcctgcacagcatcatggccctgctgcctgagcccaaggaggaggatggcggctgccagaagagcctgtacctggagaccctgcacgccctggaggacctgctgaccagcctgctgcagaggaacatgaccccccagggcctgcagatcatgattgagcacctgagcccctggatcaagagcccccggggccacgagcgggcccgggccctgggcctgagcgccctgctgctgcgctacttcctggagcacctgcgggtgtctgccctggtgcccttccacaacctgggcctgctgattggcctcttcagcccccgctgtgccgacctgtggccagccacccggcaggaggccgtggactgtgtgtacagcctgctgtacctgcagctgggctatgagggcttcagccgggactacagagatgatgtggccgagcggctgctgagcctgaaggatggcctggtgcacccagaccctgccatcctcttccacacctgccacagcgtgggccagatcatcgccaagaggctgcccccagaccagctgatcagcctgctgctgaccatgtttgaggccctgggggaccctgagaagaactgcagccgggccgccaccgtgatgatcaactgcctgctgcaggagcggggcggcgtgctgcaggagaaggtgcctgagatcgtgtctgtgctgcggagcaagctgcaggaggcccagggcgagcacgtgctgcctgctgcccagcacagcgtgtacctgctggccacccagcactgtgccgctgtggtgagcagcctgctgggcagccccctgcccctggacagccacacctgcatgctgtggagggccctggccgtggagccccggctggccgcccaggtgctgggcctgctgctggagaagatgagcagagatgtgcccttcaaggagagccgggccttcctgctgggccgcaccccagacagagtggccaccctgctgcccctgagcgccacctgtgccctgtttgaggtgatgagcaccccagctgctggccctgctgtgctggagctgtacccccagctgtttgtggtgctgctgctgcgggtgtcctgcaccgtgggcgtgcagctgcccaggaacctgcaggcccaggagcggcggggggccagccctgccctggccaccaggaacctggagccctgcagcagcgctgtggacaccctgcgctccatgctgctgcggagcggctctgaagatgtggtgcagaggatggacctggagggcggctgggagctgctgcggaccagcgctggccacgaggagggcgccacccggctggcccgggccatggccgagcacgccggcccccggctgcccctggtgctgaagaccctggcctgcacccacagcagcgcctatgagaaccagagggtgaccaccacagccttcctggccgagctgctgaacagcaatgtggccaatgacctgatgctgctggacagcctgctggagagcctggccgcccggcagaaggacacctgtgcctctgtgcggcggctggtgctgcggggcctggccaacctggccagcggctgcccagacaaggtgaggacccacggcccccagctgctgacagccatgattggaggcctggatgatggagacaacccccacagccctgtggccctggaggccatgctgggcctggcccggctggtgcacctggtggagagctgggacctgcggagcggcctgctgcacgtggccatccgcatccggcccttctttgacagcgagaagatggagttcagaacagccagcatccggctgtttggccacctgaacaaggtgtgccacggggactgtgaagatgtgttcctggaccaggtggtgggcggcctggcccccctgctgctgcacctgcaggacccccaggccaccgtggccagcgcctgccgctttgccctgaggatgtgtggccccaacctggcctgtgaggagctgtctgctgccttccagaagcacctgcaggagggccgggccctgcactttggagagttcctgaacaccacctgcaagcacctgatgcaccacttcccagacctgctgggccgcctgctgaccacctgcctcttctacttcaagagctcctgggagaatgtgcgggccgccgcccccctcttcaccggcttcctggtgctgcacagcgagccccggcagcagccccaggtggacctggaccagctgattgctgccctgcagatcctgctgaaggaccctgcccctgaggtgaggaccagggctgctgaggccctgggccgcctggtgaagctggcctag

SEQ ID NO: 39226 - DNA, 1023 bp, Artificial Sequence
  Description of Artificial Sequence: Synthetic coding sequence
atggagcgggtgctgagcagccgggccagcgagctggacaaggacacagccagcaccatcatcctgctggccagcagcgagatgaccaagaccaaggacctggtgtgggactggcagcaggccgccagcggcgtgctggtggccgtgggccggcagttcatcagcaaggtgatggaggagctgctgcggcggctgcaccctggcaccctgccccactgtgctgtgctgcacaccctggccagcctgtctgtggccaatgccttcggcgtggtgcccttcctgcccagcgtgctgagcagcctgctgcctgtgctgggcgtggccaagcaggacacagtgcgggtggccttctgcagcgccctgcagcgcttcagcgagggcgccctggagtacctggccaacctggaccgggccccagaccccaccgtgaggaaggatgcctttgccacagacatcttcagcgcctatgatgtgctcttccaccagtggctgcagagccgggaggccaagctgcggctggccgtggtggaggccctgggccccatgagccacctgctgcccagcgagcggctggaggagcagctgcccaagctgctgcccggcatcctggccctgtacaagaagcacgccgagaccttctacctgagcaagagcctgggccagatcctggaggccgctgtgtctgtgggcagcaggaccctggagacccagctggatgccctgctggccgccctgcacagccagatctgtgtgcctgtggagagcagcagccccctggtgatgagcaaccagaaggaggtgctgcgctgcttcaccgtgctggcctgcagcagcccagaccggctgctggccttcctgctgccccggctggacaccagcaatgaaagaaccagggtgggcaccctgcaggtggtgagacatgtgatcaacagcgctggggagtgcctgcacgccagcctggccgccaccccaggccacgtgcaggatggagctggccctggccgcctgtgccccagcaagtag

SEQ ID NO: 39227 - DNA, 4926 bp, Artificial Sequence; identical to SEQ ID NO: 39225
  Description of Artificial Sequence: Synthetic coding sequence

SEQ ID NO: 39228 - DNA, 1653 bp, Artificial Sequence
  Description of Artificial Sequence: Synthetic coding sequence
atgatcaactgcctgctgcaggagcggggcggcgtgctgcaggagaaggtgcctgagatcgtgtctgtgctgcggagcaagctgcaggaggcccagggcgagcacgtgctgcctgctgcccagcacagcgtgtacctgctggccacccagcactgtgccgctgtggtgagcagcctgctgggcagccccctgcccctggacagccacacctgcatgctgtggagggccctggccgtggagccccggctggccgcccaggtgctgggcctgctgctggagaagatgagcagagatgtgcccttcaaggagagccgggccttcctgctgggccgcaccccagacagagtggccaccctgctgcccctgagcgccacctgtgccctgtttgaggtgatgagcaccccagctgctggccctgctgtgctggagctgtacccccagctgtttgtggtgctgctgctgcgggtgtcctgcaccgtgggcgtgcagctgcccaggaacctgcaggcccaggagaggagaggagccagccctgccctggccaccaggaacctggagccctgcagcagcgctgtggacaccctgcgctccatgctgctgcggagcggctctgaagatgtggtgcagaggatggacctggagggcggctgggagctgctgcggaccagcgctggccacgaggagggcgccacccggctggcccgggccatggccgagcacgccggcccccggctgcccctggtgctgaagaccctggcctgcacccacagcagcgcctatgagaaccagagggtgaccaccacagccttcctggccgagctgctgaacagcaatgtggccaatgacctgatgctgctggacagcctgctggagagcctggccgcccggcagaaggacacctgtgcctctgtgcggcggctggtgctgcggggcctggccaacctggccagcggctgcccagacaaggtgaggacccacggcccccagctgctgacagccatgattggaggcctggatgatggagacaacccccacagccctgtggccctggaggccatgctgggcctggcccggctggtgcacctggtggagagctgggacctgcggagcggcctgctgcacgtggccatccgcatccggcccttctttgattctgagaagatggagttcagaacagccagcatccggctgtttggccacctgaacaaggtgtgccacggggactgtgaagatgtgttcctggaccaggtggtgggcggcctggcccccctgctgctgcacctgcaggacccccaggccaccgtggccagcgcctgccgctttgccctgaggatgtgtggccccaacctggcctgtgaggagctgtctgctgccttccagaagcacctgcaggagggccgggccctgcactttggagagttcctgaacaccacctgcaagcacctgatgcaccacttcccagacctgctgggccgcctgctgaccacctgcctcttctacttcaagagctcctgggagaatgtgcgggctgctgcccccctcttcaccggcttcctggtgctgcacagcgagccccggcagcagccccaggtggacctggaccagctgattgctgcccccctgctgtacccccagaggagccgcagctgctag

SEQ ID NO: 39229 - DNA, 1269 bp, Artificial Sequence
  Description of Artificial Sequence: Synthetic coding sequence
atgacagagagctccatgaagaagctggccagcaccctgctggatgccatcacagacaaggaccccctggtgcaggagcaggtgtgcagcgccctgtgcagcctgggggaggcccggcctgtggagaccctgcgggcctgtgaggagtacctgcggcagcacgacaagctggcccacccctacagagctgctgtgctgcgggccatggagcgggtgctgagcagccgggccagcgagctggacaaggacacagccagcaccatcatcctgctggccagcagcgagatgaccaagaccaaggacctggtgtgggactggcagcaggccgccagcggcgtgctggtggccgtgggccggcagttcatcagcaaggtgatggaggagctgctgcggcggctgcaccctggcaccctgccccactgtgctgtgctgcacaccctggccagcctgtctgtggccaatgccttcggcgtggtgcccttcctgcccagcgtgctgagcagcctgctgcctgtgctgggcgtggccaagcaggacacagtgcgggtggccttctgcagcgccctgcagcgcttcagcgagggcgccctggagtacctggccaacctggaccgggccccagaccccaccgtgaggaaggatgcctttgccacagacatcttcagcgcctatgatgtgctcttccaccagtggctgcagagccgggaggccaagctgcggctggccgtggtggaggccctgggccccatgagccacctgctgcccagcgagcggctggaggagcagctgcccaagctgctgcccggcatcctggccctgtacaagaagcacgccgagaccttctacctgagcaagagcctgggccagatcctggaggccgctgtgtctgtgggcagcaggaccctggagacccagctggatgccctgctggccgccctgcacagccagatctgtgtgcctgtggagagcagcagccccctggtgatgagcaaccagaaggaggtgctgcgctgcttcaccgtgctggcctgcagcagcccagaccggctgctggccttcctgctgccccggctggacaccagcaatgaaagaaccagggtgggcaccctgcaggtggtgagacatgtgatcaacagcgctggcagcaccaacacccgcatcaccctgatgctgcccagcgctgtgacccggctgaagcatgaggactgcccagcccgggccgccccccagcctgctgacctgacagctgccccagcctctgtggcctag

SEQ ID NO: 39230 - DNA, 4926 bp, Artificial Sequence; identical to SEQ ID NO: 39225
  Description of Artificial Sequence: Synthetic coding sequence

SEQ ID NO: 39231 - DNA, 1848 bp, Artificial Sequence
  Description of Artificial Sequence: Synthetic coding sequence
atgaggatcatcgccaagaggctgcccccagaccagctgatcagcctgctgctgaccatgtttgaggccctgggggaccctgagaagaactgcagccgggccgccaccgtgatgatcaactgcctgctgcaggagcggggcggcgtgctgcaggagaaggtgcctgagatcgtgtctgtgctgcggagcaagctgcaggaggcccagggcgagcacgtgctgcctgctgcccagcacagcgtgtacctgctggccacccagcactgtgccgctgtggtgagcagcctgctgggcagccccctgcccctggacagccacacctgcatgctgtggagggccctggccgtggagccccggctggccgcccaggtgctgggcctgctgctggagaagatgagcagagatgtgcccttcaaggagagccgggccttcctgctgggccgcaccccagacagagtggccaccctgctgcccctgagcgccacctgtgccctgtttgaggtgatgagcaccccagctgctggccctgctgtgctggagctgtacccccagctgtttgtggtgctgctgctgcgggtgtcctgcaccgtgggcgtgcagctgcccaggaacctgcaggcccaggagcggcggggggccagccctgccctggccaccaggaacctggagccctgcagcagcgctgtggacaccctgcgctccatgctgctgcggagcggctctgaagatgtggtgcagaggatggacctggagggcggctgggagctgctgcggaccagcgctggccacgaggagggcgccacccggctggcccgggccatggccgagcacgccggcccccggctgcccctggtgctgaagaccctggcctgcacccacagcagcgcctatgagaaccagagggtgaccaccacagccttcctggccgagctgctgaacagcaatgtggccaatgacctgatgctgctggacagcctgctggagagcctggccgcccggcagaaggacacctgtgcctctgtgcggcggctggtgctgcggggcctggccaacctggccagcggctgcccagacaaggtgaggacccacggcccccagctgctgacagccatgattggaggcctggatgatggagacaacccccacagccctgtggccctggaggccatgctgggcctggcccggctggtgcacctggtggagagctgggacctgcggagcggcctgctgcacgtggccatccgcatccggcccttctttgacagcgagaagatggagttcagaacagccagcatccggctgtttggccacctgaacaaggtgtgccacggggactgtgaagatgtgttcctggaccaggtggtgggcggcctggcccccctgctgctgcacctgcaggacccccaggccaccgtggccagcgcctgccgctttgccctgaggatgtgtggccccaacctggcctgtgaggagctgtctgctgccttccagaagcacctgcaggagggccgggccctgcactttggagagttcctgaacaccacctgcaagcacctgatgcaccacttcccagacctgctgggccgcctgctgaccacctgcctcttctacttcaagagctcctgggagaatgtgcgggccgccgcccccctcttcaccgggaagcaccaccccctgccccacccccacgccgcccggcagccccggctgatgccacccctgcaccgggtgcctggggccgccctgggcgcccaggccgctgctgctgggggccctggccctgcccactgtggggccccagaccctgctgagggccctggccccagaggagcagatgagggctgctag

SEQ ID NO: 39232 - DNA, 4926 bp, Artificial Sequence; identical to SEQ ID NO: 39225
  Description of Artificial Sequence: Synthetic coding sequence

SEQ ID NO: 39233 - DNA, 3873 bp, Artificial Sequence
  Description of Artificial Sequence: Synthetic coding sequence
atgaaggccagcagctgcttcctgatcctggcccacagcaaccctggagagctgatggagttctttgatgagcaggtgcgcagcaacaatgaggccatccgggtgggcatcctgaccctgctgcggctggccgtgaatgctgatgagccccggctgcgggaccacatcatcagcattgaaagaacagtgaagatcgtgatgggagacctgagcaccaaggtgagaaattctgtgctgctgctgatccagaccatgtgtgagaagagctacatcgaggcccgggagggctggcccctgattgattatgtgttcagccagtttgccaccctgaacagaaacctggagaagcctgtgaagaccaacttccatgaaaatgagaaggaggaggagagcgtgcgggagaccagcctggaggtgctgaagaccctggaccccctggtgattggcatgccccaggtgctgtggccccgcatcctgacctttgtggtgcctgctgagtacacagaggccctggagcccctcttcagcatcatccgcatcctgatcatggccgaggagaagaagcagcacagcgccaaggagagcacagccctggtggtgtccactggagctgtgaagctgcccagcccccagcagctgctggcccggctgctggtgatctccatgcctgccagcctgggggagctgcggggggccggggccatcggcctgctgaagatcctgcctgagatcatccaccccaagctggtggacctgtggaagacccggctgcctgagctgctgcagcccctggagggcaagaacatcagcacagtgctgtgggagaccatgctgctgcagcagctgctgaaggagagcctgtggaagatcagtgatgtggcctggaccatccagctgacccaggacttcaagcagcagatgggcagctacagcaacaacagcacagagaagaagttcctgtggaaggccctgggcaccaccctggcctgctgccaggacagcgactttgtgaacagccagatcaaggagttcctgacagcccccaaccagctgggggaccagaggcagggcatcaccagcatcctgggctactgtgccgagaaccacctggacatcgtgctgaaggtgctgaagaccttccagaaccaggagaagttcttcatgaaccgctgcaagagcctcttcagcggcaagaagagcctgaccaagacagatgtgatggtgatctacggggctgtggccctgcacgcccccaagaagcagctgctgagccggctgaaccaggacatcatcagccaggtgctgagcctgcacggccagtgcagccaggtgctgggcatgtctgtgatgaacaaggacatggacctgcagatgtccttcaccaggagcatcacagaaattggaattgctgtgcaggatgctgaggaccagggcttccagttctcctacaaggagatgctgattggctacatgctggacttcatcagagatgagcccctggacagcctggccagccccatccgctggaaggccctgattgccatccgctacctgagcaagctgaagccccagctgagcctgcaggaccacctgaacatcctggaggagaacatccggcggctgctgcccctgccccccctggagaacctgaagtctgagggccagacagacaaggacaaggagcacatccagttcctgtatgaaagatccatggatgccctgggcaagctgctgaagaccatgatgtgggacaacgtgaatgctgaggactgccaggagatgttcaacctgctgcagatgtggctggtgtcccagaaggagtgggagcgggagcgggccttccagatcacagccaaggtgctgaccaatgacatcgaggcccctgagaacttcaagattggcagcctgctgggcctgctggccccccacagctgtgacaccctgcccaccatccggcaggccgccgccagcagcaccatcggcctcttctacatcaagggcatccacctggaggtggagcggctgcagggcctgcaggagggcctggagagtgatgatgtgcaggtgcagatcaagatcagcagcaagatcgccaagatcgtgtccaagttcatccccaatgaggagatcctgatgttcctggaggagatgctggatggcctggagagcctgaaccccacctgcaccaaggcctgtggcatctggatgatcaccgtgctgaagcagcagggcgccgccctggaggaccagctgctggagatcctgggcaccatctaccaccacatgcctgtgctgcggcagaaggaggagagcttccagttcatcctggaggccatcagccagatcgccagcttccacatggacacagtggtggtgaacctgctgcagaagcccctgccctttgaccgggacaccaagaccctgtggaaggccctggccgagaagccagccagcagcggcaagctgctgcaggccctgattgacaagctggagacagagctggaggatgacatcgcccgggtggaggccatctctgtggcctgtgccatgtatgaagtcatctccatgggcacctctgtgacaggcctgtacccagagctgttcaccctgctgctgaagctggtgtcctgcaccctgggccagaagatgctgacctgcccctggagccacagaagacatgtgatgcagcagggcgagcagcagcagatcccagacccctgccgcctgagcacagccaccctgaagtgcctgcaggcccaggccatgagggagggcctggccaaggagagtgatgaaggagacaacctgtggaccctgctgagcagccccagcacccaccacatcggcgtgtgcagcctggcccgctccatggctgtgtggcagcacggcgtcatcctggacatcatggagcagctgctgagcagcctgaccagcagcagcgagaactaccgcatcaccggggccgccttcttcagcgagctgatgaaggagcccatcctgtggaagcacggcaacctgagaaatgtgctgatcctgatggaccagagcgcctgggacagcaatgccaccctgcggcagatggccatccggggcctgggcaacacagccagcggggccccccacaaggtgaagaagcacaagcagctgatgctggagagcatcatccggggcctgtaccacctggccaggacagaggtggtgtgtgagagcctgaaggccctgaagaagatcctggagctgctgacagacagagatgtgtccttctacttcaaggagatcgtgctgcagaccaggaccttctttgaagatgagcaggatgatgtgcggctgacagccatcttcctgtttgaggacctggcccccctgactggaagacgctggaagatcttctttgctgaggagatcaagaagagcctcatctccttcctgctgcacctgtgggaccccaaccccaagattggagtggcctgcagagatgtgctgatggtgtgcatccccttcctgggcctgcaggagctgtatggagtgctggaccggctgctggaccaggacctgccccgggcccgggacttctaccggcagttctgtgtgaagctggccaagaagaaccaggagatcctgtggatcctgcacacccacagcttcaccttcttcaccagcacctgggaggtgatccgctctgctgctgtgaagctgacagatgctgtggtgctgaacctgaccagccagtatgtggagctgctggaccgggagcagctgaccacccggctgcaggccctgcggcaggacccctgcatctctgtgcagagagctgctgaggccgccctgcagaccctgctgcggcgctgcaaggagaccagcatccccctgtag

SEQ ID NO: 39234 - DNA, 4758 bp, Artificial Sequence
  Description of Artificial Sequence: Synthetic coding sequence
atgaccctgagcacagaggagagcattgagatgtttggagacatcaacctgaccctgggcatgctgaacaaggaggacatcgtgaacaaggaggacatctacagccacctgaccagcgtcatccagaacacagacatcctggatgatgccatcgtgcagaggctcatctactatgccagcaaggacatgagggacaacaacatgctgcgggagatccgcatgctggccggggaggtgctggtgtccctggccgcccatgacttcaacagcgtgatgtatgaggtgcagagcaacttccgcatcctggagctgcctgatgaatttgtggtgctggccctggccgagctggccaccagctatgtgtcccagagcatccccttcatgatgatgaccctgctgaccatgcagaccatgctgcggctggctgaagatgagaggatgaagggcaccttctgcatcgccctggagaagttcagcaaggccatctacaagtatgtgaaccactggagggacttcccctacccccggctggatgccaaccggctgagtgacaagatcttcatgctgttctggtacatcatggagaagtgggcccccctggccagccccatgcagaccctgagcatcgtgaaggcccacggccccaccgtgtccctgctgctgcaccgggaggacttccggggctacgccctgggccaggtgccctggctgctgaaccagtacaaggacaaggagattgacttccacgtgacccagagcctgaagcagatcctgacagctgctgtgctgtatgacatcggcctgcccaggagcctgcggcgcagcatcttcatcaacctgctgcagcagatctgccgggcccctgagccccctgtgaaggaaaatgagatgaaggccagcagctgcttcctgatcctggcccacagcaaccctggagagctgatggagttctttgatgagcaggtgcgcagcaacaatgaggccatccgggtgggcatcctgaccctgctgcggctggccgtgaatgctgatgagccccggctgcgggaccacatcatcagcattgaaagaacagtgaagatcgtgatgggagacctgagcaccaaggtgagaaattctgtgctgctgctgatccagaccatgtgtgagaagagctacatcgaggcccgggagggctggcccctgattgattatgtgttcagccagtttgccaccctgaacagaaacctggagaagcctgtgaagaccaacttccatgaaaatgagaaggaggaggagagcgtgcgggagaccagcctggaggtgctgaagaccctggaccccctggtgattggcatgccccaggtgctgtggccccgcatcctgacctttgtggtgcctgctgagtacacagaggccctggagcccctcttcagcatcatccgcatcctgatcatggccgaggagaagaagcagcacagcgccaaggagagcacagccctggtggtgtccactggagctgtgaagctgcccagcccccagcagctgctggcccggctgctggtgatctccatgcctgccagcctgggggagctgcggggggccggggccatcggcctgctgaagatcctgcctgagatcatccaccccaagctggtggacctgtggaagacccggctgcctgagctgctgcagcccctggagggcaagaacatcagcacagtgctgtgggagaccatgctgctgcagctgctgaaggagagcctgtggaagatcagtgatgtggcctggaccatccagctgacccaggacttcaagcagcagatgggcagctacagcaacaacagcacagagaagaagttcctgtggaaggccctgggcaccaccctggcctgctgccaggacagcgactttgtgaacagccagatcaaggagttcctgacagcccccaaccagctgggggaccagaggcagggcatcaccagcatcctgggctactgtgccgagaaccacctggacatcgtgctgaaggtgctgaagaccttccagaaccaggagaagttcttcatgaaccgctgcaagagcctcttcagcggcaagaagagcctgaccaagacagatgtgatggtgatctatggagctgtggccctgcacgcccccaagaagcagctgctgagccggctgaaccaggacatcatcagccaggtgctgagcctgcacggccagtgcagccaggtgctgggcatgtctgtgatgaacaaggacatggacctgcagatgtccttcaccaggagcatcacagagatcggcattgctgtgcaggatgctgaggaccagggcttccagttctcctacaaggagatgctgattggctacatgctggacttcatcagagatgagcccctggacagcctggccagccccatccgctggaaggccctgattgccatccgctacctgagcaagctgaagccccagctgagcctgcaggaccacctgaacatcctggaggagaacatccggcggctgctgcccctgccccccctggagaacctgaagtctgagggccagacagacaaggacaaggagcacatccagttcctgtatgaaagatccatggatgccctgggcaagctgctgaagaccatgatgtgggacaacgtgaatgctgaggactgccaggagatgttcaacctgctgcagatgtggctggtgtcccagaaggagtgggagcgggagcgggccttccagatcacagccaaggtgctgaccaatgacatcgaggcccctgagaacttcaagattggcagcctgctgggcctgctggccccccacagctgtgacaccctgcccaccatccggcaggccgccgccagcagcaccatcggcctcttctacatcaagggcatccacctggaggtggagcggctgcagggcctgcaggagggcctggagagtgatgatgtgcaggtgcagatcaagatcagcagcaagatcgccaagatcgtgtccaagttcatccccaatgaggagatcctgatgttcctggaggagatgctggatggcctggagagcctgaaccccacctgcaccaaggcctgtggcatctggatgatcaccgtgctgaagcagcagggcgccgccctggaggaccagctgctggagatcctgggcaccatctaccaccacatgcctgtgctgcggcagaaggaggagagcttccagttcatcctggaggccatcagccagatcgccagcttccacatggacacagtggtggtgaacctgctgcagaagcccctgccctttgaccgggacaccaagaccctgtggaaggccctggccgagaagccagccagcagcggcaagctgctgcaggccctgattgacaagctggagacagagctggaggatgacatcgcccgggtggaggccatctctgtggcctgtgccatgtatgaggtgatctccatgggcacctctgtgacaggcctgtacccagagctgttcaccctgctgctgaagctggtgtcctgcaccctgggccagaagatgctgacctgcccctggagccaccggcggcacgtgatgcagcagggcgagcagcagcagatcccagacccctgccgcctgagcacagccaccctgaagtgcctgcaggcccaggccatgagggagggcctggccaaggagagtgatgaaggagacaacctgtggaccctgctgagcagccccagcacccaccacatcggcgtgtgcagcctggcccgctccatggctgtgtggcagcacggcgtcatcctggacatcatggagcagctgctgagcagcctgaccagcagcagcgagaactaccgcatcactggagctgccttcttcagcgagctgatgaaggagcccatcctgtggaagcacggcaacctgagaaatgtgctgatcctgatggaccagagcgcctgggacagcaatgccaccctgcggcagatggccatccggggcctgggcaacacagccagcggggccccccacaaggtgaagaagcacaagcagctgatgctggagagcatcatccggggcctgtaccacctggccaggacagaggtggtgtgtgagagcctgaaggccctgaagaagatcctggagctgctgacagacagagatgtgtccttctacttcaaggagatcgtgctgcagaccaggaccttctttgaagatgagcaggatgatgtgcggctgacagccatcttcctgtttgaggacctggcccccctgaccggccgccgctggaagatcttctttgctgaggagatcaagaagagcctcatctccttcctgctgcacctgtgggaccccaaccccaagattggagtggcctgcagagatgtgctgatggtgtgcatccccttcctgggcctgcaggagctgtatggagtgctggaccggctgctggaccaggacctgccccgggcccgggacttctaccggcagttctgtgtgaagctggccaagaagaaccaggagatcctgtggatcctgcacacccacagcttcaccttcttcaccagcacctgggaggtgatccgctctgctgctgtgaagctgacagatgctgtggtgctgaacctgaccagccagtatgtggagctgctggaccgggagcagctgaccacccggctgcaggccctgcggcaggacccctgcatctctgtgcagagagctgctgaggccgccctgcagaccctgctgcggcgctgcaaggagaccagcatccccctgtag

SEQ ID NO: 39235 - DNA, 225 bp, Artificial Sequence
  Description of Artificial Sequence: Synthetic coding sequence
atggatgtgcggggccctgaggcccctgggggccgggccctgagagatgctgctgaaaatctcttccaggagctgcaggagcacttccaggccctgacagccaccctgaacctgaggatggaggagatgggcaacagaattgaggacctgcagaagaatgtgaaggacctgatggtgcaggccggcatcgagaacagcatcaaggagcagatgctgaagacctag

SEQ ID NO: 39236 - DNA, 549 bp, Artificial Sequence
  Description of Artificial Sequence: Synthetic coding sequence
atgagcggccgctctgtgccccacgcccacccagccacagcagaatatgaatttgccaaccccagccggctgggggagcagagatttggagagggcctgctgcctgaggagatcctgacccccaccctgtaccacggctactacgtgcggcccagggctgccccagctggggagggcagccgggccggggccagcgagctgcggctgtctgagggcaagttccaggccttcctggatgtgagccacttcaccccagatgaggtgacagtgaggacagtggacaacctgctggaggtgtctgcccggcacccccagaggctggacagacatggctttgtgtcccgggagttctgcaggacctacgtgctgcctgcagatgtggacccctggagggtgcgggccgccctgagccatgatggcatcctgaacctggaggccccccggggcggccgccacctggacacagaggtgaatgaggtgtacatcagcctgctgcctgcccccccagaccctgaggaggaggaggaggccgccatcgtggagccctag

SEQ ID NO: 39237 - DNA, 435 bp, Artificial Sequence
  Description of Artificial Sequence: Synthetic coding sequence
atgaggaagattgacctgtgcctgagcagcgagggcagcgaggtgatcctggccaccagcagtgatgagaagcaccccccagagaacatcattgatggcaaccctgagaccttctggaccaccaccggcatgttcccccaggagttcatcatctgcttccacaagcacgtgagaattgagcggctggtgatccagagctactttgtgcagaccctgaagattgagaagagcaccagcaaggagcctgtggactttgagcagtggattgagaaggacctggtgcacacagagggccagctgcagaatgaggagatcgtggcccatgatggcagcgccacctacctgcgcttcatcatcgtgtctgcctttgaccactttgcctctgtgcacagcgtgtctgctgagggcaccgtggtgagcaacctgagcagctag

SEQ ID NO: 39238 - DNA, 225 bp, Artificial Sequence
  Description of Artificial Sequence: Synthetic coding sequence
atgaggaagattgacctgtgcctgagcagcgagggcagcgaggtgatcctggccaccagcagtgatgagaagcaccccccagagaacatcattgatggcaaccctgagaccttctggaccaccaccggcatgttcccccaggagttcatcatctgcttccacaagcacgtgagaattgagcggctggtgatccagagctactttgggaagcagatcctgcactag

SEQ ID NO: 39239 - DNA, 339 bp, Artificial Sequence
  Description of Artificial Sequence: Synthetic coding sequence
atgaggaagattgacctgtgcctgagcagcgagggcagcgaggtgatcctggccaccagcagtgatgagaagcaccccccagagaacatcattgatggcaaccctgagaccttctggaccaccaccggcatgttcccccaggagttcatcatctgcttccacaagcacgtgagaattgagcggctggtgatccagagctactttgtgcagaccctgaagattgagaagagcaccagcaaggagcctgtggactttgagcagtggattgagaaggacctggtgcacacagagggccagctgcagaatgaggagatcgtggtgtctgagtacaccctgtag

SEQ ID NO: 39240 - DNA, 435 bp, Artificial Sequence; identical to SEQ ID NO: 39237
  Description of Artificial Sequence: Synthetic coding sequence

SEQ ID NO: 39241 - DNA, 417 bp, Artificial Sequence
  Description of Artificial Sequence: Synthetic coding sequence
atgggcgtgagcaaccagggctgcagcagaaatgcccggcaccagaaggcccgctccatgcccctgcaggaccagcacctggccctggccatcctgctggagctggccgtgcagaggggcaccctgagccagatgctgagcgccatcctgctgctgctgcagctgtgggacagccgggcccaggagacagacaatgaaagaagtgcccagggcaccagcaccctgctgctgagcctgctgcagaccttccagagcatcatctgtgggaaggacaccccaccttctgagggcaacatgcacctgctgagcggccccctgagccccagcgagagcttcctgcgctacctgaccctgcacaagaccaccagcctgcccctcatctgcaacaagaggcagctgctgtcctggcccatctag

SEQ ID NO: 39242 - DNA, 7839 bp, Artificial Sequence
  Description of Artificial Sequence: Synthetic coding sequence
atggctgatgtggaccctgacaccctgctggagtggctgcagatgggccagggagatgagcgggacatgcagctgattgccctggagcagctgtgcatgctgctgctgatgtctgacaacgtggaccgctgctttgagacctgcccccccaggaccttcctgcctgccctgtgcaagatcttcctggatgaaagtgccccagacaacgtgctggaggtgacagcccgggccatcacctactacctggatgtgtctgcagaatgtacccggcgcatcgtgggcgtggatggagccatcaaggccctgtgcaaccggctggtggtggtggagctgaacaacagaaccagccgggacctggccgagcagtgtgtgaaggtgctggagctgatctgcacccgggagagcggggctgtgtttgaagctgggggcctgaactgtgtgctgaccttcatccgggacagcggccacctggtgcacaaggacaccctgcacagcgccatggctgtggtgtcccggctgtgtgggaagatggagccccaggacagcagcctggagatctgtgtggagagcctgagcagcctgctgaagcatgaggaccaccaggtgtctgatggagccctgcgctgctttgccagcctggccgaccgcttcaccaggagaggagtggaccctgcccccctggccaagcacggcctgacagaggagctgctgagcaggatggctgctgctgggggcaccgtgtctggccccagcagcgcctgcaagccaggccgcagcaccactggagcccccagcaccacagctgacagcaagctgagcaaccaggtgtccaccatcgtgtccctgctgagcaccctgtgccggggcagccctgtggtgacccatgacctgctgcggtctgagctgcctgacagcattgagagcgccctgcagggagatgagcgctgtgtgctggacaccatgaggctggtggacctgctgctggtgctgctgtttgagggcaggaaggccctgcccaagagcagcgctggcagcacaggccgcatccctggcctgcggcggctggacagcagcggggagaggagccaccggcagctgattgactgcatccgcagcaaggacacagatgccctgattgatgccatcgacaccggggcctttgaggtgaacttcatggatgatgtgggccagaccctgctgaactgggccagcgccttcggcacccaggagatggtggagttcctgtgtgaaagaggagcagatgtgaacagaggccagaggagcagcagcctgcactacgccgcctgcttcggccggccccaggtggccaagaccctgctgcggcatggagccaacccagacctgagagatgaagatggcaagacccccctggacaaggcccgggagcggggccacagcgaggtggtggccatcctgcagagccctggggactggatgtgccctgtgaacaagggagatgacaagaagaagaaggacaccaacaaggatgaggaggagtgcaatgagcccaagggggaccctgagatggcccccatctacctgaagaggctgctgcctgtgtttgcccagaccttccagcagaccatgctgcccagcatcaggaaggccagcctggccctgatcaggaagatgatccacttctgcagcgaggccctgctgaaggaggtgtgtgacagtgatgtgggccacaacctgcccaccatcctggtggagatcacagccaccgtgctggaccaggaggatgatgatgatggccacctgctggccctgcagatcatccgggacctggtggacaagggcggggacatcttcctggaccagctggcccggctgggcgtcatcagcaaggtgtccaccctggccggccccagcagtgatgatgaaaatgaggaggagagcaagccagagaaggaggatgagccccaggaggatgccaaggagctgcagcagggcaagccctaccactggagggactggagcatcatccggggccgggactgcctgtacatctggagcgatgctgctgccctggagctgagcaatggcagcaatggctggttccgcttcatcctggatggcaagctggccaccatgtacagcagcggcagccctgagggcggcagtgacagcagcgagagccgctctgagttcctggagaagctgcagagggcccggggccaggtgaagcccagcaccagcagccagcccatcctgagcgcccctggccccaccaagctgactgtgggcaactggagcctgacctgcctgaaggagggggagatcgccatccacaacagtgatggccagcaggccaccatcctgaaggaggacctgcccggctttgtgtttgagagcaacagaggcaccaagcacagcttcaccgctgagaccagcctgggcagcgagtttgtgacaggctggacaggcaagaggggcaggaagctgaagagcaagctggagaagaccaagcagaaggtgaggaccatggcccgggacctgtatgatgaccacttcaaggctgtggagagcatgccccggggcgtggtggtgaccctgaggaacatcgccacccagctggagagctcctgggagctgcacaccaaccggcagtgcattgaaagtgagaacacctggagggacctgatgaagacagccctggagaacctgattgtgctgctgaaggatgagaacaccatcagcccctatgagatgtgcagcagcggcctggtgcaggccctgctgactgtgctgaacaacgtgtccctgagcagcagcaaggagcagaagtacagcttcacccccagcgtggagatcaacgtgttcaagacagccttctctgaaaatgaagatgatgagagcaggcctgctgtggccctgatcaggaagctgattgctgtgctggagagcattgagcggctgcccctgcacctgtatgacaccccaggcagcacctacaacctgcagatcctgacccggcggctgcgcttccggctggagcgggcccctggagaaacagccctgattgacagaacaggccgcatgctgaagatggagcccctggccaccgtggagagcctggagcagtacctgctgaagatggtggccaagcagtggtatgactttgacaggagcagctttgtgtttgtgaggaagctgcgggagggccagaacttcatcttccgccaccagcacgactttgatgaaaatggcatcatctactggattggcaccaatgccaagacagcctatgagtgggtgaacccagctgcctacggcctggtggtggtgaccagcagcgagggcaggaacctgccctacggccgcctggaggacatcctgagccgggacaacagcgccctgaactgccacagcaatgatgacaagaatgcctggtttgccatcgacctgggcctgtgggtgatccccagcgcctacaccctgcggcatgcccggggctacggccgcagcgccctgaggaactgggtgttccaggtgtccaaggatggccagaactggaccagcctgtacacccacgtggatgactgcagcctgaatgagcccggcagcacagccacctggcccctggacccccccaaggatgagaagcagggctggaggcatgtgcgcatcaagcagatgggcaagaatgccagcggccagacccactacctgagcctgagcggctttgagctgtatggaacagtgaatggagtgtgtgaggaccagctgggcaaggccgccaaggaggccgaggccaacctgcggcggcagaggcggctggtgcgcagccaggtgctgaagtacatggtgcctggggcccgggtcatccggggcctggactggaagtggagggaccaggacggcagcccccagggcgagggcaccgtgactggagagctgcacaacggctggattgatgtgacctgggatgctgggggcagcaacagctacaggatgggcgctgagggcaagtttgacctgaagctggcccctggctatgaccctgacacagtggccagccccaagcctgtgagcagcacagtgtctggcaccacccagagctggagcagcctggtgaagaacaactgcccagacaagaccagcgctgctgctggcagcagcagcaggaagggcagcagcagctctgtgtgcagcgtggccagcagcagtgacatcagcctgggcagcaccaagacagagcggcgctctgagatcgtgatggagcacagcatcgtgtctggagcagatgtgcatgagcccatcgtggtgctgagcagcgcagaaaatgtgccccagacagaggtgggcagcagcagcagcgccagcaccagcaccctgacagctgagactggaagtgaaaatgctgagaggaagctgggccctgacagctctgtgaggaccccaggagagagcagcgccatctccatgggcatcgtgtctgtgagcagcccagatgtgtcctctgtgtctgagctgaccaacaaggaggccgccagccagaggcccctgagcagcagcgccagcaaccggctgtctgtgagcagcctgctggccgccggggcccccatgagcagcagcgcctctgtgcccaacctgagcagccgggagaccagcagcctggagagctttgtgcggcgggtggccaacatcgcccggaccaatgccaccaacaacatgaacctgagccgcagcagcagtgacaacaacaccaacaccctgggcagaaatgtgatgagcacagccaccagccccctgatgggcgcccagagcttccccaacctgaccaccccaggcaccaccagcacagtgaccatgagcaccagctctgtgaccagcagcagcaatgtggccacagccaccaccgtgctgtctgtgggccagagcctgagcaacaccctgaccaccagcctgaccagcaccagcagcgagagtgacaccggccaggaggccgagtacagcctgtatgacttcctggacagctgccgggccagcaccctgctggccgagctggatgatgatgaggacctgcctgagccagatgaagaagatgatgaaaatgaagatgacaaccaggaggaccaggagtatgaggaggtgatgatcctgcggcggcccagcctgcagaggcgggccggcagcagaagtgatgtgacccaccacgctgtgaccagccagctgccccaggtgcctgctggggccggcagccggcccatcggggagcaggaggaggaggagtatgagaccaagggcggcagaagaaggacctgggatgatgattatgtgctgaagaggcagttcagcgccctggtgcctgcctttgacccccggcccggccgcaccaacgtgcagcagaccacagacctggagatccccccacctggcaccccccacagcgagctgctggaggaggtggagtgcacccccagcccccggctggccctgaccctgaaggtgacaggcctgggcaccacccgggaggtggagctgcccctgaccaacttccgcagcaccatcttctactacgtgcagaagctgctgcagctgagctgcaatggaaatgtgaagagtgacaagctgcggcgcatctgggagcccacctacaccatcatgtaccgggagatgaaggacagcgacaaggagaaggaaaatggcaagatgggctgctggagcattgagcacgtggagcagtacctgggcacagatgagctgcccaagaatgacctgatcacctacctgcagaagaatgctgatgctgccttcctgcggcactggaagctgaccggcaccaacaagagcatcaggaagaacagaaactgcagccagctgattgctgcctacaaggacttctgtgaacatggcaccaagagcggcctgaaccagggcgccatcagcaccctgcagagcagtgacatcctgaacctgaccaaggagcagccccaggccaaggctggaaatggccagaacagctgtggggtggaggatgtgctgcagctgctgcgcatcctgtacatcgtggccagtgacccctacagccgcatcagccaggaggatggagatgagcagctgcagttcaccttccccccagatgagttcaccagcaagaagatcaccaccaagatcctgcagcagatcgaggagcccctggccctggccagcggggccctgcctgactggtgtgagcagctgaccagcaagtgccccttcctgatcccctttgagacccggcagctgtacttcacctgcacagcctttggagccagccgggccatcgtgtggctgcagaacagaagagaggccaccgtggagaggaccaggaccaccagctctgtgagaagagatgaccccggggagttccgggtgggccgcctgaagcatgagcgggtgaaggtgcccagaggagagagcctgatggagtgggccgagaatgtgatgcagatccatgctgacaggaagtctgtgctggaggtggagttcctgggggaggagggcaccggcctgggccccaccctggagttctacgccctggtggccgctgagttccagaggacagacctgggcgcctggctgtgtgatgacaacttcccagatgatgagagccgccacgtggacctgggcggcggcctgaagcccccaggctactacgtgcagaggagctgtggcctcttcaccgcccccttcccccaggacagtgatgagctggagcgcatcaccaagctgttccacttcctgggcatcttcctggccaagtgcatccaggacaaccggctggtggacctgcccatcagcaagcccttcttcaagctgatgtgcatgggagacatcaagagcaacatgagcaagctgatctatgagagcagaggagaccgggacctgcactgcacagagagccagagcgaggccagcacagaggagggccatgacagcctgtctgtgggcagctttgaggaggacagcaagtctgagttcatcctggacccccccaagcccaagcccccagcctggttcaacggcatcctgacctgggaggactttgagctggtgaacccccaccgggcccgcttcctgaaggagatcaaggacctggccatcaagaggcggcagatcctgagcaacaagggcctgtctgaagatgagaagaacaccaagctgcaggagctggtgctgaagaaccccagcggcagcggcccccccctgagcattgaggacctgggcctgaacttccagttctgccccagcagccgcatctacggcttcaccgctgtggacctgaagcccagcggagaagatgagatgatcaccatggacaatgctgaggagtatgtggacctgatgtttgacttctgcatgcacacaggcatccagaagcagatggaggccttcagagatggcttcaacaaggtgttccccatggagaagctgagcagcttcagccatgaggaggtgcagatgatcctgtgtggcaaccagagccccagctgggccgctgaggacatcatcaactacacagagcccaagctgggctacacccgggacagccctggcttcctgcgctttgtgcgggtgctgtgtggcatgagcagtgatgagaggaaggccttcctgcagttcaccaccggctgcagcaccctgcccccaggcggcctggccaacctgcacccccggctgactgtggtgaggaaggtggatgccacagatgccagctaccccagcgtgaacacctgtgtgcactacctgaagctgcctgagtacagcagcgaggagatcatgagggagcggctgctggccgccaccatggagaagggcttccacctgaactag

SEQ ID NO: 39243 - DNA, 516 bp, Artificial Sequence
  Description of Artificial Sequence: Synthetic coding sequence
aaggtgttcctgaaggctgtggccggcaactaccacatcttccgccacacaggcatccagaagcagatggaggccttcagagatggcttcaacaaggtgttccccatggagaagctgagcagcttcagccatgaggaggtgcagatgatcctgtgtggcaaccagagccccagctgggccgctgaggacatcatcaactacacagagcccaagctgggctacacccgggacagccctggcttcctgcgctttgtgcgggtgctgtgtggcatgagcagtgatgagaggaaggccttcctgcagttcaccaccggctgcagcaccctgcccccaggcggcctggccaacctgcacccccggctgactgtggtgaggaaggtggatgccacagatgccagctaccccagcgtgaacacctgtgtgcactacctgaagctgcctgagtacagcagcgaggagatcatgagggagcggctgctggccgccaccatggagaagggcttccacctgaactag

SEQ ID NO: 39244 - DNA, 7833 bp, Artificial Sequence
  Description of Artificial Sequence: Synthetic coding sequence
atggctgatgtggaccctgacaccctgctggagtggctgcagatgggccagggagatgagcgggacatgcagctgattgccctggagcagctgtgcatgctgctgctgatgtctgacaacgtggaccgctgctttgagacctgcccccccaggaccttcctgcctgccctgtgcaagatcttcctggatgaaagtgccccagacaacgtgctggaggtgacagcccgggccatcacctactacctggatgtgtctgcagaatgtacccggcgcatcgtgggcgtggatggagccatcaaggccctgtgcaaccggctggtggtggtggagctgaacaacagaaccagccgggacctggccgagcagtgtgtgaaggtgctggagctgatctgcacccgggagagcggggctgtgtttgaagctgggggcctgaactgtgtgctgaccttcatccgggacagcggccacctggtgcacaaggacaccctgcacagcgccatggctgtggtgtcccggctgtgtgggaagatggagccccaggacagcagcctggagatctgtgtggagagcctgagcagcctgctgaagcatgaggaccaccaggtgtctgatggagccctgcgctgctttgccagcctggccgaccgcttcaccaggagaggagtggaccctgcccccctggccaagcacggcctgacagaggagctgctgagcaggatggctgctgctgggggcaccgtgtctggccccagcagcgcctgcaagccaggccgcagcaccactggagcccccagcaccacagctgacagcaagctgagcaaccaggtgtccaccatcgtgtccctgctgagcaccctgtgccggggcagccctgtggtgacccatgacctgctgcggtctgagctgcctgacagcattgagagcgccctgcagggagatgagcgctgtgtgctggacaccatgaggctggtggacctgctgctggtgctgctgtttgagggcaggaaggccctgcccaagagcagcgctggcagcacaggccgcatccctggcctgcggcggctggacagcagcggggagaggagccaccggcagctgattgactgcatccgcagcaaggacacagatgccctgattgatgccatcgacaccggggcctttgaggtgaacttcatggatgatgtgggccagaccctgctgaactgggccagcgccttcggcacccaggagatggtggagttcctgtgtgaaagaggagcagatgtgaacagaggccagaggagcagcagcctgcactacgccgcctgcttcggccggccccaggtggccaagaccctgctgcggcatggagccaacccagacctgagagatgaagatggcaagacccccctggacaaggcccgggagcggggccacagcgaggtggtggccatcctgcagagccctggggactggatgtgccctgtgaacaagggagatgacaagaagaagaaggacaccaacaaggatgaggaggagtgcaatgagcccaagggggaccctgagatggcccccatctacctgaagaggctgctgcctgtgtttgcccagaccttccagcagaccatgctgcccagcatcaggaaggccagcctggccctgatcaggaagatgatccacttctgcagcgaggccctgctgaaggaggtgtgtgacagtgatgtgggccacaacctgcccaccatcctggtggagatcacagccaccgtgctggaccaggaggatgatgatgatggccacctgctggccctgcagatcatccgggacctggtggacaagggcggggacatcttcctggaccagctggcccggctgggcgtcatcagcaaggtgtccaccctggccggccccagcagtgatgatgaaaatgaggaggagagcaagccagagaaggaggatgagccccaggaggatgccaaggagctgcagcagggcaagccctaccactggagggactggagcatcatccggggccgggactgcctgtacatctggagcgatgctgctgccctggagctgagcaatggcagcaatggctggttccgcttcatcctggatggcaagctggccaccatgtacagcagcggcagccctgagggcggcagtgacagcagcgagagccgctctgagttcctggagaagctgcagagggcccggggccaggtgaagcccagcaccagcagccagcccatcctgagcgcccctggccccaccaagctgactgtgggcaactggagcctgacctgcctgaaggagggggagatcgccatccacaacagtgatggccagcaggccaccatcctgaaggaggacctgcccggctttgtgtttgagagcaacagaggcaccaagcacagcttcaccgctgagaccagcctgggcagcgagtttgtgacaggctggacaggcaagaggggcaggaagctgaagagcaagctggagaagaccaagcagaaggtgaggaccatggcccgggacctgtatgatgaccacttcaaggctgtggagagcatgccccggggcgtggtggtgaccctgaggaacatcgccacccagctggagagctcctgggagctgcacaccaaccggcagtgcattgaaagtgagaacacctggagggacctgatgaagacagccctggagaacctgattgtgctgctgaaggatgagaacaccatcagcccctatgagatgtgcagcagcggcctggtgcaggccctgctgactgtgctgaacaacagcatggacctggacatgaagcaggactgcagccagctggtggagcgcatcaacgtgttcaagacagccttctctgaaaatgaagatgatgagagcaggcctgctgtggccctgatcaggaagctgattgctgtgctggagagcattgagcggctgcccctgcacctgtatgacaccccaggcagcacctacaacctgcagatcctgacccggcggctgcgcttccggctggagcgggcccctggagaaacagccctgattgacagaacaggccgcatgctgaagatggagcccctggccaccgtggagagcctggagcagtacctgctgaagatggtggccaagcagtggtatgactttgacaggagcagctttgtgtttgtgaggaagctgcgggagggccagaacttcatcttccgccaccagcacgactttgatgaaaatggcatcatctactggattggcaccaatgccaagacagcctatgagtgggtgaacccagctgcctacggcctggtggtggtgaccagcagcgagggcaggaacctgccctacggccgcctggaggacatcctgagccgggacaacagcgccctgaactgccacagcaatgatgacaagaatgcctggtttgccatcgacctgggcctgtgggtgatccccagcgcctacaccctgcggcatgcccggggctacggccgcagcgccctgaggaactgggtgttccaggtgtccaaggatggccagaactggaccagcctgtacacccacgtggatgactgcagcctgaatgagcccggcagcacagccacctggcccctggacccccccaaggatgagaagcagggctggaggcatgtgcgcatcaagcagatgggcaagaatgccagcggccagacccactacctgagcctgagcggctttgagctgtatggaacagtgaatggagtgtgtgaggaccagctgggcaaggccgccaaggaggccgaggccaacctgcggcggcagaggcggctggtgcgcagccaggtgctgaagtacatggtgcctggggcccgggtcatccggggcctggactggaagtggagggaccaggacggcagcccccagggcgagggcaccgtgactggagagctgcacaacggctggattgatgtgacctgggatgctgggggcagcaacagctacaggatgggcgctgagggcaagtttgacctgaagctggcccctggctatgaccctgacacagtggccagccccaagcctgtgagcagcacagtgtctggcaccacccagagctggagcagcctggtgaagaacaactgcccagacaagaccagcgctgctgctggcagcagcagcaggaagggcagcagcagctctgtgtgcagcgtggccagcagcagtgacatcagcctgggcagcaccaagacagagcggcgctctgagatcgtgatggagcacagcatcgtgtctggagcagatgtgcatgagcccatcgtggtgctgagcagcgcagaaaatgtgccccagacagaggtgggcagcagcagcagcgccagcaccagcaccctgacagctgagactggaagtgaaaatgctgagaggaagctgggccctgacagctctgtgaggaccccaggagagagcagcgccatctccatgggcatcgtgtctgtgagcagcccagatgtgtcctctgtgtctgagctgaccaacaaggaggccgccagccagaggcccctgagcagcagcgccagcaaccggctgtctgtgagcagcctgctggccgccggggcccccatgagcagcagcgcctctgtgcccaacctgagcagccgggagaccagcagcctggagagctttgtgcggcgggtggccaacatcgcccggaccaatgccaccaacaacatgaacctgagccgcagcagcagtgacaacaacaccaacaccctgggcagaaatgtgatgagcacagccaccagccccctgatgggcgcccagagcttccccaacctgaccaccccaggcaccaccagcacagtgaccatgagcaccagctctgtgaccagcagcagcaatgtggccacagccaccaccgtgctgtctgtgggccagagcctgagcaacaccctgaccaccagcctgaccagcaccagcagcgagagtgacaccggccaggaggccgagtacagcctgtatgacttcctggacagctgccgggccagcaccctgctggccgagctggatgatgatgaggacctgcctgagccagatgaagaagatgatgaaaatgaagatgacaaccaggaggaccaggagtatgaggaggtgatgatcctgcggcggcccagcctgcagaggcgggccggcagcagaagtgatgtgacccaccacgctgtgaccagccagctgccccaggtgcctgctggggccggcagccggcccatcggggagcaggaggaggaggagtatgagaccaagggcggcagaagaaggacctgggatgatgattatgtgctgaagaggcagttcagcgccctggtgcctgcctttgacccccggcccggccgcaccaacgtgcagcagaccacagacctggagatccccccacctggcaccccccacagcgagctgctggaggaggtggagtgcacccccagcccccggctggccctgaccctgaaggtgacaggcctgggcaccacccgggaggtggagctgcccctgaccaacttccgcagcaccatcttctactacgtgcagaagctgctgcagctgagctgcaatggaaatgtgaagagtgacaagctgcggcgcatctgggagcccacctacaccatcatgtaccgggagatgaaggacagcgacaaggagaaggaaaatggcaagatgggctgctggagcattgagcacgtggagcagtacctgggcacagatgagctgcccaagaatgacctgatcacctacctgcagaagaatgctgatgctgccttcctgcggcactggaagctgaccggcaccaacaagagcatcaggaagaacagaaactgcagccagctgattgctgcctacaaggacttctgtgaacatggcaccaagagcggcctgaaccagggcgccatcagcaccctgcagagcagtgacatcctgaacctgaccaaggagcagccccaggccaaggctggaaatggccagaacagctgtggggtggaggatgtgctgcagctgctgcgcatcctgtacatcgtggccagtgacccctacagccgcatcagccaggaggatggagatgagcagctgcagttcaccttccccccagatgagttcaccagcaagaagatcaccaccaagatcctgcagcagatcgaggagcccctggccctggccagcggggccctgcctgactggtgtgagcagctgaccagcaagtgccccttcctgatcccctttgagacccggcagctgtacttcacctgcacagcctttggagccagccgggccatcgtgtggctgcagaacagaagagaggccaccgtggagaggaccaggaccaccagctctgtgagaagagatgaccccggggagttccgggtgggccgcctgaagcatgagcgggtgaaggtgcccagaggagagagcctgatggagtgggccgagaatgtgatgcagatccatgctgacaggaagtctgtgctggaggtggagttcctgggggaggagggcaccggcctgggccccaccctggagttctacgccctggtggccgctgagttccagaggacagacctgggcgcctggctgtgtgatgacaacttcccagatgatgagagccgccacgtggacctgggcggcggcctgaagcccccaggctactacgtgcagaggagctgtggcctcttcaccgcccccttcccccaggacagtgatgagctggagcgcatcaccaagctgttccacttcctgggcatcttcctggccaagtgcatccaggacaaccggctggtggacctgcccatcagcaagcccttcttcaagctgatgtgcatgggagacatcaagagcaacatgagcaagctgatctatgagagcagaggagaccgggacctgcactgcacagagagccagagcgaggccagcacagaggagggccatgacagcctgtctgtgggcagctttgaggaggacagcaagtctgagttcatcctggacccccccaagcccaagcccccagcctggttcaacggcatcctgacctgggaggactttgagctggtgaacccccaccgggcccgcttcctgaaggagatcaaggacctggccatcaagaggcggcagatcctgagcaacaagggcctgtctgaagatgagaagaacaccaagctgcaggagctggtgctgaagaaccccagcggcagcggcccccccctgagcattgaggacctgggcctgaacttccagttctgccccagcagccgcatctacggcttcaccgctgtggacctgaagcccagcggagaagatgagatgatcaccatggacaatgctgaggagtatgtggacctgatgtttgacttctgcatgcacacaggcatccagaagcagatggaggccttcagagatggcttcaacaaggtgttccccatggagaagctgagcagcttcagccatgaggaggtgcagatgatcctgtgtggcaaccagagccccagctgggccgctgaggacatcatcaactacacagagcccaagctgggctacacccgggacagccctggcttcctgcgctttgtgcgggtgctgtgtggcatgagcagtgatgagaggaaggccttcctgcagttcaccaccggctgcagcaccctgcccccaggcggcctggccaacctgcacccccggctgactgtggtgaggaaggtggatgccacagatgccagctaccccagcgtgaacacctgtgtgcactacctgaagctgcctgagtacagcagcgaggagatcatgagggagcggctgctggccgccaccatggagaagggcttccacctgaactag

SEQ ID NO: 39245 - DNA, 7833 bp, Artificial Sequence; identical to SEQ ID NO: 39244
  Description of Artificial Sequence: Synthetic coding sequence

SEQ ID NO: 39246 - DNA, 2781 bp, Artificial Sequence
  Description of Artificial Sequence: Synthetic coding sequence
atggctgatgtggaccctgacaccctgctggagtggctgcagatgggccagggagatgagcgggacatgcagctgattgccctggagcagctgtgcatgctgctgctgatgtctgacaacgtggaccgctgctttgagacctgcccccccaggaccttcctgcctgccctgtgcaagatcttcctggatgaaagtgccccagacaacgtgctggaggtgacagcccgggccatcacctactacctggatgtgtctgcagaatgtacccggcgcatcgtgggcgtggatggagccatcaaggccctgtgcaaccggctggtggtggtggagctgaacaacagaaccagccgggacctggccgagcagtgtgtgaaggtgctggagctgatctgcacccgggagagcggggctgtgtttgaagctgggggcctgaactgtgtgctgaccttcatccgggacagcggccacctggtgcacaaggacaccctgcacagcgccatggctgtggtgtcccggctgtgtgggaagatggagccccaggacagcagcctggagatctgtgtggagagcctgagcagcctgctgaagcatgaggaccaccaggtgtctgatggagccctgcgctgctttgccagcctggccgaccgcttcaccaggagaggagtggaccctgcccccctggccaagcacggcctgacagaggagctgctgagcaggatggctgctgctgggggcaccgtgtctggccccagcagcgcctgcaagccaggccgcagcaccactggagcccccagcaccacagctgacagcaagctgagcaaccaggtgtccaccatcgtgtccctgctgagcaccctgtgccggggcagccctgtggtgacccatgacctgctgcggtctgagctgcctgacagcattgagagcgccctgcagggagatgagcgctgtgtgctggacaccatgaggctggtggacctgctgctggtgctgctgtttgagggcaggaaggccctgcccaagagcagcgctggcagcacaggccgcatccctggcctgcggcggctggacagcagcggggagaggagccaccggcagctgattgactgcatccgcagcaaggacacagatgccctgattgatgccatcgacaccggggcctttgaggtgaacttcatggatgatgtgggccagaccctgctgaactgggccagcgccttcggcacccaggagatggtggagttcctgtgtgaaagaggagcagatgtgaacagaggccagaggagcagcagcctgcactacgccgcctgcttcggccggccccaggtggccaagaccctgctgcggcatggagccaacccagacctgagagatgaagatggcaagacccccctggacaaggcccgggagcggggccacagcgaggtggtggccatcctgcagagccctggggactggatgtgccctgtgaacaagggagatgacaagaagaagaaggacaccaacaaggatgaggaggagtgcaatgagcccaagggggaccctgagatggcccccatctacctgaagaggctgctgcctgtgtttgcccagaccttccagcagaccatgctgcccagcatcaggaaggccagcctggccctgatcaggaagatgatccacttctgcagcgaggccctgctgaaggaggtgtgtgacagtgatgtgggccacaacctgcccaccatcctggtggagatcacagccaccgtgctggaccaggaggatgatgatgatggccacctgctggccctgcagatcatccgggacctggtggacaagggcggggacatcttcctggaccagctggcccggctgggcgtcatcagcaaggtgtccaccctggccggccccagcagtgatgatgaaaatgaggaggagagcaagccagagaaggaggatgagccccaggaggatgccaaggagctgcagcagggcaagccctaccactggagggactggagcatcatccggggccgggactgcctgtacatctggagcgatgctgctgccctggagctgagcaatggcagcaatggctggttccgcttcatcctggatggcaagctggccaccatgtacagcagcggcagccctgagggcggcagtgacagcagcgagagccgctctgagttcctggagaagctgcagagggcccggggccaggtgaagcccagcaccagcagccagcccatcctgagcgcccctggccccaccaagctgactgtgggcaactggagcctgacctgcctgaaggagggggagatcgccatccacaacagtgatggccagcaggccaccatcctgaaggaggacctgcccggctttgtgtttgagagcaacagaggcaccaagcacagcttcaccgctgagaccagcctgggcagcgagtttgtgacaggctggacaggcaagaggggcaggaagctgaagagcaagctggagaagaccaagcagaaggtgaggaccatggcccgggacctgtatgatgaccacttcaaggctgtggagagcatgccccggggcgtggtggtgaccctgaggaacatcgccacccagctggagagctcctgggagctgcacaccaaccggcagtgcattgaaagtgagaacacctggagggacctgatgaagacagccctggagaacctgattgtgctgctgaaggatgagaacaccatcagcccctatgagatgtgcagcagcggcctggtgcaggccctgctgactgtgctgaacaactag

SEQ ID NO: 39247 - DNA, 2331 bp, Artificial Sequence
  Description of Artificial Sequence: Synthetic coding sequence
atgtctgaggccgtgcgggtgcccagccctgccacccccctggtggtggccgccccagcccctgaggagaggaagggcaaggagagcgagcgggagaagctgccccccatcgtgtctgctggggccggggccacagctggcctggacagaggagccaagggccagatcagcaccttcagcagcttcatctctgctgtgagccccaagaaggaggccgctgagaacagaagcagccctgcccacctggtgttccccaacatcaagaatgtgcgggagcccccacccatctgcctggatgtgcggcagaagcagaggacctccatggatgccagcagcagcgagatgaaggcccctgtgctgcctgagcccatcctgcccatccagcccaagacagtgaaggacttccaggaggatgtggagaaggtgaagagcagcggggactggaaggctgtgcatgacttctacctgaccacctttgacagcttccctgagctgaatgctgccttcaagaaggatgccacagccagcttcaacaccattgaagattctggcatcaatgccaagtttgtgaatgctgtgtatgacaccctgctgaacaccccccaggatgtgcagaagacagtgctgaagggcatcatcaacagcctgctgcgggagtggaagggccccaggaccaaggatgacctgcgggcctacttcatcctgctgcagaacccccagttcaacaacaccagcacctacgtgatctatgcccacctgctgcggcagatcgccaccctggtggaggccgaccaccacttcctggtgcactggttcaagaagctgagccagaagcgcttcaagcagctggtggagcggctgctgcagttcatcagcctgcggctcttccctgccaagccagaggagttcccccccatcaccaagtgctcctggtggatccccagcgctgccaaggtgctggccctgctgaacacagccaacaacctggtgcaccccccactcatcccctacacagacttctacaacagcaccctggaccacatcgacctgatggaggagtaccacacctggcagaactttggaaacagccaccgcttctccttctgccagtacccctttgtgatctctgtggccgccaagaagatcatcatccagagggacagcgagcagcagatgatcaacatcgcccggcagagcctggtggacaaggtgtcccggcggcagaggccagacatgaacatcctcttcctgaacatgaaggtgcggaggacccacctggtgtctgacagcctggatgagctgaccaggaagagagctgacctgaagaagaagctgaaggtgacctttgtgggggaggccggcctggacatgggcggcctgaccaaggagtggttcctgctgctgatccggcagatcttccacccagactatggcatgttcacctaccacaaggacagccactgccactggttcagcagcttcaagtgtgacaactacagcgagttccggctggtgggcatcctgatgggcctggccgtgtacaacagcatcaccctggacatccgcttccccccctgctgctacaagaagctgctgagcccccccatcatccccagcgaccagaacatccctgtgggcatctgcaatgtgacagtggatgacctgtgccagatcatgcctgagctggcccacggcctgtctgagctgctgagccatgagggcaatgtggaggaggacttctacagcaccttccaggtgttccaggaggagtttggcatcatcaagagctacaacctgaagccaggaggagacaagatctctgtgaccaaccagaacaggaaggagtatgtgcagctgtacacagacttcctgctgaacaagagcatctacaagcagtttgctgccttctactacggcttccacagcgtgtgtgccagcaatgccctgatgctgctgcggcctgaggaggtggagatcctggtgtgtggcagcccagacctggacatgcacgccctgcagaggagcacccagtatgatggctacgccaagacagacctgaccatcaagtacttctgggatgtggtgctgggcttccccctggacctgcagaagaagctgctgcacttcaccactggaagtgacagagtgcctgtgggcggcatggctgacctgaacttcaagatcagcaagaatgagaccagcaccaactgcctgcctgtggcccacacctgcttcaaccagctgtgcctgcccccctacaagagcaagaaggacctgaagcagaagctgatcatcggcatcagcaacagcgagggcttcggcctggagtag

SEQ ID NO: 39248 - DNA, 1281 bp, Artificial Sequence
  Description of Artificial Sequence: Synthetic coding sequence
atggaggagtaccacacctggcagaactttggaaacagccaccgcttctccttctgccagtacccctttgtgatctctgtggccgccaagaagatcatcatccagagggacagcgagcagcagatgatcaacatcgcccggcagagcctggtggacaaggtgtcccggcggcagaggccagacatgaacatcctcttcctgaacatgaaggtgcggaggacccacctggtgtctgacagcctggatgagctgaccaggaagagagctgacctgaagaagaagctgaaggtgacctttgtgggggaggccggcctggacatgggcggcctgaccaaggagtggttcctgctgctgatccggcagatcttccacccagactatggcatgttcacctaccacaaggacagccactgccactggttcagcagcttcaagtgtgacaactacagcgagttccggctggtgggcatcctgatgggcctggccgtgtacaacagcatcaccctggacatccgcttccccccctgctgctacaagaagctgctgagcccccccatcatccccagcgaccagaacatccctgtgggcatctgcaatgtgacagtggatgacctgtgccagatcatgcctgagctggcccacggcctgtctgagctgctgagccatgagggcaatgtggaggaggacttctacagcaccttccaggtgttccaggaggagtttggcatcatcaagagctacaacctgaagccaggaggagacaagatctctgtgaccaaccagaacaggaaggagtatgtgcagctgtacacagacttcctgctgaacaagagcatctacaagcagtttgctgccttctactacggcttccacagcgtgtgtgccagcaatgccctgatgctgctgcggcctgaggaggtggagatcctggtgtgtggcagcccagacctggacatgcacgccctgcagaggagcacccagtatgatggctacgccaagacagacctgaccatcaagtacttctgggatgtggtgctgggcttccccctggacctgcagaagaagctgctgcacttcaccactggaagtgacagagtgcctgtgggcggcatggctgacctgaacttcaagatcagcaagaatgagaccagcaccaactgcctgcctgtggcccacacctgcttcaaccagctgtgcctgcccccctacaagagcaagaaggacctgaagcagaagctgatcatcggcatcagcaacagcgagggcttcggcctggagtag

SEQ ID NO: 39249 - DNA, 444 bp, Artificial Sequence
  Description of Artificial Sequence: Synthetic coding sequence
ctgagccagaagcgcttcaagcagctggtggagcggctgctgcagttcatcagcctgcggctcttccctgccaagccagaggagttcccccccatcaccaagtgctcctggtggatccccagcgctgccaaggtgctggccctgctgaacacagccaacaacctggtgcaccccccactcatcccctacacagacttctacaacagcaccctggaccacatcgacctgatggaggagtaccacacctggcagaactttggaaacagccacaggatggctgtgcgcatcaagaggaactacacccacaccatcatcctgtacatggtgaagcacaaccccaaggtgatgttctacatcgccacccggggcaccctggacagcctgagcatcatcctgctgaagatccaccactttgccttctccttcttccacctgctgtcctag

SEQ ID NO: 39250 - DNA, 624 bp, Artificial Sequence
  Description of Artificial Sequence: Synthetic coding sequence
atgtctgaggccgtgcgggtgcccagccctgccacccccctggtggtggccgccccagcccctgaggagaggaagggcaaggagagcgagcgggagaagctgccccccatcgtgtctgctggggccggggccacagctggcctggacagaggagccaagggccagatcagcaccttcagcagcttcatctctgctgtgagccccaagaaggaggccgctgagaacagaagcagccctgcccacctggtgttccccaacatcaagaatgtgcgggagcccccacccatctgcctggatgtgcggcagaagcagaggacctccatggatgccagcagcagcgagatgaaggcccctgtgctgcctgagcccatcctgcccatccagcccaagacagtgaaggacttccaggaggatgtggagaaggtgaagagcagcggggactggaaggctgtgcatgacttctacctgaccacctttgacagcttccctgagctgaatgctgccttcaagaaggatgccacagccagcttcaacaccattgaagattctggcatcaatgccaagtttgtgaatgctgtgtatgacaccctgctgaacacagtgtccatcatgacctgcaagtag

SEQ ID NO: 39251 - DNA, 2343 bp, Artificial Sequence
  Description of Artificial Sequence: Synthetic coding sequence
atgtctgaggccgtgcgggtgcccagccctgccacccccctggtggtggccgccccagcccctgaggagaggaagggcaaggagagcgagcgggagaagctgccccccatcgtgtctgctggggccggggccacagctggcctggacagaggagccaagggccagatcagcaccttcagcagcttcatctctgctgtgagccccaagaaggaggccgctgagaacagaagcagccctgcccacctggtgttccccaacatcaagaatgtgcgggagcccccacccatctgcctggatgtgcggcagaagcagaggacctccatggatgccagcagcagcgagatgaaggcccctgtgctgcctgagcccatcctgcccatccagcccaagacagtgaaggacttccaggaggatgtggagaaggtgaagagcagcggggactggaaggctgtgcatgacttctacctgaccacctttgacagcttccctgagctgaatgctgccttcaagaaggatgccacagccagcttcaacaccattgaagattctggcatcaatgccaagtttgtgaatgctgtgtatgacaccctgctgaacaccccccaggatgtgcagaagacagtgctgaagggcatcatcaacagcctgctgcgggagtggaagggccccaggaccaaggatgacctgcgggcctacttcatcctgctgcagaacccccagttcaacaacaccagcacctacgtgatctatgcccacctgctgcggcagatcgccaccctggtggaggccgaccaccacttcctggtgcactggttcaagaagcagtacagccggctgagccagaagcgcttcaagcagctggtggagcggctgctgcagttcatcagcctgcggctcttccctgccaagccagaggagttcccccccatcaccaagtgctcctggtggatccccagcgctgccaaggtgctggccctgctgaacacagccaacaacctggtgcaccccccactcatcccctacacagacttctacaacagcaccctggaccacatcgacctgatggaggagtaccacacctggcagaactttggaaacagccaccgcttctccttctgccagtacccctttgtgatctctgtggccgccaagaagatcatcatccagagggacagcgagcagcagatgatcaacatcgcccggcagagcctggtggacaaggtgtcccggcggcagaggccagacatgaacatcctcttcctgaacatgaaggtgcggaggacccacctggtgtctgacagcctggatgagctgaccaggaagagagctgacctgaagaagaagctgaaggtgacctttgtgggggaggccggcctggacatgggcggcctgaccaaggagtggttcctgctgctgatccggcagatcttccacccagactatggcatgttcacctaccacaaggacagccactgccactggttcagcagcttcaagtgtgacaactacagcgagttccggctggtgggcatcctgatgggcctggccgtgtacaacagcatcaccctggacatccgcttccccccctgctgctacaagaagctgctgagcccccccatcatccccagcgaccagaacatccctgtgggcatctgcaatgtgacagtggatgacctgtgccagatcatgcctgagctggcccacggcctgtctgagctgctgagccatgagggcaatgtggaggaggacttctacagcaccttccaggtgttccaggaggagtttggcatcatcaagagctacaacctgaagccaggaggagacaagatctctgtgaccaaccagaacaggaaggagtatgtgcagctgtacacagacttcctgctgaacaagagcatctacaagcagtttgctgccttctactacggcttccacagcgtgtgtgccagcaatgccctgatgctgctgcggcctgaggaggtggagatcctggtgtgtggcagcccagacctggacatgcacgccctgcagaggagcacccagtatgatggctacgccaagacagacctgaccatcaagtacttctgggatgtggtgctgggcttccccctggacctgcagaagaagctgctgcacttcaccactggaagtgacagagtgcctgtgggcggcatggctgacctgaacttcaagatcagcaagaatgagaccagcaccaactgcctgcctgtggcccacacctgcttcaaccagctgtgcctgcccccctacaagagcaagaaggacctgaagcagaagctgatcatcggcatcagcaacagcgagggcttcggcctggagtag

SEQ ID NO: 39252 - DNA, 1098 bp, Artificial Sequence
  Description of Artificial Sequence: Synthetic coding sequence
atgaacatcctcttcctgaacatgaaggtgcggaggacccacctggtgtctgacagcctggatgagctgaccaggaagagagctgacctgaagaagaagctgaaggtgacctttgtgggggaggccggcctggacatgggcggcctgaccaaggagtggttcctgctgctgatccggcagatcttccacccagactatggcatgttcacctaccacaaggacagccactgccactggttcagcagcttcaagtgtgacaactacagcgagttccggctggtgggcatcctgatgggcctggccgtgtacaacagcatcaccctggacatccgcttccccccctgctgctacaagaagctgctgagcccccccatcatccccagcgaccagaacatccctgtgggcatctgcaatgtgacagtggatgacctgtgccagatcatgcctgagctggcccacggcctgtctgagctgctgagccatgagggcaatgtggaggaggacttctacagcaccttccaggtgttccaggaggagtttggcatcatcaagagctacaacctgaagccaggaggagacaagatctctgtgaccaaccagaacaggaaggagtatgtgcagctgtacacagacttcctgctgaacaagagcatctacaagcagtttgctgccttctactacggcttccacagcgtgtgtgccagcaatgccctgatgctgctgcggcctgaggaggtggagatcctggtgtgtggcagcccagacctggacatgcacgccctgcagaggagcacccagtatgatggctacgccaagacagacctgaccatcaagtacttctgggatgtggtgctgggcttccccctggacctgcagaagaagctgctgcacttcaccaccggcagtgacagagtgcctgtgggcggcatggctgacctgaacttcaagatcagcaagaatgagaccagcaccaactgcctgcctgtggcccacacctgcttcaaccagctgtgcctgcccccctacaagagcaagaaggacctgaagcagaagctgatcatcggcatcagcaacagcgagggcttcggcctggagtag

SEQ ID NO: 39253 - DNA, 3306 bp, Artificial Sequence
  Description of Artificial Sequence: Synthetic coding sequence
atggatgaatgtggcagccgcatcagaagaagagtgtccctgcccaagaggaaccggcccagcctgggctgcatctttggagcccccacagctgctgagctggtgcctggagatgagggcaaggaggaggaggagatggtggctgaaaatagaagaaggaagacagctggggtgctgcctgtggaggtgcagcccctgctgctgagtgacagcccagaatgtctggtgctgggcggcggggacaccaacccagacctgctgcggcacatgcccacagacagaggagtgggggaccagcccaatgattctgaggtggacatgtttggagactatgacagcttcacagagaacagcttcatcgcccaggtggatgacctggagcagaagtacatgcagctgcctgagcacaagaagcacgccacagactttgccacagagaacctgtgcagcgagagcatcaagaacaagctgagcatcaccaccatcggcaacctgacagagctgcagacagacaagcacacagagaaccagagcggctatgagggcgtgaccatcgagcctggagctgacctgctgtatgatgtgcccagcagccaggccatctactttgagaacctgcagaacagcagcaatgacctgggggaccacagcatgaaggagcgggactggaagagcagcagccacaacacagtgaatgaggagctgccccacaactgcatcgagcagccccagcagaatgatgagagcagcagcaaggtgaggaccagcagtgacatgaacagaaggaagagcatcaaggaccacctgaagaatgccatgactggaaatgccaaggcccagacccccatcttcagccgcagcaagcagctgaaggacaccctgctgtctgaggagatcaacgtggccaagaagacagtggagagcagcagcaatgacctgggccccttctacagcctgcccagcaaggtgcgggacctgtatgcccagttcaagggcatcgagaagctgtatgagtggcagcacacctgcctgaccctgaacagcgtgcaggagaggaagaacctgatctacagcctgcccaccagcggcggcaagaccctggtggccgagatcctgatgctgcaggagctgctgtgctgcaggaaggatgtgctgatgatcctgccctacgtggccatcgtgcaggagaagatcagcggcctgagcagctttggcatcgagctgggcttctttgtggaggagtatgccggcagcaagggccgcttcccccccaccaagagaagagagaagaagagcctgtacatcgccaccatcgagaagggccacagcctggtgaacagcctgattgaaacaggaagaattgacagcctgggcctggtggtggtggatgagctgcacatgattggagagggcagcagaggagccaccctggagatgaccctggccaagatcctgtacaccagcaagaccacccagatcatcggcatgtctgccaccctgaacaacgtggaggacctgcagaagttcctgcaggccgagtactacaccagccagttccggcctgtggagctgaaggagtacctgaagatcaatgacaccatctatgaggtggacagcaaggccgagaatggcatgaccttcagccggctgctgaactacaagtacagcgacaccctgaagaagatggaccctgaccacctggtggccctggtgacagaggtgatccccaactacagctgcctggtgttctgccccagcaagaagaactgtgaaaatgtggccgagatgatctgcaagttcctgagcaaggagtacctgaagcacaaggagaaggagaagtgtgaggtgatcaagaacctgaagaacattggaaatggaaacctgtgccctgtgctgaagaggaccatccccttcggcgtggcctaccaccacagcggcctgaccagtgatgagaggaagctgctggaggaggcctacagcactggagtgctgtgcctcttcacctgcaccagcaccctggccgccggcgtgaacctgcctgcccggcgggtcatcctgcgggccccctacgtggccaaggagttcctgaagaggaaccagtacaagcagatgattggccgggccggccgggccggcatcgacaccatcggggagagcatcctgatcctgcaggagaaggacaagcagcaggtgctggagctgatcaccaagcccctggagaactgctacagccacctggtgcaggagttcaccaagggcatccagaccctcttcctgagcctcatcggcctgaagatcgccaccaacctggatgacatctaccacttcatgaatggcaccttcttcggcgtgcagcagaaggtgctgctgaaggagaagagcctgtgggagatcaccgtggagagcctgcgctacctgacagagaagggcctgctgcagaaggacaccatctacaagtctgaggaggaggtgcagtacaacttccacatcaccaagctgggccgggccagcttcaagggcaccatcgacctggcctactgtgacatcctgtacagagacctgaagaagggcctggagggcctggtgctggagagcctgctgcacctgatctacctgaccaccccctatgacctggtgtcccagtgcaacccagactggatgatctacttccggcagttcagccagctgagccctgctgagcagaatgtggccgccatcctgggcgtgtctgagagcttcatcggcaagaaggccagcggccaggccatcggcaagaaggtggacaagaatgtggtgaacagactctacctgagctttgtgctgtacaccctgctgaaggagaccaacatctggacagtgtctgagaagttcaacatgccccggggctacatccagaacctgctgactggaacagccagcttcagcagctgtgtgctgcacttctgtgaggagctggaggagttctgggtgtaccgggccctgctggtggagctgaccaagaagctgacctactgtgtgaaggccgagctgatccccctgatggaggtgactggagtgctggagggccgggccaagcagctgtacagcgctggctacaagagcctgatgcacctggccaatgccaaccctgaggtgctggtgaggaccatcgaccacctgagccggcggcaggccaagcagatcgtgagcagcgccaagatgctgctgcacgagaaggccgaggccctgcaggaggaggtggaggagctgctgcggctgcccagcgacttccctggagctgtggccagcagcacagacaaggcctag

SEQ ID NO: 39254 - DNA, 546 bp, Artificial Sequence
  Description of Artificial Sequence: Synthetic coding sequence
atgaccaccaccaccaccttcaagggcgtggaccccaacagcaggaacagcagccgggtgctgcggcccccaggcggcggcagcaacttcagcctgggctttgatgagcccacagagcagcctgtgaggaagaacaagatggccagcaacatcttcggcaccccagaggagaaccaggcctcctgggccaagtctgctggggccaagagcagcggcggccgggaggacctggagagcagcggcctgcagaggaggaacagcagcgaggccagcagcggggacttcctggacctgaagaagatgtggacccagacctgccaggccgcctggggccgggtgaagaggagcccctgcctgctgcggctgtgcccagcccgctggccccggccccagtgccaccctgaggagatccccctggccgccagccctgccagctcctgggtgtccagtgactgcccagagcgctgccgctctgtgtgcttcctgcacgcctgtgagctgcacaacctgagcctgactgtgcacctgctggacctcttccactag

SEQ ID NO: 39255 - DNA, 327 bp, Artificial Sequence
  Description of Artificial Sequence: Synthetic coding sequence
atggccagcaacatcttcggcaccccagaggagaaccaggcctcctgggccaagtctgctggggccaagagcagcggcggccgggaggacctggagagcagcggcctgcagaggaggaacagcagcgaggccagcagcggggacttcctggacctgaagaccagcggcggcaagattgaaaatgtggacacagacctgcccggcagcctgggccagagcgaggagaagcctgtgcctgctgcccctgtgcccagccctgtggccccagcccctgtgcccagcagaagaaaccccccaggcggcaagagcagcctggtgctgggctag

SEQ ID NO: 39256 - DNA, 327 bp, Artificial Sequence
  Description of Artificial Sequence: Synthetic coding sequence
atggccagcaacatcttcggcaccccagaggagaaccaggcctcctgggccaagtctgctggggccaagagcagcggcggccgggaggacctggagagcagcggcctgcagaggaggaacagcagcgaggccagcagcggggacttcctggacctgaagggggagggggacatccatgaaaatgtggacacagacctgcccggcagcctgggccagagcgaggagaagcctgtgcctgctgcccctgtgcccagccctgtggccccagcccctgtgcccagcagaagaaaccccccaggcggcaagagcagcctggtgctgggctag

SEQ ID NO: 39257 - DNA, 465 bp, Artificial Sequence
  Description of Artificial Sequence: Synthetic coding sequence
atgaccaccaccaccaccttcaagggcgtggaccccaacagcaggaacagcagccgggtgctgcggcccccaggcggcggcagcaacttcagcctgggctttgatgagcccacagagcagcctgtgaggaagaacaagatggccagcaacatcttcggcaccccagaggagaaccaggcctcctgggccaagtctgctggggccaagagcagcggcggccgggaggacctggagagcagcggcctgcagaggaggaacagcagcgaggccagcagcggggacttcctggacctgaagggggagggggacatccatgaaaatgtggacacagacctgcccggcagcctgggccagagcgaggagaagcctgtgcctgctgcccctgtgcccagccctgtggccccagcccctgtgcccagcagaagaaaccccccaggcggcaagagcagcctggtgctgggctag

SEQ ID NO: 39258 - DNA, 198 bp, Artificial Sequence
  Description of Artificial Sequence: Synthetic coding sequence
atgcagagcgaggtgcagaggcagcctgacaggagcatccagaaccccctgactgtgggcagccacaccccctgcctgaccccacccaccatgagctgcaacaacagccaggtgtggtggtgtgtgcctgtggtgcctgccacctgggagcctgaggccggcggcagcctggagagcagcagcagccggctgcagtag

SEQ ID NO: 39259 - DNA, 663 bp, Artificial Sequence
  Description of Artificial Sequence: Synthetic coding sequence
atggccctgagctctgtgggccgggcctggtgccccccaggcttcatccggcagaatggagtgtgcacagacctggatgaatgtcgggtgaggaacctgtgccagcacgcctgcaggaacacagagggcagctaccagtgcctgtgcccagctggctaccgcctgctgcccagcggcaagaactgccaggacatcaatgaatgtgaggaggagagcattgaatgtggccctggccagatgtgcttcaacacccggggcagctaccagtgtgtggacaccccctgcccagccacctaccggcagggccccagccctggcacctgcttccgccgctgcagccaggactgtggcaccggcggccccagcaccctgcagtaccgcctgctgcccctgcccctgggcgtgcgggcccaccatgatgtggcccggctgacagccttcagcgaggtgggcgtgcctgccaacagaacagagctgtccatgctggagccagaccccaggagcccctttgccctgcggcccctgcgggccggcctgggcgctgtgtacacccggcgggccctgaccagggctggcctgtaccgcctgactgtgcgggctgctgcccccaggcaccagagcgtgtttgtgctgctgattgctgtgagcccctacccctactag

SEQ ID NO: 39260 - DNA, 990 bp, Artificial Sequence
  Description of Artificial Sequence: Synthetic coding sequence
atgatggcccctgtggtgctgacctgccacagcacaggcatcccagcccccaccgtgtcctggagcaaggccggggcccagctgggcgcccggggcagcggctacagagtgagccccagcggggccctggagatcggccaggccctgcccatccatgctggccgctacacctgcagcgccagaaattctgctggggtggcccacaagcacgtgttcctgactgtgcaggccagccctgtggtgaagcccctgcccagcgtggtgcgggctgtggccgaggaggaggtgctgctgccctgtgaggccagcggcatcccccggcccaccatcacctggcagaaggagggcctgaatgtggccactggagtgtccacccaggtgctgcccggcggccagctgagaattgcccacgccagcccagaagatgctggcaactacctgtgcatcgccaagaacagcgctggcagcgccatgggcaagacccggctggtggtgcaggtgccccctgtgattgaaaatggcctgcctgacctgagcaccacagagggcagccacgccttcctgccctgcaaggcccggggcagccctgagcccaacatcacctgggacaaggatggccagcctgtgtctggagctgagggcaagttcaccatccagcccagcggggagctgctggtgaagaacctggagggccaggatgctggcacctacacctgcacagcagaaaatgctgtgggccgggcccggcggcgggtgcacctgaccatcctggtgctgcccgtcttcaccaccctgcccggggacaggagcctgcggctgggggaccggctgtggctgcgctgtgccgcccggggcagccccaccccaagaattggctggacagtgaatgacaggcctgtgacaggcctgggcctgctgggcatgggcggcacagagagccaggacaccggccgcctgcggcgggagggccgctggggagaccccacctag

SEQ ID NO: 39261 - DNA, 462 bp, Artificial Sequence
  Description of Artificial Sequence: Synthetic coding sequence
atgagaggagccagcgcccggccccccctgctgggcagcgaggagcccttctgcccagccagccgctctgtgcgggagggcggcggcggcgtgtccccacctcctggccagcccccctgcccagagggccgctggggcggccagcccccagcccggcctgctgaccccagcggccgggaggtgggcggcagcgccccctgcccagccagcaggcctgtgcgggaggtgcggggggccagcgcccggccccccctgctgggcagcgaggagcccctgtgcccagccagccggcccatctgggagggcggcggcggcgtgagccccccaccctgccagcccccctgccctgggggccgcggggccagcgcccggccccccctgctgggcaatgaggagcccctgtgcccagccaccaccccatctggccgctgcacccagcagctggtggagaatggcccctag

SEQ ID NO: 39262 - DNA, 1866 bp, Artificial Sequence
  Description of Artificial Sequence: Synthetic coding sequence
atgagccctgtgttccccatgctgactgtgctgaccatgttctactacatctgcctgcggcggcgggccaggacagccaccagaggagagatgatgaacacccaccgggccatcgagagcaacagccagaccagccccctgaatgctgaggtggtgcagtatgccaaggaggtggtggacttcagcagccactacggcagcgagaacagcatgagctacaccatgtggaacctggccggcgtgcccaacgtgttccccagcagcggggacttcacccagacagctgtgttccgcacctacggcacctggtgggaccagtgccccagcgccagcctgcccttcaagaggaccccacccaacttccagagccaggactatgtggagctgacctttgagcagcaggtgtaccccacagctgtgcacgtgctggagacctaccaccctggggccgtcatccgcatcctggcctgcagcgccaacccctacagccccaaccccccagctgaggtgcgctgggagatcctgtggagcgagcggcccaccaaggtgaatgccagccaggcccggcagttcaagccctgcatcaagcagatcaacttccccaccaacctgatccggctggaggtgaacagcagcctgctggagtactacacagagctggatgctgtggtgctgcacggcgtgaaggacaagcctgtgctgagcctgaagaccagcctgattgacatgaatgacattgaagatgatgcctatgcagagaaggatggctgcggcatggacagcctgaacaagaagttcagcagcgctgtgctgggggagggccccaacaacggctactttgacaagctgccctatgagctgatccagctgatcctgaaccacctgaccctgcctgacctgtgccgcctggcccagacctgcaagctgctgagccagcactgctgtgaccccctgcagtacatccacctgaacctgcagccctactgggccaagctggatgacaccagcctggagttcctgcagagccgctgcaccctggtgcagtggctgaacctgtcctggacaggcaacagaggcttcatctctgtggccggcttcagccgcttcctgaaggtgtgtggcagcgagctggtgcggctggagctgagctgcagccacttcctgaatgagacctgcctggaggtgatcagcgagatgtgccccaacctgcaggccctgaacctgagcagctgtgacaagctgcccccccaggccttcaaccacatcgccaagctgtgcagcctgaagaggctggtgctgtaccgcaccaaggtggagcagacagccctgctgagcatcctgaacttctgcagcgagctgcagcacctgagcctgggcagctgtgtgatgattgaagattatgatgtgattgcctccatgattggagccaagtgcaagaagctgcggaccctggacctgtggcgctgcaagaacatcacagaaaatggaattgctgagctggccagcggctgccccctgctggaggagctggacctgggctggtgccccaccctgcagagcagcacaggctgcttcacccggctggcccaccagctgcccaacctgcagaagctgttcctgacagccaacagatctgtgtgtgacacagacattgatgagctggcctgcaactgcacccggctgcagcagctggacatcctgggcaccaggatggtgtccccagccagcctgaggaagctgctggagagctgcaaggacctgagcctgctggatgtgtccttctgcagccagattgacaacagagctgtgctggagctgaatgccagcttccccaaggtgttcatcaagaagagcttcacccagtag

SEQ ID NO: 39263 - DNA, 756 bp, Artificial Sequence
  Description of Artificial Sequence: Synthetic coding sequence
atgtctgcctacggcatgcccatgtacaagagcggggacctggtgtttgccaagctgaagggctacgcccactggccagccagaattgagcacatgacccagcccaaccgctaccaggtgttcttcttcggcacccatgaaacagccttcctgagccccaagaggctcttcccctacaaggagtgcaaggagaagtttgggaagcccaacaagaggcggggcttctctgctggcctgtgggagattgagaacaaccccaccgtgcaggccagtgactgccccctggccagcgagaagggcagcggagatggcccctggccagagcctgaggccgcagaaggagatgaggacaagcccacccacgccggcggcggcggagatgagctgggcaagccagatgatgacaagcccacagaggaggagaagggccccctgaagaggtctgctggggaccccccagaagatgcccccaagaggcccaaggaggccgccccagaccaggaggaggaggccgaggccgagagagctgctgaggccgagagagctgctgctgctgctgctgccacagctgtggatgaggagagccccttcctggtggccgtggagaatggaagtgcccccagcgagcccggcctggtgtgtgagcccccccagcctgaggaggaggagctgcgggaggaggaggtggctgatgaggaggccagccaggagtggcacgccgaggcccctgggggcggggaccgggacagcctgtag

SEQ ID NO: 39264 - DNA, 345 bp, Artificial Sequence
  Description of Artificial Sequence: Synthetic coding sequence
atgtttggagcctgctacaagcagcccctgaagcccagcggcagcgagcccccagcagaagaatgtaggatgacccccaggcatgctggctgtgatgtgacagagatgcagaggatcctgagccagcccaccttcacagagcacctgctgcgggctgtgtgcaccaagctggccaacatgtacagcaccagcacagactgccgggagcactgccggcggggcatgaaggccaagcagctgaaggccgaggccggccgcagctgccagaggaaaggagtgcccatccagaccccccgggagcacagctggatcagctgcaagaaggagtttgaggccaacccctag

SEQ ID NO: 39265 - DNA, 231 bp, Artificial Sequence
  Description of Artificial Sequence: Synthetic coding sequence
atgtttggagcctgctacaagcagcccctgaagcccagcggcagcgagcccccagcagaagaatgtaggatgacccccaggcatgctggctgtgatgtgacagagatgcagaggatcctgagccagcccaccttcacagagcacctgctgcgggctgtgctgagcacagagcggggcccctacccagaccccaagagggccttcctggacctgctgcaggagcgcatctag

SEQ ID NO: 39266 - DNA, 366 bp, Artificial Sequence
  Description of Artificial Sequence: Synthetic coding sequence
atgtttggagcctgctacaagcagcccctgaagcccagcggcagcgagcccccagcagaagaatgtaggatgacccccaggcatgctggctgtgatgtgacagagatgcagaggatcctgagccagcccaccttcacagagcacctgctgcgggctgtgtgcctggtgaatggcaagggcagcctgagccggccccaggagagcatcctgggcagcctggccaggaagaacctgcggcgcatccaccgggtgtccctggtgatgtgtgtgcggcccctgagccccagcaaggccatcatcagccctgtgacctgcatgtacaccagccgctggccagaggccagcgaggagagccagaagaagtag

SEQ ID NO: 39267 - DNA, 465 bp, Artificial Sequence
  Description of Artificial Sequence: Synthetic coding sequence
atgtttggagcctgctacaagcagcccctgaagcccagcggcagcgagcccccagcagaagaatgtaggatgacccccaggcatgctggctgtgatgtgacagagatgcagaggatcctgagccagcccaccttcacagagcacctgctgcgggctgtgtgcaccaagctggccaacatgtacagcaccagcacagactgccgggagcactgccggcggggcatgaaggccaagcagctgaaggccgaggccggccggggcctggtgaatggcaagggcagcctgagccggccccaggagagcatcctgggcagcctggccaggaagaacctgcggcgcatccaccgggtgtccctggtgatgtgtgtgcggcccctgagccccagcaaggccatcatcagccctgtgacctgcatgtacaccagccgctggccagaggccagcgaggagagccagaagaagtag

SEQ ID NO: 39268 - DNA, 345 bp, Artificial Sequence; identical to SEQ ID NO: 39264
  Description of Artificial Sequence: Synthetic coding sequence

SEQ ID NO: 39269 - DNA, 1350 bp, Artificial Sequence
  Description of Artificial Sequence: Synthetic coding sequence
atgatgctgagcacagagggccgggagggctttgtggtgaaggtgcggggcctgccctggagctgcagcgcagatgaggtgatgaggttcttcagtgactgcaagatccagaatggcaccagcggcatccgcttcatctacacccgggagggccggcccagcggggaggcctttgtggagctggagagcgaggaggaggtgaagctggccctgaagaaggaccgggagaccatgggccaccgctacgtggaggtgttcaagagcaacagcgtggagatggactgggtgctgaagcacacaggccccaacagcccagacacagccaatgatggctttgtgcggctgcggggcctgcccttcggctgcagcaaggaggagatcgtgcagttcttcagcggcctggagatcgtgcccaacggcatgaccctgcctgtggacttccagggccgcagcactggagaggcctttgtgcagtttgccagccaggagattgctgagaaggccctgaagaagcacaaggagcgcatcggccaccgctacatcgagatcttcaagagcagcagagctgaggtgaggacccactatgacccccccaggaagctgatggccatgcagaggcctggcccctatgacaggcctggagctggccggggctacaacagcatcggccgcggggccggctttgagaggatgagaagaggagcctacggcggcggctacggcggctatgatgattatggaggctacaatgatggctacggctttggaagtgaccgcttcggccgggacctgaactactgcttcagcggcatgtctgaccacagatatggagatggcggcagcagcttccagagcaccaccggccactgtgtgcacatgaggggcctgccctaccgggccacagaaaatgacatctacaacttcttcagccccctgaaccccatgagggtgcacattgaaattggaccagatggccgggtgactggagaggctgatgtggagtttgccacccatgaagatgctgtggccgccatggccaaggacaaggccaacatgcagcaccgctacgtggagctgttcctgaacagcacagctggcaccagcggcggggcctatgaccacagctatgtggagctgttcctgaacagcacagctggggccagcggcggggcctacggcagccagatgatgggcggcatgggcctgagcaaccagagcagctatggaggccctgccagccagcagctgagcggcggctacggcggcggctacggcggccagagctccatgagcggctatgaccaggtgctgcaggagaacagcagtgactaccagagcaacctggcctag

SEQ ID NO: 39270 - DNA, 1656 bp, Artificial Sequence
  Description of Artificial Sequence: Synthetic coding sequence
atggatgagggcgtgaacttcaagcccacagaggccggccgcctgatggcctggtactacatcacctttgaaacagtgaagaagttctacaccatcagcggcaaggagaccctgagtgacctggtgaccctgattgctggctgcaaggagttcctggacatccagctgcgcatcaatgagaagaagaccctgaacaccctgaacaaggaccccaaccgcatcaccatccgcttccccatggagggccgcatcaagacccgggagatgaaggtgaactgcctgatccaggcccagctgggctgcatccccatccaggactttgccctgacccaggacacagccaagatcttcagacatggcagccgcatcacccgctggctgagtgactttgtggccgcccaggagaagaagtttgctgtgctgctgaacagcctcatcctggccaagtgcttccgctgcaagctgtgggagaacagcctgcacgtgtccaagcagctggagaagattggcatcaccctgagcaatgccatcgtgaatgccggcctgaccagcttcaagaagattgaggagacagatgcccgggagctggagctgatcctgaacagacacccccccttcggcacccagatcaaggagaccgtgatgtacctgcccaagtatgagctgaaggtggagcagatcacccgctacagcgacaccacagctgagatcctggtgaccgtcatcctgaggaactttgagcagctgcagaccaagaggacagccagtgacagccactacgtgaccctcatcattggagatgctgacaaccaggtggtgtacctgcacaagatcacagattctgtgctgctgaaggccggctcctgggccaagaagattgctgtgaagagggccctgaagtctgaggacctgagcatcaacctgatcagcagcgagtttgtgggcctggacatccagcagaagctgactgtgttctacctggagcccaagcgcttcggcaaccagatcaccatgcagaggaagtctgagacccagatcagccacagcaagcacagcgacatcagcaccatcgccggccccaacaagggcaccacagccagcaagaagccaggcaaccgggagtgcaaccacctgtgcaagagcaagcacacctgtggccatgactgctgcaagattggagtggcccagaagtctgagatcaaggagagcaccatcagcagctacctgagtgacctgaggaacagaaatgctgtgtcctctgtgccccctgtgaagaggctgaagatccagatgaacaagagccagagcgtggacctgaaggagtttggcttcacccccaagcccagcctgcccagcatcagccgctctgagtacctgaacatcagcgagctgcccatcatggagcagtgggaccagcctgagatctacggcaaggtgcggcaggagcccagcgagtaccaggacaaggaggtgctgaatgtgaactttgagctgggcaatgaggtgtgggatgactttgatgatgagaacctggaggtgaccagcttcagcacagacacagagaagaccaagatctctgtgctcttccaccacatgcgctgccgcatcttcctgtaccagatcctgctgtgccccagctctgtgcaccccccatag

SEQ ID NO: 39271 - DNA, 2493 bp, Artificial Sequence
  Description of Artificial Sequence: Synthetic coding sequence
atgattgcctgcttcctgtggaagatctgcttcctgaagaaccagatgaagctgaagatggcccccatcaaggccctgtgcagccagagatttgatgactggaaggagaagtttggccccatcggcctgaactgcaaggagctgactggagacacagtgatggatgacctgtttgagatccagcacgcccacatcatcatgaccaccccagagaagtgggacagcatgaccaggaagtggagggacaacagcctggtgcagctggtgcggctcttcctgattgatgaggtgcacatcgtgaaggatgaaaatagaggccccaccctggaggtggtggtgtccaggatgaagacagtgcagagcgtgtcccagaccctgaagaacaccagcacagccatccccatgagatttgtggccgtgtctgccaccatccccaatgctgaggacattgctgagtggctgagtgatggagagaggcctgctgtgtgcctgaagatggatgagagccacaggcctgtgaagctgcagaaggtggtgctgggcttcccctgcagcagcaaccagacagagttcaagtttgacctgaccctgaactacaagatcgccagcgtcatccagatgtacagcgaccagaagcccaccctggtgttctgtgccaccaggaagggcgtgcagcaggccgcctctgtgctggtgaaggatgccaagttcatcatgacagtggagcagaagcagaggctgcagaagtatgcctacagcgtgcgggacagcaagctgcgggacatcctgaaggatggagctgcctaccaccacgccggcatggagctgagtgacaggaaggtggtggagggcgccttcaccgtgggggacctgcctgtgctcttcaccaccagcaccctggccatgggcgtgaacctgcctgcccacctggtggtgatcaagagcaccatgcactacgccggcggcctgtttgaggagtacagcgagacagacatcctgcagatgattggccgggccggccggccccagtttgacaccacagccacagctgtgatcatgacccggctgagcacccgggacaagtacatccagatgctggcctgccgggacacagtggagagcagcctgcaccgccacctgattgagcacctgaatgctgagatcgtgctgcacaccatcacagatgtgaacattgctgtggagtggatccgcagcaccctgctgtacatccgggccctgaagaaccccagccactacggctttgccagcggcctgaacaaggatggcatcgaggccaagctgcaggagctgtgcctgaagaacctgaatgacctgagcagcctggacctgatcaagatggatgagggcgtgaacttcaagcccacagaggccggccgcctgatggcctggtactacatcacctttgaaacagtgaagaagttctacaccatcagcggcaaggagaccctgagtgacctggtgaccctgattgctggctgcaaggagttcctggacatccagctgcgcatcaatgagaagaagaccctgaacaccctgaacaaggaccccaaccgcatcaccatccgcttccccatggagggccgcatcaagacccgggagatgaaggtgaactgcctgatccaggcccagctgggctgcatccccatccaggactttgccctgacccaggacacagccaagatcttcagacatggcagccgcatcacccgctggctgagtgactttgtggccgcccaggagaagaagtttgctgtgctgctgaacagcctcatcctggccaagtgcttccgctgcaagctgtgggagaacagcctgcacgtgtccaagcagctggagaagattggcatcaccctgagcaatgccatcgtgaatgccggcctgaccagcttcaagaagattgaggagacagatgcccgggagctggagctgatcctgaacagacacccccccttcggcacccagatcaaggagaccgtgatgtacctgcccaagtatgagctgaaggtggagcagatcacccgctacagcgacaccacagctgagatcctggtgaccgtcatcctgaggaactttgagcagctgcagaccaagaggacagccagtgacagccactacgtgaccctcatcattggagatgctgacaaccaggtggtgtacctgcacaagatcacagattctgtgctgctgaaggccggctcctgggccaagaagattgctgtgaagagggccctgaagtctgaggacctgagcatcaacctgatcagcagcgagtttgtgggcctggacatccagcagaagctgactgtgttctacctggagcccaagcgcttcggcaaccagatcaccatgcagaggaagtctgagacccagatcagccacagcaagcacagcgacatcagcaccatcgccggccccaacaagggcaccacagccagcaagacctgggagcccaggatgcagagcagcctgtag

SEQ ID NO: 39272 - DNA, 3345 bp, Artificial Sequence
  Description of Artificial Sequence: Synthetic coding sequence
atggaggtgcccctgccctggctgaacatcaagatcgtgtacatggcccccatcaaggccctgtgcagccagagatttgatgactggaaggagaagtttggccccatcggcctgaactgcaaggagctgaccggggacacagtgatggatgacctgtttgagatccagcacgcccacatcatcatgaccaccccagagaagtgggacagcatgaccaggaagtggagggacaacagcctggtgcagctggtgcggctcttcctgattgatgaggtgcacatcgtgaaggatgagaacagaggccccaccctggaggtggtggtgtccaggatgaagacagtgcagagcgtgtcccagaccctgaagaacaccagcacagccatccccatgagatttgtggccgtgtctgccaccatccccaatgcagaagatattgctgagtggctgagtgatggagagaggcctgctgtgtgcctgaagatggatgagagccacaggcctgtgaagctgcagaaggtggtgctgggcttcccctgcagcagcaaccagacagagttcaagtttgacctgaccctgaactacaagatcgccagcgtcatccagatgtacagcgaccagaagcccaccctggtgttctgtgccaccaggaaaggagtgcagcaggccgcctctgtgctggtgaaggatgccaagttcatcatgacagtggagcagaagcagaggctgcagaagtatgcctacagcgtgcgggacagcaagctgcgggacatcctgaaggatggagctgcctaccaccacgccggcatggagctgagtgacaggaaggtggtggagggcgccttcaccgtgggggacctgcctgtgctcttcaccaccagcaccctggccatgggcgtgaacctgcctgcccacctggtggtgatcaagagcaccatgcactacgccggcggcctgtttgaggagtacagcgagacagacatcctgcagatgattggccgggccggccggccccagtttgacaccacagccacagctgtgatcatgacccggctgagcacccgggacaagtacatccagatgctggcctgccgggacacagtggagagcagcctgcaccgccacctgattgagcacctgaatgctgagatcgtgctgcacaccatcacagatgtgaacattgctgtggagtggatccgcagcaccctgctgtacatccgggccctgaagaaccccagccactacggctttgccagcggcctgaacaaggatggcatcgaggccaagctgcaggagctgtgcctgaagaacctgaatgacctgagcagcctggacctgatcaagatggatgaaggagtgaacttcaagcccacagaagctggccgcctgatggcctggtactacatcacctttgagaccgtgaagaagttctacaccatcagcggcaaggagaccctgagtgacctggtgaccctgattgctggctgcaaggagttcctggacatccagctgcgcatcaatgagaagaagaccctgaacaccctgaacaaggaccccaaccgcatcaccatccgcttccccatggagggccgcatcaagacccgggagatgaaggtgaactgcctgatccaggcccagctgggctgcatccccatccaggactttgccctgacccaggacacagccaagatcttccgccacggcagccgcatcacccgctggctgagtgactttgtggccgcccaggagaagaagtttgctgtgctgctgaacagcctcatcctggccaagtgcttccgctgcaagctgtgggagaacagcctgcacgtgtccaagcagctggagaagattggcatcaccctgagcaatgccatcgtgaatgccggcctgaccagcttcaagaagattgaggagacagatgcccgggagctggagctgatcctgaacagacaccccccatttggcacccagatcaaggagaccgtgatgtacctgcccaagtatgagctgaaggtggagcagatcacccgctacagcgacaccacagctgagatcctggtgaccgtcatcctgaggaactttgagcagctgcagaccaagaggacagccagtgacagccactacgtgaccctcatcattggagatgctgacaaccaggtggtgtacctgcacaagatcacagacagcgtgctgctgaaggccggctcctgggccaagaagattgctgtgaagagggccctgaagtctgaggacctgagcatcaacctgatcagcagcgagtttgtgggcctggacatccagcagaagctgaccgtcttctacctggagcccaagagatttggaaaccagatcaccatgcagaggaagtctgagacccagatcagccacagcaagcacagcgacatcagcaccatcgccggccccaacaagggcaccacagccagcaagaagccaggcaaccgggagtgcaaccacctgtgcaagagcaagcacacctgtggccatgactgctgcaagattggagtggcccagaagtctgagatcaaggagagcaccatcagcagctacctgagtgacctgaggaacagaaatgctgtgtcctctgtgccccctgtgaagaggctgaagatccagatgaacaagagccagagcgtggacctgaaggagtttggcttcacccccaagcccagcctgcccagcatcagccgctctgagtacctgaacatcagcgagctgcccatcatggagcagtgggaccagcctgagatctacggcaaggtgcggcaggagcccagcgagtaccaggacaaggaggtgctgaatgtgaactttgagctgggcaatgaggtgtgggatgactttgatgatgagaacctggaggtgaccagcttcagcacagacacagagaagaccaagatcagcggctttggaaacaccctgagcagcagcacccggggcagcaagctgcccctgcaggagagcaagagcaagttccagcgggagatgagcaacagctttgtgagcagccatgagatgtctgacatcagcctgagcaacagcgccatgcccaagttcagcgccagctccatgaccaagctgccccagcaggccggaaatgctgtgattgtgcacttccaggagaggaagccccagaacctgagccctgagattgagaagcagtgcttcaccttcagcgagaagaaccccaacagcagcaactacaagaaggtggacttcttcatcagaaattctgagtgcaagaaggaggtggacttctccatgtaccacccagatgatgaagcagatgagatgaagagcctgctgggcatctttgatggcatcttctag

SEQ ID NO: 39273 - DNA, 4308 bp, Artificial Sequence
  Description of Artificial Sequence: Synthetic coding sequence
atgctgaagagcaatgactgcctcttcagcctggagaacctcttctttgagaagccagatgaggtggagaaccacccagacaatgagaagagcctggactggttcctgcccccagcccccctcatcagcgagatcccagacacccaggagctggaggaggagctggagagccacaagctgctgggccaggagaagaggcccaagatgctgaccagcaacctgaagatcaccaatgaagacaccaactacatcagcctgacccagaagttccagtttgccttccccagcgacaagtatgagcaggatgacctgaacctggagggcgtgggcaacaatgacctgagccacatcgccggcaagctgacctacgccagccagaagtacaagaaccacatcggcacagagatcgcccctgagaagtctgtgcctgatgacaccaagctggtgaactttgctgaagataaaggagagagcaccagcgtcttcaggaagaggctcttcaagatcagtgacaacatccacggcagcgcctacagcaatgacaatgagctggacagccacatcggctctgtgaagatcgtgcagacagagatgaacaagggcaagagcaggaactacagcaacagcaagcagaagttccagtacagcgccaacgtgttcaccgccaacaatgccttcagcgccagcgagattggagagggcatgttcaaggcccccagcttctctgtggccttccagccccatgacatccaggaggtgacagaaaatggcctgggcagcctgaaggctgtgacagagatcccagccaagttccgcagcatcttcaaggagttcccctacttcaactacatccagagcaaggcctttgatgacctgctgtacacagacaggaactttgtgatctgtgcccccactggaagtggcaagacagtggtgtttgagctggccatcacccggctgctgatggaggtgcccctgccctggctgaacatcaagatcgtgtacatggcccccatcaaggccctgtgcagccagagatttgatgactggaaggagaagtttggccccatcggcctgaactgcaaggagctgactggagacacagtgatggatgacctgtttgagatccagcacgcccacatcatcatgaccaccccagagaagtgggacagcatgaccaggaagtggagggacaacagcctggtgcagctggtgcggctcttcctgattgatgaggtgcacatcgtgaaggatgaaaatagaggccccaccctggaggtggtggtgtccaggatgaagacagtgcagagcgtgtcccagaccctgaagaacaccagcacagccatccccatgagatttgtggccgtgtctgccaccatccccaatgctgaggacattgctgagtggctgagtgatggagagaggcctgctgtgtgcctgaagatggatgagagccacaggcctgtgaagctgcagaaggtggtgctgggcttcccctgcagcagcaaccagacagagttcaagtttgacctgaccctgaactacaagatcgccagcgtcatccagatgtacagcgaccagaagcccaccctggtgttctgtgccaccaggaagggcgtgcagcaggccgcctctgtgctggtgaaggatgccaagttcatcatgacagtggagcagaagcagaggctgcagaagtatgcctacagcgtgcgggacagcaagctgcgggacatcctgaaggatggagctgcctaccaccacgccggcatggagctgagtgacaggaaggtggtggagggcgccttcaccgtgggggacctgcctgtgctcttcaccaccagcaccctggccatgggcgtgaacctgcctgcccacctggtggtgatcaagagcaccatgcactacgccggcggcctgtttgaggagtacagcgagacagacatcctgcagatgattggccgggccggccggccccagtttgacaccacagccacagctgtgatcatgacccggctgagcacccgggacaagtacatccagatgctggcctgccgggacacagtggagagcagcctgcaccgccacctgattgagcacctgaatgctgagatcgtgctgcacaccatcacagatgtgaacattgctgtggagtggatccgcagcaccctgctgtacatccgggccctgaagaaccccagccactacggctttgccagcggcctgaacaaggatggcatcgaggccaagctgcaggagctgtgcctgaagaacctgaatgacctgagcagcctggacctgatcaagatggatgagggcgtgaacttcaagcccacagaggccggccgcctgatggcctggtactacatcacctttgaaacagtgaagaagttctacaccatcagcggcaaggagaccctgagtgacctggtgaccctgattgctggctgcaaggagttcctggacatccagctgcgcatcaatgagaagaagaccctgaacaccctgaacaaggaccccaaccgcatcaccatccgcttccccatggagggccgcatcaagacccgggagatgaaggtgaactgcctgatccaggcccagctgggctgcatccccatccaggactttgccctgacccaggacacagccaagatcttcagacatggcagccgcatcacccgctggctgagtgactttgtggccgcccaggagaagaagtttgctgtgctgctgaacagcctcatcctggccaagtgcttccgctgcaagctgtgggagaacagcctgcacgtgtccaagcagctggagaagattggcatcaccctgagcaatgccatcgtgaatgccggcctgaccagcttcaagaagattgaggagacagatgcccgggagctggagctgatcctgaacagacacccccccttcggcacccagatcaaggagaccgtgatgtacctgcccaagtatgagctgaaggtggagcagatcacccgctacagcgacaccacagctgagatcctggtgaccgtcatcctgaggaactttgagcagctgcagaccaagaggacagccagtgacagccactacgtgaccctcatcattggagatgctgacaaccaggtggtgtacctgcacaagatcacagattctgtgctgctgaaggccggctcctgggccaagaagattgctgtgaagagggccctgaagtctgaggacctgagcatcaacctgatcagcagcgagtttgtgggcctggacatccagcagaagctgactgtgttctacctggagcccaagcgcttcggcaaccagatcaccatgcagaggaagtctgagacccagatcagccacagcaagcacagcgacatcagcaccatcgccggccccaacaagggcaccacagccagcaagaagccaggcaaccgggagtgcaaccacctgtgcaagagcaagcacacctgtggccatgactgctgcaagattggagtggcccagaagtctgagatcaaggagagcaccatcagcagctacctgagtgacctgaggaacagaaatgctgtgtcctctgtgccccctgtgaagaggctgaagatccagatgaacaagagccagagcgtggacctgaaggagtttggcttcacccccaagcccagcctgcccagcatcagccgctctgagtacctgaacatcagcgagctgcccatcatggagcagtgggaccagcctgagatctacggcaaggtgcggcaggagcccagcgagtaccaggacaaggaggtgctgaatgtgaactttgagctgggcaatgaggtgtgggatgactttgatgatgagaacctggaggtgaccagcttcagcacagacacagagaagaccaagatcagcggcttcggcaacaccctgagcagcagcacccggggcagcaagctgcccctgcaggagagcaagagcaagttccagcgggagatgagcaacagctttgtgagcagccatgagatgtctgacatcagcctgagcaacagcgccatgcccaagttcagcgccagctccatgaccaagctgccccagcaggccggaaatgctgtgattgtgcacttccaggagaggaagccccagaacctgagccctgagattgagaagcagtgcttcaccttcagcgagaagaaccccaacagcagcaactacaagaaggtggacttcttcatccggaacagcgagtgcaagaaggaggtggacttctccatgtaccacccagatgatgaagcagatgagatgaagagcctgctgggcatctttgatggcatcttctag

SEQ ID NO: 39274 - DNA, 417 bp, Artificial Sequence
  Description of Artificial Sequence: Synthetic coding sequence
atgctgaagagcaatgactgcctcttcagcctggagaacctcttctttgagaagccagatgaggtggagaaccacccagacaatgagaagagcctggactggttcctgcccccagcccccctcatcagcgagatcccagacacccaggagctggaggaggagctggagagccacaagctgctgggccaggagaagaggcccaagatgctgaccagcaacctgaagatcaccaatgaagacaccaactacatcagcctgacccagaagttccagtttgccttccccagcgacaagtatgagcaggatgacctgaacctggagggcgtgggcaacaatgacctgagccacatcgccggcaagctgacctacgccagccagaagtacaagaaccacatcggcacagagatcgccccctag

SEQ ID NO: 39275 - DNA, 2187 bp, Artificial Sequence
  Description of Artificial Sequence: Synthetic coding sequence
agccaggcctggaggagcagcgagggcctcatcaacagaagaagcacaggcctgggcgctgtgcggcgggagatctatgacaaggtgcagttcagcaccatgctgaagagcaatgactgcctcttcagcctggagaacctcttctttgagaagccagatgaggtggagaaccacccagacaatgagaagagcctggactggttcctgcccccagcccccctcatcagcgagatcccagacacccaggagctggaggaggagctggagagccacaagctgctgggccaggagaagaggcccaagatgctgaccagcaacctgaagatcaccaatgaagacaccaactacatcagcctgacccagaagttccagtttgccttccccagcgacaagtatgagcaggatgacctgaacctggagggcgtgggcaacaatgacctgagccacatcgccggcaagctgacctacgccagccagaagtacaagaaccacatcggcacagaaattgcccctgagaagtctgtgcctgatgacaccaagctggtgaactttgctgaggacaagggggagagcacctctgtgttcaggaagaggctcttcaagatcagtgacaacatccacggcagcgcctacagcaatgacaatgagctggacagccacatcggctctgtgaagatcgtgcagacagagatgaacaagggcaagagcaggaactacagcaacagcaagcagaagttccagtacagcgccaacgtgttcaccgccaacaatgccttcagcgccagcgagatcggggagggcatgttcaaggcccccagcttctctgtggccttccagccccatgacatccaggaggtgacagaaaatggcctgggcagcctgaaggctgtgacagagatcccagccaagttccgcagcatcttcaaggagttcccctacttcaactacatccagagcaaggcctttgatgacctgctgtacacagacaggaacttcgtcatctgtgcccccaccggcagcggcaagacagtggtgtttgagctggccatcacccggctgctgatggaggtgcccctgccctggctgaacatcaagatcgtgtacatggcccccatcaaggccctgtgcagccagagatttgatgactggaaggagaagtttggccccatcggcctgaactgcaaggagctgaccggggacacagtgatggatgacctgtttgagatccagcacgcccacatcatcatgaccaccccagagaagtgggacagcatgaccaggaagtggagggacaacagcctggtgcagctggtgcggctcttcctgattgatgaggtgcacatcgtgaaggatgagaacagaggccccaccctggaggtggtggtgtccaggatgaagacagtgcagagcgtgtcccagaccctgaagaacaccagcacagccatccccatgagatttgtggccgtgtctgccaccatccccaatgcagaagatattgctgagtggctgagtgatggagagaggcctgctgtgtgcctgaagatggatgagagccacaggcctgtgaagctgcagaaggtggtgctgggcttcccctgcagcagcaaccagacagagttcaagtttgacctgaccctgaactacaagatcgccagcgtcatccagatgtacagcgaccagaagcccaccctggtgttctgtgccaccaggaaaggagtgcagcaggccgcctctgtgctggtgaaggatgccaagttcatcatgacagtggagcagaagcagaggctgcagaagtatgcctacagcgtgcgggacagcaagctgcgggacatcctgaaggatggagctgcctaccaccacgccggcatggagctgagtgacaggaaggtggtggagggcgccttcaccgtgggggacctgcctgtgctcttcaccaccagcaccctggccatgggcgtgaacctgcctgcccacctggtggtgatcaagagcaccatgcactacgccggcggcctgtttgaggagtacagcgagacagacatcctgcagatgattggccgggccggccggccccagtttgacaccacagccacagctgtgatcatgacccggctgagcacccgggacaagtacatccagatgctggcctgccgggacacagtggagagccggctgcacgcccactag

SEQ ID NO: 39276 - DNA, 294 bp, Artificial Sequence
  Description of Artificial Sequence: Synthetic coding sequence
atgagcagtgacaaccagtggagcgcagatgaagatgagggccagctgagccgcctcatcaggaagagccgggacagcccctttgtgcccatcggcattgctggctttgtgacagtggtgtcctgtggcctgtacaagctgaagtaccgccgggaccagaagatgagcatccacctgatccacatgagggtggccgcccagggctttgtggtgggcgctgtgaccctgggcgtgctgtacagcatgtacaaggactacatccggccccgcttcttcagcgagagcaagaagtag

SEQ ID NO: 39277 - DNA, 603 bp, Artificial Sequence
  Description of Artificial Sequence: Synthetic coding sequence
atggccaagggggaccccaagaagcccaagggcaagatgtctgcctatgccttctttgtgcagacctgccgggaggagcacaagaagaagaaccctgaggtgcctgtgaactttgctgagttcagcaagaagtgcagcgagcgctggaagaccatgtctgggaaggagaagagcaagtttgatgagatggccaaggctgacaaggtgcgctatgaccgggagatgaaggactatggccctgccaagggcggcaagaagaagaaggaccccaatgcccccaagaggcctcccagcggcttcttcctgttctgcagcgagttccggcccaagatcaagagcaccaaccctggcatcagcattggagatgtggccaagaagctgggggagatgtggaacaacctgaatgattctgagaagcagccctacatcaccaaggccgccaagctgaaggagaagtatgagaaggatgtggccgactacaagagcaagggcaagtttgatggagccaagggccctgccaaggtggccaggaagaaggtggaggaggaggatgaggaggaggaggaggaggaggaggaggaggaggaggaggaggatgaatag

SEQ ID NO: 39278 - DNA, 267 bp, Artificial Sequence
  Description of Artificial Sequence: Synthetic coding sequence
atgcccaagaggaaggccaagggagatgccaagggggacaaggccaagagaagaagcacccggctgagcgccaagccagccccacccaagccccagcccaagcccaagaaggccccagccaagaagggggagaagatccccaagggcaagaagggcaaggcagatgctgggaaggagggcaacaacccagcagaaaatggagatgccaagacagaccaggcccagaaggccgagggcgctggggtggccaaggccagtgatgaatag

SEQ ID NO: 39279 - DNA, 576 bp, Artificial Sequence
  Description of Artificial Sequence: Synthetic coding sequence
atgggcaagaccaacagcaagctggcccctgaggtgctggaggacctggtgcagaacacagagttcagcgagcaggagctgaagcagtggtacaagggcttcctgaaggactgccccagcggcatcctgaacctggaggagttccagcagctgtacatcaagttcttcccctatggagatgccagcaagtttgcccagcacgccttccgcacctttgacaagaatggagatggcaccatcgacttccgggagttcatctgtgccctgtctgtgaccagccggggcagctttgagcagaagctgaactgggcctttgagatgtatgacctggatggagatggccgcatcacccggctggagatgctggagatcatcgaggccatctacaagatggtgggcaccgtcatcatgatgaggatgaaccaggacggcctgaccccccagcagagggtggacaagatcttcaagaagatggaccaggacaaggatgaccagatcaccctggaggagttcaaggaggccgccaagagtgaccccagcatcgtgctgctgctgcagtgtgacatgcagaagtag

SEQ ID NO: 39280 - DNA, 552 bp, Artificial Sequence
  Description of Artificial Sequence: Synthetic coding sequence
atgggcaagaccaacagcaagctggcccctgaggtgctggaggacctggtgcagaacacagagttcagcgagcaggagctgaaggactgccccagcggcatcctgaacctggaggagttccagcagctgtacatcaagttcttcccctatggagatgccagcaagtttgcccagcacgccttccgcacctttgacaagaatggagatggcaccatcgacttccgggagttcatctgtgccctgtctgtgaccagccggggcagctttgagcagaagctgaactgggcctttgagatgtatgacctggatggagatggccgcatcacccggctggagatgctggagatcatcgaggccatctacaagatggtgggcaccgtcatcatgatgaggatgaaccaggacggcctgaccccccagcagagggtggacaagatcttcaagaagatggaccaggacaaggatgaccagatcaccctggaggagttcaaggaggccgccaagagtgaccccagcatcgtgctgctgctgcagtgtgacatgcagaagtag

SEQ ID NO: 39281 - DNA, 1065 bp, Artificial Sequence
  Description of Artificial Sequence: Synthetic coding sequence
atggccgaggtgctgcggaccctggccggcaagcccaagtgccacgccctgcggcccatgatcctcttcctgatcatgctggtgctggtgctgtttggctacggcgtgctgagccccaggagcctgatgcctggcagcctggagcggggcttctgcatggctgtgcgggagccagaccacctgcagagggtgtccctgcccaggatggtgtacccccagcccaaggtgctgaccccctgcaggaaggatgtgctggtggtgaccccctggctggcccccatcgtgtgggagggcaccttcaacatcgacatcctgaatgagcagttccggctgcagaacaccaccatcggcctgactgtgtttgccatcaagaagtatgtggccttcctgaagctgttcctggagacagctgagaagcacttcatggtgggccaccgggtgcactactacgtgttcacagaccagctggccgctgtgccccgggtgaccctgggcaccggccggcagctgtctgtgctggaggtgcgggcctacaagcgctggcaggatgtgtccatgaggaggatggagatgatcagtgacttctgtgagcggcgcttcctgtctgaggtggactacctggtgtgtgtggatgtggacatggagttccgggaccacgtgggcgtggagatcctgacccccctgtttggcaccctgcaccctggcttctacggcagcagccgggaggccttcacctatgaaagaagaccccagagccaggcctacatccccaaggatgaaggagacttctactacctgggcggcttcttcggcggctctgtgcaggaggtgcagaggctgacccgggcctgccaccaggccatgatggtggaccaggccaacggcatcgaggccgtgtggcatgatgagagccacctgaacaagtacctgctgcggcacaagcccaccaaggtgctgagccctgagtacctgtgggaccagcagctgctgggctggccagctgtgctgaggaagctgcgcttcaccgctgtgcccaagaaccaccaggccgtgaggaacccctag

SEQ ID NO: 39282 - DNA, 126 bp, Artificial Sequence
  Description of Artificial Sequence: Synthetic coding sequence
ctggaggagcagcctgagtgccgggaggagaagaggggcagcctgcacgtgtggaagtctgagctggtggaggtggaggatgatgtgtacctgcggcacagcagcagcctgacctaccgcctgtag

SEQ ID NO: 39283 - DNA, 3648 bp, Artificial Sequence
  Description of Artificial Sequence: Synthetic coding sequence
atgaccagcacaggccaggacagcaccaccacccggcagaggaggagccggcagaacccccagagccccccccaggacagctctgtgaccagcaagaggaacatcaagaagggagctgtgcccaggagcatccccaacctggccgaggtgaagaagaagggcaagatgaagaagctgggccaggccatggaggaggacctgattgtgggcctgcagggcatggacctgaacctggaggccgaggccctggccggcaccggcctggtgctggatgagcagctgaatgagttccactgcctgtgggatgacagcttccctgagggccctgagcggctgcacgccatcaaggagcagctgatccaggagggcctgctggacagatgtgtgtccttccaggccaggtttgctgagaaggaggagctgatgctggtgcacagcctggagtacatcgacctgatggagaccacccagtacatgaatgaaggagagctgcgggtgctggccgacacctatgattctgtgtacctgcaccccaacagctacagctgtgcctgcctggccagcggctctgtgctgcggctggtggatgctgtgctgggcgctgagatcagaaatggcatggccatcatccggcccccaggccaccacgcccagcacagcctgatggatggctactgcatgttcaaccacgtggccgtggccgcccgctatgcccagcagaagcaccgcatcagaagagtgctgattgtggactgggatgtgcaccacggccagggcacccagttcacctttgaccaggaccccagcgtgctgtacttcagcatccacagatatgagcagggccgcttctggccccacctgaaggccagcaactggagcaccactggatttggccagggccagggctacaccatcaacgtgccctggaaccaggtgggcatgagagatgctgactacatcgccgccttcctgcacgtgctgctgcctgtggccctggagttccagccccagctggtgctggtggccgccggctttgatgccctgcagggcgaccccaagggggagatggccgccaccccagctggctttgcccagctgacccacctgctgatgggcctggccggcggcaagctgatcctgagcctggagggcggctacaacctgcgggccctggccgagggcgtgtctgccagcctgcacaccctgctgggggacccctgccccatgctggagagccctggggccccctgccgcagcgcccaggcctctgtgtcctgtgccctggaggccctggagcccttctgggaggtgctggtgcgcagcacagagaccgtggagcgggacaacatggaggaggacaacgtggaggagagcgaggaggagggcccctgggagccccctgtgctgcccatcctgacctggcctgtgctgcagagcaggacaggcctggtgtatgaccagaacatgatgaaccactgcaacctgtgggacagccaccaccctgaggtgccccagaggatcctgcgcatcatgtgccgcctggaggagctgggcctggccggccgctgcctgaccctgacccccaggcctgccacagaggccgagctgctgacctgccacagcgcagaatatgtgggccacctgcgggccacagagaagatgaagacccgggagctgcaccgggagagcagcaactttgacagcatctacatctgccccagcacctttgcctgtgcccagctggccactggagctgcctgccgcctggtggaggccgtgctgtctggagaggtgctgaatggagctgctgtggtgcggcccccaggccaccacgccgagcaggatgctgcctgtggcttctgcttcttcaacagcgtggccgtggccgcccggcatgcccagaccatcagcggccacgccctgcgcatcctgattgtggactgggatgtgcaccacggcaatggcacccagcacatgtttgaagatgaccccagcgtgctgtatgtgtccctgcacagatatgaccacggcaccttcttccccatgggagatgagggcgccagcagccagatcggccgggctgctggcaccggcttcaccgtgaatgtggcctggaatggccccaggatgggagatgctgactacctggccgcctggcaccggctggtgctgcccatcgcctatgagttcaaccctgagctggtgctggtgtctgctggctttgatgctgcccggggggaccccctgggcggctgccaggtgtccccagagggctacgcccacctgacccacctgctgatgggcctggccagcggccgcatcatcctgatcctggagggcggctacaacctgaccagcatcagcgagagcatggccgcctgcaccaggagcctgctgggggaccccccacccctgctgaccctgcccaggcctcccctgagcggggccctggccagcatcacagagaccatccaggtgcaccggcgctactggaggagcctgcgggtgatgaaggtggaggaccgggagggccccagcagcagcaagctggtgaccaagaaggccccccagcctgccaagccccggctggccgagaggatgaccacccgggagaagaaggtgctggaggccggcatgggcaaggtgaccagcgccagctttggagaggagagcaccccaggccagaccaacagcgagacagctgtggtggccctgacccaggaccagcccagcgaggccgccactggaggagccaccctggcccagaccatcagcgaggccgccatcggcggggccatgctgggccagaccaccagcgaggaggccgtgggcggggccaccccagaccagaccaccagcgaggagaccgtgggcggggccatcctggaccagaccaccagtgaagatgctgtgggcggggccaccctgggccagaccaccagcgaggaggccgtgggcggggccaccctggcccagaccaccagcgaggccgccatggagggcgccaccctggaccagaccaccagcgaggaggcccctgggggcacagagctgatccagacccccctggccagcagcacagaccaccagaccccacccaccagccctgtgcagggcaccaccccccagatcagccccagcaccctcatcggcagcctgcggaccctggagctgggcagcgagagccagggcgccagcgagagccaggcccctggagaggagaacctgctgggggaggccgccggcggccaggacatggctgacagcatgctgatgcagggcagccggggcctgacagaccaggccatcttctatgctgtgacccccctgccctggtgcccccacctggtggccgtgtgccccatcccagctgctggcctggatgtgacccagccctgtggggactgtggcaccatccaggagaactgggtgtgcctgagctgctaccaggtgtactgcggccgctacatcaatggccacatgctgcagcaccacggcaacagcggccaccccctggtgctgagctacatcgacctgagcgcctggtgctactactgccaggcctacgtgcaccaccaggccctgctggatgtgaagaacatcgcccaccagaacaagtttggagaggacatgccccacccccactag

SEQ ID NO: 39284 - DNA, 312 bp, Artificial Sequence
  Description of Artificial Sequence: Synthetic coding sequence
atgagcggccggggcaagggcggcaagggcctgggcaaaggaggagccaagaggcacaggaaggtgctgcgggacaacatccagggcatcaccaagccagccatccggcggctggcccggcggggcggcgtgaagaggatcagcggcctcatctatgaggagacccggggcgtgctgaaggtgttcctggagaatgtcatcagagatgctgtgacctacacagagcacgccaagaggaagacagtgacagccatggatgtggtgtatgccctgaagaggcagggccgcaccctgtatggctttggaggatag

SEQ ID NO: 39285 - DNA, 312 bp, Artificial Sequence; identical to SEQ ID NO: 39284
  Description of Artificial Sequence: Synthetic coding sequence

SEQ ID NO: 39286 - DNA, 2145 bp, Artificial Sequence
  Description of Artificial Sequence: Synthetic coding sequence
atgcctgctgctgctggagatggcctgctgggggagcctgctgcccctgggggcggcggcggcgcagaagatgctgcccggcctgctgctgcctgtgagggcagcttcctgcctgcctgggtgtctggagtgccccgggagcggctgcgggacttccagcaccacaagagggtgggcaactacctgattggcagcaggaagctgggggagggcagctttgccaaggtgcgggagggcctgcacgtgctgaccggggagaaggtggccatcaaggtgattgacaagaagagggccaagaaggacacctacgtgaccaagaacctgcggcgggagggccagatccagcagatgatccgccaccccaacatcacccagctgctggacatcctggagacagaaaattcctactacctggtgatggagctgtgccctgggggcaacctgatgcacaagatctatgagaagaagaggctggaggagagcgaggcccggcgctacatccggcagctgatctctgctgtggagcacctgcaccgggccggcgtggtgcaccgggacctgaagattgagaacctgctgctggatgaggacaacaacatcaagctgattgactttggcctgagcaactgtgccggcatcctgggctacagcgaccccttcagcacccagtgtggcagccctgcctatgctgcccctgagctgctggccaggaagaagtatggccccaagattgatgtgtggagcattggagtgaacatgtatgccatgctgaccggcaccctgcccttcaccgtggagcccttcagcctgcgggccctgtaccagaagatggtggacaaggagatgaaccccctgcccacccagctgagcactggagccatctccttcctgcggagcctgctggagccagaccctgtgaagaggcccaacatccagcaggccctggccaaccgctggctgaatgaaaactacacaggcaaggtgccctgcaatgtgacctaccccaaccgcatcagcctggaggacctgagccccagcgtggtgctgcacatgacagagaagctgggctacaagaacagtgatgtgatcaacacagtgctgagcaacagagcctgccacatcctggccatctacttcctgctgaacaagaagctggagcgctacctgagcggcaagagtgacatccaggacagcctgtgctacaagacccggctgtaccagatcgagaagtaccgggcccccaaggagagctatgaggccagcctggacacctggacccgggacctggagttccacgctgtgcaggacaagaagcccaaggagcaggagaagagaggagacttcctgcaccggcccttcagcaagaagctggacaagaacctgcccagccacaagcagcccagcggcagcctgatgacccagatccagaacaccaaggccctgctgaaggacaggaaggccagcaagagcagcttcccagacaaggacagctttggctgcaggaacatcttcaggaagaccagtgacagcaactgtgtggccagcagctccatggagttcatccctgtgcccccacccaggaccccaagaattgtgaagaagccagagccccaccagcccggccctggcagcacaggcatcccccacaaggaggaccccctgatgctggacatggtgcgcagctttgagagcgtggacagagatgaccacgtggaggtgctgagccccagccaccactaccgcatcctgaacagccctgtgtccctggcccggaggaacagcagcgagaggaccctgagccctggcctgcccagcggctccatgagccccctgcacacccccctgcaccccaccctggtgtcctttgcccacgaggacaagaacagcccccccaaggaggagggcctgtgctgccccccacctgtgcccagcaatggccccatgcagcccctgggcagccccaactgtgtgaagagccggggccgcttccccatgatgggcatcggccagatgctgaggaagaggcaccagagcctgcagcccagcgctgaccggcccctggaggccagcctgccccccctgcagcccctggcccctgtgaacctggcctttgacatggctgatggagtgaagacccagtgctag

SEQ ID NO: 39287 - DNA, 762 bp, Artificial Sequence
  Description of Artificial Sequence: Synthetic coding sequence
atgggcctgagccctggagctgagggggagtatgccctgcggctgccccgcatccccccacccctgcccaagccagccagcaggacagccagcacaggccccaaggaccagcccccagccctgcggcgctctgctgtgccccacagcggcctgaacagcatcagccccctggagctggaggagagcgtgggctttgctgccctggtgcagctgcctgccaagcagcccccacctggcaccctggagcagggccgcagcatccagcagggcgagaaggctgtggtgtccctggagaccacccccagccagaaggctgactggagcagcatccccaagccagaaaatgaaggcaagctgatcaagcaggccgctgagggcaagccccggcccaggcctggggacctgattgagatcttcagaattggctatgagcactgggccatctacgtggaggatgactgtgtggtgcacctggccccacccagcgaggagtttgaggtgggcagcatcaccagcatcttcagcaacagagctgtggtgaagtacagccggctggaggatgtgctgcacggctgctcctggaaggtgaacaacaagctggatggcacctacctgcccctgcctgtggacaagatcatccagaggaccaagaagatggtgaacaagatcgtgcagtacagcctgattgagggcaactgccgggcccggccagatggccgctctgagggctgctggagcagctacttcagctgcagcggctag

SEQ ID NO: 39288 - DNA, 810 bp, Artificial Sequence
  Description of Artificial Sequence: Synthetic coding sequence
atgggcctgagccctggagctgagggggagtatgccctgcggctgccccgcatccccccacccctgcccaagccagccagcaggacagccagcacaggccccaaggaccagcccccagccctgcggcgctctgctgtgccccacagcgaggagagcgtgggctttgctgccctggtgcagctgcctgccaagcagcccccacctggcaccctggagcagggccgcagcatccagcagggcgagaaggctgtggtgtccctggagaccacccccagccagaaggctgactggagcagcatccccaagccagaaaatgaaggcaagctgatcaagcaggccgctgagggcaagccccggcccaggcctggggacctgattgagatcttcagaattggctatgagcactgggccatctacgtggaggatgactgtgtggtgcacctggccccacccagcgaggagtttgaggtgggcagcatcaccagcatcttcagcaacagagctgtggtgaagtacagccggctggaggatgtgctgcacggctgctcctggaaggtgaacaacaagctggatggcacctacctgcccctgcctgtggacaagatcatccagaggaccaagaagatggtgaacaagatcgtgcagtacagcctgattgagggcaactgtgagcactttgtgaatggcctgcgctatggagtgcccaggagccagcaggtggagcacgccctgatggagggcgccaaggctgctggagctgtgatctctgctgtggtggacagcatcaagcccaagcccatcacagcctag

SEQ ID NO: 39289 - DNA, 840 bp, Artificial Sequence
  Description of Artificial Sequence: Synthetic coding sequence
atgggcctgagccctggagctgagggggagtatgccctgcggctgccccgcatccccccacccctgcccaagccagccagcaggacagccagcacaggccccaaggaccagcccccagccctgcggcgctctgctgtgccccacagcggcctgaacagcatcagccccctggagctggaggagagcgtgggctttgctgccctggtgcagctgcctgccaagcagcccccacctggcaccctggagcagggccgcagcatccagcagggcgagaaggctgtggtgtccctggagaccacccccagccagaaggctgactggagcagcatccccaagccagaaaatgaaggcaagctgatcaagcaggccgctgagggcaagccccggcccaggcctggggacctgattgagatcttcagaattggctatgagcactgggccatctacgtggaggatgactgtgtggtgcacctggccccacccagcgaggagtttgaggtgggcagcatcaccagcatcttcagcaacagagctgtggtgaagtacagccggctggaggatgtgctgcacggctgctcctggaaggtgaacaacaagctggatggcacctacctgcccctgcctgtggacaagatcatccagaggaccaagaagatggtgaacaagatcgtgcagtacagcctgattgagggcaactgtgagcactttgtgaatggcctgcgctatggagtgcccaggagccagcaggtggagcacgccctgatggagggcgccaaggctgctggagctgtgatctctgctgtggtggacagcatcaagcccaagcccatcacagcctag

SEQ ID NO: 39290 - DNA, 2961 bp, Artificial Sequence
  Description of Artificial Sequence: Synthetic coding sequence
atggacaggatggccagctccatgaagcaggtgcccaaccccctgcccaaggtgctgagcagaagaggagtgggcgccggcctggaggccgctgagcgggagagctttgagaggacccagacagtgtccatcaacaaggccatcaacacccaggaggtggccgtgaaggagaagcacgcccggacctgcatcctgggcacccaccacgagaagggggcccagaccttctggagcgtggtgaaccggctgcccctgagcagcaatgctgtgctgtgctggaagttctgccacgtgttccacaagctgctgagagatggccaccccaacgtgctgaaggacagcctgcgctacagaaatgagctgagtgacatgagcaggatgtggggccacctgtctgagggctacggccagctgtgcagcatctacctgaagctgctgcggaccaagatggagtaccacaccaagaacccccgcttccctggcaacctgcagatgtctgaccggcagctggatgaagctggggagagtgatgtgaacaacttcttccagctgactgtggagatgtttgactacctggagtgtgagctgaacctcttccagacagtgttcaacagcctggacatgagccgctctgtgtctgtgacagctgctggccagtgccgcctggcccccctcatccaggtgatcctggactgcagccacctgtatgactacacagtgaagctgctcttcaagctgcacagctgcctgcctgctgacaccctgcagggccaccgggaccgcttcatggagcagttcaccaagctgaaggacctcttctaccgcagcagcaacctgcagtacttcaagaggctcatccagatcccccagctgcctgaaaatccacccaacttcctgcgggccagcgccctgtctgagcacatcagccctgtggtggtgatcccagctgaggccagcagcccagattctgagcctgtgctggagaaggatgacctgatggacatggatgccagccagcagaacctgtttgacaacaagtttgatgacatcttcggcagcagcttcagcagtgaccccttcaacttcaacagccagaatggagtgaacaaggatgagaaggaccacctgattgagcggctgtaccgggagatcagcggcctgaaggcccagctggagaacatgaagacagagagccagagggtggtgctgcagctgaagggccacgtgtctgagctggaggccgacctggccgagcagcagcacctgcggcagcaggccgcagatgactgtgagttcctgcgggcagagctggatgagctgcggcggcagcgggaggacacagagaaggcccagaggagcctgtctgaaattgaaaggaaggcccaggccaatgagcagcgctacagcaagctgaaggagaagtacagcgagctggtgcagaaccacgccgacctgctgaggaagaatgctgaggtgaccaagcaggtgtccatggcccggcaggcccaggtggacctggagcgggagaagaaggagctggaggacagcctggagcgcatcagtgaccagggccagaggaagacccaggagcagctggaggtgctggagagcctgaagcaggagctggccaccagccagcgggagctgcaggtgctgcagggcagcctggagaccagcgcccagagcgaggccaactgggccgctgagtttgctgagctggagaaggagcgggacagcctggtgtctggggccgcccaccgggaggaggagctgagcgccctgaggaaggagctgcaggacacccagctgaagctggccagcacagaggagagcatgtgccagctggccaaggaccagaggaagatgctgctggtgggcagcaggaaggctgctgagcaggtgatccaggatgccctgaaccagctggaggagcccccactcatcagctgtgccggcagcgctgaccacctgctgagcacagtgaccagcatcagcagctgcatcgagcagctggagaagtcctggagccagtacctggcctgcccagaggacatcagcggcctgctgcacagcatcaccctgctggcccacctgaccagtgatgccatcgcccatggagccaccacctgcctgcgggcccctcctgagcctgctgacagcctgacagaggcctgcaagcagtatggccgggagaccctggcctacctggccagcctggaggaggagggcagcctggagaatgctgacagcacagccatgaggaactgcctgagcaagatcaaggccatcggggaggagctgctgccccggggcctggacatcaagcaggaggagctgggggacctggtggacaaggagatggccgccaccagcgctgccatcgagacagccacagccagaattgagggcacagccagccccaaggagttctacgccaagaacagccgctggacagagggcctcatcagcgccagcaaggctgtgggctggggcgccaccgtgatggtggatgctgctgacctggtggtgcagggccggggcaagtttgaggagctgatggtgtgcagccatgaaattgctgccagcacagcccagctggtggccgccagcaaggtgaaggctgacaaggacagccccaacctggcccagctgcagcaggccagccggggcgtgaaccaggccacagctggggtggtggccagcaccatcagcggcaagagccagatcgaggagacagacaacatggacttcagctccatgaccctgacccagatcaagaggcaggagatggacagccaggtgcgggtgctggagctggagaatgagctgcagaaggagcggcagaagctgggggagctgaggaagaagcactatgagctggccggcgtggccgagggctgggaggagggcacagaggccagcccccccaccctgcaggaggtggtgacagagaaggagtag

SEQ ID NO: 39291 - DNA, 1308 bp, Artificial Sequence
  Description of Artificial Sequence: Synthetic coding sequence
atggccgcccacctgctgcccatctgtgccctcttcctgaccctgctggacatggcccagggcttccggggccccctgctgcccaaccggcccttcaccaccgtgtggaatgccaacacccagtggtgcctggagagacatggagtggatgtggatgtgtctgtgtttgatgtggtggccaaccctggccagaccttccggggccctgacatgaccatcttctacagcagccagctgggcacctacccctactacacccccaccggggagcctgtgtttggaggcctgccccagaatgccagcctgattgcccacctggcccggaccttccaggacatcctggccgccatcccagccccagacttcagcggcctggccgtcatcgactgggaggcctggaggccccgctgggccttcaactgggacaccaaggacatctaccggcagaggagccgggccctggtgcaggcccagcacccagactggccagccccccaggtggaggccgtggcccaggaccagttccagggcgccgcccgggcctggatggccggcaccctgcagctgggccgggccctgcggccccggggcctgtggggcttctacggcttcccagactgctacaactatgacttcctgagccccaactacacaggccagtgccccagcggcatccgggcccagaatgaccagctgggctggctgtggggccagagccgggccctgtaccccagcatctacatgcctgctgtgctggagggcaccgggaagagccagatgtatgtgcagcaccgggtggccgaggccttccgggtggccgtggccgccggggaccccaacctgcctgtgctgccctacgtgcagatcttctatgacaccaccaaccacttcctgcccctggatgagctggagcacagcctgggggagagcgctgcccagggcgccgccggcgtggtgctgtgggtgtcctgggagaacaccaggaccaaggagagctgccaggccatcaaggagtacatggacaccaccctgggccccttcatcctgaatgtgaccagcggggccctgctgtgcagccaggccctgtgcagcggccacggccgctgtgtgcggaggaccagccaccccaaggccctgctgctgctgaacccagccagcttcagcatccagctgaccccaggcggcggccccctgagcctgcggggggccctgagcctggaggaccaggcccagatggctgtggagttcaagtgccgctgctacccaggctggcaggccccctggtgtgagaggaagtccatgtggtag

SEQ ID NO: 39292 - DNA, 1308 bp, Artificial Sequence; identical to SEQ ID NO: 39291
  Description of Artificial Sequence: Synthetic coding sequence

SEQ ID NO: 39293 - DNA, 1422 bp, Artificial Sequence
  Description of Artificial Sequence: Synthetic coding sequence
atgagagctggccctggccccaccgtgaccctggccctggtgctggccgtgtcctgggccatggagctgaagcccacagccccacccatcttcaccggccggccctttgtggtggcctgggatgtgcccacccaggactgtggcccccggctgaaggtgcccctggacctgaatgcctttgatgtgcaggccagccccaatgaaggatttgtgaaccagaacatcaccatcttctacagagaccggctgggcctgtaccccaggtttgattctgctggccgctctgtgcatggaggagtgccccagaatgtgtccctgtgggcccacaggaagatgctgcagaagagggtggagcactacatccgcacccaggagagcgctggcctggccgtcatcgactgggaggactggaggcctgtgtgggtgaggaactggcaggacaaggatgtgtaccgccgcctgagccggcagctggtggccagccgccacccagactggcccccagacagaattgtgaagcaggcccagtatgaatttgaatttgctgcccagcagttcatgctggagaccctgcgctacgtgaaggctgtgcggcccaggcacctgtggggcttctacctgttcccagactgctacaaccacgactatgtgcagaactgggagagctacacaggccgctgcccagatgtggaggtggccagaaatgaccagctggcctggctgtgggccgagagcacagccctcttccccagcgtgtacctggatgagaccctggccagcagcagacatggaagaaactttgtgtccttccgggtgcaggaggccctgcgggtggcccggacccaccacgccaaccacgccctgcctgtgtatgtgttcacccggcccacctacagccggcggctgaccggcctgtctgagatggacctgatcagcaccatcggggagagcgctgccctgggcgctgctggggtcatcctgtggggagatgctggctacaccaccagcacagagacctgccagtacctgaaggactacctgacccggctgctggtgccctacgtggtgaatgtgtcctgggccacccagtactgcagccgggcccagtgccacggccacggccgctgtgtgagaagaaaccccagcgccagcaccttcctgcacctgagcaccaacagcttccggctggtgcccggccacgcccctggagagccccagctgcggcctgtgggggagctgtcctgggccgacatcgaccacctgcagacccacttccgctgccagtgctacctgggctggagcggggagcagtgccagtgggaccaccggcaggccgccggcggggccagcgaggcctgggccggcagccacctgaccagcctgctggccctggccgccctggccttcacctggaccctgtag

SEQ ID NO: 39294 - DNA, 1422 bp, Artificial Sequence; identical to SEQ ID NO: 39293
  Description of Artificial Sequence: Synthetic coding sequence

SEQ ID NO: 39295 - DNA, 1164 bp, Artificial Sequence
  Description of Artificial Sequence: Synthetic coding sequence
atgaccacccagctgggccctgccctggtgctgggcgtggccctgtgcctgggctgcggccagcccctgccccaggtgcctgagcggcccttctctgtgctgtggaatgtgcccagcgcccactgtgaggcccgcttcggcgtgcacctgcccctgaatgccctgggcatcatcgccaacagaggccagcacttccacggccagaacatgaccatcttctacaagaaccagctgggcctgtacccctacttcggcccccggggcacagcccacaacggcggcatcccccaggccctgcccctggacagacacctggccctggccgcctaccagatccaccacagcctgcggcccggctttgctggccctgctgtgctggactgggaggagtggtgccccctgtgggccggcaactggggcagaagaagagcctaccaggccgcctcctgggcctgggcccagcaggtgtttcctgacctggacccccaggagcagctgtacaaggcctacacaggctttgagcaggccgcccgggccctgatggaggacaccctgcgggtggcccaggccctgcggccccacggcctgtggggcttctaccactacccagcctgtggaaatggctggcacagcatggccagcaactacacaggccgctgccacgccgccaccctggccaggaacacccagctgcactggctgtgggccgccagcagcgccctcttccccagcatctacctgcccccccggctgcccccagcccaccaccaggcctttgtgcgccaccggctggaggaggccttccgggtggccctggtgggccaccgccaccccctgcctgtgctggcctacgtgcggctgacccaccggcgcagcggccgcttcctgagccaggaggagtgctggcacctgcatgactacctggtggacaccctgggcccctacgtgatcaacgtgacccgggccgccatggcctgcagccaccagcgctgccacggccacggccgctgtgcccggcgggaccccggccagatggaggccttcctgcacctgtggccagatggcagcctgggggactggaagagcttcagctgccactgctactggggctgggccggccccacctgccaggagcccaggcctggccccaaggaggccgtgtag

SEQ ID NO: 39296 - DNA, 612 bp, Artificial Sequence
  Description of Artificial Sequence: Synthetic coding sequence
atgaaggtgaaggtgattcctgtgctggaggacaactacatgtacctggtgattgaggagctgacccgggaggccgtggccgtggatgtggccgtgcccaagaggctgctggagatcgtgggccgggagggcgtgtccctgacagctgtgctgaccacccaccaccactgggaccacgcccggggcaaccctgagctggcccggctgcggcccggcctggccgtgctgggcgcagatgagcgcatcttcagcctgacccggcggctggcccatggagaggagctgcgggtgtctgcccggagccgggagggccggggcggccggcccggcagcacccggccccacaggtctgcctgcagcagcgctgctgtgcggggccacccccgggccctgcccccagatgcccggccccacagaagacctcatgagctgctgcctgtgggcggccgcctgcccggccccaccaggcctgtgctgggcagaagagctgtgggcggccgcctgcggctggtgcctgggggccagaggcctgcagatgtgcctgagcccggccgggccggctacccagcccccagagatgaaggagtgctgcggccccgggcccacgcctag

SEQ ID NO: 39297 - DNA, 849 bp, Artificial Sequence
  Description of Artificial Sequence: Synthetic coding sequence
atgaaggtgaaggtgattcctgtgctggaggacaactacatgtacctggtgattgaggagctgacccgggaggccgtggccgtggatgtggccgtgcccaagaggctgctggagatcgtgggccgggagggcgtgtccctgacagctgtgctgaccacccaccaccactgggaccacgcccggggcaaccctgagctggcccggctgcggcccggcctggccgtgctgggcgcagatgagcgcatcttcagcctgacccggcggctggcccatggagaggagctgcgctttggagccatccacgtgcgctgcctgctgaccccaggccacacagctggccacatgagctacttcctgtgggaggatgactgcccagaccccccagccctcttctctggagatgccctgtctgtggccggctgcggcagctgcctggagggcagcgcccagcagatgtaccagagcctggccgagctgggcaccctgcccccagagaccaaggtgttctgtggccacgagcacaccctgagcaacctggagtttgcccagaaggtggagccctgcaatgaccacgtgcgggccaagctgtcctgggccaagaagagagatgaagatgatgtgcccaccgtgcccagcaccctgggggaggagcggctgtacaaccccttcctgcgggtggccgaggagcctgtgaggaagttcaccgggaaggctgtgcctgcagatgtgctggaggccctgtgcaaggagcgggccaggtttgagcaggccggggagccccggcagccccaggcccgggccctgctggccctgcagtggggcctgctgtctgctgcccctcatgactag

SEQ ID NO: 39298 - DNA, 609 bp, Artificial Sequence
  Description of Artificial Sequence: Synthetic coding sequence
atgaaggtgaaggtgattcctgtgctggaggacaactacatgtacctggtgattgaggagctgacccgggaggccgtggccgtggatgtggccgtgcccaagaggctgctggagatcgtgggccgggagggcgtgtccctgacagctgtgctgaccacccaccaccactgggaccacgcccggggcaaccctgagctggcccggctgcggcccggcctggccgtgctgggcgcagatgagcgcatcttcagcctgacccggcggctggcccatggagaggagctgcgctttggagccatccacgtgcgctgcctgctgaccccaggccacacagctggccacatgagctacttcctgtgggaggatgactgcccagaccccccagccctcttcagcggcaccaggtctgctgagcgggcccacccagccagcagaagaccccggcccatctgcagcgacccccccagccctgcccggcggcgggctgtgggcggccgcctgcggctggtgcctgggggccagaggcctgcagatgtgcctgagcccggccgggccggctacccagcccccagagatgagggcgtgctgcggccccgggcccacgcctag

SEQ ID NO: 39299 - DNA, 507 bp, Artificial Sequence
  Description of Artificial Sequence: Synthetic coding sequence
atgttccccctcatcagcagccaccacctgtggtggggcggcctgcggaggacagtgtgcctgaacctgcctgtgctgaccctgcagcacttccagcacatgcacatcaaggtgggggacagagctgagctgcggcgggccttcacccagacagatgtggccaccttcagcgagctgactggagatgtgaaccccctgcacctgaatgaagattttgccaagcacaccaagtttggaaacaccatcgtgcacggcgtgctgatcaatggcctcatcagcgccctgctgggcaccaagatgcctggccctggctgtgtgttcctgagccaggagatctccttccctgcccccctgtacatcggggaggtggtgctggccagcgctgaggtgaagaagctgaagcgcttcatcgccatcatcgctgtgtcctgcagcgtgattgagagcaagaagacagtgatggagggctgggtgaaggtgatggtgcctgaggccagcaagagctag

SEQ ID NO: 39300 - DNA, 1164 bp, Artificial Sequence
  Description of Artificial Sequence: Synthetic coding sequence
atgaacagacaccacctgcaggaccacttcctggagattgacaagaagaactgctgcgtgttcagagatgacttcatcgccaaggtgctgccccctgtgctgggcctggagttcatcttcggcctgctgggcaatggcctggccctgtggatcttctgcttccacctgaagtcctggaagagcagccgcatcttcctgttcaacctggccgtggccgacttcctgctgatcatctgcctgccctttgtgatggactactacgtgagaagaagtgactggaagtttggagacatcccctgccgcctggtgctcttcatgtttgccatgaaccggcagggcagcatcatcttcctgactgtggtggccgtggaccgctacttccgggtggtgcacccccaccacgccctgaacaagatcagcaactggacagctgccatcatcagctgcctgctgtggggcatcaccgtgggcctgactgtgcacctgctgaagaagaagctgctgatccagaatggaacagccaacgtgtgcatctccttcagcatctgccacaccttccgctggcatgaggccatgttcctgctggagttcttcctgcccctgggcatcatcctcttctgcagcgcccgcatcatctggagcctgcggcagaggcagatggacagacatgccaagatcaagagggccatcaccttcatcatggtggtggccatcgtgtttgtgatctgcttcctgcccagcgtggtggtgcgcatccacatcttctggctgctgcacaccagcggcacccagaactgtgaggtgtacagatctgtggacctggccttcttcatcaccctgtccttcacctacatgaacagcatgctggaccctgtggtgtactacttcagcagccccagcttccccaacttcttcagcaccctcatcaaccgctgcctgcagaggaagatcaccggggagccagacaacaacagaagcacctctgtggagctgaccggggaccccaacaagaccaggggggcccctgaggccctgattgccaacagcggggagccctggagccccagctacctgggccccaccagcaacaaccacagcaagaagggccactgccaccaggagcccgccagcctggagaagcagctgggctgctgcatcgagtag

SEQ ID NO: 39301 - DNA, 966 bp, Artificial Sequence
  Description of Artificial Sequence: Synthetic coding sequence
atgtctggaaatggaaatgctgctgccacagctgaggagaacagccccaagatgagggtcatccgggtgggcaccaggaagagccagctggcccgcatccagacagattctgtggtggccaccctgaaggccagctacccaggcctgcagtttgagatcatcgccatgagcaccactggagacaagatcctggacacagccctgagcaagattggagagaagagcctcttcaccaaggagctggagcacgccctggagaagaatgaggtggacctggtggtgcacagcctgaaggacctgcccaccgtgctgcccccaggcttcaccatcggggccatctgcaagcgggagaacccccatgatgctgtggtgttccaccccaagtttgtgggcaagaccctggagaccctgcctgagaagtctgtggtgggcaccagcagcctgcggcgggccgcccagctgcagaggaagttcccccacctggagttccgcagcatccggggcaacctgaacacccggctgaggaagctggatgagcagcaggagttcagcgccatcatcctggccacagctggcctgcagaggatgggctggcacaacagagtgggccagatcctgcaccctgaggagtgcatgtatgctgtgggccaggagggcggctgcagcgtgcctgtggccgtgcacacagccatgaaggatggccagctgtacctgactggaggagtgtggagcctggatggcagtgacagcatccaggagaccatgcaggccaccatccacgtgcctgcccagcatgaagatggcccagaagatgacccccagctggtgggcatcacagccaggaacatcccccggggcccccagctggccgcccagaacctgggcatcagcctggccaacctgctgctgagcaaaggagccaagaacatcctggatgtggcccggcagctgaatgatgcccactag

SEQ ID NO: 39302 - DNA, 1035 bp, Artificial Sequence
  Description of Artificial Sequence: Synthetic coding sequence
atgagggtcatccgggtgggcaccaggaagagccagctggcccgcatccagacagacagcgtggtggccaccctgaaggccagctacccaggcctgcagtttgagatcatcgccatgagcaccaccggggacaagatcctggacacagccctgagcaagatcggggagaagagcctcttcaccaaggagctggagcacgccctggagaagaatgaggtggacctggtggtgcacagcctgaaggacctgcccaccgtgctgcccccaggcttcaccatcggggccatctgcaagcgggagaacccccatgatgctgtggtgttccaccccaagtttgtgggcaagaccctggagaccctgcctgagaagtctgtggtgggcaccagcagcctgcggcgggccgcccagctgcagaggaagttcccccacctggagttccgcagcatccggggcaacctgaacacccggctgaggaagctggatgagcagcaggagttcagcgccatcatcctggccacagctggcctgcagaggatgggctggcacaacagagtgggccagatcctgcaccctgaggagtgcatgtatgctgtgggccagggcgccctgggcgtggaggtgcgggccaaggaccaggacatcctggacctggtgggcgtgctgcatgaccctgagaccctgctgcgctgcatcgccgagcgggccttcctgcggcacctggagggcggctgcagcgtgcctgtggccgtgcacacagccatgaaggatggccagctgtacctgaccggcggcgtgtggagcctggatggcagtgacagcatccaggagaccatgcaggccaccatccacgtgcctgcccagcatgaagatggcccagaagatgacccccagctggtgggcatcacagccaggaacatcccccggggcccccagctggccgcccagaacctgggcatcagcctggccaacctgctgctgagcaagggggccaagaacatcctggatgtggcccggcagctgaatgatgcccactag

SEQ ID NO: 39303 - DNA, 915 bp, Artificial Sequence
  Description of Artificial Sequence: Synthetic coding sequence
atgagggtcatccgggtgggcaccaggaagagccagctggcccgcatccagacagacagcgtggtggccaccctgaaggccagctacccaggcctgcagtttgagatcatcgccatgagcaccaccggggacaagatcctggacacagccctgagcaagatcggggagaagagcctcttcaccaaggagctggagcacgccctggagaagaatgaggtggacctggtggtgcacagcctgaaggacctgcccaccgtgctgcccccaggcttcaccatcggggccatctgcaagcgggagaacccccatgatgctgtggtgttccaccccaagtttgtgggcaagaccctggagaccctgcctgagaagtctgtggtgggcaccagcagcctgcggcgggccgcccagctgcagaggaagttcccccacctggagttccgcagcatccggggcaacctgaacacccggctgaggaagctggatgagcagcaggagttcagcgccatcatcctggccacagctggcctgcagaggatgggctggcacaacagagtgggccagatcctgcaccctgaggagtgcatgtatgctgtgggccaggagggcggctgcagcgtgcctgtggccgtgcacacagccatgaaggatggccagctgtacctgaccggcggcgtgtggagcctggatggcagtgacagcatccaggagaccatgcaggccaccatccacgtgcctgcccagcatgaagatggcccagaagatgacccccagctggtgggcatcacagccaggaacatcccccggggcccccagctggccgcccagaacctgggcatcagcctggccaacctgctgctgagcaagggggccaagaacatcctggatgtggcccggcagctgaatgatgcccactag

SEQ ID NO: 39304 - DNA, 834 bp, Artificial Sequence
  Description of Artificial Sequence: Synthetic coding sequence
atggcccccctgcgcttcagcgccaacctgtcctggctgtttcctgagctgagcggcctgcctgcccgggtgcgggctgctggcagcagcggctttgaggccgtggaggtggcctggccctatgcagagaccccagaggccctggcccgggccgcccgggaggccggcctgcggctggtgctgatcaacaccccacctggggaccaggagaagggggagatgggcctgggcgctgtgcccggccggcaggccgccttccgggagggcctggagcaggccgtgcgctatgccaaggccctgggctgcccccgcatccacctgatggccggccgggtgccccagggcgctgacagaattgctgtgaaggccgagatggaggccgtgttcctggagaacctgcggcatgctgctggggtgctggcccaggaggacctggtgggcctgctggagcccatcaacacccgcatcacagacccccagtacttcctggacaccccccagcaggccgccgccatcctgcagaaggtgggccggcccaacctgcagctgcagatggacatcttccactggcagatcatggatggcaacctgaccggcaacatccgggagttcctgcccatcgtgggccacgtgcaggtggcccaggtgcccggccgcggggagcccagcagccctggagagctgaacttcccctacctgttccagctgctggaggatgagggctacaagggctttgtgggctgtgagtaccagcccaggggggacacagtggagggcctgtcctggctgcggagctactgggacagaagaggccaccctgaggccggccagtag

SEQ ID NO: 39305 - DNA, 690 bp, Artificial Sequence
  Description of Artificial Sequence: Synthetic coding sequence
atgggcctgggcgctgtgcccggccggcaggccgccttccgggagggcctggagcaggccgtgcgcagcggccactgcctgatgggcaggaagctgtctgtgccctgcaagggagctgtggcccggggcggcctggtgtacctggccgccttcctgcggctggacatgatccacctgatggccggccgggtgccccagggcgctgacagaattgctgtgaaggccgagatggaggccgtgttcctggagaacctgcggcatgctgctggggtgctggcccaggaggacctggtgggcctgctggagcccatcaacacccgcatcacagacccccagtacttcctggacaccccccagcaggccgccgccatcctgcagaaggtgggccggcccaacctgcagctgcagatggacatcttccactggcagatcatggatggcaacctgaccggcaacatccgggagttcctgcccatcgtgggccacgtgcaggtggcccaggtgcccggccgcggggagcccagcagccctggagagctgaacttcccctacctgttccagctgctggaggatgagggctacaagggctttgtgggctgtgagtaccagcccaggggggacacagtggagggcctgtcctggctgcggagctactgggacagaagaggccaccctgaggccggccagtag

SEQ ID NO: 39306 - DNA, 615 bp, Artificial Sequence
  Description of Artificial Sequence: Synthetic coding sequence
atgggcctgggcgctgtgcccggccggcaggccgccttccgggagggcctggagcaggccgtgcgctatgccaaggccctgggctgcccccgcatccacctgatggccggccgggtgccccagggcgctgacagaattgctgtgaaggccgagatggaggccgtgttcctggagaacctgcggcatgctgctggggtgctggcccaggaggacctggtgggcctgctggagcccatcaacacccgcatcacagacccccagtacttcctggacaccccccagcaggccgccgccatcctgcagaaggtgggccggcccaacctgcagctgcagatggacatcttccactggcagatcatggatggcaacctgactggaaacatccgggagttcctgcccatcgtgggccacgtgcaggtggcccaggtgcccggccgcggggagcccagcagccctggagagctgaacttcccctacctgttccagctgctggaggatgagggctacaagggctttgtgggctgtgagtaccagcccaggggggacacagtggagggcctgtcctggctgcggagctactgggaccggcggggccaccctgaggccggccagtag

SEQ ID NO: 39307 - DNA, 744 bp, Artificial Sequence
  Description of Artificial Sequence: Synthetic coding sequence
atggcccccctgcgcttcagcgccaacctgtcctggctgtttcctgagctgagcggcctgcctgcccgggtgcgggctgctggcagcagcggctttgaggccgtggaggtggcctggccctatgcagagaccccagaggccctggcccgggccgcccgggaggccggcctgcggctggtgctgatcaacaccccacctggggaccaggagaagggggagatgggcctgggcgctgtgcccggccggcaggccgccttccgggagggcctggagcaggccgtgcgctatgccaaggccctgggctgcccccgcatccacctgatggccggccgggtgccccagggcgctgacagaattgctgtgaaggccgagatggaggccgtgttcctggagaacctgcggcatgctgctggggtgctggcccaggaggacctggtgggcctgctggagcccatcaacacccgcatcacagacccccagtacttcctggacaccccccagcaggccgccgccatcctgcagaaggtgggccggcccaacctgcagctgcagatggacatcttccactggcagatcatggatggcaacctgaccggcaacatccgggagttcctgcccatcgtgggccacgtgcaggtggcccaggtgcccggccgcggggagcccagcagccctggagagctgaacttcccctacctgttccagctgctggaggatgagggctacaagggctttgtgggctag

SEQ ID NO: 39308 - DNA, 909 bp, Artificial Sequence
  Description of Artificial Sequence: Synthetic coding sequence
atggcccccctgcgcttcagcgccaacctgtcctggctgtttcctgagctgagcggcctgcctgcccgggtgcgggctgctggcagcagcggctttgaggccgtggaggtggcctggccctatgcagagaccccagaggccctggcccgggccgcccgggaggccggcctgcggctggtgctgatcaacaccccacctggggaccaggagaagggggagatgggcctgggcgctgtgcccggccggcaggccgccttccgggagggcctggagcaggccgtgcgcagcggccactgcctgatgggcaggaagctgtctgtgccctgcaagggagctgtggcccggggcggcctggtgtacctggccgccttcctgcggctggacatgatccacctgatggccggccgggtgccccagggcgctgacagaattgctgtgaaggccgagatggaggccgtgttcctggagaacctgcggcatgctgctggggtgctggcccaggaggacctggtgggcctgctggagcccatcaacacccgcatcacagacccccagtacttcctggacaccccccagcaggccgccgccatcctgcagaaggtgggccggcccaacctgcagctgcagatggacatcttccactggcagatcatggatggcaacctgactggaaacatccgggagttcctgcccatcgtgggccacgtgcaggtggcccaggtgcccggccgcggggagcccagcagccctggagagctgaacttcccctacctgttccagctgctggaggatgagggctacaagggctttgtgggctgtgagtaccagcccaggggggacacagtggagggcctgtcctggctgcggagctactgggaccggcggggccaccctgaggccggccagtag

SEQ ID NO: 39309 - DNA, 162 bp, Artificial Sequence
  Description of Artificial Sequence: Synthetic coding sequence
atgtgcagctactaccacatgaagaagaggtctgtgtctggctgcaacatcaccatctttgctgtgatgttcagccacctgtctgctgggaagagcccctgtggcaaccaggccaacgtgctgtgcatcagccggctggagtttgtgcagtaccagagctag

SEQ ID NO: 39310 - DNA, 1011 bp, Artificial Sequence
  Description of Artificial Sequence: Synthetic coding sequence
atgcctcctccagcccctggggcccggctgcggctgctggccgccgccgccctggccggcctggccgtcatcagccggggcctgctgagccagagcctggagttcaacagccctgctgacaactacacagtgtgtgagggggacaatgccaccctgagctgcttcattgatgaacatgtgaccagggtggcctggctgaacagaagcaacatcctgtatgctggaaatgaccgctggaccagtgacccccgggtgcggctgctgatcaacaccccagaggagttcagcatcctgatcacagaggtgggcctgggagatgagggcctgtacacctgcagcttccagaccaggcaccagccctacaccacccaggtgtacctgattgtgcacgtgcctgccagaattgtgaacatcagcagccctgtgacagtgaatgaaggaggaaatgtgaacctgctgtgcctggccgtgggccggcctgagcccaccgtgacctggaggcagctgagagatggcttcaccagcgagggggagatcctggagatcagtgacatccagaggggccaggccggggagtatgaatgtgtgacccacaatggagtgaacagcgccccagacagccggcgggtgctggtgacagtgaactacccacccaccatcacagatgtgaccagcgccaggacagccctgggccgggccgccctgctgcgctgtgaggccatggctgtgcccccagctgacttccagtggtacaaggatgaccggctgctgagcagcggcacagctgagggcctgaaggtgcagacagagaggaccaggtccatgctgctgtttgccaacgtgtctgcccggcactacggcaactacacctgcagagctgccaaccggctgggcgccagcagcgcctccatgaggctgctgcggcccggcagcctggagaacagcgcccccaggcctcctggcctgctggccctgctgagcgccctgggctggctgtggtggaggatgtag

SEQ ID NO: 39311 - DNA, 1215 bp, Artificial Sequence
  Description of Artificial Sequence: Synthetic coding sequence
atggagtgtgccctggatgcccagagcctcatcagcatcagcctgaggaagatccacagcagcaggacccagaggggcggcatcaagctgcacaagaacctgctggtgtcctatgtgctgagaaatgcccggcagctgtacctgtctgaaagatatgcagagctgtaccgccggcagcagcagcagcagcagcagcagcccccccaccaccagcaccagcacctggcctatgctgcccctggcatgcctgccagcgctgctgactttggccccctgcagctgggcggcggcggagatgctgaggcccgggagcctgctgcccggcaccagctgcaccagctgcaccagctgcaccagctgcacctgcagcagcagctgcaccagcaccagcacccagccccccggggctgtgccgctgctgctgctgctggggccccagctggaggagctggggccctgtctgagctgcccggctgtgccgccctgcagcccccccacggggccccccaccggggccagcccctggagcccctgcagcccggccctgcccccctgcccctgcccctgcccccaccagccccagctgccctgtgcccccgggacccccgggccccagctgcctgcagcgcccctcctggggccgcccccccagctgctgctgccagccccccagccagccctgccccagccagcagccctggcttctacagaggagcctaccccacccccagcgactttggcctgcactgcagcagccagaccaccgtgctggacctggacacccacgtggtgaccaccgtggagaatggctacctgcaccaggactgctgtgccagcgcccactgcccctgctgcggccagggcgcccctggccctggcctggccagcgctgctggctgcaagaggaagtactacccaggccaggaggaggaggaggatgatgaggaggatgctgggggcctgggcgctgagcccccaggaggagccccctttgccccctgcaagagggccaggtttgaggacttctgcccagacagcagcccagatgccagcaacatcagcaacctgatcagcatcttcggcagcggcttcagcggcctggtgtcccggcagcctgacagcagcgagcagcccccacccctgaatggccagctgtgtgccaagcaggccctggccagcctgggcgcctggacccgggccatcgtggccttctag

SEQ ID NO: 39312 - DNA, 1392 bp, Artificial Sequence
  Description of Artificial Sequence: Synthetic coding sequence
atggccaccagcaagctgcctgtggtgcctggagaggaggagaacaccatcctgatggccaaggagcggctggaggccctgaggacagcctttgaaagtggggacctgccccaggccgccagccacctgcaggagctgctggccagcacagagagcatccggctggaggtgggcgtgactggagagagcggggccggcaagagcagcctcatcaatgccctgcggggcctggaggccgaggaccccggggccgccctgactggagtgatggagaccaccatgcagcccagcccctacccccacccccagttcccagatgtgaccctgtgggacctgcctggagctggcagccctggctgcccagctgacaagtacctgaagcaggtggacttcagccgctatgacttcttcctgctggtgagcccccggcgctgtggggctgtggagacccggctggccgctgagatcctgtgccagggcaagaagttctactttgtgaggaccaaggtggatgaggacctggccgccaccaggacccagaggccttctggcttccgggaggccgctgtgctgcaggagatccgggaccactgtgccgagcggctgcgggaggccggcgtggccgacccccgcatcttcctggtgagcaacctgagccctgcccgctatgacttccccaccctggtgtccacctgggagcatgacctgcccagccacagaagacatgctggcctgctgagcctgcctgacatcagcctggaggccctgcagaagaagaaggccatgctgcaggagcaggtgctgaagacagccctggtgctgggcgtcatccaggccctgcctgtgcccggcctggccgccgcctatgatgatgccctgctgatccacagcctgcggggctaccacaggagctttggcctggatgatgacagcctggccaagctggccgagcaggtgggcaagcaggccggggacctgcggagcgtcatccgcagccccctggccaatgaggtgtccccagagaccgtgctgcggctgtacagccagagcagtgatggagccatgagggtggcccgggcctttgagcggggcatccctgtgtttggcaccctggtggccggcggcatcagctttggagctgtgtacaccatgctgcagggctgcctgaatgagatggccgaggatgcccagagggtgcgcatcaaggccctggaggatgatgagccccagcctgaggtgtccctggaggtggccagtgacaatggagtggagaagggcggcagcggggagggcggcggggaggaggcccccctgagcacctgcaggaagctgggcctgctgctgaagtacatcctggacagctggaagaagcatgacagcgaggagaagtag

SEQ ID NO: 39313 - DNA, 1872 bp, Artificial Sequence
  Description of Artificial Sequence: Synthetic coding sequence
atgcccccaccccagggagatgtgacagccctcttcctgggccccccaggcctgggcaagagcgccctgattgctgccctgtgtgacaaggatgtggagaccctggaggcccctgagggccgcccagacagcggcgtgcccagcctgcgggccgccggccctggcctcttcctgggggagctgagctgccccccagctgcccctggcccctgggccgctgaggccaacgtgctggtgctggtgctgcccggccctgagggcaatggagagcccctggccccagccctgggggaggccgccctggccgccctggcccggggcacccccctgctggccgtgaggaacctgcggcctggggacagccagacagctgcccaggcccgggaccagacagctgccctgctgaacagcgctggcctgggcgctgctgacctgtttgtgctgcctgccaactgtggcagcagtgatggctgtgaggagctggagcggctgcgggccgccctgcagagccaggccgaggccctgcggcggctgctgcccccagcccaggacggctttgaggtgctgggcgctgctgagctggaggccgtgcgggaggcctttgaaacaggaggcctggaggccgccctgtcctgggtgcgcagcggcctggagcggctgggcagcgcccggctggacctggccgtggccggcaaggcagatgtgggcctggtggtggacatgctgctgggcctggaccccggggaccccggggccgccccagcctctgtgcccacagcccccacccccttccctgcccctgagcggcccaacgtggtgctgtggacagtgcccctgggccacactggaacagccaccacagctgctgctgccagccaccccacccactatgatgccctgatcctggtgacccctggggcccccacagagaaggactgggcccaggtgcaggccctgctgctgcctgatgcccccctggtgtgtgtgaggacagatggagagggggaggaccctgaatgtctgggggagggcaagatggagaaccccaagggggagagcctgaagaatgccggcggcggcggcctggagaatgccctgagcaagggccgggagaagtgcagcgctggcagccagaaggccggcagcggggagggccctgggaaggccggcagcgagggcctgcagcaggtggtgggcatgaagaagagcggcggcggggacagcgagagagctgctgccctgagcccagaagatgagacctgggaggtgctggaggaggcccctcctcctgtgttccccctgcggcctgggggcctgcccggcctgtgtgagtggctgcggcgggccctgcccccagcccaggccggggccctgctgctggccctgcccccagccagccccagcgctgcccggaccaaggctgctgccctgcgggccggggcctggaggcctgccctgctggccagcctggccgctgctgctgcccccctgcccggcctgggctgggcctgtgatgtggccctgctgcggggccagctggccgagtggaggcggggcctgggcctggagcccacagccctggcccggcgggagcgggccctgggcctggccagcggggagctggccgcccgggcccacttccctggccctgtgaccagggctgaggtggaggcccggctgggcgcctgggccggggagggcacagctggaggagctgccctgggcgccctgtccttcctgtggccagctggaggagctgctgccactggaggcctgggctaccgggccgcccacggcgtgctgctgcaggccctggatgagatgagagcagatgctgaggccgtgctggcccctcctgagcccgcccagtag

SEQ ID NO: 39314 - DNA, 3981 bp, Artificial Sequence
  Description of Artificial Sequence: Synthetic coding sequence
atgaccaccatccacagccggcagatgctgcaggagcacgtgtccatggagttcagcagcagcaccacccacgtgcagaccttcagccagaccaccaagatcgtgggggaggaggtggtgcggaggaagagcagcagcatcgtggagttcttcagcctggtgaccaggagcagcaacatcccagctggggacagcgtgcctgagtttgtggagaagccccagcctgtgacagcccctgagggggacaaggctgtgttccgggcccgggtgcagggcaatgccaagccccacatctcctggaagcgggagagcggcatccccatcaaggagagcgccaagatcttctatgacagcatcaacaaggagcacgtgctgaagctggagcccctgaccagtgatgacagcgacaactacaagtgcatcgccagcaatgaccatgctgatgccatctacacagtgtccctgctggtgacagagggccaggagaagatggacttcaagaagatgctgaagaagagggcccccccagcccccaagaagaagcagaagaaggtggccaatgagaaggagatgctggagatcctgagcaaggtgcccaagaaggactttgagaaggtgtgcatggagtatggcttcacagacttccggggcctgctgaggaagctgaaggagatgaagaagaaggtggaggtggaggccatccgcatcctgaagcccctggaggacaaggagaccaaggtggacaccaccgtggtgtttgactgcatcatggagctgaaggaccccaacgtgaagatgatctggatcaagggcacagagcccctgcgcatccagtacagcctgggcaagtatgatgtgaagcagatgggcaccaagtacatgctggtgatcagcaatgtgaacatgaatgatgctggcatctacagcctgtctgtgggggacaagaggatgtctgctgagctgactgtgctggatgagcccctgaagttcctgggggagatgaagcctgtgaaggtgacagagcggcagacagctgtgtttgagatccggctgagcaagaaggagcccaactttgtgtggaagttcaacgggaaggagctgaagagagatgacaagtatgagatcaccgtgtctgaagatggcctgacccacaccctgaagatcaaggatgcccggctgagtgacagcggggagttctctgctgaggccggcaacctggtgcagaaggcccagctgactgtggaccgcatccccatcaagtttgtgagcaacctgaagaatgtgcgggtgaaggagaggagccgggcctgcctggagtgtgagctgaccagcaaggatgtgaccctgcgctggaagaaggatggccagctgctgatgcacggcaccaagtacagcatgaaccacgagggcaagagagctgagctgatcattgaagatgcccagctgagtgatggaggagagtacacagtggtggccatgcaggatggagaccccacagagtactacagcacagccatcgtgacagtggaggagcggctggccaccgtgaagagcggcatgtctgatgtgcatgctgccaccggcagccctgctgagctgtgtgtggtgctgaatgatgagaaggtggagggcgtgtggctgaaggatggcaaggagatcacagacctgcccggcatgcagatcgtgaagcagggcgctgtgcacaagctgatcttccccagcatgggccctgagcacgagggcaagtacaccttccgggccaagggcacagagagcgaggcctctgtgttcatcgctgacccccccaccatcgaccccagcgtgctggaggccctggccgcccacgccatcaccgtgaaggtgggccacacagcccacatcaaggtgcccttccggggcaagcccctgcccaaggtgacctggtacaaggatggcatggaggtgacagaggaggagcgggtgtccatggagcggggggaggaccaggccctgctgaccatcagcaactgtgtgagagaagattctggcctcatcctgctgaagctgaagaatgaccacggcagcgccacagccaccctgcacctgtctgtgctggaccggcccaagccaccccagggccgggtggagttcctggagctgagcggcagctgtgtgcacatgaagtggaaggcccccaaggacaatggaggccggcctgtgacccagttcatcgtggagcggcgggctgtgggcaagaagtcctggatcaagattggagaggtggatggcaaggtgaccaacttcagcaccaacaaggtggaggagggcaaggcctaccagttccgcatcctggccgtgaacagcgagggcgtgtctgaccccctggagacagaggaggtgtttgctggcaaccccatcgagcccccaggctttgccagccagccccaggtgacagatgtgaccaaggaggccgtgaccatcacctggaatgcccccacccaggacggcggggcccctgtgctgggctacatcgtggagaggaggaagaagggcagcaacctgtgggtgcctgtgaacaaggaccccatccagggcaccaagtgcaccgtggatggcctgctggaggacacagaatatgagttccgggtgattgctgtgaacaaggccggccctggccagcccagcgtgcccagcagctctgtggtggccaaggaccctgtgaagcccccaggcctggtgcaggacctgcacgtgtctgacagcagcaacagcagcatcagcctggcctggagggagcctgctgagggggaccccccatctggctacatcctggagatgagagctgaggacaccaaggagtggagcaagtgcaccaagatccccatcagcggcacctgctacacagtgggcggcctcatcgagcggcagaagtacttcttccgcatccgggctgtgaatgaagctggggtgggggagcctgtggagctggacaagggcgtgcgggccatgcctcctcctgctgcccccaagtttgacctgagcgcccggctgaagagccacatggtggtgcgggccggcacagccctgtgcatccacgccgccttcagcggcagccccccaccagatgtgatctggcagaaggatggagtgcccaccaagggccgggagaccatcaccaagagcaagaaccacagccagttcctgatcaacagcaccaagagaagtgacagcggcgtgtaccgcatcctgctgcagaatgaatttggagaggcccgctatgacatccacgtgcgggtggccgacttcccccggccccccaccaacctgcggctgtttgaggaggtgcccaacacagtgaccctgacctggaaccacagcccagatgtgcaggaggatggagaggcccactacatcatcatgaagagagatgccagcacagccacctggtacacagctgctgagagggtcttcagcaacaagtacacagtgacaggcctgctgcccggcaggaagtactacttccgggtggtggccagaaatgaaattggagacagcgagcccctggacagccgggacacctggctgatcaacaaggaccagatccaggacctgagcgccaagctgaagccctatgagaagaaggactggaggcatgcccccaggtttgtgacccccctgaagccccacacagtgctgcggggccaggactgcaccatgacctgtgccttcctgggcaacccccggcccaccgtgaccctgtacaagggagatgtgaacatcacagccaacagcaagttctggtacaacagcaccagcggcgtgtgcaccctggtgatccccacctgcaccctgaaggacagcggggactacagcgtgctggtggagaatgagctgggcaaggacaggagcagctgcaccctgactgtgtatgacaaggatgacaagtctgtggtggccagcatcacagagagcctgcagaagaagagcaagcacctgatgtag

SEQ ID NO: 39315 - DNA, 1827 bp, Artificial Sequence
  Description of Artificial Sequence: Synthetic coding sequence
atgggctggcagcccatgggagagaactggggctgcctggaggagatgctgaatgaagaccagagccgggagcccccaggccacctgggcagccgccgcagcggcaaggatggccgcctggacatctatggagagaggagagatgccaccaggagcagcaccagccgctacaagccaggcaccggcagcttcagcaaggatgcccagggccccatgggccacttcagccagggcctggccgacatggaggtgcagcccggggaggccgccaccctgagctgcaccctgaccagtgacctgggccctggcacctggttcaaggatggagtgaagctgaccacccaggatggagtcatcttcaagcaggacggcctggtgcacagcctcttcatcacccacgtgcagggcacccaggccggccgctacacctttgtggccggggaccagcagagcgaggccaccctgactgtgcaggacagccccaccatcgccccagatgtgacagagaagctgcgggagcccctggtggtgaaggccggcaagcctgtgattgtgaagatccccttccagagccacctgcccatccaggccgcctggaggaaggatggagctgaggtggtgggcagcagtgaccgggaggcccaggtggacctgggagatggctacacccggctgtgcctgcccagcgctggcaggaaggactgtggccagtacagcgtgaccctgcggtctgagggcggctctgtgcaggccgagctgaccctgcaggtgattgacaagccagaccccccccagggccccatggaggtgcaggactgccaccgggccggcgtgtgcctgcgctggaggcctccccgggacaatggaggccgcacagtggagtgctacgtggtggagcggcggcaggccggccgcagcacctggctgaaggtgggggaggccccagctgacagcaccaccttcacagatgcccacgtggagcccggcaggaagtacaccttccgggtgcgggctgtgaccagcgagggcgctggggaggccctggagagcgaggagatcctggtggcccctgaggccctgcccaaggcccccagcgccccagccatcctgagcgccagcagccagggcatcaccctgacctggacagccccccggggccctggcagcgcccacatcctgggctacctgattgaaagaaggaagaagggcagcaacacctggacagctgtgaatgaccagcctgtgcctgagcggcgctggacagtggctgatgtgcggcagggctgccagtatgagttccgggtgacagctgtggcccccagcggccctggagagcccggccccccatctgatgctgtgtttgcccgggaccccatgaggcctcctggcctggtgaggaacctgcaggtgacagacaggagcaacaccagcatcaccctgtcctgggccggccctgacacccaggagggagatgaggcccagggctacgtggtggagctgtgcagcagtgacagcctgcagtggctgccctgccacgtgggcaccgtgcctgtgaccacctacacagccaagggcctgcggcctggagagggctactttgtgcgggtgacagctgtgaatgaaggaggccagagccagcccagcgccctggacaccctggtgcaggccatgcctgtgacagtgtgccccaagttcctggtggacagcagcaccaaggacctgctgactgtgaaggtgggggacacagtgcgggtgcctgtgtcctttgaacatgcccggcggcccctgggccccagcacctgcaggaggacctgcctgggccgctag

SEQ ID NO: 39316 - DNA, 11127 bp, Artificial Sequence
  Description of Artificial Sequence: Synthetic coding sequence
atggccggcaagctgaggaagagccacatccctggggtgtccatctggcagctggtggaggagatccctgagggctgcagcaccccagactttgagcagaagcctgtgaccagcgccctgcctgagggcaagaatgctgtgttccgggctgtggtgtgtggggagcccaggcctgaggtgcgctggcagaacagcaagggggacctgagtgacagcagcaagtacaagatcagcagcagccctggcagcaaggagcacgtgctgcagatcaacaagctgaccggggaggacacagacctgtaccgctgcacagctgtgaatgcctatggagaggccgcctgcagcgtgcggctgactgtgattgaggtgggcttcaggaagaacaggaagaggcaccgggagccccaggaggacctgaggaaggagctgatggacttcaggaagctgctgaagaagagggcccccccagcccccaagaagaagatggacctggagcagatctggcagctgctgatgacagctgacaggaaggactatgagaagatctgcctgaagtatggcatcgtggactaccggggcatgctgcggcggctgcaggagatgaagaaggagcaggaggacaagatggcccagtacatcaacaccatcagcagcctgcggcacatccgggtgaccaaggatggaaatgccaagtttgacctggagctggacctgaaggacagccagagcaagatctacctgtacaaggatggagagatgatcccctacggcttcaacaaccagaccaagcactgcctgcggcggctgggcaagagatatgagttccagatccaggacctgcggccagaagattctggcatctaccaggtgaaggtggaggatgctgtggtgttcagcacagagctggaggccagcgccatccccccccgggtggtggtgcccctggccgagacccactgtgaggagcagggagatgctgtgtttgaatgtaccctgagcagcccctgccccagcgctgcctggcacttccgccaccggctgctgcaccccagcgacaagtatgaggtgtatgtgtccccagatggcctgacccaccggctggtggtgcggggggcccgcttcagtgacatgggcccctacagcctgggcaccggcctgtacaccagcagcgcctggctggtggtggaggccggcaaggacaaggacctgcagagcaccagcgctgaccacaagctgcagaggcagggcgcccaggccagcggggctgaggagagcggcagcattgagagccagggcgagaagagccgggagcagggcccccggggcggcagcctggagggcgccggccctgccagcggcctgcagcacatcgccagcccagacagagatggcctgggccgccacggctacagcctgatgggagacaagggcacagctgacagcgcctggggccctggccaggagggggagggcttccctgtggccgagggcagccgggccaccctgccccgggagaaccagagccaccgggagggcggctgggcccggagcctggccgagcggccccacctgcagggcgagagcagcgagagcggcctgggcctgcctgagaagcagcagcaggaccggggccgggacagcaacagtgatgagtgctggaggaaggccggcggctgggaggccggcagcagccggctgcaggccggcggcctgggcagcagccgggagggcaaggagcacagaggagacagcggccggcagctggacagacatgcccctgagcagctgtgggatgcccggctgggccctggccggggcaagagtgacctgcagggctgccagagcgaccctgtgggctcctggccccggggcaagcagatcgagatcagccaggatgacagcctggccgagatggacagaggagatgcccccagccgggagcggggccggggcatcgtggtgtggggcggcggcaccggcctgggggaggccggggacagcaatggagctgggggccctggcaccctggagctgactggaggccggggcagcggcagcaaggtgggcatggcccctgagagctggggcagccagggcggcagagatgctgactatggagaggcccggggctactggggcagcggggagctgctggagcagatccctgggggcaaggacttccaggagcccagcatcagcggcggcaggaagttcctgctgggagatggcagccctgagatcaaggccgaggacagcctgcaggaggctgatggcatctgccgcggggagagcgtggtgactggaagtgcctacaagacaggccctgggggccctggggacccccggggctgtgagggcgtgctgcaggagctgcggggcagagatggccaggagacagcctgggccagcggggaggtggagtatgaccccaggagcttccagagcagccagggctggacagctggccacagagctgctgggggcatcggccgcatcgagagcaagggcaccagcccctgggatgacacccccagcagcctgaggaagacaggagcccaccacggccctggggtgctgggccccagcggcggccaggagggcatgggcggcatctgggtggccggcctgacagaaagtggccagggcgtggatgcccggagccactggctgagccgggcccctggcctgggcgcccagggcagcggcggcaccctgggggacaagaagggcctgcggggccctggcagcatcggcagcgagccagacttctggaatggaagtggcagcagccgggtgaagggccccagaggagaaacaggctacaaggatggcctggagggccctggccgcatggagagccgctatgaaggaggcctgggctacagccgggagatcagcagcaagtctggagctggctacagctatggcagcggcgtgcctggagagatgggcagcggccatggagctggctgccgggtgagcccccgggccccagctggggtggagagcgaggagggcggcggctacagacatggcagcggggcccctgggggcgtgtggagcggaaatgaagacagcggccctgctgggggcggcagcggccgggtggccagcctgaagaatggaagtggcggcccagatggagcccccatgaatgacaccaggaactgggccagcgcctgccaggccggcatggacccccggggcggccaccacagtgatggcggcctgggcagccctggggtgactggatctgctggccggggcggcctgaaggcccctggggtggtggagaccgtgggcatgggctgtgtggaggccgagcctgagagcagcggccgcatccggccctggggccagacaggcaactacggcggcttccgggccagcgaggccctgggcgccttcggggagggcggctatgaagatggcagcggcggccctggggccatgggccctggcagcctgcgggccggcagcaaggtgggggagggagatggcacccgctgccctggggccaaggccagcggggccggggccggctacagagatgacaccaggcaccctgagagcctggccccccacaacggggccgccagcggcagccagtgggcctacggggctggaaatgtgctgggctatgaagatggcagcgagctgcccggcccccagggcaccggggtgaggacagcctacggggagaggagccggggcctgggccccaggagcacaggccctggaggagaggccggcttcagagatggcagcggcggcctgcagggcatgggcagcgcagatggccctggctgcaggaagggcatcggcagcagtggagagatgggctctgtggacaaggagggctacaagaaggacctgggcgcccctgagaacatgggcagcggcagcaaggctgactacagagatggagtgggcggcagcggggccatgggctccatggatgaggccggctacaggaaggacctgggcgcccctgagggcatcagcagcggcagcaaggctgactaccggggcggcctgcaggacagccgggaggccggcagcggcagcaaggctgactacagcggcggcctgaagggcagccgggagatcggctccatggatgaaacagacaacaggaaggacctgggcgtgcctgagggcatgggcgccggctaccgggccggcctgcggggccctggagagatgggcagcctggatgagagcggccacagaaatggcatcggcggctatggagagatgggcagcggctaccgggaggacctgggcgcccctgagggcatgggcaccggcagcaaggccggctacagagatggcctgcggggcagcggggagatgaggtccatggatgaggccggctacaggaagaacctgggcgcccctgagaggatggacagcggcagcaaggccggctaccggggcggcctgcggggcagcggggagatgggcctgattgaagctggctacaggaaggacctgggcgtgtctgagggcggcggcagcggcagcaaggccggctacagaggaggcctgggcagcggggagatgggctctgtggacaaggccggctacaggaaggacctgggcgccagcgaggccatcggcagcggcagcaaggccggcttcacagatggcctgggcggcagcgaggagatgggctctgtgaacaaggccggctacaggaaggacctgggcgcccccaagggcatgggcagcggcagcaaggccagcttcagagatggcctgggcggcagcggggagatgggctctgtgaatgaggccggctacaggaaggacctgggcgtgcctgagggcatcggcagcggcagcaaggccggcttcagagatggcctgggcggcagcgaggagatgggctctgtgaacaaggccggctacaggaaggacctgggcgcccccaagggcatcggcagcggcagcaaggccggcttcagagatggcctgggcagcagtggagagatgggctccatggatgaggccggctacaggaagaacctgggcgcccctgagggcatcggcagcggcagcaaggccggcttcagagatggcctgggcagctctgtggagatgggctctgtgaatgaggccggctacaggaaggacctgggcgcccctgagggcatgggcagcggcagcaaggccggcttcagagatggcctgggcggcagcggggagatgggctctgtgaatgaggccggctacaggaaggacctgggcgcccccaagggcatcggcagcggcagcaaggctgacttcagagatgccctgggcagcagtggagagatgggctccatggatgaggccggctacaggaaggacctgtgggcccctgagggcatcggcagcggcagcaaggccggcttcagagatggcctgggcagctctgtggagatgggctctgtgaatgaggccggctacaggaaggacctgggcgcccctgagggcatgggcagcggcagcaaggccggcttcagagatggcctgggcggcagcggggagatgggctctgtgaatgaggccggctacaggaaggacctgggcgcccccaagggcatcggcagcggcagcaaggctgacttcagagatgccctgggcagcagtggagagatgggctccatggatgaggccggctacaggaaggacctgtgggcccctgagggcatcggcagcggcagcaaggccggcttcagagatggcctgggcagctctgtggagatgggctctgtgaatgaggccggctacaggaaggacctgggcgcccctgagggcatgggcagcggcagcaaggagggcttcagagatggcctgggcggcagcgaggagatgggctctgtgaacaaggccggctacaggaaggacctgggcgcccccaagggcatgggcagcggcagcaaggagggcttcagagatggcctgggcggcagcgaggagatgggctccatggatgaggccggctacaggaaggacctgggcgcccctgagggcatcggcagcggcagcaaggccggcttcagagatggcctgggcggcagcgaggagatgaggtccatggatgaggccggctacaggaaggacctgggcgcccctgagcgcatcggcagcggcagcaaggccggcttcagagatggcctgggcagctctgtggagatgggctctgtgaatgaggccggctacaggaaggacctgggcgcccccaagggcatgggcagcggcagcaagacaggcttcagagatggcctgggcggcagcgaggagatggagagcatggatgaggccggctacaggaaggacctgggcgcccctgagggcatcggcagcggcagcaaggccggcttcagagatggcctgggcagcagcacagagatgggctctgtgaatgaggccggctacaggaaggacctgggcgcccccaagggcatgggcagcgagagcaaggccggcttcagagatggcctgggcagcagtggagagatgggctccatggatgaggccggctacaggaaggacctgggcgcccctgagggcatgggcagcggcagcaaggccggcttcagagatggcctgggcggcagcgaggagatgggctctgtgaacaaggccggctacaggaaggacctgggcgcccccaagggcatgggcagcggcagcaaggccggcttcagagatggcctgggcagcagtggagagatgggctccatggatgaggccgactacaggaaggacctgggcgcccctgaggagatgggcagcggcagctacacagactacagaaatggcctgggcagcagcggcaagatcagcagtggagatgaggccggctacaagaatgtgctgggcggcagcggcaggaaccccctgggcagcgaggccggcagccggggcagcctggaggacagcggctacatcctgtcctggaatgaggccggcagccggcagggctttggaggcaccagcggcatgggcagcggcagcgaggtgtcctaccggggcggcagcggcggcagcggggagaccggccctgagggcaagatgggctatggagatggcagcggccgcctgggcgtgcccggcagcctggccggcatcggccacgaggccggcccccggggccacaaggccatgggccacaggagcggctactgggtggccagcgagggggacaccaacagcaaggatggccctgagcgggcccgggagacccggctggtggatggagctggccctggggtggagcccggcatggccggcatgcctggaacagctgggggcatggcccaccgggacagcctgcggggcactggagtgctgggcagccagggcggccggcagaccctgagtgatgagcggggcagcaccaaggacctgggcggctacggcaccagcggcatccctgaggccagcgaggccgccggggccaagggcaagccagatgtgaaggagtggcaggacagcagcggcaccccaggcagcagccgggacagaggagccccccgggtgaaggacaggagcccagaccaggccggcatcatgggcgccagcggcttcctggatggaaaaggagctgtggagggggagacctgggccggcatggccgccctgggcagcggctatgagcgggacatctggaaggccggccctggcatgacagaccggggccgggtggccggccagggcggcctggccagccagggcggcggggacagcctgctgggcggcagaagagtgggcagcggcagctctgtgggcaccggccaggacctggacagcggctccatgcctgggggccggggcaagagcaccagcggccctgctgaccggcagggcaccagcaatgcctgggccccagactgggagaaccagggcttcagccagggcagcattgatgctgggaagcagcctgctggcagccgggccagcggcagcctgcaggagaaggatgctgcctttggaggcacccatgagggccctgggggcttcaagggcggggagggcgcccctggccaggaggccgccggcggctgccgcagcccctggagcctggacagcaagggcagcagccctggccggggcagctctgtggatgctgaggacagcggcatcctgggcaaaggaaacagcacagagtggggcaatgccctgacccccaagccaggagagagcggcccccagggcgcctggaatggcctggatggcccctttggaaggaaggccagccgggacagaagtggcggcacccaggacctgagcagccagaggggcaagggccagaggggcggcaagaggagcctgggggagcagggcagcctggaggccgagaatggagaggtgcagggccctggggccctgaaggaggatgagggccagggcgtggaggaggccggccgcagcggccggcggcccggcagcctgcggagccgcagccaggcccagagcggggctgaggtgggcggcggcaagagaagaggagcagatgaggccggctccatgggctggcagcccatgggagagaactggggctgcctggaggagatgctgaatgaagaccagagccgggagcccccaggccacctgggcagccgccgcagcggcaaggatggccgcctggacatctatggagagaggagagatgccaccaggagcagcaccagccgctacaagccaggcaccggcagcttcagcaaggatgcccagggccccatgggccacttcagccagggcctggccgacatggaggtgcagcccggggaggccgccaccctgagctgcaccctgaccagtgacctgggccctggcacctggttcaaggatggagtgaagctgaccacccaggatggagtcatcttcaagcaggacggcctggtgcacagcctcttcatcacccacgtgcagggcacccaggccggccgctacacctttgtggccggggaccagcagagcgaggccaccctgactgtgcaggacagccccaccatcgccccagatgtgacagagaagctgcgggagcccctggtggtgaaggccggcaagcctgtgattgtgaagatccccttccagagccacctgcccatccaggccgcctggaggaaggatggagctgaggtggtgggcagcagtgaccgggaggcccaggtggacctgggagatggctacacccggctgtgcctgcccagcgctggcaggaaggactgtggccagtacagcgtgaccctgcggtctgagggcggctctgtgcaggccgagctgaccctgcaggtgattgacaagccagaccccccccagggccccatggaggtgcaggactgccaccgggccggcgtgtgcctgcgctggaggcctccccgggacaatggaggccgcacagtggagtgctacgtggtggagcggcggcaggccggccgcagcacctggctgaaggtgggggaggccccagctgacagcaccaccttcacagatgcccacgtggagcccggcaggaagtacaccttccgggtgcgggctgtgaccagcgagggcgctggggaggccctggagagcgaggagatcctggtggcccctgaggccctgcccaaggcccccagcgccccagccatcctgagcgccagcagccagggcatcaccctgacctggacagccccccggggccctggcagcgcccacatcctgggctacctgattgaaagaaggaagaagggcagcaacacctggacagctgtgaatgaccagcctgtgcctgagcggcgctggacagtggctgatgtgcggcagggctgccagtatgagttccgggtgacagctgtggcccccagcggccctggagagcccggccccccatctgatgctgtgtttgcccgggaccccatgaggcctcctggcctggtgaggaacctgcaggtgacagacaggagcaacaccagcatcaccctgtcctgggccggccctgacacccaggagggagatgaggcccagggctacgtggtggagctgtgcagcagtgacagcctgcagtggctgccctgccacgtgggcaccgtgcctgtgaccacctacacagccaagggcctgcggcctggagagggctactttgtgcgggtgacagctgtgaatgaaggaggccagagccagcccagcgccctggacaccctggtgcaggccatgcctgtgacagtgtgccccaagttcctggtggacagcagcaccaaggacctgctgactgtgaaggtgggggacacagtgcgggtgcctgtgtcctttgaggccatgcccatgcctgaggtgacctggctgaaggatggcctgcccctgcccaagaggtctgtgacagtgaccaaggatggcctgacccagctgctgatccctgtggccggcctgagtgacagcggcctgtacacagtggtgctgcggaccctgcagggcaaggaggtggcccacagcttccgcatccgggtggccgcctgcccccaggcccctggccccatccacctgcaggagaatgtgcccggcaccgtgacagctgagtgggagcccagcccagatgaggcccaggatgtgcccctgcactatgctgtgttcaccaggagcagcgcccacggcccctggcatgaagctgctgaccgcatccacaccaaccgcttcaccctgctgggcatcctgcccggccacgagtaccacttccgggtggtggccaagaatgagctgggcgccagcaagcccagcgacaccagccagccctggtgcatcccccggcagagggaccgcttcaccgtgaaggccccctgctaccgggagccagacctgagccagaagccccgcttcctggtgggcctgcggagccacctgctgccccagggctgtgagtgctgcatgagctgtgctgtgcagggcagcccccggccccacgtgacctggttcaagaatgacaggagcctggagggcaacccagctgtgtacagcacagacctgctgggcgtgtgcagcctgaccatccccagcgtgagccccaaggacagcggggagtacaaggctgtggccgagaacaccctgggccaggccgtgtccacagccaccctcatcgtcatcgagcccagcacctag

SEQ ID NO: 39317 - DNA, 1713 bp, Artificial Sequence
  Description of Artificial Sequence: Synthetic coding sequence
atggccggcaagctgaggaagagccacatccctggggtgtccatctggcagctggtggaggagatccctgagggctgcagcaccccagactttgagcagaagcctgtgaccagcgccctgcctgagggcaagaatgctgtgttccgggctgtggtgtgtggggagcccaggcctgaggtgcgctggcagaacagcaagggggacctgagtgacagcagcaagtacaagatcagcagcagccctggcagcaaggagcacgtgctgcagatcaacaagctgaccggggaggacacagacctgtaccgctgcacagctgtgaatgcctatggagaggccgcctgcagcgtgcggctgactgtgattgaggtgggcttcaggaagaacaggaagaggcaccgggagccccaggaggacctgaggaaggagctgatggacttcaggaagctgctgaagaagagggcccccccagcccccaagaagaagatggacctggagcagatctggcagctgctgatgacagctgacaggaaggactatgagaagatctgcctgaagtatggcatcgtggactaccggggcatgctgcggcggctgcaggagatgaagaaggagcaggaggacaagatggcccagtacatcaacaccatcagcagcctgcggcacatccgggtgaccaaggatggaaatgccaagtttgacctggagctggacctgaaggacagccagagcaagatctacctgtacaaggatggagagatgatcccctacggcttcaacaaccagaccaagcactgcctgcggcggctgggcaagagatatgagttccagatccaggacctgcggccagaagattctggcatctaccaggtgaaggtggaggatgctgtggtgttcagcacagagctggaggccagcgccatccccccccgggtggtggtgcccctggccgagacccactgtgaggagcagggagatgctgtgtttgaatgtaccctgagcagcccctgccccagcgctgcctggcacttccgccaccggctgctgcaccccagcgacaagtatgaggtgtatgtgtccccagatggcctgacccaccggctggtggtgcggggggcccgcttcagtgacatgggcccctacagcctgggcaccggcctgtacaccagcagcgcctggctggtggtggaggccggcaaggacaaggacctgcagagcaccagcgctgaccacaagctgcagagcagaagaagtggcaaggatggccgcctggacatctacggggagaggagagatgccaccaggagcagcaccagccgctacaagccaggcaccggcagcttcagcaaggatgcccagggccccatgggccacttcagccagggcctggccgacatggaggtgcagcctggagaggccgccaccctgagctgcaccctgaccagtgacctgggccctggcacctggttcaaggatggagtgaagctgaccacccaggatggagtcatcttcaagcaggacggcctggtgcacagcctcttcatcacccacgtgcagggcacccaggccggccgctacacctttgtggccggggaccagcagagcgaggccaccctgactgtgcaggacagccccaccatcgccccagatgtgacagagaagctgcgggagcccctggtggtgaaggccggcaagcccatccagacctaccactag

SEQ ID NO: 39318 - DNA, 1446 bp, Artificial Sequence
  Description of Artificial Sequence: Synthetic coding sequence
atgatgctgaagagcatcacagagagctttgccacagccatccacggcctgaaggtgggccacctgacagacagagtcatccagaggagcaagaggatgatcctggacaccctgggcgccggcttcctgggcaccaccacagaggtgttccacatcgccagccagtacagcaagatctacagcagcaacatcagcagcacagtgtggggccagcctgacatccggctgccccccacctatgctgcctttgtgaatggagtggccatccacagcatggactttgatgacacctggcacccagccacccaccccagcggggctgtgctgcctgtgctgacagccctggccgaggccctgcccaggagccccaagttcagcggcctggacctgctgctggccttcaacgtgggcatcgaggtgcagggccgcctgctgcactttgccaaggaggccaatgacatgcccaagcgcttccacccccccagcgtggtgggcaccctgggcagcgctgctgctgccagcaagttcctgggcctgagcagcaccaagtgccgggaggccctggccatcgctgtgtcccatgctggggcccccatggccaatgctgccacccagaccaagcccctgcacatcggaaatgctgccaagcatggaattgaagctgccttcctggccatgctgggcctgcagggcaacaagcaggtgctggacctggaggccggctttggagccttctacgccaactacagccccaaggtgctgcccagcatcgccagctacagctggctgctggaccagcaggatgtggccttcaagcgcttccctgcccacctgagcacccactgggtggctgatgctgctgcctctgtgaggaagcacctggtggccgagcgggccctgctgcccacagactacatcaagagaattgtgctgcgcatccccaacgtgcagtatgtgaaccggcccttccctgtgtctgagcacgaggcccggcacagcttccagtatgtggcctgtgccatgctgctggatggcggcatcaccgtgcccagcttccacgagtgccagatcaaccggccccaggtgcgggagctgctgagcaaggtggagctggagtaccccccagacaacctgcccagcttcaacatcctgtactgtgagatctctgtgaccctgaaggatggagccaccttcacagacagaagtgacaccttctacggccactggaggaagcccctgagccaggaggacctggaggagaagttccgggccaatgccagcaagatgctgtcctgggacacagtggagagcctcatcaagatcgtgaagaacctggaggacctggaggactgcagcgtgctgaccaccctgctgaagggccccagccccccagaggtggccagcaacagccctgcctgcaacaacagcatcaccaacctgtcctag

SEQ ID NO: 39319 - DNA, 1446 bp, Artificial Sequence
  Description of Artificial Sequence: Synthetic coding sequence
ttccccctgaagagcatcacagagagctttgccacagccatccacggcctgaaggtgggccacctgacagacagagtcatccagaggagcaagaggatgatcctggacaccctgggcgccggcttcctgggcaccaccacagaggtgttccacatcgccagccagtacagcaagatctacagcagcaacatcagcagcacagtgtggggccagcctgacatccggctgccccccacctatgctgcctttgtgaatggagtggccatccacagcatggactttgatgacacctggcacccagccacccaccccagcggggctgtgctgcctgtgctgacagccctggccgaggccctgcccaggagccccaagttcagcggcctggacctgctgctggccttcaacgtgggcatcgaggtgcagggccgcctgctgcactttgccaaggaggccaatgacatgcccaagcgcttccacccccccagcgtggtgggcaccctgggcagcgctgctgctgccagcaagttcctgggcctgagcagcaccaagtgccgggaggccctggccatcgctgtgtcccatgctggggcccccatggccaatgctgccacccagaccaagcccctgcacatcggaaatgctgccaagcatggaattgaagctgccttcctggccatgctgggcctgcagggcaacaagcaggtgctggacctggaggccggctttggagccttctacgccaactacagccccaaggtgctgcccagcatcgccagctacagctggctgctggaccagcaggatgtggccttcaagcgcttccctgcccacctgagcacccactgggtggctgatgctgctgcctctgtgaggaagcacctggtggccgagcgggccctgctgcccacagactacatcaagagaattgtgctgcgcatccccaacgtgcagtatgtgaaccggcccttccctgtgtctgagcacgaggcccggcacagcttccagtatgtggcctgtgccatgctgctggatggcggcatcaccgtgcccagcttccacgagtgccagatcaaccggccccaggtgcgggagctgctgagcaaggtggagctggagtaccccccagacaacctgcccagcttcaacatcctgtactgtgagatctctgtgaccctgaaggatggagccaccttcacagacagaagtgacaccttctacggccactggaggaagcccctgagccaggaggacctggaggagaagttccgggccaatgccagcaagatgctgtcctgggacacagtggagagcctcatcaagatcgtgaagaacctggaggacctggaggactgcagcgtgctgaccaccctgctgaagggccccagccccccagaggtggccagcaacagccctgcctgcaacaacagcatcaccaacctgtcctag

SEQ ID NO: 39320 - DNA, 963 bp, Artificial Sequence
  Description of Artificial Sequence: Synthetic coding sequence
atggccgagggagatgctggcagtgaccagaggcagaatgaggagattgaggccatggccgccatctatggagaggagtggtgtgtgattgatgactgtgccaagatcttctgcatccgcatcagtgatgacattgatgaccccaagtggaccctgtgcctgcaggtgatgctgcccaatgagtacccaggcacagccccacccatctaccagctgaatgccccctggctgaagggccaggagagagctgacctgagcaacagcctggaggagatctacatccagaacattggagagagcatcctgtacctgtgggtggagaagatcagagatgtgctgatccagaagagccagatgacagagcccggcccagatgtgaagaagaagacagaggaggaggatgtggagtgtgaagatgacctgatcctggcctgccagcctgagagcagcctgaaggccctggactttgacatcagcgagaccaggacagaggtggaggtggaggagctgccccccatcgaccacggcatccccatcacagaccggcgcagcaccttccaggcccacctggcccctgtggtgtgccccaagcaggtgaagatggtgctgagcaagctgtatgagaacaagaagatcgccagcgccacccacaacatctatgcctaccgcatctactgtgaggacaagcagaccttcctgcaggactgtgaagatgatggagaaacagctgctgggggccgcctgctgcacctgatggagatcctgaatgtgaagaatgtgatggtggtggtgagccgctggtacggcggcatcctgctgggccctgaccgcttcaagcacatcaacaactgtgccaggaacatcctggtggagaagaactacaccaacagccctgaggagagcagcaaggccctgggcaagaacaagaaggtgaggaaggacaagaagagaaatgagcactag

SEQ ID NO: 39321 - DNA, 492 bp, Artificial Sequence
  Description of Artificial Sequence: Synthetic coding sequence
atgagcaccaatgaaaatgccaacacccaggccgcccacctgcacaggagcaagaacaagggcaaggacagcacagagacccggcggcaccgcatcgaggtgaatgtggagctgaggaaggccaagaaggatgaccagatgctgaagagaagaaatgtgtcctccttcccagatgatgccaccagccccctgcaggagaactgcaacaaccagaccccagccctgcgggccatcggcaacatcgtgactggaacagatgagcagacccaggtggtgattgatgctggggccctggccgtgttccccagcctgctgaccaaccccaagaccaacatccagaaggaggccacctggaccatgagcaacatcacagccagccggcaggaccagatccagcaggtggtgaaccacggcctggtgcccttcctggtgtctgacctgagcaagatcctgcggcacaagaggaagctgtatggcccctggaacagctag

SEQ ID NO: 39322 - DNA, 156 bp, Artificial Sequence
  Description of Artificial Sequence: Synthetic coding sequence
atgagcggccccctgagccctgtgtgcagctgcccccagctgcccttcatgctgagcccctgccacatgcaccaccaccctggccacgtggccctgagccagacagtgtccccagccagcctgctgacccagggcctgggcctgccccagcactag

SEQ ID NO: 39323 - DNA, 2775 bp, Artificial Sequence
  Description of Artificial Sequence: Synthetic coding sequence
atggagatcaaggaggagggcgccagcgaggagggccagcacttcctgcccacagcccaggccaatgaccccggggactgccagttcaccagcatccagaagaccccaaatgagccccagctggagttcatcctggcctgcaaggacctggtggcccctgtgcgggacaggaagctgaacaccctggtgcagatcagcgtcatccaccctgtggagcagagcctgacccgctacagcagcacagaaattgtggagggcacccgggaccccctcttcctgactggagtgaccttccccagcgagtaccccatctatgaggagaccaagatcaagctgactgtgtatgatgtgaaggacaagagccatgacacagtgaggacctctgtgctgcctgagcacaaggaccccccacctgaggtgggccgctccttcctgggctacgccagcttcaaggtgggggagctgctgaagagcaaggagcagctgctggtgctgagcctgcggaccagtgatggcggcaaggtggtgggcaccatcgaggtgtctgtggtgaagatgggagaaattgaagatggagaggccgaccacatcaccacagatgtgcagggccagaagtgtgccctggtgtgtgaatgtacagcccctgagagcgtgtctgggaaggacaacctgcccttcctgaacagcgtgctgaagaaccctgtgtgcaagctgtaccgcttccccaccagtgacaacaagtggatgaggatccgggagcagatgtctgagagcatcctgtccttccacatccccaaggagctgatcagcctgcacatcaaggaggacctgtgcaggaaccaggagatcaaggagctgggggagctgagcccccactgggacaacctgaggaagaatgtgctgacccactgtgaccagatggtgaacatgtaccaggacatcctgacagagctgagcaaggagaccggcagcagcttcaagagcagcagcagcaagggggagaagaccctggagtttgtgcccatcaacctgcacctgcagaggatgcaggtgcacagcccccacctgaaggatgccctgtatgatgtgatcaccgtgggcgccccagctgcccacttccagggcttcaagaatggaggcctgaggaagctgctgcacagatttgaaacagagaggaggaacacaggctaccagttcatctactacagcccagaaaatacagccaaggccaaggaggtgctgagcaacatcaaccagctgcagcccctcatcgccacccacgccgacctgctgctgaacagcgccagccagcacagcccagacagcctgaagaacagcctgaagatgctgtctgagaagacagagctgtttgtgcacgccttcaaggaccagctggtgcgcagcgccctgctggccctgtacacagcccggcctgggggcatcctgaagaagccacccagccccaagagcagcacagaggagagcagcccccaggaccagccccctgtgatgaggggccaggacagcatcccccaccacagcgactatgatgaggaggagtgggacagagtgtgggccaacgtgggcaagagcctgaactgcatcatcgccatggtggacaagctgattgaaagagatggcggcagcgagggcagcggcggcaacaatgatggagagaaggagcccagcctgacagatgccatccccagccacccccgggaggactggtatgagcagctgtaccccctcatcctgaccctgaaggactgcatgggagaggtggtgaacagagccaagcagagcctgacctttgtgctgctgcaggagctggcctacagcctgccccagtgcctgatgctgaccctgcggcgggacatcgtgttcagccaggccctggccggcctggtgtgtggcttcatcatcaagctgcagaccagcctgtatgaccccggcttcctgcagcagctgcacacagtgggcctcatcgtgcagtatgagggcctgctgagcacctacagtgatgagatcggcatgctggaggacatggctgtgggcatcagtgacctgaagaaggtggccttcaagatcatcgaggccaagagcaatgatgtgctgcccgtcatcactggaagaagagagcactacgtggtggaggtgaagctgcctgccaggatgtttgagagcctgcccctgcagatcaaggagggccagctgctgcacgtgtaccctgtgctcttcaacgtgggcatcaatgagcagcagaccctggccgagagatttggagatgtgtccctgcaggagagcatcaaccaggagaactttgagctgctgcaggagtactacaagatcttcatggagaagatgcccccagactacatcagccacttccaggagcagaatgacctgaaggccctgctggagaacctgctgcagaacatccagagcaagaagaggaagaatgtggagatcatgtggctggccgccaccatctgcaggaagctgaatggcatccgcttcacctgctgcaagagcgccaaggacaggacctccatgtctgtgaccctggagcagtgcagcatcctgagagatgagcaccagctgcacaaggacttcttcatccgggccctggactgcatgaggcgggagggctgcagaattgaaaatgtgctgaagaacatcaagtgcaggaaatatgccttcaacatgctgcagctgatggccttccccaagtactaccggcccccagagggcacctacggcaaggctgacacctag

SEQ ID NO: 39324 - DNA, 2775 bp, Artificial Sequence; identical to SEQ ID NO: 39323
  Description of Artificial Sequence: Synthetic coding sequence

SEQ ID NO: 39325 - DNA, 120 bp, Artificial Sequence
  Description of Artificial Sequence: Synthetic coding sequence
atggagatcaaggaggagggcgccagcgaggagggccagcacttcctgcccacagcccaggccaatgaccccggggactgccagttcaccagcatccagaagaccccaaatgagccctag

SEQ ID NO: 39326 - DNA, 396 bp, Artificial Sequence
  Description of Artificial Sequence: Synthetic coding sequence
atggagatcaaggaggagggcgccagcgaggagggccagcacttcctgcccacagcccaggccaatgaccccggggactgccagttcaccagcatccagaagaccccaaatgagccccagctggagttcatcctggcctgcaaggacctggtggcccctgtgcgggacaggaagctgaacaccctggtgcagatcagcgtcatccaccctgtggagcagagcctgacccgctacagcagcacagaaattgtggagggcacccgggaccccctcttcctgactggagtgaccttccccagcgagtaccccatctatgaggagaccaagatcaagctgactgtgtatgatgtgaaggacaagagccatgacaccatcgccaacagcagccgcatctag

SEQ ID NO: 39327 - DNA, 255 bp, Artificial Sequence
  Description of Artificial Sequence: Synthetic coding sequence
atggagatcaaggaggagggcgccagcgaggagggccagcacttcctgcccacagcccaggccaatgaccccggggactgccagttcaccagcatccagaagaccccaaatgagccccagctggagttcatcctggcctgcaaggacctggtggcccctgtgcgggacaggaagctgaacaccctggtgcagatcagcgtcatccaccctgtggagcagagcctgacccgctacagcagcacagaaattgtgtag

SEQ ID NO: 39328 - DNA, 162 bp, Artificial Sequence
  Description of Artificial Sequence: Synthetic coding sequence
atggagatcaaggaggagggcgccagcgaggagggccagcacttcctgcccacagcccaggccaatgaccccggggactgccagttcaccagcatccagaagaccccaaatgagccccagctggagttcatcctggacctgaaccaggagctgcgggactag

SEQ ID NO: 39329 - DNA, 2775 bp, Artificial Sequence; identical to SEQ ID NO: 39323
  Description of Artificial Sequence: Synthetic coding sequence

SEQ ID NO: 39330 - DNA, 2817 bp, Artificial Sequence
  Description of Artificial Sequence: Synthetic coding sequence
atggagatcaaggaggagggcgccagcgaggagggccagcacttcctgcccacagcccaggccaatgaccccggggactgccagttcaccagcatccagaagaccccaaatgagccccagctggagttcatcctggcctgcaaggacctggtggcccctgtgcgggacaggaagctgaacaccctggtgcagatcagcgtcatccaccctgtggagcagagcctgacccgctacagcagcacagaaattgtggagggcacccgggaccccctcttcctgactggagtgaccttccccagcgagtaccccatctatgaggagaccaagatcaagctgactgtgtatgatgtgaaggacaagagccatgacacagtgaggacctctgtgctgcctgagcacaaggaccccccacctgaggtgggccgctccttcctgggctacgccagcttcaaggtgggggagctgctgaagagcaaggagcagctgctggtgctgagcctgcggaccagtgatggcggcaaggtggtgggcaccatcgaggtgtctgtggtgaagatgggagaaattgaagatggagaggccgaccacatcaccacagatgtgcagggccagaagtgtgccctggtgtgtgaatgtacagcccctgagagcgtgtctgggaaggacaacctgcccttcctgaacagcgtgctgaagaaccctgtgtgcaagctgtaccgcttccccaccagtgacaacaagtggatgaggatccgggagcagatgtctgagagcatcctgtccttccacatccccaaggagctgatcagcctgcacatcaaggaggacctgtgcaggaaccaggagatcaaggagctgggggagctgagcccccactgggacaacctgaggaagaatgtgctgacccactgtgaccagatggtgaacatgtaccaggacatcctgacagagctgagcaaggagaccggcagcagcttcaagagcagcagcagcaagggggagaagaccctggagtttgtgcccatcaacctgcacctgcagaggatgcaggtgcacagcccccacctgaaggatgccctgtatgatgtgatcaccgtgggcgccccagctgcccacttccagggcttcaagaatggaggcctgaggaagctgctgcacagatttgaaacagagaggaggaacacaggctaccagttcatctactacagcccagaaaatacagccaaggccaaggaggtgctgagcaacatcaaccagctgcagcccctcatcgccacccacgccgacctgctgctgaacagcgccagccagcacagcccagacagcctgaagaacagcctgaagatgctgtctgagaagacagagctgtttgtgcacgccttcaaggaccagctggtgcgcagcgccctgctggccctgtacacagcccggcctgggggcatcctgaagaagccacccagccccaagagcagcacagaggagagcagcccccaggaccagccccctgtgatgaggggccaggacagcatcccccaccacagcgactatgatgaggaggagtgggacagagtgtgggccaacgtgggcaagagcctgaactgcatcatcgccatggtggacaagctgattgaaagagatggcggcagcgagggcagcggcggcaacaatgatggagagaaggagcccagcctgacagatgccatccccagccacccccgggaggactggtatgagcagctgtaccccctcatcctgaccctgaaggactgcatgggagaggtggtgaacagagccaagcagagcctgacctttgtgctgctgcaggagctggcctacagcctgccccagtgcctgatgctgaccctgcggcgggacatcgtgttcagccaggccctggccggcctggtgtgtggcttcatcatcaagctgcagaccagcctgtatgaccccggcttcctgcagcagctgcacacagtgggcctcatcgtgcagtatgagggcctgctgagcacctacagtgatgagatcggcatgctggaggacatggctgtgggcatcagtgacctgaagaaggtggccttcaagatcatcgaggccaagagcaatgatgtgctgcccgtcatcactggaagaagagagcactacgtggtggaggtgaagctgcctgccaggatgtttgagagcctgcccctgcagatcaaggagggccagctgctgcacgtgtaccctgtgctcttcaacgtgggcatcaatgagcagcagaccctggccgagagatttggagatgtgtccctgcaggagagcatcaaccaggagaactttgagctgctgcaggagtactacaagatcttcatggagaagatgcccccagactacatcagccacttccaggagcagaatgacctgaaggccctgctggagaacctgctgcagaacatccagagcaagaagaggaagaatgtggagatcatgtggctggccgccaccatctgcaggaagctgaatggcatccgcttcacctgctgcaagagcgccaaggacaggacctccatgtctgtgaccctggagcagtgcagcatcctgagagatgagcaccagctgcacaaggacttcttcatccgggccctggactgcatgaggagccggcagacccagggcgccctgaatgaaagtgatgatcctgagaccggctgcctgacagacaacaagcccaccagccgccacttctaccctgtggccctgctgctggtgagcagccacctgctggtggtgtggctgatcctgagcctggccctgctgctggccaagtaccagtag

SEQ ID NO: 39331 - DNA, 2454 bp, Artificial Sequence
  Description of Artificial Sequence: Synthetic coding sequence
atggagatcaaggaggagggcgccagcgaggagggccagcacttcctgcccacagcccaggccaatgaccccggggactgccagttcaccagcatccagaagaccccaaatgagccccagctggagttcatcctggcctgcaaggacctggtggcccctgtgcgggacaggaagctgaacaccctggtgcagatcagcgtcatccaccctgtggagcagagcctgacccgctacagcagcacagaaattgtggagggcacccgggaccccctcttcctgactggagtgaccttccccagcgagtaccccatctatgaggagaccaagatcaagctgactgtgtatgatgtgaaggacaagagccatgacacagtgaggacctctgtgctgcctgagcacaaggaccccccacctgaggtgggccgctccttcctgggctacgccagcttcaaggtgggggagctgctgaagagcaaggagcagctgctggtgctgagcctgcggaccagtgatggcggcaaggtggtgggcaccatcgaggtgtctgtggtgaagatgggagaaattgaagatggagaggccgaccacatcaccacagatgtgcagggccagaagtgtgccctggtgtgtgaatgtacagcccctgagagcgtgtctgggaaggacaacctgcccttcctgaacagcgtgctgaagaaccctgtgtgcaagctgtaccgcttccccaccagtgacaacaagtggatgaggatccgggagcagatgtctgagagcatcctgtccttccacatccccaaggagctgatcagcctgcacatcaaggaggacctgtgcaggaaccaggagatcaaggagctgggggagctgagcccccactgggacaacctgaggaagaatgtgctgacccactgtgaccagatggtgaacatgtaccaggacatcctgacagagctgagcaaggagaccggcagcagcttcaagagcagcagcagcaagggggagaagaccctggagtttgtgcccatcaacctgcacctgcagaggatgcaggtgcacagcccccacctgaaggatgccctgtatgatgtgatcaccgtgggcgccccagctgcccacttccagggcttcaagaatggaggcctgaggaagctgctgcacagatttgaaacagagaggaggaacacaggctaccagttcatctactacagcccagaaaatacagccaaggccaaggaggtgctgagcaacatcaaccagctgcagcccctcatcgccacccacgccgacctgctgctgaacagcgccagccagcacagcccagacagcctgaagaacagcctgaagatgctgtctgagaagacagagctgtttgtgcacgccttcaaggaccagctggtgcgcagcgccctgctggccctgtacacagcccggcctgggggcatcctgaagaagccacccagccccaagagcagcacagaggagagcagcccccaggaccagccccctgtgatgaggggccaggacagcatcccccaccacagcgactatgatgaggaggagtgggacagagtgtgggccaacgtgggcaagagcctgaactgcatcatcgccatggtggacaagctgattgaaagagatggcggcagcgagggcagcggcggcaacaatgatggagagaaggagcccagcctgacagatgccatccccagccacccccgggaggactggtatgagcagctgtaccccctcatcctgaccctgaaggactgcatgggagaggtggtgaacagagccaagcagagcctgacctttgtgctgctgcaggagctggcctacagcctgccccagtgcctgatgctgaccctgcggcgggacatcgtgttcagccaggccctggccggcctggtgtgtggcttcatcatcaagctgcagaccagcctgtatgaccccggcttcctgcagcagctgcacacagtgggcctcatcgtgcagtatgagggcctgctgagcacctacagtgatgagatcggcatgctggaggacatggctgtgggcatcagtgacctgaagaaggtggccttcaagatcatcgaggccaagagcaatgatgtgctgcccgtcatcactggaagaagagagcactacgtggtggaggtgaagctgcctgccaggatgtttgagagcctgcccctgcagatcaaggagggccagctgctgcacgtgtaccctgtgctcttcaacgtgggcatcaatgagcagcagaccctggccgagagatttggagatgtgtccctgcaggagagcatcaaccaggagaactttgagctgctgcaggagtactacaagatcttcatggagaagatgcccccagactacatcagccacttccaggagcagaatgacctgaaggccctgctggagaacctgctgcagaacatccagagcaagaagtag

SEQ ID NO: 39332 - DNA, 2775 bp, Artificial Sequence; identical to SEQ ID NO: 39323
  Description of Artificial Sequence: Synthetic coding sequence

SEQ ID NO: 39333 - DNA, 1971 bp, Artificial Sequence
  Description of Artificial Sequence: Synthetic coding sequence
atgggagaaattgaagatggagaggccgaccacatcaccacagatgtgcagggccagaagtgtgccctggtgtgtgagtgcacagcccctgagagcgtgtctgggaaggacaacctgcccttcctgaacagcgtgctgaagaaccctgtgtgcaagctgtaccgcttccccaccagtgacaacaagtggatgaggatccgggagcagatgtctgagagcatcctgtccttccacatccccaaggagctgatcagcctgcacatcaaggaggacctgtgcaggaaccaggagatcaaggagctgggggagctgagcccccactgggacaacctgaggaagaatgtgctgacccactgtgaccagatggtgaacatgtaccaggacatcctgacagagctgagcaaggagaccggcagcagcttcaagagcagcagcagcaaaggagagaagaccctggagtttgtgcccatcaacctgcacctgcagaggatgcaggtgcacagcccccacctgaaggatgccctgtatgatgtgatcaccgtgggcgccccagctgcccacttccagggcttcaagaatggaggcctgaggaagctgctgcacagatttgaaacagaaagaagaaacacaggctaccagttcatctactacagccctgagaacacagccaaggccaaggaggtgctgagcaacatcaaccagctgcagcccctgattgccacccatgctgacctgctgctgaacagcgccagccagcacagcccagacagcctgaagaacagcctgaagatgctgtctgagaagacagagctgtttgtgcacgccttcaaggaccagctggtgcgcagcgccctgctggccctgtacacagcccggcctgggggcatcctgaagaagccacccagccccaagagcagcacagaggagagcagcccccaggaccagccccctgtgatgaggggccaggacagcatcccccaccacagcgactatgatgaggaggagtgggacagagtgtgggccaacgtgggcaagagcctgaactgcatcatcgccatggtggacaagctgattgaaagagatggcggcagcgagggcagcggcggcaacaatgatggagagaaggagcccagcctgacagatgccatccccagccacccccgggaggactggtatgagcagctgtaccccctcatcctgaccctgaaggactgcatgggagaggtggtgaacagagccaagcagagcctgacctttgtgctgctgcaggagctggcctacagcctgccccagtgcctgatgctgaccctgcggcgggacatcgtgttcagccaggccctggccggcctggtgtgtggcttcatcatcaagctgcagaccagcctgtatgaccccggcttcctgcagcagctgcacacagtgggcctgattgtgcagtatgagggcctgctgagcacctacagtgatgaaattggcatgctggaggacatggctgtgggcatcagtgacctgaagaaggtggccttcaagatcatcgaggccaagagcaatgatgtgctgcctgtgatcaccggccggcgggagcactacgtggtggaggtgaagctgcctgccaggatgtttgagagcctgcccctgcagatcaaggagggccagctgctgcacgtgtaccctgtgctcttcaacgtgggcatcaatgagcagcagaccctggccgagagatttggagatgtgtccctgcaggagagcatcaaccaggagaactttgagctgctgcaggagtactacaagatcttcatggagaagatgcccccagactacatcagccacttccaggagcagaatgacctgaaggccctgctggagaacctgctgcagaacatccagagcaagaagaaggagtgcaggaactacgtggccggctgcaatgacctgccccagacagagtggtacagcttccacctgctgtag

SEQ ID NO: 39334 - DNA, 2061 bp, Artificial Sequence
  Description of Artificial Sequence: Synthetic coding sequence
atgatccacttccaccccctcatcctgccccatgagaggagcttcctgggctacgccagcttcaaggtgggggagctgctgaagagcaaggagcagctgctggtgctgagcctgcggaccagtgatggcggcaaggtggtgggcaccatcgaggtgtctgtggtgaagatgggagaaattgaagatggagaggccgaccacatcaccacagatgtgcagggccagaagtgtgccctggtgtgtgagtgcacagcccctgagagcgtgtctgggaaggacaacctgcccttcctgaacagcgtgctgaagaaccctgtgtgcaagctgtaccgcttccccaccagtgacaacaagtggatgaggatccgggagcagatgtctgagagcatcctgtccttccacatccccaaggagctgatcagcctgcacatcaaggaggacctgtgcaggaaccaggagatcaaggagctgggggagctgagcccccactgggacaacctgaggaagaatgtgctgacccactgtgaccagatggtgaacatgtaccaggacatcctgacagagctgagcaaggagaccggcagcagcttcaagagcagcagcagcaaaggagagaagaccctggagtttgtgcccatcaacctgcacctgcagaggatgcaggtgcacagcccccacctgaaggatgccctgtatgatgtgatcaccgtgggcgccccagctgcccacttccagggcttcaagaatggaggcctgaggaagctgctgcacagatttgaaacagaaagaagaaacacaggctaccagttcatctactacagccctgagaacacagccaaggccaaggaggtgctgagcaacatcaaccagctgcagcccctgattgccacccatgctgacctgctgctgaacagcgccagccagcacagcccagacagcctgaagaacagcctgaagatgctgtctgagaagacagagctgtttgtgcacgccttcaaggaccagctggtgcgcagcgccctgctggccctgtacacagcccggcctgggggcatcctgaagaagccacccagccccaagagcagcacagaggagagcagcccccaggaccagccccctgtgatgaggggccaggacagcatcccccaccacagcgactatgatgaggaggagtgggacagagtgtgggccaacgtgggcaagagcctgaactgcatcatcgccatggtggacaagctgattgaaagagatggcggcagcgagggcagcggcggcaacaatgatggagagaaggagcccagcctgacagatgccatccccagccacccccgggaggactggtatgagcagctgtaccccctcatcctgaccctgaaggactgcatgggagaggtggtgaacagagccaagcagagcctgacctttgtgctgctgcaggagctggcctacagcctgccccagtgcctgatgctgaccctgcggcgggacatcgtgttcagccaggccctggccggcctggtgtgtggcttcatcatcaagctgcagaccagcctgtatgaccccggcttcctgcagcagctgcacacagtgggcctgattgtgcagtatgagggcctgctgagcacctacagtgatgaaattggcatgctggaggacatggctgtgggcatcagtgacctgaagaaggtggccttcaagatcatcgaggccaagagcaatgatgtgctgcctgtgatcaccggccggcgggagcactacgtggtggaggtgaagctgcctgccaggatgtttgagagcctgcccctgcagatcaaggagggccagctgctgcacgtgtaccctgtgctcttcaacgtgggcatcaatgagcagcagaccctggccgagagatttggagatgtgtccctgcaggagagcatcaaccaggagaactttgagctgctgcaggagtactacaagatcttcatggagaagatgcccccagactacatcagccacttccaggagcagaatgacctgaaggccctgctggagaacctgctgcagaacatccagagctag

SEQ ID NO: 39335 - DNA, 3399 bp, Artificial Sequence
  Description of Artificial Sequence: Synthetic coding sequence
atggagctgttccaggccaaggaccactacatcctgcagcagggcgagcgggccctgtggtgcagcagaagagatggcggcctgcagctgcggcctgccacagacctgctgctggcctggaaccccatctgcctgggcctggtggagggcgtcatcggcaagatccagctgcacagcgacctgccctggtggctgatcctgatccggcagaaggccctggtgggcaagctgcccggggaccacgaggtgtgcaaggtgaccaagattgctgtgctgagcctgtctgagatggagccccaggacctggagctggagctgtgcaagaagcaccacttcggcatcaacaagccagagaagatcatccccagcccagatgacagcaagttcctgctgaagaccttcacccacatcaagagcaatgtgtctgcccccaacaagaagaaggtgaaggagagcaaggagaaggagaagctggagcggcggctgctggaggagctgctgaagatgttcatggattctgagagcttctactacagcctgacctatgacctgaccaacagcgtgcagaggcagagcactggagagagagatggccggcccctgtggcagaaggtggatgaccgcttcttctggaacaagtacatgatccaggacctgacagagatcggcaccccagatgtggacttctggatcatccccatgatccagggctttgtgcagatcgaggagctggtggtgaactacacagagagcagtgatgatgagaagagcagccctgagaccccaccccaggagagcacctgtgtggatgacatccacccccgcttcctggtggccctgatcagcagaagaagccgccacagagctggcatgagatacaagagaagaggagtggacaagaatggaaatgtggccaactacgtggagacagagcagctgattcatgtgcacaaccacaccctgagctttgtgcagacccggggctctgtgcctgtgttctggagccaggtgggctaccgctacaacccccggccccggctggacagaagtgagaaggagaccgtggcctacttctgtgcccactttgaggagcagctgaacatctacaagaagcaggtgatcatcaacctggtggaccaggccggccgggagaagatcattggagatgcctacctgaagcaggtgctgctcttcaacaacagccacctgacctacgtgtcctttgacttccacgagcactgccggggcatgaagtttgaaaatgtgcagaccctgacagatgccatctatgacatcatcctggacatgaagtggtgctgggtggatgaggccggggtcatctgcaagcaggagggcatcttccgggtgaactgcatggactgcctggacaggaccaacgtggtgcaggccgccatcgcccgggtggtgatggagcagcagctgaagaagctgggcgtgatgcctcctgagcagcccctgcctgtgaagtgcaaccgcatctaccagatcatgtgggccaacaacggggacagcatcagccggcagtatgccggcacagctgccctgaagggggacttcaccaggactggagagaggaagctggccggcgtgatgaaggatggagtgaacagcgccaaccgctactacctgaaccgcttcaaggatgcctaccggcaggccgtcatcgacctgatgcagggcatccctgtgacagaggacctgtacagcatcttcaccaaggagaaggagcacgaggccctgcacaaggagaaccagaggagccaccaggagctgatcagccagctgctgcagagctacatgaagctgctgctgcctgatgatgagaagttccacggcggctgggccctgattgactgtgaccccagcctgattgatgccacccacagagatgtggatgtgctgctgctgctgagcaacagcgcctactacgtggcctactatgatgatgaggtggacaaggtgaaccagtaccagaggctgagcctggagaacctggagaagattgaaattggccctgagcccaccctgtttgggaagcccaagttcagctgcatgaggctgcactaccgctacaaggaggccagcggctacttccacaccctgcgggctgtgatgagaaatccagaagaagatggcaaggacaccctgcagtgcatcgccgagatgctgcagatcaccaagcaggccatgggcagtgacctgcccatcatcgagaagaagctggagaggaagagcagcaagccccatgaggacatcatcggcatccgcagccagaaccagggcagcctggcccagggcaagaacttcctgatgagcaagttcagcagcctgaaccagaaggtgaagcagaccaagagcaatgtgaacatcggcaacctgaggaagctgggcaacttcaccaagccagagatgaaggtgaacttcctgaagcccaacctgaaggtgaacctgtggaagagtgacagcagcctggagaccatggagaacacaggagtgatggacaaggtgcaggccgagagtgatggagacatgagcagtgacaatgacagctaccacagtgatgagttcctgaccaacagcaagagtgatgaagatcggcagctggccaacagcctggagagcgtgggccccattgattatgtgctgcccagctgtggcatcatcgccagcgccccccggctgggcagccgcagccagagcctgagcagcacagacagctctgtgcacgcccccagcgagatcaccgtggcccacggcagcggcctgggcaagggccaggagagccccctgaagaagagccccagcgctggagatgtgcacatcctgaccggctttgccaagcccatggacatctactgccacagatttgtgcaggatgcccagaacaaggtgacccacctgtctgagaccaggtctgtgtcccagcaggccagccaggagaggaaccagatgaccaaccaggtgtccaatgagacccagagcgagagcacagagcagacccccagccggcccagccagctggatgtgtccctgagcgccaccggcccccagttcctgtctgtggagcccgcccacagcgtggccagccagaagacccccaccagcgccagctccatgctggagctggagaccggcctgcacgtgacccccagccccagcgagagcagcagcagcagagctgtgagcccctttgccaagatccgcagctccatggtgcaggtggccagcatcacccaggccggcctgacccacggcatcaactttgctgtgtccaaggtgcagaagagccccccagagcctgagatcatcaaccaggtgcagcagaatgagctgaagaagatgttcatccagtgccagacccgcatcatccagatctag

SEQ ID NO: 39336 - DNA, 1569 bp, Artificial Sequence
  Description of Artificial Sequence: Synthetic coding sequence
atgtgccatgatgtgatcttcatggcctggctgaagcagcagttctctgaatgtaccctgattgatgccacccacagagatgtggatgtgctgctgctgctgagcaacagcgcctactacgtggcctactatgatgatgaggtggacaaggtgaaccagtaccagaggctgagcctggagaacctggagaagattgaaattggccctgagcccaccctgtttgggaagcccaagttcagctgcatgaggctgcactaccgctacaaggaggccagcggctacttccacaccctgcgggctgtgatgagaaatccagaagaagatggcaaggacaccctgcagtgcatcgccgagatgctgcagatcaccaagcaggccatgggcagtgacctgcccatcatcgagaagaagctggagaggaagagcagcaagccccatgaggacatcatcggcatccgcagccagaaccagggcagcctggcccagggcaagaacttcctgatgagcaagttcagcagcctgaaccagaaggtgaagcagaccaagagcaatgtgaacatcggcaacctgaggaagctgggcaacttcaccaagccagagatgaaggtgaacttcctgaagcccaacctgaaggtgaacctgtggaagagtgacagcagcctggagaccatggagaacacaggagtgatggacaaggtgcaggccgagagtgatggagacatgagcagtgacaatgacagctaccacagtgatgagttcctgaccaacagcaagagtgatgaagatcggcagctggccaacagcctggagagcgtgggccccattgattatgtgctgcccagctgtggcatcatcgccagcgccccccggctgggcagccgcagccagagcctgagcagcacagacagctctgtgcacgcccccagcgagatcaccgtggcccacggcagcggcctgggcaagggccaggagagccccctgaagaagagccccagcgctggagatgtgcacatcctgaccggctttgccaagcccatggacatctactgccacagatttgtgcaggatgcccagaacaaggtgacccacctgtctgagaccaggtctgtgtcccagcaggccagccaggagaggaaccagatgaccaaccaggtgtccaatgagacccagagcgagagcacagagcagacccccagccggcccagccagctggatgtgtccctgagcgccaccggcccccagttcctgtctgtggagcccgcccacagcgtggccagccagaagacccccaccagcgccagctccatgctggagctggagaccggcctgcacgtgacccccagccccagcgagagcagcagcagcagagctgtgagcccctttgccaagatccgcagctccatggtgcaggtggccagcatcacccaggccggcctgacccacggcatcaactttgctgtgtccaaggtgcagaagagccccccagagcctgagatcatcaaccaggtgcagcagaatgagctgaagaagatgttcatccagtgccagacccgcatcatccagatctag

SEQ ID NO: 39337 - DNA, 372 bp, Artificial Sequence
  Description of Artificial Sequence: Synthetic coding sequence
atggagccccaggacctggagctggagctgtgcaagaagcaccacttcggcatcaacaagccagagaagatcatccccagcccagatgacagcaagttcctgctgaagaccttcacccacatcaagagcaatgtgtctgcccccaacaagaagaaggtgaaggagagcaaggagaaggagaagctggagcggcggctgctggaggagctgctgaagatgttcatggattctgagagcttctactacagcctgacctatgacctgaccaacagcgtgcagaggcagagcactggagagagagatggccggcccctgtggcagaaggtgcccctgacagcccggcgggccggctttgccctgggcaagaagtag

SEQ ID NO: 39338 - DNA, 1128 bp, Artificial Sequence
  Description of Artificial Sequence: Synthetic coding sequence
atggagctgttccaggccaaggaccactacatcctgcagcagggcgagcgggccctgtggtgcagcagaagagatggcggcctgcagctgcggcctgccacagacctgctgctggcctggaaccccatctgcctgggcctggtggagggcgtcatcggcaagatccagctgcacagcgacctgccctggtggctgatcctgatccggcagaaggccctggtgggcaagctgcccggggaccacgaggtgtgcaaggtgaccaagattgctgtgctgagcctgtctgagatggagccccaggacctggagctggagctgtgcaagaagcaccacttcggcatcaacaagccagagaagatcatccccagcccagatgacagcaagttcctgctgaagaccttcacccacatcaagagcaatgtgtctgcccccaacaagaagaaggtgaaggagagcaaggagaaggagaagctggagcggcggctgctggaggagctgctgaagatgttcatggattctgagagcttctactacagcctgacctatgacctgaccaacagcgtgcagaggcagagcactggagagagagatggccggcccctgtggcagaaggtggatgaccgcttcttctggaacaagtacatgatccaggacctgacagagatcggcaccccagatgtggacttctggatcatccccatgatccagggctttgtgcagatcgaggagctggtggtgaactacacagagagcagtgatgatgagaagagcagccctgagaccccaccccaggagagcacctgtgtggatgacatccacccccgcttcctggtggccctgatcagcagaagaagccgccacagagctggcatgagatacaagagaagaggagtggacaagaatggaaatgtggccaactacgtggagacagagcagctgattcatgtgcacaaccacaccctgagctttgtgcagacccggggctctgtgcctgtgttctggagccaggtgggctaccgctacaacccccggccccggctggacagaagtgagaaggagaccgtggcctacttctgtgcccactttgaggagcagctgaacatctacaagaagcagcagcagaagtag

SEQ ID NO: 39339 - DNA, 507 bp, Artificial Sequence
  Description of Artificial Sequence: Synthetic coding sequence
atgagcaagaggaagtggaggggcttccggggggcccagcaggagcgggcccagcccccagctgccagcccccagccctgcccagcccctcatgctggcctgcccggcggcagcagaagaagagccccagccccagctggccagcagcagatgagagctgagagccgcagcggggcccagaggcggcggggcagcgccaggagaggagcccaccgggaggccggcggctgtgtgcggggccgcaccaggagcagcggcagcgagaggagcaatgccctgtggcaggccgtggatgctgctgaggccctggccctgagcagccccctgcggcggccctgggaccaggcccagcacttcaccaacccagcccccttcagcaagggcccccagagcgccccacccagccccccagctggaagaagaagaagaggagctgacctggccctgacccccctggccggggagggccacacccgctggaggcagcccggccggcctgggaagtag

SEQ ID NO: 39340 - DNA, 3129 bp, Artificial Sequence
  Description of Artificial Sequence: Synthetic coding sequence
atggagctgcagaagggcaaaggagctgctgctgctgctgctgccagcggggctgctgggggcggcggcggcggggccggggccggggcccctgggggcggccgcctgctgctgagcaccagcctggatgccaaggatgagctggaggagcggctggagcgctgcatgagcatcgtgacctccatgacagctggggtgtctgagcgggaggccaatgatgccctgaatgcctacgtgtgcaagggcctgccccagcacgaggagatctgcctgggcctcttcaccctcatcctgacagagcccgcccaggcccagaagtgctacagagacctggccctggtgtccagagatggcatgaacatcgtgctgaacaagatcaaccagatcctgatggagaagtacctgaagctgcaggacacctgcaggacccagctggtgtggctggtgcgggagctggtgaagtctggagtgctgggcgcagatggagtgtgcatgaccttcatgaagcagattgctggaggagatgtgacagccaagaacatctggctggccgagagcgtgctggacatcctgacagagcagcgggagtgggtgctgaagagcagcatcctgattgccatggctgtgtacacctacctgcggctcatcgtggaccaccacggcacagcccagctgcaggccctgcggcagaaggaggtggacttctgcatcagcctgctgcgggagcgcttcatggagtgcctgatgattggccgggacctggtgcggctgctgcagaatgtggcccgcatccctgagtttgagctgctgtggaaggacatcatccacaacccccaggccctgagcccccagttcaccggcatcctgcagctgctgcagagcaggaccagcaggaagttcctggcctgccgcctgaccccagacatggagaccaagctgctcttcatgaccagccgggtgcgcttcggccagcagaagcgctaccaggactggttccagaggcagtacctgagcaccccagacagccagagcctgcgctgtgacctgatccgctacatctgtggggtggtgcaccccagcaatgaggtgctgagcagtgacatcctgccccgctgggccatcatcggctggctgctgaccacctgcaccagcaatgtggccgccagcaatgccaagctggccctcttctatgactggctgttcttctccccagacaaggacagcatcatgaacatcgagcccgccatcctggtgatgcaccacagcatgaagccccacccagccatcacagccaccctgctggacttcatgtgccgcatcatccccaacttctacccacccctggagggccacgtgcggcagggcgtcttcagcagcctgaaccacatcgtggagaagagggtgctggcccacctggcccccctgtttgacaaccccaagctggacaaggagctgcgggccatgctgcgggagaagtttcctgagttctgcagcagccccagcccccctgtggaggtgaagattgaggagcctgtgtccatggagatggacaaccacatgtctgacaaggatgagagctgctatgacaatgctgaggccgccttcagtgatgatgaggaggacctgaacagcaagggcaagaagcgggagttccgcttccaccccatcaaggagaccgtggtggaggagcctgtggacatcaccccctacctggaccagctggatgagagcctgcgggacaaggtgctgcagctgcagaagggcagtgacacagaggcccagtgtgaggtgatgcaggagatcgtggaccaggtgctggaggaggactttgacagcgagcagctgtctgtgctggccagctgcctgcaggagctgttcaaggcccacttccggggggaggtgctgcctgaggagatcacagaggagagcctggaggagagcgtgggcaagcccctgtacctgatcttcaggaacctgtgccagatgcaggaggacaacagcagcttcagcctgctgctggacctgctgtctgagctgtaccagaagcagcccaagattggctaccacctgctgtactacctgcgggccagcaaggctgctgctgggaagatgaacctgtatgagagctttgcccaggccacccagctgggggacctgcacacctgcctgatgatggacatgaaggcctgccaggaggatgatgtgcggctgctgtgccacctgacccccagcatctacacagagttcccagatgagaccctgcggagcggggagctgctgaacatgattgtggccgtgattgattctgcccagctgcaggagctggtgtgccacgtgatgatgggcaacctggtgatgttcaggaaggacagcgtgctgaacatcctgatccagagcctggactgggagacctttgagcagtactgtgcctggcagctgttcctggcccacaacatccccctggagaccatcatccccatcctgcagcacctgaagtacaaggagcaccctgaggccctgagctgcctgctgctgcagctgcggcgggagaagcccagcgaggagatggtgaagatggtgctgagccggccctgccacccagatgaccagttcaccaccagcatcctgcggcactggtgcatgaagcatgatgagctgctggccgagcacatcaagagcctgctgatcaagaacaacagcctgcccaggaagaggcagagcctgcggagcagcagcagcaagctggcccagctgaccctggagcagatcctggagcacctggacaacctgcggctgaacctgaccaacaccaagcagaacttcttcagccagacccccatcctgcaggccctgcagcacgtgcaggccagctgtgatgaggcccacaagatgaagttcagtgacctcttcagcctggccgaggagtatgaggacagcagcaccaagccacccaagagcaggaggaaggccgccctgagcagccccaggagcaggaagaatgccacccagcccccaaatgctgaggaggagagcggcagcagcagcgccagcgaggaggaggacaccaagcccaagcccaccaagaggaagaggaagggcagcagcgctgtgggcagtgacagcgactag

SEQ ID NO: 39341 - DNA, 1224 bp, Artificial Sequence
  Description of Artificial Sequence: Synthetic coding sequence
atggagagcgccatcaccctgtggcagttcctgctgcagctgctgctggaccagaagcatgagcacctgatctgctggaccagcaatgatggagagttcaagctgctgaaggccgaggaggtggccaagctgtggggcctgaggaagaacaagaccaacatgaactatgacaagctgagccgggccctgcgctactactatgacaagaacatcatcaagaaggtgattggccagaagtttgtgtacaagtttgtgtccttccctgagatcctgaagatggacccccatgctgtggagatcagccgggagagcctgctgctgcaggacagcgactgcaaggccagccctgagggccgggaggcccacaagcacggcctggccgccctgcggagcaccagcagaaatgagtacatccacagcggcctgtacagcagcttcaccatcaacagcctgcagaaccccccagatgccttcaaggccatcaagacagagaagctggaggagcccccagaggacagcccccctgtggaggaggtgaggacagtcatccgctttgtgaccaacaagacagacaagcacgtgaccaggcctgtggtgtccctgcccagcaccagcgaggccgctgctgccagcgccttcctggccagctctgtgtctgccaagatcagcagcctgatgctgcccaatgctgccagcatcagcagcgccagccccttcagcagccgcagccccagcctgagccccaacagccccctgcccagcgagcacaggagcctcttcctggaggccgcctgccacgacagcgacagcctggagcccctgaacctgagcagcggcagcaagaccaagagccccagcctgccccccaaggccaagaagcccaagggcctggagatcagcgccccacccctggtgctgtctggaacagacatcggcagcatcgccctgaacagccctgccctgcccagcggcagcctgaccccagccttcttcaccgcccagaccccaaatggcctgctgctgacccccagccccctgctgagcagcatccacttctggagcagcctgagccctgtggcccccctgagccctgcccggctgcagggccccagcaccctcttccagttccccaccctgctgaatggccacatgcctgtgcccatccccagcctggaccgggccgccagccctgtgctgctgagcagcaacagccagaagagctag

SEQ ID NO: 39342 - DNA, 813 bp, Artificial Sequence
  Description of Artificial Sequence: Synthetic coding sequence
atgctggagggccaggtggacagcctgtctgtgaccctgggccccctgggcctgcctgagctgatggtgtcccagcccggctgtgcctatgccatcctgctgtgcacctggaagaaggacaccggcagccccccagccagcgagggccccacagatggcagccgggagaccccagctgccagagatgtggtgctgcaccagaccagcggccgcatccacaacaagaatgtgtccacccacctgattggcaacatcaagcagggccatggaacagagagcagcggcagcggcctgtttgccctgtgcaccctggatggcaccctgaagctgatggaggagatggaggaggccgacaagctgctgtggagcgtgcaggtggaccaccagctgtttgccctggagaagctggatgtgactggaaatggacatgaggaggtggtggcctgtgcctgggatggccagacctacatcatcgaccacaacagaacagtggtgcgcttccaggtggatgagaacatccgggccttctgtgccggcctgtatgcctgcaaggagggcaggaacagcccctgcctggtgtatgtgaccttcaaccagaagatctacgtgtactgggaggtgcagctggagaggatggagagcaccaacctggtgaagctgctggagaccaagccagagtaccacagcctgctgcaggagctgggcgtggaccctgatgacctgcctgtgacccgggccctgctgcaccagaccctgtaccacccagaccagcccccccagtgtgcccccagcagcctgcaggaccccacctag

SEQ ID NO: 39343 - DNA, 1008 bp, Artificial Sequence
  Description of Artificial Sequence: Synthetic coding sequence
atgcccacctttgctggcagccaggagagccgcagccagtggatcctggagcacatcccccgggactgggatggagatggctgccgggagctggtggtgggctacacagacagagtggtgcgggccttccgctgggaggagctgggggagggccctgagcacctgaccggccagctggtgtccctgaagaagtggatgctggagggccaggtggacagcctgtctgtgaccctgggccccctgggcctgcctgagctgatggtgtcccagcccggctgtgcctatgccatcctgctgtgcacctggaagaaggacaccggcagccccccagccagcgagggccccacagatggcagccgggagaccccagctgccagagatgtggtgctgcaccagaccagcggccgcatccacaacaagaatgtgtccacccacctgattggcaacatcaagcagggccacggcacagagagcagcggcagcggcctgtttgccctgtgcaccctggatggcaccctgaagctgatggaggagatggaggaggccgacaagctgctgtggagcgtgcaggtggaccaccagctgtttgccctggagaagctggatgtgactggaaatggccacgaggaggtggtggcctgtgcctgggatggccagacctacatcatcgaccacaacagaacagtggtgcgcttccaggtggatgagaacatccgggccttctgtgccggcctgtatgcctgcaaggagggcaggaacagcccctgcctggtgtatgtgaccttcaaccagaagatctacgtgtactgggaggtgcagctggagaggatggagagcaccaacctggtgaagctgctggagaccaagccagagtaccacagcctgctgcaggagctgggcgtggaccctgatgacctgcctgtgacccgggccctgctgcaccagaccctgtaccacccagaccagcccccccagtgtgcccccagcagcctgcaggaccccacctag

SEQ ID NO: 39344 - DNA, 693 bp, Artificial Sequence
  Description of Artificial Sequence: Synthetic coding sequence
atgaagctgattgtgggcattggaggcatgaccaacggcggcaagaccaccctgaccaacagcctgctgcgggccctgcccaactgctgcgtcatccaccaggatgacttcttcaagccccaggaccagattgctgtgggggaggatggcttcaagcagtgggatgtgctggagagcctggacatggaggccatgctggacacagtgcaggcctggctgagcagcccccagaagtttgcccgggcccatggagtgtctgtgcagcctgaggccagtgacacccacatcctgctgctggagggcttcctgctgtacagctacaagcccctggtggacctgtacagccgccgctacttcctgactgtgccctatgaggagtgcaagtggaggaggagcaccaggaactacacagtgcctgaccccccaggcctgtttgatggccacgtgtggcccatgtaccagaagtaccggcaggagatggaggccaatggagtggaggtggtgtacctggatggcatgaagagccgggaggagctgttccgggaggtgctggaggacatccagaacagcctgctgaacagaagccaggagagcgcccccagccctgcccggcctgcccggacccagggccctggccggggctgcggccacaggacagcccggcctgctgccagccagcaggacagcatgtag

SEQ ID NO: 39345 - DNA, 561 bp, Artificial Sequence
  Description of Artificial Sequence: Synthetic coding sequence
atgaagctgattgtgggcattggaggcatgaccaacggcggcaagaccaccctgaccaacagcctgctgcgggccctgcccaactgctgcgtcatccaccaggatgacttcttcaagccccaggaccagattgctgtgggggaggatggcttcaagcagtgggatgtgctggagagcctggacatggaggccatgctggacacagtgcaggcctggctgagcagcccccagaagtttgcccgggcccatggagtgtctgtgcagcctgaggccagtgacacccacatcctgctgctggagggcttcctgctgtacagctacaagtaccagaagtaccggcaggagatggaggccaatggagtggaggtggtgtacctggatggcatgaagagccgggaggagctgttccgggaggtgctggaggacatccagaacagcctgctgaacagaagccaggagagcgcccccagccctgcccggcctgcccggacccagggccctggccggggctgcggccacaggacagcccggcctgctgccagccagcaggacagcatgtag

SEQ ID NO: 39346 - DNA, 1425 bp, Artificial Sequence
  Description of Artificial Sequence: Synthetic coding sequence
atgtctgaggagagtgatggcaagctgattgaggacagcctcatccagctgcgctgccacttcacctggaagctgctgattgaggcccctgagatcccagacctggagaaccgcatctgggaggagatccagttcctggacaccaagtacaacgtgggcatccacaacctgctggcctacgtgaagcacctgaagggccagaatgaggaggccctggtgtccctgaagaaggcagaagatctcatccagaaggagcacgccaaccaggccgacatccgcagcctggtgacctggggcaactttgcctgggtgtactaccacatgggccgcctggccgaggcccagacctacctggacaaggtggagaacacctgcaagaagtttgccaaccccagccgctacaggatggagtgcccagaggtggactgtgaggagggctgggccctggccaagtgtggcggcaagaactatgagcgggccaagacctgctttgagaaggccctggagggcaacccagaaaatcctgagttcaacacaggctacgccatcaccgtgtaccgcctggacaagttcaacacagccagcggcaggaacaaggccttcagcctgcacgtgctgaagagagctgtgcggctgaacccagatgatgtgtacatccgggtgctgctggccctgaagctgcaggatgagggccaggaggccgagggggagaagtacatcgaggaggccctgaccagcatcagcagccaggcctacgtgttccagtatgctgccaagttctacagaaggaagggctctgtggacaaggccctggagctgctgaagatggccctggagaccacccccaccagcgccttcctgcaccaccagatgggcctgtgctaccgggcccagatgatccagatcaaggaggccaccaactggcagccccggggccaggaccgggagaccgtggaccggctggtgcagctggccatctgcaagtttgagaagaccatcatgctgaagaggacctttgagatggcctacgtggacctggccgagacctatgcagaaattggccaccacaggaaggccgaggagcacttccagaagggcctgaggatgaagatctttgaggaccagctgaagcaggagatccactaccactacggccgcttccaggagcaccacggcaagagccaggacaaggccatcacccactacctgaagggcctgaagattgagaagatgagccacagccgggagaagctgctgaatgccctggagaagctggccaagcgctgcatccaccagaatgtgcgggtggtggagagcgtgtccctgctgggcctcatccacaagctgaagggggaggtgtctgatgccctgctgtgctatgaaagagccctgcggctggccgctgacctgaaccccatcttctag

SEQ ID NO: 39347 - DNA, 1449 bp, Artificial Sequence
  Description of Artificial Sequence: Synthetic coding sequence
atgtctgagatcaggaaggacaccctgaaggccatcctgctggagctggagtgccacttcacctggaacctgctgaaggaggacatcgacctgtttgaggtggaggacaccatcggccagcagctggagttcctgaccaccaagagccggctggccctgtacaacctgctggcctacgtgaagcacctgaagggccagaacaaggatgccctggagtgcctggagcaggccgaggagatcatccagcaggagcacagcgacaaggaggaggtgcgcagcctggtgacctggggcaactatgcctgggtgtactaccacatggaccagctggaggaggcccagaagtacacaggcaagattggaaatgtgtgcaagaagctgagcagccccagcaactacaagctggagtgcccagagacagactgtgagaagggctgggccctgctgaagtttggaggcaagtactaccagaaggccaaggccgcctttgagaaggccctggaggtggagccagacaaccctgagttcaacatcggctacgccatcaccgtgtaccgcctggatgacagcgaccgggagggctctgtgaagagcttcagcctgggccccctgaggaaggctgtgaccctgaacccagacaacagctacatcaaggtgttcctggccctgaagctgcaggatgtgcacgccgaggccgagggggagaagtacatcgaggagatcctggaccagatcagcagccagccctacgtgctgcgctatgctgccaagttctacagaaggaagaacagctggaacaaggccctggagctgctgaagaaggccctggaggtgacccccaccagcagcttcctgcaccaccagatgggcctgtgctaccgggcccagatgatccagatcaagaaggccacccacaaccggcccaagggcaaggacaagctgaaggtggatgagctgatcagcagcgccatcttccacttcaaggccgccatggagcgggacagcatgtttgcctttgcctacacagacctggccaacatgtatgcagagggcggccagtacagcaatgctgaggacatcttcaggaaggccctgcggctggagaacatcacagatgaccacaagcaccagatccactaccactacggccgcttccaggagttccacaggaagtcagaaaatacagccatccaccactacctggaggccctgaaggtgaaggacaggagccccctgcggaccaagctgaccagcgccctgaagaagctgagcaccaagaggctgtgccacaatgccctggatgtgcagagcctgagcgccctgggctttgtgtacaagctggagggggagaagaggcaggccgctgagtactatgagaaggcccagaagattgatcctgaaaatgctgagttcctgacagccctgtgtgagctgcggctgagcatctag

SEQ ID NO: 39348 - DNA, 1305 bp, Artificial Sequence
  Description of Artificial Sequence: Synthetic coding sequence
atgtctgagatcaggaaggacaccctgaaggccatcctgctggagctggagtgccacttcacctggaacctgctgaaggaggacatcgacctgtttgaggtggaggacaccatcggccagcagctggagttcctgaccaccaagagccggctggccctgtacaacctgctggcctacgtgaagcacctgaagggccagaacaaggatgccctggagtgcctggagcaggccgaggagatcatccagcaggagcacagcgacaaggaggaggtgcgcagcctggtgacctggggcaactatgcctgggtgtactaccacatggaccagctggaggaggcccagaagtacacaggcaagattggaaatgtgtgcaagaagctgagcagccccagcaactacaagctggagtgcccagagacagactgtgagaagggctgggccctgctgaagtttggaggcaagtactaccagaaggctgtgaccctgaacccagacaacagctacatcaaggtgttcctggccctgaagctgcaggatgtgcacgccgaggccgagggggagaagtacatcgaggagatcctggaccagatcagcagccagccctacgtgctgcgctatgctgccaagttctacagaaggaagaacagctggaacaaggccctggagctgctgaagaaggccctggaggtgacccccaccagcagcttcctgcaccaccagatgggcctgtgctaccgggcccagatgatccagatcaagaaggccacccacaaccggcccaagggcaaggacaagctgaaggtggatgagctgatcagcagcgccatcttccacttcaaggccgccatggagcgggacagcatgtttgcctttgcctacacagacctggccaacatgtatgcagagggcggccagtacagcaatgctgaggacatcttcaggaaggccctgcggctggagaacatcacagatgaccacaagcaccagatccactaccactacggccgcttccaggagttccacaggaagtcagaaaatacagccatccaccactacctggaggccctgaaggtgaaggacaggagccccctgcggaccaagctgaccagcgccctgaagaagctgagcaccaagaggctgtgccacaatgccctggatgtgcagagcctgagcgccctgggctttgtgtacaagctggagggggagaagaggcaggccgctgagtactatgagaaggcccagaagattgatcctgaaaatgctgagttcctgacagccctgtgtgagctgcggctgagcatctag

SEQ ID NO: 39349 - DNA, 2061 bp, Artificial Sequence
  Description of Artificial Sequence: Synthetic coding sequence
atgaagccacccttcctgctggccctggtggtgtgcagcgtggtgtccaccaacctgaagatggtgtccaagagaaattctgtggatggctgcatcgactggagcgtggacctgaagacctacatggccctggccggggagcctgtgcgggtgaagtgtgccctcttctacagctacatccgcaccaactacagcacagcccagagcacaggcctgcggctgatgtggtacaagaacaagggggacctggaggagcccatcatcttcagcgaggtgaggatgagcaaggaggaggacagcatctggttccacagcgctgaggcccaggacagcggcttctacacctgtgtgctgaggaacagcacctactgcatgaaggtgtccatgagcctgactgtggctgaaaatgaaagtggcctgtgctacaacagccgcatccgctacctggagaagtctgaggtgaccaagaggaaggagatcagctgcccagacatggatgacttcaagaagagtgaccaggagccagatgtggtgtggtacaaggagtgcaagcccaagatgtggaggagcatcatcatccagaagggaaatgccctgctgatccaggaggtgcaggaggaggatggcggcaactacacctgtgagctgaagtatgagggcaagctggtgcggaggaccacagagctgaaggtgacagccctgctgacagacaagccacccaagcccctcttccccatggagaaccagcccagcgtgattgatgtgcagctgggcaagcccctgaacatcccctgcaaggccttcttcggcttcagcggggagagcggccccatgatctactggatgaagggggagaagttcatcgaggagctggccggccacatccgggagggggagatccggctgctgaaggagcacctgggggagaaggaggtggagctggccctgatctttgacagcgtggtggaggccgacctggccaactacacctgccacgtggagaacagaaatggaaggaagcacgcctctgtgctgctgaggaagaaggacctgatctacaagattgagctggccggcggcctgggcgccatcttcctgctgctggtgctgctggtggtgatctacaagtgctacaacatcgagctgatgctgttctaccggcagcactttggagcagatgagaccaatgatgacaacaaggagtatgatgcctacctgagctacaccaaggtggaccaggacaccctggactgtgacaaccctgaggaggagcagtttgccctggaggtgctgcctgatgtgctggagaagcactacggctacaagctgttcatccctgagcgggacctgatccccagcggcacctacatggaggacctgaccaggtatgtggagcagagccggcggctcatcatcgtgctgaccccagactacatcctgcggcggggctggagcatctttgagctggagagccggctgcacaacatgctggtgtctggagagatcaaggtgatcctgattgagtgcacagagctgaagggcaaggtgaactgccaggaggtggagagcctgaagaggagcatcaagctgctgagcctcatcaagtggaagggcagcaagagcagcaagctgaacagcaagttctggaagcacctggtgtatgagatgcccatcaagaagaaggagatgctgccccgctgccacgtgctggacagcgctgagcagggcctgtttggagagctgcagcccatccccagcatcgccatgaccagcaccagcgccaccctggtgagcagccaggccgacctgcctgagttccaccccagcgacagcatgcagatccgccactgctgccggggctacaagcatgagatcccagccaccaccctgcctgtgcccagcctgggcaaccaccacacctactgcaacctgcccctgaccctgctgaatggccagctgcccctgaacaacaccctgaaggacacccaggagttccacaggaacagcagcctgctgcccctgagcagcaaggagctgtccttcaccagtgacatctggtag

SEQ ID NO: 39350 - DNA, 1143 bp, Artificial Sequence
  Description of Artificial Sequence: Synthetic coding sequence
atggcctttgtgtgcctggccatcggctgcctgtacaccttcctgatcagcaccaccttcggctgcaccagcagcagtgacacagagatcaaggtgaaccccccccaggactttgagatcgtggaccccggctacctgggctacctgtacctgcagtggcagccccccctgagcctggaccacttcaaggagtgcaccgtggagtatgagctgaagtacagaaacatcggcagcgagacctggaagaccatcatcaccaagaacctgcactacaaggatggctttgacctgaacaagggcatcgaggccaagatccacaccctgctgccctggcagtgcaccaatggaagtgaggtgcagagctcctgggccgagaccacctactggatcagcccccagggcatccctgagaccaaggtgcaggacatggactgtgtgtactacaactggcagtacctgctgtgctcctggaagccaggcattggagtgctgctggacaccaactacaacctcttctactggtatgagggcctggaccacgccctgcagtgtgtggactacatcaaggcagatggccagaacatcggctgccgcttcccctacctggaggccagtgactacaaggacttctacatctgtgtgaatggcagcagcgagaacaagcccatccgcagcagctacttcaccttccagctgcagaacatcgtgaagcccctgccccctgtgtacctgaccttcacccgggagagcagctgtgagatcaagctgaagtggagcatccccctgggccccatcccagcccgctgctttgattatgaaattgagatccgggaggatgacaccaccctggtgacagccaccgtggagaatgagacctacaccctgaagaccaccaatgagacccggcagctgtgctttgtggtgcgcagcaaggtgaacatctactgcagtgatgatggcatctggagcgagtggagcgacaagcagtgctgggagggggaggacctgagcaagaagaccctgctgcgcttctggctgcccttcggcttcatcctgatcctggtgatctttgtgacaggcctgctgctgaggaagcccaacacctaccccaagatgatccctgagttcttctgtgacacctag

SEQ ID NO: 39351 - DNA, 1011 bp, Artificial Sequence
  Description of Artificial Sequence: Synthetic coding sequence
atgagccgctctgtgctggaggccctgaccagcagcacagccatgcagtgtgtgcccagtgatggctgtgccatgctgctgcgggtgcgggccagcatcaccctgcacgagcggctgcggggcctggaggcctgtgccatgagcctggacacccaggagacccagtgccagagcgtgtgggtggcccgggccagccaccggcagcagggcggccagcagctgcaggtgcacttcggctgctttgctgtgtctgtggcccagcacctgtatgtgaccctgcggaccatcccccacttctgtggggtgcagctggaccagaggcacctggtggaggccggcaagctgagctactgggtggacagaagaaggaaggccatcctggtgcaggtgccccgggccagcggcagcccagactactacctgcggctgtgcctgaagcgcttcacctgtgaagatgctggggcccctgtgcgggtgacagccaacagcgtgtcccaggccgtgttcctgccctacagccaggagctgccctgcctgtgcctggagggctggagcgccaccccagatgctgtgcgcatccagatctgcccctttgaaaatgacacagaggccctggaggtgctgtgggacacagtgtactaccaccctgagagccagaccctgtcctgggagcccgcctgccctgtgtctggccacgtgtccctgtgctggaggcctggccctggagctggctgcaggaagctgcagcagagcagccagctggtgcacagaagagtgcagtaccccctggtggacacccagccccagctgtgcctgaagttcagcacctcctggggctcctgggtgcgctgcccctttgagcagaggcgcttccccaccccacccaccagccgctgcacctgtgtgactggaggcagccacagcagcctgcctgccaatgcccacagcaggcctgcccggagcctgcagccccaggtgacctggcagccccccctgctgctgcccagctag

SEQ ID NO: 39352 - DNA, 1011 bp, Artificial Sequence; identical to SEQ ID NO: 39351
  Description of Artificial Sequence: Synthetic coding sequence

SEQ ID NO: 39353 - DNA, 471 bp, Artificial Sequence
  Description of Artificial Sequence: Synthetic coding sequence
atgagaggaggcggcggcgtgcccctcatccacttcagcctgcctgtgtgcagccccttcctgtacctgagcctgcctgagccccaggccaagcaccagaggcggcccggcagcgagcagggcgcccacgtggcctctgtggaccaccccccagcctgcacagccctgggcggccccagaaatgcccggcccagcgctgggggcagcctcttcaccagcctgcagcccagcgaggacaccagcgagtggggcgctgagccagcagatggagagaacaagaatgatgacaccctgtacaccccagatgacctgagcatccctggccactttgtgcccaccgtgtgcccagctgagaccctgggctgcagccggctggagctgagcgtcatcggctttgaggagggccccagcatgggcacagctgtgttccagctgcagtacctgctggacctgctgggcagccggctgtag

SEQ ID NO: 39354 - DNA, 1386 bp, Artificial Sequence
  Description of Artificial Sequence: Synthetic coding sequence
atggccctggccttcggctgccccccaggcggcggcggcggcggctgccctgggggcggcggcggcggcggcggggccggccctggccccagccctgtgacagctgccctgagagatgacctgggcagcaacatccacctgctgaagggcctgaatgtgcgcttccgctgcttcctggccaaggtgcatgagctggagaggaggaaccggctgctggagaagcagctggagcagcagcagagcgagcgggagcggcggctgcgctacaagaccttcagccgggagcaggccgtgcagacaggccctgagctgctgcggcccccagcccctgggggcggccacggcctgagcagcggggctgctgctggggccaatgccaatgctgtggccctgggcggcctgcccccaggcggcggcagccacccccagcactacggccgcctgcccggcaccatctggagctacacccaggtgagaagaactggaggcggcggcgtggagaccgtgcagggccctggggtgtcctgggtgcacccagatggagtgggcgtgcagattgacaccatcaccccagagatccgggccctgtacaacgtgctggccaaggtgaagcgggagagagatgagtacaagaggcgctgggaggaggagctggccaagaggatgaacctgcagaccatggtggacaccctgcaggaggccgcccaggaggctgatgccatccaggaggagatgaatgagaagattgagcggctgaaggccgagctggtggtgttcaagggcctgatgtctgatgtggtgcccaagaagaaggagaggaaggtggccagtgatgatgacatcagcgagcaggatggagaggtgaaccgcttcagtgatgatgaggtgggctccatgaacatcacagatgagatgaagaggatgttcaaccagctgcgggagacctttgattttgatgatgactgtgacagcctgacctgggaggagaatgaagacaccctgctgctgtgggaggacttcaccaactgcaaccccaccatcgacctgcagggcgagcaggaggagaacctgggcaacctgatccacgagacagagagcttcttcaagacccgggacaaggagtaccaggagaccatcggccagatcgagctggagctggccacagccaagagtgacatgaacagacacctgcacgagtacatggagatgtgcagcatgaagaggggcctggatgtgcagatggagacctgccggcggctcatcaagggcagcgctgacaggaacagccccagccccagctctgtggccagcagtgacagcggcagcacagatgagatccaggatgaatttgagcgggaggctgatgtggagcccatggtgtcctag

SEQ ID NO: 39355 - DNA, 1554 bp, Artificial Sequence
  Description of Artificial Sequence: Synthetic coding sequence
atggtgaacagcctgctgtttggagagatggccctggccttcggctgccccccaggcggcggcggcggcggctgccctgggggcggcggcggcggcggcggggccggccctggccccagccctgtgacagctgccctgagagatgacctgggcagcaacatccacctgctgaagggcctgaatgtgcgcttccgctgcttcctggccaaggtgcatgagctggagaggaggaaccggctgctggagaagcagctggagcagcagcagagcgagcgggagcggcggctgcgctacaagaccttcagccgggagcaggccgtgcagacaggccctgagctgctgcggcccccagcccctgggggcggccacggcctgagcagtggagctgctgctggggccaatgccaatgctgtggccctgggcggcctgcccccaggcggcggcagccacccccagcactacggccgcctgcccggcaccatctggagctacacccaggtgcggaggactggaggcggcggcgtggagaccgtgcagggccctggggtgtcctgggtgcacccagatggagtgggcgtgcagattgacaccatcaccccagagatccgggccctgtacaacgtgctggccaaggtgaagcgggagagagatgagtacaagaggcgctgggaggaggagctggccaagaggatgaacctgcagaccatggtggacaccctgcaggaggccgcccaggaggctgatgccatccaggaggagatgaatgagaagattgaaaggctgaaggccgagctggtggtgttcaagggcctgatgtctgaccccatgacagacctggacaccaagatccaggagaaggccatgaaggtggacatggacatctgcagaagaattgacatcacagccaagctgtgtgatgtggcccagcagagaaattctgaagatgtgtccaagatcttccaggtggtgcccaagaagaaggagaggaaggtggccagtgatgatgacatcagcgagcaggatggagaggtgaaccgcttcagtgatgatgaggtgggctccatgaacatcacagatgagatgaagaggatgttcaaccagctgcgggagacctttgattttgatgatgactgtgacagcctgacctgggaggagaatgaagacaccctgctgctgtgggaggacttcaccaactgcaaccccaccatcgacctgcagggcgagcaggaggagaacctgggcaacctgatccacgagacagagagcttcttcaagacccgggacaaggagtaccaggagaccatcggccagatcgagctggagctggccacagccaagagtgacatgaacagacacctgcacgagtacatggagatgtgcagcatgaagaggggcctggatgtgcagatggagacctgccggcggctcatcaagggcagcgctgacaggaacagccccagccccagctctgtggccagcagtgacagcggcagcacagatgagatccaggatgaatttgagcgggaggctgatgtggagcccatggtgtcctag

SEQ ID NO: 39356 - DNA, 1971 bp, Artificial Sequence
  Description of Artificial Sequence: Synthetic coding sequence
atggccaggatgtgtgtgaagacccagaggctggatgtggccaaggtgtgcctgggcaacatgggccacgcccggggggcccgggccctgcgggaggccgagcaggagcctgagctggaggcccgggtggccgtgctggccacccagctgggcatgctggaggatgctgagcagctgtacaggaagtgcaagagacatgacctgctgaacaagttctaccaggccgccggccgctggcaggaggccctgcaggtggccgagcaccacgacagagtgcacctgcggagcacctaccacagatatgccggccacctggaggccagcgctgactgcagccgggccctgagctactatgagaagagtgacacccacagatttgaggtgcccaggatgctgtctgaggacctgcccagcctggagctgtatgtgaacaagatgaaggacaagaccctgtggcgctggtgggcccagtacctggagagccagggcgagatggatgctgccctgcactactatgagctggcccgggaccacttcagcctggtgcgcatccactgcttccagggcaatgtgcagaaggccgcccagatcgccaatgaaacaggcaacctggccgccagctaccacctggcccggcagtatgagagccaggaggaggtgggccaggccgtgcacttctacacccgggcccaggccttcaagaatgccatccggctgtgcaaggaaaatggcctggatgaccagctgatgaacctggccctgctgagcagccctgaggacatgattgaggccgcccgctactatgaggagaagggcgtgcagatggacagagctgtgatgctgtaccacaaggccggccacttcagcaaggccctggagctggcctttgccacccagcagtttgtggccctgcagctgattgctgaggacctggatgagaccagtgaccctgccctgctggcccgctgcagcgacttcttcatcgagcacagccagtatgaaagagctgtggagctgctgctggccgccaggaagtaccaggaggccctgcagctgtgcctgggccagaacatgagcatcacagaggagatggccgagaagatgacagtggccaaggacagcagtgacctgcctgaggagagccggcgggagctgctggagcagattgctgactgctgcatgaggcagggcagctaccacctggccaccaagaagtacacccaggccggcaacaagctgaaggccatgagggccctgctgaagagcggggacacagagaagatcaccttctttgcctctgtgtcccggcagaaggagatctacatcatggccgccaactacctgcagagcctggactggaggaaggagcctgagatcatgaagaacatcatcggcttctacaccaagggccgggccctggacctgctggccggcttctatgatgcctgtgcccaggtggagattgatgagtaccagaactatgacaaggcccacggggccctgacagaggcctacaagtgcctggccaaggccaaggccaagagccccctggaccaggagacccggctggcccagctgcagagcaggatggccctggtgaagcgcttcatccaggcccggaggacctacacagaggaccccaaggagagcatcaagcagtgtgagctgctgctggaggagccagacctggacagcaccatcagaattggagatgtgtatggcttcctggtggagcactacgtgaggaaggaggagtaccagacagcctaccgcttcctggaggagatgagaagaaggctgcccctggccaacatgagctactacgtgagcccccaggccgtggatgctgtgcaccggggcctgggcctgcccctgcccaggacagtgcctgagcaggtgcgccacaacagcatggaggatgcccgggagctggatgaggaggtggtggaggaggctgatgatgacccctag

SEQ ID NO: 39357 - DNA, 4389 bp, Artificial Sequence
  Description of Artificial Sequence: Synthetic coding sequence
atggccctgtactatgaccaccagatcgaggccccagatgctgctggcagccccagcttcatctcctggcaccctgtgcaccccttcctggccgtggcctacatcagcaccaccagcacaggctctgtggacatctacctggagcagggagaatgtgtgcctgacacccacgtggagcggcccttccgggtggccagcctgtgctggcaccccacccggctggtgctggccgtgggctgggagaccggggaggtgaccgtcttcaacaagcaggacaaggagcagcacaccatgcccctgacccacacagctgacatcaccgtgctgcgctggagccccagcggcaactgcctgctgagcggggaccggctgggcgtgctgctgctgtggaggctggaccagaggggccgggtgcagggcacccccctgctgaagcatgaatatggcaagcacctgacccactgcatcttccggctgcccccacctggagaggacctggtgcagctggccaaggctgctgtgtctggagatgagaaggccctggacatgttcaactggaagaagagcagcagcggcagcctgctgaagatgggcagccatgagggcctgctcttctttgtgtccctgatggatggcaccgtgcactacgtggatgagaagggcaagaccacccaggtggtgtctgctgacagcaccatccagatgctgttctacatggagaagcgggaggccctggtggtggtgacagagaacctgcggctgagcctgtacacagtgcccccagagggcaaggccgaggaggtgatgaaggtgaagctgagcggcaagacaggaagaagagctgacatcgccctgattgagggcagcctgctggtgatggctgtgggggaggccgccctgcgcttctgggacatcgagagaggagagaactacatcctgagcccagatgagaagtttggatttgagaagggggagaacatgaactgtgtgtgctactgcaaggtgaagggcctgctggccgccggcacagaccggggccgggtggccatgtggaggaaggtgcctgacttcctgggcagccctggagctgagggcaaggaccgctgggccctgcagacccccacagagctgcagggcaacatcacccagatccagtggggcagcaggaagaacctgctggccgtgaacagcgtcatctctgtggccatcctgtctgagcgggccatgagcagccacttccaccagcaggtggccgccatgcaggtgagccccagcctgctgaatgtgtgcttcctgagcactggagtggcccacagcctgaggacagacatgcacatctctggagtgtttgccaccaaggatgctgtggccgtgtggaatggccggcaggtggccatctttgagctgagcggggccgccatccgctctgctggcaccttcctgtgtgagacccctgtgctggccatgcatgaggagaatgtgtacacagtggagagcaacagagtgcaggtgaggacctggcagggcaccgtgaagcagctgctgctcttcagcgagacagagggcaacccctgcttcctggacatctgtggcaacttcctggtggtgggcacagacctggcccacttcaagagctttgacctgagccggcgggaggccaaggcccactgcagctgccgcagcctggccgagctggtgcctggggtgggcggcatcgccagcctgcgctgcagcagcagcggcagcaccatcagcatcctgcccagcaaggctgacaacagcccagacagcaagatctgcttctatgatgtggagatggacacagtgacagtgtttgacttcaagacaggccagattgacagaagagagaccctgtccttcaatgagcaggagaccaacaagagccacctgtttgtggatgagggcctgaagaactacgtgcctgtgaaccacttctgggaccagagcgagccccggctgtttgtgtgtgaggccgtgcaggagacccccaggagccagccccagagcgccaacggccagccccaggacggccgggccggccctgctgctgatgtgctgatcctgtccttcttcatcagcgaggagcacggcttcctgctgcacgagagcttccccaggcctgccaccagccacagcctgctgggcatggaggtgccctactactacttcaccaggaagccagaggaggccgaccgggaggatgaggtggagcccggctgccaccacatcccccagatggtgtcccggcggcccctgcgggactttgtgggcctggaggactgtgacaaggccaccagagatgccatgctgcacttctccttctttgtgaccatcggggacatggatgaggccttcaagagcatcaagctgatcaagtctgaggccgtgtgggagaacatggccaggatgtgtgtgaagacccagaggctggatgtggccaaggtgtgcctgggcaacatgggccacgcccggggggcccgggccctgcgggaggccgagcaggagcctgagctggaggcccgggtggccgtgctggccacccagctgggcatgctggaggatgctgagcagctgtacaggaagtgcaagagacatgacctgctgaacaagttctaccaggccgccggccgctggcaggaggccctgcaggtggccgagcaccacgacagagtgcacctgcggagcacctaccacagatatgccggccacctggaggccagcgctgactgcagccgggccctgagctactatgagaagagtgacacccacagatttgaggtgcccaggatgctgtctgaggacctgcccagcctggagctgtatgtgaacaagatgaaggacaagaccctgtggcgctggtgggcccagtacctggagagccagggcgagatggatgctgccctgcactactatgagctggcccgggaccacttcagcctggtgcgcatccactgcttccagggcaatgtgcagaaggccgcccagatcgccaatgaaacaggcaacctggccgccagctaccacctggcccggcagtatgagagccaggaggaggtgggccaggccgtgcacttctacacccgggcccaggccttcaagaatgccatccggctgtgcaaggaaaatggcctggatgaccagctgatgaacctggccctgctgagcagccctgaggacatgattgaggccgcccgctactatgaggagaagggcgtgcagatggacagagctgtgatgctgtaccacaaggccggccacttcagcaaggccctggagctggcctttgccacccagcagtttgtggccctgcagctgattgctgaggacctggatgagaccagtgaccctgccctgctggcccgctgcagcgacttcttcatcgagcacagccagtatgaaagagctgtggagctgctgctggccgccaggaagtaccaggaggccctgcagctgtgcctgggccagaacatgagcatcacagaggagatggccgagaagatgacagtggccaaggacagcagtgacctgcctgaggagagccggcgggagctgctggagcagattgctgactgctgcatgaggcagggcagctaccacctggccaccaagaagtacacccaggccggcaacaagctgaaggccatgagggccctgctgaagagcggggacacagagaagatcaccttctttgcctctgtgtcccggcagaaggagatctacatcatggccgccaactacctgcagagcctggactggaggaaggagcctgagatcatgaagaacatcatcggcttctacaccaagggccgggccctggacctgctggccggcttctatgatgcctgtgcccaggtggagattgatgagtaccagaactatgacaaggcccacggggccctgacagaggcctacaagtgcctggccaaggccaaggccaagagccccctggaccaggagacccggctggcccagctgcagagcaggatggccctggtgaagcgcttcatccaggcccggaggacctacacagaggaccccaaggagagcatcaagcagtgtgagctgctgctggaggagccagacctggacagcaccatcagaattggagatgtgtatggcttcctggtggagcactacgtgaggaaggaggagtaccagacagcctaccgcttcctggaggagatgagaagaaggctgcccctggccaacatgagctactacgtgagcccccaggccgtggatgctgtgcaccggggcctgggcctgcccctgcccaggacagtgcctgagcaggtgcgccacaacagcatggaggatgcccgggagctggatgaggaggtggtggaggaggctgatgatgacccctag

SEQ ID NO: 39358 - DNA, 4389 bp, Artificial Sequence; identical to SEQ ID NO: 39357
  Description of Artificial Sequence: Synthetic coding sequence

SEQ ID NO: 39359 - DNA, 2406 bp, Artificial Sequence
  Description of Artificial Sequence: Synthetic coding sequence
atggccctgtactatgaccaccagatcgaggccccagatgctgctggcagccccagcttcatctcctggcaccctgtgcaccccttcctggccgtggcctacatcagcaccaccagcacaggctctgtggacatctacctggagcagggagaatgtgtgcctgacacccacgtggagcggcccttccgggtggccagcctgtgctggcaccccacccggctggtgctggccgtgggctgggagaccggggaggtgaccgtcttcaacaagcaggacaaggagcagcacaccatgcccctgacccacacagctgacatcaccgtgctgcgctggagccccagcggcaactgcctgctgagcggggaccggctgggcgtgctgctgctgtggaggctggaccagaggggccgggtgcagggcacccccctgctgaagcatgaatatggcaagcacctgacccactgcatcttccggctgcccccacctggagaggacctggtgcagctggccaaggctgctgtgtctggagatgagaaggccctggacatgttcaactggaagaagagcagcagcggcagcctgctgaagatgggcagccatgagggcctgctcttctttgtgtccctgatggatggcaccgtgcactacgtggatgagaagggcaagaccacccaggtggtgtctgctgacagcaccatccagatgctgttctacatggagaagcgggaggccctggtggtggtgacagagaacctgcggctgagcctgtacacagtgcccccagagggcaaggccgaggaggtgatgaaggtgaagctgagcggcaagacaggaagaagagctgacatcgccctgattgagggcagcctgctggtgatggctgtgggggaggccgccctgcgcttctgggacatcgagagaggagagaactacatcctgagcccagatgagaagtttggatttgagaagggggagaacatgaactgtgtgtgctactgcaaggtgaagggcctgctggccgccggcacagaccggggccgggtggccatgtggaggaaggtgcctgacttcctgggcagccctggagctgagggcaaggaccgctgggccctgcagacccccacagagctgcagggcaacatcacccagatccagtggggcagcaggaagaacctgctggccgtgaacagcgtcatctctgtggccatcctgtctgagcgggccatgagcagccacttccaccagcaggtggccgccatgcaggtgagccccagcctgctgaatgtgtgcttcctgagcactggagtggcccacagcctgaggacagacatgcacatctctggagtgtttgccaccaaggatgctgtggccgtgtggaatggccggcaggtggccatctttgagctgagcggggccgccatccgctctgctggcaccttcctgtgtgagacccctgtgctggccatgcatgaggagaatgtgtacacagtggagagcaacagagtgcaggtgaggacctggcagggcaccgtgaagcagctgctgctcttcagcgagacagagggcaacccctgcttcctggacatctgtggcaacttcctggtggtgggcacagacctggcccacttcaagagctttgacctgagccggcgggaggccaaggcccactgcagctgccgcagcctggccgagctggtgcctggggtgggcggcatcgccagcctgcgctgcagcagcagcggcagcaccatcagcatcctgcccagcaaggctgacaacagcccagacagcaagatctgcttctatgatgtggagatggacacagtgacagtgtttgacttcaagacaggccagattgacagaagagagaccctgtccttcaatgagcaggagaccaacaagagccacctgtttgtggatgagggcctgaagaactacgtgcctgtgaaccacttctgggaccagagcgagccccggctgtttgtgtgtgaggccgtgcaggagacccccaggagccagccccagagcgccaacggccagccccaggacggccgggccggccctgctgctgatgtgctgatcctgtccttcttcatcagcgaggagcacggcttcctgctgcacgagagcttccccaggcctgccaccagccacagcctgctgggcatggaggtgccctactactacttcaccaggaagccagaggaggccgaccgggaggatgaggtggagcccggctgccaccacatcccccagatggtgtcccggcggcccctgcgggactttgtgggcctggaggactgtgacaaggccaccagagatgccatgctgcacttctccttctttgtgaccatcggggacatggatgaggccttcaagagcatcaagctgatcaagagggcctag

SEQ ID NO: 39360 - DNA, 399 bp, Artificial Sequence
  Description of Artificial Sequence: Synthetic coding sequence
atggccaaggacatcctgggggaggccggcctgcactttgatgagctgaacaagctgcgggtgctggaccctgaggtgacccagcagaccatcgagctgaaggaggagtgcaaggactttgtggacaagattggccagttccagaagatcgtgggcggcctgattgagctggtggaccagctggccaaggaggccgagaatgagaagatgaaggccatcggggccaggaacctgctgaagagcatcgccaagcagcgggaggcccagcagcagcagctgcaggccctgattgctgagaagaagatgcagctggagcgctacagagtggagtatgaggccctgtgcaaggtggaggccgagcagaatgagttcatcgaccagttcatcttccagaagtag

SEQ ID NO: 39361 - DNA, 477 bp, Artificial Sequence
  Description of Artificial Sequence: Synthetic coding sequence
atgacccacctgctgctgacagccaccgtgaccccatctgagcagaacagcagccgggagcccggctgggagacagccatggccaaggacatcctgggggaggccggcctgcactttgatgagctgaacaagctgcgggtgctggaccctgaggtgacccagcagaccatcgagctgaaggaggagtgcaaggactttgtggacaagattggccagttccagaagatcgtgggcggcctgattgagctggtggaccagctggccaaggaggccgagaatgagaagatgaaggccatcggggccaggaacctgctgaagagcatcgccaagcagcgggaggcccagcagcagcagctgcaggccctgattgctgagaagaagatgcagctggagcgctacagagtggagtatgaggccctgtgcaaggtggaggccgagcagaatgagttcatcgaccagttcatcttccagaagtag

SEQ ID NO: 39362 - DNA, 345 bp, Artificial Sequence
  Description of Artificial Sequence: Synthetic coding sequence
atggccaaggacatcctgggggaggccggcctgcactttgatgagctgaacaagctgcgggtgctggaccctgaggtgacccagcagaccatcgagctgaaggaggagtgcaaggactttgtggacaagattggccagttccagaagatcgtgggcggcctgattgagctggtggaccagctggccaaggaggccgagaatgagaagatgaaggccatcggggccaggaacctgctgaagagcatcgccaagcagcgggaggcccagcagcagcagctgcaggccctgattgctgagaagaagatgcagctggagagaaatgagctgaagatcagcctgctgtag

SEQ ID NO: 39363 - DNA, 399 bp, Artificial Sequence; identical to SEQ ID NO: 39360
  Description of Artificial Sequence: Synthetic coding sequence

SEQ ID NO: 39364 - DNA, 216 bp, Artificial Sequence
  Description of Artificial Sequence: Synthetic coding sequence
gacatcctgggggaggccggcctgcactttgatgagctgaacaagctgcgggtgctggaccctgaggtgacccagcagaccatcgagctgaaggaggagtgcaaggactttgtggacaagattggccagttccagaagatcgtgggcggcctcatcgagctggtggaccagctggccaaggaggctgaaaatgagaagatgaaggtgtctggatag

SEQ ID NO: 39365 - DNA, 558 bp, Artificial Sequence
  Description of Artificial Sequence: Synthetic coding sequence
atggtgaagctggccgccaagtgcatcctggccgaccctgctgtgggcaagacagccctggcccagatcttcagaagtgatggagcccacttccagaagagctacaccctgaccaccggcatggacctggtggtgaagacagtgcctgtgcctgacacaggagacagcgtggagctgttcatctttgacagcgctgggaaggagctgttcagcgagatgctggacaagctgtgggagagccccaacgtgctgtgcctggtgtatgatgtgaccaatgaggagagcttcaacaactgcagcaagtggctggagaaggcccggagccaggcccctggcatcagcctgcccggggtgctggtgggcaacaagacagacctggccggcagaagagctgtggacagcgctgaggcccgggcctgggccctgggccagggcctggagtgctttgagacctctgtgaaggagatggagaactttgaggcccccttccactgcctggccaagcagttccaccagctgtaccgggagaaggtggaggtgttccgggccctggcctag

SEQ ID NO: 39366 - DNA, 390 bp, Artificial Sequence
  Description of Artificial Sequence: Synthetic coding sequence
tgaagtgatggagcccacttccagaagagctacaccctgaccaccggcatggacctggtggtgaagacagtgcctgtgcctgacacaggagacagcgtggagctgttcatctttgacagcgctgggaaggagctgttcagcgagatgctggacaagctgtgggagagccccaacgtgctgtgcctggtgtatgatgtgaccaatgaggagagcttcaacaactgcagcaagtggctggagaaggcccggagccaggcccctggcatcagcctgcccggggtgctggtgggcaacaagacagacctggccggcagaagagctgtggacagcgctgaggcccgggcctgggccctgggccagggcctggagtgctttgagacctctgtgtag

SEQ ID NO: 39367 - DNA, 552 bp, Artificial Sequence
  Description of Artificial Sequence: Synthetic coding sequence
atggtgaagctggccgccaagtgcatcctggccgtgcctgtggacaagaggctgagcagagctgaggtgtgcagcggctgctgtgaggtgtgccgctctgtgtcctggacctgtgccctgcctgctgccagcgagcaggtgcctgtgcggggggaccctgctgtgggcaagacagccctggcccagatcttcagaagtgatggagcccacttccagaagagctacaccctgaccaccggcatggacctggtggtgaagacagtgcctgtgcctgacacaggagacagcgtggagctgttcatctttgacagcgctgggaaggagctgttcagcgagatgctggacaagctgtgggagagccccaacgtgctgtgcctggtgtatgatgtgaccaatgaggagagcttcaacaactgcagcaagtggctggagaaggcccggagccaggcccctggcatcagcctgcccggggtgctggtgggcaacaagacagacctggccggcagaagagctgtggacagcgctgaggcccgggcctgggccctgggctag

SEQ ID NO: 39368 - DNA, 351 bp, Artificial Sequence
  Description of Artificial Sequence: Synthetic coding sequence
atggtgaagctggccgccaagtgcatcctggccgaccctgctgtgggcaagacagccctggcccagatcttcagaagtgatggagcccacttccagaagagctacaccctgaccaccggcatggacctggtggtgaagacagtgcctgtgcctgacacaggagacagcgtggagctgttcatctttgacagcgctgggaaggagctgttcagcgagatgctggacaagctgtgggagagccccaacgtgctgtgcctggtgtatgatgtgaccaatgaggagagcttcaacaactgcagcaagtggctggagaaggcccggagccaggcccctggcatcagcctgccctag

SEQ ID NO: 39369 - DNA, 561 bp, Artificial Sequence
  Description of Artificial Sequence: Synthetic coding sequence
atggtgaagctggccgccaagtgcatcctggccggggaccctgctgtgggcaagacagccctggcccagatcttcagaagtgatggagcccacttccagaagagctacaccctgaccaccggcatggacctggtggtgaagacagtgcctgtgcctgacaccggggacagcgtggagctgttcatctttgattctgctgggaaggagctgttcagcgagatgctggacaagctgtgggagagccccaacgtgctgtgcctggtgtatgatgtgaccaatgaggagagcttcaacaactgcagcaagtggctggagaaggcccggagccaggcccctggcatcagcctgcccggggtgctggtgggcaacaagacagacctggccggccggcgggctgtggacagcgctgaggcccgggcctgggccctgggccagggcctggagtgctttgagacctctgtgaaggagatggagaactttgaggcccccttccactgcctggccaagcagttccaccagctgtaccgggagaaggtggaggtgttccgggccctggcctag

SEQ ID NO: 39370 - DNA, 156 bp, Artificial Sequence
  Description of Artificial Sequence: Synthetic coding sequence
atggacctggtggtgaagacagtgcctgtgcctgacacaggagacagcgtggagctgttcatctttgacagcgctgggaaggagctgttcagcgagatgctggacaagctgtgggagagccccaacgtgctgtgcctggtgtatgatgtgacctag

SEQ ID NO: 39371 - DNA, 438 bp, Artificial Sequence
  Description of Artificial Sequence: Synthetic coding sequence
atggacctggtggtgaagacagtgcctgtgcctgacacaggagacagcgtggagctgttcatctttgacagcgctgggaaggagctgttcagcgagatgctggacaagctgtgggagagccccaacgtgctgtgcctggtgtatgatgtgaccaatgaggagagcttcaacaactgcagcaagtggctggagaaggcccggagccaggcccctggcatcagcctgcccggggtgctggtgggcaacaagacagacctggccggcagaagagctgtggacagcgctgaggcccgggcctgggccctgggccagggcctggagtgctttgagacctctgtgaaggagatggagaactttgaggcccccttccactgcctggccaagcagttccaccagctgtaccgggagaaggtggaggtgttccgggccctggcctag

SEQ ID NO: 39372 - DNA, 1314 bp, Artificial Sequence
  Description of Artificial Sequence: Synthetic coding sequence
atggagaaggagctgcggagcaccatcctcttcaatgcctacaagaaggagatcttcaccaccaacaacggctacaagtccatgcagaagaagctgcggagcaactggaagatccagagcctgaaggatgagatcaccagcgagaagctgaatggagtgaagctgtggatcacagctggcccccgggagaagttcaccgctgctgagtttgagatcctgaagaagtacctggacacaggaggagatgtgtttgtgatgctgggggagggcggggagagcagatttgacaccaacatcaacttcctgctggaggagtatggcatcatggtgaacaatgatgctgtggtgagaaatgtgtaccacaagtacttccaccccaaggaggccctggtgtcctctggagtgctgaaccgggagatcagcagagctgctgggaaggctgtgcccggcatcattgatgaggagagcagcggcaacaatgcccaggccctgacctttgtgtacccctttggagccaccctgtctgtgatgaagccagctgtggccgtgctgagcacaggctctgtgtgcttccccctgaaccggcccatcctggccttctaccacagcaagaaccagggcggcaagctggccgtgctgggcagctgccacatgttcagtgaccagtacctggacaaggaggagaacagcaagatcatggatgtggtgttccagtggctgaccaccggggacatccacctgaaccagattgatgctgaagatcctgagatcagtgactacatgatgctgccctacacagccaccctgagcaagaggaacagagaatgtctgcaggagagtgatgagatcccccgggacttcaccaccctgtttgacctgagcatcttccagctggacaccaccagcttccacagcgtgattgaggcccacgagcagctgaatgtgaagcatgagcccctgcagctgatccagccccagtttgagacccccctgcccaccctgcagcctgctgtgttcccccccagcttccgggagctgcccccaccacccctggagctgtttgacctggatgagaccttcagcagcgagaaggcccggctggcccagatcaccaacaagtgcacagaggaggacctggagttctacgtgaggaaatgtggggacatcctgggcgtgaccagcaagctgcccaaggaccagcaggatgccaagcacatcctggagcacgtgttcttccaggtggtggagttcaagaagctgaaccaggagcatgacatcgacaccagcgagacagccttccagaacaacttctag

SEQ ID NO: 39373 - DNA, 1314 bp, Artificial Sequence; identical to SEQ ID NO: 39372
  Description of Artificial Sequence: Synthetic coding sequence

SEQ ID NO: 39374 - DNA, 1401 bp, Artificial Sequence
  Description of Artificial Sequence: Synthetic coding sequence
atggagcctgagctgctggtgaggaaggtgtctgccctgcaggcctgtgtgcggggcttcctggtgcggcggcagttccagagcctgcgggcagaatatgaggccatcgtgcgggaggtggagggggacctgggcaccctgcagtggacagagggccgcatcccccggccccgcttcctgcctgagaaggccaagagccaccagacctggaaggccggggacagagtggccaaccctgagcagggcctgtggaaccacttcccctgtgaggagagcgagggggaggccacctgggaggagatggtgctgaagaagagcggggagagcagcgccaaccagggcagcctgtgccgggaccacagctcctggctgcagatgaagcagaacaggaagcccagccaggagaagacccgggacaccaccaggatggagaaccctgaggccacagaccagaggctgccccacagccagccccagctgcaggagctgcagtaccacaggagccacctggccatggagctgctgtggctgcagcaggccatcaacagcaggaaggagtacctgctgctgaagcagaccctgcggagccctgaggccggccccatccgggaggagcccagggtcttcctggagcacggggagcaggcctgtgagcgggaccagagccagcccagcgcccccctggaggaccagagctacagagacaggaccaccggggagctggagcaggaggatgacagctgccaccgggtgaagagcccccacaggagccctggcagcctggccaccacccagaagaacattgctggggccaagtgccgggagccctgctacagcaagagcggcccccccagcagcatccccagcaacagccaggccctgggggaccggctgaccaagggcccagatgatggccggcagacctttggaggcacctgcctgctgcagatgaagatcctggaggaccagaccccccggggcctgaagcccaggaaccactgccccaggaagagcaggacccagctgagcgccctgtatgaggacagcaacatcaaggagatgagccccaggaagctggaccacaaggagccagactgcaggacagtgaggacccaggagctgggcctgtctgaggaccacatcatctgggatggcaccctgggcggccctgagcacagcgtgctggacctgtggaggaccaagccacccaagggccaggcccccacagacaggagcagcagagatggcaccagcaatgagcccagccatgagggccagaagaagcagaggaccatcccctggaggagcaagagccctgagatcctgagcagcaccaaggccggctgcaccggggaggagcagtggaggggccggccctggaagacagagcccccaggatag

SEQ ID NO: 39375 - DNA, 1641 bp, Artificial Sequence
  Description of Artificial Sequence: Synthetic coding sequence
atggagcctgagctgctggtgaggaaggtgtctgccctgcaggtgcggggccgggcccggggcagccaggacttctccttccgggagatcatgggcagcaggacctggaccagccagagagatgccaccaccttcagccccctgacagcccggcagcccctggagatcccagctgtgcccaacagagctgaggagagctgggaccccaggaccccctgcccagcccggccccacagccaccacaccctggccccagaccagggcaatggcaagagcctgaaggcctgtgtgcggggcttcctggtgcggcggcagttccagagcctgcgggcagaatatgaggccatcgtgcgggaggtggagggggacctgggcaccctgcagtggacagagggccgcatcccccggccccgcttcctgcctgagaaggccaagagccaccagacctggaaggccggggacagagtggccaaccctgagcagggcctgtggaaccacttcccctgtgaggagagcgagggggaggccacctgggaggagatggtgctgaagaagagcggggagagcagcgccaaccagggcagcctgtgccgggaccacagctcctggctgcagatgaagcagaacaggaagcccagccaggagaagacccgggacaccaccaggatggagaaccctgaggccacagaccagaggctgccccacagccagccccagctgcaggagctgcagtaccacaggagccacctggccatggagctgctgtggctgcagcaggccatcaacagcaggaaggagtacctgctgctgaagcagaccctgcggagccctgaggccggccccatccgggaggagcccagggtcttcctggagcacggggagcaggcctgtgagcgggaccagagccagcccagcgcccccctggaggaccagagctacagagacaggaccaccggggagctggagcaggaggatgacagctgccaccgggtgaagagcccccacaggagccctggcagcctggccaccacccagaagaacattgctggggccaagtgccgggagccctgctacagcaagagcggcccccccagcagcatccccagcaacagccaggccctgggggaccggctgaccaagggcccagatgatggccggcagacctttggaggcacctgcctgctgcagatgaagatcctggaggaccagaccccccggggcctgaagcccaggaaccactgccccaggaagagcaggacccagctgagcgccctgtatgaggacagcaacatcaaggagatgagccccaggaagctggaccacaaggagccagactgcaggacagtgaggacccaggagctgggcctgtctgaggaccacatcatctgggatggcaccctgggcggccctgagcacagcgtgctggacctgtggaggaccaagccacccaagggccaggcccccacagacaggagcagcagagatggcaccagcaatgagcccagccatgagggccagaagaagcagaggaccatcccctggaggagcaagagccctgagatcctgagcagcaccaaggccggctgcaccggggaggagcagtggaggggccggccctggaagacagagcccccaggatag

SEQ ID NO: 39376 - DNA, 1044 bp, Artificial Sequence
  Description of Artificial Sequence: Synthetic coding sequence
atggccctggacatcctggccatggcccccctgtaccaggccccagccatcaaccgcatcggccccaagacagaccccagcaagaggcctgctgaccccctgaagcccctggtgctgagcaggaccaagctgaccaccatcgaggccaagaggatcatgagcatcctggatgaggccatctacaaggtggagctggtgaccctgctgtcctatgtggccagcaaccgggaggacatggagggcatgctgggagaagatgtgatgagagctgtgcgggagcacgaggacctgtgccaggtgctgctggagaatgtgcgctgcctgaaggagaaggagcggcagctgcaggagcagaaggaggccgaggaggagggctggctgcgggaccggctgctgagcattgagctgcagaagagcagcctgagccccctgatgcagcagatcaaggacagcaccaagaatgtgctgcggctgctgctgagcaacccccaggccgcccggctgctgcagatgcagacccagggccgctctgctgaggcccagaacttcatcgacagcctcatcgagctgcggggcttcctgtttgagaagctgctgaccagccccatggaggcccgggacaaggcccagttcctgcaggacatcagccggcagaacagcaacaaccagcagatcatcgacaccctggagaaggagctggccgagaggatgaagaacagaaatgctgaggaggagctggaggacctggatgctgtgcaccgggaggagaagatcagcctggaggagctgcggcggcggcacaaggtgctggtgggggagtttgcccagatccgggaggagcgggagatcaacagcaagaagaggatggaggccgagcaggagatggtgaggatggtgcgggccgccaccctcatccaggccctgtggaagggctacctggtgcgcagcctgctgcggagcaagaagaagaggggcaagggcaaggccaaggacaaggagaagggcaagcagaagggcaaggagaagggcaagggcaagaagtag

SEQ ID NO: 39377 - DNA, 1110 bp, Artificial Sequence
  Description of Artificial Sequence: Synthetic coding sequence
atggccctggacatcctggccatggcccccctgtaccaggccccagccatcaaccgcatcggccccaagacagaccccagcaagaggcctgctgaccccctgaagcccctggtgctgagcaggaccaagctgaccaccatcgaggccaagaggatcatgagcatcctggatgaggccatctacaaggtggagctggtgaccctgctgtcctatgtggccagcaaccgggaggacatggagggcatgctgggagaagatgtgatgagagctgtgcgggagcacgaggacctgtgccaggtgctgctggagaatgtgcgctgcctgaaggagaaggagcggcagctgcaggagcagaaggaggccgaggaggagggctggctgcgggaccggctgctgagcattgagctgcagaagagcagcctgagccccctgatgcagcagatcaaggacagcaccaagaatgtgctgcggctgctgctgagcaacccccaggccgcccggctgctgcagatgcagacccagggccgctctgctgaggcccagaacttcatcgacagcctcatcgagctgcggggcttcctgtttgagaagctgctgaccagccccatggaggcccgggacaaggcccagttcctgcaggacatcagccggcagaacagcaacaaccagcagatcatcgacaccctggagaaggagctggccgagaggatgaagaacagaaatgctgaggtgctcttccacagcattgctgagatcacagaggaggccacccagatcttctgctggctgggcttcagctccatgattgacttcttcttcaagatggagagccgctctgtggtgcagaccagggtgcagtggtgcaacctggacagcctgcagcccctgcccccacgcttcaagcgcttcagccaccacagcctgcccagctcctgggactacagaaggatgccacccaggcctgccaacttctgcatcttcagccgggacagagtgacccccttcagctgcctgagcctgcccagctcctgggactaccgctgcccccccctgtacagcagcctggccgctgagcaggaccctgtgtccaagaagaagggcaagcagtag

SEQ ID NO: 39378 - DNA, 1350 bp, Artificial Sequence
  Description of Artificial Sequence: Synthetic coding sequence
atggccctggacatcctggccatggcccccctgtaccaggccccagccatcaaccgcatcggccccaagacagaccccagcaagaggcctgctgaccccctgaagcccctggtgctgagcaggaccaagctgaccaccatcgaggccaagaggatcatgagcatcctggatgaggccatctacaaggtggagctggtgaccctgctgtcctatgtggccagcaaccgggaggacatggagggcatgctgggagaagatgtgatgagagctgtgcgggagcacgaggacctgtgccaggtgctgctggagaatgtgcgctgcctgaaggagaaggagcggcagctgcaggagcagaaggaggccgaggaggagggctggctgcgggaccggctgctgagcattgagctgcagaagagcagcctgagccccctgatgcagcagatcaaggacagcaccaagaatgtgctgcggctgctgctgagcaacccccaggccgcccggctgctgcagatgcagacccagggccgctctgctgaggcccagaacttcatcgacagcctcatcgagctgcggggcttcctgtttgagaagctgctgaccagccccatggaggcccgggacaaggcccagttcctgcaggacatcagccggcagaacagcaacaaccagcagatcatcgacaccctggagaaggagctggccgagaggatgaagaacagaaatgctgaggtggagaaggaaaattttgtgatccaggagctgaagaaccacctgcaccaggtgctgaagttcagcgagaacagcctggtgaggaccaagcaggaggccgagaagcagcagaaggctgacttccgggccagccaggcccgggtggccaagatccagcaggagatcctgcagctgcagagccagttctacaacctggtgatggagaaccgggaggccgagcaggccctgaggaagaagaagtacaaggtggagacagaaattgagaactggatccagaagtatgacacagagatgggagagaagcaggaggagctggaggacctggatgctgtgcaccgggaggagaagatcagcctggaggagctgcggcggcggcacaaggtgctggtgggggagtttgcccagatccgggaggagcgggagatcaacagcaagaagaggatggaggccgagcaggagatggtgaggatggtgcgggccgccaccctcatccaggccctgtggaagggctacctggtgcgcagcctgctgcggagcaagaagaagaggggcaagggcaaggccaaggacaaggagaagggcaagcagaagggcaaggagaagggcaagggcaagaagtag

SEQ ID NO: 39379 - DNA, 618 bp, Artificial Sequence
  Description of Artificial Sequence: Synthetic coding sequence
atggaggagaagcagccccagaagaccaaggagcccagcaaagaagatgagccccagcagaaggagatgcccacccacctgagcctgggcgctgagagcaaggccgaggccaagacccctgtgctggtggagacccagacagtggacaatgccaatgagaagtctgagaagcccccagagaaccagaagaagctgagtgacaaggacacagtggccaccaagatccaggcctggtggaggggcaccctggtgagaagagccctgctgcatgctgccctgagcgcctgcatcatccagtgctggtggaggctcatcctgagcaagatcctgaagaagaggcggcaggccgccctggaggccttcagcaggaaggagtgggccgctgtgaccctgcagagccaggccaggatgtggaggatcagaagacgctactgccaggtgctgaatgctgtgcgcatcatccaggcctactggcgctgccgcagctgtgccagccggggcttcatcaagggccagtacagagtgacagccaaccagctgcacctgcagctggagatcctgctggacagcggcccctgcatcgtgacagagtgcatccccttcagcatcaaggagtag

SEQ ID NO: 39380 - DNA, 249 bp, Artificial Sequence
  Description of Artificial Sequence: Synthetic coding sequence
atggaggagaagcagccccagaagaccaaggagcccagcaaagaagatgagccccagcagaaggagatgcccacccacctgagcctgggcgctgagagcaaggccgaggccaagacccctgtgctggtggagacccagacagtggacaatgccaatgagaagtctgagaagagggtgtgccagtggaacatggtgattgtgtccatggactggaagagcctggagagcgaggacctgaggaacctgtag

SEQ ID NO: 39381 - DNA, 495 bp, Artificial Sequence
  Description of Artificial Sequence: Synthetic coding sequence
atgagggtgcgcttctgcaccaagggcaacctgatcctggtgatcattgaagatgtggaggagagcattgagtggaagaccctgcagaagaagaagcagcagaagatcaaggagaagctgcgcatccgcaccaaggctgctgtgaagatccaggcctggtggaggggcaccctggtgcggaggaccctgctgcacgccgccctgcgggcctggatcatccagtgctggtggaggatgaccctgagccgggtgctggagaagaagaggcaggccgccctgattgcctatgccacccgggagcgggccgtcatcaagctgcagagcctggtgaggatgtggagggtgcgctggagatactgccaggtgctgaatgccatctacatcatccagggccactggcagtgccacaactgccagacctgtgccctgctgcagggccactgtgtggtgacagccacccacctgcagttccacatcgagatcatcaacagctag

SEQ ID NO: 39382 - DNA, 465 bp, Artificial Sequence
  Description of Artificial Sequence: Synthetic coding sequence
atgggcagcaagtgctgcaagggcggcccagatgaagatgctgtggagcggcagaggcggcagaagctgctgctggcccagctgcaccacaggaagagggtgaaggctgctggccagatccaggcctggtggaggggcgtgctggtgcggaggaccctgctggtggccgccctgcgggcctggatgatccagtgctggtggaggaccctggtgcagaggcgcatccggcagaggcggcaggccctgctgcgggtgtatgtgatccaggagcaggccaccgtgaagctgcagagctgcatccgcatgtggcagtgccggcagtgctaccggcagatgtgcaatgccctgtgcctcttccaggtgcctgagagcagcctggccttccagacagatggcttcctgcaggtgcagtatgccatccccagcaagcagcctgagttccacatcgagatcctgagcatctag

SEQ ID NO: 39383 - DNA, 465 bp, Artificial Sequence; identical to SEQ ID NO: 39382
  Description of Artificial Sequence: Synthetic coding sequence

SEQ ID NO: 39384 - DNA, 465 bp, Artificial Sequence; identical to SEQ ID NO: 39382
  Description of Artificial Sequence: Synthetic coding sequence

SEQ ID NO: 39385 - DNA, 465 bp, Artificial Sequence; identical to SEQ ID NO: 39382
  Description of Artificial Sequence: Synthetic coding sequence

SEQ ID NO: 39386 - DNA, 366 bp, Artificial Sequence
  Description of Artificial Sequence: Synthetic coding sequence
accaagaagaagaagaagaagaagaagaggaaggagaagaagctgcgggagaggtctgctgctgtgttcatccaggcctggtggaggggcatgctggtgcggaggaccctgctgcacgccgccctgcgggcctggatcatccagtgctggtggaggcaggtgctggagaagctgctggccaagagaagaaggatggtgctggagttctacgtgcagcaggagtgggccgctgtgcggctgcagagctgggtgaggatgtggtgtgtgcggcagcgctactgccgcctgctgaatgctgtgcgcatcatccaggtgtactggcgctggcacagctgccacagcagggtcttcatcgagggccactag

SEQ ID NO: 39387 - DNA, 447 bp, Artificial Sequence
  Description of Artificial Sequence: Synthetic coding sequence
atgggccctgaggagaagaccatcatgacagagaggtctgctgctgtgttcatccaggcctggtggaggggcatgctggtgcggaggaccctgctgcacgccgccctgcgggcctggatcatccagtgctggtggaggcaggtgctggagaagctgctggccaagagaagaaggatggtgctggagttctacgtgcagcaggagtgggccgctgtgcggctgcagagctgggtgaggatgtggtgtgtgcggcagcgctactgccgcctgctgaatgctgtgcgcatcatccaggtgtactggcgctggcacagctgccacagcagggtcttcatcgagggccactatgagctgaaggagaaccagctgaacatccagctggagatcagcctgggcctgcaggcctgcaaggtgcagcagtgcatccccctgcccctgaaggagtag

SEQ ID NO: 39388 - DNA, 324 bp, Artificial Sequence
  Description of Artificial Sequence: Synthetic coding sequence
atggtgcggaggaccctgctgcaggccgccctgcgggcctgggtgatccagtgctggtggaggtccatgcaggccaagatgctggagcagaggcggcggctggccctgcggctgtacacctgccaggagtgggccgtggtgaaggtgcaggcccaggtgaggatgtggcaggcccggcggcgcttcctgcaggcccggcaggccgcctgcatcatccagagccactggcgctggcacgccagccagacccggggcctcatccggggccactatgaggtgcgggccagccggctggagctggacatcgagatcctgatgacctag

SEQ ID NO: 39389 - DNA, 570 bp, Artificial Sequence
  Description of Artificial Sequence: Synthetic coding sequence
atggccgccccccggcagatccccagccacatcgtgcggctgaagcccagctgcagcacagacagcagcttcaccaggacccctgtgcccaccgtgtccctggccagccgggagctgcctgtgtcctcctggcaggtgacagagcccagcagcaagaacctgtgggagcagatctgcaaggagtatgaggccgagcagccccccttccctgagggctacaaggtgaagcaggagcctgtgatcaccgtggcccctgtggaggagatgctgttccacggcttctctgctgagcactacttccctgtgagccacttcaccatgatcagcaggaccccctgcccccaggacaagtctgagaccatcaaccccaagacctgcagccccaaggagtacctggagaccttcatcttccctgtgctgctgcccggcatggccagcctgctgcaccaggccaagaaggagaagtgctttgagcccacagctgccaaccccaccctggccccagctgacagaagaggcagcagccccctgcacagcatcctgctggagagcctgtgtggcagcctgtag

SEQ ID NO: 39390 - DNA, 864 bp, Artificial Sequence
  Description of Artificial Sequence: Synthetic coding sequence
atggccgccccccggcagatccccagccacatcgtgcggctgaagcccagctgcagcacagacagcagcttcaccaggacccctgtgcccaccgtgtccctggccagccgggagctgcctgtgtcctcctggcaggtgacagagcccagcagcaagaacctgtgggagcagatctgcaaggagtatgaggccgagcagccccccttccctgagggctacaaggtgaagcaggagcctgtgatcaccgtggcccctgtggaggagatgctgttccacggcttctctgctgagcactacttccctgtgagccacttcaccatgatcagcaggaccccctgcccccaggacaagtctgagaccatcaaccccaagacctgcagccccaaggagtacctggagaccttcatcttccctgtgctgctgcccggcatggccagcctgctgcaccaggccaagaaggagaagtgctttgagaggaagaggaccaagttcatcgcctgtgacttcctgacagagtggctgtacaaccagaaccccaagagagctggggagcccttcacagagttcttcagcatcccctttgtggaggagcggctgaagcagcaccccaggcctcccatccccctgagcctgctgctgacagaggaggaggccgccctgtacatccagagcttctggagggcctgtgtggtgcgctgtgaccctgagatccaggagctgcggcagtggcagaagaagctgcgggaggccaagcacatccaccagcaggtgaagatcttctgggccaagcaggagcagaaggtgaagtgcaagatggaggatgatgctgtgcctgctgccaagatgaagatccccagcagctag

SEQ ID NO: 39391 - DNA, 600 bp, Artificial Sequence
  Description of Artificial Sequence: Synthetic coding sequence
atgctgttccacggcttctctgctgagcactacttccctgtgagccacttcaccatgatcagcaggaccccctgcccccaggacaagtctgagaccatcaaccccaagacctgcagccccaaggagtacctggagaccttcatcttccctgtgctgctgcccggcatggccagcctgctgcaccaggccaagaaggagaagtgctttgagaggaagaggaccaagttcatcgcctgtgacttcctgacagagtggctgtacaaccagaaccccaagagagctggggagcccttcacagagttcttcagcatcccctttgtggaggagcggctgaagcagcaccccaggcctcccatccccctgagcctgctgctgacagaggaggaggccgccctgtacatccagagcttctggagggcctgtgtggtgcgctgtgaccctgagatccaggagctgcggcagtggcagaagaagctgcgggaggccaagcacatccaccagcaggtgaagatcttctgggccaagcaggagcagaaggtgaagtgcaagatggaggatgatgctgtgcctgctgccaagatgaagatccccagcagctag

SEQ ID NO: 39392 - DNA, 720 bp, Artificial Sequence
  Description of Artificial Sequence: Synthetic coding sequence
atggccgccccccggcagatccccagccacatcgtgcggctgaagcccagctgcagcacagacagcagcttcaccaggacccctgtgcccaccgtgtccctggccagccgggagctgcctgtgtcctcctggcaggtgacagagcccagcagcaagaacctgtgggagcagatctgcaaggagtatgaggccgagcagccccccttccctgagggctacaaggtgaagcaggagcctgtgatcaccgtggcccctgtggaggagatgctgttccacggcttctctgctgagcactacttccctgtgagccacttcaccatgatcagcaggaccccctgcccccaggacaagtctgagaccatcaaccccaagacctgcagccccaaggagtacctggagaccttcatcttccctgtgctgctgcccggcatggccagcctgctgcaccaggccaagaaggagaagtgctttgagaggaagaggaccaagttcatcgcctgtgacttcctgacagagtggctgtacaaccagaaccccaagagagctggggagcccttcacagagttcttcagcatcccctttgtggaggagcggctgaagcagcagtttgctgtgatcctgcgcttcaagaactgtgtgtctggaagaagaaactttgcccggcccagcaccttcaccagcaagagcaagttcagcggccccagcaagaacaagaagtag

SEQ ID NO: 39393 - DNA, 2460 bp, Artificial Sequence
  Description of Artificial Sequence: Synthetic coding sequence
atgtacaacaagatgtggcaccagacccaggaggccctgggcgccctgctggacaaggagccccagaagatgattgagccccagaggaaccaggtgttcatcttccagaccctggccaccttctacgtgaagtatgtgcagatcttcaggaacctggagaatgtgtatgaccagtttgtgcacccccagaagaggatcctgatcaggaaggtgctggatggagtgatgggccgcatcctggagctgaagaatgagatggtggagctggagctgacagagttccactactttgatgacatcctgcaggacctgaagctggccccccagcagctggacatccccatccccaagtacttcctgaaggagaagctggaggtgatcaagggccgggagaagatcctggcccagatcctggccgacagcggcatcgacaccagtgacatgaagtaccctgtgaagagcatcccctttgatgaggccgtgaagctgatccagattgctgagcgggcccggcagggccgcctgcgggccctcttcatgaagcagatctacctgcaggagtaccgggccaagcagagcaagatgctgggcaagaaggtgacagacacctgggccgccgccctgcgcatccagaaggtgtggaggcgcttccaccagaggaaggagacagagaagctgcgggaggaggagatgatcttcctgggcatgaaccccccacccctcttcaatgaggtgtctgccaccgtcatccaggccgagaaggtggaccggctgagaaatgaggtgcagatcaagcatgaggaggactaccgggaggccctggtgaccatcaagaatgacctgaagctgattgagggcgtggacatcaaggagaacctgcaggaccagatccgccactggttcattgaatgtagaaacctgaccggcaccttcccagactacccagatgtggaggagggcggcagcgccatcatcttcagtgacaagaccatccagcaggtgattgaggacatcatcgccaaccaggaggaggaggagaagaacaagaagaagaagaagaagaaggagaagcagcccaagaaggccaagaagcagaagaagggcaccaaggagaagaacaaggaggaggatgagaagtggaagatgagccccagcctcttcctgcctgccatgaaggagggctgcaatgcctacaaggagatctggatgaagaaggatgagagctggaacttcagccaggactatgaccctgagctgatcaaggaggagaagaggaaggagctgcagagcgagatccgcatccaggtggatgagctgatgaggcaggagctgaagaacctgaagctggccgtggaccgggagcgggagaggcctgtgaaggccggcaagaagaaggacaagaagaagggcaagaagggcaagaagaaggagaagaaggccaagaaggacaaggacctgacagctgacaggaccatcgagagcctgtacaaggagctggtggaggagggcctgctgatccaggccctgaaggtgaacctgagtgactacatcggggagtacagctacctgggcaccaccctgcggcaggtgtccattgagcccatgcccagcctgctggatgtgcggcagctgatcaccctgtatggcatctggcccctgggcagcgctgctgtgcatgagaaggcccccctggtgaagagcctgctgctggccggccccagcggcgtgggcaagaagatgctggtgcacgccatctgcacagaaacaggagccaacctcttcaacctgagcagcagcaacattgctgggaagtacccaggcaagaatggcctgcagatgatgctgcatgctgtgttcaaggtggcccggcagctgcagcccagcgtggtgtggattgaggacacagagaagaccttctacaagaaggtgcccaatgctgagaagatgaatgagcccaagaggctgaagaagcacctgccccagatcctgaagctgctgaagccagatgaccgcatcctgattgtgggcaccacccggcggccctttgatgctgagctgcagagcttctgcaaggtgtaccagaagatcatcctggtgcccaggccagactatgccagccgctacgtgctgtggaagcagatcattgaaagaaatggaggagtgctgaccagcgccctgaatgtgtcctgcctggccaaggtgacagatggcttcacccagggccacatcgtggaggtggtgaagggcgtgctgacagaccagaggatccggcggcagatccacaagcccctgacagctgtggagttcatcacagccatcacctccatgaaccctgtgtacaaggaggaggaggagagcttcaagaactggtacgccaagacccccctgggcaagaagagggccctggccatcactggaggcagcacagagaaggccaaggacaagggcaagaggaagtag

SEQ ID NO: 39394 - DNA, 2469 bp, Artificial Sequence
  Description of Artificial Sequence: Synthetic coding sequence
atgagcaatgccatgtacaacaagatgtggcaccagacccaggaggccctgggcgccctgctggacaaggagccccagaagatgattgagccccagaggaaccaggtgttcatcttccagaccctggccaccttctacgtgaagtatgtgcagatcttcaggaacctggagaatgtgtatgaccagtttgtgcacccccagaagaggatcctgatcaggaaggtgctggatggagtgatgggccgcatcctggagctgaagaatgagatggtggagctggagctgacagagttccactactttgatgacatcctgcaggacctgaagctggccccccagcagctggacatccccatccccaagtacttcctgaaggagaagctggaggtgatcaagggccgggagaagatcctggcccagatcctggccgacagcggcatcgacaccagtgacatgaagtaccctgtgaagagcatcccctttgatgaggccgtgaagctgatccagattgctgagcgggcccggcagggccgcctgcgggccctcttcatgaagcagatctacctgcaggagtaccgggccaagcagagcaagatgctgggcaagaaggtgacagacacctgggccgccgccctgcgcatccagaaggtgtggaggcgcttccaccagaggaaggagacagagaagctgcgggaggaggagatgatcttcctgggcatgaaccccccacccctcttcaatgaggtgtctgccaccgtcatccaggccgagaaggtggaccggctgagaaatgaggtgcagatcaagcatgaggaggactaccgggaggccctggtgaccatcaagaatgacctgaagctgattgagggcgtggacatcaaggagaacctgcaggaccagatccgccactggttcattgaatgtagaaacctgaccggcaccttcccagactacccagatgtggaggagggcggcagcgccatcatcttcagtgacaagaccatccagcaggtgattgaggacatcatcgccaaccaggaggaggaggagaagaacaagaagaagaagaagaagaaggagaagcagcccaagaaggccaagaagcagaagaagggcaccaaggagaagaacaaggaggaggatgagaagtggaagatgagccccagcctcttcctgcctgccatgaaggagggctgcaatgcctacaaggagatctggatgaagaaggatgagagctggaacttcagccaggactatgaccctgagctgatcaaggaggagaagaggaaggagctgcagagcgagatccgcatccaggtggatgagctgatgaggcaggagctgaagaacctgaagctggccgtggaccgggagcgggagaggcctgtgaaggccggcaagaagaaggacaagaagggcaagaagggcaagaagaaggagaagaaggccaagaaggacaaggacctgacagctgacaggaccatcgagagcctgtacaaggagctggtggaggagggcctgctgatccaggccctgaaggtgaacctgagtgactacatcggggagtacagctacctgggcaccaccctgcggcaggtgtccattgagcccatgcccagcctgctggatgtgcggcagctgatcaccctgtatggcatctggcccctgggcagcgctgctgtgcatgagaaggcccccctggtgaagagcctgctgctggccggccccagcggcgtgggcaagaagatgctggtgcacgccatctgcacagagaccggggccaacctcttcaacctgagcagcagcaacattgctgggaagtacccaggcaagaatggcctgcagatgatgctgcatgctgtgttcaaggtggcccggcagctgcagcccagcgtggtgtggattgaggacacagagaagaccttctacaagaaggtgcccaatgctgagaagatgaatgagcccaagaggctgaagaagcacctgccccagatcctgaagctgctgaagccagatgaccgcatcctgattgtgggcaccacccggcggccctttgatgctgagctgcagagcttctgcaaggtgtaccagaagatcatcctggtgcccaggccagactatgccagccgctacgtgctgtggaagcagatcatcgagagaaatggaggagtgctgaccagcgccctgaatgtgtcctgcctggccaaggtgacagatggcttcacccagggccacatcgtggaggtggtgaagggcgtgctgacagaccagaggatccggcggcagatccacaagcccctgacagctgtggagttcatcacagccatcacctccatgaaccctgtgtacaaggaggaggaggagagcttcaagaactggtacgccaagacccccctgggcaagaagagggccctggccatcaccggcggcagcacagagaaggccaaggacaagggcaagaggaagtag

SEQ ID NO: 39395 - DNA, 2013 bp, Artificial Sequence
  Description of Artificial Sequence: Synthetic coding sequence
atgtacaacaagatgtggcaccagacccaggaggccctgggcgccctgctggacaaggagccccagaagatgattgagccccagaggaaccaggtgttcatcttccagaccctggccaccttctacgtgaagtatgtgcagatcttcaggaacctggagaatgtgtatgaccagtttgtgcacccccagaagaggatcctgatcaggaaggtgctggatggagtgatgggccgcatcctggagctgaagaatgagatggtggagctggagctgacagagttccactactttgatgacatcctgcaggacctgaagctggccccccagcagctggacatccccatccccaagtacttcctgaaggagaagctggaggtgatcaagggccgggagaagatcctggcccagatcctggccgacagcggcatcgacaccagtgacatgaagtaccctgtgaagagcatcccctttgatgaggccgtgaagctgatccagattgctgagcgggcccggcagggccgcctgcgggccctcttcatgaagcagatctacctgcaggagtaccgggccaagcagagcaagatgctgggcaagaaggtgacagacacctgggccgccgccctgcgcatccagaaggtgtggaggcgcttccaccagaggaaggagacagagaagctgcgggaggaggagatgatcttcctgggcatgaaccccccacccctcttcaatgaggtgtctgccaccgtcatccaggccgagaaggtggaccggctgagaaatgaggtgcagatcaagcatgaggaggactaccgggaggccctggtgaccatcaagaatgacctgaagctgattgagggcgtggacatcaaggagaacctgcaggaccagatccgccactggttcattgaatgtagaaacctgaccggcaccttcccagactacccagatgtggaggagggcggcagcgccatcatcttcagtgacaagaccatccagcaggtgattgaggacatcatcgccaaccaggaggaggaggagaagaacaagaagaagaagaagaagaaggagaagcagcccaagaaggccaagaagcagaagaagggcaccaaggagaagaacaaggaggaggatgagaagtggaagatgagccccagcctcttcctgcctgccatgaaggagggctgcaatgcctacaaggagatctggatgaagaaggatgagagctggaacttcagccaggactatgaccctgagctgatcaaggaggagaagaggaaggagctgcagagcgagatccgcatccaggtggatgagctgatgaggcaggagctgaagaacctgaagctggccgtggaccgggagcgggagaggcctgtgaaggccggcaagaagaaggacaagaagaagggcaagaagggcaagaagaaggagaagaaggccaagaaggacaaggacctgacagctgacaggaccatcgagagcctgtacaaggagctggtggaggagggcctgctgatccaggccctgaaggtgaacctgagtgactacatcggggagtacagctacctgggcaccaccctgcggcaggtgtccattgagcccatgcccagcctgctggatgtgcggcagctgatcaccctgtatggcatctggcccctgggcagcgctgctgtgcatgagaaggcccccctggtgaagagcctgctgctggccggccccagcggcgtgggcaagaagatgctggtgcacgccatctgcacagaaacaggagccaacctcttcaacctgagcagcagcaacattgctgggaagtacccaggcaagaatggcctgcagatgatgctgcatgctgtgttcaaggtggcccggcagctgcagcccagcgtggtgtggattgaggacacagagaagaccttctacaagaaggtgcccaatgctgagaagatgttcaccccatctgctggggaggtggccgccctgcagaagaacctgaagaggagcaccagcaggtag

SEQ ID NO: 39396 - DNA, 2346 bp, Artificial Sequence
  Description of Artificial Sequence: Synthetic coding sequence
atgagcaatgccatgtacaacaagatgtggcaccagacccaggaggccctgggcgccctgctggacaaggagccccagaagatgattgagccccagaggaaccaggtgttcatcttccagaccctggccaccttctacgtgaagtatgtgcagatcttcaggaacctggagaatgtgtatgaccagtttgtgcacccccagaagaggatcctgatcaggaaggtgctggatggagtgatgggccgcatcctggagctgaagaatgagatggtggagctggagctgacagagttccactactttgatgacatcctgcaggacctgaagctggccccccagcagctggacatccccatccccaagtacttcctgaaggagaagctggaggtgatcaagggccgggagaagatcctggcccagatcctggccgacagcggcatcgacaccagtgacatgaagtaccctgtgaagagcatcccctttgatgaggccgtgaagctgatccagattgctgagcgggcccggcagggccgcctgcgggccctcttcatgaagcagatctacctgcaggagtaccgggccaagcagagcaagatgctgggcaagaaggtgacagacacctgggccgccgccctgcgcatccagaaggtgtggaggcgcttccaccagaggaaggagacagagaagctgcgggaggaggagatgatcttcctgggcatgaaccccccacccctcttcaatgaggtgtctgccaccgtcatccaggccgagaaggtggaccggctgagaaatgaggtgcagatcaagcatgaggaggactaccgggaggccctggtgaccatcaagaatgacctgaagctgattgagggcgtggacatcaaggagaacctgcaggaccagatccgccactggttcattgaatgtagaaacctgaccggcaccttcccagactacccagatgtggaggagggcggcagcgccatcatcttcagtgacaagaccatccagcaggaggaggatgagaagtggaagatgagccccagcctcttcctgcctgccatgaaggagggctgcaatgcctacaaggagatctggatgaagaaggatgagagctggaacttcagccaggactatgaccctgagctgatcaaggaggagaagaggaaggagctgcagagcgagatccgcatccaggtggatgagctgatgaggcaggagctgaagaacctgaagctggccgtggaccgggagcgggagaggcctgtgaaggccggcaagaagaaggacaagaagggcaagaagggcaagaagaaggagaagaaggccaagaaggacaaggacctgacagctgacaggaccatcgagagcctgtacaaggagctggtggaggagggcctgctgatccaggccctgaaggtgaacctgagtgactacatcggggagtacagctacctgggcaccaccctgcggcaggtgtccattgagcccatgcccagcctgctggatgtgcggcagctgatcaccctgtatggcatctggcccctgggcagcgctgctgtgcatgagaaggcccccctggtgaagagcctgctgctggccggccccagcggcgtgggcaagaagatgctggtgcacgccatctgcacagaaacaggagccaacctcttcaacctgagcagcagcaacattgctgggaagtacccaggcaagaatggcctgcagatgatgctgcatgctgtgttcaaggtggcccggcagctgcagcccagcgtggtgtggattgaggacacagagaagaccttctacaagaaggtgcccaatgctgagaagatgaatgagcccaagaggctgaagaagcacctgccccagatcctgaagctgctgaagccagatgaccgcatcctgattgtgggcaccacccggcggccctttgatgctgagctgcagagcttctgcaaggtgtaccagaagatcatcctggtgcccaggccagactatgccagccgctacgtgctgtggaagcagatcattgaaagaaatggaggagtgctgaccagcgccctgaatgtgtcctgcctggccaaggtgacagatggcttcacccagggccacatcgtggaggtggtgaagggcgtgctgacagaccagaggatccggcggcagatccacaagcccctgacagctgtggagttcatcacagccatcacctccatgaaccctgtgtacaaggaggaggaggagagcttcaagaactggtacgccaagacccccctgggcaagaagagggccctggccatcactggaggcagcacagagaaggccaaggacaagggcaagaggaagtag

SEQ ID NO: 39397 - DNA, 2493 bp, Artificial Sequence
  Description of Artificial Sequence: Synthetic coding sequence
atgacccccagcctgtctgcagaagaaaataggatgtacaacaagatgtggcaccagacccaggaggccctgggcgccctgctggacaaggagccccagaagatgattgagccccagaggaaccaggtgttcatcttccagaccctggccaccttctacgtgaagtatgtgcagatcttcaggaacctggagaatgtgtatgaccagtttgtgcacccccagaagaggatcctgatcaggaaggtgctggatggagtgatgggccgcatcctggagctgaagaatgagatggtggagctggagctgacagagttccactactttgatgacatcctgcaggacctgaagctggccccccagcagctggacatccccatccccaagtacttcctgaaggagaagctggaggtgatcaagggccgggagaagatcctggcccagatcctggccgacagcggcatcgacaccagtgacatgaagtaccctgtgaagagcatcccctttgatgaagctgtgaagctgatccagattgctgagcgggcccggcagggccgcctgcgggccctcttcatgaagcagatctacctgcaggagtaccgggccaagcagagcaagatgctgggcaagaaggtgacagacacctgggccgccgccctgcgcatccagaaggtgtggaggcgcttccaccagaggaaggagacagagaagctgcgggaggaggagatgatcttcctgggcatgaaccccccacccctcttcaatgaggtgtctgccaccgtcatccaggccgagaaggtggaccggctgagaaatgaggtgcagatcaagcatgaggaggactaccgggaggccctggtgaccatcaagaatgacctgaagctgattgaaggagtggacatcaaggagaacctgcaggaccagatccgccactggttcatcgagtgcaggaacctgaccggcaccttcccagactacccagatgtggaggagggcggcagcgccatcatcttcagtgacaagaccatccagcaggtgattgaggacatcatcgccaaccaggaggaggaggagaagaacaagaagaagaagaagaagaaggagaagcagcccaagaaggccaagaagcagaagaagggcaccaaggagaagaacaaggaggaggatgagaagtggaagatgagccccagcctcttcctgcctgccatgaaggagggctgcaatgcctacaaggagatctggatgaagaaggatgagagctggaacttcagccaggactatgaccctgagctgatcaaggaggagaagaggaaggagctgcagagcgagatccgcatccaggtggatgagctgatgaggcaggagctgaagaacctgaagctggccgtggaccgggagcgggagaggcctgtgaaggccggcaagaagaaggacaagaagaagggcaagaagggcaagaagaaggagaagaaggccaagaaggacaaggacctgacagctgacaggaccatcgagagcctgtacaaggagctggtggaggagggcctgctgatccaggccctgaaggtgaacctgagtgactacatcggggagtacagctacctgggcaccaccctgcggcaggtgtccattgagcccatgcccagcctgctggatgtgcggcagctgatcaccctgtatggcatctggcccctgggcagcgctgctgtgcatgagaaggcccccctggtgaagagcctgctgctggccggccccagcggcgtgggcaagaagatgctggtgcacgccatctgcacagagaccggggccaacctcttcaacctgagcagcagcaacattgctgggaagtacccaggcaagaatggcctgcagatgatgctgcatgctgtgttcaaggtggcccggcagctgcagcccagcgtggtgtggattgaggacacagagaagaccttctacaagaaggtgcccaatgctgagaagatgaatgagcccaagaggctgaagaagcacctgccccagatcctgaagctgctgaagccagatgaccgcatcctgattgtgggcaccacccggcggccctttgatgctgagctgcagagcttctgcaaggtgtaccagaagatcatcctggtgcccaggccagactatgccagccgctacgtgctgtggaagcagatcatcgagagaaatggaggagtgctgaccagcgccctgaatgtgtcctgcctggccaaggtgacagatggcttcacccagggccacatcgtggaggtggtgaagggcgtgctgacagaccagaggatccggcggcagatccacaagcccctgacagctgtggagttcatcacagccatcacctccatgaaccctgtgtacaaggaggaggaggagagcttcaagaactggtacgccaagacccccctgggcaagaagagggccctggccatcaccggcggcagcacagagaaggccaaggacaagggcaagaggaagtag

SEQ ID NO: 39398 - DNA, 1449 bp, Artificial Sequence
  Description of Artificial Sequence: Synthetic coding sequence
atggacagctttggccagcccaggcctgaggacaaccagagcgtggtgcggaggatgcagaagaagtactggaagaccaagcaggtgttcatcaaggccaccgggaagaaggaggatgagcacctggtggccagtgatgctgagctggatgccaagctggaggtgttccacagcgtgcaggagacctgcacagagctgctgaagatcatcgagaagtaccagctgcggctgaatgtcatcagcgaggaggagaatgagctgggcctcttcctgaagttccaggccgagagagatgccacccaggccggcaagatgatggatgccaccgggaaggccctgtgcagcagcgccaagcagaggctggccctgtgcacccccctgagccggctgaagcaggaggtggccaccttcagccagagagctgtgtctgacaccctgatgaccatcaacaggatggagcaggccaggacagagtacagaggagccctgctgtggatgaaggatgtgtcccaggagctggaccctgacaccctgaagcagatggagaagttcaggaaggtgcagatgcaggtgaggaacagcaaggccagctttgacaagctgaagatggatgtgtgccagaaggtggacctgctgggcgccagccgctgcaacatgctgagccacagcctgaccacctaccagaggaccctgctgggcttctggaagaagacagccaggatgatgagccagatccacgaggcctgcatcggcttccacccctatgactttgtggccctgaagcagctgcaggacacccccagcaagatcagcgaggacaacaaggatgagcagattggaggcttcctgacagagcagctgaacaagctggtgctgagtgatgaggaggccagctttgaaagtgagcaggccaacaaggaccacaatgagaagcacagccagatgagggagtttggagccccccagttcagcaacagtgaaaatgtggccaaggacctgcctgtggacagcctggagggagaagattttgagaaggagttctccttcctgaacaacctgctgagcagcggcagcagcagcaccagcgagttcacccaggagtgccagacagccttcggcagccccagcgccagcctgaccagccaggagcccagcatgggcagcgagcccctggcccacagcagccgcttcctgcccagccagctgtttgacctgggcttccacgtggccggggccttcaacaactgggtgtcccaggaggagagcgagctgtgcctgagccacacagacaaccagcctgtgcccagccagagccccaagaagctgaccaggagccccaacaacggcaaccaggacatgtctgcctggttcaacctgtttgctgacctggaccccctgagcaacccagatgccatcggccacagtgatgatgagctgctgaatgcctag

SEQ ID NO: 39399 - DNA, 1449 bp, Artificial Sequence; identical to SEQ ID NO: 39398
  Description of Artificial Sequence: Synthetic coding sequence

SEQ ID NO: 39400 - DNA, 237 bp, Artificial Sequence
  Description of Artificial Sequence: Synthetic coding sequence
atggacagctttggccagcccaggcctgaggacaaccagagcgtggtgcggaggatgcagaagaagtactggaagaccaagcaggtgttcatcaaggccaccgggaagaaggaggatgagcacctggtggccagtgatgctgagctggatgccaagctggaggtgttccacagcgtgcaggagacctgcacagagctgctgaagatcatcgagaagtaccagctgcggctgaactag

SEQ ID NO: 39401 - DNA, 360 bp, Artificial Sequence
  Description of Artificial Sequence: Synthetic coding sequence
atggacagctttggccagcccaggcctgaggacaaccagagcgtggtgcggaggatgcagaagaagtactggaagaccaagcaggtgttcatcaaggccaccgggaagaaggaggatgagcacctggtggccagtgatgctgagctggatgccaagctggaggtgttccacagcgtgcaggagacctgcacagagctgctgaagatcatcgagaagtaccagctgcggctgaatgtcatcagcgaggaggagaatgagctgggcctcttcctgaagttccaggccgagagagatgccacccaggccggcaagatgatggatgccaccgggaaggccctgtgcagcagcgccaagcagtag

SEQ ID NO: 39402 - DNA, 297 bp, Artificial Sequence
  Description of Artificial Sequence: Synthetic coding sequence
atggacagctttggccagcccaggcctgaggacaaccagagcgtggtgcggaggatgcagaagaagtactggaagaccaagcaggtgttcatcaaggccaccgggaagaaggaggatgagcacctggtggccagtgatgctgagctggatgccaagctggaggtgttccacagcgtgcaggagacctgcacagagctgctgaagatcatcgagaagtaccagctgcggctgaatgtcatcagcgaggaggagaatgagctgggcctcttcctgaagttccaggccgagcgggactag

SEQ ID NO: 39403 - DNA, 375 bp, Artificial Sequence
  Description of Artificial Sequence: Synthetic coding sequence
atggacagctttggccagcccaggcctgaggacaaccagagcgtggtgcggaggatgcagaagaagtactggaagaccaagcaggtgttcatcaaggccaccgggaagaaggaggatgagcacctggtggccagtgatgctgagctggatgccaagctggaggtgttccacagcgtgcaggagacctgcacagagctgctgaagatcatcgagaagtaccagctgcggctgaatgtcatcagcgaggaggagaatgagctgggcctcttcctgaagttccaggccgagagagatgccacccaggccggcaagatgatggatgccaccgggaaggccctgtgcagcagcgccaagcagaggctggccctgtgctag

SEQ ID NO: 39404 - DNA, 129 bp, Artificial Sequence
  Description of Artificial Sequence: Synthetic coding sequence
atggacagctttggccagcccaggcctgaggacaaccagagcgtggtgcggaggatgcagaagaagtactggaagaccaagcaggtgttcatcaaggccaccgggaagaaggaggatgagcacctgtag

SEQ ID NO: 39405 - DNA, 300 bp, Artificial Sequence
  Description of Artificial Sequence: Synthetic coding sequence
atggacagctttggccagcccaggcctgaggacaaccagagcgtggtgcggaggatgcagaagaagtactggaagaccaagcaggtgttcatcaaggccaccgggaagaaggaggatgagcacctggtggccagtgatgctgagctggatgccaagctggaggtgttccacagcgtgcaggagacctgcacagagctgctgaagatcatcgagaagtaccagctgcggctgaatgtcatcagcgaggaggagaatgagctgggcctcttcctgaagttccaggccgagagagatgcctag

SEQ ID NO: 39406 - DNA, 405 bp, Artificial Sequence
  Description of Artificial Sequence: Synthetic coding sequence
atggacagctttggccagcccaggcctgaggacaaccagagcgtggtgcggaggatgcagaagaagtactggaagaccaagcaggtgttcatcaaggccaccgggaagaaggaggatgagcacctggtggccagtgatgctgagctggatgccaagctggaggtgttccacagcgtgcaggagacctgcacagagctgctgaagatcatcgagaagtaccagctgcggctgaatgtcatcagcgaggaggagaatgagctgggcctcttcctgaagttccaggccgagagagatgccacccaggccggcaagatgatggatgccaccgggaaggccctgtgcagcagcgccaagcagaggctggccctgtgcacccccctgagccggctgaagcaggaggtgtag

SEQ ID NO: 39407 - DNA, 360 bp, Artificial Sequence; identical to SEQ ID NO: 39401
  Description of Artificial Sequence: Synthetic coding sequence

SEQ ID NO: 39408 - DNA, 456 bp, Artificial Sequence
  Description of Artificial Sequence: Synthetic coding sequence
atggacagctttggccagcccaggcctgaggacaaccagagcgtggtgcggaggatgcagaagaagtactggaagaccaagcaggtgttcatcaaggccaccgggaagaaggaggatgagcacctggtggccagtgatgctgagctggatgccaagctggaggtgttccacagcgtgcaggagacctgcacagagctgctgaagatcatcgagaagtaccagctgcggctgaatgtcatcagcgaggaggagaatgagctgggcctcttcctgaagttccaggccgagagagatgccacccaggccggcaagatgatggatgccaccgggaaggccctgtgcagcagcgccaagcagaggctggccctgtgcacccccctgagccggctgaagcaggaggtggccaccttcagccagagagctgtgtctgacaccctgatgaccatcaacagatag

SEQ ID NO: 39409 - DNA, 294 bp, Artificial Sequence
  Description of Artificial Sequence: Synthetic coding sequence
atggacagctttggccagcccaggcctgaggacaaccagagcgtggtgcggaggatgcagaagaagtactggaagaccaagcaggtgttcatcaaggccaccgggaagaaggaggatgagcacctggtggccagtgatgctgagctggatgccaagctggaggtgttccacagcgtgcaggagacctgcacagagctgctgaagatcatcgagaagtaccagctgcggctgaatgtcatcagcgaggaggagaatgagctgggcctcttcctgaagttccaggccgagaggtag

SEQ ID NO: 39410 - DNA, 303 bp, Artificial Sequence
  Description of Artificial Sequence: Synthetic coding sequence
atggacagctttggccagcccaggcctgaggacaaccagagcgtggtgcggaggatgcagaagaagtactggaagaccaagcaggtgttcatcaaggccaccgggaagaaggaggatgagcacctggtggccagtgatgctgagctggatgccaagctggaggtgttccacagcgtgcaggagacctgcacagagctgctgaagatcatcgagaagtaccagctgcggctgaatgtcatcagcgaggaggagaatgagctgggcctcttcctgaagttccaggccgagagagatgccacctag

SEQ ID NO: 39411 - DNA, 408 bp, Artificial Sequence
  Description of Artificial Sequence: Synthetic coding sequence
atggtgcagtacctgaagtctgtggacatccctgagaacagagtcatcctgatcacccccacccccctgtgtgaaacagcctgggaggagcagtgcatcatccagggctgcaagctgaaccggctgaacagcgtggtgggggagtatgccaatgcctgcctgcaggtggcccaggactgtggcacagatgtgctggacctgtggaccctgatgcaggacagccaggacttcagcagctacctgagtgatggcctgcacctgagccccaagggaaatgagttcctgttcagccacctgtggcccctgattgagaagaaggtgagcagcctgcccctgctgctgccctactggagagatgtggccgaggccaagccagagctgagcctgctgggagatggagaccactag

SEQ ID NO: 39412 - DNA, 747 bp, Artificial Sequence
  Description of Artificial Sequence: Synthetic coding sequence
atggccctgtgtgaggccgccggctgcggcagcgccctgctgtggccccggctgctgctgtttggagacagcatcacccagttctccttccagcagggcggctggggcgccagcctggccgaccggctggtgaggaaatgtgatgtgctgaacagaggcttcagcggctacaacacccgctgggccaagatcatcctgcccaggctcatcaggaagggcaacagcctggacatccctgtggccgtgaccatcttcttcggggccaatgattctgccctgaaggatgagaaccccaagcagcacatccccctggaggagtatgctgccaacctgaagtccatggtgcagtacctgaagtctgtggacatcccagaaaatagagtcatcctgatcacccccacccccctgtgtgaaacagcctgggaggagcagtgcatcatccagggctgcaagctgaaccggctgaacagcgtggtgggggagtatgccaatgcctgcctgcaggtggcccaggactgtggcacagatgtgctggacctgtggaccctgatgcaggacagccaggacttcagcagctacctgagtgatggcctgcacctgagccccaagggaaatgagttcctgttcagccacctgtggcccctcatcgagaagaaggtgagcagcctgcccctgctgctgccctactggagagatgtggccgaggccaagccagagctgagcctgctgggagatggagaccactag

SEQ ID NO: 39413 - DNA, 408 bp, Artificial Sequence; identical to SEQ ID NO: 39411
  Description of Artificial Sequence: Synthetic coding sequence

SEQ ID NO: 39414 - DNA, 1356 bp, Artificial Sequence
  Description of Artificial Sequence: Synthetic coding sequence
atggaggccggccccccaggcagcgcccggcctgctgagcccggcccctgcctgagcggccagagaggagctgaccacacagccagcgccagcctgcagagcgtggccggcacagagcccggccgccacccccaggccgtggccgctgtgctgcctgctgggggctgtggggagaggatgggcgtgcccacccccaagcagttctgccccatcctggagcggcccctcatctcctacaccctgcaggccctggagcgggtgtgctggatcaaggacatcgtggtggccgtgactggagagaacatggaggtgatgaagagcatcatccagaagtaccagcacaagaggatcagcctggtggaggccggcgtgaccaggcacaggagcatcttcaacggcctgaaggccctggccgaggaccagatcaacagcaagctgagcaagccagaggtggtgatcatccatgatgctgtgcggccctttgtggaggagggcgtgctgctgaaggtggtgacagctgccaaggagcacggggccgccggggccatccggcccctggtgtccacagtggtgagccccagcgcagatggctgcctggactacagcctggagcgggcccggcaccgggccagcgagatgccccaggccttcctgtttgatgtgatctatgaggcctaccagcagtgcagcgactatgacctggagtttggaacagaatgtctgcagctggccctgaagtactgctgcaccaaggccaagctggtggagggcagcccagacctgtggaaggtgacctacaagagggacctgtatgctgctgagagcatcatcaaggagcgcatcagccaggagatctgtgtggtgatggacacagaggaggacaacaagcacgtgggccacctgctggaggaggtgctgaagtctgagctgaaccacgtgaaggtgaccagcgaggccctgggccatgctggccgccacctgcagcagatcatcctggaccagtgctacaactttgtgtgtgtgaatgtgaccaccagtgacttccaggagacccagaagctgctgtccatgctggaggagagcagcctgtgcatcctgtaccctgtggtggtggtgtctgtgcacttcctggacttcaagctggtgccccccagccagaagatggagaacctgatgcagatccgggagtttgccaaggaggtgaaggagaggaacatcctgctgtatggcctgctgatctcctacccccaggatgaccagaagctgcaggagagcctgcggcagggcgccatcatcatcgccagcctcatcaaggagaggaacagcggcctgattggccagctgctgattgcctag

SEQ ID NO: 39415 - DNA, 996 bp, Artificial Sequence
  Description of Artificial Sequence: Synthetic coding sequence
atggccagaaatgctgagaaggccatgacagccctggcccgcttccggcaggcccagctggaggagggcaaggtgaaggagcggcggcccttcctggcctctgaatgtacagagctgcccaaggccgagaagtggaggcggcagatcatcggggagatcagcaagaaggtggcccagatccagaatgccggcctgggggagttccgcatccgggacctgaatgatgagatcaacaagctgctgcgggagaagggccactgggaggtgcgcatcaaggagctgggcggccctgactatggcaaggtgggccccaagatgctggaccacgagggcaaggaggtgcccggcaacagaggctacaagtactttggagctgccaaggacctgcccggggtgcgggagctgtttgagaaggagcccctgcccccacccaggaagaccagggctgagctgatgaaggccatcgactttgagtactacggctacctggatgaagatgatggagtcatcgtgcccctggagcaggagtatgagaagaagctgcgggcagagctggtggagaagtggaaggccgagcgggaggcccggctggcccggggggagaaggaggaggaggaggaggaggaggaggagatcaacatctatgctgtgacagaggaggagagtgatgaggagggcagccaggagaagggaggagatgacagccagcagaagttcatcgcccacgtgcctgtgcccagccagcaggagattgaggaggccctggtgcggaggaagaagatggagctgctgcagaagtatgccagcgagaccctgcaggcccagagcgaggaggcccggcggctgctgggctgccgcagcggcaccaggcctgcccggagcggcagcgcccccagcccccgggccaccacagctgtgcccatgggccccagcctgcccaccaccagccccaggggggcccccagctgccgctgcctgaccggcctgaggatgtag

SEQ ID NO: 39416 - DNA, 1671 bp, Artificial Sequence
  Description of Artificial Sequence: Synthetic coding sequence
atggccagcaagccagctgctgggaagagcagaggagagaagaggaagagggtggtgctgaccctgaaggagaagattgacatctgcacccggctggagaagggggagagcaggaaggccctgatgcaggagtacaacgtgggcatgagcaccctgtatgacatccgggcccacaaggcccagctgctgcgcttctttgccagcagtgacagcaacaaggccctggagcagaggaggaccctgcacacccccaagctggagcacctggacagagtgctgtatgagtggttcctgggcaagaggtctgagggcgtgcctgtgtctggccccatgctgattgagaaggccaaggacttctatgagcagatgcagctgacagagccctgtgtgttcagcggcggctggctgtggaggttcaaggcccggcacggcatcaagaagctggatgccagcagcgagaagcagagcgctgaccaccaggccgctgagcagttctgtgccttcttccgcagcctggccgctgagcacggcctgtctgctgagcaggtgtacaatgctgatgaaacaggcctcttctggcgctgcctgcccaaccccaccccagagggcggcgctgtgcccggccccaagcagggcaaggaccggctgactgtgctgatgtgtgccaatgccaccggcagccaccggctgaagcccctggccatcggcaaatgttctggcccccgggccttcaagggcatccagcacctgcctgtggcctacaaggcccagggcaatgcctgggtggacaaggagatcttcagtgactggttccaccacatctttgtgcccagcgtgcgggagcacttccgcaccatcggcctgcctgaggacagcaaggctgtgctgctgctggacagcagccgggcccacccccaggaggccgagctggtgagcagcaatgtgttcaccatcttcctgcctgcctctgtggccagcctggtgcagcccatggagcagggcatccggcgggacttcatgaggaacttcatcaacccccctgtgcccctgcagggcccccacgcccgctacaacatgaatgatgccatcttctctgtggcctgtgcctggaatgctgtgcccagccacgtgttcagaagagcctggaggaagctgtggcccagcgtggcctttgctgagggcagcagcagcgaggaggagctggaggccgagtgcttccctgtgaagccccacaacaagagctttgcccacatcctggagctggtgaaggagggcagcagctgccccggccagctgcggcagaggcaggccgcctcctggggcgtggccggccgggaggccgagggcggccggcccccagctgccaccagccctgctgaggtggtgtggagcagcgagaagacccccaaggctgaccaggacggccgcggggaccctggagagggggaggaggtggcctgggagcaggccgctgtggcctttgatgctgtgctgcgctttgctgagcggcagccctgcttcagcgcccaggaggtgggccagctgcgggccctgcgggctgtgttccgcagccagcagcaggagaccgtgggcctggaggatgtggtggtgaccagccctgaggagctggccatccccaagtgctgcctggaggccagcacagagacctag

SEQ ID NO: 39417 - DNA, 1707 bp, Artificial Sequence
  Description of Artificial Sequence: Synthetic coding sequence
atggccagcaagccagctgctgggaagagcagaggagagaagaggaagagggtggtgctgaccctgaaggagaagattgacatctgcacccggctggagaagggggagagcaggaaggccctgatgcaggagtacaacgtgggcatgagcaccctgtatgacatccgggcccacaaggcccagctgctgcgcttctttgccagcagtgacagcaacaaggccctggagcagaggaggaccctgcacacccccaagctggagcacctggacagagtgctgtatgagtggttcctgggcaagaggtctgagggcgtgcctgtgtctggccccatgctgattgagaaggccaaggacttctatgagcagatgcagctgacagagccctgtgtgttcagcggcggctggctgtggaggttcaaggcccggcacggcatcaagaagctggatgccagcagcgagaagcagagcgctgaccaccaggccgctgagcagttctgtgccttcttccgcagcctggccgctgagcacggcctgtctgctgagcaggtgtacaatgctgatgaaacaggcctcttctggcgctgcctgcccaaccccaccccagagggcggcgctgtgcccggccccaagcagggcaaggaccggctgactgtgctgatgtgtgccaatgccaccggcagccaccggctgaagcccctggccatcggcaaatgttctggcccccgggccttcaagggcatccagcacctgcctgtggcctacaaggcccagggcaatgcctgggtggacaaggagatcttcagtgactggttccaccacatctttgtgcccagcgtgcgggagcacttccgcaccatcggcctgcctgaggacagcaaggctgtgctgctgctggacagcagccgggcccacccccaggaggccgagctggtgagcagcaatgtgttcaccatcttcctgcctgcctctgtggccagcctggtgcagcccatggagcagggcatccggcgggacttcatgaggaacttcatcaacccccctgtgcccctgcagggcccccacgcccgctacaacatgaatgatgccatcttctctgtggcctgtgcctggaatgctgtgcccagccacgtgttcagaagagcctggaggaagctgtggcccagcgtggcctttgctgagggcagcagcagcgaggaggagctggaggccgagtgcttccctgtgaagccccacaacaagagctttgcccacatcctggagctggtgaaggagggcagcagctgccccggccagctgcggcagaggcaggccgcctcctggggcgtggccggccgggaggccgagggcggccggcccccagctgccaccagccctgctgaggtggtgtggagcagcgagaagacccccaaggctgaccaggacggccgcggggaccctggagagggggaggaggtggcctgggagcaggccgctgtggcctttgatgctgtgctgcgctttgctgagcggcagccctgcttcagcgcccaggaggtgggccagctgcgggccctgcgggctgtgttccgcagccagcagcaggtgagaagaagaagaggagccctgggcgctgtggtgaaggtggaggccctgcaggagggccctgggggctgtggggccacagcccagagccccctgccctgcagcagcacagctggggacaactag

SEQ ID NO: 39418 - DNA, 960 bp, Artificial Sequence
  Description of Artificial Sequence: Synthetic coding sequence
atgaagggggagatccagcagagcctgggcgcctgggtgctgctgacctgcctgggcctgtactgtgggaagaccctgctcttcaagaatggcagcacagagatctacggggagtgtggggtgtgcccccggggccagaggaccaatgcccagaagtactgccagccctgcacagagagccctgagctgtatgactggctgtacctgggcttcatggccatgctgcccctggtgctgcactggttcttcatcgagtggtacagcggcaagaagagcagcagcgccctcttccagcacatcacagccctgtttgaatgttccatggccgccatcatcaccctgctggtgtctgaccctgtgggcgtgctgtacatccgcagctgccgggtgctgatgctgagtgactggtacaccatgctgtacaaccccagcccagactatgtgaccaccgtgcactgcacccatgaagctgtgtaccccctgtacaccatcgtgttcatctactatgccttctgcctggtgctgatgatgctgctgcggcccctgctggtgaagaagatcgcctgtggcctgggcaagagtgaccgcttcaagagcatctatgctgccctgtacttcttccccatcctgactgtgctgcaggccgtgggcggcggcctgctgtactatgccttcccctacatcatcctggtgctgagcctggtgaccctggccgtgtacatgtctgccagcgagattgagaactgctatgacctgctggtgaggaagaagaggctcatcgtgctcttcagccactggctgctgcacgcctacggcatcatcagcatcagccgggtggacaagctggagcaggacctgcccctgctggccctggtgcccaccccagccctcttctacctgttcaccgccaagttcacagagcccagccgcatcctgtctgagggcgccaacggccactag

SEQ ID NO: 39419 - DNA, 936 bp, Artificial Sequence
  Description of Artificial Sequence: Synthetic coding sequence
atggctgtggacatccagcctgcctgcctgggcctgtactgtgggaagaccctgctcttcaagaatggcagcacagagatctacggggagtgtggggtgtgcccccggggccagaggaccaatgcccagaagtactgccagccctgcacagagagccctgagctgtatgactggctgtacctgggcttcatggccatgctgcccctggtgctgcactggttcttcatcgagtggtacagcggcaagaagagcagcagcgccctcttccagcacatcacagccctgtttgaatgttccatggccgccatcatcaccctgctggtgtctgaccctgtgggcgtgctgtacatccgcagctgccgggtgctgatgctgagtgactggtacaccatgctgtacaaccccagcccagactatgtgaccaccgtgcactgcacccatgaagctgtgtaccccctgtacaccatcgtgttcatctactatgccttctgcctggtgctgatgatgctgctgcggcccctgctggtgaagaagatcgcctgtggcctgggcaagagtgaccgcttcaagagcatctatgctgccctgtacttcttccccatcctgactgtgctgcaggccgtgggcggcggcctgctgtactatgccttcccctacatcatcctggtgctgagcctggtgaccctggccgtgtacatgtctgccagcgagattgagaactgctatgacctgctggtgaggaagaagaggctcatcgtgctcttcagccactggctgctgcacgcctacggcatcatcagcatcagccgggtggacaagctggagcaggacctgcccctgctggccctggtgcccaccccagccctcttctacctgttcaccgccaagttcacagagcccagccgcatcctgtctgagggcgccaacggccactag

SEQ ID NO: 39420 - DNA, 918 bp, Artificial Sequence
  Description of Artificial Sequence: Synthetic coding sequence
atggcctgcctgggcctgtactgtgggaagaccctgctcttcaagaatggcagcacagagatctacggggagtgtggggtgtgcccccggggccagaggaccaatgcccagaagtactgccagccctgcacagagagccctgagctgtatgactggctgtacctgggcttcatggccatgctgcccctggtgctgcactggttcttcatcgagtggtacagcggcaagaagagcagcagcgccctcttccagcacatcacagccctgtttgaatgttccatggccgccatcatcaccctgctggtgtctgaccctgtgggcgtgctgtacatccgcagctgccgggtgctgatgctgagtgactggtacaccatgctgtacaaccccagcccagactatgtgaccaccgtgcactgcacccatgaagctgtgtaccccctgtacaccatcgtgttcatctactatgccttctgcctggtgctgatgatgctgctgcggcccctgctggtgaagaagatcgcctgtggcctgggcaagagtgaccgcttcaagagcatctatgctgccctgtacttcttccccatcctgactgtgctgcaggccgtgggcggcggcctgctgtactatgccttcccctacatcatcctggtgctgagcctggtgaccctggccgtgtacatgtctgccagcgagattgagaactgctatgacctgctggtgaggaagaagaggctcatcgtgctcttcagccactggctgctgcacgcctacggcatcatcagcatcagccgggtggacaagctggagcaggacctgcccctgctggccctggtgcccaccccagccctcttctacctgttcaccgccaagttcacagagcccagccgcatcctgtctgagggcgccaacggccactag

SEQ ID NO: 39421 - DNA, 1518 bp, Artificial Sequence
  Description of Artificial Sequence: Synthetic coding sequence
atgagccgcagctacaatgatgagctgcagttcctggagaagatcaacaagaactgctggaggatcaagaagggctttgtgcccaacatgcaggtggagggcgtcttctacgtgaatgatgccctggagaagctgatgtttgaggagctgagaaatgcctgccggggcggcggcgtgggcggcttcctgcctgccatgaagcagattggaaatgtggccgccctgcccggcatcgtgcacaggagcatcggcctgcctgatgtgcacagcggctacggctttgccatcggcaacatggccgcctttgacatgaatgaccctgaggccgtggtgtccccaggaggagtgggctttgacatcaactgtggggtgcggctgctgcggaccaacctggatgaaagtgatgtgcagcctgtgaaggagcagctggcccaggccatgtttgaccacatccctgtgggcgtgggcagcaagggcgtcatccccatgaatgccaaggacctggaggaggccctggagatgggcgtggactggagcctgcgggagggctacgcctgggccgaggacaaggagcactgtgaggagtatggccgcatgctgcaggccgaccccaacaaggtgtctgcccgggccaagaagaggggcctgccccagctgggcaccctgggcgccggcaaccactatgcagagatccaggtggtggatgagatcttcaatgaatatgctgccaagaagatgggcatcgaccacaagggccaggtgtgtgtgatgatccacagcggcagccggggcctgggccaccaggtggccacagatgccctggtggccatggagaaggccatgaagagggacaagatcatcgtgaatgaccggcagctggcctgtgcccgcatcgccagccctgagggccaggactacctgaagggcatggctgctgctggcaactatgcctgggtgaacagaagctccatgaccttcctgacccggcaggcctttgccaaggtgttcaacaccaccccagatgacctggacctgcacgtgatctatgatgtgagccacaacatcgccaaggtggagcagcacgtggtggatggcaaggagaggaccctgctggtgcacaggaagggcagcacccgggccttccccccccaccaccccctgattgctgtggactaccagctgaccggccagcctgtgctgattggaggcaccatgggcacctgcagctatgtgctgactggaacagagcagggcatgacagagaccttcggcaccacctgccacggggccggccgggccctgagccgggccaagagcagaagaaacctggacttccaggatgtgctggacaagctggccgacatgggcatcgccatccgggtggccagccccaagctggtgatggaggaggcccctgagagctacaagaatgtgacagatgtggtgaacacctgccatgatgctggcatcagcaagaaggccatcaagctgcggcccatcgctgtgatcaagggctag

SEQ ID NO: 39422 - DNA, 315 bp, Artificial Sequence
  Description of Artificial Sequence: Synthetic coding sequence
atgagctgtgtgccctggaagggggacaaggccaagtctgagagcctggagctgccccaggccgccccaccccagatctaccacgagaagcagaggcgggagctgtgtgccctgcacgccctgaacaacgtgttccaggacagcaatgccttcacccgggacaccctgcaggagatcttccagaggctgagccccaacaccatggtgaccccccacaagaagtccatgctgggcaatggaaattatgatgtgaatgtcatcatggccgccctgcagaccaagggctatgaggccgtgtggtgggacaagaggtag

SEQ ID NO: 39423 - DNA, 189 bp, Artificial Sequence
  Description of Artificial Sequence: Synthetic coding sequence
atgagctgtgtgccctggaagggggacaaggccaagtctgagagcctggagctgccccaggccgccccaccccagatctaccacgagaagcagaggcgggagctgtgtgccctgcacgccctgaacaacgtgttccaggacagcaatgccttcacccgggacaccctgcaggagatcttccagaggtag

SEQ ID NO: 39424 - DNA, 186 bp, Artificial Sequence
  Description of Artificial Sequence: Synthetic coding sequence
atgagctgtgtgccctggaagggggacaaggccaagtctgagagcctggagctgccccaggccgccccaccccagatctaccacgagaagcagaggcgggagctgtgtgccctgcacgccctgaacaacgtgttccaggacagcaatgccttcacccgggacaccctgcaggagatcttccagtag

SEQ ID NO: 39425 - DNA, 627 bp, Artificial Sequence
  Description of Artificial Sequence: Synthetic coding sequence
ggggatgctgagaccccaggctctgtggagcggcggggcagaagaggagcagaagatggcatgagccaggcccctggggcccagcccagccccccaacagtgtaccacgagcggcagaggctggagctgtgtgctgtgcacgccctgaacaacgtgctgcagcagcagctgttcagccaggaggccgcagatgagatctgcaagaggctggccccagacagccggctgaacccccacaggagcctgctgggcactggaaattatgatgtgaatgtcatcatggccgccctgcagggcctgggcctggccgctgtgtggtgggacagaagaagacccctgagccagctggccctgccccaggtgctgggcctcatcctgaacctgcccagccctgtgtccctgggcctgctgagcctgcccctgcggcggcggcactgggtggccctgcggcaggtggatggagtgtactacaacctggacagcaagctgcgggcccctgaggccctgggagatgaagatggagtgcgggccttcctggccgccgccctggcccagggcctgtgtgaggtgctgctggtggtgaccaaggaggtggaggagaagggctcctggctgaggacagactag

SEQ ID NO: 39426 - DNA, 567 bp, Artificial Sequence
  Description of Artificial Sequence: Synthetic coding sequence
atgagccaggcccctggggcccagcccagccccccaacagtgtaccacgagcggcagaggctggagctgtgtgctgtgcacgccctgaacaacgtgctgcagcagcagctgttcagccaggaggccgcagatgagatctgcaagaggctggccccagacagccggctgaacccccacaggagcctgctgggcactggaaattatgatgtgaatgtcatcatggccgccctgcagggcctgggcctggccgctgtgtggtgggacagaagaagacccctgagccagctggccctgccccaggtgctgggcctcatcctgaacctgcccagccctgtgtccctgggcctgctgagcctgcccctgcggcggcggcactgggtggccctgcggcaggtggatggagtgtactacaacctggacagcaagctgcgggcccctgaggccctgggagatgaagatggagtgcgggccttcctggccgccgccctggcccagggcctgtgtgaggtgctgctggtggtgaccaaggaggtggaggagaagggctcctggctgaggacagactag

SEQ ID NO: 39427 - DNA, 441 bp, Artificial Sequence
  Description of Artificial Sequence: Synthetic coding sequence
atgagccaggcccctggggcccagcccagccccccaacagtgtaccacgagcggcagaggctggagctgtgtgctgtgcacgccctgaacaacgtgctgcagcagcagctgttcagccaggaggccgcagatgagatctgcaagaggcccctgagccagctggccctgccccaggtgctgggcctcatcctgaacctgcccagccctgtgtccctgggcctgctgagcctgcccctgcggcggcggcactgggtggccctgcggcaggtggatggagtgtactacaacctggacagcaagctgcgggcccctgaggccctgggagatgaagatggagtgcgggccttcctggccgccgccctggcccagggcctgtgtgaggtgctgctggtggtgaccaaggaggtggaggagaagggctcctggctgaggacagactag

SEQ ID NO: 39428 - DNA, 567 bp, Artificial Sequence; identical to SEQ ID NO: 39426
  Description of Artificial Sequence: Synthetic coding sequence

SEQ ID NO: 39429 - DNA, 1392 bp, Artificial Sequence
  Description of Artificial Sequence: Synthetic coding sequence
atgagagctggccctgagccccaggccctggccggccagaagagaggagccctgcggctgctggtgccccggctggtgctgactgtgtctgccccagctgaggtgagaagaagagtgctgcggcctgtgctgtcctggatggaccgggagacccgggccctggccgacagccacttccggggcctgggcgtggatgtgcctggggtgggccaggcccctggccgggtggcctttgtgtctgagcccggggccttctcctatgctgactttgtgcggggcttcctgctgcccaacctgccctgtgtgttcagcagcgccttcacccagggctggggcagcagaagacgctgggtgaccccagctggccgcccagactttgaccacctgctgcggacctatggagatgtggtggtgcctgtggccaactgtggggtgcaggagtacaacagcaaccccaaggagcacatgaccctgcgggactacatcacctactggaaggagtacatccaggccggctacagcagcccccggggctgcctgtacctgaaggactggcacctgtgccgggacttccctgtggaggatgtgttcaccctgcctgtgtacttcagcagtgactggctgaatgagttctgggatgccctggatgtggatgactacagatttgtgtatgccggccctgctggctcctggagccccttccacgccgacatcttccgctccttctcctggagcgtgaatgtgtgtggcaggaagaagtggctgctcttccccccaggccaggaggaggccctgcgggacagacatggcaacctgccctatgatgtgaccagccctgccctgtgtgacacccacctgcaccccaggaaccagctggccggcccccccctggagatcacccaggaggccggggagatggtgtttgtgcccagcggctggcaccaccaggtgcacaacctggatgacaccatcagcatcaaccacaactgggtgaatggcttcaacctggccaacatgtggaggttcctgcagcaggagctgtgtgctgtgcaggaggaggtgtctgagtggagggacagcatgccagactggcaccaccactgccaggtgatcatgaggagctgcagcggcatcaactttgaggagttctaccacttcctgaaggtgattgctgagaagaggctgctggtgctgcgggaggccgctgctgaagatggagctggcctgggctttgagcaggccgcctttgatgtgggccgcatcacagaggtgctggccagcctggtggcccacccagacttccagagggtggacaccagcgccttcagcccccagcccaaggagctgctgcagcagctgcgggaggccgtggatgctgctgctgccccctag

SEQ ID NO: 39430 - DNA, 1323 bp, Artificial Sequence
  Description of Artificial Sequence: Synthetic coding sequence
tgagccctggccggccagaagagaggagccctgcggctgctggtgccccggctggtgctgactgtgtctgccccagctgaggtgagaagaagagtgctgcggcctgtgctgtcctggatggaccgggagacccgggccctggccgacagccacttccggggcctgggcgtggatgtgcctggggtgggccaggcccctggccgggtggcctttgtgtctgagcccggggccttctcctatgctgactttgtgcggggcttcctgctgcccaacctgccctgtgtgttcagcagcgccttcacccagggctggggcagcagaagacgctgggtgaccccagctggccgcccagactttgaccacctgctgcggacctatggagatgtggtggtgcctgtggccaactgtggggtgcaggagtacaacagcaaccccaaggagcacatgaccctgcgggactacatcacctactggaaggagtacatccaggccggctacagcagcccccggggctgcctgtacctgaaggactggcacctgtgccgggacttccctgtggaggatgtgttcaccctgcctgtgtacttcagcagtgactggctgaatgagttctgggatgccctggatgtggatgactacagatttgtgtatgccggccctgctggctcctggagccccttccacgccgacatcttccgctccttctcctggagcgtgaatgtgtgtggcaggaagaagtggctgctcttccccccaggccaggaggaggccctgcgggacagacatggcaacctgccctatgatgtgaccagccctgccctgtgtgacacccacctgcaccccaggaaccagctggccggcccccccctggagatcacccaggaggccggggagatggtgtttgtgcccagcggctggcaccaccaggtgcacaacctggatgacaccatcagcatcaaccacaactgggtgaatggcttcaacctggccaacatgtggaggttcctgcagcaggagctgtgtgctgtgcaggaggaggtgatcatgaggagctgcagcggcatcaactttgaggagttctaccacttcctgaaggtgattgctgagaagaggctgctggtgctgcgggaggccgctgctgaagatggagctggcctgggctttgagcaggccgcctttgatgtgggccgcatcacagaggtgctggccagcctggtggcccacccagacttccagagggtggacaccagcgccttcagcccccagcccaaggagctgctgcagcagctgcgggaggccgtggatgctgctgctgccccctag

SEQ ID NO: 39431 - DNA, 951 bp, Artificial Sequence
  Description of Artificial Sequence: Synthetic coding sequence
atggccgaggccgccctggaggccgtgcgctctgagctgcgggagttccctgctgctgcccgggagctgtgtgtgcccctggccgtgccctacctggacaagccacccacccccctgcacttctacagagactgggtgtgccccaaccggccctgcatcatcagaaatgccctgcagcactggccagccctgcagaagtggagcctgccctacttccgggccaccgtgggcagcacagaggtgtctgtggccgtgaccccagatggctatgcagatgctgtgcggggggaccgcttcatgatgcctgctgagcggcggctgcccctgagctttgtgctggatgtgctggagggccgggcccagcaccctggggtgctgtatgtgcagaagcagtgcagcaacctgcccagcgagctgccccagctgctgcctgacctggagagccacgtgccctgggccagcgaggccctgggcaagatgccagatgctgtgaacttctggctgggggaggccgctgctgtgaccagcctgcacaaggaccactatgaaaatctctactgtgtggtgtctggagagaagcacttcctgttccaccccccaagtgaccggcccttcatcccctatgagctgtacaccccagccacctaccagctgacagaggagggcaccttcaaggtggtggatgaggaggccatggagaaggtgccctggatccccctggaccccctggccccagacctggcccgctaccccagctacagccaggcccaggccctgcgctgcaccgtgcgggccggggagatgctgtacctgcctgccctgtggttccaccacgtgcagcagagccagggctgcatcgctgtgaacttctggtatgacatggagtatgacctgaagtacagctacttccagctgctggacagcctgaccaaggccagcggcctggactag

SEQ ID NO: 39432 - DNA, 1005 bp, Artificial Sequence
  Description of Artificial Sequence: Synthetic coding sequence
atggtgactggaggagcccacagccgcagccggggcggcctgcccagcgccagcagaagaggcctcttccggggcggccccaaggaggtgaccagcggcgtgcggcccggcagccggcccctgccccggcggcgcagctgccggcccatggccggcggctgggcccagggcagcagaagagctgcccggctgcctgagggcggccgcctgatggccccagccagccggctgctggccctgtgggccctggccgctgtggccctgcccggcagcggggctgaaggagatggcggctggaggcctgggggccctggagctgtggccgaggaggagcgctgcaccgtggagaggagagctgacctgacctacgccgagtttgtgcagcagtatgcctttgtgcggcctgtgatcctgcagggcctgacagacaacagccgcttccgggccctgtgcagccgggaccggctgctggccagctttggagacagagtggtgcggctgagcacagccaacacctacagctaccacaaggtggacctgcccttccaggagtatgtggagcagctgctgcacccccaggaccccaccagcctgggcaatgacaccctgtacttcttcggggacaacaacttcacagagtgggccagcctcttccgccactacagccccccacccttcggcctgctgggcacagccccagcctacagctttggaattgctggggccggcagcggcgtgcccttccactggcacggccctggctacagcgaggtgatctacggcaggaagcgctggttcctgtacccacctgagaagaccccagagttccaccccaacaagaccaccctggcctggctgcgggacacctacccagccctgccccccagcgcccggcccctggagtgcaccatccgggccggggaggtgctgtacttcccagaccgctggtggcacgccaccctgaacctggacaccagcgtcttcatcagcaccttcctgggctag

SEQ ID NO: 39433 - DNA, 858 bp, Artificial Sequence
  Description of Artificial Sequence: Synthetic coding sequence
atggccggcggctgggcccagggcagccggcgggccgcccggctgcctgagggcggccgcctgatggccccagccagccggctgctggccctgtgggccctggccgctgtggccctgcccggcagcggggctgaaggagatggcggctggaggcctgggggccctggagctgtggccgaggaggagcgctgcaccgtggagcggcgggctgacctgacctatgcagagtttgtgcagcagtatgcctttgtgcggcctgtgatcctgcagggcctgacagacaacagccgcttccgggccctgtgcagccgggaccggctgctggccagctttggagacagagtggtgcggctgagcacagccaacacctacagctaccacaaggtggacctgcccttccaggagtatgtggagcagctgctgcacccccaggaccccaccagcctgggcaatgacaccctgtacttctttggagacaacaacttcacagagtgggccagcctcttccgccactacagccccccaccatttggcctgctgggcacagccccagcctacagctttggaattgctggagctggcagcggcgtgcccttccactggcacggccctggctacagcgaggtgatctacggcaggaagcgctggttcctgtacccacctgagaagaccccagagttccaccccaacaagaccaccctggcctggctgcgggacacctacccagccctgcccccatctgcccggcccctggagtgcaccatccgggccggggaggtgctgtacttcccagaccgctggtggcacgccaccctgaacctggacacctctgtgttcatcagcaccttcctgggctag

SEQ ID NO: 39434 - DNA, 915 bp, Artificial Sequence
  Description of Artificial Sequence: Synthetic coding sequence
atggtgactggaggagcccacagccgcagccggggcggcctgcccagcgccagcagaagaggcctcttccggggcggccccaaggaggtgaccagcggcgtgcggcccggcagccggcccctgccccggcggcgcagctgccggcccatggccggcggctgggcccagggcagcagaagagctgcccggctgcctgagggcggccgcctgatggccccagccagccggctgctggccctgtgggccctggccgctgtggccctgcccggcagcggggctgaaggagatggcggctggtacgcctttgtgcggcctgtgatcctgcagggcctgacagacaacagccgcttccgggccctgtgcagccgggaccggctgctggccagctttggagacagagtggtgcggctgagcacagccaacacctacagctaccacaaggtggacctgcccttccaggagtatgtggagcagctgctgcacccccaggaccccaccagcctgggcaatgacaccctgtacttcttcggggacaacaacttcacagagtgggccagcctcttccgccactacagccccccacccttcggcctgctgggcacagccccagcctacagctttggaattgctggggccggcagcggcgtgcccttccactggcacggccctggctacagcgaggtgatctacggcaggaagcgctggttcctgtacccacctgagaagaccccagagttccaccccaacaagaccaccctggcctggctgcgggacacctacccagccctgccccccagcgcccggcccctggagtgcaccatccgggccggggaggtgctgtacttcccagaccgctggtggcacgccaccctgaacctggacaccagcgtcttcatcagcaccttcctgggctag

SEQ ID NO: 39435 - DNA, 2238 bp, Artificial Sequence
  Description of Artificial Sequence: Synthetic coding sequence
atggaggtgatgaacctgatggagcagcccatcaaggtgacagagtggcagcagacctacacctatgacagcggcatccacagcggggccaacacctgtgtgcccagcgtgagcagcaagggcatcatggaggaggatgaggcctgtggccggcagtacaccctgaagaagaccaccacctacacccagggcgtgccccccagccagggcgacctggagtaccagatgagcaccacagcccgggccaagagggtgcgggaggccatgtgccctggggtgtctggagaggacagcagcctgctgctggccacccaggtggagggccaggccaccaacctgcagaggctggccgagcccagccagctgctgaagagcgccatcgtgcacctgatcaactaccaggatgatgctgagctggccacccgggccctgcctgagctgaccaagctgctgaatgatgaggaccctgtggtggtgaccaaggccgccatgattgtgaaccagctgagcaagaaggaggccagccggcgggccctgatgggcagcccccagctggtggccgctgtggtgaggaccatgcagaacaccagtgacctggacacagcccgctgcaccaccagcatcctgcacaacctgagccaccaccgggagggcctgctggccatcttcaagagcggcggcatcccagccctggtgaggatgctgagcagccctgtggagagcgtgctcttctacgccatcaccaccctgcacaacctgctgctgtaccaggagggcgccaagatggctgtgcggctggctgatggcctgcagaagatggtgcccctgctgaacaagaacaaccccaagttcctggccatcaccacagactgcctgcagctgctggcctacggcaaccaggagagcaagctgatcatcctggccaatggaggcccccaggccctggtgcagatcatgaggaactacagctatgagaagctgctgtggaccaccagccgggtgctgaaggtgctgtctgtgtgccccagcaacaagccagccatcgtggaggccggcggcatgcaggccctgggcaagcacctgaccagcaacagcccccggctggtgcagaactgcctgtggaccctgaggaacctgagtgatgtggccaccaagcaggagggcctggagagcgtgctgaagatcctggtgaaccagctgtctgtggatgatgtgaatgtgctgacctgtgccaccggcaccctgagcaacctgacctgcaacaacagcaagaacaagaccctggtgacccagaacagcggcgtggaggccctgatccacgccatcctgcgggccggggacaaggatgacatcacagagcctgctgtgtgtgccctgcggcacctgaccagccgccaccctgaggccgagatggcccagaacagcgtgcggctgaactacggcatcccagccatcgtgaagctgctgaaccagcccaaccagtggcccctggtgaaggccaccatcggcctcatccggaacctggccctgtgcccagccaaccacgcccccctgcaggaggccgccgtcatcccccggctggtgcagctgctggtgaaggcccaccaggatgcccagagacatgtggccgccggcacccagcagccctacacagatggagtgaggatggaggagatcgtggagggctgcaccggggccctgcacatcctggcccgggaccccatgaacaggatggagatcttccggctgaacaccatccccctgtttgtgcagctgctgtacagctctgtggagaacatccagagggtggccgccggcgtgctgtgtgagctggcccaggacaaggaggccgcagatgccattgatgctgagggcgccagcgcccccctgatggagctgctgcacagcagaaatgaaggaacagccacctatgctgctgctgtgctcttccgcatcagcgaggacaagaacccagactacaggaagagggtgtctgtggagctgaccaacagcctcttcaagcatgaccctgctgcctgggaggccgcccagagcatgatccccatcaatgagccctatggagatgacatggatgccacctaccggcccatgtacagcagtgatgtgcccctggaccccctggagatgcacatggacatggatggagactaccccatcgacacctacagtgatggcctgcggcccccctaccccacagctgaccacatgctggcctag

SEQ ID NO: 39436 - DNA, 2238 bp, Artificial Sequence; identical to SEQ ID NO: 39435
  Description of Artificial Sequence: Synthetic coding sequence

SEQ ID NO: 39437 - DNA, 1890 bp, Artificial Sequence
  Description of Artificial Sequence: Synthetic coding sequence
atgcacgtgcctgggggcaagtttgattttgatgatggcggctgctacgtgggcggctgggaggccggccgggcccacggctacggcgtgtgcaccggccctggggcccagggcgagtacagcggctgctgggcccacggctttgagagcctgggcgtcttcaccggccctgggggccacagctaccagggccactggcagcagggcaagcgggagggcctgggcgtggagaggaagagccgctggacctacagaggagagtggctgggcggcctgaagggccgcagcggcgtgtgggagagcgtgtctggcctgcgctatgccggcctgtggaaggatggcttccaggacggctatggaacagagacctacagtgatggcggcacctaccagggccagtggcaggccggcaagagacatggctacggcgtgcggcagagcgtgccctaccaccaggccgccctgctgcggagccccaggaggaccagcctggacagcggccacagcgacccccccaccccacctccacccctgcccctgcctggagatgaaggaggcagccctgccagcggcagccggggcggctttgtgctggccggccctggagatgctgatggagccagcagcaggaagaggaccccagctgctgggggcttcttcagaagaagcctgctgctgagcggcctgcgggccggcggccgccgcagcagcctgggcagcaagaggggcagcctgcggtctgaggtgtcctctgaggtgggcagcacaggccccccaggcagcgaggccagcggccccccagctgctgcccccccagccctgattgagggcagcgccacagaggtgtatgctggggagtggagggctgacagaagaagtggctttggagtgtcccagaggagcaatggcctgcgctatgaaggagagtggctgggcaacagaagacatggctacggccgcaccaccaggccagatggcagccgggaggagggcaagtacaagaggaaccggctggtgcacggcggccgggtgcgcagcctgctgcccctggccctgcggcggggcaaggtgaaggagaaggtggacagagctgtggagggcgccaggagagctgtgtctgctgcccggcagaggcaggagattgctgctgcccgggctgctgatgccctgctgaaggctgtggccgccagctctgtggccgagaaggctgtggaggccgccaggatggccaagctgattgcccaggacctgcagcccatgctggaggcccctggccggcggccccggcaggacagcgagggcagtgacacagagcccctggatgaggacagccctggggtgtatgaaaatggcctgaccccatctgagggcagccctgagctgcccagcagccctgccagcagccggcagccctggaggcccccagcctgccgcagccccctgcccccaggaggagaccagggccccttcagcagccccaaggcctggccagaggagtggggcggggccggggcccaggccgaggagctggccggctatgaagcagaagatgaagctggcatgcagggccctggccccagagatggcagccccctgctgggcggctgcagcgacagcagcggcagcctgcgggaggaggagggagaagatgaggagcccctgccccccctgcgggccccagctggaacagagcctgagcccatcgccatgctggtgctgcggggcagcagcagccggggcccagatgctggctgcctgacagaggagctgggggagcctgctgccacagagaggcctgcccagcccggggccgccaaccccctggtggtgggcgctgtggccctgctggacctgagcctggccttcctgttcagccagctgctgacctag

SEQ ID NO: 39438 - DNA, 1590 bp, Artificial Sequence
  Description of Artificial Sequence: Synthetic coding sequence
atgagcaccaatgaaaatgccaacaccccagctgcccggctgcaccgcttcaagaacaagggcaaggacagcacagagatgagaagaagacgcatcgaggtgaatgtggagctgaggaaggccaagaaggatgaccagatgctgaagagaagaaatgtgtcctccttcccagatgatgccaccagccccctgcaggagaacagaaacaaccagggcaccgtgaactggagcgtggatgacatcgtgaagggcatcaacagcagcaatgtggagaaccagctgcaggccacccaggccgccaggaagctgctgagccgggagaagcagccccccatcgacaacatcatccgggccggcctcatccccaagtttgtgtccttcctgggccgcacagactgcagccccatccagtttgagagcgcctgggccctgaccaacatcgccagcggcaccagcgagcagaccaaggctgtggtggatggaggagccatcccagccttcatcagcctgctggccagcccccacgcccacatcagcgagcaggccgtgtgggccctgggcaacattgctggagatggcagcgtcttccgggacctggtgatcaagtatggagctgtggaccccctgctggccctgctggccgtgcctgacatgagcagcctggcctgtggctacctgaggaacctgacctggaccctgagcaacctgtgcaggaacaagaacccagccccacccattgatgctgtggagcagatcctgcccaccctggtgcggctgctgcaccatgatgatcctgaggtgctggccgacacctgctgggccatctcctacctgacagatggccccaatgaaagaattggcatggtggtgaagacaggagtggtgccccagctggtgaagctgctgggcgccagcgagctgcccatcgtgaccccagccctgcgggccatcggcaacatcgtgactggaacagatgagcagacccaggtggtgattgatgctggggccctggccgtgttccccagcctgctgaccaaccccaagaccaacatccagaaggaggccacctggaccatgagcaacatcacagctggccggcaggaccagatccagcaggtggtgaaccacggcctggtgcccttcctggtgtctgtgctgagcaaggctgacttcaagacccagaaggaggccgtgtgggccgtgaccaactacaccagcggcggcaccgtggagcagatcgtgtacctggtgcactgcggcatcatcgagcccctgatgaacctgctgacagccaaggacaccaagatcatcctggtgatcctggatgccatcagcaacatcttccaggccgctgagaagctgggggagacagagaagctgagcatcatgattgaggagtgtggcggcctggacaagattgaggccctgcagaaccatgaaaatgaatctgtgtacaaggccagcctgagcctcatcgagaagtacttctctgtggaggaggaggaggaccagaatgtggtgcctgagaccaccagcgagggctacaccttccaggtgcaggatggagcccctggcaccttcaacttctag

SEQ ID NO: 39439 - DNA, 459 bp, Artificial Sequence
  Description of Artificial Sequence: Synthetic coding sequence
atgagggagaagctgatccggctgcagagcctgtacatcgaccagttcaagaggctgcagcacctgctgaaggagaagaagaggcgctacctgcacaacaggaaggtggagcacgaggccctgggcagcagcctgctgactggacctgagggcctgctggccaaggagcgggagaacctgaagaggctgaagtgcctgcggcgctaccggcagagatatggagtggaggccctgctgcaccggcagctgaaggagaggaggatgctggccacagatggagctgcccagcaggcccacaccaccaggagcagccagcgctgcctggcctttgtggatgatgtgcgctgcagcaaccagagcctgcccatgaccaggcactgcctgacccagaaggatgccacagccatcggggacctgctgaccctgtactgcggcctgatggagacagccctggactag

SEQ ID NO: 39440 - DNA, 1479 bp, Artificial Sequence
  Description of Artificial Sequence: Synthetic coding sequence
atgaaccgcatccgcatccacgtgctgcccaccaacagaggccgcatcacccctgtgcccaggagccaggagcccctgagctgtgccttcacccaccggccctgcagccacccccggctggagggccaggagttctgcatcaagcacatcctggaggacaagaatgcccccttcaagcagtgcagctacatcagcaccaagaatggcaagcgctgccccaatgctgcccccaagccagagaagaaggatggagtgtccttctgtgccgagcacgtgagaagaaatgccctggccctgcacgcccagatgaagaagaccaaccctggccctgtgggggagaccctgctgtgccagctgagcagctatgccaagacagagctgggcagccagaccccagagagcagccgctctgaggccagccgcatcctggatgaagattcctggagcgatggagagcaggagcccatcaccgtggaccagacctggaggggggaccctgacagcgaggccgacagcattgacagcgaccaggaggaccccctgaagcacgccggcgtgtacacagctgaggaggtggccctgatcatgagggagaagctgatccggctgcagagcctgtacatcgaccagttcaagaggctgcagcacctgctgaaggagaagaagaggcgctacctgcacaacaggaaggtggagcacgaggccctgggcagcagcctgctgaccggccctgagggcctgctggccaaggagcgggagaacctgaagaggctgaagtgcctgcggcgctaccggcagagatatggagtggaggccctgctgcaccggcagctgaaggagaggaggatgctggccacagatggagctgcccagcaggcccacaccaccaggagcagccagcgctgcctggcctttgtggatgatgtgcgctgcagcaaccagagcctgcccatgaccaggcactgcctgacccacatctgccaggacaccaaccaggtgctcttcaagtgctgccagggcagcgaggaggtgccctgcaacaagcctgtgcctgtgtccctgtctgaggacccctgctgccccctgcacttccagctgcccccccagatgtacaagccagagcaggtgctgtctgtgcctgatgacctggaggccggccccatggacctgtacctgtctgctgctgagctgcagcccacagagagcctgcccctggagttcagtgatgacctggatgtggtgggagatggcatgcagtgcccccccagccccctgctgtttgaccccagcctgaccctggaggaccacctggtgaaggagattgctgaagatcctgtggacatcctgggccagatgcagatggctggagatggctgccgcagccagggcagcagaaattctgagaaggccagcgcccccctgagccagagcggcctggccacagccaacgggaagccagagcccaccagcatctcctag

SEQ ID NO: 39441 - DNA, 210 bp, Artificial Sequence
  Description of Artificial Sequence: Synthetic coding sequence
atgaaccgcatccgcatccacgtgctgcccaccaacagaggccgcatcacccctgtgcccaggagccaggagcccctgagctgtgccttcacccaccggccctgcagccacccccggctggagggccaggagttctgcatcaagcacatcctggaggacaagaatgcccccttcaagcagtgcagctacatcagcaccaagaatggatag

SEQ ID NO: 39442 - DNA, 2376 bp, Artificial Sequence
  Description of Artificial Sequence: Synthetic coding sequence
atgcccctgtatgacaaccagaaggcccggtctgtgatgaatgaatgtgaaagacatgtgatctttgccaggacagatgctgatgcccctcctcctcctgaggactgggaggagcacgtgaacagaacaggctggaccatggcccagaacaagctgttcaacaagatcctgaaggccctgcagagcgaccggctggcccggctggccaatgaaggagcctgcaatgaacctgtgctgcggcgggtggccgtggacaagtgtgccaggagagtgcggcaggccctggcctctgtgtcctgggacaccaagctgatccagtggctgcacaccaccctggtggagaccctgagcctgcccatgctggccgcctacctggatgccctgcagaccctgaagggcaagatccccaccctgattgacaggatgctggtgagcagcaacaccaagacaggagctgctggagctgaggccctgagcctgctgctgaagaggccctgggaccctgctgtgggcgtgctgagccacaacaagcccagcaagctgcccggcagccccctcatcctgattgccagcagcggccccagcagctctgtgttccccaccagcagaagacaccgcttctggcagagccagctgagctgcctgggcaaggtgattcctgtggccacccacctgctgaacaacggcagcggcgtgggcgtgctgcagtgcctggagcacatgattggagctgtgcgcagcaaggtgctggagatccacagccacttcccccacaagcccatcatcctgattggctggaacacaggagccctggtggcctgccacgtgtctgtgatggagtatgtgacagctgtggtgtgcctgggcttccccctgctgactgtggatggccccagaggagatgtggatgaccccctgctggacatgaagacccctgtgctgtttgtgattggccagaacagcctgcagtgccaccctgaggccatggaggacttccgggagaagatccgggcagagaacagcctggtggtggtgggcggcgcagatgacaacctgcgcatcagcaaggccaagaagaagtctgagggcctgacccagagcatggtggaccgctgcatccaggatgaaattgtggacttcctgactggagtgctgaccagggctgagggccacatgggcagcgagccccgggaccaggatgctgagaagaagaagaagcccagagatgtggcccggcgggacctggcctttgaggtgcctgagcggggcagcaggcctgccagccctgctgccaagctgcctgccagccccagcggcagcgaggacctgagctctgtgagcagcagccccaccagcagccccaagaccaaggtgaccaccgtgaccagcgcccagaagagcagccagatcggcagcagccagctgctgaagagacatgtgcagaggacagaagctgtgctgacccacaagcaggcccaggtgcccatcagcagcgagcccccagaggagggggagaaggaggacctgcgggtgcagctgaagaggcaccaccccagcagccccctgcccggcagcaagaccagcaagaggcccaagatcaaggtgtccctcatcagccagggcgacacagctgggggcccctgtgcccccagccagggcagcgcccctgaggccgccggcggcaagcccatcaccatgaccctgggccaggccagcgctggggccaaggagctgaccggcctgctgaccacagccaagagcagcagcagcgagggcggcgtgtctgccagccctgtgcccagcgtggtgagcagcagcacagcccccagcgccctgcacaccctgcagagccggctggtggccaccagccctggcagcagcctgcccggggccaccagcgccagcagcctgctgcagggcctgtccttcagcctgcaggacatcagcagcaagaccagcggcctgcctgccaaccccagccctggccctgccccccaggccacctctgtgaagctgcccacccccatgcagagcctgggcgccatcaccaccggcaccagcaccatcgtgaggaccatccctgtggccaccaccctgagcagcctgggcgccacccctgggggcaagcccacagccatccaccagctgctgaccaatggaggcctggccaagctggccagcagcctgcccggcctggcccagatcagcaaccaggccagcggcctgaaggtgcccaccaccatcaccctgaccctgcggggccagcccagccgcatcaccaccctgagccccatgggcagcggggccgcccccagcgaggagagcagcagccaggtgctgcccagcagcagccagaggctgcccccagccccctag

SEQ ID NO: 39443 - DNA, 2637 bp, Artificial Sequence
  Description of Artificial Sequence: Synthetic coding sequence
atggcccacagaggaggagagcgggacttccagaccagcgcccggaggatgggcaccagcctgctcttccagctgtctgtgcatgagcgggagctggacctggtgttcctggaccacagctatgccaagccctggagcgcccacccagatgccagcagcgcccggcccaccaggatgctgtttgtgaccccccggcggcagcacgagagcaccatcgagagtgatgtgcccattgatgtggagaccgtgaccagcacccccatgcccctgtatgacaaccagaaggcccggtctgtgatgaatgaatgtgagcggcacgtgatctttgccaggacagatgctgatgcccctcctcctcctgaggactgggaggagcacgtgaacagaacaggctggaccatggcccagaacaagctgttcaacaagatcctgaaggccctgcagagcgaccggctggcccggctggccaatgaaggagcctgcaatgaacctgtgctgcggcgggtggccgtggacaagtgtgcccggcgggtgcggcaggccctggcctctgtgtcctgggacaccaagctgatccagtggctgcacaccaccctggtggagaccctgagcctgcccatgctggccgcctacctggatgccctgcagaccctgaagggcaagatccccaccctgattgacaggatgctggtgagcagcaacaccaagacaggagctgctggagctgaggccctgagcctgctgctgaagaggccctgggaccctgctgtgggcgtgctgagccacaacaagcccagcaagctgcccggcagccccctcatcctgattgccagcagcggccccagcagcagcgtcttccccaccagccgccgccaccgcttctggcagagccagctgagctgcctgggcaaggtgattcctgtggccacccacctgctgaacaatggaagtggagtgggcgtgctgcagtgcctggagcacatgattggagctgtgcgcagcaaggtgctggagatccacagccacttcccccacaagcccatcatcctgattggctggaacacaggagccctggtggcctgccacgtgtctgtgatggagtatgtgacagctgtggtgtgcctgggcttccccctgctgactgtggatggccccagaggagatgtggatgaccccctgctggacatgaagacccctgtgctcttcgtcatcggccagaacagcctgcagtgccaccctgaggccatggaggacttccgggagaagatccgggcagagaacagcctggtggtggtgggcggcgcagatgacaacctgcgcatcagcaaggccaagaagaagtctgagggcctgacccagagcatggtggaccgctgcatccaggatgagatcgtggacttcctgactggagtgctgaccagggctgagggccacatgggcagcgagccccgggaccaggatgctgagaagaagaagaagcccagagatgtggcccggcgggacctggcctttgaggtgcctgagcggggcagcaggcctgccagccctgctgccaagctgcctgccagccccagcggcagcgaggacctgagctctgtgagcagcagccccaccagcagccccaagaccaaggtgaccaccgtgaccagcgcccagaagagcagccagatcggcagcagccagctgctgaagagacatgtgcagaggacagaggccgtgctgacccacaagcaggcccaggtgcccatcagcagcgagcccccagaggagggggagaaggaggacctgcgggtgcagctgaagaggcaccaccccagcagccccctgcccggcagcaagaccagcaagaggcccaagatcaaggtgtccctcatcagccagggcgacacagctgggggcccctgtgcccccagccagggcagcgcccctgaggccgccggcggcaagcccatcaccatgaccctgggccaggccagcgctggggccaaggagctgaccggcctgctgaccacagccaagagcagcagcagcgagggcggcgtgtctgccagccctgtgcccagcgtggtgagcagcagcacagcccccagcgccctgcacaccctgcagagccggctggtggccaccagccctggcagcagcctgcccggggccaccagcgccagcagcctgctgcagggcctgtccttcagcctgcaggacatcagcagcaagaccagcggcctgcctgccaaccccagccctggccctgccccccaggccacctctgtgaagctgcccacccccatgcagagcctgggcgccatcaccaccggcaccagcaccatcgtgaggaccatccctgtggccaccaccctgagcagcctgggcgccaccccaggcggcaagcccacagccatccaccagctgctgaccaacggcggcctggccaagctggccagcagcctgcccggcctggcccagatcagcaaccaggccagcggcctgaaggtgcccaccaccatcaccctgaccctgcggggccagcccagccgcatcaccaccctgagccccatgggcagcggggccgcccccagcgaggagagcagcagccaggtgctgcccagcagcagccagaggctgcccccagccccctag

SEQ ID NO: 39444 - DNA, 426 bp, Artificial Sequence
  Description of Artificial Sequence: Synthetic coding sequence
atgcccctgtatgacaaccagaaggcccggtctgtgatgaatgaatgtgaaagacatgtgatctttgccaggacagatgctgatgcccctcctcctcctgaggactgggaggagcacgtgaacagaacaggctggaccatggcccagaacaagctgttcaacaagatcctgaaggccctgcagagcgaccggctggcccggctggccaatgaaggagcctgcaatgaacctgtgctgcggcgggtggccgtggacaagtgtgccaggagagtgcggcaggccctggcctctgtgtcctgggacaccaagctgatccagtggctgcacaccaccctggtggagaccctgagcctgcccatgctggccgcctacctggatgccctgcagaccctgaagggcaaggtgatcctgaccttctgtggctag

SEQ ID NO: 39445 - DNA, 1593 bp, Artificial Sequence
  Description of Artificial Sequence: Synthetic coding sequence
atgcccctgtatgacaaccagaaggcccggtctgtgatgaatgaatgtgaaagacatgtgatctttgccaggacagatgctgatgcccctcctcctcctgaggactgggaggagcacgtgaacagaacaggctggaccatggcccagaacaagctgttcaacaagatcctgaaggccctgcagagcgaccggctggcccggctggccaatgaaggagcctgcaatgaacctgtgctgcggcgggtggccgtggacaagtgtgccaggagagtgcggcaggccctggcctctgtgtcctgggacaccaagctgatccagtggctgcacaccaccctggtggagaccctgagcctgcccatgctggccgcctacctggatgccctgcagaccctgaagggcaagatccccaccctgattgacaggatgctggtgagcagcaacaccaagacaggagctgctggagctgaggccctgagcctgctgctgaagaggccctgggaccctgctgtgggcgtgctgagccacaacaagcccagcaagctgcccggcagccccctcatcctgattgccagcagcggccccagcagctctgtgttccccaccagcagaagacaccgcttctggcagagccagctgagctgcctgggcaaggtgattcctgtggccacccacctgctgaacaacggcagcggcgtgggcgtgctgcagtgcctggagcacatgattggagctgtgcgcagcaaggtgctggagatccacagccacttcccccacaagcccatcatcctgattggctggaacacaggagccctggtggcctgccacgtgtctgtgatggagtatgtgacagctgtggtgtgcctgggcttccccctgctgactgtggatggccccagaggagatgtggatgaccccctgctggacatgaagacccctgtgctgtttgtgattggccagaacagcctgcagtgccaccctgaggccatggaggacttccgggagaagatccgggcagagaacagcctggtggtggtgggcggcgcagatgacaacctgcgcatcagcaaggccaagaagaagtctgagggcctgacccagagcatggtggaccgctgcatccaggatgaaattgtggacttcctgactggagtgctgaccagggctgagggccacatgggcagcgagccccgggaccaggatgctgagaagaagaagaagcccagagatgtggcccggcgggacctggcctttgaggtgcctgagcggggcagcaggcctgccagccctgctgccaagctgcctgccagccccagcggcagcgaggacctgagctctgtgagcagcagccccaccagcagccccaagaccaaggtgaccaccgtgaccagcgcccagaagagcagccagatcggcagcagccagctgctgaagagacatgtgcagaggacagaagctgtgctgacccacaagcaggcccaggtgcccatcagcagcgagcccccagaggagggggagaaggaggacctgcgggtgcagctgaagaggcaccaccccagcacccccctgcctgtgtacagctggttccaccactag

SEQ ID NO: 39446 - DNA, 2295 bp, Artificial Sequence
  Description of Artificial Sequence: Synthetic coding sequence
atgaccctgccccactgccaccggctgatgctgacccaccacctgttctggacaggctggaccatggcccagaacaagctgttcaacaagatcctgaaggccctgcagagcgaccggctggcccggctggccaatgaaggagcctgcaatgaacctgtgctgcggcgggtggccgtggacaagtgtgcccggcgggtgcggcaggccctggcctctgtgtcctgggacaccaagctgatccagtggctgcacaccaccctggtggagaccctgagcctgcccatgctggccgcctacctggatgccctgcagaccctgaagggcaagatccccaccctgattgacaggatgctggtgagcagcaacaccaagacaggagctgctggagctgaggccctgagcctgctgctgaagaggccctgggaccctgctgtgggcgtgctgagccacaacaagcccagcaagctgcccggcagccccctcatcctgattgccagcagcggccccagcagcagcgtcttccccaccagccgccgccaccgcttctggcagagccagctgagctgcctgggcaaggtgattcctgtggccacccacctgctgaacaatggaagtggagtgggcgtgctgcagtgcctggagcacatgattggagctgtgcgcagcaaggtgctggagatccacagccacttcccccacaagcccatcatcctgattggctggaacacaggagccctggtggcctgccacgtgtctgtgatggagtatgtgacagctgtggtgtgcctgggcttccccctgctgactgtggatggccccagaggagatgtggatgaccccctgctggacatgaagacccctgtgctcttcgtcatcggccagaacagcctgcagtgccaccctgaggccatggaggacttccgggagaagatccgggcagagaacagcctggtggtggtgggcggcgcagatgacaacctgcgcatcagcaaggccaagaagaagtctgagggcctgacccagagcatggtggaccgctgcatccaggatgagatcgtggacttcctgactggagtgctgaccagggctgagggccacatgggcagcgagccccgggaccaggatgctgagaagaagaagaagcccagagatgtggcccggcgggacctggcctttgaggtgcctgagcggggcagcaggcctgccagccctgctgccaagctgcctgccagccccagcggcagcgaggacctgagctctgtgagcagcagccccaccagcagccccaagaccaaggtgaccaccgtgaccagcgcccagaagagcagccagatcggcagcagccagctgctgaagagacatgtgcagaggacagaggccgtgctgacccacaagcaggcccaggtgcccatcagcagcgagcccccagaggagggggagaaggaggacctgcgggtgcagctgaagaggcaccaccccagcagccccctgcccggcagcaagaccagcaagaggcccaagatcaaggtgtccctcatcagccagggcgacacagctgggggcccctgtgcccccagccagggcagcgcccctgagggcggcaagcccatcaccatgaccctgggccaggccagcgctggggccaaggagctgaccggcctgctgaccacagccaagagcagcagcagcgagggcggcgtgtctgccagccctgtgcccagcgtggtgagcagcagcacagcccccagcgccctgcacaccctgcagagccggctggtggccaccagccctggcagcagcctgcccggggccaccagcgccagcagcctgctgcagggcctgtccttcagcctgcaggacatcagcagcaagaccagcggcctgcctgccaaccccagccctggccctgccccccaggccacctctgtgaagctgcccacccccatgcagagcctgggcgccatcaccaccggcaccagcaccatcgtgaggaccatccctgtggccaccaccctgagcagcctgggcgccaccccaggcggcaagcccacagccatccaccagctgctgaccaacggcggcctggccaagctggccagcagcctgcccggcctggcccagatcagcaaccaggccagcggcctgaaggtgcccaccaccatcaccctgaccctgcggggccagcccagccgcatcaccaccctgagccccatgggcagcggggccgcccccagcgaggagagcagcagccaggtgctgcccagcagcagccagaggctgcccccagccccctag

SEQ ID NO: 39447 - DNA, 1059 bp, Artificial Sequence
  Description of Artificial Sequence: Synthetic coding sequence
atgcccctgtatgacaaccagaaggcccggtctgtgatgaatgaatgtgaaagacatgtgatctttgccaggacagatgctgatgcccctcctcctcctgaggactgggaggagcacgtgaacagaacaggctggaccatggcccagaacaagctgttcaacaagatcctgaaggccctgcagagcgaccggctggcccggctggccaatgaaggagcctgcaatgaacctgtgctgcggcgggtggccgtggacaagtgtgccaggagagtgcggcaggccctggcctctgtgtcctgggacaccaagctgatccagtggctgcacaccaccctggtggagaccctgagcctgcccatgctggccgcctacctggatgccctgcagaccctgaagggcaagatccccaccctgattgacaggatgctggtgagcagcaacaccaagacaggagctgctggagctgaggccctgagcctgctgctgaagaggccctgggaccctgctgtgggcgtgctgagccacaacaagcccagcaagctgcccggcagccccctcatcctgattgccagcagcggccccagcagctctgtgttccccaccagcagaagacaccgcttctggcagagccagctgagctgcctgggcaaggtgattcctgtggccacccacctgctgaacaacggcagcggcgtgggcgtgctgcagtgcctggagcacatgattggagctgtgcgcagcaaggtgctggagatccacagccacttcccccacaagcccatcatcctgattggctggaacacaggagccctggtggcctgccacgtgtctgtgatggagtatgtgacagctgtggtgtgcctgggcttccccctgctgactgtggatggccccagaggagatgtggatgaccccctgctggacatgaagacccctgtgctgtttgtgattggccagaacagcctgcagtgccaccctgaggccatggaggacttccgggagaagatccgggcagagaacagcctggtggtggtgggcggcgcagatgacaacctgtag

SEQ ID NO: 39448 - DNA, 1329 bp, Artificial Sequence
  Description of Artificial Sequence: Synthetic coding sequence
atgtctgctgcccagggctgggacaggaacagaagaagaggaggaggagctgctggggccggcggcggcggcagcggggccggcggcggcagcggcggcagcggcggccggggcaccggccagctgaacagatttgtgcagctgagcggccggccccacctgcccgggaagaagaagatccgctgggaccctgtgagaagacgcttcatccagagctgccccatcatccgcatccccaaccgcttcctgcggggccaccggcccccaccagcccggagcggccaccgctgtgtggccgacaacaccaacctgtatgtgtttggaggctacaacccagactatgatgaaagtggcggccctgacaatgaagactaccccctcttccgggagctgtggagataccactttgccaccggggtgtggcaccagatgggcacagatggctacatgccccgggagctggcctccatgagcctggtgctgcacggcaacaacctgctggtgtttggaggcaccggcatcccctttggagagagcaatggaaatgatgtgcacgtgtgcaatgtgaagtacaagcgctgggccctgctgagctgccggggcaagaagcccagccgcatctacggccaggccatggccatcatcaatggcagcctgtatgtgtttggaggcaccaccggctacatctacagcacagacctgcacaagctggacctgaacacccgggagtggacccagctgaagcccaacaacctgagctgtgacctgcctgaggagcgctacagacatgaaattgcccatgatggccagaggatctacatcctgggcggcggcacctcctggacagcctacagcctgaacaagatccacgcctacaacctggagaccaatgcctgggaggagatcgccaccaagccccatgagaagattggcttccctgctgcccggcgctgccacagctgtgtgcagatcaagaatgatgtgttcatctgtggcggctacaatggagaggtgatcctgggggacatctggaagctgaacctgcagaccttccagtgggtgaagctgcctgccaccatgcctgagcctgtgtacttccactgtgccgctgtgaccccagctggctgcatgtacatccacggcggcgtggtgaacatccacgagaacaagaggacaggcagcctcttcaagatctggctggtggtgcccagcctgctggagctggcctgggagaagctgctggccgccttccccaacctggccaacctgagcaggacccagctgctgcacctgggcctgacccagggcctcatcgagcggctgaagtag

SEQ ID NO: 39449 - DNA, 1563 bp, Artificial Sequence
  Description of Artificial Sequence: Synthetic coding sequence
atgggcaagaagggcaagaaggagaagaagggccgcggggctgagaagacagctgccaagatggagaagaaggtgtccaagaggagcaggaaggaggaggaggacctggaggccctgattgcccacttccagaccctggatgccaagaggacccagacagtggagctgccctgccccccacccagcccccggctgaatgccagcctgtctgtgcaccctgagaaggatgagctgatcctgtttggaggagagtacttcaacggccagaagaccttcctgtacaatgagctgtatgtgtacaacaccaggaaggacacctggaccaaggtggacatccccagccccccaccccggcgctgtgcccaccaggccgtggtggtgccccagggcggcggccagctgtgggtgtttggaggagaatttgccagccccaatggagagcagttctaccactacaaggacctgtgggtgctgcacctggccaccaagacctgggagcaggtgaagagcactggaggccccagcggccgcagcggccacaggatggtggcctggaagaggcagctgatcctgtttggaggcttccacgagagcacccgggactacatctactacaatgatgtgtatgccttcaacctggacaccttcacctggagcaagctgagccccagcggcaccggccccacccccaggagcggctgccagatgtctgtgaccccccagggcggcatcgtggtgtatggaggctacagcaagcagagggtgaagaaggatgtggacaagggcaccaggcacagcgacatgttcctgctgaagccagaagatggccgggaggacaagtgggtgtggaccaggatgaaccccagcggcgtgaagcccacccccaggagcggcttctctgtggccatggcccccaaccaccagaccctcttcttcggcggcgtgtgtgatgaggaggaggaggagagcctgtctggagagttcttcaatgacctgtacttctatgatgccaccaggaaccgctggtttgagggccagctgaagggccccaagtctgagaagaagaagagaagaagaggaaggaaggaggagcctgagggcggcagcaggcctgcctgtggcggggccggcacccagggccctgtgcagctggtgaaggaggtggtggctgaagatggcaccgtggtgaccatcaagcaggtgctgacagcccctggcagcgctggccagcccaggagtgaagatgaggacagcctggaggaggccggcagccctgcccctggcccctgccccaggagcaatgccatgctggccgtgaagcatggagtgctgtatgtgtatggaggcatgtttgaagctggggaccggcaggtgaccctgagtgacctgcactgcctggacctgcacaggatggaggcctggaaggccctggtggagatggaccctgagacccaggagtggctggaggagacagattctgaagaagattctgaggaggtggagggcgctgagggcggcgtggatgatgaggacagcggggaggagagcggggctgaagattag

SEQ ID NO: 39450 - DNA, 777 bp, Artificial Sequence
  Description of Artificial Sequence: Synthetic coding sequence
atggtggcctggaagaggcagctgatcctgtttggaggcttccacgagagcacccgggactacatctactacaatgatgtgtatgccttcaacctggacaccttcacctggagcaagctgagccccagcggcaccggccccacccccaggagcggctgccagatgtctgtgaccccccagggcggcatcgtggtgtatggaggctacagcaagcagagggtgaagaaggatgtggacaagggcaccaggcacagcgacatgttcctgctgaagccagaagatggaagagaggacaagtgggtgtggaccaggatgaaccccagcggcgtgaagcccacccccaggagcggcttctctgtggccatggcccccaaccaccagaccctcttctttggaggagtgtgtgatgaggaggaggaggagagcctgagcggggagttcttcaatgacctgtacttctatgatgccaccaggaaccgctggtttgagggccagctgaagaagctgcggagcggctggaggaggaggaccaggaagaggacagtgcggcggctgcgggccccccgggtgggcagcaccaccaagacagctgagaggagagctgtgagaagaacagagagcccctgccagggccgcctggccagcgctgtgcccaccagcgcccaggaccctgctgtgctgtctgaggccctgggcgcctctgtgcggccagatgcccaggagagagctgagggcggctggccccggcccggctgtgagctgagccccatggtgtag

SEQ ID NO: 39451 - DNA, 1470 bp, Artificial Sequence
  Description of Artificial Sequence: Synthetic coding sequence
atgggcaagaagggcaagaaggagaagaagggccgcggggctgagaagacagctgccaagatggagaagaaggtgtccaagaggagcaggaaggaggaggaggacctggaggccctgattgcccacttccagaccctggatgccaagaggacccagacagtggagctgccctgccccccacccagcccccggctgaatgccagcctgtctgtgcaccctgagaaggatgagctgatcctgtttggaggagagtacttcaacggccagaagaccttcctgtacaatgagctgtatgtgtacaacaccaggaaggacacctggaccaaggtggacatccccagccccccaccccggcgctgtgcccaccaggccgtggtggtgccccagggcggcggccagctgtgggtgtttggaggagaatttgccagccccaatggagagcagttctaccactacaaggacctgtgggtgctgcacctggccaccaagacctgggagcaggtgaaggactacatctactacaatgatgtgtatgccttcaacctggacaccttcacctggagcaagctgagccccagcggcaccggccccacccccaggagcggctgccagatgtctgtgaccccccagggcggcatcgtggtgtatggaggctacagcaagcagagggtgaagaaggatgtggacaagggcaccaggcacagcgacatgttcctgctgaagccagaagatggaagagaggacaagtgggtgtggaccaggatgaaccccagcggcgtgaagcccacccccaggagcggcttctctgtggccatggcccccaaccaccagaccctcttctttggaggagtgtgtgatgaggaggaggaggagagcctgagcggggagttcttcaatgacctgtacttctatgatgccaccaggaaccgctggtttgagggccagctgaagggccccaagtctgagaagaagaagagaagaagaggaaggaaggaggagcctgagggcggcagcaggcctgcctgtggcggggccggcacccagggccctgtgcagctggtgaaggaggtggtggccgaggatggcaccgtggtgaccatcaagcaggtgctgacagcccctggcagcgctggccagcccaggagtgaagatgaggacagcctggaggaggccggcagccctgcccctggcccctgccccaggagcaatgccatgctggccgtgaagcacggcgtgctgtatgtgtatggaggcatgtttgaggccggggaccggcaggtgaccctgagtgacctgcactgcctggacctgcacaggatggaggcctggaaggccctggtggagatggaccctgagacccaggagtggctggaggagacagacagcgaggaggacagcgaggaggtggagggcgctgagggcggcgtggatgatgaagattctggagaggagagcggggctgaggactag

SEQ ID NO: 39452 - DNA, 1392 bp, Artificial Sequence
  Description of Artificial Sequence: Synthetic coding sequence
atgggcaagaagggcaagaaggagaagaagggccgcggggctgagaagacagctgccaagatggagaagaaggtgtccaagaggagcaggaaggaggagaccttcctgtacaatgagctgtatgtgtacaacaccaggaaggacacctggaccaaggtggacatccccagccccccaccaagaagatgtgcccaccaggccgtggtggtgccccagggcggcggccagctgtgggtgtttggaggagaatttgccagccccaacggggagcagttctaccactacaaggacctgtgggtgctgcacctggccaccaagacctgggagcaggtgaagagcactggaggccccagcggccgcagcggccacaggatggtggcctggaagaggcagctgatcctgtttggaggcttccacgagagcacccgggactacatctactacaatgatgtgtatgccttcaacctggacaccttcacctggagcaagctgagccccagcggcaccggccccacccccaggagcggctgccagatgtctgtgaccccccagggcggcatcgtggtgtatggaggctacagcaagcagagggtgaagaaggatgtggacaagggcaccaggcacagcgacatgttcctgctgaagccagaagatggaagagaggacaagtgggtgtggaccaggatgaaccccagcggcgtgaagcccacccccaggagcggcttctctgtggccatggcccccaaccaccagaccctcttctttggaggagtgtgtgatgaggaggaggaggagagcctgagcggggagttcttcaatgacctgtacttctatgatgccaccaggaaccgctggtttgagggccagctgaagggccccaagtctgagaagaagaagagaagaagaggaaggaaggaggagcctgagggcggcagcaggcctgcctgtggcggggccggcacccagggccctgtgcagctggtgaaggaggtggtggccgaggatggcaccgtggtgaccatcaagcaggtgctgacagcccctggcagcgctggccagcccaggagtgaagatgaggacagcctggaggaggccggcagccctgcccctggcccctgccccaggagcaatgccatgctggccgtgaagcacggcgtgctgtatgtgtatggaggcatgtttgaggccggggaccggcaggtgaccctgagtgacctgcactgcctggacctgcacaggatggaggcctggaaggccctggtggagatggaccctgagacccaggagtggctggaggagacagacagcgaggaggacagcgaggaggtggagggcgctgagggcggcgtggatgatgaagattctggagaggagagcggggctgaggactag

SEQ ID NO: 39453 - DNA, 1518 bp, Artificial Sequence
  Description of Artificial Sequence: Synthetic coding sequence
atgtctgctgaggagatggtgcagatccggctggaggaccgctgctaccctgtgtccaagaggaagctgattgagcagagcgactacttccgggccctgtaccgcagcggcatgagggaggccctgagccaggaggccggcggccctgaggtgcagcagctgcggggcctgagcgcccctggcctgcggctggtgctggacttcatcaatgccggcggggcccgggagggctggctgctgggccccagaggagagaagggcggcggcgtggatgaagatgaggagatggatgaggtgtccctgctgtctgagctggtggaggccgccagcttcctgcaggtgaccagcctgctgcagctgctgctgagccaggtgcggctgaacaactgcctggagatgtaccgcctggcccaggtgtatggcctgcctgacctgcaggaggcctgcctgcgcttcatggtggtgcacttccacgaggtgctgtgcaagccccagttccacctgctgggcagccccccccaggcccctggagatgtgtccctgaagcagaggctgcgggaggccaggatgacaggcacccctgtgctggtggccctgggggacttcctgggcggccccctggccccccacccctaccagggcgagccccccagcatgctgcgctatgaggagatgacagagcgctggttccccctggccaacaacctgcccccagacctggtgaatgtgcggggctacggcagcgccatcctggacaactacctgttcatcgtgggcggctaccgcatcaccagccaggagatctctgctgcccacagctacaaccccagcaccaatgagtggctgcaggtggcctccatgaaccagaagaggagcaacttcaagctggtggccgtgaacagcaagctgtatgccatcggcggccaggccgtgtccaatgtggagtgctacaaccctgagcaggatgcctggaactttgtggcccccctgcccaaccccctggccgagttcagcgcctgtgaatgtaaaggcaagatctacgtgattggaggctacaccacccgggacaggaacatgaacatcctgcagtactgccccagcagtgacatgtggaccctgtttgagacctgtgatgtgcacatcaggaagcagcagatggtgtctgtggaggagaccatctacatcgtgggcggctgcctgcacgagctgggccccaacagaagaagcagccagagcgaggacatgctgactgtgcagagctacaacacagtgacccggcagtggctgtacctgaaggagaacaccagcaagagcggcctgaacctgacctgtgccctgcacaatgatggcatctacatcatgagcagagatgtgaccctgagcaccagcctggagcacagggtcttcctgaagtacaacatcttcagtgacagctgggaggccttccgccgcttccctgccttcggccacaacctgctggtgagcagcctgtacctgcccaacaaggccgagacctag

SEQ ID NO: 39454 - DNA, 1785 bp, Artificial Sequence
  Description of Artificial Sequence: Synthetic coding sequence
atggtgctgcggagccaccccttcccccggcaggaccggccccagggctctgtgcccagggctgtgcccggcagccctgtgggccccagcaccagcacccacagcgaggacagacatggccccagcagctctgtgggcaccgtgattggaactggaactggaggcctggtggaggccggcggccagccccagcccaggagcagcgagaccaacggcagccccagcccagaccccccacctggcctgcggggggagggcacccgggagaagagcctggaccccctgccccaggccgccatgccccggggccctgcccagcccccagcccagaggcctcctggccctgctgccagcagcagcgcccggcgcagccagcctgtgccccagctgaggaagaggagccgctgtgagatcgcccccagcagcgagcaggaggtgcggcctgctgccagcggggacccccagggcgaggcccctggagagggcggcagccctgctggccgcagcggggccctgacagagaagcaggaggaggccaggaagctgatggtgttcctgcagaggcctgggggctggggcgtggtggagggccccaggaagcccagcagccgggccctggagcccgccacagctgctgccctgcggcggcggctggacctgggcagctgcctggatgtgctggcctttgcccagcagcacggggagcccggcctggcccaggagacctacgccctgatgtctgacaacctgctgcgggtgctgggggacccctgcctgtacagaaggctgtctgctgctgaccgggagcgcatcctgagcctgaggacaggccggggccgggctgtgctgggcgtgctggtgctgcccagcctgtaccagggcggccgcagcggcctgccccggggccccagaggagaggagcccccagctgctgcccctgtgtccctgcccctgcctgcccacctgcacgtgttcaacccccgggagaacacctggaggcccctgacccaggtgcctgaggaggcccccctgcggggctgcggcctgtgcaccatgcacaactacctgttcctggccggcggcatccggggcagcggggccaaggctgtgtgcagcaatgaggtgttctgctacaaccccctgaccaacatctggagccaggtgcggcccatgcagcaggcccgggcccagctgaagctggtggccctggatggcctgctgtatgccatcggaggagaatgtctgtacagcatggagtgctatgaccccaggacagatgcctggaccccccgggcccccctgcctgctggcaccttccctgtggcccatgaagctgtggcctgccgcggggacatctacgtgactggaggccacctgttctaccgcctgctgcgctacagccctgtgaaggatgcctgggatgaatgtccctacagcgccagccacagaagaagcagtgacatcgtggccctgggcggcttcctgtacagatttgacctgctgcggggcgtgggcgctgctgtgatgagatacaacacagtgacaggctcctggagcagagctgccagcctgcccctgcctgccccagcccccctgcactgcaccaccctgggcaacaccatctactgcctgaacccccaggtgacagccaccttcaccgtgtctgggggcacagcccagttccaggccaaggagctgcagcccttccccctgggcagcactggagtgctgagccccttcatcctgaccctgcccccagaagatcggctgcagaccagcctgtag

SEQ ID NO: 39455 - DNA, 1053 bp, Artificial Sequence
  Description of Artificial Sequence: Synthetic coding sequence
atggaggtgcccaacgtgaaggacttccagtggaagaggctggcccccctgcccagccggcgggtgtactgcagcctgctggagactggaggccaggtgtatgccatcggcggctgtgatgacaacggggtgcccatggactgctttgaggtgtacagccctgaggccgaccagtggacagccctgccccggctgcccacagcccgggccggcgtggccgtgacagccctgggcaagaggatcatggtgattggaggagtgggcaccaaccagctgcccctgaaggtggtggagatgtacaacattgatgagggcaagtggaagaagaggtccatgctgcgggaggccgccatgggcatctctgtgacagccaaggactacagagtgtatgctgctgggggcatgggcctggacctgcggccccacaaccacctgcagcactatgacatgctgaaggacatgtgggtgtccctggcccccatgcccacccccaggtatgctgccaccagcttcctgcggggcagcaagatctacgtgctgggcggccggcagagcaaatatgctgtgaatgcctttgaggtgtttgatattgagaccaggtcctggaccaagttccccaacatcccctacaagagggccttcagcagctttgtgaccctggacaaccacctgtacagcctgggcggcctgcggcagggccgcctgtaccggcagcccaagttcctgcggaccatggatgtgtttgacatggagcagggcggctggctgaagatggagaggagcttcttcctgaagaagagaagagctgactttgtggccggcagcctgagcggccgggtgattgtggccggcggcctgggcaaccagcccaccgtgctggagacagctgaggccttccaccctgggaagaacaagtgggagatcctgcctgccatgcccaccccccgctgtgcctgcagcagcatcgtggtgaagaactgcctgctggccgtgggcggcgtgaaccagggcctgagtgatgctgtggaggccctgtgtgtgtctgacagctag

SEQ ID NO: 39456 - DNA, 1053 bp, Artificial Sequence; identical to SEQ ID NO: 39455
  Description of Artificial Sequence: Synthetic coding sequence

SEQ ID NO: 39457 - DNA, 714 bp, Artificial Sequence
  Description of Artificial Sequence: Synthetic coding sequence
atgattgctggctgccgctccttcagcctgcagagcgactacagagtgtatgctgctgggggcatgggcctggacctgcggccccacaaccacctgcagcactatgacatgctgaaggacatgtgggtgtccctggcccccatgcccacccccaggtatgctgccaccagcttcctgcggggcagcaagatctacgtgctgggcggccggcagagcaaatatgctgtgaatgcctttgaggtgtttgacatcgagaccaggtcctggaccaagttccccaacatcccctacaagagggccttcagcagctttgtgaccctggacaaccacctgtacagcctgggcggcctgcggcagggccgcctgtaccggcagcccaagttcctgcggaccatggatgtgtttgacatggagcagggcggctggctgaagatggagaggagcttcttcctgaagaagagaagagctgactttgtggccggcagcctgagcggccgggtcatcgtggccggcggcctgggcaaccagcccaccgtgctggagacagctgaggccttccaccctgggaagaacaagtgggagatcctgcctgccatgcccaccccccgctgtgcctgcagcagcatcgtggtgaagaactgcctgctggccgtgggcggcgtgaaccagggcctgagtgatgctgtggaggccctgtgtgtgtctgacagctag

SEQ ID NO: 39458 - DNA, 1053 bp, Artificial Sequence; identical to SEQ ID NO: 39455
  Description of Artificial Sequence: Synthetic coding sequence

SEQ ID NO: 39459 - DNA, 1050 bp, Artificial Sequence
  Description of Artificial Sequence: Synthetic coding sequence
atggctgtggccgtgcccccaggccgggctgctggcagcggctgggcctggaggcctgtggccagagatgccctgctggcccgggccttccacagctgcacagagctgcggggccgcttctacctggtgggcggcctgctggccggcggggcccgggagcccagcagtgacacagtggtgtttgatcctgcccggggccaggccgtgcggctgggcgcccggggcagccccccaagaagccaccatgatgctgcccctgtggatggccgctggctgtgtgtggtgggcggctgggatggcagccggcggctggccaccgtgacagccctggacacagagcggggcgtgtgggaggcctggacaggcacccctggggactgccccccagctggcctgagcagccacacctgcacccgcatcagtgaccgggagctgcaggtggccggccgggagggcggcatccacacccagaggagatatggcagcatctacaccctgcggctggaccccagcgcccggacctactgctacaagcaggagggctgccacacagccagccgcagcggccactgtgccgccctgctgcagaccccaggcccccaccctggccaccagctgctgctgtttggaggctgcaacctggccgagcctgaggtggccggccactggagccacggcaagatcaaggaggagccccctgtggccccccacctgatggagcagctggcccggctggtgagcagcggccagggcagccagaagggcccccacggcctgcggcaccacagctgcagcgtggtgggcccctttgctgtgctgtttggaggagagaccctgacccgggcccgggacaccatctgcaatgacctgtacatctatgacaccaggaccagcccccccctgtggttccacttcccctgtgccgaccggggcatgaagaggatgggccacaggacctgcctgtggaatgaccagctgtacctggtgggcggctttggagaagatggccgcacagccagcccccaggtgtgcatcctggacttcatctag

SEQ ID NO: 39460 - DNA, 867 bp, Artificial Sequence
  Description of Artificial Sequence: Synthetic coding sequence
atggctgtggccgtgcccccaggccgggctgctggcagcggctgggcctggaggcctgtggccagagatgccctgctggcccgggccttccacagctgcacagagctgcggggccgcttctacctggtgggcggcctgctggccggcggggcccgggagcccagcagtgacacagtggtgtttgatcctgcccggggccaggccgtgcggctgggcgcccggggcagccccccaagaagccaccatgatgctgcccctgtggatggccgctggctgtgtgtggtgggcggctgggatggcagccggcggctggccaccgtgacagccctggacacagagcggggcgtgtgggaggcctggacaggcacccctggggactgccccccagctggcctgagcagccacacctgcacccgcatcagtgaccgggagctgcaggtggccggccgggagggcggcatccacacccagaggagatatggcagcatctacaccctgcggctggaccccagcgcccggacctactgctacaagcaggagggctgccacacagccagccgcagcggccactgtgccgccctgctgcagaccccaggcccccaccctggccaccagctgctgctgtttggaggctgcaacctggccgagcctgaggtggccggccactggagccacggcaagatcaagagcttcctgagcccccagggcggcaccacctgctgcagcagctttgatggaacagcctgcaaggcctgtgagcagtgggccggcgtgcctgagggcgccccctggaccacagccagcctgatgttctgtggccgggccctgtgctgtgctgtgtggtggaggaacagcgaccagagctag

SEQ ID NO: 39461 - DNA, 1872 bp, Artificial Sequence
  Description of Artificial Sequence: Synthetic coding sequence
atggagcacgctgtggccccctgtgtgctgtacccaggcacagagcccggggctgctggggagagcgagagcgagggcgccgccagccctgcccagaccccctgcagcctgggcgccagcctgtgcttcagcagtggagaggagagccccccccagagcctggccagcgctgctgagggcgccgccaccagcccccccagcagcggcggcccccgggtggtggagcggcagtgggaggccggcagcgctggagctgccagccctgaggagctggccagccctgaggagcgggcctgcccagaggagcctgctgcccccagccctgagccccgggtgtggctggaggaccctgccagccctgaggagcctggagagcccgcccctgtgcccccaggctttggagctgtgtatggagagccagacctggtgctggaggtgtctggaagaaggctgcgggcccacaaggctgtgctggccgcccggagtgactacttccgggcccgggccagcagagatgtgctgcgggtgcagggcgtgtccctgacagccctgcggctgctgctggctgatgcctacagcggccgcatggccggcgtgcggccagacaacgtggccgaggtggtggccggggcccggcggctgcagctgcctggagctgcccagagggccacagatgctgtgggcccccagctgagcctggccaactgctatgaggtgctgtctgctgccaagaggcagaggctgaatgagctgagagatgctgcctactgcttcatgtctgaccactacctggaggtgctgcgggagcctgctgtgtttggccgcctgtctggagctgagcgggacctgctgctgcggcggcggctgcgggccggccgggcccacctgctggccgccgccctgggccctgctggggagcgggccggcagccggccccagagccccagcggagatgctgatgcccggggagatgctgctgtgtactgcttccacgccgccgccggggagtggagggagctgacccggctgcctgagggcgccccagcccggggctgcggcctgtgtgtgctgtacaactacctgtttgtggccggcggcgtggccccagctggcccagatggccgggcccggcccagcgaccaggtgttctgctacaacccagccacagacagctggagcgctgtgcggcccctgcggcaggcccggagccagctgcggctgctggccctggatggccacctgtatgctgtgggcggggagtgcctgctgtctgtggagagatatgaccccagggctgaccgctgggcccctgtggcccccctgcccaggggggcctttgctgtggcccacgaggccaccacctgccacggggagatctacgtgtctgggggcagcctcttctaccgcctgctgaagtatgaccccaggagagatgagtggcaggagtgcccctgcagcagcagccgggagaggtctgctgacatggtggccctggatggcttcatctacagatttgacctgagcggcagcagaggagaggcccaggccgccggccccagcggcgtgtctgtgagccgctaccactgcctggccaagcagtggagcccctgtgtggcccccctgcggctgcccggcggccccaccggcctgcagcccttccgctgtgccgccctggatggagccatctactgtgtgtcccgggccggcacctggaggttccagcctgcccgggagggggaggccggaggagatgctggccagggcggcggctttgaggccctgggcgcccccctggatgtgcggggcgtgctgatcccctttgccctgagcctgcctgagaagcccccaagaggagagcagggcgccccctag

SEQ ID NO: 39462 - DNA, 1872 bp, Artificial Sequence
  Description of Artificial Sequence: Synthetic coding sequence
atggagtgcaagattgagggcaaggagaagtaccagcacagcctgaacctgctgaacaagatccagaacatgaaggagctggccgagatgattgatgtggtgctgacagctgagggggagaagttcccctgccaccggctggtgctggccgccttcagcccctacttcaaggccatgttcacctgtggcctgctggagtgcaaccagcgggaggtgatcctgtatgacatcacagctgagagcgtgtctgtgctgctgaactacatgtacaatgctgccctggagatcaacaatgccaacgtgcagacagtggccatggccgcctacttcatgcagatggaggaggtgttttctgtgtgccagaagtacatgatggaccacatggatgccagcaactgcctgggcatctactactttgccaagcagattggagctgaggacctgagtgacaggagcaagaagtacctgtaccagcactttgctgaggtgtccctgcacgaggagatcctggagattgaggtgcaccagttcctgaccctcatcaagagtgatgacctgaacatcagccgggaggagagcatcctggacctggtgctgcgctgggtgaaccacaacaaggagctgaggacagtgcacctggtggagctgctgaagcaggtgcggctggagctggtgaaccccagcttcctgcggcaggccctgcggaggaacaccatgctgctgtgtgatgctgactgtgtggacatcatccagaatgccttcaaggccatcaagaccccccagcagcacagcctgaacctgcgctatggcatggagaccaccagcctgctgctgtgcatcggcaacaacagcagcggcatccgcagccgccacaggagctatggagatgccagcttctgctatgaccctgtgtccaggaagacctacttcatcagcagccccaagtacggggagggcctgggcaccgtgtgcacaggagtggtgatggagaacaacaccatcatcgtggccggggaggccagcgccagcaagctgagccggcagaagaacaagaatgtggagatctaccgctaccatgaccggggcaaccagttctgggagaagctgtgcacagctgagttccgggagctgtatgccctgggcagcatccacaatgacctgtatgtgattggaggccagatgaagatcaagaaccagtacctgatcaccaactgtgtggacaagtacagcgtggagcgggacaactggaagagggtgagccccctgcccctgcagctggcctgccacgctgtggtgacagtgaacaacaagctgtatgtgattggaggctggaccccccagatggacctgcctgatgaggagccagaccggctgagcaacaagctgctgcagtatgaccccagccaggaccagtggagcgtgcgggcccccatgaagtacagcaagtaccgcttcagcacagctgtggtgaacagcgagatctacgtgctgggcggcatcggctgtgtgggccaggacaagggccaggtgaggaagtgcctggatgtggtggagatctacaacccagatggagacttctggagggagggcccccccatgcccagccccctgctgagcctgcggaccaacagcaccaatgctggagctgtggatggcaagctgtatgtgtgtggcggcttccatggagctgacagacatgaggtgatcagcaaggagatcctggagctggacccctgggagaaccagtggaatgtggtggccatcaacgtgctgatgcatgacagctatgatgtgtgcctggtggccaggatgaacccccgggacctgatccccccacccagcgacctggtggaggagggcaatgagcactag

SEQ ID NO: 39463 - DNA, 1872 bp, Artificial Sequence; identical to SEQ ID NO: 39462
  Description of Artificial Sequence: Synthetic coding sequence

SEQ ID NO: 39464 - DNA, 1872 bp, Artificial Sequence
  Description of Artificial Sequence: Synthetic coding sequence
atgagcacccaggatgagcggcagatcaacacagaatatgctgtgtccctgctggagcagctgaagctgttctatgagcagcagctgttcacagacatcgtgctgattgtggagggcacagagttcccctgccacaagatggtgctggccacctgcagcagctacttccgggccatgttcatgagcggcctgtctgagagcaagcagacccacgtgcacctgagaaatgtggatgctgccaccctgcagatcatcatcacctacgcctacacaggcaacctggccatgaatgacagcacagtggagcagctgtatgaaacagcctgcttcctgcaggtggaggatgtgctgcagcgctgccgggagtacctgatcaagaagatcaatgctgagaactgtgtgcggctgctgagctttgctgacctcttcagctgtgaggagctgaagcagagcgccaagaggatggtggagcacaagttcaccgctgtgtaccaccaggatgccttcatgcagctgagccatgacctgctgattgacatcctgagcagtgacaacctgaatgtggagaaggaggagaccgtgcgggaggccgccatgctgtggctggagtacaacacagagagccgcagccagtacctgagctctgtgctgagccagatcagaattgatgccctgtctgaggtgacccagagggcctggttccagggcctgcccccaaatgacaagtctgtggtggtgcagggcctgtacaagtccatgcccaagttcttcaagccccggctgggcatgaccaaggaggagatgatgatcttcatcgaggccagcagcgagaacccctgcagcctgtacagctctgtgtgctacagcccccaggccgagaaggtgtacaagctgtgcagccccccagctgacctgcacaaggtgggcaccgtggtgaccccagacaatgacatctacatcgccggcggccaggtgcccctgaagaacaccaagaccaaccacagcaagaccagcaagctgcagacagccttcagaacagtgaactgcttctactggtttgatgcccagcagaacacctggttccccaagacccccatgctgtttgtgcgcatcaagcccagcctggtgtgctgtgagggctacatctatgccatcggcggggacagcgtgggcggggagctgaacagaagaacagtggagagatatgacacagagaaggatgagtggaccatggtgagccccctgccctgtgcctggcagtggagcgctgctgtggtggtgcatgactgcatctacgtgatgaccctgaacctgatgtactgctacttccccaggagtgacagctgggtggagatggccatgaggcagaccagccgcagctttgccagcgctgctgcctttggagacaagatcttctacatcggcggcctgcacatcgccaccaacagcggcatccggctgcccagcggcaccgtggatggcagctctgtgacagtggagatctatgatgtgaacaagaatgagtggaagatggccgccaacatcccagccaagcgctacagcgacccctgtgtgcgggctgtggtgatcagcaacagcctgtgtgtgttcatgagggagacccacctgaatgaaagagccaagtatgtgacctaccagtatgacctggagctggaccgctggagcctgcggcagcacatcagcgagcgggtgctgtgggacctgggccgggacttccgctgcaccgtgggcaagctgtaccccagctgcctggaggagagcccctggaagccacccacctacctgttcagcacagatggaacagaggagtttgagctggatggagagatggtggccctgccccctgtgtag

SEQ ID NO: 39465 - DNA, 45 bp, Artificial Sequence
  Description of Artificial Sequence: Synthetic coding sequence
atgagcacccaggatgagcggcagatcaacacagaatatgcctag

SEQ ID NO: 39466 - DNA, 15 bp, Artificial Sequence
  Description of Artificial Sequence: Synthetic coding sequence
atgagcacccagtag

SEQ ID NO: 39467 - DNA, 147 bp, Artificial Sequence
  Description of Artificial Sequence: Synthetic coding sequence
atgagcacccaggatgagcggcagatcaacacagaatatgctgtgtccctgctggagcagctgaagctgttctatgagcagcagctgttcacagacatcgtgctgattgtggagggcacagagttcccctgccacaagatggtgtag

SEQ ID NO: 39468 - DNA, 90 bp, Artificial Sequence
  Description of Artificial Sequence: Synthetic coding sequence
atgagcacccaggatgagcggcagatcaacacagaatatgctgtgtccctgctggagcagctgaagctgttctatgagcagcagctgtag

SEQ ID NO: 39469 - DNA, 1050 bp, Artificial Sequence
  Description of Artificial Sequence: Synthetic coding sequence
gtgcgggaggccgccatgctgtggctggagtacaacacagagagccgcagccagtacctgagctctgtgctgagccagatcagaattgatgccctgtctgaggtgacccagagggcctggttccagggcctgcccccaaatgacaagtctgtggtggtgcagggcctgtacaagtccatgcccaagttcttcaagccccggctgggcatgaccaaggaggagatgatgatcttcatcgaggccagcagcgagaacccctgcagcctgtacagctctgtgtgctacagcccccaggccgagaaggtgtacaagctgtgcagccccccagctgacctgcacaaggtgggcaccgtggtgaccccagacaatgacatctacatcgccggcggccaggtgcccctgaagaacaccaagaccaaccacagcaagaccagcaagctgcagaccctgcagaactgtgagctgctgctgctggatgcccagcagaacaccagcaaggaccccaatgccttctgcccccacaaggccatcttctgctgtgagggctacatctatgccatcggcggggacagcgtgggcggggagctgaacagaagaacagtggagagatatgacacagagaaggatgagtggaccatggtgagccccctgccctgtgcctggcagtggagcgctgctgtggtggtgcatgactgcatctacgtgatgaccctgaacctgatgtactgctacttccccaggagtgacagctgggtggagatggccatgaggcagaccagccgcagctttgccagcgctgctgcctttggagacaagatcttctacatcggcggcctgcacatcgccaccaacagcggcatccggctgcccagcggcaccgtggatggcagctctgtgacagtggagatctatgatgtgaacaagaatgagtggaagatggccgccaacatcccagccaagcgctacagcgacccctgtgtgcgggctgtggtgatcagcaacagcctgtgtgtgttcatgagggagacccacctgaatgaaagagcctag

SEQ ID NO: 39470 - DNA, 1839 bp, Artificial Sequence
  Description of Artificial Sequence: Synthetic coding sequence
atggagctggccatggacaacagctatgccttcaaccagaggagcacctgcaatggcatccccagcgagaagaagaacaacttcctggtgtctgaggaccacggccagaagatcctgtctgtgctgcagaacttccgggagcagaatgtgttctatgacttcaagatcatcatgaaggatgagatcatcccctgccaccgctgtgtgctggccgcctgcagcgacttcttccgggccatgtttgaggtgaacatgaaggagagagatgatggctctgtgaccatcaccaacctgagcagcaaggctgtgaaggccttcctggactatgcctacaccgggaagaccaagatcacagatgacaacgtggagatgttcttccagctgagcagcttcctgcaggtgtccttcctgagcaaggcctgcagcgacttcctgatcaagagcatcaacctggtgaactgcctgcagctgctgagcatcagtgacagctatggcagcaccagcctgtttgaccacgccctgcactttgtgcagcaccacttcagcctgctcttcaagagcagtgacttcctggagatgaactttggagtgctgcagaagtgcctggagagtgatgagctgaatgtgcctgaggaggagatggtgctgaaggtggtgctgtcctggaccaagcacaacctggagagccggcagaagtacctgccccacctgattgagaaggtgcggctgcaccagctgtctgaggagaccctgcaggactgcctcttcaatgaggagagcctgctgaagagcaccaactgctttgacatcatcatggatgccatcaagtgtgtgcagggcagcggcggcctcttcccagatgcccggcccagcaccacagagaagtacatcttcatccacaagacagaggagaatggagagaaccagtacaccttctgctacaacatcaagagtgacagctggaagatcctgccccagagccacctgattgacctgcccggcagcagcctgagcagctatggagagaagatcttcctgactggaggctgcaagggcaagtgctgcaggacagtgcggctgcacatcgccgagagctaccatgatgccacagaccagacctggtgctactgccctgtgaagaatgacttcttcctggtgtccaccatgaagacccccaggaccatgcacacctctgtgatggccctggacaggctcttcgtcatcggcggcaagacccggggcagccgggacatcaagagcctgctggatgtggagagctacaaccccctgagcaaggagtggatctctgtgagccccctgccccggggcatctactacccagaggccagcacctgccagaatgtcatctacgtgctgggcagcgaggtggagatcacagatgccttcaaccccagcctggactgcttcttcaagtacaatgccaccacagaccagtggagcgagctggtggccgagtttggccagttcttccacgccaccctcatcaaggctgtgcctgtgaactgcaccctgtacatctgtgacctgagcacctacaaggtgtacagcttctgcccagacacctgtgtgtggaagggggagggcagctttgaatgtgccggcttcaatgctggggccatcggcatcgaggacaagatctacatcctgggcggggactatgccccagatgagatcacagatgaggtgcaggtgtaccacagcaacagaagtgagtgggaggaggtgagccccatgccccgggccctgacagagttctactgccaggtgatccagttcaacaagtacagagacccctggttcagcaacctgtgtgcctag

SEQ ID NO: 39471 - DNA, 1839 bp, Artificial Sequence; identical to SEQ ID NO: 39470
  Description of Artificial Sequence: Synthetic coding sequence

SEQ ID NO: 39472 - DNA, 957 bp, Artificial Sequence
  Description of Artificial Sequence: Synthetic coding sequence
atgaagggcggcaatgctgacagctggcagcgggagaagctggcctccatggagagccctgaggagcccggggcctccatggatgagaactactttgtgaactacaccttcaaggacaggagccacagcggccgggtggcccagggcatcatgaagctgtgcctggaggaggagctgtttgctgatgtgaccatctctgtggagggccgggagttccagctgcaccggctggtgctgagcgcccagagctgcttcttccgctccatgttcaccagcaacctgaaggaggcccacaacagagtcatcgtgctgcaggatgtgtctgagagcgtcttccagctgctggtggactacatctaccatggaacagtgaagctgcgggcagaggagctgcaggagatctatgaggtgtctgacatgtaccagctgaccagcctcttcaatgccctgggcttctggccagcccagtgcaagtgggagacagccttccgggctgacagacacagcgacagcagcatccggctgcccagctgtgccaagacccacctggcccagctgcagaacacagaggagttcctgcacctgccccaccggctgctgacagacatcatcagtgatggagtgccctgcagccagaaccccacagaggccatcgaggcctggatcaacttcaacaaggaggagcgggaggcctttgctgagagcctgcggaccagcctgaaggagattggagaaaatgtgcacatctacctgattggcaaggagagcagcaggacccacagcctggccgtgtccctgcactgtgccgaggatgacagcatctctgtgtctggccagaacagcctgtgccaccagatcacagctgcctgcaagcacggcggggacctgtatgtggtgggcggcagcatccccaggaggatgtggaagtgcaacaatgccaccgtggactgggagtag

SEQ ID NO: 39473 - DNA, 1557 bp, Artificial Sequence
  Description of Artificial Sequence: Synthetic coding sequence
atggagagccctgaggagcccggggcctccatggatgagaactactttgtgaactacaccttcaaggacaggagccacagcggccgggtggcccagggcatcatgaagctgtgcctggaggaggagctgtttgctgatgtgaccatctctgtggagggccgggagttccagctgcaccggctggtgctgagcgcccagagctgcttcttccgctccatgttcaccagcaacctgaaggaggcccacaacagagtcatcgtgctgcaggatgtgtctgagagcgtcttccagctgctggtggactacatctaccatggaacagtgaagctgcgggcagaggagctgcaggagatctatgaggtgtctgacatgtaccagctgaccagcctgtttgaagaatgtagccgcttcctggccaggacagtgcaggtgggcaactgcctgcaggtgatgtggctggccgacagacacagcgaccctgagctgtacacagctgccaagcactgtgccaagacccacctggcccagctgcagaacacagaggagttcctgcacctgccccaccggctgctgacagacatcatcagtgatggagtgccctgcagccagaaccccacagaggccatcgaggcctggatcaacttcaacaaggaggagcgggaggcctttgctgagagcctgcggaccagcctgaaggagatcggggagaatgtgcacatctacctgattggcaaggagagcagcaggacccacagcctggccgtgtccctgcactgtgctgaagatgacagcatctctgtgtctggccagaacagcctgtgccaccagatcacagctgcctgcaagcatggaggagacctgtatgtggtgggcggcagcatccccaggaggatgtggaagtgcaacaatgccaccgtggactgggagtggtgtgcccccctgccccgggaccggctgcagcacaccctggtgtctgtgcctgggaaggatgccatctacagcctgggcggcaagaccctgcaggacaccctgagcaatgctgtgatctactacagagtgggggacaacgtgtggacagagaccacccagctggaggtggccgtgtctggagctgctggggccaacctgaatggcatcatctacctgctgggcggggaggagaatgacctggacttcttcaccaagcccagccgcctcatccagtgctttgacacagaaacagacaagtgccacgtgaagccctacgtgctgccctttgctggccgcatgcatgctgctgtgcacaaggacctggtgttcatcgtggccgagggggacagcctggtgtgctacaaccccctgctggacagcttcacccggctgtgcctgcctgaggcctggagcagcgcccccagcctgtggaagatcgccagctgcaatggcagcatctacgtgttccgggaccgctacaagaagggagatgccaacacctacaagctggaccctgccaccagcgctgtgacagtgacccggggcatcaaggtgctgctgaccaacctgcagtttgtgctggcctag

SEQ ID NO: 39474 - DNA, 1605 bp, Artificial Sequence
  Description of Artificial Sequence: Synthetic coding sequence
atgaagggcggcaatgctgacagctggcagcgggagaagctggcctccatggagagccctgaggagcccggggcctccatggatgagaactactttgtgaactacaccttcaaggacaggagccacagcggccgggtggcccagggcatcatgaagctgtgcctggaggaggagctgtttgctgatgtgaccatctctgtggagggccgggagttccagctgcaccggctggtgctgagcgcccagagctgcttcttccgctccatgttcaccagcaacctgaaggaggcccacaacagagtcatcgtgctgcaggatgtgtctgagagcgtcttccagctgctggtggactacatctaccatggaacagtgaagctgcgggcagaggagctgcaggagatctatgaggtgtctgacatgtaccagctgaccagcctgtttgaagaatgtagccgcttcctggccaggacagtgcaggtgggcaactgcctgcaggtgatgtggctggccgacagacacagcgaccctgagctgtacacagctgccaagcactgtgccaagacccacctggcccagctgcagaacacagaggagttcctgcacctgccccaccggctgctgacagacatcatcagtgatggagtgccctgcagccagaaccccacagaggccatcgaggcctggatcaacttcaacaaggaggagcgggaggcctttgctgagagcctgcggaccagcctgaaggagatcggggagaatgtgcacatctacctgattggcaaggagagcagcaggacccacagcctggccgtgtccctgcactgtgctgaagatgacagcatctctgtgtctggccagaacagcctgtgccaccagatcacagctgcctgcaagcatggaggagacctgtatgtggtgggcggcagcatccccaggaggatgtggaagtgcaacaatgccaccgtggactgggagtggtgtgcccccctgccccgggaccggctgcagcacaccctggtgtctgtgcctgggaaggatgccatctacagcctgggcggcaagaccctgcaggacaccctgagcaatgctgtgatctactacagagtgggggacaacgtgtggacagagaccacccagctggaggtggccgtgtctggagctgctggggccaacctgaatggcatcatctacctgctgggcggggaggagaatgacctggacttcttcaccaagcccagccgcctcatccagtgctttgacacagaaacagacaagtgccacgtgaagccctacgtgctgccctttgctggccgcatgcatgctgctgtgcacaaggacctggtgttcatcgtggccgagggggacagcctggtgtgctacaaccccctgctggacagcttcacccggctgtgcctgcctgaggcctggagcagcgcccccagcctgtggaagatcgccagctgcaatggcagcatctacgtgttccgggaccgctacaagaagggagatgccaacacctacaagctggaccctgccaccagcgctgtgacagtgacccggggcatcaaggtgctgctgaccaacctgcagtttgtgctggcctag

SEQ ID NO: 39475 - DNA, 1866 bp, Artificial Sequence
  Description of Artificial Sequence: Synthetic coding sequence
atggccctgggcctggagcaggccgaggagcagaggctgtaccagcagaccctgctgcaggacggcctgaaggacatgctggaccacggcaagttcctggactgtgtggtgcgggccggggagcgggagttcccctgccaccggctggtgctggccgcctgcagcccctacttccgggcccgcttcctggccgagcctgagagagctggggagctgcacctggaggaggtgtccccagatgtggtggcccaggtgctgcactacctgtacaccagcgagatcgccctggatgaggcctctgtgcaggacctgtttgctgctgcccaccgcttccagatccccagcatcttcaccatctgtgtgtccttcctgcagaagaggctgtgcctgagcaactgcctggccgtgttccggctgggcctgctgctggactgtgcccggctggccgtggccgcccgggacttcatctgtgcccacttcaccctggtggccagagatgctgacttcctgggcctgtctgcagatgagctgattgccatcatcagcagtgatggcctgaatgtggagaaggaggaggccgtgtttgaagctgtgatgcgctgggccggcagcggagatgctgaggcccaggccgagcggcagagggccctgcccaccgtgtttgaatctgtgcgctgccgcctgctgccccgggccttcctggagagccgggtggagcggcaccccctggtgcgggcccagcctgagctgctgaggaaggtgcagatggtgaaggatgcccacgagggccgcatcaccaccctgaggaagaagaagaagggcaaggatggagctggggccaaggaggccgacaagggcaccagcaaggccaaggccgaggaggatgaggaggccgagcgcatcctgcccggcatcctgaatgacaccctgcgcttcggcatgttcctgcaggacctgatcttcatgatcagcgaggagggcgctgtggcctatgaccctgctgccaatgaatgctactgtgccagcctgagcaaccaggtgcccaagaaccacgtgtccctggtgaccaaggagaaccaggtgtttgtggccggcggcctcttctacaatgaagacaacaaggaggaccccatgtctgcctacttcctgcagtttgaccacctggacagcgagtggctgggcatgccacccctgcccagcccccgctgcctgtttggcctgggggaggccctgaacagcatctacgtggtgggcggccgggagatcaaggatggagagcgctgcctggacagcgtgatgtgctatgaccggctgtccttcaagtggggcgagagtgaccccctgccctacgtggtgtatggccacacagtgctgagccacatggacctggtgtatgtgattggaggcaagggcagtgacaggaagtgcctgaacaagatgtgtgtgtatgaccccaagaagtttgagtggaaggagctggcccccatgcagacagcccggagcctgtttggagccaccgtgcatgatggccgcatcatcgtggccgccggcgtgacagacaccggcctgaccagcagcgctgaggtgtacagcatcacagacaacaagtgggccccctttgaggccttcccccaggagaggagcagcctgagcctggtgtccctggtgggcaccctgtatgccatcggcggctttgccaccctggagacagagagcggggagctggtgcccacagagctgaatgacatctggagatacaatgaggaggagaagaagtgggagggcgtgctgcgggagatcgcctatgctgctggggccaccttcctgcctgtgcggctgaatgtgctgtgcctgaccaagatgtag

SEQ ID NO: 39476 - DNA, 1101 bp, Artificial Sequence
  Description of Artificial Sequence: Synthetic coding sequence
atggtgaaggatgcccacgagggccgcatcaccaccctgaggaagaagaagaagggcaaggatggagctggggccaaggaggccgacaagggcaccagcaaggccaaggccgaggaggatgaggaggccgagcgcatcctgcccggcatcctgaatgacaccctgcgcttcggcatgttcctgcaggacctgatcttcatgatcagcgaggagggcgctgtggcctatgaccctgctgccaatgaatgctactgtgccagcctgagcaaccaggtgcccaagaaccacgtgtccctggtgaccaaggagaaccaggtgtttgtggccggcggcctcttctacaatgaagacaacaaggaggaccccatgtctgcctacttcctgcagtttgaccacctggacagcgagtggctgggcatgccacccctgcccagcccccgctgcctgtttggcctgggggaggccctgaacagcatctacgtggtgggcggccgggagatcaaggatggagagcgctgcctggacagcgtgatgtgctatgaccggctgtccttcaagtggggcgagagtgaccccctgccctacgtggtgtatggccacacagtgctgagccacatggacctggtgtatgtgattggaggaaaaggaagtgacaggaagtgcctgaacaagatgtgtgtgtatgaccccaagaagtttgagtggaaggagctggcccccatgcagacagcccggagcctgtttggagccaccgtgcatgatggccgcatcatcgtggccgccggcgtgacagacaccggcctgaccagcagcgctgaggtgtacagcatcacagacaacaagtgggccccctttgaggccttcccccaggagaggagcagcctgagcctggtgtccctggtgggcaccctgtatgccatcggcggctttgccaccctggagacagaaagtggagagctggtgcccacagagctgaatgacatctggagatacaatgaggaggagaagaagtgggagggcgtgctgcgggagatcgcctatgctgctggggccaccttcctgcctgtgcggctgaatgtgctgtgcctgaccaagatgtag

SEQ ID NO: 39477 - DNA, 2025 bp, Artificial Sequence
  Description of Artificial Sequence: Synthetic coding sequence
atgcagagcagagaagatgcccccaggagccggcggctggccagcccccggggcggcaagaggcccaagaagatccacaagcccaccgtgtctgccttcttcaccggccctgaggagctgaaggacacagcccacagcgctgccctgctggcccagctgaagagcttctatgatgcccggctgctgtgtgatgtgaccatcgaggtggtgaccccaggcagcggccctggcaccggccgcctcttcccctgcaacagaaatgtgctggccgccgcctgcccctacttcaagtccatgttcaccggcggcatgtatgagagccagcaggcctctgtgaccatgcatgatgtggatgctgagagctttgaggtgctggtggactactgctacacaggccgggtgtccctgtctgaggccaacgtggagcggctgtatgctgccagtgacatgctgcagctggagtatgtgcgggaggcctgtgccagcttcctggcccggcggctggacctgaccaactgcacagccatcctgaagtttgctgatgccttcggccacaggaagctgcggagccaggcccagagctacatcgcccagaacttcaagcagctgagccacatgggcagcatccgggaggagaccctggccgacctgaccctggcccagctgctggccgtgctgcggctggacagcctggatgtggagagcgagcagacagtgtgccacgtggccgtgcagtggctggaggccgcccccaaggagcggggccccagcgctgctgaggtgttcaagtgtgtgcgctggatgcacttcacagaggaggaccaggactacctggagggcctgctgaccaagcccatcgtgaagaagtactgcctggatgtgattgaaggagccctgcagatgagatatggagacctgctgtacaagagcctggtgcctgtgcccaacagcagcagcagcagcagcagcagcaacagcctggtgtctgctgctgagaaccccccccagaggctgggcatgtgtgccaaggagatggtgatcttcttcggccacccccgggaccccttcctgtgctgtgacccctacagcggggacctgtacaaggtgcccagccccctgacctgcctggcccacaccaggacagtgaccaccctggccgtgtgcatcagcccagaccatgacatctacctggccgcccagcccaggacagacctgtgggtgtacaagccagcccagaacagctggcagcagctggccgaccggctgctgtgccgggagggcatggatgtggcctacctgaatggctacatctacatcctgggcggccgggaccccatcactggagtgaagctgaaggaggtggagtgctacaacgtgaagaggaaccagtgggccctggtggcccccctgccccacagcttcctgagctttgacctgatggtgatccgggactacctgtatgccctgaacagcaagaggatgttctgctatgaccccagccacaacatgtggctgaagtgtgtgtccctgaagagaaatgacttccaggaggcctgtgtgttcaatgaggagatctactgcatctgtgacatccctgtgatgaaggtgtacaaccctgtgcgggcagagtggaggcagatgaacaacatccccctggtgtctgagaccaacaactaccgcatcatcaagcacggccagaagctgctgctgatcaccagcaggaccccccagtggaagaagaacagagtgacagtgtatgaatatgacatccggggggaccagtggatcaacatcggcaccaccctgggcctgctgcagtttgacagcaacttcttctgcctgagcgcccgggtgtaccccagctgcctggagcccggccagagcttcctgacagaggaggaggagatccccagcgagagcagcacagagtgggacctgggcggcttcagcgagccagacagcgagagcggcagcagcagcagcctgagtgatgatgacttctgggtgcgggtggccccccagtag

SEQ ID NO: 39478 - DNA, 1827 bp, Artificial Sequence
  Description of Artificial Sequence: Synthetic coding sequence
atgcagagcagagaagatgcccccaggagccggcggctggccagcccccggggcggcaagaggcccaagaagatccacaagcccaccgtgtctgccttcttcaccggccctgaggagctgaaggacacagcctctgtgaccatgcatgatgtggatgctgagagctttgaggtgctggtggactactgctacacaggccgggtgtccctgtctgaggccaacgtggagcggctgtatgctgccagtgacatgctgcagctggagtatgtgcgggaggcctgtgccagcttcctggcccggcggctggacctgaccaactgcacagccatcctgaagtttgctgatgccttcggccacaggaagctgcggagccaggcccagagctacatcgcccagaacttcaagcagctgagccacatgggcagcatccgggaggagaccctggccgacctgaccctggcccagctgctggccgtgctgcggctggacagcctggatgtggagagcgagcagacagtgtgccacgtggccgtgcagtggctggaggccgcccccaaggagcggggccccagcgctgctgaggtgttcaagtgtgtgcgctggatgcacttcacagaggaggaccaggactacctggagggcctgctgaccaagcccatcgtgaagaagtactgcctggatgtgattgaaggagccctgcagatgagatatggagacctgctgtacaagagcctggtgcctgtgcccaacagcagcagcagcagcagcagcagcaacagcctggtgtctgctgctgagaaccccccccagaggctgggcatgtgtgccaaggagatggtgatcttcttcggccacccccgggaccccttcctgtgctgtgacccctacagcggggacctgtacaaggtgcccagccccctgacctgcctggcccacaccaggacagtgaccaccctggccgtgtgcatcagcccagaccatgacatctacctggccgcccagcccaggacagacctgtgggtgtacaagccagcccagaacagctggcagcagctggccgaccggctgctgtgccgggagggcatggatgtggcctacctgaatggctacatctacatcctgggcggccgggaccccatcactggagtgaagctgaaggaggtggagtgctacaacgtgaagaggaaccagtgggccctggtggcccccctgccccacagcttcctgagctttgacctgatggtgatccgggactacctgtatgccctgaacagcaagaggatgttctgctatgaccccagccacaacatgtggctgaagtgtgtgtccctgaagagaaatgacttccaggaggcctgtgtgttcaatgaggagatctactgcatctgtgacatccctgtgatgaaggtgtacaaccctgtgcgggcagagtggaggcagatgaacaacatccccctggtgtctgagaccaacaactaccgcatcatcaagcacggccagaagctgctgctgatcaccagcaggaccccccagtggaagaagaacagagtgacagtgtatgaatatgacatccggggggaccagtggatcaacatcggcaccaccctgggcctgctgcagtttgacagcaacttcttctgcctgagcgcccgggtgtaccccagctgcctggagcccggccagagcttcctgacagaggaggaggagatccccagcgagagcagcacagagtgggacctgggcggcttcagcgagccagacagcgagagcggcagcagcagcagcctgagtgatgatgacttctgggtgcgggtggccccccagtag

SEQ ID NO: 39479 - DNA, 2055 bp, Artificial Sequence
  Description of Artificial Sequence: Synthetic coding sequence
atgcagagcagagaagatgtgcccaggagccggcggctggccagcccccggggcggccggcggcccaagaggatcagcaagcccagcgtgtctgccttcttcaccggccctgaggagctgaaggacacagcccacagcgctgccctgctggcccagctgaagagcttctatgatgcccggctgctgtgtgatgtgaccatcgaggtggtgaccccaggcagcggccctggcaccggccgcctcttcagctgcaacagaaatgtgctggccgccgcctgcccctacttcaagtccatgttcaccggcggcatgtatgagagccagcaggcctctgtgaccatgcatgatgtggatgctgagagctttgaggtgctggtggactactgctacacaggccgggtgtccctgtctgaggccaacgtgcagaggctgtatgctgccagtgacatgctgcagctggagtatgtgcgggaggcctgtgccagcttcctggcccggcggctggacctgaccaactgcacagccatcctgaagtttgctgatgcctttgaccaccacaagctgcggagccaggcccagagctacatcgcccacaacttcaagcagctgagcaggatgggcagcatccgggaggagaccctggccgacctgaccctggcccagctgctggccgtgctgcggctggacagcctggacattgaaagtgagaggacagtgtgccacgtggccgtgcagtggctggaggccgccgccaaggagcggggccccagcgctgctgaggtgttcaagtgtgtgcgctggatgcacttcacagaggaggaccaggactacctggagggcctgctgaccaagcccatcgtgaagaagtactgcctggatgtgattgaaggagccctgcagatgagatatggagacctgctgtacaagagcctggtgcctgtgcccaacagcagcagcagcagcagcagcagcaacagcctggtgtctgctgctgagaaccccccccagaggctgggcatgtgtgccaaggagatggtgatcttcttcggccacccccgggaccccttcctgtgctatgacccctacagcggggacatctacaccatgcccagccccctgaccagctttgcccacaccaagacagtgaccagcagcgctgtgtgtgtgtccccagaccatgacatctacctggccgcccagcccaggaaggacctgtgggtgtacaagccagcccagaacagctggcagcagctggccgaccggctgctgtgccgggagggcatggatgtggcctacctgaatggctacatctacatcctgggcggccgggaccccatcactggagtgaagctgaaggaggtggagtgctacagcgtgcagaggaaccagtgggccctggtggcccctgtgccccacagcttctacagctttgagctgattgtggtgcagaactacctgtatgctgtgaacagcaagaggatgctgtgctatgaccccagccacaacatgtggctgaactgtgccagcctgaagagaagtgacttccaggaggcctgtgtgttcaatgatgagatctactgcatctgtgacatccctgtgatgaaggtgtacaacccagcccggggggagtggaggcgcatcagcaacatccccctggacagcgagacccacaactaccagatcgtgaaccacgaccagaagctgctgctgatcaccagcaccaccccccagtggaagaagaacagagtgacagtgtatgaatatgacacccgggaggaccagtggatcaacatcggcaccatgctgggcctgctgcagtttgattctggcttcatctgcctgtgtgcccgggtgtaccccagctgcctggagcccggccagagcttcatcacagaagaagatgatgcccggtctgagagcagcacagagtgggacctggatggcttcagcgagctggacagcgagagcggcagcagcagcagcttcagtgatgatgaggtgtgggtgcaggtggccccccagagaaatgcccaggaccagcagggcagcctgtag

SEQ ID NO: 39480 - DNA, 1761 bp, Artificial Sequence
  Description of Artificial Sequence: Synthetic coding sequence
atgttcaccggcggcatgtatgagagccagcaggcctctgtgaccatgcatgatgtggatgctgagagctttgaggtgctggtggactactgctacacaggccgggtgtccctgtctgaggccaacgtgcagaggctgtatgctgccagtgacatgctgcagctggagtatgtgcgggaggcctgtgccagcttcctggcccggcggctggacctgaccaactgcacagccatcctgaagtttgctgatgcctttgaccaccacaagctgcggagccaggcccagagctacatcgcccacaacttcaagcagctgagcaggatgggcagcatccgggaggagaccctggccgacctgaccctggcccagctgctggccgtgctgcggctggacagcctggacattgaaagtgagaggacagtgtgccacgtggccgtgcagtggctggaggccgccgccaaggagcggggccccagcgctgctgaggtgttcaagtgtgtgcgctggatgcacttcacagaggaggaccaggactacctggagggcctgctgaccaagcccatcgtgaagaagtactgcctggatgtgattgaaggagccctgcagatgagatatggagacctgctgtacaagagcctggtgcctgtgcccaacagcagcagcagcagcagcagcagcaacagcctggtgtctgctgctgagaaccccccccagaggctgggcatgtgtgccaaggagatggtgatcttcttcggccacccccgggaccccttcctgtgctatgacccctacagcggggacatctacaccatgcccagccccctgaccagctttgcccacaccaagacagtgaccagcagcgctgtgtgtgtgtccccagaccatgacatctacctggccgcccagcccaggaaggacctgtgggtgtacaagccagcccagaacagctggcagcagctggccgaccggctgctgtgccgggagggcatggatgtggcctacctgaatggctacatctacatcctgggcggccgggaccccatcactggagtgaagctgaaggaggtggagtgctacagcgtgcagaggaaccagtgggccctggtggcccctgtgccccacagcttctacagctttgagctgattgtggtgcagaactacctgtatgctgtgaacagcaagaggatgctgtgctatgaccccagccacaacatgtggctgaactgtgccagcctgaagagaagtgacttccaggaggcctgtgtgttcaatgatgagatctactgcatctgtgacatccctgtgatgaaggtgtacaacccagcccggggggagtggaggcgcatcagcaacatccccctggacagcgagacccacaactaccagatcgtgaaccacgaccagaagctgctgctgatcaccagcaccaccccccagtggaagaagaacagagtgacagtgtatgaatatgacacccgggaggaccagtggatcaacatcggcaccatgctgggcctgctgcagtttgattctggcttcatctgcctgtgtgcccgggtgtaccccagctgcctggagcccggccagagcttcatcacagaagaagatgatgcccggtctgagagcagcacagagtgggacctggatggcttcagcgagctggacagcgagagcggcagcagcagcagcttcagtgatgatgaggtgtgggtgcaggtggccccccagagaaatgcccaggaccagcagggcagcctgtag

SEQ ID NO: 39481 - DNA, 1728 bp, Artificial Sequence
  Description of Artificial Sequence: Synthetic coding sequence
atggaccccttccacgcctgcagcatcctgaagcagctgaagaccatgtatgatgagggccagctgacagacatcgtggtggaggtggaccacggcaagaccttcagctgccacagaaatgtgctggccgccatcagcccctacttccgctccatgttcaccagcggcctgacagagagcacccagaaggaggtgagaattgtgggcgtggaggccgagagcatggacctggtgctgaactatgcctacaccagcagggtcatcctgacagaggccaacgtgcaggccctcttcaccgctgccagcatcttccagatccccagcatccaggaccagtgtgccaagtacatgatcagccacctggacccccagaacagcattggagtcttcatctttgctgaccactacggccaccaggagctgggggacaggagcaaggagtacatcaggaagaagttcctgtgtgtgaccaaggagcaggagttcctgcagctgaccaaggaccagctgatcagcatcctggacagtgatgacctgaatgtggaccgggaggagcacgtgtatgagagcatcatccgctggtttgaacatgagcagaatgaaagagaggtgcacctgcctgagatctttgccaagtgcatccgcttccccctgatggaggacaccttcatcgagaagatccccccccagtttgcccaggccatcgccaagagctgtgtggagaagggccccagcaacaccaacggctgcacccagaggctgggcatgacagccagcgagatgatcatctgctttgatgctgcccacaagcacagcggcaagaagcagacagtgccctgcctggacatcgtgacaggccgggtcttcaagctgtgcaagcccccaaatgacctgcgggaggtgggcatcctggtgtccccagacaatgacatctacatcgccggcggctaccggcccagcagcagcgaggtgtccattgaccacaaggcagaaaatgacttctggatgtatgaccacagcaccaaccgctggctgagcaagcccagcctgctgcgggccagaattggctgcaagctggtgtactgctgcggcaagatgtatgccatcggcggccgggtgtatgaaggagatggaagaaacagcctgaagtctgtggagtgctatgacagccgggagaactgctggaccaccgtgtgtgccatgcctgtggccatggagttccacaatgctgtggagtacaaggagaagatctacgtgctgcagggcgagttcttcctgttctatgagccccagaaggactactggggcttcctgacccccatgacagtgccccgcatccagggcctggccgctgtgtacaaggacagcatctactacatcgccggcacctgtggcaaccaccagaggatgttcaccgtggaggcctatgacatcgagctgaacaagtggaccaggaagaaggacttcccctgtgaccagagcatcaacccctacctgaagctggtgctcttccagaacaagctgcacctgtttgtgcgggccacccaggtgacagtggaggagcacgtgttccgcaccagcaggaagaacagcctgtaccagtatgatgacattgctgaccagtggatgaaggtgtatgagaccccagaccggctgtgggacctgggccgccactttgaatgtgctgtggccaagctgtacccccagtgcctgcagaaggtgctgtag

SEQ ID NO: 39482 - DNA, 1806 bp, Artificial Sequence
  Description of Artificial Sequence: Synthetic coding sequence
atggccgccagcgctgacctgagcaagagcagccccaccccaaatggcatccccagcagtgaccctgccagtgatgccatggaccccttccacgcctgcagcatcctgaagcagctgaagaccatgtatgatgagggccagctgacagacatcgtggtggaggtggaccacggcaagaccttcagctgccacagaaatgtgctggccgccatcagcccctacttccgctccatgttcaccagcggcctgacagagagcacccagaaggaggtgagaattgtgggcgtggaggccgagagcatggacctggtgctgaactatgcctacaccagcagggtcatcctgacagaggccaacgtgcaggccctcttcaccgctgccagcatcttccagatccccagcatccaggaccagtgtgccaagtacatgatcagccacctggacccccagaacagcattggagtcttcatctttgctgaccactacggccaccaggagctgggggacaggagcaaggagtacatcaggaagaagttcctgtgtgtgaccaaggagcaggagttcctgcagctgaccaaggaccagctgatcagcatcctggacagtgatgacctgaatgtggaccgggaggagcacgtgtatgagagcatcatccgctggtttgaacatgagcagaatgaaagagaggtgcacctgcctgagatctttgccaagtgcatccgcttccccctgatggaggacaccttcatcgagaagatccccccccagtttgcccaggccatcgccaagagctgtgtggagaagggccccagcaacaccaacggctgcacccagaggctgggcatgacagccagcgagatgatcatctgctttgatgctgcccacaagcacagcggcaagaagcagacagtgccctgcctggacatcgtgacaggccgggtcttcaagctgtgcaagcccccaaatgacctgcgggaggtgggcatcctggtgtccccagacaatgacatctacatcgccggcggctaccggcccagcagcagcgaggtgtccattgaccacaaggcagaaaatgacttctggatgtatgaccacagcaccaaccgctggctgagcaagcccagcctgctgcgggccagaattggctgcaagctggtgtactgctgcggcaagatgtatgccatcggcggccgggtgtatgaaggagatggaagaaacagcctgaagtctgtggagtgctatgacagccgggagaactgctggaccaccgtgtgtgccatgcctgtggccatggagttccacaatgctgtggagtacaaggagaagatctacgtgctgcagggcgagttcttcctgttctatgagccccagaaggactactggggcttcctgacccccatgacagtgccccgcatccagggcctggccgctgtgtacaaggacagcatctactacatcgccggcacctgtggcaaccaccagaggatgttcaccgtggaggcctatgacatcgagctgaacaagtggaccaggaagaaggacttcccctgtgaccagagcatcaacccctacctgaagctggtgctcttccagaacaagctgcacctgtttgtgcgggccacccaggtgacagtggaggagcacgtgttccgcaccagcaggaagaacagcctgtaccagtatgatgacattgctgaccagtggatgaaggtgtatgagaccccagaccggctgtgggacctgggccgccactttgaatgtgctgtggccaagctgtacccccagtgcctgcagaaggtgctgtag

SEQ ID NO: 39483 - DNA, 948 bp, Artificial Sequence
  Description of Artificial Sequence: Synthetic coding sequence
atggatgtgaacaagtttgaggcctctgtgggcttcctggatgtgaagaagttcctgagcacctggaagctgcagaaccccaggacccactttgtgctgagcccccactgcttcatgggcggcatcatggcccccaaggacatcatgaccaacacccacgccaagagcatcctgaacagcatgaacagcctgaggaagagcaacaccctgtgtgatgtgaccctgcgggtggagcagaaggacttccctgcccacagaattgtgctggccgcctgcagcgactacttctgtgccatgttcaccagcgagctgtctgagaagggcaagccctacgtggacatccagggcctgacagccagcaccatggagatcctgctggactttgtgtacacagaaacagtgcacgtgacagtggagaatgtgcaggagctgctgcctgctgcctgcctgctgcagctgaagggcgtgaagcaggcctgctgtgagttcctggagagccagctggaccccagcaactgcctgggcatccgggactttgctgagacccacaactgtgtggacctgatgcaggccgctgaggtgttcagccagaagcacttccctgaggtggtgcagcacgaggagttcatcctgctgagccagggcgaggtggagaagctgatcaagtgtgatgagatccaggtggacagcgaggagcctgtgtttgaagctgtgatcaactgggtgaagcacgccaagaaggagcgggaggagagcctgcccaacctgctgcagtatgtgaggatgcccctgctgaccccccgctacatcacagatgtgattgatgctgagcccttcatccgctgcagcctgcagtgccgggacctggtggatgaggccaagaagttccacctgcggcctgagctgcggagccagatgcagggccccaggacccgggcccggctgtag

SEQ ID NO: 39484 - DNA, 615 bp, Artificial Sequence
  Description of Artificial Sequence: Synthetic coding sequence
atgcagggccccaggacccgggcccggctgggcgccaatgaggtgctgctggtggtgggcggcttcggcagccagcagagccccattgatgtggtggagaagtatgaccccaagacccaggagtggagcttcctgcccagcatcaccaggaagaggcgctacgtggcctctgtgtccctgcatgaccgcatctacgtgattggaggctatgatggccgcagccggctgagctctgtggagtgcctggactacacagcagatgaagatggagtgtggtacagcgtggcccccatgaatgtgagaagaggcctggccggggccaccaccctgggggacatgatctacgtgtctgggggctttgatggcagccgccgccacacctccatggagagatatgaccccaacatcgaccagtggagcatgctgggggacatgcagacagcccgggagggcgccggcctggtggtggccagcggggtcatctactgcctgggcggctatgatggcctgaacatcctgaacagcgtggagaagtatgacccccacacaggccactggaccaacgtgacccccatggccaccaagagaagtgacatgatggtgatcccctgctag

SEQ ID NO: 39485 - DNA, 1707 bp, Artificial Sequence
  Description of Artificial Sequence: Synthetic coding sequence
atgggcggcatcatggcccccaaggacatcatgaccaacacccacgccaagagcatcctgaacagcatgaacagcctgaggaagagcaacaccctgtgtgatgtgaccctgcgggtggagcagaaggacttccctgcccacagaattgtgctggccgcctgcagcgactacttctgtgccatgttcaccagcgagctgtctgagaagggcaagccctacgtggacatccagggcctgacagccagcaccatggagatcctgctggactttgtgtacacagaaacagtgcacgtgacagtggagaatgtgcaggagctgctgcctgctgcctgcctgctgcagctgaagggcgtgaagcaggcctgctgtgagttcctggagagccagctggaccccagcaactgcctgggcatccgggactttgctgagacccacaactgtgtggacctgatgcaggccgctgaggtgttcagccagaagcacttccctgaggtggtgcagcacgaggagttcatcctgctgagccagggcgaggtggagaagctgatcaagtgtgatgagatccaggtggacagcgaggagcctgtgtttgaagctgtgatcaactgggtgaagcacgccaagaaggagcgggaggagagcctgcccaacctgctgcagtatgtgaggatgcccctgctgaccccccgctacatcacagatgtgattgatgctgagcccttcatccgctgcagcctgcagtgccgggacctggtggatgaggccaagaagttccacctgcggcctgagctgcggagccagatgcagggccccaggacccgggcccggctgggcgccaatgaggtgctgctggtggtgggcggcttcggcagccagcagagccccattgatgtggtggagaagtatgaccccaagacccaggagtggagcttcctgcccagcatcaccaggaagagaagatatgtggcctctgtgtccctgcatgaccgcatctacgtgattggaggctatgatggccgcagccggctgagctctgtggagtgcctggactacacagcagatgaagatggagtgtggtacagcgtggcccccatgaatgtgcggcggggcctggccggggccaccaccctgggggacatgatctacgtgtctgggggctttgatggcagcagaagacacacctccatggagagatatgaccccaacatcgaccagtggagcatgctgggggacatgcagacagcccgggagggcgccggcctggtggtggccagcggggtcatctactgcctgggcggctatgatggcctgaacatcctgaacagcgtggagaagtatgacccccacacaggccactggaccaacgtgacccccatggccaccaagaggtctggggccggcgtggccctgctgaatgaccacatctacgtggtgggcggctttgatggaacagcccacctgagctctgtggaggcctacaacatcagaacagacagctggaccaccgtgacctccatgaccaccccccgctgctacgtgggcgccaccgtgctgcggggccgcctgtatgccatcgccggctatgatggcaacagcctgctgagcagcattgagtgctatgaccccatcatcgacagctgggaggtggtgacctccatgggcacccagagatgtgatgctggggtgtgtgtgctgcgggagaagtag

SEQ ID NO: 39486 - DNA, 1821 bp, Artificial Sequence
  Description of Artificial Sequence: Synthetic coding sequence
atggatgtgaacaagtttgaggcctctgtgggcttcctggatgtgaagaagttcctgagcacctggaagctgcagaaccccaggacccactttgtgctgagcccccactgcttcatgggcggcatcatggcccccaaggacatcatgaccaacacccacgccaagagcatcctgaacagcatgaacagcctgaggaagagcaacaccctgtgtgatgtgaccctgcgggtggagcagaaggacttccctgcccacagaattgtgctggccgcctgcagcgactacttctgtgccatgttcaccagcgagctgtctgagaagggcaagccctacgtggacatccagggcctgacagccagcaccatggagatcctgctggactttgtgtacacagaaacagtgcacgtgacagtggagaatgtgcaggagctgctgcctgctgcctgcctgctgcagctgaagggcgtgaagcaggcctgctgtgagttcctggagagccagctggaccccagcaactgcctgggcatccgggactttgctgagacccacaactgtgtggacctgatgcaggccgctgaggtgttcagccagaagcacttccctgaggtggtgcagcacgaggagttcatcctgctgagccagggcgaggtggagaagctgatcaagtgtgatgagatccaggtggacagcgaggagcctgtgtttgaagctgtgatcaactgggtgaagcacgccaagaaggagcgggaggagagcctgcccaacctgctgcagtatgtgaggatgcccctgctgaccccccgctacatcacagatgtgattgatgctgagcccttcatccgctgcagcctgcagtgccgggacctggtggatgaggccaagaagttccacctgcggcctgagctgcggagccagatgcagggccccaggacccgggcccggctgggcgccaatgaggtgctgctggtggtgggcggcttcggcagccagcagagccccattgatgtggtggagaagtatgaccccaagacccaggagtggagcttcctgcccagcatcaccaggaagagaagatatgtggcctctgtgtccctgcatgaccgcatctacgtgattggaggctatgatggccgcagccggctgagctctgtggagtgcctggactacacagcagatgaagatggagtgtggtacagcgtggcccccatgaatgtgcggcggggcctggccggggccaccaccctgggggacatgatctacgtgtctgggggctttgatggcagcagaagacacacctccatggagagatatgaccccaacatcgaccagtggagcatgctgggggacatgcagacagcccgggagggcgccggcctggtggtggccagcggggtcatctactgcctgggcggctatgatggcctgaacatcctgaacagcgtggagaagtatgacccccacacaggccactggaccaacgtgacccccatggccaccaagaggtctggggccggcgtggccctgctgaatgaccacatctacgtggtgggcggctttgatggaacagcccacctgagctctgtggaggcctacaacatcagaacagacagctggaccaccgtgacctccatgaccaccccccgctgctacgtgggcgccaccgtgctgcggggccgcctgtatgccatcgccggctatgatggcaacagcctgctgagcagcattgagtgctatgaccccatcatcgacagctgggaggtggtgacctccatgggcacccagagatgtgatgctggggtgtgtgtgctgcgggagaagtag

SEQ ID NO: 39487 - DNA, 1815 bp, Artificial Sequence
  Description of Artificial Sequence: Synthetic coding sequence
atggctggagatgtggagggcttctgcagcagcatccatgacacctctgtgtctgctggcttccgggccctgtatgaggagggcctgctgctggatgtgaccctggtgattgaggaccaccagttccaggcccacaaggccctgctggccacccagagcgactacttccgcatcatgttcaccgctgacatgagggagcgggaccaggacaagatccacctgaagggcctgacagccaccggcttcagccacgtgctgcagttcatgtactacggcaccatcgagctgtccatgaacacagtgcatgagatcctgcaggccgccatgtatgtgcagctgattgaggtggtgaagttctgctgcagcttcctgctggccaagatctgcctggagaactgtgccgagatcatgaggctgctggatgactttggagtgaacattgaaggagtgcgggagaagctggacaccttcctgctggacaactttgtgcccctgatgagcaggccagacttcctgagctacctgagctttgagaagctgatgagctacctggacaatgaccacctgagccgcttccctgagattgagctgtatgaggccgtgcagagctggctgcggcatgacagaagacgctggaggcacacagacaccatcatccagaacatccgcttctgcctgatgacccccacctctgtgtttgagaaggtgaagaccagcgagttctaccgctacagccggcagctgcgctatgaggtggaccaggccctgaactacttccagaatgtgcaccagcagcccctgctggacatgaagagcagccgcatccgcagcgccaagccccagaccaccgtcttccggggcatgattggccacagcatggtgaacagcaagatcctgctgctgaagaagccccgggtgtggtgggagctggagggcccccaggtgcccctgcggccagactgcctggccatcgtgaacaactttgtgttcctgctgggcggggaggagctgggcccagatggagagttccacgccagcagcaaggtgttccgctatgacccccggcagaacagctggctgcagatggctgacatgtctgtgcccaggagtgaatttgctgtgggcgtgattggcaagttcatctatgctgtggccggccgcaccagagatgagaccttctacagcacagaaagatatgacatcaccaatgacaagtgggagtttgtggacccctaccctgtgaacaagtatggccacgagggcaccgtgctgaacaacaagctgttcatcactggaggcatcaccagcagcagcaccagcaagcaggtgtgtgtgtttgaccccagcaaggagggcaccatcgagcagaggaccaggaggacccaggtggtgaccaactgctgggagaacaagagcaagatgaactatgcccgctgcttccacaagatgatctcctacaacgggaagctgtatgtgtttggaggagtgtgtgtgatcctgcgggccagctttgagagccagggctgccccagcacagaggtgtacaaccctgagacagaccagtggaccatcctggcctccatgcccatcggccgcagcggccatggagtgacagtgctggacaagcagatcatggtgctgggcggcctgtgctacaacggccactacagcgacagcatcctgacctttgatcctgatgagaacaagtggaaggaggatgagtaccccaggatgccctgcaagctggatggcctgcaggtgtgcaacctgcacttcccagactatgtgctggatgaggtgcggcgctgcaactag

SEQ ID NO: 39488 - DNA, 1437 bp, Artificial Sequence
  Description of Artificial Sequence: Synthetic coding sequence
atggacaccagtgacctgtttgccagctgcaggaaaggagatgtgggccgggtgcgctacctgctggagcagagagatgtggaggtgaatgtgcgggacaagtgggacagcacccccctgtactatgcctgcctgtgtggccacgaggagctggtgctgtacctgctggccaacggggcccgctgtgaggccaacacctttgatggagagcgctgcctgtatggagccctgagtgaccccatccggcgggccctgcgggactacaagcaggtgacagccagctgcagaagaagagactactatgatgacttcctgcagaggctgctggagcagggcatccacagtgatgtggtgtttgtggtgcacggcaagcccttccgggtgcaccgctgtgtgctgggcgcccggagcgcctactttgccaacatgctggacaccaagtggaagggcaagtctgtggtggtgctgcggcaccccctcatcaaccctgtggccttcggggccctgctgcagtacctgtacacaggccgcctggacatcggcgtggagcacgtgtctgactgtgagcggctggccaagcagtgccagctgtgggacctgctgagtgacctggaggccaagtgtgagaaggtgtctgaatttgtggccagcaagccaggcacctgtgtgaaggtgctgaccatcgagcccccacctgctgacccccggctgcgggaggacatggccctgctggccgactgtgccctgcccccagagctgcggggggacctgtgggagctgcccttcccctgcccagatggcttcaacagctgcccagacatctgcttccgggtggccggctgcagcttcctgtgccacaaggccttcttctgtggccgcagtgactacttccgggccctgctggatgaccacttccgggagagcgaggagcccgccaccagcggcggccccccagctgtgaccctgcacggcatcagcccagatgtgttcacccacgtgctgtactacatgtacagcgaccacacagagctgagccctgaggccgcctatgatgtgctgtctgtggccgacatgtacctgctgcccggcctgaagaggctgtgtggccgcagcctggcccagatgctggatgaggacacagtggtgggcgtgtggagggtggccaagctgttccggctggcccggctggaggaccagtgcacagagtacatggccaaggtgattgagaagctggtggagagagaagattttgtggaggccgtgaaggaggaggccgctgctgtggccgcccggcaggagacagacagcatccccctggtggatgacatccgcttccacgtggccagcacagtgcagacctacagcgccatcgaggaggcccagcagaggctgcgggccctggaggacctgctggtgtccatcggcctggactgctag

SEQ ID NO: 39489 - DNA, 1389 bp, Artificial Sequence
  Description of Artificial Sequence: Synthetic coding sequence
atgggcgccagcttcctgcagctgcagagcatcaaggatgcctgctgcaccttcctgcgggagcggctgcaccccaagaactgcctgggcgtgcggcagtttgctgagaccatgatgtgtgctgtgctgtatgatgctgccaacagcttcatccaccagcactttgtggaggtgtccatgtctgaggagttcctggccctgcccctggaggatgtgctggagctggtgtccagagatgagctgaatgtgaagtctgaggagcaggtgtttgaggccgccctggcctgggtgcgctatgaccgggagcagaggggcccctacctgcctgagctgctgagcaacatccggctgcccctgtgccggccccagttcctgagtgacagagtgcagcaggatgacctggtgcgctgctgccacaagtgccgggacctggtggatgaggccaaggactaccacctgatgcctgagcggcggccccacctgcctgccttccgcacccggccccgctgctgcaccagcattgctggcctcatctatgctgtgggcggcctgaacagcgctggggacagcctgaatgtggtggaggtgtttgaccccatcgccaactgctgggagcgctgccggcccatgaccacagcccggagccgggtgggcgtggccgtggtgaatggcctgctgtatgccatcggcggctatgatggccagctgcggctgagcacagtggaggcctacaaccctgagacagacacctggaccagggtgggctccatgaacagcaagaggtctgccatgggcaccgtggtgctggatggccagatctacgtgtgtggcggctatgatggcaacagcagcctgagctctgtggagacctacagccctgagacagacaagtggacagtggtgacctccatgagcagcaacagatctgctgctggggtgacagtgtttgagggccgcatctacgtgtctgggggccatgatggcctgcagatcttcagctctgtggagcactacaaccaccacacagccacctggcaccctgctgctggcatgctgaacaagcgctgccgccacggggccgccagcctgggcagcaagatgtttgtgtgtggcggctatgatggcagcggcttcctgagcattgctgagatgtacagctctgtggccgaccagtggtgcctgattgtgcccatgcacaccaggaggagccgggtgtccctggtggccagctgtggccgcctgtatgctgtgggcggctatgatggccagagcaacctgagctctgtggagatgtatgaccctgagacagactgctggaccttcatggcccccatggcctgccacgagggcggcgtgggcgtgggctgcatccccctgctgaccatctag

SEQ ID NO: 39490 - DNA, 1905 bp, Artificial Sequence
  Description of Artificial Sequence: Synthetic coding sequence
atggccgaggagcaggagttcacccagctgtgcaagctgcctgcccagcccagccacccccactgtgtgaacaacacctacagaagtgcccagcacagccaggccctgctgcggggcctgctggccctgcgggacagcggcatcctgtttgatgtggtgctggtggtggagggccgccacatcgaggcccaccgcatcctgctggccgccagctgtgactacttccggggcatgtttgctgggggcctgaaggagatggagcaggaggaggtgctgatccacggcgtgtcctacaatgccatgtgccagatcctgcacttcatctacaccagcgagctggagctgagcctgagcaatgtgcaggagaccctggtggccgcctgccagctgcagatccctgagatcatccacttctgctgtgacttcctgatgtcctgggtggatgaggagaacatcctggatgtgtaccgcctggccgagctgtttgacctgagccggctgacagagcagctggacacctacatcctgaagaactttgtggccttcagcaggacagacaagtaccggcagctgcccctggagaaggtgtacagcctgctgagcagcaaccggctggaggtgtcctgtgaaacagaggtgtatgagggcgccctgctgtaccactacagcctggagcaggtgcaggccgaccagatcagcctgcacgagccccccaagctgctggagaccgtgcgcttccccctgatggaggccgaggtgctgcagaggctgcatgacaagctggaccccagccccctgcgggacacagtggccagcgccctgatgtaccacagaaatgaaagcctgcagcccagcctgcagagcccccagacagagctgcggagtgacttccagtgtgtggtgggctttggaggcatccacagcacccccagcacagtgctgagtgaccaggccaagtacctgaaccccctgctgggggagtggaagcacttcaccgccagcctggcccccaggatgagcaaccagggcattgctgtgctgaacaactttgtgtacctgattggaggagacaacaacgtgcagggcttccgggcagagagccgctgctggaggtatgaccccaggcacaaccgctggttccagatccagagcctgcagcaggagcacgccgacctgtctgtgtgtgtggtgggccgctacatctatgctgtggccggccgggactaccacaatgacctgaatgctgtggagagatatgaccctgccaccaacagctgggcctacgtggcccccctgaagcgggaggtgtatgcccacgccggggccaccctggagggcaagatgtacatcacctgtggcagaagaggagaggactacctgaaggagacccactgctatgaccccggcagcaacacctggcacaccctggctgatggccctgtgcggcgggcctggcacggcatggccaccctgctgaacaagctgtatgtgattggaggcagcaacaatgatgctggctacagaagagatgtgcaccaggtggcctgctacagctgcaccagcggccagtggagctctgtgtgccccctgcctgctggccacggggagcccggcattgctgtgctggacaaccgcatctacgtgctgggcggccgcagccacaacagaggcagcaggacaggctacgtgcacatctatgatgtggagaaggactgctgggaggagggcccccagctggacaacagcatcagcggcctggccgcctgtgtgctgaccctgcccaggagcctgctgctggagcccccccggggcaccccagacaggagccaggccgaccctgactttgccagcgaggtgatgtctgtgtctgactgggaggagtttgacaacagcagtgaagattag

SEQ ID NO: 39491 - DNA, 1476 bp, Artificial Sequence
  Description of Artificial Sequence: Synthetic coding sequence
atgtcctgggtggatgaggagaacatcctggatgtgtaccgcctggccgagctgtttgacctgagccggctgacagagcagctggacacctacatcctgaagaactttgtggccttcagcaggacagacaagtaccggcagctgcccctggagaaggtgtacagcctgctgagcagcaaccggctggaggtgtcctgtgaaacagaggtgtatgaaggagccctgctgtaccactacagcctggagcaggtgcaggccgaccagatcagcctgcacgagccccccaagctgctggagaccgtgcgcttccccctgatggaggccgaggtgctgcagaggctgcatgacaagctggaccccagccccctgcgggacacagtggccagcgccctgatgtaccacagaaatgaaagcctgcagcccagcctgcagagcccccagacagagctgcggagtgacttccagtgtgtggtgggctttggaggcatccacagcacccccagcacagtgctgagtgaccaggccaagtacctgaaccccctgctgggggagtggaagcacttcaccgccagcctggcccccaggatgagcaaccagggcattgctgtgctgaacaactttgtgtacctgattggaggagacaacaacgtgcagggcttccgggcagagagccgctgctggaggtatgaccccaggcacaaccgctggttccagatccagagcctgcagcaggagcacgccgacctgtctgtgtgtgtggtgggccgctacatctatgctgtggccggccgggactaccacaatgacctgaatgctgtggagagatatgaccctgccaccaacagctgggcctacgtggcccccctgaagcgggaggtgtatgcccatgctggggccaccctggagggcaagatgtacatcacctgtggcagaagaggagaggactacctgaaggagacccactgctatgaccccggcagcaacacctggcacaccctggctgatggccctgtgagaagagcctggcacggcatggccaccctgctgaacaagctgtatgtgattggaggcagcaacaatgatgctggctacagaagagatgtgcaccaggtggcctgctacagctgcaccagcggccagtggagctctgtgtgccccctgcctgctggccatggagagcccggcattgctgtgctggacaaccgcatctacgtgctgggcggccgcagccacaacagaggcagcaggacaggctacgtgcacatctatgatgtggagaaggactgctgggaggagggcccccagctggacaacagcatcagcggcctggccgcctgtgtgctgaccctgcccaggagcctgctgctggagcccccccggggcaccccagacaggagccaggccgaccctgactttgccagcgaggtgatgtctgtgtctgactgggaggagtttgacaacagcagcgaggactag

SEQ ID NO: 39492 - DNA, 708 bp, Artificial Sequence
  Description of Artificial Sequence: Synthetic coding sequence
atggccgaggagcaggagttcacccagctgtgcaagctgcctgcccagcccagccacccccactgtgtgaacaacacctacagaagtgcccagcacagccaggccctgctgcggggcctgctggccctgcgggacagcggcatcctgtttgatgtggtgctggtggtggagggccgccacatcgaggcccaccgcatcctgctggccgccagctgtgactacttccggggcatgtttgctgggggcctgaaggagatggagcaggaggaggtgctgatccacggcgtgtcctacaatgccatgtgccagatcctgcacttcatctacaccagcgagctggagctgagcctgagcaatgtgcaggagaccctggtggccgcctgccagctgcagatccctgagatcatccacttctgctgtgacttcctgatgtcctgggtggatgaggagaacatcctggatgtgtaccgcctggccgagctgtttgacctgagccggctgacagagcagctggacacctacatcctgaagaactttgtggccttcagcaggacagacaagtaccggcagctgcccctggagaaggtgtacagcctgctgagcagcaaccggctggaggtgtcctgtgaaacagaggtgtatgagggcgccctgctgtaccactacagcctggagcaggtgcaggccgaccagatcagcctgcactag

SEQ ID NO: 39493 - DNA, 1677 bp, Artificial Sequence
  Description of Artificial Sequence: Synthetic coding sequence
atggccctgaagggccaggaggactacatctacctgttcaaggacagcacccaccctgtggacttcctggatgccttccgcaccttctacctggatggcctcttcacagacatcaccctgcagtgccccagcggcatcatcttccactgccacagagctgtgctggccgcctgcagcaactacttcaaggccatgttcaccgctgacatgaaggagaagttcaagaacaagatcaagctgagcggcatccaccacgacatcctggagggcctggtgaactatgcctacaccagccagatcgagatcaccaagagaaatgtgcagagcctgctggaggccgctgacctgctgcagttcctgtctgtgaagaaggcctgtgagcgcttcctggtgcgccacctggacatcgacaactgcatcggcatgcacagctttgctgagttccacgtgtgcccagagctggagaaggagagccgccgcatcctgtgcagcaagttcaaggaggtgtggcagcaggaggagttcctggagatcagcctggagaagttcctgttcatcctgagcaggaagaacctgtctgtgtggaaggaggaggccatcatcgagcctgtgatcaagtggacagcccatgatgtggagaacagaattgaatgtctgtacaacctgctgagctacatcaacatcgacatcgaccctgtgtacctgaagacagccctgggcctgcagaggagctgcctgctgacagagaacaagatccgcagcctcatctacaatgccctgaaccccatgcacaaggagatcagccagaggagcacagccaccatgtacatcatcggcggctactactggcaccccctgtctgaggtgcacatctgggaccccctgaccaacgtgtggatccagggcgctgagatcccagactacacccgggagagctatggagtgacctgcctgggccccaacatctacgtgactggaggctacagaacagacaacatcgaggccctggacacagtgtggatctacaacagcgagagtgatgagtggacagagggcctgcccatgctgaatgcccgctactaccactgtgctgtgaccctgggcggctgtgtgtatgccctgggcggctacagaaaaggagccccagctgaggaggccgagttctatgaccccctgaaggagaagtggatccccatcgccaacatgatcaagggcgtgggcaatgccacagcctgtgtgctgcatgatgtgatctacgtgattggaggccactgcggctaccggggcagctgcacctatgacaaggtgcagagctacaacagcgacatcaatgagtggagcctcatcaccagcagcccccacccagaatatggcctgtgcagcgtgccctttgagaacaagctgtacctggtgggcggccagaccaccatcacagaatgttatgaccctgagcagaatgagtggagagaaattgcccccatgatggagaggaggatggagtgtggggctgtgatcatgaatggctgcatctacgtgactggaggctacagctacagcaagggcacctacctgcagagcattgagaagtatgaccctgacctgaacaagtgggagatcgtgggcaacctgcccagcgccatgaggagccacggctgtgtgtgtgtgtacaacgtgtag

SEQ ID NO: 39494 - DNA, 1677 bp, Artificial Sequence; identical to SEQ ID NO: 39493
  Description of Artificial Sequence: Synthetic coding sequence

SEQ ID NO: 39495 - DNA, 1848 bp, Artificial Sequence
  Description of Artificial Sequence: Synthetic coding sequence
atggccgagagcggcggcagcagcggcggggccggcggcggcggggcctttggagctggccctggccctgagcggcccaacagcacagctgacaagaatggagccctgaagtgcaccttcagcgcccccagccacagcaccagcctgctgcagggcctggccaccctgcgggcccagggccagctgctggatgtggtgctgaccatcaaccgggaggccttccctgcccacaaggtggtgctggccgcctgcagcgactacttccgggccatgttcaccggcggcatgagggaggccagccaggacgtcatcgagctgaagggcgtgtctgcccggggcctgcggcacatcatcgactttgcctacagcgctgaggtgaccctggacctggactgtgtgcaggatgtgctgggcgctgctgtgttcctgcagatgctgcctgtggtggagctgtgtgaggagttcctgaaggccgccatgtctgtggagacctgcctgaacatcggccagatggccaccaccttcagcctggccagcctgcgggagagcgtggatgccttcaccttccgccacttcctgcagattgctgaggaggaggacttcctgcggctgcccctggagcggctggtgttcttcctgcagagcaaccggctgcagagctgtgccgagattgacctcttccgggctgctgtgcgctggctgcagcacgaccctgcccggcggccccgggccagccacgtgctgtgccacatccgcttccccctgatgcagagcagcgagctggtggacagcgtgcagaccctggacatcatggtggaggatgtgctgtgccggcagtacctgctggaggccttcaactaccaggtgctgcccttccggcagcacgagatgcagagccccaggacagctgtgcggagtgatgtgcccagcctggtgaccttcggcggcaccccctacacagacagcgacagatctgtgagcagcaaggtgtaccagctgcctgagcccggggcccggcacttccgggagctgacagagatggaggtgggctgcagccacacctgtgtggccgtgctggacaactttgtgtatgtggccggcggccagcacctgcagtacagaagtggagagggcgctgtggatgcctgctaccgctatgacccccacctgaaccgctggctgcggctgcaggccatgcaggagagccgcatccagttccagctgaatgtgctgtgtggcatggtgtatgccaccggcggcaggaacagagctggcagcctggcctctgtggagcgctactgccccaggagaaatgagtggggctacgcctgcagcctgaagaggaggacctggggccacgccggggccgccagcggcggccgcctgtacatcagcggcggctacggcatctctgtggaggacaagaaggccctgcactgctatgaccctgtggccgaccagtgggagttcaaggcccccatgtctgagccccgggtgctgcacgccatggtgggcgctgggggccgcatctatgccctgggcggccgcatggaccacgtggaccgctgctttgatgtgctggccgtggagtactacgtgcctgagacagaccagtggacctctgtgagccccatgagagctggccagagcgaggccggctgctgcctgctggagaggaagatctacatcgtgggcggctacaactggaggctgaacaacgtgactggaattgtgcaggtgtacaacacagacacagatgagtgggagcgggacctgcacttccctgagagctttgctggcatcgcctgtgcccctgtgctgctgcccagggctggcaccaggaggtag

SEQ ID NO: 39496 - DNA, 438 bp, Artificial Sequence
  Description of Artificial Sequence: Synthetic coding sequence
atggccgagagcggcggcagcagcggcggggccggcggcggcggggcctttggagctggccctggccctgagcggcccaacagcacagctgacaagaatggagccctgaagtgcaccttcagcgcccccagccacagcaccagcctgctgcagggcctggccaccctgcgggcccagggccagctgctggatgtggtgctgaccatcaaccgggaggccttccctgcccacaaggtggtgctggccgcctgcagcgactacttccgggccatgttcaccggcggcatgagggaggccagccaggacgtcatcgagctgaagggcgtgtctgcccggggcctgcggcacatcatcgactttgcctacagcgctgaggtgaccctggacctggactgtgtgcaggaggtggcccccaagaccccaggcaccctggcctag

SEQ ID NO: 39497 - DNA, 1716 bp, Artificial Sequence
  Description of Artificial Sequence: Synthetic coding sequence
atggaccacaccagccccacctacatgctggccaacctgacccacctgcacagcgagcagctgctgcagggcctgaacctgctgcggcagcaccacgagctgtgtgacatcatcctgcgggtgggagatgtgaagatccacgcccacaaggtggtgctggcctctgtgagcccctacttcaaggccatgttcaccggcaacctgtctgagaaggagaacagcgaggtggagttccagtgcattgatgaaacagccctgcaggccatcgtggagtatgcctacacaggaacagtgttcatcagccaggacacagtggagagcctgctgcctgctgccaacctgctgcagatcaagctggtgctgaaggagtgctgtgccttcctggagagccagctggaccccggcaactgcatcggcatcagcagatttgctgagacctacggctgccgggacctgtacctggccgccaccaagtacatctgccagaactttgaggccgtgtgccagacagaggagttctttgagctgacccatgctgacctggatgagatcgtgtccaatgactgcctgaatgtggccacagaggagaccgtcttctacgccctggagagctggatcaagtatgatgtgcaggagcggcagaagtacctggcccagctgctgaacagcgtgcggctgcccctgctgtctgtgaagttcctgacccggctgtatgaggccaaccacctgatcagagatgacaggacctgcaagcacctgctgaatgaggccctgaagtaccacttcatgcctgagcaccggctgagccaccagacagtgctgatgacccggccccgctgtgcccccaaggtgctgtgtgctgtgggcggcaagagcggcctgtttgcctgcctggacagcgtggagatgtacttcccccagaatgacagctggattggcctggcccccctgaacatccccaggtatgaatttggcatctgtgtgctggaccagaaggtgtatgtgattggaggcatcgccaccaacgtgcggcctggggtgaccatcaggaagcatgaaaattctgtggagtgctggaacccagacaccaacacctggaccagcctggagaggatgaatgaaagccgcagcaccctgggcgtggtggtgctggccggggagctgtatgccctgggcggctatgatggccagagctacctgcagagcgtggagaagtacatccccaagatcaggaagtggcagcctgtggcccccatgaccaccaccaggagctgctttgctgctgctgtgctggatggcatgatctatgccatcggcggctacggccctgcccacatgaacagcgtggagagatatgaccccagcaaggacagctgggagatggtggcctccatggctgacaagaggatccactttggagtgggcgtgatgctgggcttcatctttgtggtgggcggccacaacggggtgagccacctgagcagcattgaaagatatgacccccaccagaaccagtggacagtgtgccggcccatgaaggagcccaggactggagtgggcgccgccgtcatcgacaactacctgtatgtggtgggcggccacagcggcagcagctacctgaacacagtgcagaagtatgaccccatcagtgacacctggctggacagcgctggcatgatctactgccgctgcaactttggcctgacagccctgtag

SEQ ID NO: 39498 - DNA, 255 bp, Artificial Sequence
  Description of Artificial Sequence: Synthetic coding sequence
atggaccacaccagccccacctacatgctggccaacctgacccacctgcacagcgagcagctgctgcagggcctgaacctgctgcggcagcaccacgagctgtgtgacatcatcctgcgggtgggagatgtgaagatccacgcccacaaggtggtgctggcctctgtgagcccctacttcaaggccatgttcaccggcaacctgtctgagaaggagaacagcgaggtggagttccagtgcattgatgagacctag

SEQ ID NO: 39499 - DNA, 489 bp, Artificial Sequence
  Description of Artificial Sequence: Synthetic coding sequence
atggaccacaccagccccacctacatgctggccaacctgacccacctgcacagcgagcagctgctgcagggcctgaacctgctgcggcagcaccacgagctgtgtgacatcatcctgcgggtgggagatgtgaagatccacgcccacaaggtggtgctggcctctgtgagcccctacttcaaggccatgttcaccggcaacctgtctgagaaggagaacagcgaggtggagttccagtgcattgatgaaacagccctgcaggccatcgtggagtatgcctacacaggaacagtgttcatcagccaggacacagtggagagcctgctgcctgctgccaacctgctgcagatcaagctggtgctgaaggagtgctgtgccttcctggagagccagctggaccccggcaactgcatcggcatcagcagatttgctgagacctacggctgccgggacctgtacctggccgccaccaagtacatctgccagtag

SEQ ID NO: 39500 - DNA, 138 bp, Artificial Sequence
  Description of Artificial Sequence: Synthetic coding sequence
atggaccacaccagccccacctacatgctggccaacctgacccacctgcacagcgagcagctgctgcagggcctgaacctgctgcggcagcaccacgagctgtgtgacatcatcctgcgggtgggagatgtgaagtag

SEQ ID NO: 39501 - DNA, 2628 bp, Artificial Sequence
  Description of Artificial Sequence: Synthetic coding sequence
atgagccgccaccacagcagatttgagcgggactacagagtgggctgggaccggcgggagtggagcgtgaatggcacccacggcaccaccagcatctgcagcgtgaccagcggggccggcggcggcacagccagcagcctgtctgtgcggcccggcctgctgcccctgcctgtggtgcccagccggctgcccaccccagccacagccccagccccctgcaccaccggcagcagcgaggccatcaccagcctggtggccagcagcgccagcgctgtgaccaccaaggcccctggcatcagcaaaggagacagccagagccagggcctggccaccagcatccgctggggccagacccccatcaaccagagcaccccctgggacacagatgagccccccagcaagcagatgagggagagtgacaaccctggcaccggcccctgggtgaccaccgtggccgccggcaaccagcccaccctcatcgcccacagctatggagtggcccagccccccaccttcagccctgctgtgaatgtgcaggcccctgtgattggagtgacccccagcctgcccccccacgtgggcccccagctgcccctgatgcctggccactacagcctgccccagccccccagccagcccctgagctctgtggtggtgaacatgcctgcccaggccctgtatgccagcccccagcccctggccgtgtccaccctgcccggggtgggccaggtggcccggcccggccccacagctgtgggcaatggccacatggccggccccctgctgcccccacctcctccagcccagcccagcgccaccctgcccagcggggccccagccaccaacggcccccccaccacagattctgcccacggcctgcagatgctgcggaccatcggcgtgggcaagtatgagttcacagatcctggccacccccgggagatgctgaaggagctgaaccagcagaggcgggccaaggccttcacagacctgaagatcgtggtggagggccgggagtttgaggtgcaccagaatgtgctggccagctgcagcctgtacttcaaggacctgatccagaggtctgtgcaggacagcggccagggcggccgggagaagctggagctggtgctgagcaacctgcaggctgatgtgctggagctgctgctggagtttgtgtacacaggcagcctggtgattgattctgccaatgccaagaccctgctggaggccgccagcaagttccagttccacaccttctgcaaggtgtgtgtgtccttcctggagaagcagctgacagccagcaactgcctgggcgtgctggccatggccgaggccatgcagtgcagcgagctgtaccacatggccaaggcctttgccctgcagatcttccctgaggtggccgcccaggaggagatcctgagcatcagcaaggatgacttcatcgcctacgtgtccaatgacagcctgaacaccaaggccgaggagctggtgtatgagaccgtcatcaagtggatcaagaaggaccctgccaccaggacccagtatgctgctgagctgctggccgtggtgcggctgcccttcatccaccccagctacctgctgaatgtggtggacaatgaggagctgatcaagagcagcgaggcctgccgggacctggtgaatgaggccaagcgctaccacatgctgccccacgcccggcaggagatgcagacccccaggacccggccccggctgtctgctggggtggccgaggtgattgtgctggtgggcggccggcagatggtgggcatgacccagaggagcctggtggccgtgacctgctggaacccccagaacaacaagtggtaccccctggccagcctgcccttctatgaccgggagttcttctctgtggtgtctgctggggacaacatctacctgagcggcggcatggagagcggcgtgaccctggctgatgtgtggtgctacatgagcctgctggacaactggaacctggtgtccaggatgacagtgccccgctgccgccacaacagcctggtgtatgatggcaagatctacaccctgggcggcctgggcgtggccggaaatgtggaccacgtggagagatatgacaccatcaccaaccagtgggaggccgtggcccccctgcccaaggctgtgcacagcgctgctgccaccgtgtgtggcggcaagatctacgtgtttggaggagtgaatgaagctggccgggctgctggggtgctgcagagctatgtgccccagaccaacacctggagcttcatcgagagccccatgattgacaacaagtatgccccagctgtgaccctgaatggatttgtgttcatcctgggcggggcctatgcccgggccaccaccatctatgaccctgagaagggcaacatcaaggccggccccaacatgaaccacagccggcagttctgcagcgctgtggtgctggatggcaagatctatgccaccggcggcatcgtgagcagcgagggccctgccctgggcaacatggaggcctatgagcccaccaccaacacctggaccctgctgccccacatgccctgccctgtgttcagacatggctgtgtggtgatcaagaagtacatccagagcggctag

SEQ ID NO: 39502 - DNA, 1683 bp, Artificial Sequence
  Description of Artificial Sequence: Synthetic coding sequence
atgctggatggcctgcagaggctgcggagccagcccaagctggctgatgtgaccctgctggtgggcggccgggagctgccctgccaccggggcctgctggccctgagcagcccctacttccacgccatgtttgctggggactttgctgagagcttcagcgcccgggtggagctgagagatgtggagcctgctgtggtgggccagctggtggactttgtgtacacaggccgcctgaccatcacccagggcaatgtggaggccctgaccaggacagctgcccggctgcacttccccagcgtgcagaaggtgtgtggccgctacctgcagcagcagctggatgctgccaactgcctgggcatctgtgaatttggagagcagcagggcctgctgggcgtggccgccaaggcctgggccttcctgcgggagaactttgaggccgtggcccgggaggatgagttcctgcagctgccccgggagcggctggtgacctgcctggccggggacctgctgcaggtgcagcctgagcagagccggctggaggccctgatgcgctgggtgagacatgacccccaggcccgggccgcccacctgcctgagctgctgagcctggtgcacctggatgctgtgccccggccctgtgtgcagcagctgctggccagcgagcccctcatccaggagagcgaggcctgccgggccgccctgagccagggccatgatggagcccccctggccctgcagcagaagctggaggaggtgctggtggtggtgggcggccaggccctggaggaggaggaggccggggaggagcccaccccaggcctgggcaactttgccttctacaacagcaaggccaagcgctggatggccctgcctgacttcccagactaccacaagtggggcttcagcctggccgccctgaacaacaacatctacgtgactggaggcagccggggcaccaagacagacacctggagcaccacccaggcctggtgcttccccctgaaggaggcctcctggaagcctgtggcccccatgctgaagcccaggaccaaccacgccagcgctgccctgaatggagagatctacgtgattggaggcaccaccctggatgtggtggaggtggagagctatgacccctacacagacagctggacccctgtgtccccagccctgaagtatgtgagcaacttctctgctgctggctgccggggccgcctgtacctggtgggcagcagcgcctgcaagtacaatgccctggccctgcagtgctacaaccctgtgacagatgcctggagcgtcatcgccagccccttcctgcccaagtacctgagcagcccccgctgtgccgccctgcacggggagctgtacctgattggagacaacaccaagaaggtgtatgtgtatgaccccggggccaacctgtggcagaaggtgcagagccagcacagcctgcatgaaaatggagccctggtgcccctgggagatgccctgtatgtgactggaggccgctggcagggcatggagggggactaccacgtggagatggaggcctatgacacagtgcgggacacctggaccaggcatggagccctgccccggctgtggctgtaccacggggccagcaccgtcttcctggatgtgtccaagtggacccagcccagcggccccacccaggagcactag

SEQ ID NO: 39503 - DNA, 1737 bp, Artificial Sequence
  Description of Artificial Sequence: Synthetic coding sequence
atggtgagaaatgtggatgacctggacttccacctgcccagccacgcccaggacatgctggatggcctgcagaggctgcggagccagcccaagctggctgatgtgaccctgctggtgggcggccgggagctgccctgccaccggggcctgctggccctgagcagcccctacttccacgccatgtttgctggggactttgctgagagcttcagcgcccgggtggagctgagagatgtggagcctgctgtggtgggccagctggtggactttgtgtacacaggccgcctgaccatcacccagggcaatgtggaggccctgaccaggacagctgcccggctgcacttccccagcgtgcagaaggtgtgtggccgctacctgcagcagcagctggatgctgccaactgcctgggcatctgtgaatttggagagcagcagggcctgctgggcgtggccgccaaggcctgggccttcctgcgggagaactttgaggccgtggcccgggaggatgagttcctgcagctgccccgggagcggctggtgacctgcctggccggggacctgctgcaggtgcagcctgagcagagccggctggaggccctgatgcgctgggtgagacatgacccccaggcccgggccgcccacctgcctgagctgctgagcctggtgcacctggatgctgtgccccggccctgtgtgcagcagctgctggccagcgagcccctcatccaggagagcgaggcctgccgggccgccctgagccagggccatgatggagcccccctggccctgcagcagaagctggaggaggtgctggtggtggtgggcggccaggccctggaggaggaggaggccggggaggagcccaccccaggcctgggcaactttgccttctacaacagcaaggccaagcgctggatggccctgcctgacttcccagactaccacaagtggggcttcagcctggccgccctgaacaacaacatctacgtgactggaggcagccggggcaccaagacagacacctggagcaccacccaggcctggtgcttccccctgaaggaggcctcctggaagcctgtggcccccatgctgaagcccaggaccaaccacgccagcgctgccctgaatggagagatctacgtgattggaggcaccaccctggatgtggtggaggtggagagctatgacccctacacagacagctggacccctgtgtccccagccctgaagtatgtgagcaacttctctgctgctggctgccggggccgcctgtacctggtgggcagcagcgcctgcaagtacaatgccctggccctgcagtgctacaaccctgtgacagatgcctggagcgtcatcgccagccccttcctgcccaagtacctgagcagcccccgctgtgccgccctgcacggggagctgtacctgattggagacaacaccaagaaggtgtatgtgtatgaccccggggccaacctgtggcagaaggtgcagagccagcacagcctgcatgaaaatggagccctggtgcccctgggagatgccctgtatgtgactggaggccgctggcagggcatggagggggactaccacgtggagatggaggcctatgacacagtgcgggacacctggaccaggcatggagccctgccccggctgtggctgtaccacggggccagcaccgtcttcctggatgtgtccaagtggacccagcccagcggccccacccaggagcactag

SEQ ID NO: 39504 - DNA, 420 bp, Artificial Sequence
  Description of Artificial Sequence: Synthetic coding sequence
atgcccagcgagcgctgcctgagcatccaggagatgctgaccggccagaggctgtgccacagcgagagccacaatgattctgtgctggccgccctgaaccagcagaggagtgatggcatcctgtgtgacatcaccctgattgctgaggagcagaagttccacgcccacaaggctgtgctggccgcctgcagcgactacttccgggccatgttcagcctgtgcatggtggagagcggggctgatgaggtgaacctgcacggcgtgaccagcctgggcctgaagcaggccctggagtttgcctacacaggccagatcctgctggagcccggggtcatccaggatgtgctggccgccggcagccacctgcagctgctggagctgctgaacctgtgcagccactacctgatccaggtggagtag

SEQ ID NO: 39505 - DNA, 621 bp, Artificial Sequence
  Description of Artificial Sequence: Synthetic coding sequence
atggtggagagcggggctgatgaggtgaacctgcacggcgtgaccagcctgggcctgaagcaggccctggagtttgcctacacaggccagatcctgctggagcccggggtcatccaggatgtgctggccgccggcagccacctgcagctgctggagctgctgaacctgtgcagccactacctgatccaggagctgaacagcttcaactacctggacctgtaccgcctggccgacctcttcaacctgaccctgctggagaaggccgtcatcgacttcctggtgaagcacctgtctgagctgctgaagagcaggcctgaggaggtgctgaccctgccctactgcctgctgcaggaggtgctgaagagtgaccggctgaccagcctgtctgaggagcagatctggcagaagtgtggcatctgtgccgccttctgtgccctgcggggggactggtgccccggcctgccccagtgggatgacaagacagccagctgtgaggtggtgggcacccagctgcccctgcctgtgcacggccgggccccagccatccaccccctgtggcccaacggctgcggctacagcccctacagctgccctgtgcccccaccctgccccagcaagtag

SEQ ID NO: 39506 - DNA, 1863 bp, Artificial Sequence
  Description of Artificial Sequence: Synthetic coding sequence
atgcccagcgagcgctgcctgagcatccaggagatgctgaccggccagaggctgtgccacagcgagagccacaatgattctgtgctggccgccctgaaccagcagaggagtgatggcatcctgtgtgacatcaccctgattgctgaggagcagaagttccacgcccacaaggctgtgctggccgcctgcagcgactacttccgggccatgttcagcctgtgcatggtggagagcggggctgatgaggtgaacctgcacggcgtgaccagcctgggcctgaagcaggccctggagtttgcctacacaggccagatcctgctggagcccggggtcatccaggatgtgctggccgccggcagccacctgcagctgctggagctgctgaacctgtgcagccactacctgatccaggagctgaacagcttcaactacctggacctgtaccgcctggccgacctcttcaacctgaccctgctggagaaggccgtcatcgacttcctggtgaagcacctgtctgagctgctgaagagcaggcctgaggaggtgctgaccctgccctactgcctgctgcaggaggtgctgaagagtgaccggctgaccagcctgtctgaggagcagatctggcagctggccgtgcgctggctggagcacaactgccactaccagtacatggatgagctgctgcagtacatccgcttcggcctgatggatgtggacaccctgcacacagtggccctgagccaccccctggtgcaggccagcgagacagccacagccctggtgaatgaggccctggagtaccaccagagcatctatgcccagcctgtgtggcagaccaggaggaccaagccccgcttccagagcgacaccctgtacatcatcggcggcaagaagcgggaggtgtgcaaggtgaaggagctgcgctacttcaaccctgtggaccaggagaatgccctgattgctgccatcgccaactggagcgagctggcccccatgcctgtgggccgcagccaccactgtgtggccgtgatgggagacttcctgtttgtggccggcggggaggtggagcacgccagcggccgcacctgtgctgtgaggacagcctgccgctatgaccccaggagcaacagctgggccgagatcgcccccatgaagaactgccgggagcactttgtgctgggcgccatggaggagtacctgtatgctgtgggcggcagaaatgagctgcggcaggtgctgcccaccgtggagcgctactgccccaagaagaacaagtggacctttgtgcagagctttgacaggagcctgagctgccacgccggctacgtggctgatggcctgctgtggatctctggaggagtgaccaacacagcccagtaccagaaccggctgatggtgtatgagcccaaccagaacaagtggatcagccgcagccccatgctgcagaggagagtgtaccacagcatggctgctgtgcagaggaagctgtatgtgctgggcggcaatgacctggactacaacaatgaccgcatcctggtgcgccacatcgacagctacaacatcgacacagaccagtggacccgctgcaacttcaacctgctgaccggccagaatgaaagtggagtggccgtgcacaacggccgcatctacctggtgggcggctacagcatctggaccaatgagcccctggcctgcatccaggtgctggatgtgtcccgggagggcaaggaggaggtgttctacggccccaccctgccctttgccagcaatggaattgctgcctgcttcctgcctgccccctacttcacctgccccaacctgcagaccctgcaggtgccccaccacagaattggcaccatctag

SEQ ID NO: 39507 - DNA, 531 bp, Artificial Sequence
  Description of Artificial Sequence: Synthetic coding sequence
atcctgctggagcccggggtcatccaggatgtgctggccgccggcagccacctgcagctgctggagctgctgaacctgtgcagccactacctgatccaggagctgaacagcttcaactacctggacctgtaccgcctggccgacctcttcaacctgaccctgctggagaaggccgtcatcgacttcctggtgaagcacctgtctgagctgctgaagagcaggcctgaggaggtgctgaccctgccctactgcctgctgcaggaggtgctgaagagtgaccggctgaccagcctgtctgaggagcagatctggcagaagtgtggcatctgtgccgccttctgtgccctgcggggggactggtgccccggcctgccccagtgggatgacaagacagccagctgtgaggtggtgggcacccagctgcccctgcctgtgcacggccgggccccagccatccaccccctgtggcccaacggctgcggctacagcccctacagctgccctgtgcccccaccctgccccagcaagtag

SEQ ID NO: 39508 - DNA, 1755 bp, Artificial Sequence
  Description of Artificial Sequence: Synthetic coding sequence
atgcccagcgagcgctgcctgagcatccaggagatgctgaccggccagaggctgtgccacagcgagagccacaatgattctgtgctggccgccctgaaccagcagaggagtgatggcatcctgtgtgacatcaccctgattgctgaggagcagaagttccacgcccacaaggctgtgctggccgcctgcagcgactacttccgcatcctgctggagcccggggtcatccaggatgtgctggccgccggcagccacctgcagctgctggagctgctgaacctgtgcagccactacctgatccaggagctgaacagcttcaactacctggacctgtaccgcctggccgacctcttcaacctgaccctgctggagaaggccgtcatcgacttcctggtgaagcacctgtctgagctgctgaagagcaggcctgaggaggtgctgaccctgccctactgcctgctgcaggaggtgctgaagagtgaccggctgaccagcctgtctgaggagcagatctggcagctggccgtgcgctggctggagcacaactgccactaccagtacatggatgagctgctgcagtacatccgcttcggcctgatggatgtggacaccctgcacacagtggccctgagccaccccctggtgcaggccagcgagacagccacagccctggtgaatgaggccctggagtaccaccagagcatctatgcccagcctgtgtggcagaccaggaggaccaagccccgcttccagagcgacaccctgtacatcatcggcggcaagaagcgggaggtgtgcaaggtgaaggagctgcgctacttcaaccctgtggaccaggagaatgccctgattgctgccatcgccaactggagcgagctggcccccatgcctgtgggccgcagccaccactgtgtggccgtgatgggagacttcctgtttgtggccggcggggaggtggagcacgccagcggccgcacctgtgctgtgaggacagcctgccgctatgaccccaggagcaacagctgggccgagatcgcccccatgaagaactgccgggagcactttgtgctgggcgccatggaggagtacctgtatgctgtgggcggcagaaatgagctgcggcaggtgctgcccaccgtggagcgctactgccccaagaagaacaagtggacctttgtgcagagctttgacaggagcctgagctgccacgccggctacgtggctgatggcctgctgtggatctctggaggagtgaccaacacagcccagtaccagaaccggctgatggtgtatgagcccaaccagaacaagtggatcagccgcagccccatgctgcagaggagagtgtaccacagcatggctgctgtgcagaggaagctgtatgtgctgggcggcaatgacctggactacaacaatgaccgcatcctggtgcgccacatcgacagctacaacatcgacacagaccagtggacccgctgcaacttcaacctgctgaccggccagaatgaaagtggagtggccgtgcacaacggccgcatctacctggtgggcggctacagcatctggaccaatgagcccctggcctgcatccaggtgctggatgtgtcccgggagggcaaggaggaggtgttctacggccccaccctgccctttgccagcaatggaattgctgcctgcttcctgcctgccccctacttcacctgccccaacctgcagaccctgcaggtgccccaccacagaattggcaccatctag

SEQ ID NO: 39509 - DNA, 1656 bp, Artificial Sequence
  Description of Artificial Sequence: Synthetic coding sequence
atgcccagcgagcgctgcctgagcatccaggagatgctgaccggccagaggctgtgccacagcgagagccacaatgattctgtgctggccgccctgaaccagcagaggagtgatggcatcctgtgtgacatcaccctgattgctgaggagcagaagttccacgcccacaaggctgtgctggccgcctgcagcgactacttccgggagctgaacagcttcaactacctggacctgtaccgcctggccgacctcttcaacctgaccctgctggagaaggctgtgattgacttcctggtgaagcacctgtctgagctgctgaagagcaggcctgaggaggtgctgaccctgccctactgcctgctgcaggaggtgctgaagagtgaccggctgaccagcctgtctgaggagcagatctggcagctggccgtgcgctggctggagcacaactgccactaccagtacatggatgagctgctgcagtacatccgcttcggcctgatggatgtggacaccctgcacacagtggccctgagccaccccctggtgcaggccagcgagacagccacagccctggtgaatgaggccctggagtaccaccagagcatctatgcccagcctgtgtggcagaccaggaggaccaagccccgcttccagagcgacaccctgtacatcattggaggcaagaagcgggaggtgtgcaaggtgaaggagctgcgctacttcaaccctgtggaccaggagaatgccctgattgctgccatcgccaactggagcgagctggcccccatgcctgtgggccgcagccaccactgtgtggccgtgatgggagacttcctgtttgtggccggcggggaggtggagcacgccagcggccgcacctgtgctgtgaggacagcctgccgctatgaccccaggagcaacagctgggccgagatcgcccccatgaagaactgccgggagcactttgtgctgggcgccatggaggagtacctgtatgctgtgggcggcagaaatgagctgcggcaggtgctgcccaccgtggagcgctactgccccaagaagaacaagtggacctttgtgcagagctttgacaggagcctgagctgccacgccggctacgtggctgatggcctgctgtggatcagcggcggcgtgaccaacacagcccagtaccagaaccggctgatggtgtatgagcccaaccagaacaagtggatcagccgcagccccatgctgcagaggagagtgtaccacagcatggctgctgtgcagaggaagctgtatgtgctgggcggcaatgacctggactacaacaatgaccgcatcctggtgcgccacatcgacagctacaacatcgacacagaccagtggacccgctgcaacttcaacctgctgaccggccagaatgaaagtggagtggccgtgcacaacggccgcatctacctggtgggcggctacagcatctggaccaatgagcccctggcctgcatccaggtgctggatgtgtcccgggagggcaaggaggaggtgttctacggccccaccctgccctttgccagcaatggaattgctgcctgcttcctgcctgccccctacttcacctgccccaacctgcagaccctgcaggtgccccaccaccgcatcggcaccatctag

SEQ ID NO: 39510 - DNA, 531 bp, Artificial Sequence
  Description of Artificial Sequence: Synthetic coding sequence
atgctgcccctgagccaccctggaggagtgaccaacacagcccagtaccagaaccggctgatggtgtatgagcccaaccagaacaagtggatcagccgcagccccatgctgcagaggagagtgtaccacagcatggctgctgtgcagaggaagctgtatgtgctgggcggcaatgacctggactacaacaatgaccgcatcctggtgcgccacatcgacagctacaacatcgacacagaccagtggacccgctgcaacttcaacctgctgaccggccagaatgaaagtggagtggccgtgcacaacggccgcatctacctggtgggcggctacagcatctggaccaatgagcccctggcctgcatccaggtgctggatgtgtcccgggagggcaaggaggaggtgttctacggccccaccctgccctttgccagcaatggaattgctgcctgcttcctgcctgccccctacttcacctgccccaacctgcagaccctgcaggtgccccaccacagaattggcaccatctag

SEQ ID NO: 39511 - DNA, 1602 bp, Artificial Sequence
  Description of Artificial Sequence: Synthetic coding sequence
atgctgctgagcggcatgagggagagccagggcacagaggtgtccctgcggaccatcagcacccaggacctgcggctgctggtgtcctttgcctacagcggcgtggtgcgggcccgctggccaggcctgctgcgggccgcccaggccgccctgcagtaccagagcagcagctgcctggacctgtgccagaagggcctggcccggggcctgagccctgcccgctgcctggccctcttccccatggccgaggcccctggcctggagcggctgtggagcaaggcccggcactacctgctgacccacctgcctgctgtggccctgtgcccagccttccccagcctgcctgctgcctgcctggccgagctgctggacagtgatgagctgcacgtgcaggaggagtttgaggcctttgtggccgcccgctgctggctggccgccaaccctgagacccaggagagcgaggccaaggccctgctgcgctgtgtgcgcttcggccgcatgagcacccgggagctgcggcgggtgcgggccgccggcctgctgccccccctgaccccagacctgctgcaccagctgatggtggaggctgatgtgcccggccaggagcggcggcgggagccagaccgggccctggtggtgattggaggagatggcctgcggccagacatggccctgcggcagcccagcagagctgtgtggtgggcccgggccttccgctgtggggtgggcctggtgaggacagtggagtggggccagctgcctgccctgcctgcccctggccgcttccgccacggggccgccagcctggccggcagcgagctgtatgtgtgtggcggccaggacttctacagccacagcaacaccctggccagcaccctgcgctgggagcccagccaggaggactgggaggagatggcccccctgagccaggcccggagcctcttcagcctggtggccctggatggcaagctgtatgccctgggcggccgccacaatgatgtggccctggacagcgtggagacctacaaccctgagctgaatgtgtggaggcctgccccagccctgcctgccccctgctttgcccatgctgctgccatcctggagggccagctgtatgtgtctgggggctgcggcggcaccggccagtacctggccagcctgatgcactatgaccccaagctggagaagccaggcaccttcctgagccccatgggcgtgcccagggctggccacgtgatggccgccctgggcggccgcctgtatgtggccggcggcctgggggagacagaggacctgctgagctttgaggcctatgagctgaggacagacagctggacccacctggcccccctgcccagcccccacgtgggcgccgccagcgctgtgctgcagggcgagctgctggtgctgggcggctacagccacaggacctacgccctgagccacctgattcatgcctactgccccggcctgggccgctggctgtgcctgggcaccctgccccggcccagggctgagatgcctgcctgcatcctgaccctgcctgctgtgcagcacatcgccctggtgcccaccccccaccagaccaagccagctggatag

SEQ ID NO: 39512 - DNA, 1935 bp, Artificial Sequence
  Description of Artificial Sequence: Synthetic coding sequence
atgagctacttcctgagctactgcaaggcccatggaggagccctgctgaccggctaccaggccctgcgggcagagggcttcctgtgtgatgtgaccctggagacagagggcagcgagttccctgcccacaggagcctgctggcctgcagcagtgactacttccgggccctcttcaagagccacacccaggagagccgggcccgggtcatccacctgcacgtgcccagcgctgctggcctgcagaggctgctggacttcatctacacagcctggctgagcctgtccatggacacagtggaggacaccctggaggccgccagctacctgcaggtgacagaggccctgggcctgtgtggccgctacctggagcggcagctggcccctgagaactgctgctttgctgccaacgtggccgccaggtttggcctggcccacaccctggatgctgctgagcgctgcatcgtgagccacctgcaggagctgctggcccggggggccggccctgctggcctgctggagctgaaccccaccagcctgcgggctgtgctgggcgccccagatgtggcccgggtgcctgaggcccggctgctgggcctggccctggcctggctgcggcaggagcccaccacagagcggctggcccactgcacagagctgctggagcgggtgcgcttcggcctggtgcctgcagatgtgctgcggcgggtgtacagcggcagcggcctggtgctgcctgcccgggtgaagggcctcatcatccaggccctgaactaccacaccacccccagccggcagcccctgatgcagggcgagcagaccagcatccgcagcccccagacccgcatcctgctggtgggcggccggcgggcccgggaggtggtgattgaggaggtggccgccccccagagagctgcccggggccaggtggccgcccctgagcctgaggaggaggaggaggagctggaggaggaggaggaggaggaggagtgggagctgacccagaatgtggtggcctttgatgtgtacaaccaccgctggaggagcctgacccagctgcccacccccctgctgggccacagcgtgtgcacagctggcaacttcctgtttgtgctgggcggggagagccccagcggcagcgccagcagccccctggctgatgacagccgggtggtgacagcccaggtgcacagatatgacccccgcttccacgcctggacagaggtgcctgccatgagggaggcccgggcccacttctggtgtggggctgtgggggagcggctgctggccgtgggcggcctgggcgccggcggggaggtgctggcctctgtggagatgtatgacctgcggcgggaccgctggacagctgctggggccctgccccgggccctgcacggccatgctggagctgtgggggaccggggcgtggtgtacatcagcggcggcaaggccggccgcggggagggcggggccagcagcctgcgggacctgtatgtgctgggccctgaggagcaggtgtggagcaagaaggcccccatgggcacagccaggtttggccaccacatggctgtgctgcggggagctgtgtttgccttcctgggccgctatgagcccttcagcgagattgaaagatatgaccccggggctgaccagtggacccggctgcggcccctgccctatgaccgcttctgctacggcctggccgtggtggaggagacagccctgctgctgggcggcctgaagtggagggacagccggcaggtgcccaccagaaatgtggtgggctatgacctggacctggaccgctgggaggacatcggctgtgccctgccctgggcctggagcggcctgcgctgtgctgtgctgcagctggccgagggcggagatgatgagcgggagggggaggtgggggaggccctggacctggtgctgggctag

SEQ ID NO: 39513 - DNA, 1092 bp, Artificial Sequence
  Description of Artificial Sequence: Synthetic coding sequence
atgcgctgggtgagacatgatgccccagcccggcggggccagctgcggcggctgctggagcacgtgcggctgcccctgctggccccagcctacttcctggagaaggtggaggctgatgagctgctgcaggcctgtggagaatgtcggcccctgctgctggaggcccgggcctgcttcatcctgggccgggaggccggggccctgcggacccggccccggcgcttcatggacctggccgaggtgattgtggtgattggaggctgtgacaggaagggcctgctgaagctgccctttgctgatgcctaccaccctgagagccagcgctggacccccctgcccagcctgcccggctacaccaggagtgaatttgctgcctgtgccctgagaaatgatgtgtatgtgtctgggggccacatcaacagccatgatgtgtggatgttcagcagccacctgcacacctggatcaaggtggccagcctgcacaagggccgctggaggcacaagatggctgtggtgcagggccagctgtttgctgtgggcggctttgatggcctgcggcggctgcacagcgtggagagatatgaccccttcagcaacacctgggccgccgccgcccccctgcctgaggccgtgtcctctgctgctgtggccagctgtgccggcaagctgtttgtgattggaggagcccggcagggcggcgtgaacacagacaaggtgcagtgctttgaccccaaggaggaccgctggagcctgcggagccctgcccccttcagccagcgctgcctggaggccgtgtccctggaggacaccatctacgtgatgggcggcctgatgagcaagatcttcacctatgaccccggcacagatgtgtggggcgaggccgctgtgctgcccagccctgtggagagctgtggggtgacagtgtgtgatggcaaggtgcacatcctgggcggcagagatgacagaggagagagcacagacaaggtgttcacctttgaccccagcagcggccaggtggaggtgcagcccagcctgcagcgctgcaccagcagccacggctgtgtgaccatcatccagagcctgggccgctag

SEQ ID NO: 39514 - DNA, 1752 bp, Artificial Sequence
  Description of Artificial Sequence: Synthetic coding sequence
atgaggcagggccacgcccctgaggagagcgagcccggctgtgaggccccctgtgccggcccctgccacgcccagagggtgctgcaggccctgaatgcctacagaagaagtggcaccctgacagatgtggtgctgcgggccggcggccgggacttcccctgccacagagctgccctgtctgctggcagcgcctacttccgcagcctgtttgctgctggccggcctgagcggggccctgctgtggtgcctgtggtgcctgtggcccctgaggcccctggcaccagccctgctggagctgctgctgccctggccgtggtgctggactatgtgtatggagctggggtgcggctgcgggcagaagatgaagctgctgctgtgctggccctggccgagcggctgggcgtggccggcctgcgggaggcctgtgtgcgcttcctggagggccgcctgcgggccgccaacagcctggccctgcggcgggtggccgccgccttcagcctggcccccctggccgagcgctgtggccgggtgctgcggcaggcctttgctgaggtggcccggcatgctgacttcctggagctggccccagatgaggtggtggccctgctggccgaccctgccctgggcgtggcccgggaggaggccgtgtttgaagctgccatgcgctgggtgagacatgatgccccagcccggcggggccagctgcggcggctgctggagcacgtgcggctgcccctgctggccccagcctacttcctggagaaggtggaggctgatgagctgctgcaggcctgtggagaatgtcggcccctgctgctggaggcccgggcctgcttcatcctgggccgggaggccggggccctgcggacccggccccggcgcttcatggacctggccgaggtgattgtggtgattggaggctgtgacaggaagggcctgctgaagctgccctttgctgatgcctaccaccctgagagccagcgctggacccccctgcccagcctgcccggctacaccaggagtgaatttgctgcctgtgccctgagaaatgatgtgtatgtgtctgggggccacatcaacagccatgatgtgtggatgttcagcagccacctgcacacctggatcaaggtggccagcctgcacaagggccgctggaggcacaagatggctgtggtgcagggccagctgtttgctgtgggcggctttgatggcctgcggcggctgcacagcgtggagagatatgaccccttcagcaacacctgggccgccgccgcccccctgcctgaggccgtgtcctctgctgctgtggccagctgtgccggcaagctgtttgtgattggaggagcccggcagggcggcgtgaacacagacaaggtgcagtgctttgaccccaaggaggaccgctggagcctgcggagccctgcccccttcagccagcgctgcctggaggccgtgtccctggaggacaccatctacgtgatgggcggcctgatgagcaagatcttcacctatgaccccggcacagatgtgtggggcgaggccgctgtgctgcccagccctgtggagagctgtggggtgacagtgtgtgatggcaaggtgcacatcctgggcggcagagatgacagaggagagagcacagacaaggtgttcacctttgaccccagcagcggccaggtggaggtgcagcccagcctgcagcgctgcaccagcagccacggctgtgtgaccatcatccagagcctgggccgctag

SEQ ID NO: 39515 - DNA, 1662 bp, Artificial Sequence
  Description of Artificial Sequence: Synthetic coding sequence
atgatggagggcagccggcagaccagggtgtcccggccctacaagatcagcgagagcagcaaggtgtaccgctgggccgaccacagcagcacagtgctgcagaggctgaatgagcagaggctgcggggcctcttctgtgatgtggtgctggtggctgatgagcagagggtgcctgcccacaggaacctgctggccgtgtgcagcgactacttcaacagcatgttcaccatcggcatgagggaggccttccagaaggaggtggagctgattggagccagctacatcggcctgaaggctgtggtggacttcctgtatggaggagagctggtgctggatggcggcaacatcgactatgtgctggagacagcccacctgctgcagatctggacagtggtggacttctgctgtgagtacctggagcaggaggtgtctgaggacaactacctgtacctgcaggagctggccagcatctacagcctgaagaggctggatgccttcattgatggcttcatcctgaaccacttcggcaccctgtccttcaccccagacttcctgcagaatgtgtccatgcagaagctgtgtgtgtacctgagcagcagcgaggtgcagagagaatgtgaacatgacctgctgcaggccgccctgcagtggctgacccagcagcctgagcgggaggcccacgcccggcaggtgctggagaacatccacttccccctcatccccaagaatgacctgctgcaccgggtgaagccagctgtgtgcagcctgctgcccaaggaggccaactgtgagggcttcatcgaggaggccgtgcgctaccacaacaacctggccgcccagcctgtgatgcagaccaagaggacagccctgcggaccaaccaggagcggctgctgtttgtgggcggggaggtgtctgagcgctgcctggagctgagtgatgacacctgctacctggatgccaagtctgagcagtgggtgaaggagacccccctgcctgcccggcgcagccaccactgtgtggccgtgctgggcggcttcatcttcatcgccggcggcagcttcagccgggacaatggaggagatgctgccagcaacctgctgtaccgcttcacctacggccatgctggcaccatctacaaggactttgtgtacatcagcggcggccatgactaccagatcggcccctacaggaagaacctgctgtgctatgaccacaggacagatgtgtgggaggagcggcggcccatgaccacagcccggggctggcacagcatgtgcagcctgggggacagcatctacagcattggaggcagtgatgacaacatcgagagcatggagagatttgatgtgctgggcgtggaggcctacagcccccagtgcaaccagtggaccagggtggcccccctgctgcacgccaacagcgagagcggcgtggccgtgtgggagggccgcatctacatcctgggcggctacagctgggagaacacagccttcagcaagacagtgcaggtgtatgaccgggaggccgacaagtggagcagaggagtggacctgcccaaggccatcgccggcggcagcgcctgtgtgtgtgccctggagcccaggcctgaggacaagaagaagaagggcaagggcaagaggcaccaggaccggggccagtag

SEQ ID NO: 39516 - DNA, 1851 bp, Artificial Sequence
  Description of Artificial Sequence: Synthetic coding sequence
atgatggagggcagccggcagaccagggtgtcccggccctacaagatcagcgagagcagcaaggtgtaccgctgggccgaccacagcagcacagtgctgcagaggctgaatgagcagaggctgcggggcctcttctgtgatgtggtgctggtggctgatgagcagagggtgcctgcccacaggaacctgctggccgtgtgcagcgactacttcaacagcatgttcaccatcggcatgagggaggccttccagaaggaggtggagctgattggagccagctacatcggcctgaaggctgtggtggacttcctgtatggaggagagctggtgctggatggcggcaacatcgactatgtgctggagacagcccacctgctgcagatctggacagtggtggacttctgctgtgagtacctggagcaggaggtgtctgaggacaactacctgtacctgcaggagctggccagcatctacagcctgaagaggctggatgccttcattgatggcttcatcctgaaccacttcggcaccctgtccttcaccccagacttcctgcagaatgtgtccatgcagaagctgtgtgtgtacctgagcagcagcgaggtgcagagagaatgtgaacatgacctgctgcaggccgccctgcagtggctgacccagcagcctgagcgggaggcccacgcccggcaggtgctggagaacatccacttccccctcatccccaagaatgacctgctgcaccgggtgaagccagctgtgtgcagcctgctgcccaaggaggccaactgtgagggcttcatcgaggaggccgtgcgctaccacaacaacctggccgcccagcctgtgatgcagaccaagaggacagccctgcggaccaaccaggagcggctgctgtttgtgggcggggaggtgtctgagcgctgcctggagctgagtgatgacacctgctacctggatgccaagtctgagcagtgggtgaaggagacccccctgcctgcccggcgcagccaccactgtgtggccgtgctgggcggcttcatcttcatcgccggcggcagcttcagccgggacaatggaggagatgctgccagcaacctgctgtaccgctatgacccccgctgcaagcagtggatcaaggtggcctccatgaaccagaggagagtggacttctacctggccagcattgaggacatgctggtggccatcggcggcagaaatgaaaatggagccctgagctctgtggagacctacagccccaagacagacagctggagctatgtggccggcctgccccgcttcacctacggccacgccggcaccatctacaaggactttgtgtacatcagcggcggccatgactaccagatcggcccctacaggaagaacctgctgtgctatgaccacaggacagatgtgtgggaggagcggcggcccatgaccacagcccggggctggcacagcatgtgcagcctgggggacagcatctacagcatcggcggcagtgatgacaacattgaatccatggagagatttgatgtgctgggcgtggaggcctacagcccccagtgcaaccagtggaccagggtggcccccctgctgcacgccaacagcgagagcggcgtggccgtgtgggagggccgcatctacatcctgggcggctacagctgggagaacacagccttcagcaagacagtgcaggtgtatgaccgggaggccgacaagtggagccggggcgtggacctgcccaaggccatcgccggcggcagcgcctgtgtgtgtgccctggagcccaggcctgaggacaagaagaagaagggcaagggcaagaggcaccaggaccggggccagtag

SEQ ID NO: 39517 - DNA, 1851 bp, Artificial Sequence; identical to SEQ ID NO: 39516
  Description of Artificial Sequence: Synthetic coding sequence

SEQ ID NO: 39518 - DNA, 1746 bp, Artificial Sequence
  Description of Artificial Sequence: Synthetic coding sequence
atggatgaggagagcctggatggcctgctcttcaaggaccatgacttcagcagtgacctgctgcggcagctgaacagcctgcggcagagccgcatcctgacagatgtgtccatctgtgccggggcccgggagatcccctgccacagaaatgtgctggccagcagcagcccctacttccgggccatgttctgcagcagcttccgggagaagtctgaggccaaggtgcagctgaagggcatcgacccccccaccctggaccagatcgtgtcctatgtgtacaccggggaggcccacatcgccacagacaacgtgctgcctgtgatggaggccgcctccatgctgcagttccccaagctgtttgaggcctgcagcagctacctgcagagccagctggcccccagcaactgcctgggcatgatccggctgtctgagatcctgagctgtgagaccctgaagaagaaggcccgggaggtggccctgaccagcttccctgaggtggccgccagcgctgacctgaaggagctgtgtgccctggagctgcgggactacctgggagatgatggcctgtgtggggaggaggagaaggtgtttgaggccctgatggtgtggatcaagcatgacctgcaggccaggaagcgctacatgcaggagctgttcaagcaggtgcggctgcagtacatccacccagccttcttccaccacttcatcgccaatgatgccctgctgcagagcagccctgcctgccagatcatcctggagacagccaagaggcagatgttcagcctgtgtggcaccaccgtgcctgactgcaagctgctgctgcacgtgcccccaagaaattcctaccaggacttcctgatcctgctgggcggcaggaaggacagccagcagaccaccagagatgtgctgctgtacagcaagcagacaggccagtggcagagcctggccaagctgcccacccggctgtacaaggccagcgccatcaccctgcacaggagcatctacgtgctgggcggcatggctgtgagcagcggccgcagcctggtgagccacaacgtgtacatcttcagcctgaagctgaaccagtggaggctgggggagcccatgctggtggcccgctacagccacaggagcacagcccacaagaacttcatcttcagcatcggcggcattggagagggccaggagctgatgggctccatggagagatatgacagcatctgcaatgtgtgggagagcatggcctccatgcctgtgggcgtgctgcaccctgctgtggccgtgaaggaccagaggctgtacctgtttggaggagaggacatcatgcagaaccctgtgcggctcatccaggtgtaccacatcagcaggaacagctggttcaagatggagaccaggatgatcaagaatgtgtgtgccccagctgtggtgctgggggagagaattgtgattgtgggcggctacacccggcgcatcctggcctatgacccccagagcaacaagtttgtgaagtgtgccgacatgaaggacaggaggatgcaccacggggccaccgtgatgggcaacaagctgtatgtgactggaggaagaaggctgaccacagactgcaacatcgaggacagcgccagctttgactgctatgaccctgagacagacacctggaccagccagggccagctgccccacaagctgtttgaccacgcctgcctgaccctgcagtgcatccccaggaccagcggcctgccctag

SEQ ID NO: 39519 - DNA, 1854 bp, Artificial Sequence
  Description of Artificial Sequence: Synthetic coding sequence
atgaaggtgtccctgggcaatggagagatgggcgtgtctgcccacctgcagccctgcaaggccggcaccacccgcttcttcaccagcaacacccacagctctgtggtgctgcagggctttgaccagctgagaattgagggcctgctgtgtgatgtgaccctggtgcctggagatggagatgagatcttccctgtgcaccgggccatgatggccagcgccagtgactacttcaaggccatgttcaccggcggcatgaaggagcaggacctgatgtgcatcaagctgcacggcgtgaacaaggtgggcctgaagaagatcatcgacttcatctacacagccaagctgagcctgaacatggacaacctgcaggacaccctggaggccgccagcttcctgcagatcctgcctgtgctggacttctgcaaggtgttcctgatctctggagtgtccctggacaactgtgtggaggtgggccgcatcgccaacacctacaacctgattgaggtggacaagtatgtgaacaacttcatcctgaagaacttccctgccctgctgagcactggagagttcctgaagctgccctttgagcggctggcctttgtgctgagcagcaacagcctgaagcactgcacagagctggagctgttcaaggccgcctgccgctggctgcggctggaggaccccaggatggactatgctgccaagctgatgaagaacatccgcttccccctgatgaccccccaggacctgatcaactacgtgcagacagtggacttcatgaggacagacaacacctgtgtgaacctgctgctggaggccagcaactaccagatgatgccctacatgcagcctgtgatgcagagcgacagaacagccatccgcagtgacagcacccacctggtgaccctgggcggcgtgctgcggcagcagctggtggtgtccaaggagctgaggatgtatgatgagcgggcccaggagtggaggagcctggcccccatggatgccccccgctaccagcacggcattgctgtgattggcaacttcctgtatgtggtgggcggccagagcaactatgacaccaagggcaagacagctgtggacaccgtcttccgctttgacccccgctacaacaagtggatgcaggtggccagcctgaatgagaagaggaccttcttccacctgagcgccctgaagggccacctgtatgctgtgggcggccgctctgctgctggggagctggccaccgtggagtgctacaaccccaggatgaatgagtggagctatgtggccaagatgtctgagccccactacggccacgccggcaccgtgtatggaggcctgatgtacatcagcggcggcatcacccatgacaccttccagaatgagctgatgtgctttgatcctgacacagacaagtggatgcagaaggcccccatgaccaccgtgcggggcctgcactgcatgtgcaccgtgggggacaagctgtatgtgattggaggcaaccacttccggggcaccagtgactatgatgatgtgctgagctgtgagtactacagccccaccctggaccagtggacccccatcgccgccatgctgcggggccagagtgatgtgggcgtggccgtgtttgagaacaagatctacgtggtgggcggctacagctggaacaaccgctgcatggtggagatcgtgcagaagtatgaccctgagaaggatgagtggcacaaggtgtttgacctgcctgagagcctgggcggcatccgggcctgcaccctgactgtgttccccccagaagaaaatcctggcagccccagccgggagagccccctgagcgcccccagcgaccacagctag

SEQ ID NO: 39520 - DNA, 1650 bp, Artificial Sequence
  Description of Artificial Sequence: Synthetic coding sequence
atgatggccagcgccagtgactacttcaaggccatgttcaccggcggcatgaaggagcaggacctgatgtgcatcaagctgcacggcgtgaacaaggtgggcctgaagaagatcatcgacttcatctacacagccaagctgagcctgaacatggacaacctgcaggacaccctggaggccgccagcttcctgcagatcctgcctgtgctggacttctgcaaggtgttcctgatctctggagtgtccctggacaactgtgtggaggtgggccgcatcgccaacacctacaacctgattgaggtggacaagtatgtgaacaacttcatcctgaagaacttccctgccctgctgagcactggagagttcctgaagctgccctttgagcggctggcctttgtgctgagcagcaacagcctgaagcactgcacagagctggagctgttcaaggccgcctgccgctggctgcggctggaggaccccaggatggactatgctgccaagctgatgaagaacatccgcttccccctgatgaccccccaggacctgatcaactacgtgcagacagtggacttcatgaggacagacaacacctgtgtgaacctgctgctggaggccagcaactaccagatgatgccctacatgcagcctgtgatgcagagcgacagaacagccatccgcagtgacagcacccacctggtgaccctgggcggcgtgctgcggcagcagctggtggtgtccaaggagctgaggatgtatgatgagcgggcccaggagtggaggagcctggcccccatggatgccccccgctaccagcacggcattgctgtgattggcaacttcctgtatgtggtgggcggccagagcaactatgacaccaagggcaagacagctgtggacaccgtcttccgctttgacccccgctacaacaagtggatgcaggtggccagcctgaatgagaagaggaccttcttccacctgagcgccctgaagggccacctgtatgctgtgggcggccgctctgctgctggggagctggccaccgtggagtgctacaaccccaggatgaatgagtggagctatgtggccaagatgtctgagccccactacggccacgccggcaccgtgtatggaggcctgatgtacatcagcggcggcatcacccatgacaccttccagaatgagctgatgtgctttgatcctgacacagacaagtggatgcagaaggcccccatgaccaccgtgcggggcctgcactgcatgtgcaccgtgggggacaagctgtatgtgattggaggcaaccacttccggggcaccagtgactatgatgatgtgctgagctgtgagtactacagccccaccctggaccagtggacccccatcgccgccatgctgcggggccagagtgatgtgggcgtggccgtgtttgagaacaagatctacgtggtgggcggctacagctggaacaaccgctgcatggtggagatcgtgcagaagtatgaccctgagaaggatgagtggcacaaggtgtttgacctgcctgagagcctgggcggcatccgggcctgcaccctgactgtgttccccccagaagaaaatcctggcagccccagccgggagagccccctgagcgcccccagcgaccacagctag

SEQ ID NO: 39521 - DNA, 534 bp, Artificial Sequence
  Description of Artificial Sequence: Synthetic coding sequence
atgaccaccagcatccggcagttcaccagcagcagcagcatcaagggcagcagcggcctgggcggcggcagcagcaggaccagctgccagctgagcggcggcctgggcgccggcagctgccggcccggcagcgctgggggcctgggcagcgccctgggcggcagcagctacagcagctgctacagctttggaagtggcggcggctacggcagcagcagctttgagggcgtggatggcctgctggtgggcggggagaaggccaccatgcagaacctgaatgaccggctggccagctacctggacaaggtgcgggccctggaggaggccgacacagagctggaggtgaagatccgggactggtaccagaggcaggcccctggccctgcccgggactacagccagtactaccgcatcatcgaggagctgcagaacaagccaccctggaccatgcccaccagctgctacatcctgaccatgcccatctggctgctgctgaccagcgcccccaagtcctggcagaatgaaggaagatag

SEQ ID NO: 39522 - DNA, 1326 bp, Artificial Sequence
  Description of Artificial Sequence: Synthetic coding sequence
atgaccaccagcatccggcagttcaccagcagcagcagcatcaagggcagcagcggcctgggcggcggcagcagcaggaccagctgccagctgagcggcggcctgggcgccggcagctgccggcccggcagcgctgggggcctgggcagcgccctgggcggcagcagctacagcagctgctacagctttggaagtggcggcggctacggcagcagcagctttgagggcgtggatggcctgctggtgggcggggagaaggccaccatgcagaacctgaatgaccggctggccagctacctggacaaggtgcgggccctggaggaggccgacacagagctggaggtgaagatccgggactggtaccagaggcaggcccctggccctgcccgggactacagccagtactaccgcatcatcgaggagctgcagaacaagatcctgacagccaccgtggacaatgccaacatcctgctgcacatcgacaatgcccacctggccgctgctgacttccgcaccaagtttgaaacagagcaggccctgtgcctgtctgtggaggccgacatcaatggcccctgccgggtgctggatgagctgaccctggcccgggctgacctggagatgcacatcgagaacctgaaggaggagctggcctacctgaagaagaaccacgaggagatgaatgccccccggggccaggtgggcggggagatcaacgtggagatgggcgccgcccctggggtggacctgagccgcatcctgaatgagatgagggagcagtatgagaagatggccgagaagaacaggaaggatgctgaggactggttcttcagcaagacagaggagctgaaccgggaggtggccaccaacagcgagctggtgcagagcggcaagtctgagatcagcgagctgcgctgcaccatgcaggccctggagattgagctgcagagccagctgtccatgaaggccagcctggagggcaacctggccgagacagagaaccgctactgcatgcagctgagccagatccagggcctcatcggctctgtggaggagcggctggcccagctgctgtgtgagatggagcagcagaaccaggagtacaagatcctgctggacatgaagatgaggctggagctggagatcaccacctaccaccggctgctggagggagaagatgcccacgagggcctgctggcccccacccacttcaagctgcctgccagccctgctgctgtgaccacctgccaggtgcccaccatcgtggaggaggtgcaggacggcaaggtgatcagcagccgggagcaggtgcggcagaccaccaggtag

SEQ ID NO: 39523 - DNA, 366 bp, Artificial Sequence
  Description of Artificial Sequence: Synthetic coding sequence
atggccagctgcagcaccagcggcacctgtggcagcagctgctgccagcccagctgctgtgagaccagctgctgccagcccagctgctgccagaccagcagctgtggcaccggctgcggcattggaggcggcatcggctacggccaggagggcagcggcggctctgtgtccacccgcatccgctggtgccacccagactgccacgtggagggcacctgcctgcccccctgctacctggtgtcctgcaccccacccagctgctgccagctgcaccacgccgaggccagctgctgccggcccagctactgcggccagagctgctgcaggcctgcctgctgctgccactgctgtgagcccacctgctag

SEQ ID NO: 39524 - DNA, 372 bp, Artificial Sequence
  Description of Artificial Sequence: Synthetic coding sequence
atgacaggcagctgctgcggcagcaccttcagcagcctgtcctatggaggcggctgctgccagccctgctgctgccgggacccctgctgctgcaggcctgtgacctgccagaccaccgtgtgcaggcctgtgacctgtgtgccccgctgcacccggcccatctgtgagccctgcagaagacctgtgtgctgtgacccctgcagcctgcaggagggctgctgccggcccatcacctgctgccccagcagctgcacagctgtggtgtgccggccctgctgctgggccaccacctgctgccagcctgtgtctgtgcagagcccctgtggccagcccaccccctgcagcaccacctgcaggaccagcagctgctag

SEQ ID NO: 39525 - DNA, 390 bp, Artificial Sequence
  Description of Artificial Sequence: Synthetic coding sequence
atgacaggcagctgctgcggcagcaccttcagcagcctgtcctatggaggcggctgctgccagccctgctgctgccgggacccctgctgctgcaggcctgtgacctgccagaccaccgtgtgcaggcctgtgacctgtgtgccccgctgcacccggcccatctgtgagccctgcagaagacctgtgtgctgtgacccctgcagcctgcaggagggctgctgccggcccatcacctgctgccccagcagctgcacagctgtggtgtgccggccctgctgctgggccaccacctgctgccagcctgtgtctgtgcagagcccctgtggccagcccagcccctgtggccagcccaccccctgcagcaccacctgcaggaccagcagctgctag

SEQ ID NO: 39526 - DNA, 468 bp, Artificial Sequence
  Description of Artificial Sequence: Synthetic coding sequence
atggtgagcagctgctgcggctctgtgtgcagcgaccagggctgcagccaggacctgtgccaggagacctgctgccggcccagctgctgccagaccacctgctgcaggaccacctgctaccggcccagctgctgcgtgagcagctgctgccggccccagtgctgccagagcgtgtgctgccagcccacctgctgccggcccacctgctgtgagaccacctgctgccacccccgctgctgcatcagcagctgctgccggcccagctgctgcatgagcagctgctgcaagccccagtgctgccagagcgtgtgctgccagcccacctgctgccggcccagctgctgccggccctgctgctgcctgcggcctgtgtgtggccgggtgtcctgccacaccacctgctaccggcccacctgtgtgatcagcacctgcccccggcccctgtgctgtgccagcagctgctgctag

SEQ ID NO: 39527 - DNA, 660 bp, Artificial Sequence
  Description of Artificial Sequence: Synthetic coding sequence
atgggctgctgcggctgcagcggcggctgcggcagcggctgcggcggctgcggcagcggctgcggcggctgcggcagcggctgcggcggctgcggcagcggctgcggcggctgcggcagcggctgcggcggctgcggcagcagctgctgcgtgcccatctgctgctgcaagcctgtgtgctgctgcgtgcctgcctgcagctgcagcagctgtggcagctgtggcggcagcaagggcggctacggcagctgtggcggcagcaagggcggctgtgtgtcctgtggcggcagcaagggcggctgcggcagctgtggcggcagcaagggcggctgcggcagctgtggcggcagcaagggcggctgcggcagctgtggcggcagcaagggcggctgcggcagctgtggctgcagccagtgcagctgctgcaagccctgctgcttcagcagcggctgcggcagcagctgctgccagagcagctgctgcaagcccagctgctgccagagcagctgctgcaagccctactgctgccagagcagctgctgcaagccctgctgcagcagcagcggctgcggcagcagctgctgccagagcagctgctgcaacccctgctgcagccagagcagctgctgcgtgcctgtgtgctgccagtgcaagatctag

SEQ ID NO: 39528 - DNA, 687 bp, Artificial Sequence
  Description of Artificial Sequence: Synthetic coding sequence
atgggctgctgcggctgcagcggcggctgcggcagcggctgcggcggctgcggcagcggctgcggcggctgcggcagcggctgcggcggctgcggcagcggctgcggcggctgcggcagcggctgcggcggctgcggcagcagctgctgcgtgcccatctgctgctgcaagcctgtgtgctgctgcgtgcctgcctgcagctgcagcagctgtggcagctgtggcggcagcaagggcggctacggcagctgtggcggcagcaagggcggctgtgtgtcctgtggcggcagcaagggcggctgcggcagctgtggcggcagcaagggcggctgcggcagctgtggcggcagcaagggcggctgcggcagctgtggcggcagcaagggcggctgcggcagctgtggctgcagccagtgcagctgctgcaagccctgctgcttcagcagcggctgcggcagcagctgctgccagagcagctgctgcaagccctgctgcagcagcagcggctgcggcagcagctgctgccagagcagctgctgcaagccctactgctgccagagcagctgctgcaagccctgctgcagcagcagcggctgcggcagcagctgctgccagagcagctgctgcaacccctgctgcagccagagcagctgctgcgtgcctgtgtgctgccagtgcaagatctag

SEQ ID NO: 39529 - DNA, 351 bp, Artificial Sequence
  Description of Artificial Sequence: Synthetic coding sequence
tgctgccaccccacctgctgccagaacacctgctgcaggaccacctgctgccagcccacctgtgtggccagctgctgccagcccagctgctgcagcaccccctgctgccagcccacctgctgcggcagcagctgctgcggcaccacctgctgccagcccacctgctgccagcccacctgctgcaggaacaccagctgccagcccacctgctgcggcagcagctgctgccagcccccctgctgccggcccacctgctgccagaccacctgctaccgcaccacctgctgccggcccagctgctgctgcagcccctgctgcgtgagcagctgctgccagcccagctgctgctag

SEQ ID NO: 39530 - DNA, 306 bp, Artificial Sequence
  Description of Artificial Sequence: Synthetic coding sequence
cggcccttctgctgccacaccccctgctgccagcccagctgctgcgtgcccagctgctgccagccctgctgccaccccacctgctgccagaacacctgctgcaggaccacctgctgccagcccacctgtgtggccagctgctgccagcccagctgctgcagcaccccctgctgccagcccacctgctgcggccagacctgcaatgaaagcagctactgcctgccctgctgccggcccacctgctgccagaccacctgctaccgcaccacctgctgccggcccagctgctgctgcagcccctgctag

SEQ ID NO: 39531 - DNA, 753 bp, Artificial Sequence
  Description of Artificial Sequence: Synthetic coding sequence
atgacccactgctgcagcccctgctgccagcccacctgctgcaggaccacctgctgcaggaccacctgctggaagcccaccaccgtgaccacctgcagcagcaccccctgctgccagcccagctgctgcgtgcccagctgctgccagccctgctgccaccccacctgctgccagaacacctgctgcaggaccacctgctgccagcccacctgtgtggccagctgctgccagcccagctgctgcagcaccccctgctgccagcccacctgctgcggcagcagctgctgcggccagaccagctgtggcagcagctgctgccagcccatctgtggcagcagctgctgccagccctgctgccaccccacctgctaccagaccatctgcttccgcaccacctgctgccagcccacctgctgccagcccacctgctgcaggaacaccagctgccagcccacctgctgcggcagcagctgctgccagccctgctgccaccccacctgctgccagaccatctgccgcagcacctgctgccagcccagctgtgtgacccgctgctgcagcaccccctgctgccagcccacctgtggcggcagcagctgctgcagccagacctgcaatgaaagcagctactgcctgccctgctgccggcccacctgctgccagaccacctgctaccgcaccacctgctgccggcccagctgctgctgcagcccctgctgcgtgagcagctgctgccagcccagctgctgctag

SEQ ID NO: 39532 - DNA, 483 bp, Artificial Sequence
  Description of Artificial Sequence: Synthetic coding sequence
atgacccactgctgcagccctggctgccagcccacctgctgcaggaccacctgctgcaggaccacctgctggcagcccaccatcgtgaccacctgcagcagcaccccctgctgccagcccagctgctgcgtgagcagctgctgccagccctactgccaccccacctgctgccagaacacctgctgcaggaccacctgctgccagcccacctgtgtgaccagctgctgccagcccagctgctgcagcaccccctgctaccagcccatctgctgcggcagcagctgctgcggccagaccagctgtggcagcagctgtggccagagcagcagctgtgcccctgtgtactgcaggaggacctgctaccaccccaccaccgtgtgcctgcccggctgcctgaaccagagctgtggcagcagctgctgccagccctgctactgcccagcctgctgcgtgagcagctgctgccagcacagctgctgctag

SEQ ID NO: 39533 - DNA, 510 bp, Artificial Sequence
  Description of Artificial Sequence: Synthetic coding sequence
atgacccactgctgcagcccctgctgccagcccacctgctgcaggaccacctgctggaagcccaccaccgtgaccacctgcagcagcaccccctgctgccagcccagctgctgcgtgagcagctgctgccagccctgctgccaccccacctgctgccagaacacctgctgcaggaccacctgctgccagcccacctgtgtgaccagctgctgccagcccagctgctgcagcaccccctgctgccagcccatctgctgcggcagcagctgctgcggccagaccagctgtggcagcagctgctgccagcccagcagctgtgcccccatctactgcaggaggacctgctaccaccccacctctgtgtacctgcccggctgcctgaaccagagctgtggcagcagctgctgccagccctgctgcaggcctgcctgctgtgagaccacctgctgcaggaccacctgcttccagcccacctgtgtgaccagctgctgccagcctgcctgctgctag

SEQ ID NO: 39534 - DNA, 510 bp, Artificial Sequence
  Description of Artificial Sequence: Synthetic coding sequence
atgacccactgctgcagcccctgctgccagcccacctgctgcaggaccacctgctggaagcccaccaccgtgaccacctgcagcagcaccccctgctgccagcccagctgctgcgtgagcagctgctgccagccctgctgcaggcctgcctgctgccagaacacctgctgcaggaccacctgctgccagcccacctgcctgaccagctgctgccagcccagctgctgcagcaccacctgctgccagcccatctgctgcggcagcagctgctgcggccagaccagctgtggcagcagctgtggccagagcagcagctgtgcccctgtgtactgcaggaggacctgctactaccccaccaccgtgtgcctgcccggctgcctgaaccagagctgtggcagcagctgctgccagccctgctgcaggcctgcctgctgtgagaccacctgctgcaggaccacctgcttccagcccacctgtgtgagcagctgctgccagcccagctgctgctag

SEQ ID NO: 39535 - DNA, 528 bp, Artificial Sequence
  Description of Artificial Sequence: Synthetic coding sequence
atgacccactgctgcagcccctgctgccagcccacctgctgcaggaccacctgctgcaggaccacctgctggaagcccaccaccgtgaccacctgcagcagcaccccctgctgccagcccagctgctgcgtgagcagctgctgccagcccccctgctgcaggcctgcctgctgccagaacacctgctgcaggaccacctgctgccagcccacctgcctgaccagctgctgccagcccagctgctgcagcaccacctgctgccagcccatctgctgcggcagcagctgctgcggccagaccagctgtggcagcagctgtggccagagcagcagctgtgcccctgtgtactgcaggaggacctgctactaccccaccaccgtgtgcctgcccggctgcctgaaccagagctgtggcagcagctgctgccagccctgctgcaggcctgcctgctgtgagaccacctgctgcaggaccacctgcttccagcccacctgtgtgagcagctgctgccagcccagctgctgctag

SEQ ID NO: 39536 - DNA, 2037 bp, Artificial Sequence
  Description of Artificial Sequence: Synthetic coding sequence
atgcccacctggggcgcccggcctgccagcccagacagatttgctgtgtctgctgaggccgagaacaaggtgcgggagcagcagccccacgtggagcgcatcttctctgtgggcgtgtctgtgctgcccaaggactgcccagacaacccccacatctggctgcagctggagggccccaaggaaaatgccagccgggccaaggagtacctgaagggcctgtgcagccctgagctgcaggatgagatccactacccacccaagctgcactgcatcttcctgggcgcccagggcttcttcctggactgcctggcctggagcaccagcgcccacctggtgccccgggcccctggcagcctgatgatcagcggcctgacagaggcctttgtgatggcccagagccgggtggaggagctggccgagcggctgtcctgggacttcaccccaggccccagcagcggggccagccagtgcaccggggtgctgcgggacttcagcgccctgctgcagagccctggagatgcccaccgggaggccctgctgcagctgcccctggccgtgcaggaggagctgctgagcctggtgcaggaggccagcagcggccagggccctggggccctggcctcctgggagggccgcagcagcgccctgctgggcgcccagtgccagggcgtgcgggcccccccatctgatggccgggagagcctggacaccggctccatgggccctggggactgccgcggggcccggggggacacctatgctgtggagaaggagggcggcaagcagggcggcccccgggagatggactggggctggaaggagctgcccggggaggaggcctgggagcgggaggtggccctgcggccccagagcgtgggcggcggggcccgggagagcgcccccctgaagggcaaggccctgggcaaggaggagatcgccctgggcggcggcggcttctgtgtgcaccgggagcccccaggggcccacggcagctgccacagagctgcccagagcagaggagccagcctgctgcagaggctgcacaatggaaatgccagccccccccgggtgcccagccccccaccagcccctgagcccccctggcactgtggggacagaggagactgtggggacagaggagatgtgggggacagaggagacaagcagcagggcatggcccggggccggggcccccagtggaagagaggagcccggggcggcaacctggtgacaggcacccagcgcttcaaggaggccctgcaggaccccttcaccctgtgcctggccaacgtgcccggccagcctgacctgcggcacatcgtgattgatggcagcaatgtggccatggtgcacggcctgcagcactacttcagcagccggggcatcgccatcgctgtgcagtacttctgggaccggggccaccgggacatcaccgtgtttgtgccccagtggaggttcagcaaggatgccaaggtgcgggagagccacttcctgcagaagctgtacagcctgagcctgctgagcctgacccccagccgggtgatggatggcaagaggatcagcagctatgatgaccgcttcatggtgaagctggccgaggagacagatggcatcatcgtgtccaatgaccagttccgggacctggccgaggagagcgagaagtggatggccatcatccgggagcggctgctgcccttcacctttgtgggcaacctcttcatggtgcctgatgaccccctgggcagaaatggccccaccctggatgagttcctgaagaagccagcccggacccagggcagcagcaaggcccagcaccccagccggggctttgctgagcacggcaagcagcagcagggccgggaggaggagaagggcagcggcggcatcaggaagacccgggagacagagcggctgcggcggcagctgctggaggtgttctggggccaggaccacaaggtggacttcatcctgcagcgggagccctactgccgggacatcaaccagctgtctgaggccctgctgagcctgaacttctag

SEQ ID NO: 39537 - DNA, 2037 bp, Artificial Sequence; identical to SEQ ID NO: 39536
  Description of Artificial Sequence: Synthetic coding sequence

SEQ ID NO: 39538 - DNA, 408 bp, Artificial Sequence
  Description of Artificial Sequence: Synthetic coding sequence
atgcccacctggggcgcccggcctgccagcccagacagatttgctgtgtctgctgaggccgagaacaaggtgcgggagcagcagccccacgtggagcgcatcttctctgtgggcgtgtctgtgctgcccaaggactgcccagacaacccccacatctggctgcagctggagggccccaaggaaaatgccagccgggccaaggagtacctgaagggcctgtgcagccctgagctgcaggatgagatccactacccacccaagctgcactgcatcttcctgggcgcccagggcttcttcctggactgcctggcctggagcaccagcgcccacctggtgccccgggcccctggcagcctgatgatcagcggcctgacagaggcctttgtgatggcccagagccgggtgtag

SEQ ID NO: 39539 - DNA, 2037 bp, Artificial Sequence; identical to SEQ ID NO: 39536
  Description of Artificial Sequence: Synthetic coding sequence

SEQ ID NO: 39540 - DNA, 387 bp, Artificial Sequence
  Description of Artificial Sequence: Synthetic coding sequence
atggctgtgggcaccagcgccctgagcaaggagccctggtggaccctgcctgagaacttccacagccccatggtgttccacatggaggaggaccaggaggagctgatcttcggcctggatgacacctacctgcgctgcatcgagctgcacagccacaccctcatccagctggagcgctgcttcaccgccaccggccagaccagggtgacagtggtgggcccccccatggccaagcagtggctgctgctgatgttccactgtgtgggcagccaggacagcaagtgccacgcccggggcctgaagatgctggagcgggtgcgcagccagcccctgaccaatgatgacctggtgacctctgtgtccctgcccccctacaccggggactag

SEQ ID NO: 39541 - DNA, 1251 bp, Artificial Sequence
  Description of Artificial Sequence: Synthetic coding sequence
atgagccccagccacgtggtggtgaatgtgtccacagcccggagcggccccctgaccaccagcagcgcccctgtgtccagagctgagagcctgcggcccggcagccgcagctgcaccatgtccatgagccccaccgtcatcatcctggcctgcctgggcttcttcctggaccagagcgtgtgggcccacgtgggcggccaggacaagcccttctgcagcgcctggcccagcgctgtggtgccccagggcggccacgtgaccctgcgctgccactgcagaagaggcttcaacatcttcaccctgtacaagaaggatggagtgcctgtgcctgagctgtacaaccgcatcttctggaacagcttcctgatcagccctgtgaccccagcccatgctggcacctaccgctgccggggcttccacccccacagccccacagagtggagcgcccccagcaaccccctggtgatcatggtgacaggcctgtatgagaagcccagcctgacagcccggcccggccccaccgtgcgggctggagaaaatgtgaccctgagctgcagcagccagagcagctttgacatctaccacctgagccgggagggggaggcccacgagctgcggctgcctgctgtgcccagcatcaatggcaccttccaggccgacttccccctgggccctgccacccacggggagacctaccgctgcttcggcagcttccacggcagcccctatgagtggagcgaccccagcgaccccctgcctgtgtctgtgactggaaaccccagcagctcctggcccagccccacagagcccagcttcaagacaggcatcgcccggcacctgcacgccgtcatccgctacagcgtggccatcatcctcttcaccatcctgcccttcttcctgctgcaccgctggtgcagcaagaagaagaatgctgctgtgatgaaccaggagcctgctggccacaggacagtgaacagagaagattctgatgagcaggacccccaggaggtgacctacgcccagctggaccactgcatcttcacccagaggaagatcaccggccccagccagaggagcaagaggcccagcacagacacctctgtgtgcatcgagctgcccaatgctgagccccgggccctgagccctgcccacgagcaccacagccaggccctgatgggcagcagccgggagaccacagccctgagccagacccagctggccagcagcaatgtgcctgctgctggcatctag

SEQ ID NO: 39542 - DNA, 915 bp, Artificial Sequence
  Description of Artificial Sequence: Synthetic coding sequence
atgagcctgatggtggtgtccatggcctgtgtgggcttcttcctgctgcagggcgcctggccccatgagggcgtgcacaggaagcccagcctgctggcccaccctggccccctggtgaagtctgaggagaccgtcatcctgcagtgctggagcgatgtgcgctttgagcacttcctgctgcaccgggagggcaagtacaaggacaccctgcacctgattggagagcaccatgatggagtgtccaaggccaacttcagcatcggccccatgatgcaggacctggccggcacctaccgctgctacggctctgtgacccacagcccctaccagctgagcgcccccagcgaccccctggacatcgtcatcaccggcctgtatgagaagcccagcctgagcgcccagcccggccccaccgtgctggccggggagagcgtgaccctgagctgcagcagccgcagcagctatgacatgtaccacctgagccgggagggggaggcccatgaaagacgcttctctgctggccccaaggtgaatggcaccttccaggccgacttccccctgggccctgccacccacggcggcacctaccgctgcttcggcagcttccgggacagcccctatgagtggagcaacagcagtgaccccctgctggtgtctgtgactggaaaccccagcaacagctggcccagccccacagagcccagcagcaagacaggcaaccccaggcacctgcacgtgctgattggcacctctgtggtgaagatccccttcaccatcctgctcttcttcctgctgcaccgctggtgcagcaacaagaagaatgctgctgtgatggaccaggagcctgctggcaacagaacagtgaacagtgaagattctgatgagcaggaccaccaggaggtgtcctatgcctag

SEQ ID NO: 39543 - DNA, 915 bp, Artificial Sequence; identical to SEQ ID NO: 39542
  Description of Artificial Sequence: Synthetic coding sequence

SEQ ID NO: 39544 - DNA, 867 bp, Artificial Sequence
  Description of Artificial Sequence: Synthetic coding sequence
atggcctgtgtggccttcttcctgctgcagggcgcctggccccatgagggcttccggaggaagcccagcctgctggcccaccctggccccctggtgaagtctgaggagaccgtcatcctgcagtgctggagcgatgtgatgtttgagcacttcctgctgcaccgggagggcaccttcaaccacaccctgcggctcatcggggagcacattgatggagtgtccaaaggaaacttcagcatcggccgcatgacccaggacctggccggcacctaccgctgctacggctctgtgacccacagcccctaccagctgagcgcccccagcgaccccctggacatcgtcatcaccggcctgtatgagaagcccagcctgagcgcccagcccggccccaccgtgctggccggggagagcgtgaccctgagctgcagcagccgcagcagctatgacatgtaccacctgagccgggagggggaggcccacgagcggcggctgcctgctggccccaaggtgaacagaaccttccaggccgacttccccctggaccctgccacccatggaggcacctaccgctgcttcggcagcttccgggacagcccctatgagtggagcaagagcagtgaccccctgctggtgtctgtgacaggcaacagcagcaacagctggcccagccccacagagcccagcagcgagactggaaaccccaggcacctgcacgtgctgattggcacctctgtggtgaagctgcccttcaccatcctgctcttcttcctgctgcaccgctggtgcagcaacaagaagaatgcctctgtgatggaccagggccctgctggcaacagaacagtgaaccgggaggacagtgatgaatag

SEQ ID NO: 39545 - DNA, 666 bp, Artificial Sequence
  Description of Artificial Sequence: Synthetic coding sequence
atgagcctgactgtggtgtccatggcctgtgtgggcttcttcctgctgcagggcgcctggcccctgatgggcaaccacaggaagcccagcctgctggcccaccctggccccctgctgaagtctggagagaccgtcatcctgcagtgctggagcgatgtgatgtttgagcacttcttcctgcaccgggagggcatcagcgaggaccccagccggctggtgggccagatccatgatggagtgtccaaggccaacttcagcatcggccccctgatgcctgtgctggccggcacctaccgctgctacggctctgtgccccacagcccctaccagctgagcgcccccagcgaccccctggacatcgtcatcaccggcctgtatgagaagcccagcctgagcgcccagcccggccccaccgtgcaggccggagaaaatgtgaccctgagctgcagctcctggagcagctatgacatctaccacctgagccgggagggggaggcccatgaaagaaggctgcgggctgtgcccaaggtgaacagaaccttccaggccgacttccccctgggccctgccacccacggcggcacctaccgctgcttcggcagcttccgggccctgccctgtgtgtggagcaacagcagtgaccccctgctggtgtctgtgacctag

SEQ ID NO: 39546 - DNA, 1002 bp, Artificial Sequence
  Description of Artificial Sequence: Synthetic coding sequence
atgagcctgactgtggtgtccatggcctgtgtgggcttcttcctgctgcagggcgcctggcccctgatgggcggccaggacaagcccttcctgagcgcccggcccagcacagtggtgccccggggcggccacgtggccctgcagtgccactaccgccggggcttcaacaacttcatgctgtacaaggaggacaggagccacgtgcccatcttccacggccgcatcttccaggagagcttcatcatgggccctgtgaccccagcccacgccggcacctaccgctgccggggcagccggccccacagcctgaccggctggagcacccccagcaaccccctggtgatcatggtgacaggcaaccacaggaagcccagcctgctggcccaccctggccccctgctgaagagcggggagaccgtcatcctgcagtgctggagcgatgtgatgtttgagcacttcttcctgcaccgggagggcatcagcgaggaccccagccggctggtgggccagatccatgatggagtgtccaaggccaacttcagcatcggccccctgatgcctgtgctggccggcacctaccgctgctacggctctgtgccccacagcccctaccagctgagcgcccccagcgaccccctggacatcgtcatcaccggcctgtatgagaagcccagcctgagcgcccagcccggccccaccgtgcaggccggggagaatgtgaccctgagctgcagctcctggagcagctatgacatctaccacctgagccgggagggggaggcccacgagcggcggctgcgggctgtgcccaaggtgaacagaaccttccaggccgacttccccctgggccctgccacccatggaggcacctaccgctgcttcggcagcttccgggccctgccctgtgtgtggagcaacagcagtgaccccctgctggtgtctgtgacaggcaaccccagcagctcctggcccagccccacagagcccagcagcaagagctag
